United States Patent 11,882,838 (BACTERIAL INOCULANTS) - sequence listing, part 9

SEQ ID NO: 3211 - DNA, 7737 bp, Unknown
  Kingdom: Bacteria, Phylum: Actinobacteria, Class: Actinobacteria, Order: Streptomycetales, Family: Streptomycetaceae, Genus: Streptomyces
cccggctcgccgacaccgccgtgctgacctccgacaacccccgctccgaggaccccctcgcgatcctcgccgcgatgctctccggcgccgccgaagtgcccgtccacgagcgcggcgacgtgctggtcgacgccgaccgcgcctccgccatcgccgctgccgtcgcccgcgcggaggcgggcgacaccgtcctcgtcgcgggcaagggtcacgaacagggccaggacatccacggggtggtacgcgccttcgacgaccgcaaggtcctgcacgcagccatcgagcggtccctgacgcgccccggcgccgcggaccgtgtccctcacctcgagaacaacagtcagggatgaccaagtgatcaccctttccctcgccgagatcgccgaaatcgtcggcgggcagtcgtacgacataccggatccggcagtcaccgtgaccggacccgtcgtcatcgactcccgcgaggtcgcgcccggaagcctgttcgccgcgttcgcgggcgaacgggtcgacggccacgactacgcccagcgcgccgtcgaggcgggcgcggcagccgtactggcggcccgccccgtcggcgttccggcgatcgtcgtggacgacgtcgtcggcgcgctcggagccctcgcgcgtgccgtggtggaacgcctcggcaccaccgtcgtcggactcaccggatccgccggcaagacgtccaccaaggacctgatcgctcagctcctccagcgcaagggcccgaccgtctggacgcccggctccctcaacaacgagatcggcctgccggtgacggcactgaccgccaccgccgagaccgagcacctggtcctggagatgggggcccgcggtgtcggccacatccactacctggccaacctcacgccaccccggatcggcctggtcctcaacgtcggctccgcgcacctcggcgagttcggcagccgggaggccatcgcccaggccaagggcgagctggtcgaggtccttcccgaggacggctgcgccgtgctgaacgcggacgacccgctcgtccgcgccatggcctcgcgcaccaaggcccgcgtcctgctcttcggagaagccccggaagcggacgtacggggcgagaaggtcaggatgaccgccgacgggcggcccgccttcgagctccacacacccaccgggtgcagcgacgtgaccatgcgcctgtacggtgagcaccacgtgtcgaacgcgctcgccgcggccgccgtcgcccatgagttgggcatgtccgtgaccgagatcgccgaggcgctctcggaggcgggcaccctctcccgctggcgcatggaggtcaccgagcgtccggacggtgtgacggtcgtcaacgacgcctacaacgcgaaccccgaatccatgagagccgcactgcgtgcgctggctgccatgggccaggcccgaggggccgacgggggacgcacctgggcggtgctcggtcagatggccgagctcggtgacgcgtcgctcgccgagcacgacgcggtcggacggctcgccgtccggctcaacgtcagcaagctcgtcgctgtcggggggagagaagcctcctggctgcaactgggcgcatataacgagggttcgtggggtgaggagtcggtgcacgtgtccgacgcacaggcggccgtcgacctgttgcgcagtgaactgcgcccgggagacgtcgtgctggtgaaggcgtcccggtcggtcggcctggagaaggtcgccctggcactgctggagaactcgaccgagggcgaggtcgccggccgatgaggcagatcctcttcgcgggggccatcgggctctttctgaccctggtcggtactccgctgctgatcaagctgctggcccgcaagggatacgggcagttcatccgggacgacggcccgcgcacgcacggcagcaagaagggcacgcccacgatgggcggcatcgccttcatcctggcgacgatcatcgcgtacctcctcgcgaaggtcatcacgggtgaggacatccgctactccggcgtcctcgtgctgttcctcatgaccgggatggggctcgtcggcttcctcgacgactacatcaagatcgtcaagcagcgttcgctcggcctgcgggccaaggcgaagatggccggccagctgatcgtcggcatcgccttcgcggtgctctcgctccagttccccaactccatgaactacaccccggcctccacccggctctcgttcgtcgaggacttcggctggtcgatcggaccggtgctgttctgcgtctgggcgctgttcatgatcctcgccatgtccaacggcgtgaacctcacggacggcctcgacggactggccaccggcgcctcggtgatggtcttcggcgcctacaccttcatcggtctctggcagttccaggagtcctgcgccaacgcggacaacctgaccaacccgagcgcctgcttcgaggtgcgcgacccgctggacctcgccgtcgtcgccgccgcgctgatgggtgcgtgcttcggcttcctgtggtggaacacctcgcccgccaagatcttcatgggcgacaccggctcgctcgcactcggcggcgcgctcgcgggcctcgcgatcctgtcccgcaccgagttcctgatggccatcctcggcggcctcttcgtgatgatcaccatgtccgtggtcatccaggtcggttcgttcaagatgaccggcaagcgggtcttccggatggcgccgctccagcaccacttcgaactcaaggggtggtccgaagtccttgtcgtggtccgcttctggatcatccagggcatgtgcgtgatcgtcggcctcggcctcttctacgcgggatgggcagccaagaagtgagcagcaccgtggactggcagggcaagcacgtcaccgtcgccgggctcggcgtaagcgggatccccgcggcccgcgccctgcacgagcgcggcgcgctcgtcaccgtcgtcaacgacggcgacgacgagcgcgcccgcgcgcaggcggccgaactggaggcgctcggcatcaccgtgcgcctcggcgacggcgcgaccctgccgccgtccacggaactcgtcgtcaccgcccccggctggcagccggacaagccgctcttcctggctgcggccgaggcgggcgtcccggtctggggcgatgtcgaactggcctggcgactgcgcggcacaggcggccgcgagcccgccccctggctcgcggtcaccggcaccaacggcaagacctccgtctcgtacatgaccgagtcggtgctgcggatcgccgaaggggcccgggtcggggtgatcggcaccgcgggcagccgcatcggggacgagcccatcccgatgcccccctcggtgctcaccaccccggaatcgcccgatctccagtatctgctggggcacatgcgcgaccgcgccaccggcagcgtcgtcctggaggccacctcgatggggctgctgacgcaccgtctggaccgtacgttcatcgacgtcggcgtcttcaccaacctcacccaggaccacctcgacgaccacggcacgatggagaactaccgggacgccaaactccgcctcttccaagggctgtgccgccgcgccgtggtcaacgccgacgacccggtgggcgccgggatccgggagctgatgcccgacgccgtgaccacgtacgcgctggacggcgacgcggactaccgcgcgagcgatctcaccgtggacgcctcgggcacccggttcacgctgcaccacgacggccgcaagtacccggcggccatcccctcaccgggccggttctcggtctccaacgcgctggccacggtggccgcctgccacctcctcggccacggtctggccgggctggtcgacgcactggagcggatgccgcagatccccggccgcttcgaacgcctccacacccccggcggcagctcggtgatcgtggactacgcacactcgccggactccctcagcaaggtgctcaccacgatccggagcttcgcccggggccgggtcatcaccgtcttcggctgcggcggcgaccgcgacacgaccaagcgcgccgagatgggcgccatcgcgggcgaccactccgacctgtgcgtcctcacctccgacaatccccgctacgaggaccccgaggtcatcctcgacgagatcgcccccggcattgcgtccaccggaacgccgttcgagcggatcaccgaccgccgcctggccatcgccgccgcgctggcggaggcggggccgacagacatcgtgctcatcgcgggcaagggcagcgaaccgcaccagagcgtccggggcgaactgctgccgttcagcgacatggccaccgtgcgcgagctgatcggcggctgaaagtcccgcctgaccaggtctggctgatctagtattccggcagtcggcggggaggcacgttcttgacgcggatcaccccgtcgaccggtgaggtgaccagctggcccagccctgtacgtgacccggatgggttcgccgtgcgcgaccgtcgagcggtcctgaccaagcgcgttcacaaccagaggtcaaccgaagtggtgcgagccgagttggatggtgatacctggagggtgaccgagcggcgcgatattcgagtgcccggacgggtggtcatgcgctgcggtcagggtcgcgacggtcttctatggcttcgcgccggcgacacgtggcttcgcgtcgaggcctgatagcggccgagacgcgcagctcacgagcggtgggcgggtcacctcggctgcgtagacgactctgacggcccctgctgccactgcccaccgttcggcggcgaaggcgccgaccccgaggagtcgttgaaggacggctggaggcatctggatgcagaggccgagcagagcggcgcatcgtgcggcttcggattcatcgctccaggcgggccaggtatgcgtcgcggacgaggagatcagtgtttcgtcggtcgcccgcgccggtgtccaccgcagcctgattcaacccacggtgctctgcacgcggccgtcatcgccggcacggtccggtcctcccgcccggcacggcggcgggacgcaggtcagccgcaagtcgctgctggccgacctcgggaacctcacggcccgcagcaggagactggccgcgcacatcacccggctcgaacggtgcctgtccgagactctgggccagacggctcgggaagcattcggcctcggtgccccggccggcatcgagacgctcacacgccgcgccaccgagtcggagcagcagattctcgagctgcgcggcgaactcgccgaacgggacgaggaccttgaagccgcccgcgctgcgaaccgtgagctgatggcccaggtcaaccgttgacctgcttcggctcacgggcgtcgctcggcggggtgccgaaccactggtgcagcgcggctcgcagaccgtcgacgtcgttcggcccgtgtccggtccacgctatgtgggagtcgggacgcagcagcaggccggtcgcgctcgtgctctccgccttgccgcttatgacatcgacccggtcgtgccagggcttcgcggcctcggcgaagtcgccgcacagatccagcagcaagggccgggcggtggtggtcaagtcggcaagccgacgggtgcccgtgccggtgtggaccacgaggtcgggcgcgaagtcctcggtggttccagcgagcaggtgagcgatgcgttcagtgccgccaggtgaggtgagcaggtcgccgaagaccgtccgcagggcactgacttccggtccggggcgcatcagcgccgactgggacagggtcgaggcgacgacgtgttctgcgacaggccggcgttcctcgtcgtaggtgtcgagcagcccttggggggcccaccctcgcactgtggcggccagcttccaaccgaggttgaccgcgtcctgcaggccgaggttgagtcccgggccgccgatcgccgagtgcacgtgggccgcgtcgcccagcagcagtacccgcctgtcccggtagcggtccgccagtcgggtgtttccgccggcgagacgtcgaagcaggtgcggtccctctccttgcggcggacccagtgggacgggcacacccagcacgcgttcggcgctcgccatcatctcttcgaacgtcatcggggtggtgtgctcgtccggtctgccggtttcggtggtgttgaggactggcactcgaccgggcagcaggccccacgcgatcgtgccgcgctccgtgcgcacgtacagcaggggtggcaagctcccgtagccgggaacgtgcaggctgccgtccgggcccaggtattcgtccgccacggacacgttcgcggagcgggtgacgaagtcgtcggtggtcacgccggggaagccgatgcgggagaggcgtcgcaccaggctgtgccccccgtcagcccctaccaggtaacgggcggtgagagccgcaccgtcggcaagggtgatccggacgacgtcgttgtcctggtgcagatcggccacctcctgccccctgcggaggtcgacgccgagttccgcggcgcgttcggcgaggaccttttcgatctgctcctgcggcgccgggagcaggctcacggggttgtcgtcgagtcctgtgaggtccagcgtgaacgcgccgaacatgtagcggggcgcgggccggggcggctcgctggagccgctgatgcgtgcgtagagaccacgtcggtcgagcatgcgcaccacctgaccgaccagaccgttcgccctgggctcggtcttcgggccggcgagacgctccagcaccaccggacgcaccccggccagtgccagctcgcaggcgagcatcaatccgttcgggccggcaccgacaattactacatcaagcatgaccattctcctcttttggggaatgacggcgtagaggctgcgagcggcagcccctgttcagggtggaaaggaggggaaggaggggcctacggagtgggaagtccggtggccaccaagcgcagagcccggggcagcagaacctccatcggctcgcccgagtcgccttgcacgaacagctcgagggcgacattgttcgcggccatcacgctcgcggccaccaggcgagggtagagatcggacccggcatccgtgcccgtgcggtcagcgatcactgcggcaagctccttctccgcgatcttgctcgcccgcagcatctcggcctccagcgcgggttcggccaacatcacccgcagaccggccgcccactcatcgggctcctggggtggcatgtgctccacctcagggccaggctccagctgccgtagtgccgcccgagtgatcgcctcccacaacggctcgccgggtggtccgtcacgcagctcggccgcgagccgcaaggagcgctcaaggtagcgaaacgcaatcgcttcggccttgctggagaagtagttgttgtaggtgcgcggagacaccccgaccgccgcggcgatgtcttccaccttgaccgcactcaacccgcgctcgacggtgagccggaccgcggcccagctcagcgctgtgcgcgtggcttccttcttccgttcccgaagaccactcatgcccttcacgctaacagaaggtgcgtgatgcgcaaatattcgtgccacgcaactttctgctcgggtggtctgtcggctcgaagtcggccatccactcgtcgatatgggcgaccgtcccacttcactggtactcattcgtgaagtccctgaactgctcaaagatcaattccgttggcggtgacgccgggtggggcggcatgctggcccggtcc

SEQ ID NO: 3212 - DNA, 5247 bp, Unknown
  Kingdom: Bacteria, Phylum: Actinobacteria, Class: Actinobacteria, Order: Streptomycetales, Family: Streptomycetaceae, Genus: Streptomyces
gacggcggtgccgatggtggcgttgacggtggctccggcaacaacggcggctcgggtaacaacggtggctccggcaacaacggtggctccggcaacaacggtggcggcgaccagggtggcaccagcacctccggcggctccaccgacggcggttccgcgaccaccggtggctccaccaccggtggtgacgacgccggctgcaccgtcgacctcgacggcgccgagtgcaccgacaacaccgacaccgacagcgtcggcaacaagccggtggagcagagcaagggcaaggaagagctcgccgagaccggtgcggccgagacgaccttcctggtcatcggcgccgcgacgatgatcgcgggcggcatcggcttccgtatcctgccgcgcctggtcggcggcggtcgcacggtcgcctaggtccgcagcggaccgtaccgacgcgtagcgggcgcatgccaggcccctgcgcggcgcggcacagcatgaagaagggcccgggagggcgtacgacgcctcccgggcccttctgtgcgcccgaaccgctcaggcggccgtacgcatacgtctgtcagccccgacggagcggtgaggggcggccccggagggccgtgcggaccggatcaggccgcttggtgcgccagcagcgcgagcgcggtcagcagcaccaccatcagggcgatcagcatcgccgggctcatcccggccagtgggccctggccctgctcctccagcatctgctgccgcacggcacggcagacgcggcagcggccctcactgacgggggacgcgcagttcgcgcacaccagtcggtcataggtcatgcgcattcctcctcccgcgcggcggagccgcttgcctgctttctctccgcacaacgctcacggaaacgcaaccgttccccccaccactgtgccagctcgcggcgatttcggcgcggcccgccggacaaggtccgtcacgacccgtttcgttccagggggtgatccgccataaaacgcccattgccggacgccgcctgcacgcgtgagcctggttcgcgtatggtcacgctcacctactcccggccgaccgtggtgcatccgtgatccgattcgacaacgtctccaagacctacccgaagcagacccgaccggctctgcgcgatgtctcgttggacatcgagaagggtgagttcgtcttcctggtggggtcctccggctccggcaagtcgaccttcatgcgactgatcctgcgcgaggagcgcgccagcacgggcacggtccatgtgctcggcaaggatctcgcacggctgtccaactggaaggtgccggagatgcgccgccagctggggacggtcttccaggacttccgcctgctgcccaacaagacggtcgcggagaacgtggccttcgcgcaggaggtcatcggcaagccccgcggggagatccgcaaggccgtgccccaggtcctcgacctcgtcggcctcggcggcaaggaggagcggatgcccggtgagctctccggtggtgagcagcagcgcgtggccatcgcccgtgccttcgtgaaccgtcccatgctgctgatcgcggacgagccgacaggcaacctcgacccgcagacctccgtaggcatcatgaagctgctggaccggatcaaccggaccggcaccaccgtgatcatggcgacccacgaccagaacatcgtcgaccagatgcgcaagcgcgtcatcgagctcgagcagggccgtctcgtacgcgaccaggcacgcggcgtctacggctaccagcactgaccgaagggctccggcccttcgtgcatttcgagcatcgagtactgaaaggacgccatgcgcgcccagttcgtcctgtcggagatcggcgtcggtctccgccgcaacctcacgatgaccttcgcggtcgtggtctccgtcgccctctcgctcgccctgttcggcggtgcgctgctgatgcgcgaacaggtcagcacgatgaaggactactggtacgacaaggtcaacgtctcgatcttcctctgcaacaagaacgacgccaaggacatgcccaagtgcgccaagggggctgtcaccaaagagcagaaggatcagatcgaggacgatctgaagaagatggacgccgtggagacggtccacttcgagacggtcgacgaggcgtacaagcactaccaggagcagttcggcgactccccgatggcgggcaacatcacgcccgaccagatgcaggagtccttccgggtcaagctggacgacccgcagaagtacaaggtcgtcgcgacggccttcgccgggcgggacggggtgcagtccgtccaggaccagcggtccatcctggaccagctcttcgagctgatgaacggcatgaacgccgtcgcgatctacgtgatgatcctgatgctggtcatcgcgctgatcctgatcgtcaacaccgtgcgcgtctccgcgttcagccggagacgtgaaacgggcatcatgcgcctcgtgggggcctccggcttctacatccaggcccccttcatcatggaggccgccgtcgccggtctgatcggcggcgtgctggcctgcgcgatgctgctcggcggacggtacttcctgatcgacggcggcctcgcgctccaggagaagctcaacctgatcaacttcatcggctgggacgcggtcctcaccaagcttccgctggtgctcgcgatcggtctgctgctgcccgccgtcgccgctctgttcgcgctgcgcaagtacctgaaggtgtgacatgtgccccctggggcgcacgggtgagtgcccgtgcgccccagggggcttgtcctagactcggcgccatgtcgggttgttcgcaccgcttccggccccgcggcctctgccgcggggcggccctgacattggtcttcgggtgtgctctcgccaccgcggccgcgaccggttcgctgccgcaggaccccgatcccgggccgggaccgcagacccgtgccgtctcctccaccgttgccccggtcgaccgcgacgagatcgaggacgccgccgccgaggccgaggccgacgggaagtccgtgaaggacgccgccgaggaggtcgtcagccgtagcggggaccgctggggcgcggtctacgacgagcgggagtacgaggagttcgagcaggcgctggacggcacctacaccggtgtcgggctctccgcccggcgcaccgaccgcggcgacgtcaccgtctcccgcgtccagcccggcggccccgccgaccgggccgggatccgcgccggagacctgttgcgcaccctggacggccgcgcggtcggcaagcgccccgtcgccgaggtcgtcgcgttactgcgcggcgacggtacgggcgcggccgagggcagccgggtggagctgggtctggtccgggagggccggagctggacggagacccttcggcgggcccggctgaacaccgaggcggtcaccgtgcggcgactgggggccgagcggtcgtcggcggtcctggtcaaggtggaggcgttcaccaagggcgccggggccgatgtccgggacgcggtccgcgaggctcccgacggggccgggatactgctcgacctgcgcgccaactccggcggactcgtcgctgaggccgtcgtcgccgcctccgccttcctggacggcggactggtcgccacgtacgacgtgcgcggggagcagcaggccctgtacgccgatccgggcggtgacacggaccggccggtcgtcgtcctggtcgacggcggcacgatgagcgccgccgagctgctgaccggtgcgctccaggaccggggccgcgcggtcaccgtcggctcgcccaccttcggcaagggctccgtgcagatgcccagcgagctgccgggcggttcggtggccgagctgaccgtcggccactaccgcaccccggccggccggaacgtcgacggcaggggtatcacacccgacctcgtggtgggggagagggcccagcagcgggccgagacggtattgagtggcctcgggggtgggtcgtagtgcgaaaatgaccgcactatggcgaaggaaaaagacaccgggcgcaagatggtcgcgcagaacaagaaggcgcggcacgactacacgatcctcgacacctacgagtgcggcctcgtcctcatgggtacggaggtcaagtccctgcgcatgggacgggcctccctggtcgacggcttcgtccagatcgacgaccacgaggcctggctccacaacatccacgtacccgagtacgtccagggcacctggaccaaccacacggccaagcggaagcggaagctgctgctgcaccgggccgagatcgacaagctggagtcgaagtcgcaggagacgggccacacgatcgtgccgctcgcgctgtacttcaaggacggccgggtcaaggtcgagatcgcgctcgcgaagggcaagaaggagtacgacaagcggcagacgctccgcgagaagcaggacacgcgggagacgaaccgcgccatctcggcggcccgccggcggcagcgcagcgcctgagcgggacctgacccggcgggacggtggccggacaggaatacagtggcatcgtccggcgttggtcacgtacgatgggccgtgcacctcagcgaaggtgcgcgttttgaaaaatcaacatggggatgatcggtttcgacagcggatgtcgaagcaggggaagcgagtcgaggaagcggcaatgatctcgtaaaccatatgtcgcaaacaataatcgccaattccaagcgcgattcctccgccttcgccctcgctgcctaattagcagctaagcgaagactctgcggagtgtcagcccgggggtggtcccgacccggatcctggcatcaactagggatctaaacttctcggcccggccacggggccgagaaggaaatcaaacagtggctgggcctgtcggaggcttgttcgcgtgacctccggggccgagaaaagcgtagcgaactgcactcggagaagccctggttccgcaccgttggacgcgggttcgattcccgccatctccaccaccccatgtaagcctccgccccgcgagttcactcgcggggcggaggctttttcatgcctcatgcctgatgtccgataccgatctgtgtccggcacctggggtgcccgcgcttgcgtgtcatcccgctcggctccctcgacgccccgccgtccccgcgcccgcgatgaccagggcgagggccgccgcggacatcggagccgcgtagccggtggctgtgcccgcgtgctcgaccagcc

SEQ ID NO: 3213 - DNA, 3328 bp, Unknown
  Kingdom: Bacteria, Phylum: Actinobacteria, Class: Actinobacteria, Order: Streptomycetales, Family: Streptomycetaceae, Genus: Streptomyces
cgcgggcgccgagcgcgacgagcgccccgtagccgatgcctccggccgcgcccgcgccgggcagggccgccgtgtccgggcccaggatcgaggcgtagtgcgcgagggccgcgtcgaggaccgcgatgtcctcctcgctcgcgcccttctggcggccgtacacctcgggcgctcccttcggccccgtcagcgggttgtccacgtcgctggccaggaccaggtcgatgtccgccaaccggaggtcgagccccgagaggtcggcctcggccagctccgcgagaggacccccgccggggcccacgggcttgccgtccgcgtccaggaagcgtgccccgagggcggcgagcatgcccgcgccgccgtccgtggtggcgctgccgccgacaccgaacacgatcgtcgtcgcccccgccgccagggcggccaggagcagttcgcccgagccgtaggtggtggccgtgagcggggcgaacaccccgtcgggcaggtgctggaggcccgaggcctcggccatctccaccacggcggtggacccgctcagcgcgtacgccgccgtcaccgggtccccgagaggaccggtcacccgcgcctcccggcgctcgaacccggcggccaccgccgccgcgaccgtgccgtcgccgccgtccgcgaccggcagggtctccacccgcgctccggggacgacgcgccgcagcccggccgtcacccgctccgcgacctgcacggccgtgagcgagcccttgaacttgtccgccgccacgagcacgcgggcggtctccacatctgctccgtccgtcaccttgcatcccttgctttcgaacaggcagtcgcgccgccccgaccctatccgcacgccccctgatctgcccatggctgtccacggccgtgcggttcggcccgcgccgctacgctgtcggccgtgacgactcccgatgccgactacgccgtgtacatcgccgggctcccccgggtcctgtccgccgcctcctcgctcttccgtgacgcggagggacggctcctcctcgtcgagccgaactaccgcaagggctgggcgctgcccggcgggaccgtcgagtcggaggcgggtgaggggccccggcaggccgcgcggcgcgagacggcggaggagatcggcctcgacctcgcgccgggacggctgctcgccgtggactgggcgcggggcgtcggccgtccgccgatcgtggcgtacctgtacgacggcggagtgctcaccgcggaccagctggcggcgatccggctccaggaggaggaactgttgtcctggcgactggtggcccccgcagatctggacggcttcctgctcggcccgctcggcggccgggtacgggcggcgctggaggtcctggcgtccggcggcgggaccgtggagctggaggacggcgagccggtcgcgtagagccggtcgcgaaggaggcgaggggtgatcagccctgctgcgcctcgggcttgctctccgtggcgcgcaccgccccctcgcggtcggcgaccagggcctcggtgcggtggccgcgcgcgatgtagtcgcgtaccacgagttcgacggcgtcctgggggttgccgacccccgcgagcaccatcacttcgacgacgagttcggcatccagactgacggtcaccttggccatgcgcggaccctaccccggcgtgttccgcacgtgggccggattccccgaggaacatcgctcgggaccgtcgcgaccaccatccggaccggccccgctatggggtcggccgccatcgccgcgagccgtcaccggttcctactctcgtgcgcagtcgatgaggcgagaggtggacggatgagcacggacaaggtggtcgccgacgcggcggacgcgatcgcggacgtcgagcgcggggcgtcgctggccgtgggcggattcgggctgtgcggcattcccggtgtgctgatccacgccctgctggagcggggcgccggtgagctgagggtggtgtccaacaactgcggggtggacgactgggggctgggcctcctgctgcgggaggggctgatctcgcggatgaccagctcctacgtgggagagaacaaggagttcgcacgtcagtacctccagggtgagctggaggtggaactcgtcccccagggcacgctcgcggaacggttgcgggccggcggttcgggcatcccggcgttctacacgccggccggcgcgggcaccatggtcgcggagggcggtctggcctggcgccacggtgcggacggctccgtcgcggtggcctcgccgcccaaggaacgcaggaccttcggcgggcgcgagcacgtcctggaggagggcatcaccaccgacttcgcgctggtgcgcgcggccgtgggcgaccggcacgggaaccttcgcttcgactcctccgcccgcaacttcaacccgcaggccgcgatggccggtcgcatcaccgtggcggaggtggaggaactcgtcgaacccggcgaactcgcccccgacgacgtccacctccccgggatcttcgtgcagcgggtcgtcctcgtcgggagcgccgacccgcgtgcggagaagcgcgtcgagcgccgtaccgtccgccccgaccgcgaagggaaactctgagatgccgctgacgcgtacgcagatggcggcccgcgccgcccgggagctgaaggacggcgcctacgtcaaccttggcatcggtctgccgacgctgatccccgaccagctgccggagggcgtcgaggtggtgttccactcggagaacggccttctcggcgtcggcccctaccccgtcgcgtccgaggtccggcccgatctgatcaacgcgggcaaggagacggtgacgctgttgcccggggcgtcctgtgtcgactccgcgctctccttcgcgatgatccgcggcgggcacatcgacgtcgcggtcctgggggcgatgcaggtgtccgcctccggcgacctcgccaactgggtgatccccggctcgatggtcaagggcatgggcggcgccatggatctcgtccacggcgcccggcacgtcatcgtgttgacggagcacacagcgcgcgacggttcccccaagctgctcggggagtgcaccctgcccctcaccggccggagcgtggtgcatcggatcatcaccgatctcgcggtgctcgacgtcacccccggcggcttcctgctgcgggaagtggccgacggggtgacggtggatcaggtgcgcgccgcgaccggggtggaggtggccgtggcgcacgacctcgcaccggcggcctgagcgtcggcggcctgagcgccggcggtccgagcacccgcggcccgcaccgtccgtacccgcaccgtccggg

SEQ ID NO: 3214 - DNA, 22090 bp, Unknown
  Kingdom: Bacteria, Phylum: Actinobacteria, Class: Actinobacteria, Order: Streptomycetales, Family: Streptomycetaceae, Genus: Streptomyces
gcccggggccgtgccaccccctggcccccgtcccgcacggccgcctgctggtgcggcagcggggagacctatgggcggtgccacggagtcgggtgacgtctcagccgacctggggcgaggcccaccagcctggccccaggccgcgcctgcccctcccgcttagcttcccctgccgacttcctcgccaacaaccgggcgttaattcatacagccttagcagtcgccacgatatttgatccgattccaccgcatcgcacacttcacttcgataacaacgcgccgcggcagcgttcggaacgaaagaagctcaccgcccgggaattgcacgcgcgtgccaggagtctggtcagacgcgcaccctcaaaccaatcctttcacggaagcgtgtcagtgtgaccctttttgacccacccggcccagtatccggcgtctgcgatgacccggaactgatggtggtacaccagcacttgatggggcttgaccctcacggaatccgattcgccaaagtactgcgggacacgatcgaccaactcctcaacggcgaggccactggacgctacgaatgggcgtcactgtttaaaaccgaaaagactcacgctggaacactcgtcgaaatcaacctgcaacgcgagtttgagttcaccgatggcgtcgacatggattatcgcatagagggaatcgatgtcgactgcaagtactcgcagaggttcggatcatggatgattcctcccgaagctgaaggccacctatgcctgctcgtctgggccgatgactaccagagcagatggagcgcgggcttgctacgcattaagcgcgaatggctcaatggcggaaccaatcgggatatgaagttcacggtaaaggcagaacaccgcaacaagatcacatggctctggaaggatgccgcacttccggaaaacgtactacttcatcttccaactgcaacacgagaacgcattctgatcccgggcaagaacaaggggcaagctcgcgttcgcgaactgttccgttcagtacacggcaagcgcatcggccgaggcgtggtgcgtacggccgcccaacagctcgactacatggcgcgcgtgcgcgaaggaagcaaagggcgcgcccgtccagcactacgccctgaggggatcatcatcctgggcgactaccagtcccaccaggctgtagcgagggacttgggcggcccggtaccaacggaaggggagttcgtcgcgcatcgcgtcgtgcgcgcacggccagaacacagcagccgcccgcatgccgagatcgacggggagctctgggttatcgcgcagcccggtgatgccgtggagattgccccgcagctacctgaagcgcaggagggcagcacaagagccgctcagcgccgtcgccttcccctgaaaggtgacggcgtcatcctaaccacgccacagcaagaggagctgggcagtgactgagcctgaggaagagcttccgatgatcaaacagttccgcgactggatccagaagggtccgtccgagagcgacccagagagaattcgattcttcactgacagcattatcgtgctcgatacgaacatcctgctcagtctttacgaatatacccccgtcgcccggcagcaggttcttgatgcccttcgaaatgtgcaacctctcctttggctcccacaccaggtaggactggaattcttccagaatcgccaccgggtaatcactggaaggaagaaggcgctcgaagagtctcagcgcattcttcgaaataagatcactgacgccaaaaaggcactcagggaagcccgcacacatacacaaaacatgctgattaggtatgcacaggatacggaagcgagcagcaggctcgaaaaacagatttctgataaggaaatcaacagcctattgggcgatataagcagcacacttgagggtcaggcatcccggcttcgggagtacgatatctcggtgtcaccaaacggtgaaggcgacgcggtactgtcacaggttgcggctttgttcggagaccagatcgccagtccgccaaatccgaagctgacccggcagcgcgtcgaagaagcgtcgctgtatagattccccaatcttattccacctgggttcaaggatgcaggaaagggcaccgccctggcgtcatctggagatttcctcctctgggaggagacaatttcgcacatgtctgcttcagaaggccgatctcacttgcttttcgtttcaaacgacaccaaggaggactggtaccagccgtcaggtgaaggccgcagcgagccacgcccgtggccttacctcaagagcgagatgagggcgcgagcgggtgccgagttgcggtttgagacccccggcaccttttaccgcgggatcaatcacttccttcatgcggagatcgcagagacgacctatgcggagatcgaccgggcagcggtaggcgcggtacctgcctcgatcaccgagactgccgctatccgcacccagcctccgcccgatcttgtggctgctgcgctcgacgcagccggcttgggggaggggctggtgtacaccatcagcaacaccccgcaccgattgctgttcctctggtggctgatcggtgctacagcacagcttgagcgtcgggtccccgccgacaacgaaccagacgttcttttcatgcccgcgactcgggcgacaacccagccagataacagctgggtacctggcgtccgcctgcatctcggcgaatggccctatcgcagctcctcgtggattgccccgtggttcgcggacaccatcaacgcgttgtctgtccgcgacagaaagatcctgcaaggtctcgctgcacagcagctggtactcaagccgagtgccatacaggtcgaccgatgacaccctcacctaagagaggcttcaccccatgaaaaatcgacgttccccagaggacgagtggaaaagactcaaaccggatgccgagcatgcactgcagattctgctctccgaaatcccgtcccacgcaactccgcagtcactgttcgaggcctacgcctatgccaaggacatcgccgctcgggccatgcagtcccgtatgctgggtgatctccccgctgaaaacaagcacttcaaagcgcttcacgtaaaaattaaacaggaaatggattcacgatataaggacgcagttccggcgaatctcctcagaacgccgtacagtggaaagactcacgagtgcctgttctctctgcttcagaagaatctcgcccagcccgttcaagcagctatgttgcgcatcgtaaccgcagacaacgtacacaccgaacgcagagctcgagaacttcgggaactcggccttgacgtacattggtatgatatcgaagagatcagtgtctacgagctccgctcactcgacattgacttcgaaatgattcctgccatcatcaggaacaatgcacggaagaacaagtccatgcccaaagaacagaaacagcgcatcctccgggatgccggaatcgccgaaatatgatgagtgacggcgcctgggaaccgcccgtcggctcgtgggcttcatccgccgctcggcgccgaaacatgcaggcgatccggagccgcgacaccaggcctgaactgctggtgcgcaggctcctgcacgctcaggggcttcgataccgagttgcggccaagccgctgcctgggcttcgccggacggcggacattgtcttccgtccggcgaagttggctgtctttattgacggctgttattggcacggctgtccgaagcattacgttccgccaaagactaactccggttactggtcggagaaggttcttcgaaatgccagccgtgacagagacacggactgtcgtctcaaggccgctggctggacggtgctgcggttctgggagcacgagtcagccgacgattgcgcgctcgcgatcgctgctgcggtcagccgccttcgggacagccgagactggtagctcagccagcctgaacagcagctcgctatccttaacgccagcctcggaacgcggctggcgtaccgcggcaacgacgccagcctccttgcccgccttcagggctgcgatgatctgttcacctacggcttgggcaaccggcggcgggaacgcgtttcccacttgtcggtaggcagccgtcttcctgcccttgaacttccaggtcggcgggaagccctggatgatcgccgcctgctcgacagtcaacttcggtcctgccgcagcgaagagatcgcgctcgtagctttcctgcttcttcatctcttcggagtcgtttgcgactccaagtccgcaaacgccgagggctgcccatgcctttttagcccgggtcggaccgaggtcagccccaccgtgcttcttggaaccgccaactagcgtgggggctacgcccttagatgccgcctcacgccatttcttcagcgcatccgcagcgcgcgggtcatcgatctccgcaaatcgctgggccatcgtcgcctctagagccgcgcccactgtacgcacaggaagcttctttggcttagtttgggcgaagaagggcaggtaggccgttttcagagccaccaagatggcgcgtggccgaagctgaggaacgccgtagttcttggcttccagcacttcccagtagcattttccgtaccccatggactcaaggcgctccagtagctcctcgcggtagccctggaacttctccctcggctccagaagtccgcggacgttctcgatcatcacagctttgggctcaagctcttcgacaaggttgagcatgatcgggaacagatcacgttcgtcgtctggccccaactgcttgccggccaccgagaatggcgggcagggaacaccaccagccaacagatcaagctcaccaggctccagacccagctccacacgcaggtccttcggatcaagcgtcgtcaggtcggcctgtttgaccacgcatccttcccaggcttcattcccttccacgttctcccgaagtgttgccactgcatggggatcgatctcgatgagcgccaagtgcctgaacagcgcttcgtggagccctagcgcctgtccacccgccccagcgcagatctcaactgaggtgaacgtcctctcagtgctggtcatgcaccctccttcctaacgtgcccgactggcaccggttctcgccagtcatcacagagggttacagaccccactgacaacgcgatcgccttcaagtgtgcgtcacgcaccagaacactccgaccgtcccacacgtgacagcgaacactcatacgatatggcccatgccgagaagccctgcatggacccacgacgagctgctgcttgcctgcgctctcgtggtcgagaacggatggaacgagctccgcgagggcgacctccgtgtagtggatctgtccgacctgctccggtccttgcccatccacgagggtgctgcacgcaccatcccaaagttccggtccatcggcagcgtcagccgcaagacctccgacctggcctctaaccaccccgcctacgtcggctcgcccaccaagggtggccgactggacagggaagtgatcagcgccttcatcgcccggcctgctgagatgctgctcgctgcagccacactgcggcaaggaatcggaacaggcgagctctacaccattcctcaggatccagatgagctggatgacgagggaaattcggcgatcgaaggccgccttctcacgcgctgggcactgtatcgcgaacgtgacagagcgctgcgtgctcgcaagatcgcacaagcagcgaagctggggcagcccctgcagtgcgaagtatgtgatttcgactttggcagcatctacggtgacgtcggcgcgggatacattgaggtgcaccatcgactgcccctccacgtgtccgggctccgcgagaccaagctggacgacctggccttcctgtgtgctaactgccaccgaatgtgccacaggagccgcgccggagaatcgtggcgcactccaagtgccctgcgggcggaactggccaaatcgacctcgcgaccagcaccaggccgagagactccagacacgcaaaggcagggggacggctctcgcggcctgcctggccgacaaccgcgtcataacgtctgccccctctgctcctcaaagctcatctgagcacagcccagggccccgtccggatcgcagccgtgggcccggagccagtggaggaggtcggcgatcacgtcgatggcggcctcctccgcgtgcgccacggtcagcggccctcgccgaacatccttgtcccgcacggacagaccgagaagcccgagcagcgcctcggccctcgccacctggggcccgtccacatgatcgaccgacgaccgcagccctgtcgccagctcgcaccagacgaccttcgaatcggcccggaggacgacaccccaacagtcggcgagggcatccacaagaaccagtccacgcccgtgctcctccccgtccgcccccgtgacgaggacggggacactccgcacatccgggtcgctcacctcgatgcgcaggcgactgccgctcatggacacggcgaggcgagcgtgcgtgccgcatcccacgtgcttgatcacattggccgccaactccgaagcacagagctgggcgtccgggacaacgccggccagtccccagaggtccagccgaaacctgaccgcgtctctcagccctgccaactccgcgggctccgcgaggaagggcatctcccacgccttccgcaccacaccgaagcgacagccatccatgtccatcaccgctctcgatcgatccgggtcacccgcagtgaccgttcgtaagagaacagtgtcagtgaaactctcattttggaactctcaccaagaactcccgggagcacttcctcgtgccgcacgcccccggcgcgcgccggcttgcccgtacatcaaccagccgtgcacgctctgaagcgtcgacgtgaggaaccccagccatgacagtcggacccaccacccgaaggcgccaactcggcgcggacctgcgccgcctgcgtgagcgcaagggcctcaccctggaggaggccgggtccctggtcggcatctccaaagcgaccctgagccgctacgagaggaaagagggtgcggtcaaatggccggccgtggacgctctgtgccgtgagtacggcaccacggacgatgagcgctcctcactcgtcgagctggccaagggcgcgcggatccagggctggtggcgttcgctcgcggaccccgtccccgagtccatgaacctcatgctgaccctggaggacgaagtggtcagtgaggaccactacgcctgcatgtacgtccccgggttgctccagacacgcgcctacgccgaagccgtgcaccgtgcctccgaaatacggtgcacggacaaggagatccagcacatggtggacatccgcatgaagcgacaggagctgctcgaaaggtccgagccgccccacatctgggcggtggtcgacgaagcggtcatccgccgcgccgtgggtgaccgcgacaccatgcgcgcacagctgcgccatctgctcgaacaggcccggcgcccccacgtcaccgtgcagattctgcccttcgctgcgggcgcgcacgcggcggccgtggggagcttcgtcgtactcggcggaccggcgcccgaactcgatgtcgtgtacgtggacatcctcggaggcggtctcttcatggagaagccgcaggaactgtcacgctataagttggcgttcgactatctgcgtgcgcagtccctggacatcgagcggtctgccgcgctcctgaatcaagtgagtggggagttttgatggttcacggcgtcggtcactggttcaagtcgtcgtacagcgggggcagcggaacggaatgcgtggaggtcgccgatctggtcgcgaccgtgggagtgcgtgactcgacgaggcccgagggtccacacatatccgtgagccacacggcctgggccgggtttgtgggcggcgtggggaagcagagccagtagtccggcggaaagtcgcgcctgttgccacactcctacggaatcgcctgtcgagcccgggcaatgacgtgttgcgcctcggcgccgaacacggctgactcgcgcagggactcccagacccgccggtacagggcgaccgtatcggcggcgtccagccagagttccgcgtgccagtcctctgtgatcaccagttgctcaccgacgatccagaacgcgttggcaggaggtagacgcagagcggcgttcatcgggacaatccccagccgcacggtgtccatgccgacgacgcccagcaggcggtccagctgccccgccagaacctccggtgggcacacctgagcccgtagcgcgccttcccacatcaggaggttcagacgctttccgggctggtacagccatctctggcggtccatgcgagcccgtaccgcgtcctcggtgtcgcgaggagagttctggagcgtcgcgtagcgctcgaacacatgccgagcatagtccggggtctgcagcagaccgttgacggcgaaggaatcccacacgtgcagtacgcgagcggtcgccgtcacctcgttccacgtctcctgtaccgggcggtgccccgacgacagctgtcgccgccatgaccggatgtgcgactcgaagcccttcaaccgtccgtgcagctcgtcgtacgccccggggtgcccggtggcatcagcccaggccctgaggtcttccgcggtgggtgtctggcgtccgttctccagcttgctcaccttgctctgcacccagccgagggaggcgctcagagcggtgccggtgagtcggccgtgagggcactccgtccggagagcccggagtcgtcgccccagatcctcacgagccttctgaaagtcggtgctcaccagtacgcgtctgttccttctgctcttactcgctgccgctcagcttcgccgcgaactcctcgtaaggcaacgcgtgatgccatgccgcatcacggatgacggagtaccggacgacttcggccggctcggtgatcaactcgacgtccacgaggtggtcatcgtcgtcgaagcgcagcttcgcggcaagccgactgtcgaacaaccagaagtcttcagagggaagttggagacgatcggcatccgctcgccatacgttccggatgtcttcccccagaccgctgttccgcctcgcgttgttcaggaggtaaagctgccctgtggtcggcggatgatcaacgatccgcacccgttcgacccgcttgccctgcgaggcctgggaacggatcagctcgcagtacggatcatccacgggccagtcgacgcctccggtctcgacgaactggcggtaggtgtccgtggcttcgtcactggcgaagcgccgccgggtctccagccgccatgccgagtggctgaacgtacggaacaggccctcgaactcgtccgggccgatgatccgtgcctgacgggtcgtgtccttcggcgtccagtcgaccaacaatgcacgtggtacgaccaccgccacctcaccctcggacaagtgccgcagccgggcgatgtcgccggcatcggtcaacggcggtccgtgaacgatgacctcgccgctctccacatcctcgtgaacagaggggcatcccgtaccaccactacctgtgccgttgaaacgtaaccgccgtgccatcatgcgccgcctttcgcttcgaggggcgttccctccgctgttccaaggctgtccggtgttcctcgtgcatgtcgagggatgatcgcgtcgcccacgagaatattcgcgaatagtggccgtggccgtcgaaccggtcggccgaccatggcgccatgaccgagcccaccaggtacagcgccactcccgtacagctttcaccgctcccggaggccgatccagcgcccgtggacggttgcgcgggatgcaccgaactctcggcggtgagaaaccgtgccagagcggtcggcgacatgaccacggtgtccgactgcaatgtgctgctgcggcgacaccctcaggggcactgaagcagggcaccgaaatggggcgatgcaaggagcatcgaccaccacgcccacgggagccgcttctcctcgttcaggcgaccggtcccgccaatgggcctcagccgcaaatctccgatcatctgcaccggaaggacttctccatgaacggaaatctctatgccctgtcggcccccgcagctgacgccttcgccgacttctgcggcggcaacgccggcggctccaacgagacctgcgtgagcctcgccgcgatccccagcgcggaggcctccttcgtcatccgcgacaccaagcccgagggcgcgggcaaggagctgcggttcaccggggcggagctcgacgacttcgccaccgggtgggtcaggacgaggggcctgacgctctaatttggcccccttcctgagcacgaagcaccacacagtgggccggaccggacatgctccggaccggcccttctcccccagcgaagggcgcagatgacctggtcaggacactggcacggatacggtccgtggaccggcagcagggacgcgtacggtcaggaggccctacgccgtccgggtgtggaactgaactccgagcagacccgggccttcgtcgcctcgacgctgccgcccctcatgaccggccattggctcatgcggcagaaccagacggctacggaccgcacctggacccgtgtggtgggcgccgtcacgtggctgaagagcacgtacgaggcgaatccccctgcggagagggacgacggtggccgcgcctacgtcaccctcgaacacaagatcgcgcacgcgatggactcccttccccgaggggtcgacgtctgctgggtgcactacaccaagtcccagagcctgatctccttctcggtggtgtgctgcctcaaccaccaccatcccggtctcccgtgccccctcccgcccgcctgacctccgcaccccatcggtgacgtgaagcgaggaagccatccgtgtcactcaacctcttactgcccgaaccgggtgtgacagcactcctgacctcctggccggacaagcgtgcgtgtacgaacgtgaggccggcgagctcgaccgtgcgatcaccccggagagcatcgaccattacctggaaaccgggtgcgtgcccgccgacgagatcgccgtcgtgagcaacggtgccgcgctgcacccggaccgccatcgaacggcgggccggaccgacccggcgaagctgcggagcctctacgagggcggctacacgatccggctcggcaacctccagcgggtcgtccctttcctggcggacgtctcccgcggtattcagcaggagaccggctacagcaactacctgcacgccttcgtgaccccacccggccggcagggcctgctccaccactgggatcaacagatggccgtcatcgtgcagatcgcgggtatcaagcggtggcagctctggcgccctatgtttccttccccgatgcgggagtaccaggaatccttccgcgtctgggacccgcacttcatccctcagtgggaggccgcgggccccgatctggaggtcgatctccgaccgggtcagtccctggtcctgccgagagggtgggtgcacaaccctcatgcgctcgacgcgcaggcccgcagcatccacctgacgttcgcgatccgggagcgcacgccgctctgggtcgcggagaagctcgtcggcggcgcgatcgagaagaacgctttccggcgcgtcatccctccccgcgacatcacggggcaccagttgtccgagcatgtgcggcacgtccgccgggcgctcatcgagcacttggccggtcttgacgtgaacgacttcgcccaattcttgtaccggactgccgtctcggagaaggagtacaccacctgagagcctcgccctcagaactgattcgcccggcagcccgtcctagggaacgaggccgagcaggatgggacgtcgtggcgaatcagcaggtgaacaaggggaagacctcggtgccaggagtggcaggagaggtttcggctcggcggagtgaggctcggcggagtgaggctcggtggagtggggcgcggtggagtggggcacgggggcgcgtcctcgccacgttcgccgtggtgctggccggggtgatggcttttcaccggggggtgcccaacgcggtcgggcgggtggggagtctgctggagtcgtttctgccgtgggtcggcgtcctcgttgtcgtgctgttcgtcgccgccctcgtgcggcggtccgccgtcgccctggtggcggtgctcctgcccgtgggcgtctgggtccatctcttcggcgggttgctcctgcccggtgcggaaggcggcgggcgggagctcgtcgtcgtgcagcacaacgtcagcgacgagaaccgtgatccggcggcgaccgcccgggcgctggtcgaggccggagccgatctcgtcgcgctggaggagctggtggtcccgcagctgccggtgtacgagaaggctctcgccgcggactatccgcatcacgtcgtccggggcaccgtcgggctctggtccaagtatccgctcagcggggagcggctggtcgacatcaagccccctggcatcgccgaagggtggagccgtggcgtccgtgccgtcgtcgattccccgtacggcgacatcgcggcgtacgtcgcccacctgccctccgtccgggtcggagcgggtgggctcgcgtccgagcggcgagacgagagcgccgagctgctggggcgcgccatcgccgccgagagagtcgatacggtgattctgctcggggatctcaacggggctgtggaggaccgggggttggctcctctcacctcacgcctgaacgtcgccgagcgcggcttcgccttcagcttccccgcctcccttccgctggcccggatcgatcaggtcatggcccgctccgccaccgtcggccacatccgcaccctgcccgccaccggcagcgaccacctgcccgtcgccgctcgcgtcaccctggggtgagtgcgcggctcggagcgcgtccccctcccgtaccgccgcgacacgttgcctccaggtcatgtcctcggggaagtcgtacgtgtccctgtcgaccgtccagctcgcgtacgccgccgacctgcggcagtccacgcaccgcgtctcgtcgcccagcgggcggaagacgtgtgcctccccctcgcccgcgcaggcgatcagctccctggtcggcggcgggggtggcggagccggcagcggggtcaccgggcacttctggatcaggcggtggcgcaggaagcccaccgccgagcgcaccccggtctcgggcgggtcggccaggagcgcctgccgcaggtccccctccggcaagccgccctccagccacttcaccgcttccaccgccagccctcgtgcctcccgcacccccagcaacaggtcgcggcgtgtgtggcgcagcgacagcagcagcctttccgctttcgccagttgggaagcggggtggggtgccagggcggggcgagggcccggcagcactccttccgcttccgcttccgccagccgcgcttccggccgttccgcttcggagggtgggtggggagtggtcttatcactctggtcttcctccggttcatagccaccggccgtccgggaggtcggtcggccgaccgtcggttgccgcgtactcggtggcggaacggcagccgccactcccggtgagcgcccgccgtccggctccagcgtcgcccgtacggtcctcgcctcggcgctcgtcagcggggtgttggtgaacagttggtccgtcgcccagcgtccgccctcgccctgcgcccgccactcgtggaggtagccgtgctccaccagttgtttcttggccagctggtacgagcggcccttcatctccagcttccccgccagctcgccgagcgggcggtcggtggcggagtcggggaggccctggacgtacagcaggaggaccttcgcgtcactgttcagccgccggtcgcgtacgaccgtgtgcggagctttggtccagcccgaagagggcgcgataacatggcgcagcatttccggtggctcctaaccactcgggggtgtaggccctcgggtgggtgttggtgcacctccgggggccgccctatgcgcgcgtacgcacacagaacgtgatgtcgccgtcacgctaccgcacggttttgcctcgctacgacgtcggcgaaaagtgcgcccccgctcacaacccagctcacaacctgactaccaccgcgcgccgttgtgccggtcggcctcggcgggacccgtgtttccctcgaaggctcccagattgatcaggctcacccggtcgtcccaggcatcccatctcacgtgcttccgtgcgccccagtagtaggtgtcgtagcccatgagatcgccgtacgcctcgtcttcgcgcacccggtcgggtctgccgaaggcagccagtagttcctcgtacgaagccaggtgggcgaagtgggagagatgcgggccgtggatcgcgaagccgacgaccgcaccggctcgcaccttgtacgtgaccttgtcggcgcggtacaggaacccgtccgaccgggcagcgtcgtcgaagacctcgtcgagagtcagccgccgcccgtcggcgtcgtcgtactcgctgtcgaggtcggtcccaccccgataccgggcgaccaggggggactgggcctcgatgatgctccggcgtgggacgccgacgccgggcgtccccagggccacgccgcccacctcgatcgtcgtgagatcgaggtgcggctgatacagcacgtccaggttgtcgaggatctcgatcatcctgacgggtggtaccgagaccttcttaccggccggcaccggccgccctgtccgtcagtgcggccaccgcgtcgaccaggccgtcccacgcctgtcgcgtgtcggccgtgtccgggtgccgcgcgctgaggatgtcgagtgcggacgccatgtcgtccagggtccaacggagttcgtagtacgcgagcagggccggatccgggtggtggccggtgagttcggcgtagcgggacaggtcctccgggccgccggtggccagccagaggtcgcgctccggcggcgcgagagcgacggtgtcccagtcgaccaggagggtgcggccgccggggtccaggatgttgccggggtggggttcgccgtgggtgatcacggtggcggcggtcgacgcgtcggacgcgagctgcgccgtgcctctgccgaagtgctccaagccggcccgcagcgctgcgtagttggcggtcagcagggcttgacatcgttgcgcgtacgggcccgactccgcgcggaagcgctgcgggtcggccaacgcctcatcgatcaccgaaaaccccggcaggcccggtccatgcatcggcgtcgtcaacgggggttctgccttgtgcagttgggccagtcgttccaccagaatccggcgcgcccctgggtccagcacctggccgaagcggccggtgggcgcgtcctcgtacgggaagacgctcacggcgtaccggtcggccaggcggagcagcgtctcgccatcaccggtacgcaggggtgccgccaacacaccctcccccagggtggattcgagcgtcgccgccgtgttcatggcgcggctcaggcccgtccacgcctcggccgcgtcccgtccgcagtgcggcttgtgcgcgaggtcggcgaccgtgacgaaggtccgccggccttccgcgtcggccgcgacccagtggtggtcgccgaagccgaccggagcgtgggtgagcctgacgggctcgatgccccaggcgccgagagcggaggccaggacggcttcgtcgatgccggtcgggcggtccttcatacgggacaccgtagcggccctccgtgaaggaccgagagggtcgtctccgccctctccctcccccctccccgaccctctccacgttttgcacacgctctcatcacaattccgcttcgcttccggcatgcccctgatgcacgccggggcgcgctgcgagcatcggctgctccacagcacagagttcggccttgggggcaacacatgcagacgaggaagcagtcacggcgaccgaggcgcgggatcctccgcatacggatatcggccggagcgggcgcgctcgcgctgatcctgacggggtgcgggggcgacgacggcaccacggacgacggaggcgggaaagtcgcggcgtcggtcggtccgtccgcctccgtggaacgggcgctggcgctcatggacgacgagcagagcgtggacgcgggcagcagcctggacgtggacgtcctcgacaacgactccgtcaccctggagaacggggaacgggcggcactgctccacacctacgaccccgccgaactgaccctgagcatcgacgccgagcccgcccacggttccgcatcggtgtccgggagcacggtcacgtacaacgcccgggacgggtacgccggcgaggacgagctcacgtacgaggtcctcgtgaagggcaccgaggtccccgccgccaccgccgtacgcctcgggcagatggatgccgatgagcccctgcgccgcgagcgcctcccaatgggccgggcgtacgccggggacggccgggctccccgcgtcgaggagttcgcgcacctcgccggggggtgcggcgcgggccagccatccccgtacggagtgcgccagcgcgcggtgctcctcggtgatcccgatgccggtaccgatacctgtgccgatgcccatgcgcgtcctcgccggtcggggccactggaacggcgcaagagtagaacacgttgcaatctgacggaaggtcaggagactgtcgaattcggaccggaatagagcgccaccgcgaagcgttcaccatgcacgcacttggggggagcccgggtgatcgacgctgcccggaggccccacgtatgcgacggacgaaacagatacggcacaccggggagctctccgagccgcgacaagcgcgctccggccccatcgtgcccgtcctcgccttcgcgggcatcaccgtcgcggtcatgcagaccctgctggtcccggtcatcaaggacctgcctgtcctgctgagcaccgacccggccaacgccacctgggtgatgaccgccaccctgctcgcgggtgccgtctcgaccccgatcatggggcggctcggcgacctgtacggcaagcggcggatgctgctcctctccctcgccgtcatggtggccggctcgctgatctgcgcgtccaccgacgacctggtcgtgatgatcaccggccgcgcactccagggcttcgccatgggcgccatcccgctcggcatcggcatcatgcgcgacgaactgccgcgcgagaagctcggctcggcgatggccctgatgagctcgtcgatcggggtgggcggcggtctcgcactgcccgccgccgcgctggtcgcccagcacgccgactggcacgcgctgttcctcggctcggccgggctcggactgctcgcgatggcgctcacgtacgcactcgtccccgagccgccgctgcgcgcgcccggcaccttcgacgtcgtcggagccctcgggctctcgctcggcctggtccttctcctgctgccggtcaccaagggaagcgactggggctggacctccgccccgaccctcgggctgctcgccgcgtccgtcgccaccctggtgctgtggggcctgttcgaactgcgcaccccggcgccgctcgtcgatctgcgcaccaccgcccgccgcgaggtgctgctcaccaacctcgcctcgatcatggtcggcgtcgccttctacgcggtctccctggtcctgccgcaactgctccagttgcccacgtccaccggctacggcctcgggcagtccatggtggtcgccgggctctgcgtggccccgctcggcgtgacgatgatgttcgtcgccccgctctacgcccggatctcggcccgccgcggccccaaggtcacgctgatgctcggcatgctggtcatcgcgatcggctacggggccgggctcggactgctcagcgccgcctggcagaccgtgctgatcgcggtggtgctcggcgccgggatcggcctcgcctactcctcgctgcccgccctgatcatcggggccgtcgacccgtcggagaccggcgcggccaacggcctcaacaccctgatgcggtccatcggcacctcggtgtcgagcgccgtcatcggcatggtgctggccaacacctccgtgacgacgggctcggtccaggtgccgtccatggagggcttccggatctcgttcctgatcgccacgggcgcggtgctgatcggcctggtgctggcggcgttcctgccctcccagcgggcctccgcgcacccggtgctcctggcgagcagcgcggacgacgcgcaggccgcgcgggcggccgggcgtggtcagctcaccggagcgtcgaaccgcggcaccgtcgtgagcagccgggacacgtcggaccccggcaggagctcctgaggctcggccgcgcgggagaacagccgggcgggacgcgcgccccggacatgagcccggcccccgtcgacgcggagccaggagccctcgcgcagcccgagcacgggtacgtcgttctcctccaggaactcggtgagccgctcctcgcgggtctcgcccttgtgggtgctgtccgggtccgggtccaggtagtgcgggttgatctggaacgggaccaggcccagcgtctcgaaggacggcggctgcacgatgggcatgtcgttggacgtgcgcagggtcggtgcggccatgttggtccccgcgctcgcgcccatgtagggcagccctccccgtaccgcgtcgcgcacggcctcgcgcagaccggtgcggtagagggcgtcgagcagccggaaggagttgcctccgccgatgaacacggcgtcggacgctgcgagttcggcgaccgggtcgacgttctcgtggacgccgcgcacggtgatgccggacggctccagggcctcgcggacccgggtggtgtacgcggtgtgatcggcgagcgcgtacgggacgaaggcgagtcgcgcgttcgcggggaggaacgcggtgacggtgtccagggcgtgttccaggtaaccgcagccgtactgggtggagttggagagcagaagcagattcacggggttcctcgggtacgtcgggcacatcgggtcggtcaggtggtacggggccgccgggcgcgggacttcggccgctgcggcgggtgggtgaggcgctgctccagcagctgggccgcgtggcgcagcgcgtcgagccggtcctcgggcgcgccctggaaccggtcctctccgccaccgagactgagacttccgtacggctcgcgccccaggaacaccggtacggcgacggtggcgatcccggtgtcgtactcgccgaccgtccaggcgtagccctgggcccggatcttcaagaactcccgttccagcaggtccggttcggtgacggtgcggtccgtgaagcgcgccatggggcggccccggaagagccggtggcgctgctcgtcgggcagacaggcgtagtaggacttgctggtcgcccccgcgtgcgccgggtagagctcgccgaccagcgggtagtagcgcagcggtccggtctcgccctcctcggcggccacgcagcgcatgtggaagctgtccgggaggcagaacaggaccgtgtcgccggtggtccggcgcagctcctccaggaccggaccggccagcagctccagcgagcccgagcgctcccagagccggccgagccgcagcacggcggggccgatgcggtagcggcgggtggccgggtcggagaccaggaagccacggccggccagggtggcgagcagccgctgggcgacggaggtgtcccagccgaactcctcggcgacctcggtgacgccccagtcgggcctggtgcgctcgaaggcgagcagcaccaggagtgcccggtcgacggtttgcagcgccccggcgggcgtacgtcggtccagatcgaactcggccatcgtcatctcaccattcagaccggaattgctaatagcgggaaacagttgcgctcaacgctatccgatcccgaatgttgcctcagcaccccgccccgcgctctccccgtcgagcgccgggcgggtgtcaggatcaggagaaaagcccccatgttgaagtacgtactggacatcgtcgagcttctggacgatccccaggtcaatggcaagacggtcgtcgagtacctcgacgccgcagcgggggccgagggctcgtccgcgcaggtcaccaccgtcacgggtgaccagggctcgacggacttcgtgctcgtccgcatccccggctcccacggccggacgtcgggcggcagcgcccgcaccctcggcgtggtgggccggctcggcggtatcggcgcccggcccgaggtgaccggtctggtctccgacgccgacggcgcggcctccgccatcgccacggcggccaagctgctcgacatgcgccgccgcggcgatgtgctgcccggtgacgtgatcgtcgccacgcacatctgcccgaacgcgccgaccgagccgcacgacccggtgccgttcatgggctcgcccgtggacatcgccacgatgaaccggcacgaggtgaccgccgacatggaggccgtgctctccatcgacaccaccaagggcaaccggatcatcaatcacaagggcctggccctgtcgcccaccgtcaaggagggctgggtgctccgggtcagcgagcagctcggcgagctgctggccgtggtgaccggtgagccgttggtcacatacccggtgaccacccaggacatcacgccgtacggtaacggtgcacaccacatcaattcgattctccagcccgccaccgcgaccgccgctccggtcgtcggtctcgcggtcacctcggccgccgcggtaccgggctgccagacgggcgcgagtcacgagagcgacatcgcgtccgccgcccgctacgccgtggaggtcgccaagggcttcggcgccgggaatctggacttccacgacgcggtggagttcgacaacctcgtcaaccgctacgggtcgctggctcacctgcagaccctcggccgcaccacccaggagtcctgatggcatccgccccccaggccgacgccacggcccccgaagccaagagcatcggcagtgacgactactcgctctcgcgggtcccgcgcgacaagcgcttcggcttctggtccatgctcctgcagtggctggcccagtccggctcgatctcccagttcacgctgggcgccaccatcggcgtcggcatgaccttcggggacgccttcctcgccttcacgctcggcgcggtcatcctggagatcgtgatcttcgcgatcggtctggccggcatgcgcgagggtctggcgaccccgatgctcacccgttggacgggcttcggccgcaacggttcggcactggtcagcttcgtcatcgcggtcagcctggtcggctggttcggcgtccagaacacgatcttcggcaacagcgtctcgacgctggtcggcggaccgtcctggatgtggtgcgtgatcgcgggcatcgccatcaccgccctggtgatcttcggcttcaggtacatggccctgttcgccaagatcgtcaccccgctgttcttcggcatggtcgcctggtcgatcatcacgacgctcaacgaccactcgatcagtgagctgatcagctcaccgccgcccggcgaggcgatcccgctggccgtcgccgccaccgccatcgcgggcggctacatgaccggcgccatcgtctccccggagatgacccgctacaacaagaagggttcgcacgtcttcgtgcagagcgcctcctcgatgatcctgtccgagtacatcgtcggcatggtcggtgtgctgctcggccacctggtgaagtcgagcgacgtctcccacatcgtgctctccacctcgggcgccttcggtgtgatggtggtcctgatgtccaccgcgaagatcaacgactggaacctgtacggctcctcgctcggcgtcgtcaacttcttccaggtcgtcttccgcaagcggctgcaccgcggcgtggtcaccgtcgtcctcggcgtcgccggcacgctcctgtccgcggtcggcatcatgacccacttcacggagttcctctccctgctgggcgtgatgatcccgccgatcggcg

SEQ ID NO: 3215 - DNA, 1676 bp, Unknown
  Kingdom: Bacteria, Phylum: Actinobacteria, Class: Actinobacteria, Order: Streptomycetales, Family: Streptomycetaceae, Genus: Streptomyces
gccccggatcgccacgggctccctcgcggtgctgatcccgggggccctggcactcgccgccgccacgggcggcggtccggggggcgtgctcgccggggtcggcctgaccgtggccgcgctctcgctcgcggcgtgcgtcgtcctcctgctgaagatcgagcggccgctgaaccgaaggttcgtggaggaggaacgcaccatgatcgaagaggtgaaccggatgcgggagctgttcacccatgtcgcggagcgggaccggtgggaggaacggctgaaacgctcggtccgtgaacgtctctcccgctttcccgtggaaggggggtcgttccgttgatccggcgtctgaccgtcttcttcggtctggtggccttccccgcagccctgttcacctcggtcggatacgtgctggccacccgggagccgggaccgtatcagcgggcgttcgagggccagtgggacgccatcgcggccggtttcgccgtcaccgtgtgcggggtgctggccgcggcccacggagtgcggctgtgcttcagcgtgctcggcggcttccagcccgacaacgtccggcgtggcgcgctggccctgctcgccggactgctcgtctgcggtgtggggttgctgctgctccggcggctgctggcgccctgaggggacgccgacgggccctgaacggaccgtagtcggtgtggtacgggcaggtgaccacgaaggtgatccacagcaaaatggcgttgctctctggtgaggagtggtcccgccgtgtagcgtcgccggaagatgtcgtggttcgcagtacctgcccgcgcctggcgcgggcgttttgctgtgcagtgcctgagaaccagggcgatcacctccgggtccgcgcggtgcggatccgtttactgctgagaggtacgggcatggccagcggaaccgtcaagtggttcaactcggaaaagggcttcggcttcatcgcgcaggacggcggcggtcccgacgtcttcgcgcactactccaacatcaactcctccggcttccgtgagctccaggaaggccaggcggtgaccttcgacatcacccagggccagaagggcccgcaggcggagaacatcaccaccgcctgatccgggttcgaccgaccctggagccccggagcgcatcgcgctccggggctccagggcgttccgggcggattcctgccgggtggctctccgattggagcggcgcgtaccgggtacgcggtggctctcgcgccgatcgttccggaacttccggaaggtccgggcgggaatggagggcgacccatgctgaaggccatcgcagacgtactccgctccatcggaggagccatcgccaccgtggtcacgctgcccttccgggccctggccaggctgttcggcggtgcgtcgagcagcgcgcgcggccaccactgaaacacacgtgcccgtgccccggcccacgaagggccggggcacgggcacgcgtgcgcggtgagccgtccgggttcccggggcggggctccgaggcgcgcccacccgcaggccgacccgcactcagggggcgtccctagcccgtcgactcgtccggggccgggtgcctgtcggggtgcgcgcccgcgttgcgtggcgtgttccggccggcgccggcctcgtccagctcgggctcgccgctctggcgggccacccggtccggca

SEQ ID NO: 3216 - DNA, 8180 bp, Unknown
  Kingdom: Bacteria, Phylum: Actinobacteria, Class: Actinobacteria, Order: Streptomycetales, Family: Streptomycetaceae, Genus: Streptomyces
tggacgcgatgctgacggcgtgccggccgccgtcagcatcgcgtccagcgaccgggcgaactcccgctgctcgtcgtcgaggaggaaacgcatcagcgccgtcccttcggcaggccgagcagccgctcggcgatgatgtcccgctggatctcgttcgtcccggcgtacacgggacccgcgagcgcgaagacgtacccctccgcccacgccgtgtccgccagctccgcgtccgggcccagcagatcgagcgccgtctcgtgcagcgcgatgtcgtaactcgaccagaacaccttgttcaggctggactcgggtcccagcgacgcccccgccgcgaagcgggacgccgaggcggccgtgaacagctgatacgcccgcgccccgatcaccgcgtccgccacccggtcccgcagcgccgtgtccgccgggtctcccgccttccgccacaggtccttcagccggccggcggaggccaggaaacggccgggggagcggagggtgaggccgcgctcgtcgccggtggccgacatggcgatgcgccagccccggcccggctccccgatgacgtcctcgtccggtacgaagacctcgtcgaggaagatctccgcgaacgcgggcttcccgtccagccgcccgatggggcgcacggtgacccccggctccgacagcccgaacatcagatacgtgagcccgtgatgcggcttcgaagctccggggtccgtacggaagatgccgaaggcccggtccgcgaacgccgcccgcgaggaccaggtcttctgccccgacaacagccagccgccgtccgtgcgcaccgcccgcgaccgcagcgccgccaggtccgacccggcctccggctccgaccatgcctgtgcccagatcgtctcgccgctcgccatcgggggcagtacccgggcccgctgctcggccgtgccgtgggcgaggagggtcggggcgaggaggctgatcccgttctgcgagacccggcccggtgcgcccgccgcccagtactcctcctcgaacgccagccagccgaagaggtccgcaccccggcccccgtactccttcggccaggagaccgccgaccaccggccggtgtgcagcagcgcttcccactcccggtgcgcggcgaacccctcctccgtctccagggagggcagcggccgggccggtaggtgctcgcggagccagacccgggcctcggagcgcagggcttctgtccgtgccgtgtgcgtcagatccatgaagcgcccgccttccgtccggtcggcccgtcgccgagggcgttccctaacaagtgtttggtaggttaacgtacgacccacagaccgtcgagaagtcgggggaccgggccatggacataccgccgtacctgccgggacacggactgctggccggccgcaccgccgtcgtcaccgccgcagccggagccgggatcggcggcgcgaccgcccgccgcttcctggaggagggcgctcgcgtagtgatcggcgacgcccacgcccgccggctgaaggagagcgcgcacaccctcgccgacgcgttcggatccgaccgcgtcacccacctgacctgcgacgtcaccgacgaggatcaggtcgtggccctcttcgcacacgccgaacgtgcccatggcggcctggacatcgtcgtcaacaacgcgggcctcggcggcaccgccgaactcaccgagatgaccgacgaccagtggacgaggatcctcgacgtcaccctcaacggcaccttccgctgcacccgagcagccctgcgctccctcaaggccgccggaaccggaggagtcctcgtcaacaacgcctccgtcgtcggctggcgcgcccagcgaggccaggcccactacgccgccgccaaggccggcgtcatggccctcacccgctgcgccgccgtcgaggccgccgactacggcgtacgcgtcaacgccgtcgcccccagcctcgccatgcacccgcacctggccaaggtcacctccgccgaactgctcgccgaactcaccgcgaaggaggccttcggccggtacgccgaaccctgggaggtcgccaacgtgatcgtcttcctcgccagcggctactcctcgtacatgaccggcgaggtggtccccgtcagcagccagcatgcgtgaacacacgggccgcgggcggacaatggccgggtgcctaccaagaagaagccccaggtgacccccacgccggagcgacgccgtgaactgctcgccaccgccgccgaggtcttcgccgcccagggatacaacgccaccaccgtccgccgcatcgcggacgaggcagggatgctcgcgggcagcctctactaccacttcgattccaaggaatcgatgctcgacgagatcctctccaccttcctcgacgagctctggcgggggtacgacacggtcctggaagccggtctcggcccccgcgagaccatcgaggccctggtcaccgagtccttccgggagatcgaccggcaccgccccgccgtcgcgatctaccagaaggagtccaagcacctcgccacccagccgcgcttcgcctacctcgtcgactcgcagacgaagttcgagaaggcctggctcggcaccctggaacgcggcgtcgccgaaggcgtcttccgcgacgacctcgacatccgcctcacctaccgcttcgtccgcgacaccgtctgggtcgcggcctcctggtaccggcccggcggacaccacagtcccgaagagatcgcccgtcagtacctgtcgatggtgctcgacggaatcgccctgcgtacgtgaccggtaaccggtccaccccccgagcgcaccgaggagcagcagccatggccgaggcctacatcgtcgaagcggtacgcacccccgtcgggcggcgcaagggcggcctcggggccgtccaccccgccgacctcggcgcgcaggtgctgaaagagctgatcacccgcgccggcgtcgacccggcggccgtcgaggacgtcgtcttcggctgcctcgacaccgtcggaccgcaggccggcgacatcgcccgcacgtcatggctggccgccggactccccgaggaggtccccggcgtcaccatcgaccggcagtgcggctcctcccagcaggccctccacttcgcggcccagggcgtcctctccggcacccaggacctcgtcgtggcgggcggcacccagaacatgacccagatcccgatcgccttcgcctcccgccgggccgccgaacccctcggcctcacccaggggccgttcgcgggcagcgagggctggcgcgcccgctacggcgacgcccccgtcaaccagttccacggcgcccagctgatcgccgagaagtgggacatcagccgccgggacatggaggagttcgctctcacctcccaccaccgggcgatccgcgccatcgacgagggccgcttcacccgcgagatcgtcgcgtacggggacgtcaccgtggacgaggggccgcgccgcgacaccaccctggagaaaatggccggtctgcgtcccgtcgtggagggcggcaccatcaccgcggcctgttcctcccaggtctccgacggggccgccgccctgctcatcgcctcggagcgggccgtcgccgaacacggcctcaccccgcgggcccgcgtccaccacctgtccgtacggggcgaggacccgatccggatgctctcggccccgatcccggccaccgcgtacgccctgaagaagacgggcctcaccatcgacgccatcgacctcgtcgagatcaacgaggcgttcgcccccgtcgtcctcgcctggctgaaagagaccggtgcggaccccgagcgggtcaacgtcaacggcggcgccatcgcgctgggccacccgctcggcgcgaccggggcccggctcatgacgaccctgctgcacgaactggaacgcaccggcggccgctacgggctccagacgatgtgcgagggcggcggacaggccaacgtcaccatcgtcgagcggctctgaggacccggtccgaggcccggcctcacccccacccgtacatcctctggtcagccaggttttccctccgccggtgtggcgtgatccaccgccggaggagaggacgtgctagggtgtttcccgttgcagttttggtacccatgaactttatgtgcgcctgacgggaatgcttcctcaggcgctttattgttttccggctttctccgggtggggctcaatgcggcgacttggaatccgtaaagtgcgggttctcggcactgcacctcttttaggagaatgacatggctactggaaccgtgaagtggttcaactcggaaaagggcttcggcttcatcgagcaggacggcggcggcgccgacgtcttcgcccactactccaacatcgccacctcgggcttccgtgagctccaggagggccagaaggtctccttcgacgtcacgcagggccagaagggcccgcaggcggagaacatcgtcccggcctaattgccggacgcgtacctcgctgaccggggcccgcaccgtgaaggtgcgggccccggtttgtgctgtccgagaaaaaacccgtttcgtgcgcacatcctgggggcgcatcacagacggtcgggccggcacatcgcagtaaacccactcggcagttgcccaggaatcccccaggagggcaattccgtatgaccagctccgaacgccaggaccgcaccccccgctcgcgaccggcccgtggccgaggccgcggccagggcgccggcacccaggctcccgcgaacggccggggcggcgcaccccgctccaaggcccagggcggctccaagcccccggcccgtcgtcgcgccactccgccgcagggcgagttcgccctgccggagaccgtgacccccgcgctgcccgccgtcgacgccttcgccgacctggacatgcccgccgggctgctgaagaccctcaccgcgctgggcgtcaccgagccgttcccgatccaggcggccaccctgccgaactcgctggccggccgcgacgtcctgggccggggccgcaccggctcgggcaagacgctcgccttcggcctcgcgctgctggcccgcaccgccggccgccgcgccgacgccaagcgcccgctcgccctggtcctcgtccccacccgggagctggcccagcaggtcaccgatgcgctcaccccgtacgcccggtcgctgaagctgcgcatcgccaccgtggtcggcggcatgtccatcggccgtcaggccagcgcgctgcgcggtggctccgaggtcgtcgtcgcgacgccgggccgtctcaaggacctgatcgagcgcggcgactgccggctggaccgggtcaccatcaccgtcctcgacgaggccgaccagatggccgacatgggcttcatgccgcaggtcaccgagctgctcgaccaggtgaacccggacgggcagcggatgctcttctcggccaccctggaccgcaacgtcgacctgctggtgcggtcctacctgaaggacccggtcgtgcactccgtcgacccggccgccggcgccgtcacgacgatggagcaccacgtcctgtacgtccagggcgcggacaagtacgccaccacgacggagatcgcggcccgcgacggccgcgtgatcatgttcctggacaccaagcacgcggtggacaagctcaccgaccacctgctgcacagcggggtccgggcggcggcgctgcacgggggcaagtcccagccgcagcgcacccgcaccctggagcgcttcaagaccgggcacgtcacggtgctggtcgccaccaacgtcgcggcgcgcggcatccacgtcgacaacctcgacctggtcgtcaacgtggacccgccgagcgaccacaaggactacctgcaccgcggcggccgtaccgcccgtgccggggagtccggcagcgtcgtcacgctggtgctgccgaaccagcgccgcgagatgacccggctgatggcggacgccgggatcaccccgcagatcgcccaggtccgctccggcgaggccgagctgagccggatcaccggtgcgcagacgccctccggcgtcccggtcgtcgtctccgccccggccaaggagcgcggcagcagccgcggcggcgctttcatgggccacggcaccaagcgcggcggcagcggggctccggcccggggtcgtcgtcccggcgtgccgacacccgaggcccgtgcggccgccgcgcagcgccggaacaaccgcgccgcgtgatccgtgcggccggcggtccgccgccggccgccccgtacgcccggcgatccccccccggcgcgtgcaccgggcccctcgtccgggctcccttacgtcccctccgtgcactcgacacgtcctccgtgcactcgaccctgttgaggaaccatgcgctgtgtcatcgcccgcttcccgttcgatctgttcaagaacgaggtggaggactcgatgaagggcatcaagcccgaacccgtcaccggcgacgcggtggtcatcagccgccgggtctaccccgtcaagcaggtgggtgaggtcatcacccggcaggaccggcgggacttcagctccgccgaggtggtccgggcgctgtccaagctcggcttcacctgccgtaccgccgagtcggccgtgcccgcgccggcccccgcccgtaccccgctggagacggcctccgcgcttctggggacgccggccgaggcgcggagcgaggctcccggagcggtgtccgcaccccgggccgacgaggtctgagacctgcttcccggccccgcgacgccgtcttcgggcgtcgcggggcgtgcgatgatcgccgccatgatgaggaagctgaccgcgttgggcgtgaccgtggtggcgtccatgctgcccgccaccgccgcgcacgccgacgagacgcacaccgacgctcacaacggtccgcaggtggccctgatctcgacggggcagatcgacgatccgctggaggacgtgctggagcacgtcgcggtcctcggccacaacatcatcgtggactgaacctcccccggctcccggccgttcggcgtctcaggacgcgcgggcggccggtggtttctgccgggcccactccatgcgcggctccagcagcggacgcagcagtcgccggaccggcggcgtgcacagcagggtcatgatgacgaccgcccccagggtgacggcgaccgtgcccatcgtggtgtcgaagaacgggtcgtcgtagaagccgccgtacctcaggccccggacgacgaagccgtggagcagatacccgtacagcgtgcaggtgccgagcgtggtcatccagctgcggcccctgggcacccaggcgaggaagcacgcgcccagcacgatcgcggccacgaacagcaggagcgtggcggtcggtcccgtccactcggcgacgttcatctcctcggtgctgttcttccggaagaaccacgaagtcgaggtccggggcaccagccagtacgccaccagcatcccggccacgaacaccggcaccgagacgatccgcacccaggtggagcggagagccgcgaagtgctccgggcgcagccgcaggccgagcacgtagaacggcaggaactgcaggacgcgctggacctggaggcttccgtcggcggccggcgtcaccgtcgccagggcggcgacggcgagcgagaccagcaccgggaagcgcaccgactgccacagtggggtggacagccgccagaggaacagggcgggcaggaaccacagcagccagtagggctccagcagggacagggcgaagtccgggtcgcgtgccgcccggtggaagagcgtgtagaggacttcgagcaggacataaggcaccaggaggctggtgaccagtttccagacccggtccggccgcagttcgaagttccgcgagaagtagcccgctatgaggatgaacaccggcatgtggaaggtgtagacgaaggtgtacgcggcctccacgaggcggccggggggcagaggctcccaagcgtggccgatcgccaccagcacgatcgccaggtacttcgcgttgtcgaagaagtggtcccggccgccgggcggtggctttccggtctccggggcgccggcagcggcggtggggcgcggctgctcggaggtgaggggggaaggcatcctgacaccctagaacgcggaggcgttccctccgcccactgtgtccttcatcacatcggatcggcgggtgtggggcgggcggtgggga

SEQ ID NO: 3217 - DNA, 5994 bp, Unknown
  Kingdom: Bacteria, Phylum: Actinobacteria, Class: Actinobacteria, Order: Streptomycetales, Family: Streptomycetaceae, Genus: Streptomyces
agggcgaggacggcgtcggcctgcgcggagtcgagtgcgtcgagggtgtggacctcgcgtccgggagcggggaggggtgcgtcagtcgtcatgcctccgagcgtacggcgagcggtgcgccgggtggcggcgtcggcggcctgtcggacgggagtgtgggggtgagggtggcgcgatgtgggtgctatgcgggtgttatgggtggatcgtgggctttcctgacgggccatttggccggatggcaaccagtccgtaaccccgaacacctgttgcgctacgcgcgttgactctaggctgcggcacgcaggatcccagacgtgacaccagcgacacgactgccaccaccgacagcactgacacacaaggggaccgatgtcagcgactccgcagaagaaccgtgcgacacggcgggtgctcgccgccgcggccggtctggccaccgtgggcgcgctcgtcgccgcgatgccggccggcgcccatgaccggggccacggccacgggcacaagccccgtaccgtcgacgtgcagttgctgtcgttcaacgacctgcacggcaacctggagccgccggccggttccgccggcaacgtctccgagacgcagcccgacggcacggtgaaggcgatcccggccggtggcgtcgagtacctggcgacctcgctgcgcaccgcgcgcaagggcaacccgtactccgtcacggcggccggcggcgacatggtcggcgcgagtccgctgctgtcgggtctcttccacgacgagccgacgatcgaggcgctgaacggcctcgacctggacgtcacggcggtcggcaaccacgagttcgacgagggtgcggccgagctggcccgtctgcagaacggcggctgccacccggtcgagggctgctacgagaagggcaaggagttcgagggagcggacttcccctacctcgcggccaacgtgaccaaggaggagaccggcaagccgctgctgaagccgtacaccgtctggaagaagaacggcgtcaagatcggcttcatcggcgtgacgctggagggcactccggacatcgtcacggcgaacggcgtcaagggcctcaagttccacgacgaggtcgagacgatcaacaagtacgcccgcgagctggaccgcaagggcgtcaagtccatcgtcgcgctgatccacgagggcggggccccggcctccacctcgtacaactacgactgcgacagccccggcgcgggcgacggcatctccggcccgatcgtcgacatcgcgaagggcatcacgccgaaggtggacgccctggtcacgggccacacccaccaggcgtacgtgtgcaccgtcccggacccgtcgggcaagccgcgcatggtcacctcggcctcctcgttcggcaaggtgtacacggacaccacgctcacctacgaccgccgcaccaaggacatcgtccgtacgtcggtgaagtccgcgaaccacgtcgtgacccgggaccaggccaaggccaccgacatgacgcgcctgatcgaccgctggaacaagctcgccgcccccatcgcgagcaagccgcagggctggatcagcgccgacatcaacggccgcggctccacggcccccgagaagccgctcggcaacgtcatcgccgacgcccagctcgaaggcctcgccccggccgacaagggcggcgcggaagtcgcgttcatgaacccgggcggcatccgcgcggacctggtgtacaaggcgtccggcagtgagggcgacggagtcgtcacctacggcgaggcgttcaccgtgcagccgttcaccaacatgatgaacgtcgtcgacctgaccggcgcccagctggtcgccgcgctccagcagcaggtcagcggctccaacgaggccagcccgaagatccttcaggtctccgagggcctcacctacaccctcgacctgacgaagagcggcgccgaccgtgtggtcgccgacaccatcaagctgaacggcgaggcgatcgacccggcgcgcacctaccgcgtcgcgatgaacgagttcctcgcgggcggcggcgacggcttcgcggccctcggagagggagcgaacaagctggtcggcgcctccgacctggacctgttcaacgcctacctggcggcccactccacggccgccgccccgctggctccgccggcgacggaccggatcacggtcatccagtaactcctggtggatgaaggggcggtgggcctggcgggcctgccgcccctttctgctcttccctaagctggggtcccggtcgccggacacaccacgaccccgttcccgaggagcccgccgggtgagcaacgtactgaggatgaacagcgtccggggaaaggtccggaaactcgcgtcgaccacggtccacgacacggtcgacttctacgacggatcgggcccgccccgggtggtcgcgtgcccggagcgcgagctgccgccgggcggtgtacccgcctatctcgcggcccgtaagagcggcgcccgctccttcgtgctgtgggccgacgagcaccgccgggagcgggtggccacagtggtgaccgagtcagccgccggtggcgtcgccaccttccaggtcctcggcgcgcacggcgagcacctcggcacgatcgtgcgcgagaaggcgttccgcggcaggggccttcgcacgcgctggaccgtgaccccgaacggcggccccgaggcggtgggctacaagggccggatcgtgtggtggttcgtgtggtggctgtgtctgcctctgatggtggcggtcgtcatcttcaccgtcctcgacagcacccccggcaatgagggcggtgccgcgcgcgccccccggcgcatccgatggcgcgcgggcggcagcatgcctctggagttcaggtcccgcggcagcaagctgcatctgcacgcgccggagacggactggcggctcggggcggcgctgatcgccctggtgcgcagcttcagcgccgacatgtgggacggcctgaagacgtgagggtggtgttccggagccgggcacagtagaactgggctccatgtccgaccaacagcctcccccgcgctggggcccgccgcccgtcgcgccgcccgtcgtgccgcacggtgcgccgcacggggtgtacgggccaccgcaggcccgtgaagtgaccgcttcctaccggcggtggacggtcgttatcacctgggccgccgtcgtcgtcgccgtcctcatggcgttcgcgctcgtgatgagcatcgtcttcctcgtatgggcggaccaggacacgcgcaacgccgcctacggctacctcgcgctcgtgctctgggtcgggatcgccgcggcggtcccggtcctgatcgcggccgtggtcaccgcccgggacatgaggcgtcgggtgcggcagcagaacaggacggggaacacgccttcgtaggacgccgccgggcgtgcgggcccggtccggtgctcctgccggtcggggcacgtgggcgttcaccgggtcgcaccggcgcacgacccggtcgaacgggcggattctgttcccgatgtgcggttccctaaagggacatgccgcagtacaggcgtcgtcgcggccgggcgtcgcgggcgagttcgccgaggcgttccaggaagtcggccaggagcgccgggtcctgcccgtcaccgtcctccgtgtgggtccaagcggtggcggcttccagcaggtgctccggggtggccgccgcgagggcgtcacagaggccgtccgtgagcgagacgagccagggcccttcgtgctcggcttcgttgagcagttcgcagaagcgggggtctgcttccacttgctcctcggagacccctgtcaggtgagcctcgacggttccgagaagcaggtaggggtccgcccctttgaggccgagcgtgccgaaggggtcgtccatgcggtcgtcttcgaacagcgcgagggcgtgcctgtcgtcggtggccgcgtagtagtcgtagatgtttcccatggctggatcgtgtcagctcgggggcggcgtcgcagccccccttggcgaaggtccggggcacgtcagggccggtacagcgatgtcaggccggtcacccggcccgtgccgtcgaagaccaggtcgtacccgatgccgccggagagcgtggggtccagtcggccgatcagcgtgacgagctgggccggggagtaggcgaccagctcggcgcggctcgtgccggccacctcgtcgcggaccgggaccgccagccgtacccgaccgttgccagccatgggcaccgtggtgaagggccctgtgcccggggtgatctcccaggtgtcgaaccgggagttgatctccttccgggcgggccgaacggccaggtaggtgcgcccgttgccggtccaggccttgctgatggtcacgaattgcgcggtgccggcgaagggagcgttgccggtcgtcgccgaggtgtccttcgaggctgtgggggcggccgtcctgcggtccggcgcgggggaatgggcaggggcggcggacttccgtgcggtgtctgcccggtcgctcgtccggtcgctcgtccggtcgcccgtctggtcgtcggcccgtgcggaaggagaggccttctcgccgctcgcggcgggatcggcggactttccgctgtcatgggtccggtcgtcgtccgtcgtgtccgtcgcgtcgccggccgtggaggacggggccggcccggcggccgcggcgggatccaggcggtccgagggctcctggccgcagccggtcaggacgagggcaccgagggcgacggcggtgagccagcctccgggggagtgacggcgggaaacgttcatgggtaactgctcctgtgagtacttgtgttgatcggtgtggttggggcgcacactctctacgcaccgcaccgccccacgggttgcacccgagtcaggcctttttcgcatcgcgccattcacggcttgtacagcgactgcaccctggtgacccagccctctccgtcgaagctcagatcgaagccggctccttcacgggtccggggatccaactgcgtgagcagggtgacgaattcggcctgcgaggtcagtagaggttcgccgccgctggtccccggggcgtcgtcgccgcgaatcggcacggtcagcagcacccgggcgtccttcgccagggtcaccgtgacgaattcccccgtgccggggacgatctcccaggtgtcgaactgcgtgttcaccttcttctcggcggatcgcaccgacagcttggtcagtccgccctcggtccagaccctgtcggtcgtcacgaactgcttggtaccggcgaaggggttttcggcggccggcgcggtcgccgtggctgtcacaggcacgggggtaggagttgccgcgggcccctcggccgtcacgccgcagccggtgagggcaagggcggcgaaggcggcgaaggtgagcagccgcgacgtggcccggtggcgtgaggcgtgcatggtcagcgttctcctggaaaccggtgcggtcgggtgacacggtctctacgccccgcaccacccgccgggttgcatccggccggaacaattcacttcccggatgtcatttcacggtcagccagtgtgcttcccgcagcgaccgcacccggccctcgccgtcgtagtcgaggacgaacgcccaccgcggcccggcccgcagccggtccacgacatcttccagccgcatgtctcccggcttccccccggccaggtcccgcacctcgaccggggtcaccgccggcagggtcagctcgtgcaccacgccggtgggcacggccgtccccttctcgtcgcgaagctgtcggacggtgaagcgaaccctgtccccgtcgagcgccaccgcgccgtacacgtagccgagttcggccgcgtactcctcccccggtgcgggcgtcggggtgacgaacaggggagcgctcgcggacgggttcggatcggcggcggtcggctcccgcccggggcggaccaacgacagaccccccacgaccacggcagcggccagcagcacaccgcccgaggcccgagccgcc

SEQ ID NO: 3218 - DNA, 620 bp, Unknown
  Kingdom: Bacteria, Phylum: Actinobacteria, Class: Actinobacteria, Order: Streptomycetales, Family: Streptomycetaceae, Genus: Streptomyces
ggcgagcgtcgatccgtaccgcgccaccacgtccgtgaccacgtcccccaccaccagcagcccgccggccgccgccggacggttcaccgggcgaccgccgccgcgacggcgatgcgcgccgcgagggccacgtttccgcggacggccgccaggttcgcctccagcgacgcgcccccggtccgccgcatcagctggtccagcaggaacggcgtgacgccctgccccgagattccccgctcccggcacgcgtccagcgcctccgccagcacccggtcgtgcagttccggatccaactggtcctgttccgccacggggttggcgacgatcagcgcggcctccgggccgcccagcgcctccttcgcccggatcacctccaccacctcctcggggctgtgcaccgtccagtcgacgggctcgccggagctgctcaggtagaagccggggaagtgcccggtgccgtagccgacgatgccgacgccgagggtctccagccgctggagggtcgccgggacgtcgaggatcgacttcacccccgcgcagaccacggtgatcccggtgcgggcgagcagcctcagatcggccgactcgtcctggttctcggaccattcccggtgtacgcc

SEQ ID NO: 3219 - DNA, 2494 bp, Unknown
  Kingdom: Bacteria, Phylum: Actinobacteria, Class: Actinobacteria, Order: Streptomycetales, Family: Streptomycetaceae, Genus: Streptomyces
cggcggtgtcgcagccctccagggagaccagttcgccatccgcccgttcgatgtgctgctccccgagcgcccccggctcgccgccgcccgctccgtacggcgggacgcggcggtgtccggagagcagggcgatcgtgaccggttccaggaagcggatacggcgctcgacaccgtcgccgccgtgccaccgccccgctcccccgcttccgtcccggacggcgaagccctccagcagagcgggcagccgccactccaggatctcggggtcggtgagccgggagttggtcatatgggtctggacggcgtcggctccgtcgaagccgtcccccgctccggatccgctggcgatcgtctcgtagtactggacgtggtcgttgccgaaggtgaggttgttcatggtgccggagccctcggcctgaccgccgatcgctccgtacagggctccggtgaccgcctgggaggtctccacgttgcccgcgacggtcgccgccgggtaggcggggtcgagcatggaaccgggcgggatcgtcacctccaggggcttgaggcagccgctgttgagcgggatgtcctccccgacgagggtgcggaagacgtagaggacggcggccatgacgacggaccggggcgcgttggcgttgccgggctgctggggggaggttccggtgaagtcgaggtgggcgctgcgggcgtcccggtccacggtcagccgtacctggatcagggccccgctgtcggtctcgtagcggcagtggccgtcgtgcagtccggcgacgatgcggcgtacggactcctcggcgttgtcctggacgtggcccatgtaggcgtccacgacgtcggcgccgaactggtcggtcatgcgccgcagttccgcgatgcccttctcgttggcggcgatctgggcgcgcaggtcggcgaggttggtgtccgggctgcgggaggggtacggagctgaggtgagcaggtcgcgggtctcgtcctcgcgcagtcggccgtcgcggacgagcggccagttgtcgaagagcaccccctcctcgtggatcgtccggctgaaggcgggcatggagccgggggtgatgccgccgatctcggcgtggtgcccgcgtgaggccaccaggaagcgcagccggccccggtcgccgtggcccacgccctcgccgtcgtcgctcccctcgctctcgtcgaacacaggggtcaccacggtgacatcgggcaggtgggtgccgccgtggtacgggtcgttgacggcgtacacgtcgccggggcgcaggctcccctcgttgcgccgcaggacctccttgatcgattcgcccatcgagccgaggtgcaccgggatgtgcggagcgttggcgatcaggttgccctcggcgtcgaacagggcgcaggagaagtcgaggcgctccttgatgttgaccgagtgggcggtgttctccaggcggacgcccatctgctcggcgatcgacatgaagaggttgttgaagacctccagcatcaccgggtccacccgggtgccgacggcggtgcgttcgggcctggggcgaccgcgggtgaggacgagatgcccggccgggcccgcttcggccgtccagccggggtcgacgacggtggtggcgtcgtcctcggcgacgacggcgggcccggtgacggtgtcggcggtgcgcaggtccgtgcggcggtacagcggggcccgctgccatcgtccctcggcgtacaggtgcacggtgtcggcggggcgcggcggggtgtcgcggtcgccgtcgcgcggaccggagccggcggcccgcgcggcatcgccggtggcttcggtggccccggtggcttcgaccgagaccgtctccacgacgacgggcttgtccatcgtgaagccgaacctggcccggtgggcggcggcgaacgcctccgccatggcggtctccgtgtccaggtccaccggcagcgccgcgtccgtcccggcgtaccgcagcaggacgcgggcccttgtggtgatcgcggagtccggcgttccgtcggcgcgcagggcttcgcgggtacggtcggccagctccgcgcagagcctctccacacgctccagggcggccgggtcgagctcttcctccacggactgctcgcgcatggcggtggagtcggccaggccgatgccgtacgcggagagcaccccggcgagcggggggacgaggaccgtgtcgatgcccagggcgtcggcgaccgcgcagacgtgctggccgcccgcgccgccgaaaccggtgagggcgtagcgggtgatgtcgtggccgcgctgcacggagatcttcttgacggcgttggccatgttgagcacggcgatctccaggaagccggcggcggcttccgcctcgtccggtcgccgcccggtggcgcgtcccacctcgtcggcgagcgccgcgaaccgcgtccgcaccaggtcggcgtcgagcgggaggtcgccgccctcgccgaagaccgccgggaagtggccgggctggacgcggccgagcat

SEQ ID NO: 3220 - DNA, 14568 bp, Unknown
  Kingdom: Bacteria, Phylum: Actinobacteria, Class: Actinobacteria, Order: Streptomycetales, Family: Streptomycetaceae, Genus: Streptomyces
gccgcaccgcgagcagcgcgacgaccgtggcggacagcgtcgtacgccgccaggccagccgcgtccgctcgggctgcagcccgggatcccggttcaccgcagccgtcacacgccctcccagccgaagaggaccacgaccaccatcgccacggcgacgacggcgaccacgaggcccagcagggtcgggaaccgggacaccggcaggtcctcgccccgccgcatcgcccgctcgcaccgcacccagtggttgaccgcccgcagtgcgcagagcaccccggcggccagcagcccgagcgcgagcccggcccgcacgccccacaccagctccggcaggaactgatcgacggcgaaacctccgccgatcagggccagcgccgtccggatccaggcgaggaacgtccgctcgttggccagcgagaaccggtagtcgggggtgtccccctcttccctgatccgctgcggcgcgaaccacagccgtacgctctgcgcgatcctgttcacacctggaaccctagggcctgtcgaggggcggccgagcccggtcaacccgcccggaactcccgcagccgccggtacgcctccagcccgtcgggcacccaggaccactcaccgagccgccgctccagctccgcgtcgtcgaggaacgtgtgccaggcgacctcctcggcctgcgggaccaccggcagctcgcaccgcactcggtagaccgccgaccaccaggtgtgcccggcgtcggcgtagaggaaccggaacagcggctcgggccgcggcagacccgagacccccagctcctcctccgcctcgcgcagagccgcatcgtcgtacgactctcccgcccccaccaccccgccgacgaacatgtcgtagtgcgaggggaagaccagcttcgtggccgtacgccgatggacgaagacccgcccgtcggcgtcgcgcgcctcgatgaacacacagcggtgccgcagcccccgcgctgtcgcctcgccacgtggggcctgcccgatgacctcgtcgttctcgtcgacgatgtccagaatctcgtcggagggcgtcatacgtttcatccaacagcacccggacggttgacgtggccccggcgggtacccaagatctgacgcacgggtaacttgaacgtttcgccgacccggcaggccggccgctccacccgcacccgagccaccccgacaggatggaacccatggcgtacgacgctgatgtgatcgtgatcggggcaggactcgccgggctcgtggccaccgccgaactggtcgacgccgggcgctccgtcatcctcctcgaccaggagcccgagcagtccatcggcggccaggcgcactggtccttcggcggcctcttcctcgtggactcgcccgaacagcgccggctgcggatcaaggacagccgggagctggccctccaggactggtacggcacggcgggtttcgaccgcgaggaggaggaccgctggccgcggaagtgggccgaggcgtacgtcgacttcgccgcaggcgagaagcgctcctggctgcatcagcagggtctgcgcatcttcccggtcgtcggctgggcggaacgcggcggctacgacgcgacgggccacgggaactccgtgccccgcttccacatcacctggggcaccggccccggtgtggtcgcccccttcgagcggcgggtccgcgcgggcgtcgccaagggtctcgtccagctgaggttccgccaccgggtcaccggcctcacccgtaccgccggggccctcgacacggtcaccggcgagatccttgagcccagcgcggccgagcgcggaaccgcgagcggccgggaggtcgccggcgccttcgaactgaaggcccaggcggtgatcgtcacctccggcggcatcggcggcaaccacgacctggtccgctcccagtggcccgagcgcctgggcaccccgcccgagaagatgctgtccggggtgcccgcgcacgtcgacgggctgatgctcggcatcgccgagaaggcgggcgcgcaccacatcaaccgcgaccggatgtggcactacaccgagggcatcgagaactggaacccgatctggtcccggcacggcatccggatcctgcccggtccctcgtccctctggctggacgcgcgcggcaagcggctgccggtcccgctcttcccgggcttcgacacgctcggcaccctggaacacatcatgggctccggccacggctacacctggttcgtgctcaaccagcgcatcatcggcaaggagttcgcgctctccggctccgagcagaatcccgacctcaccggcaagtcggtccgcgacgtgatcggccgggcccgcgcggacgtgcccgcgccggtcaaggcgttcatggaccacggcgtcgacttcgtcgtcgagaaggacctcggcgcgctggtccgcggcatgaacgcggtcaccggctacgacctcatcgacgaggagagcctgcgccgcgagatcaccgcccgcgaccgggagatcgccaaccccttcaccaaggacctccaggtcaccgcggtccacggggcccgcgcctatctgggcgaccgcctcatccgcaccgcgaaaccgcaccgcgtcctggacccggcggcgggtccgctgatcgccgtccgcctcaacatcctcacccgcaagtccctgggcggcctggagacggacctgtcctcccgcgtcctgaccgccgagggcaccccactccccggtctgtacgcggccggcgaggcagcgggcttcggcggcggcggagtccacggctaccgctccctggagggcacgttcctgggcggctgcatcttctccggccgggcggcgggccgggcggcggcgcgggccctgtaggcgggcccgtgtttcacgcccctccggcgatcgaggagcggggtccggggtggatccccgacgtcaccccagccgctcgaccacccggaaccgctccgcgacgatcagcgtcgcgtcgttcaccgtgaactccggatcccccaacgcctcccgcatctcctcgctgtgccagaaccgctcgtgccccgcccgccactcggccaccgaccggtatccctcgccctcgtcgagggcatgccgcagatccacctccccgagcgggagcacccgtacatcggtcagctccagcaccgccacctcccgcccctccgagtcgatcagcgcggaccgctcgcccaccgggggaagctcctcctgctcccgttcgtactcggccaacagcccggaggtggacaccttttcgccggagaggaccgccgcgaccagttggtcgcgcaacggcccgggaaaggcgaggaggaaggggctgagcggttcgcgaggttccatgtcctcagtgtgtcaggcgccactccgcgctcaccgaccccgtcgcacgctgtgcgaacgccccacccggcgggatgaattccagccaagtagccaaaaagtgaacagagttgacatcaggcgccccttgacgtggagcattgcgtaccgctttgctgtgcgcgatcatccgctcgcacaccgcatcgaaagaagcctgcggcatgcccccgcctccgccgcccctgggccgctcccgccgtcggggcagccgcacggaccacgtcttcgactcggccctcgacgacgatgaactcatcgccgcacgcggccagttcgttcagggcagatggtccgaggcgcgcaccctcctggtgggcaccgggcgggactgggaccgccgcggacaccgttttctggccctcgccgagaccccgtccgccgtggactgggccggcgactggctgctcgtagaacccgagagtgccgacgccgccgtccttctcggctgtgcccgggtcgcccgcgcgctgcgcccccaggccaaggcgaacgacgccgcccgcgcccgggaggcctgcctggccgccgcccgcctcatccccgacgaccccaccccctggctcgcgctgctcctcctggaccggggccgcgacgacggggcggacgagaccggcaggctcttcgaggaggtgcgctcccgccaccccgaccaccatcacgcccaccatgtgatgaccgctctgctggccgagggcaaccccgccagcggccacgaccccctccacgaggtgtacgacttcgccgcctgggccgccgaactggcccccgccgactccccgttggccgtgctcccggtcatcgcccacgccgagcgctaccgcgtcctggtcgccgccggcatcgagtccgaggacccggcggtctccgagcactggtccggacgccgggcccgccaggtgatgaaggccgccttcgactggtggctggaatgggagcgcgaggaccacccgcgccaccgtctcgacctgaacttcctcgcgcacgccaaggtctgcgagggacggcccgccgaggccgccgccctcttccaccgcatcggcccctatgccacggccgcgccctggtcgtacgcgggccgggagccgcacgccgcgttcgtcgccgcgcgcgcctacgcgctcggcaccccgtgatccacgaaaggcaccaccccaccacgaagaagggatccatcccgccatgtcgaccggcagttcattttccagcgataccggcaccacgagggggacggccgataccggcgggatcaacacctacaagggcgaggaacgcgccctgcgggcgaaccggctcggcacccccggcctcctgctgtcggtcgtcgcggccagcgcccccctgatggtggtcgccggagtgatgcccacggtcttcggcgtgatgggcatcgtcggccagccgctgctctacctcatcctgggcgtcgtcctgatgctgttcggcgtcggctacgcggagatgagccggcacgtccacaacgccggcgcgttctacgcgtacatcgcccgcgggctcggcccgaccgccggcgccggagcctcgctcgtggcgctggtggcgtacagcgcgatgcaggtcggcatctacgggatcctcggcttcgaggtctccggcatcttcgccacgtatctcgacatcgagctggcgtggtggattccggccctggtcgcggcggccgtcgtcggcgtcctcggctggctgaagatcgacctcaacgccaaggtgctcggcgtcctgctggtcatcgagtgcgccctcgtcgtgatcttcgacatcgccgccgtaagcaagccgggcccggagggcctgtcgctgcacgccttcaaccccgagaccctcaccggcgctgggctcggcaccgcgctctgcttctgcatcgccgcgttcgtcggcttcgagcaggccccggtgtacgcggaggagaccagccgcccgcagatcgtggtgtcccgggtgatgttcctcgcggtgggctacgccgcgctgttcctggcgatcagctcctgggccctgaccgtcgccgccggacccggcgccatcgccggcacctccctcaaggagggacccggcatgctgttcggcctcaccgaggagcggctcggctccaccttcaccgacatcctgcacatcctcttcgtcaccgggatgttcgccgcgctcctcagcttccacaacgtcgtcgcccgctacgcgttcgccatgggccgcgaagggctgctgcccgcccgcttcggccgcaccaaccgggcgagcggcgcccccggcaccggctcgctgctccagaccgtcgtctccgtggtgatcatcctggcgttcgcgttcaccgacgacaagccgatcggcgaccccaccgcccccgtcctgcggctcttcacctggatgggcaacgtcggagcgctcggcgtcatcctgctgatggccgcagcctccttcgccgtcattgccttcttcgtcaagcgcggcgcgggccgcgcgcaggccccgcgcctggtcgcctccggtctcgccggactcgcgctcctgacgatcgccgtcttcaccgtccgcgacttcgacgtcctcgtcggctccggccccggctcggccctcagctggctgctgccgggcgtgatcatcctcgcgctcgtcggaggcctcgtgtacggagcggtgctgcgctcggtcaagcccgaggtgcacgccaggatcggcctcggcaacgaggcgttccagctggagaaggcggccgagagcgagtccgcccgccgctgacctcccgtacgtatgcgaaacgcccgccccggtgccgtaccggggcgggcgtccgtccttgccgtacgaaagggctacagcaacagcgacagcagcaggatgaaggccatggccaccacggagatgatcgtctccatcaccgaccaggtcttcacggtctggccgacatccatgccgaagtactccttcaccagccagaacccggcgtcgttcacatggctgaagaagagcgaaccggcgccgacggccagcaccagcagagccgcgtgcgaggtcgacatatcggcggccagcggggcgaccagaccggcggccgagatggtggcgacggtggccgagccggtggcgaggcggatcgcgacggcgatcagccagccgagcagcagggccgggatcgaccagttctcggagaactccaggatcatctggcccaccccggcgtcgatcagcgtctgcttgaagccgccgcccgcgccgacgatgagcaggatcccggcgatcggggcgagggacttctccaccgtgccggcgagccggtccttggtgaatccggcggcccggccgagcgtgaacatcccgacgaggacggcggcgagcagcgcgatcagcggcgagccgatgaccgccgtgaccttctggaggccgttctcggggttgtcgaccacgatctcgacgagcgcgttcagcagcatcaggacgaccggcagcaggatggtcgccagggtcgcgccgaagctcggacgacggtccaggtcctcggaggggcgctgcgggatcatgttctccggcggcttgatgtccacccagcgcgcggcgtagcgggagaacaccggaccggcgatgatcaccgtcgggatggcgaccagcacgccgagcgccagcgtcacgccgagattggcgtccagggcgtcgatcgcgaccagcgggccggggtgcggcgggatcaggccgtgcatcacggagagcccggccagcgccgggatgccgatccgcatcagggagtagttgccgcgcttggcgacgagcaggacgaccgggatcatcagcacgatcccgacctcgaagaacagcggcagaccgatgatcgaggcgatcaggaccatcgcccagggcatgacccggccgctcgccttcgcgaggatggtgtcgacgacctggtcggcgccgcccgagtcggcgagcagtttgccgaggatcgcgccgagcgcgatcaggacgcccacacccgcgacggtggagcccaggcccttggtgaagctgagaatcgtgtcggccggtgcggctcccgcgaaggagccgagcgccagcgaaccgatggtcagcgccaggaacgcgtgcatcttgagcttggtgatgaggagaacgatgacggcgatgcccgccaggacggcgatgcccaactgagcgttgcctgccgaggtgatcggttcggcggcttccgctgccagcatctcgacgctgagactggtcacggtgatggtccttaactatcgagccggcgcagtgcggcgacggctcgccgggtgatttcctcaggagtgccggacacgtcgacgctcaccccggcctcgtcggcctggagcggctggagcgtcgcgaactgcgagtcgagcagcgcggtgggcatgaagtggcccttgcggtccgccatccgctcctcgatcagcgcccggtcaccggtcagatgcaggaagacggcgtccggcgccccgtcccgcagccggtcccggtagacccgcttgagcgcggagctggagacgaccccgccgagccccgcccgctcgtgcgcccacgtgccgatggcatccagccagggccaccggtcgtcgtcgtccagcggggtgccggccgacatcttggcgatgttcgccgggggatggaagtcgtcgccctcggcgtacggaacgccgagttcggcggcgagcaggggaccgatcgtggtcttgccggttcctgctacgcccatcaccacgacgacgtggggggtgctcacggggggtgcggtgttcatgggggtgtctcgctgtcttcttcgacatcggtccgtcgcgctactgaaacctattaggtacgacttattcaagagtctgtgacgtaaacgtcgtacttattgttcccgagggtcgccccgtaggcttgacccatgaccacacagagccagggactgcatacacatgtgctggacaccctgggtctggagatctcctccggccggttcccgcccggcagtgtcctgcgcaccgacgagctcgcccagcgcttcgacgtctcccgtacggtcgtgcgcgaagtggtgcgggtcctggagtcgatgcacctggtcgagtcccgccgccgcgtcggtgtgacggtccgccccaccgagacctggaacgtctacgacccccaggtcatccgctggcgcctcgccggcgccgaccgcccccgccagctgcgctccctcaccgtgctgcgctccgcgatcgaaccggtcgcggcgtccctcgccgcccgccacgccaccgccgagcagtgcgccgagctcaccgaacgcgcactcggcatggtcgccacctcgcgcggccagcagctggagggctacctcgaacacgacatcgccttccaccggatcgtcctcaacgcctccggcaacgagatgttcgcccggctcggggacgtcgtcgccgaggtcctcgcgggccgcacccaccaccaggtgatgttcgaggaccccgacccggccgccgtcaccctgcacgtccggctcgccgatgcggtccgcgagggcgacccggaggccgccgaacggatcaccaaggagatcgcggtcggcgccctgcacgagctggacgtcctcgccccgtaggccttccgcgcgacgcggcgcgggacccggtccccgaggcgtacggttggccgcgatcgatcttcgcgaaagctcaggaacagggagagcacggttatggcgcagcaggtgcaaggggtcatcgcaccggggaagaacgagccggtcagggtcgaaacgattcagatcccggatcccggccccggcgaggcggtcgtgaagatccaggcgtgcggcgtctgccacaccgacctgcactacaagcagggcggcatcaacgacgagttccccttcctcctcggccatgaggcggcgggcgtcgtggagacggtcggcgagggagtcacggacgtcgcccccggcgacttcgtcgtcctcaactggcgtgccgtgtgcggccagtgccgcgcctgtctgcgcggccgcccctggtactgcttcgacacccacaacgccaagcagaagatgacgctgctcgacggcacggagctgtcgcccgcactgggcatcggcgcgttcgccgagaagaccctcgtcgcctccggccagtgcaccaaggtcgaccccgaggtctccccggccgtcgccggactgctcggctgcggcgtcatggcgggcatcggcgccgccatcaacaccggccaggtcggccggggcgactccgtcgccgtcatcggctgcggcggcgtcggcgacgcggccatcgccggagcccggctggccggcgcggcgaagatcatcgcggtcgacatcgacgaccgcaagctggagacggcgaagaagatgggcgccacccacaccgtcaactcccgctccaccgacccggtcgaggccatccgcgccctcaccgacggcaacggcgccgacgtcgtcatcgaggccgtcggccgcccggagacctaccagcaggccttctacgcccgcgacctcgccggaacggtcgtcctcgtcggcgtccccaccccggacatgaagctcgaactgccgctcctggacgtcttcggccgcggcggctcgctcaagtcctcctggtacggcgactgcctgccctcccgcgacttcccgatgctcgtcgacctccaccagcagggccgcctcgacctcgccgccttcgtcaccgagaccatcggcctgggcgacatcgagcaggccttcgcgcggatgcacgacggcgacgttctccgctcggtggtggtcttctgatgtccgcccgcatcgaccagctggtcacctccggcaccttcgccctcgacggcggcgcgtgggacgtcgacaacaacgtctggatcgtcggcgacgacaccgaggcgatcgtcatcgacgccgcccacgacgccgccgccatcgaggccgcgctcggcggccggacgctgcgcgccatcgtctgcacccacgcgcacaacgaccacatcgacgccgcccccgccctcgcggcagccaccggcgccccgatcctgctccacccggacgacctgccgctctggcagcagacccacccggaccgcgcccccgacggcgccctggccgacggccaggaactgaccgtcgccggcaccacgctcacggtcctgcacacccccggtcacgctcccggagcggtctgcctgtacgcccccgagctggccacggtcttcaccggcgacaccctcttccagggcggccccggagccactggccgctccttctcctcgttccccacgatcatcgactcgatccgggaccggctgctcaccctgcccggcgacaccgccgtccgcaccggccacggagatcccacctccatcggcgcggaggccccgcagctcgacgagtggatcaagcgcggccactgagcgccgcacgcctcacccctccggccaggcggagagccgcagcccgctcgcgaagcggcgcggctccccgtcgaccggatcggtgaactccagcacgcgagccagcaactgcaacggccgcgagaagtcgtcagcggccgcttcctcctccaccaccggatacagcggatcgtggacgatcggcagccccagcgcgttcatatggacccgtagctgatgcgtccgcccggtggcgggcagcaaccgatagcgcccggtcccgccccggtgctccaccagctccacccggctctcgctgttcgcctcgccggactcctcgcgggcggcgagcaccccgcgctccttcacgatccggctgcgcaccgtccgggggaggaccacgccgggatcgtacggagccagcgcctcgtactccttgcgcaccagccggtcccggaacagcgtctggtacgccccccggtcctcgggccgcaccacgaacaggacgagtcccgcggtcagccggtccagccggtgcgcgggctgcagggcgggcaggtccagctcccgccgcagccgggccaccgcggtctcggtgatgtgccgcccccggggcatggtcgccaggaagtgcggcttgtccgcgacgacgagacgctcgtcccggtggacgacgccgaccgggaacggcaccggctcctccggcgcgaagtcccggtggaaccagaggcaccgccccgcggcgtacggttcggcgccccgcacggcgaccccgtcggcccccacgaaccgcccggcctccagcatctccatcacccggcccggcccgatcgccccgccgaaccgcgcgaccagatgctccccgacgcacccccactgcccctcgggatcctccggcaaccgcacccgcaccgcgtcgatcccgtgccgctgggggagcggagcgggaggcggcctcctgcgaccccgcatcgtcgcccctctccgtggtcggccggtgacgcaaaagagccccaccgaagtggggctcctgctggtgtccgaggggggacttgaacccccacgcccgataaagggcactagcacctcaagctagcgcgtctgccattccgccacccggacaaggtgtctgtctcgcgggccgtgcccgttccgacgtggaaaaccatagcaaacattcgagggtgctcgatcacgccccgatggctgtgaacggtgcgtgacggggggtgcgcgcccttgggtgcaggccgtgggcgcgggaggatgagggggagcaccacagcgacagtggaaggaaccagcgtgagcgagagcagcacgggcaaggccgtcaccggcggcaacgccgagagggaggtcgtcgacctctgtcgtgacctgatccggatcgacaccagcaactacggcgaccactccggccccggtgagcggctcgcggccgagtacgtcgcggagaagctcgcggaggtcggcctggagccgcagatcttcgagtcgcacaaggggcgggcctccacggtcgcccggatcgagggcgaggacccctcccgcccggcgctcctcatccacgggcacaccgacgtcgtcccggccaacgcggcggactggacgcacgacccgttctccggggagatcgcggacggctgcgtctggggccggggcgcggtcgacatgaaggacatggacgcgatgacgctcgcggtcgtccgggagcgcatgcgcaccggccgcaagcccccgcgcgacatcgtgctcgccttcctcgcggacgaggaggccggcgggacgtacggggcgcgctacctcgtcgacaaccaccccgggctcttcgagggcgtcaccgaggcgatcagcgaggtcggcggcttctccttcaccgtcaacgagaacctgcggctgtatctggtggagacggcccagaagggcatgcactggatgaagctgaccgtggacggcaccgccggacacggttcgatgatccacaaggacaacgcgatcacggagctgtccgaggcggtcgggcggctgggccgccacaagttcccggtgcgggtcaccaagacgctgcggcacttcctggacgagctctccgacgcgctgggcaccgagctggacccggagaacatggacgagacgctcgccaagctgggcggcatcgccaaactcatcggcgcctccctccagaacaccgccaaccccacgcagctcggcgccggctacaaggtcaacgtcatcccgggccaggcgaccgcccacgtcgacggccggtacctgccggggtacgaggaggagttcctggcggacctggaccggatcctcgggcccaacgtccggcgcgaggacgtgcacgcggacaaggccctggagaccacgttcgacggcgcgctggtggacgccatgcagaccgcgctggtcgccgaggaccccatcgcccgtgccgtgccgtacatgctctcggccggcaccgacgccaagtccttcgacgacctgggtatccggggcttcggcttcgccccgctgaagctgcctccggagctggacttcgcggggatgttccacggcgtcgacgagcgggtcccggtcgacggtctgcagttcggcgtgcgggtgctcgaccggttcatcgaccactcctgaccgctccatgaccgattcgccatcgattcgtccacctgtgcggacatgtccgaacgagtgaaacgagccgttcacacgtagccccgccccagcctcctcgttacaaggtttgcggtccgcggctgggaccgcatttccaactaggaggaataatgatcaagaaggtcgtcgcagttgcggctgctacgggtggcctcgttctcgcgggtgcgggcatggcttccgccgacgcgggcgcccagggtgctgccatcggcagccccggcgtgctctccggcaacgtcgtccaggtcccggtccacgtgccgatcaacgtgtgcggcaacacggtctccgtgatcggtctgctgaaccccgccttcggcaacacctgcgtcaacgcctgacgttggtcaacccgtaagggtttgagctcgaccggtcccggagtgcactccatgcactccgggaccgttcggcattcggctcccgcacggtcatgtccgggggtttttcggaagccagaaggcaggaaacgaacctatgcgacaggtcactcgtaaaggcctgatcaccatggcggctgcgggcggagtgctcgcgctgagtggcggatacgcccacgccgactccggggcggccggtaccgccgccggctcaccgggcgtgctgtccggcaactcggtgcaggtcccgatcgacatcccggtcaacgtctgtggcaactccatcagcgtcggcggtctgctgaaccccgccaacggaaacgactgcggaaacggatcagcagagtccgaccgctccggggaccgctcgacagcaccccaggagcgctcggtcccggccggctccggaaacggcgcccgggcaggcgacaccaccgcctcggacggtcacaccggcgcgtcggaccggtacaccgagcccggcaccggccggcaccgggccccgggcggcggcgccacggccgaggggaccgcccagggctcgcccggcatcctctccggcaactcgatccaggcgccgatcgacatccccgtgaacctctgcgggaacagcgtcaccatcggcggactgctgaaccccgtcttcggcaacagctgctccaacgacgccgaggttccgcccccgccgcccgagcagccggagaagcccccggtcacgccggagaagccggtcat

SEQ ID NO: 3221 - DNA, 9099 bp, Unknown
  Kingdom: Bacteria, Phylum: Actinobacteria, Class: Actinobacteria, Order: Streptomycetales, Family: Streptomycetaceae, Genus: Streptomyces
atccaggcgtgccggtgctcgacgcgctgctggcggcccgcccggacacgatcgtggtcgagatgggcctgccccagtcggacccgcgcggctctctgtacatcgccacccacggcgcggcccgcgtctgcggcctggcggcagcggaagcgatcaccggcgtcaaggcctgacgcaccgcaggagccacatcacgcccgtccggcccgcagctcaagcctcggaccggccacttcaagcccgtccggcgatcgaggaccaagcctcacgccggacgggcggcggcgaacacgcacggctgagggccgggacaccgacaggcgtcccggccctcagccgtgcaaggggtgaggcctacagcccctgccaccccggcttcgccgcatacgtggcacggaagtagtccgccagcttcagcttcgacgcggccgcctcgtccacgaccaccgtcgcgtgcggatgcagctggagcgccgaggccggcacgatcgaggcgatgggcccctccaccgtctgggcgacggcctccgccttgccctcaccggtggccagcaggatcgggtggcgggaatccaggatcgtcccgatgccctgcgtgatcacgtggtgcggcacctgctcgatgtcgtcgtcgaagaagcgcgcgttgtcgatccgggtctgctgcgtcagcgtcttgatccgggtgcgcgaggcgagcgaggagcacggctcgttgaagccgatgtgcccgtccgtgccgatgcccaggagctggaggtcgacgccaccggcctcggccagcgcccggtcgtacgcctcgcaggccgcctggacgtcctcggccgacccgtcggggcccatgaaggaggcctcggagagcccgagcggctcgatgacctcgcgcagtaccacggagcggtacgactccggatggcccgcgggcagtccgacgtactcgtcgagctggcagatccgggcgagcgacgcgtcgaccgcgccggaggcgaccttcgctgcgagcgcgcggtagatgggcagcggggtcgagccggtggcaacgccgagcagggcgtcgggcttgcgggcgatcagcgcggcgatggcctccgcgatcagttcgccgcctgccgcggcgtccgggacgatgacaacttccacgctgtgcctgccgatctgactaggggagccggtggtatagaccaatcaagttcccaatttagcagaatcgagcagccgtacggtgaacagtccgcccatcggcacgcacgccccggcccgctggcggcgcacggcattgcctgctcgactgggggagcctgaacggcgcggatcgcgcacccccgcgcacgcgccgtcccgtacgccgacagcgcaggaggcccccacatgtccgccacccctccggccgacccgggcggccagggcgacgagcccggccgcatcatgtccggcgagatggccgagcagcccgcgatgctgcgccgcatcctcgaacggggcgcgccccgcatccgtgaggtcgccgccgcgatcgccgcccggaagccccggttcgtgctgctcaccgcccggggtacgtcggacaacgcggcgctgtacgcgaagtacctgctggagatccgcctcggactgccctgcggactggcctcgatgtccaccacgacggcctacggcgcccggccggacctgcgggacgtcctggtggtcaccgtcagccagtcgggcggctcgccggacctggtggcctccacgagggcggcccgggaggccggggccgtcaccctcgccgtcaccaacaatccggactccgcgctggcggcggtctccgagtaccacatcgacatcctggcgggcccggagaaggcgcttccggccaccaagacgtacaccgcctccctcctctccctctacctcttcgtggaggggctgggcggcgccgacgggacggcggccgccgccggtctgcccgacctcgcgggcgcgatcctgggccgccgggccgaggtcaaggcgctggcctcgcgctaccgcttcgccgagcgcatggtgatcacctcgcgcggctacggctacccgacggccaaggaagcggccctgaagctgatggagaccagctacatccccgccctctcctactccggcgcggatctgctgcacgggccgctggcgatggtcgacaacatctccccggtgatcgccgtcgtcaccgacggccggggcggcgaggccctccagccggtgctggaccggctgcgcggacgaggcgcggatctcttcgtggtcggccccaaggtgcaggtggaggcggcctcggccggcttctcgctgcccacggcgggcgtcccggaggagctgcagccgatcctggagatcctgccgctgcagatgctggcgtacgaggtgacgatcgcccggggacaggacccggacgcgccccgcgccctggccaaggtcaccgagacccgctgaggacccggaggcggcacctccccggaaacacccgcgggccgcggcgccagagcgggaccctcagcccacccggcaccgcagcccggagcttccgaccgacggtgtgcggtgccgtcggtcatggaggcgccggcgcagtcagggcagagagtgccggagcctcggtccgctctcctgtgcggggagagcggaggtcgtgatgaactcattgtggactagaccaattgcctgtgtccatccatgtgcacgacattctccggccctgtgccggccccgtccaccggcatgcggcacccgcgtgctctccccatcagcacggcccggcggaacgatcggttcgaacgcctccggtaaccccaggtacgctccacacgtgccctccatgaacgacctcgtccgccagcacaccgctctgagcgacaccgacctcgagtggctccatctgctggtctcggagtggcaactgctctccgacctgtccttcgccgacctcgtgctgtgggtccccacccgcgacggcacacggtacgtctccgtcgcccagatgcgccccaacaccgggcccacctcctaccaggacgacatggtcggccatctggtgccgcgtggccgccgcccgctgctggacgcggccctggacgagggccggatcgtgcgcgagggcgacccggagtggcgcgaggaggtgcccgtacgggtcgagtccatccccgtacgccgcgagggccgggtgctcggcgtcatcgcccgcaacaccaacctgctcaccgtgcgcaccccctcccggctggagctcacctacctccagtccgcctccgacctggcccagatgatcgccgccgggtcgttccccttccccggccagcaggtcgacatggacgcctccccgcgcgtgggcgacggcctgatccggctcgacgccgacggaatcgtccagtacgccagccccaacggcctctccgcctaccaccgcctcggcctcgcctccgacctggtcggccaccacctcggcaccaccaccgccgaactggccccgtcccgggggccggtggacgaggccctggtcaaggtggccagcggttacgcgccccgcgagttcgaggtcgagtgcgcgggcggcgtgatccagctgcgggcgatcccgctcaagcccaagggcgtccgtatcggctccctggtcctgctccgggacgtcaccgaactgcgccgccgcgaacgcgagttgatcaccaaggacgcgaccatccgggagatccaccaccgggtgaagaacaacctccagacggtggcggccctgttgcgcctccaggcccgccggatggactccgagcagggccgcgaggcgctcaacgaggcggtccggcgcgtcggttcgatcgccatcgtccatgagacgctgtcccagaatctggacgagcgggtcgagttcgacgagatcgccgaccgggtcatcgcgatggtctcggagatctcccccggcaaggtgacctgccggcgcaccggacgcttcggcatcctggacgcagaggtcgccacgccgctctccatggtgctgaccgaggttctgcagaacgccctggaacacgccttcgccgtggccgaccgcgggacggtggaggtctccgccgtgcgcggcggatcgcccaccgaagggcggctgctgatcaccgtcaccgacgacgggcgcggtctgcccgaggggttcgacccgaagcgggcgggcaacctcgggctccagatcgtacgcaccctggtggagggggagttgggcggcacgttcggcatggtcccggcgcccgaacgcggcacccaggtggtgctggacctcccggtccgcgccgacaagtaggaagaacgggagcacacagcagagcgggcccggaccgtggtaacggtccgggcccgctccgtgatgctcacgttgcgatgcgcttcggggtactgcgcgctgcgactcgaaggcggggctgtgcgtacgctctgtacgcgccgccgggctgaggcttggtgcggttctcgctcaggcgcttgcgttgcgcgcccggttgcgagcggcgcggcgcttcatcgcacggcgctcgtcctcgctgaggccaccccagacgccggagtcctggccggactcgagcgcccactgcaggcactgctccatgacggggcagcggcggcagacagccttggcttcctcgatctgcagcagcgcaggaccggtgttgccgatggggaagaacagctcggggtcttcctcacgacaaacggcgttgtgacgccagtccatggctgctacctctccttggtattacacgcttgttgcttgtgaatgtgaacgctttcacgaatccccccgcagatgacgggccgacccccagatggactgggtgtggtctgtgatggtgaggaggggttctggctctcagtggaggccggtgttgcgggccgtcccgatcgccatgtagagattcgcaaacctcggcggcggatacaaccccttctggaaagttttttttgattcctcggtgtcgactaggtcacagccgcacttcttaggggtgggggccagtccaaacgttcgagttaaaggactttaggcccttccactcacacaatcacacgcagtgcacggcgtacgcctgtgaacgtcacgctcgtacgcagtcccaggtggtcgccgtccatctggaagggcagtgggacctttgaatgcaaggtgaagtccgtgaggtcatgcagtgaaacggcgtgcttgccgcgcggccccttctcggggctcgaagtgagcagctgggtgccgtaacgggccaccgccggggcggacagacgcttcagtccgaggacgtccagcgcggtgtcgaaggaggccttcggcgaggcgtagaccgggcgattgcccaggtaggtccagggggcggtgttgcagattatggagagcgcgaggtcggtcaccgggtcctggccgggcacgtcgagcgtgatcgtcccgtgtctgcggttggcctcgttcaggaactgccgcaccacctggcgcacgtacagggcgtgggtcgaacgttttccgcgctcgcgtttctgttcgacccggccgacgactccggcgtcgaatccgagaccggcgcagaaagtgaaccagcgttcggggacggactcgtcctcggtcccgggggtgccggccgccagaccgagcccgaccgtgcgttcggtccggttctccagggcgtccaggatcgcgccggtcgcttccaccgcgtcgttcggcagccccagggcgcgcgcgaacacattggtggacccgccggggaccacggcgagcttcgggaggccgtccacgtccggtccccggtgcagcagcccgttcacgacctcgttcaccgtgccgtcgccgccgagggcgaccaccagatcgatgtcgtcgctgtcggctgcccgccgtccgaggtcccgtgcgtgcccccggtactcggtggtcaccgcctccagcttcatctcgctggccagcgcgtggatgagcacgtcacgggtgcgggcactggtggtggtagcagctgggttgaccacgaggagtgcgcgcatgacggccagcctacctaccgggcggttcggcgctgtagtcccggttcgctccgctcgcacccggtgacggagggtgatggtcgggtccggtcctccgccgaacgggggaggctcccgcgccccccggcttcacttccgggccccggggatgccaacctgaaaggcgtgagtactcaagcgaccccctccacgccgtcgccctccgcggcggagcgcccgaccaggatcaccgtcctcgccggggtcaacgccctcgaaggcctggcgctcgccgtcggcggggtctacctgctggtcatggggctgctcgggaagctggagagcacgcagcaggcggagacggtcgggatcacgctggtcgcgctcggcgcgatcccgctgatcgccgcccgcggactgctgctgctgcgcagctggagccggggacccgcgctgatcacgcagatcatggcgctgccggtggcctggacgctgctgcgctcgcagggtgcgctgattcccaccgggatcgtcctggcggcggtggccgtcaccggcctcgtgctgatcctcaacccggcgaccacccaggacctgggtatccgccggggaccgagggcgacccccgaggcctgagagcctgtcgggtgacctcggcccgggcggtcacgccttcctcgcctactcctcgacgagcagccgctcgcgcagctgcgccagggtgcgggccagcagccgggagacgtgcatctgcgagatgccgacctcctgagcgatctgcgactgggtcatgttcccgaagaagcgcagcagcagaatgcgcttctcgcgcggcggcaggtcctccaggagcggcttgagcgactcccggtactccacgccctccagcgcctcgtcctccgagcccagcgtgtccgcgaccgccggcgactcgtcgtcggtgtccggcacgtccagcgagagcgtgctgtacgcgttggccgactccaggccctccagcacctcctcctcggagatgcccagccgctcggccagctcgtgcaccgtcggcgagcggccatgctgctgggagagctccgcggtggccgtggtcagcgacagccgcagttcctggaggcggcgcggcacccgcaccgcccagcccttgtcccggaagtggcgcttgatctcgccgaccaccgtgggggtggcgtacgtcgagaactccactccccggtccgggtcgaaccggtccacggacttgatcagcccgatcgtggccacctgggtcaggtcgtccagcggctccccgcggttgcggaagcggcgcgccaggtgctccaccagcggcagatgcatccgcaccagcctgttgcgcagctcggccttctccgtcgaaccgtcgggcagctcccgcagctcgaagaacagggcccgggccccgctgcggtcgtgtggatcgtggtgcccgtgctcgctcatctggcccgcccgctctgcctgcgactgctgctccaccgcgacgtcgatgctctcgggcccgtccgctccgtccaccggatgcggccgggcctgttgctccgggatgcctgatgggcgcaccaccccggatcggatcgtctcgtcccgcacaggaccgtccccgttcccgtcgctcacgccggcccggggcccgcgccgcgctgtttgtagaggctgatgctgaccgtacggtcgtcggcgaccgtggagtcgaccttgcccgccagtgcggagagcaccgtccaggcgaaggtgtcgcgctcgggcgcccggccgtccgtggtgggcgccgacaccgtcacttcgagggagtcgtcgacgagacggaaaacgcagctgaggacggagcccggcacggcctgctgaagcaggatcgcgcaggcctcgtcgaccgcgatacgaagatcctcgatctcgtcgagagtgaagtccaaacgcgctgcgagaccggccgtggccgttcgcagcaccgacaggtaggcacccgcagcgggcagccggacttctacgaagtcctgattcccgggctcgcctgcgatctgggacaccctcacctccaaggtggcacaaactctttcgaggttccgggaagggtggcccggagccatgcggtccgtcgacggttcttcggctcggcgacgttatcggatccatgatgccgtgtcgtacggaccccatacccctaccgtcactcatggtaagcccatgcgtacgcacagtggctaggggtctgcggcgtccaattgcgaagaaccagcgccgcattgacgtacccaggcgtcagacgatcgaaccgtcctcgaagcaccagcgccagctctcgcccgcctcgaagctccgcatcacggggtgaccggtcgcccggaagtgtccgctggcgtgccgcagcggcgacgaatcgcagcagccgacgtgcccgcaggtcaggcagagccgcagctgcacggggtggctgcccgcctccaggcactcgggacacgtctcgccgagcggcaccggctcggggcgtggcagttccgctacatgcgcacactcgatcatgatgggcaggttacgacggatccgaggacggtgggatggacgcgctgcagctggttgccctggtcgcggtcagtgcggcggtcgccggcgctgcccgccgcacaccggtgcccgcgccgctcgtactggtggccgtggggctcgtggccggctatctgccgggcgtcccgacgtaccacctggacgcgcacgtggtgctcccgctgctgcttccgccgctgctctacacggcggcggtggacagctcctacctggatctgcgggccaacgtccggccggtcgccctgctctccgtggggtacaccctcttcgcgacggtcgccgtgggctggctggcccacctgatcatccctgatctgccgctgaccgccgcgctggtcctgggggcggtcatcgccccgccggacgccgtgacggccgccgccatcgcccgccgcgtcgggctgccctcccgggtgaccacaatcctccagggcgagtccctggtgaacgacgccacggcgatcaccgccttcaaggtggcgctggccgccgcggtgggggaggggatgagctggggcg

SEQ ID NO: 3222 - DNA, 3037 bp, Unknown
  Kingdom: Bacteria, Phylum: Actinobacteria, Class: Actinobacteria, Order: Streptomycetales, Family: Streptomycetaceae, Genus: Streptomyces
agtatccgcttgccgcccagggctgggcggcaagcggatactcatcagtacgcggtgcgctccgcatggttggcgcgcatgtacgagtcgtgacaacagtgactatgggcaccacgcgtcgttgtgacaatttctctctcgccacgaaagaaccgagcgaggggaccgtgcgtgaatccggagtacgccgcgtactgccaggcggaccgccgcttctacgacgcaccccaccgttcccccggaccgggcggagccgtcgacgaggagcgctcgttctacgcgccgctccgtggccccgtacccgacggctggacccgctcccggcgcggcgactggctcgcgtacagccccgacgggctgcgactgccgccccagggctggaagatccacgtctcggccgctctcgacaacgcggcctccgtgctggaacgggtcgtcgcccactgcctggaacatcggctggccttcaagtgcgtgccgaacgcggggctgttggccctgcgcaacgccaagtacgcggaccgggcgggcagcgggaagttcatcaccgtctacccgccgtccgacgaggcgttccccgaggtgtgcaccaccctgacgcacctgctggagggcgagcacggcccgtacatcctgagcgacctgcggtgcgggaacgggcccgtgcacacccggtacggggcgttcgccgcccgcttctgctccggcccggacgggcggcccgtgcccgccgtcgccgatccgcagggccggctcgtcccggacgaccggggcccgtccttccgcgtcccctcctgggtgaccccgcccggcttcctgatgccgcacctcgaagcccgtgccgccgtgggcctggcggacctcccgtacaccgtggagaaggcgctgcacttctccaacggcggcggggtctacctcggccgcgacacccgcaccggcgagcaggtcgtcctcaaggaggcgcggccgtacgccggtctggccgccgacggggcggacgccgtggcccggctggagcgcgaacgggccgccctggagcaactggccggactggactgcgtaccggccgtccgggacgtgttcgaggccggcgaccaccacttcctggtcctccagtacatccccggcaccaccctcaacaccgtcttcgcccgccgcttcccgctcgcccggcagcacccgtcacccgaactgctcgccgaccacgcgtcctgggcggcggaactgtacgggcaggtcgagcgcgccgtcgcggcggtgcacgagcggggcatcgtcatcagcgacctgcacatgagcaacgtgatggtcgacgaggaggcctcgcggatcgtcctgctcgacttcgaggcggcctccccggccgccgaacgccgccgtcagatcgtcgccaacccggccttcgtcgccccgcccgaccggcgcggcgccgacatcgaccgctacgcgctcgcctgtcttcggctcgccctgtacctgccgctcaccacgctgttcggcatcgaccgcaccaaggccgccggcctcgcccgggacatcgcccgcgtcttcccggtcaccgaggagacgctgcggcccgcggtcgcggagatcctgcgcgacaccgggcagcccggggcgggcgtcaccgccgtgcccgctcccgtatccgtgcccgaccccggcgactggccgcgcagccgtgacgcgctggtccgggccatcaccgcctcctgcacaccggagcgcgaggaccgctgcttccccggggacatcgcccagttcgccacggccaccggcggccagtccttcgcgtacggggcggccggagtgctctacgccctccacgagacgggagccccgccgtgcgggccggccgaggactggctcctgcggcacgccaaggacccggcgtccggcagccccctcggcttctacgacgggctcaccggcatcgcctggaccctgcaccggatcggccgcaccgccgaggccgccgacctcctccggatcatcctcgaccagcccctggaaggcctcgcgcccggcctccacaacgggtacgcgggcatcggcctcgccctcgacgagctggcccgcaccgcctccgccaccgacgccccggcgctgtccgccgctgccgcacgctgcaccgccctcgccgtccgcgcgctcgtcgacggcccgccgtctccccgcaccggactgctgcacggtgcgagcggcatcgccctgctgctggtgcgccggtacgcgaccaccggggacaccgccctgctcgacctggcggccaccgccctgcgccgcgacctggaacgctgccgggccggggacgacggcgaactcctcgtcgtcgagggcaagcggctgatgccgtacctcggttcgggcagcgccggtatcgcggccgtcatcgacgcctatctggcccaccgcccggaccccgcgctcgaagcggcgggccgcgccctcctgccggccgcgctctccgccttctacgtccagcccggactgctccggggatcggccggactcctcatgcacctcgccgccactccgctgtgcgacgaggccgaccggcggcgcgccatcgcccgccacaccgacctgctgggcagccacgccctggcgtacggagacggactcgccttccccggcgagcagttgatgcgcctgtcgatggacctggccaccgggaccgccggcgctctcctcgccctgggcgccgcgctcggcggctccaccggacttcccttcctgcccgccgctccggcgggccccggccgcgcgagcggccccccgaaccggccccgtcaggggtcgtcgtagcaccaccgttcagcaccactaccgtccccgaaaggacacatcatggcgcttctcgaccttcaggcaatggagaccccggccgaggactccttcggcgagctcgccacgggcagccaggtctcgctgctggtctgtgagtacagctcgctcagcgtggtcctctgcaccccgtgacccgcaccggccggcccatcggtgatcctcaccggtgggccggccggtgcgggtc

SEQ ID NO: 3223 - DNA, 8413 bp, Unknown
  Kingdom: Bacteria, Phylum: Actinobacteria, Class: Actinobacteria, Order: Streptomycetales, Family: Streptomycetaceae, Genus: Streptomyces
gcctcggcgtgcccgccgccctcccgtgagggtgcgccggagcgctgccggtccgcccggcgcagccagtccccgagccccacacgatcacccgccttcgttgacgcgggtgttgatccgcgctatctcccgcacccactgctgacgttcgccgtgggtgaggtcgagaatgtcctcacgctgccaatggaagtggtaggcgacgtacgcgatctcctcccgcagccggggaagcgcgtacgtcacgattcccccaggcgcccacccgagaggtccacctcgaacgatccgtggcacagcgggcaggtcaccgcggcatgcgtgtggccctcgctgttgatccggcggtagaagtcctggaggaacgccacgtcggtcgcgtacatccgctcgacgatcccggcgtgcacatcggtgaccgtgccgagctgggtgatcacctggctcagcagcaccacggacagatacgccgggttctccttcacccgcagatcgatctgcgggcgcagctcgtcccgggccgtcgcgagccgcatggtgccgctgcggtgcacgtggccctcgtcgtcgacgtacccgcgcggcagctcgaaggcgaactccgtctgcagcgtctcccgttcccgggagcgggcgggagcgggcgcgggggcctcctcgcgcgcggcgggtgccgtggcgaggttgtccaggacttcttcgaggccgctgcccggcgtaacggtccggcgcctcattcgaccacgatctcctcgaaggtgatggtcaccgtctcggtcgccgcgctggactcgccggccttgagggaggggccctcccacttggaggcccagccctgcatcagctggatgcggcggacggtctcaccggtcgagtccttgatctcgatcgtgaggttctgccgcgcggtgtcgacggccccgttgttgagggtctccttgatccaggtggtgaactcgctgctcttgtcgagcccgcgggtgatcgtcacctcgccggcctgccgggcacccggctgcttgcggatgatctgcttgccctcggcggtcacctgacggacctcgacgacttcttcctcgacggtcatgccgctgatctcctggatggactccacgagatagccgccgagctgtacgccgaagacgtgggtggaaagagcgtcgccctctgccatgactgtgtgtcacctgttctgatcgggacgggaagtgagggggtggaggaggaccgcgcgggtcactcgtcgacgaggctggtgctgtcggagaactgcgagagacggaagatcacgaactccgcgggcttcaccggggccaccccgatctcgcagacgacctgaccgaggtcgatcgactcctgcgggttgttgctccggtcgcaccggacgtagaacgcctcctcggccgtgcggccgaacagcgcgccccggcgccactcctcggtgaggaaggcggtgacgttgcgccggatgctcgaccagaggcggtcgtcgttcggctcgaacaccacccactgggtgcccaggaggatggactcctccaggtagttgaagagccggcgcacgttgaggtagcgccaggccgggtcggacgagagggtgcgcgcgccccagatgcggatgccgcggcccgggaaggcgcgtacgcagttcacgccgatcgggttgaggaggtcctgctcgcccttgctgaggcggatctccaggtccaccgcgccccggatgacctcgttggcgggggccttgtggacgccgcgctcgttgtcgctgcgcgcccagacgccggccacgtgaccgctcggcgggaccagggagttacggccgctcgccgggtcgaagaccttgacccacgggtagtagagagccgcgtagcgcgagtcgtagccggcgtcctcgttgcgccaggtgcgcacccgctgggcgttcatgcccggcggggtgtcgaggacggcgacccggtctcccatctgctcgcagtgcgagatgaccgccagctgcacggtcttgacgccctcggcgtcgatgtcgccgcgctggtaggcgctcatcaggtccgggacggcgaccatcgtgatctcgtcgatcgcttcgaggccggagaagccggtacgcgcggaggcgtcgcccacgtactccgaggcgtcgagccgtgccacaccggagccgggggcgcccgccgcggcgggcgcgagagcgacggtctgcttctcggggcggctctgcgccgtgccgggctgctcggtgacccggacgaacttggagtcgcgggcctgggtgaccaggtaacccttgacgttcttgcgggtggagacgtcgtacgtctccacggccttgccggcctggcgcaccagcagccggaagcggtcctccggagggttctcgccctcggcgtcggcgatctccacggagaggtcggcgcccgtgccgggcttggcggagacgaggaacccgccgagcgcgacgggagcgggggcctgggagaccgcaccctgcgccgaaccctccgcggggccgccgatgcgcacgatgtaggccgcgccgccgccgttggcgaagaagccgtagacggcgtgggccagataggtgtcagcggtgaaggcgccgaacgtctgcacgtactggtcccagttggtcaccagcgtcggctgatggaaggggcccgtcccggcgaagccgacgaaggctgcgaccgcggtgccgactccttcgatgggccgtgctccggactgcacctcctccacgtaaacaccgggggtgaggtacgacggcatgctcgctccttctggacggtcactcgatcactgtccagtcttgaccgtccggccggccggggagtaggccccagggtcccggacgcggggcaacgagactgcctttccgggcccccgtacgccgggtaacactgcccttggcgggccgggcggaacactcgcccgtattcgcgggggccggtccgcattccacgggtgacatgaagagaacgagaacaacgtgttacggaacactccgatgccgccgcgccggtcgggggattgggcgaaagagcgggcggcgcgccagggaccttgtgtgtttggtatctctttttttccggtaaaccccggcaggtcgatcgccgtcagggccgccggggaaacgctccgaggtgacgcgattcggccagaatgcgccgagaaggtacgcggattcggccgggtgtggaaggcggaagcgggcgcgagggcgctccgaacgggcatccgcctaccgccctcggaccgtcaggaccgtttctgagcaggcttgttcgtgcccgcggccatcggaagcggatattcttccgatgctgtcgccgccgcgcgcgaccgatccggtcgaggactctggtgtatccgggagggcgaatccgccactgcccggcacgccgggtttcctctcgaccgggtttctgctgttgtctcgtcggcaggcgaagcagaacgctcggcgtcgctgtttctatcgtgcgagatcgctcagtacgccgctgacattcagaacctgatggcacccggaagcctgcgtaccggtggccggagtgccgggcttggcacaggtgacggaagcggtgacggtggcgttctccggaacctgaatgggggtgacccagtgatagtcctggttgcggaaggtttccagcgcgatggtcgtgatcttgcgctcgccgaaggagatcgtcacgatgccctcgtccccctggaagttcgccaccacgatgtcggtgacgccgaacaccttcccggccggaaccttgtaggacccctccgccgtggcccccgtgcgggactgcacatcgatggtctcggacgtctgctgaccgcccccgctcgcgccgttgcccccgcctccgccggagccgcccgggccggaaccacccgtaccgggacccgatccgtccgggccggttccctctccctgaccgcctgccgggttgtccgcaccgccgggcggggtcgacccctgctccttgccgcgctcggtctcctcctgcgcggccttcgtcccggcctgcttggccgtgctctgcaccgcgggccgcaccagggcgaaccacgcgagcagcagggccagcagcgccgccagcacgatcagcagccacttgggcagcaccggtatctgggcgaactcgccgggcagcggctcgggtccaccgggctgctcgtcctcggcctccccctcggcgccctcggtcgcccggacctcgaacggccaggtgacgggctcgccgaaccagatcagcttccgggcccggaccttcagcccgatctccgccgactcacccggctccagccgcttcctgtccggcgtgaaggccagccgcagatcctcccccgcctgcttgcccgcgagggccacatcgaccggggtgttccccttgttctgcaccgcggtacggaagcgggcgcccagccagccccggcgacggcgcggttccagctccgtgcggagctcgtggaagggctccacggtcaccgtgccctcggggaccaccaccgactcgggccgctccgcgggcaatacccgtacggccaggggggtttcgcccgcccggacctcgtgggaacggggcggggcgaaggtcagggtcaccgtctcggaggtgcccgggtacagcgacacacgcgccggctcgacggtactccaggcggcgcagtcgccgaccacttcgagtgtgtaggcctcgacgatgtcgccgtcgttgcgcacggtcagggtggtcgtcgcggtaccgccaggcgacaccgtcaccgtggggctttcgagttcggcagatgtggtcactctgcgacggtaggccgcccgcaccccccagcagcagagacgcgagggcaacgagcgggcaggggtgatgccccgcgggccccccggcacggtgtccccgcgcctcccgcacgggcccgcgcgccatgccccgaccggcgggggaggcacgagcaccagcaggcatatcgggctgaagtacctgaggaagacgggcacggaacgatgacgacgatcacggacacgacgaacagcacgacgagcggcacgacgaaccgcatggcgacgcgcgggcagtaccgcaggcccgacgcggcgcagcgccgcacggtcggctccgggggagcacccgggggaagggtctccgtcgcggtgtacgcggaggacctgatcctgcagaccggcatgattcaccaactgcgcgtgcgacccgagatagaactgctgccggaggccgaggcggaccgggcacaggtctccctggtcgtggtggacatggtggacgaacccaccgtccagctcctgcaccgcctccagcgcaacacctccacccgcaccggactggtcgtggggttcttcgagtcgggcgccctccagaccatgatcgagtgcggggtcgccgccgtcctccgccgcggcgaggccgaccaggaccggctcgtccacctggtgcgggcgatggccaacggcgagggcgtcctgccgggtgatctgctcggcaagctcctcgaccacgtcagctccctccagcggacggtcctcgacccccgcgggctcacgctctccactctcaccgcgcgcgaggcggagatgatccgactggtctcggagggctgcgacaccgccgagatcgcgcagaagacctcgtactccgaacgcaccgtcaagaacgtgctgcacgaggtcgccacccggctcgaactgcgcaaccgggcccacgcggtgggatacgcgatgcggcacgggctgatctgaggacccgtcgcccaagcgtccgggcccggggacccggcccaccgggccggctccgcgcccggctccgtcccgggcgcggtgtgccgccgccgcaaagggcagcgatcgcttcccccgtcccgggtactcgcggcctgtccttcacccccgcgcgggggtgaagctggccggtggagagtcatcaacagactgtgaggtgggccgtgaccggcactgctggcccggcaaagcattcccggctgggccgactgaccggtgcggtggtgctgttggcaccgctgctgctggtcggctcggccgccgccccgcacggggccgccgaggccgtcgccgccgtggcggacgcggaaccgctccaggcgggtcgcgtcgccttcgccggcaccgagcaccgcagcctggggcgggccaacgacaaggacaccaccgacccgctgttcggcgacggtcccgcccactacgaccaggacccctccgcccgcggggacgtcctggtcttcaccagcctgcgtgacagcgcccggccccaggtgtacgtgcgcgacccggacggatcggtgcgccggctcaccaccgacaaggacgcggcccaccccgaactctccccggacggcaggaccgtggtcttcgactcggcggagaccgaacccgacggcacggtccagcgcgacctgtggacgatcggcgtcgacggcaggggcctgcgccggctcagcgacacccgggacaacgaggagtccccgacctggtccccggacggcaagcggatcgcgtacgcctgcgacggcgacgacctccggggatggcagatattcgagcaggccgtcgccggcggcccgcgcacccggatcagcgacggaccggcgggtgacgccaccgagccgtcctggaacccggtggacgacgacgcccgccggggcctcgtcgcgtacaccctcaccacgaaccccgatccggacgtggacgacggcaccgaactgcgggccacccagggcgtcgggaccgaccggccgctgctgaccggtgcgcacgccgcgtggggcacccgctcggcctcctggctgcccgacggcgaggacatcgtcttcctcagcccgtaccacacctgcggctgcgacgacttcgaccacgtctaccgggtgaccgcgttccagaacgagccgccggaccaactggtcaacgagaaccgtgaggtgggaccgcccacctggttcgctccggccgggaccgtcatcattccccggatcaccgcgaagccggtaggcctgctgtcggcggcgtacatcgtgacgctccaggacgtccgccaggacggttccgacccccgcgacctgcacctcaccatcctgaaggaggacccggcggcccgcacgaacacggaccccgccaagaaccccctgttcaggccggccgccgggtacgacccgtggcacgagcggcagaactacacgcccgacggccggcgcatcgtcgtcacccgcttcgaggacggcgccaacgggcggatcgagcggatctggatggccgacgccgacggtaggaacgagaagccgctgccgctcgacgggcgcggccccgacgactgggacaccgaccccaccttctcgcccgacggcaccaagctcgcgttcacccggacctcacccggcggcgtcggggacgcggcgggtccgagccgcatcctcatcgccgacgtcgccagcggcgcgatcctcgacgagatccggccgcccgaggggcagcagacgggcgacgacgcccagccgacctggtcgtccgacggcgtcaacctcgccttcacccgcagccaggtcatcaacggcaacggcgccaacaagcacatctgggtcgtgccggtggccgacctcgaccggcagcgggacctgagcgccaccatctgccccggcgactgcgacgtcatcgacgacagccccgcgttctccccggacggcaagaaggtcgccttcaaccgcaaggacggcggcggccgggtcaaccaccgggccggagtgctcatcaaacccctgcgcggcggcggctgccgggtcgtgctgccctccgtccagaaggacaacccggccggctgcgacctgccggtccccgacacctccgtgaccggcccccaccagccgcgtgacgtggcctggtcacccgacggcagcaagcttctgttcacctcgcgccgggaactcccgccgaactccatggagcagctctccgtactcgacatcgcctccggcgatgtggcccccctcgacaacacgcacgacggacggcagaaggagccttccttccagcagtccgtcgacctgtcgctgaccgcaccgcccaccagggacccggtggaggtcggctcgtccaccgaggtggcgatcaccgtcaccaaccggggaccctcgccctcgccgggcaccctgctcaccgtcgacgccccacccggcgtacggctggaggagctgaccaccgacaccgggacctgcgccgccggtacgccccagtgcgacctcggcatcgtcccgcccggcaccggcgtgacgatcacggcccggctgaccggcgtgaccgtcggcgaccagcggatcaactggtccgtcagcggcgcggtcctggaccccaaccccacggacaacgccaccggaacgatcgtcccggtcgaggacg

SEQ ID NO: 3224 - DNA, 2197 bp, Unknown
  Kingdom: Bacteria, Phylum: Actinobacteria, Class: Actinobacteria, Order: Streptomycetales, Family: Streptomycetaceae, Genus: Streptomyces
ggtgaggacggcggcggcgccgaggcccgcggcctgggccgcgaagtcggcgccgtggaagcgggcgccgggcagggccgcgtacacgtcgcccggacgcacggcacgcgagtcgtgcgtgatgccggtgacctcaccggacccggccgcttcgacgccgagccggtctgccagctcgccgagcggggtgggccggagccggtccggtcggggcgctcccgggtaggtcacaggcgcgtccttctgagaggtttgggactgatcagcgtggggcacggcggtgagcgtaccgggccggtgcggcgtctcgcgaagcgagggaccccggttgtggcggttctcgttccggttcccgggatcgggggtgatggttgtcactgagggttcccttgaaggggatgctcgcgcatccccgtgttcactcgccgggcttgaaggacaccggcagccggggcggctcgctgccggacggtggagtctggagcgtcttgagcgcgaactccatgacctgcttgtagatcgggccgcagatctggccgccgaagtaactgcccttggtggggttctggatcgcgcagtagacggtgacctgcgggttgtcggcgggggcgaagcccgcgaaggaggcggtgtagcccttgtagacgccgcggacggggtcgacgcggttggcggtgccggtcttgccggcgacccggtagccggggatggcggccttggtgccggtcccttcccggtcgtcgacgacggactccagcatcgtcgccagggtcttggcggtcttctcgctgaccacccggttctcctcgggggcctcggccgcggcgaagcgcccgtcggagcccttggcgccgcggacgagggtgggggcgatccgtacgcccccgttggcgatggtggagtagaccgaggcggcctggacggcgttgagcgagaggccctggccgaaggggatcgtgtactgctgcgaggtcgaccagtccttggggtgggccagcaggcccggcgactccccggggtagccgagcccggtcttggagccgaggccgaacttgcgcaggtaggagtggaggatccggttggactccgcctgggtcctgccgagctgaccggtcgccaggatggtgccgatgttgctggacttggcgaggaccccgttgagcgtgaggtaccaggtggggtggtccacgtcgtccttgaagagccggtcgccgcggtgcagccggttggggacggtgacgtgggtgccgggcgtggcggccttctcctccagtacggcggccatggacatgaccttgctggtggagccgggctcgtacacgtcctggagtgcggcgttgccgagggaggcggaggtcgcctcggagaggtcgttggggtcgtagccgggggcgttggccatggccagcagctcgccggtcctggtgttctgcacgatgacgtagccgcggtcggccttggacttctcgacctggtcgctgatggccttctgggcggcccactggatgtcgcggtcgatggtcagctcgatgtcggagccgggcacggccgggatttcgctgctgcccgcggtggggacccggcggccgccggcctgggcgtagcggatcttgccgtcctcgcccgcgagttccttgttcagctgcgattcgaggccgccgccgcccttgccgtcggcgctgacgaatcccagtatcccggcggcgagatccccgttggggtagacgcgcttggtggtcggctcctggaggacgccggccaggacgttggctcccggaccgcccttcagctcgtcctcggacgccttctcggcgaagacggacttgaggtccttgatctgcttccagacctggggggtctgccggtaggcgaggacggtgtagcgggacttgggcgccgagagcttcttgacgagctcgtcgacgtccttgccgaggatcggggcgagcagggccgctgcctgctggggcgcgtcgggggccttgctttcctcgggcgtgaacatcttcgggtcggccgtgatgttgtgcgcgtccacgctggtggcgagcgcgacgcccttgcggtcggtgatctcgccgcgctcgccaccagcgtggacgcgcacaacatcacggccgacccgaagatgttcacgcccgaggaaagcaaggcccccgacgcgccccagcaggcagcggccctgctcgccccgatc

SEQ ID NO: 3225 - DNA, 3085 bp, Unknown
  Kingdom: Bacteria, Phylum: Actinobacteria, Class: Actinobacteria, Order: Streptomycetales, Family: Streptomycetaceae, Genus: Streptomyces
gcgccacggccgggccgccgaaccgcgcgtacagcccggcgcccgccagcggggcgatcagtttcatgccctcgttggccgtcatccgcagtccgttgaagtcggccagcaacgaggcgcgcacggtccccgcgacgagcgccgactccgccgcgtcgagcaggacgccgctcgccccgtagagcaccaggaccacgaagaccagccagacggtgcggcccgagtccaccagcaccagcgtggccagcagacaggccatggccaggttgacccggaccagcagcgtcttccggtccatccggtccgcgagcgcaccgagcgccggcccggccagcaccggggcccacatcgcgcacaccgtcagcgccgccagactgttcgagccggtcagcgacttgacccagatccccgccgtgagccacagcgccgacgtaccgaacccggagacgaccacccccgccagataccgtcccgcggtcgggtcccgcaggacccgcaccaccgccgaaccgcccatgccgcccgccctccgcctcgtggtccgcaccgtgtccgtgcgggccgtgcggctcatgctgcggagtaaggcggtgcggcggcatcgggcggattccctagaaccccgtccctcccgatccgggcgaaaggccctagtctggcccgcatgaaggagttcgacggggtggaagtcgtcgcgttcccggacgcggcggccttcgacgactggctggccgagcaccacacccgccgcgagggcgtatgggtcgaggtcgcgaagaaggcgtcggggatcgcgtcggtcacggccggcgaactggtcgacgtggggttgtgctggggctggatctccgggcagcgtcggggttcggacgaccggtactacctgcagaagtacgggccgcggcgaccgaggagcctgtggtcgcgggtgaatgtcgagaaggtcgcggctctggcggcggcgggccggatgcgggagcccggcctcgccgaggtccgccgggcccaggaggacggccgctgggaccgcgcgtacgcaccgcaggcgacggctgtggtccccgacgacctcgccgcggcgctcgccgcggatccgacggcgcgtgcggcgttcgacgggctggaccggaccgcgcgctacctggtgatgctcccgctgctccaggccgcgacaccgcggacgcggcggacgcggctggagcgggcggtacgggacctggcgaaggggcggcacgcgggcggctgatcctcccgacggaactcctggaccgccggtccggtgctccggccgcctccggaggcgccgtccgctccgggcgtcaccgctccagcgccgccttcatcgtcttctgcgcgatcggcgcggccagaccgttgccgctcacttcggagcgcgccgagccggagtcctcgacgatcaccgcgaccgcgacctccttgccgctgtcgcggtccttcgcgtacgaggtgaaccaggcgtacggggtgttggtgttgtccacaccgtgctgcgcggtacccgtcttcccgcccacctcggccccggggatgcgggcgttggtgccggtgccctcctcgacgaccgtcaccatcgcgctccgcaactgctcggcggtcgactcctcgaccacgcgcttcgtgtcgccgtcgccggtctcctccagcgccgtgccgtccccgtcgctcacctcggagaccatgtgcggcgcggccagctcaccgccgttggccagcgccgaggtgaccatcgccatctggagcggggtcgcggtgacctcgaactggccgatccccgtcagcgccgtctgggcccggtccataccggtcgggtagacgctcttcgccgcccgcaccgggacgtccagcttctcggtgtcgaacccgaacgcgtccgccatctccttgacctcgtcctggccgaggtcggcggcggccttcgcgaagacgttgttgcaggagtaccggagcgcggtgcgcaacgtcgcgttctcgcagggcgcggacgcgttctcgttggggagcacggtgctggtgccgggcagggtgtacgggtcgggactgtcggtgcgctcgtcgaccgagccgtacagcccgttctccagtgctgccgccgcgaccaccagcttgaacgtggagcccggcggcagtggctgccgcagcgcccggttgaccagcggcttgtccgggtcgtccagcagggcctgccaggcgtcctggtccgtcgtcccgctgatcttcgaggggtcgtacgagggggtggagaccatgccgaggatccggccggtcctcgggtcgatggccaccgccgcgcccttgtcgtcgccgagcgcctcgtaggccgccttctggacgtccgggtcgatggtcgtcagtacgttgccgggggtggcctgcccgccggtgagcaggtccttcggattcttcagccggtcgtccgtgccgtccaggacgtcgctgtagatcccttcgagctgggtcgccccgtaagcctgcgagctgtagccggtgacgggcgcgtacagctcgccctgggtgtacgtgcgcttgtaccggaggtcgccgccactggtccccttcgatccggtgaccggtgaaccggccacgatgatgtccccgagcggctgcgcgtactgcgcgatggtgttccgccggttgtgctcgtcgtctgcgagcgccttggcctggtagccctgtacccacgtcgcccgcaccagcagggcgagcaccatgagcagacagaagaccgaagcgcgcctgattgtcttgttcatcccgctggagggacgagcgggcacgttccggacgttcccgtccgtgccccttctcactgatttctcaggtggccggccgggccccgaagccgggcctgcgggtcagcccggggtgatgaaaccggactcgtacgccgcgatgaccgcctgggtgcggtcccgggcgccggtcttcgcgaggaccgccgccacatgcgtcttcgccgtcgccgggcccaccgagagccgtcccgcgatctccgcgttgctcagccccgccgccatcagccgcagcacgtcggcctcccgcccggtcagcctcgccacccacgccg

SEQ ID NO: 3226 - DNA, 6344 bp, Unknown
  Kingdom: Bacteria, Phylum: Actinobacteria, Class: Actinobacteria, Order: Streptomycetales, Family: Streptomycetaceae, Genus: Streptomyces
ccacccaggagcccccacgatgatccagcccggacagacctaccggtccgcgtcaccgatcaagtccgacccccagcagcgtcacacccggatcaaggtcgtcgacgagctcatcgggaagccaggtgtatacgggctcaacaaggtcgacattgtcacgctcaccgacagcggccgagaggtccgccgccgtgccatcgagatcacccaactccacgcgacggccaccacccgcgacggggcaccccgccgcaccggatacgtacaggaggacacgtgagcgagacccgcatcgccgtcgcgatcaccgtcaccgccgtcaacctcaccgagacggacctcgacaccctccgcgaggagatcgaggacgcagccgccgcctacaagggcgacgtcaccatcgacagccgggactaccccgtcgactagcgtcaccaccccccaccctgggcccgccctgaaccatcaggcgggcccgaggcgcgccggaacaccaatggcccagggttgtcatcacgccagcgcacaattggcctacaagccacttgcttcccgcacccaccacgaggagccgctgtgcacgacaaccccgcccaggccgactatgcgtggcccgtgtgcgtgaccccccgatgcgggcggcagctctgggtcgccgaagctggccgatacgcgtgccgcccctgcgaagaccaggcggccaagcggctcaccgaactcgggcccctgttccaccggctcaacgaaaccggcaccctcatgcgcggtgcccgcctgcccgggggcgccaccaccggatcccgcaccccgccgatacccccgcgccttgaagtcctcgcgctcaccgccaacgggggagtcgccacccggttgcaggccattgaggactcctggcggcaagccctcggctgggagacgtcgccgacggtcgacgagcggaccacgttccccgtcgcccgggacgctgccgggcgcacccaggtcgggcggccggtgaagggcgaccgggtctacccgcactggcgcacccaaaccgccagcagtgccgtgcccgcgcacctcaagttcctggccaacaacctgccgtgggccgtgtgctcctacgagtcggtcgggcaggacatcgacgacctccgcaagctccacgccgaatgcgtggcggtcgccgccaacgaacaccgccccggtcgggtgtccatcggccgctgccccgcccggtacgacgacgggaatctctgccgggccgacctcaccgccaccgccagcagccaccgagtacggtgcgggcaatgcggggcgcggtgggaaacgctgggggagtggaagcagctacgggagcagcaagacgcggtgctgcgagacgacgcaggggtggcggcatgaacgccgaggtcaagatcatggcgtcctttggtgtgctgagctttgccatcttcgtttgggctttcgttgacatgctcctcggaagctcgaccgccatcaacggagtcatagccttcggcttctgcgccgccgtctccgtcccctgcgctgcatcccttcgagacgacaagcccagactggccgccgtcccgaagcccgactacgccaagatcgcggcacttgagatcgagctcgggatcacgggagcgccgcggcaaggcgtcctccgcagagttgagcgcgacggcgaaacgaccgagtaccgaacctggagcgaccaccccgagtgccgggacgaatggcggccgacaccctcatcgaggccgatagttgacgaaacggggtccaagctgtaaacctgttattgatcgtggcacacatgtcacaccacgcttccgaagcccccaccgtgaacacaccggtgggggctttcgcgtacctgcgggaggtcgccatggtcgcctacaacaaccccgaccccgtagacatccacttcgcccgcctccaaggcgacgagcaactcggcaccctctgggaagccgcccgagccgtcggcgtgaaacccggcaccatccgcgtctgggtctcccgaggcaagatcgaacccgtcctcgacggagaagcaggcacctacttccacctccccaccgtcgaacgggcggcagccggtggagccaagtacaaacccgccgaccccgccgccaacagccgtggcccccacgcccgcgtcgcctgacccctgaacccctgcgctggtgggcgcaggccgggcctcgacgcgccactgcgctcggcccactctgtccgcccggtcgagggttcgggcggacacagacccgggacccccagtcccgacgtgaccccgccgtcaacacctcccccgtttgacggcggggccacaccccacgaggggaggccaccgtggcactgcccgacaacctccccaccgtcaccgtgaccggccaacgaacccaccccgacggcacacccatgcgcggcagcatccgcctcgtacccaccgccggccggttcgtccacgccgaaaccgggcttgatgtccagggcgccgctgaaaagccctacgacaaggtcaccggcgagtacagcatcaccgtcgtcgcctccgacgcagacggcatcaacccgcacaacggcacctacgagatcaccctcaccgcgttcgacgcacccaccgtgacccgaaccgttctgctgcccaaagccaaccccgtagttaagttcgcagccatcacgccagtcgaccccgacgagggcgactacgtcatcgtcgccggcccagaaggaccccaaggcgaacctggacccgcaggaattaagggcgacaccggggacgccgggccagcggggcccaccgggccggccggcacaaccggcccccagggagaccccggcgaacaagggcccaccggtcccacgggcagcacaggggccactgggccgaagggcgacaccggaagccaaggcccgaaaggcgacaccgggccacaagggcccgcaggagttcccccgatcggcgatcagcctggcgtcactcggactgtcgacaagcccgccgacgaggcagtcaccgcctccaccgtcctccaagttgacgaccatctcggcttcaccgttaccgcgggcggccggtacgcaatcgacgccatgctcgtcgccaccggcgacccggccggcgacctgctgctgaccctggcggccccgcccggttcaacaggccactggacccccggggccatcaccttgggcgtatcagacggcaccggcagcatccggcttacccgctatgacatcgggacatccatcggtgtcggcatcaccgtcgcaggcctggtcgtcgctccgctcggcacgttcaccgccggtgccgacggcactctggcccttcagtgggcgcaggtcgtcagctcggccacccccaccgtcctcaaggccgggtcctggctgcggctcacccgcaccgcctgaaccggcaaccacccagctgtagaagggcccgcgccatggtcgacgacctgctcgtcatcatcccgacccgaggacgcccccaagccgtcatggcgctcgtcagggcgtggcacgaaacgggggcgaccgcggacctgctgttcgccgtcgacaacgacgacccggagttcgacgcgtacaagcgtgaggccgccaagttcatgaagggcggccaggtccgcttcgtcttcgggaagcggctgcggctgtgcggcaccctgaacgcccaggcggtcaaggcggcaaagcgctaccggttcctggcgttcatgggcgacgaccaccggccccgcccggcggcaatgccgtgggatgcgcggatccgggagtgcctgtccggcggccccggcatcgtctacggcaacgacctgctgcagggcgaggccatggctaccgccgtggccatgacgtcggacatcgtgtcgacgctcggctacatggccccggacgtcctcacccacctctgcctcgacctcgtatgggtcgactgggggaagggcatggggaggatcacgtacctcgacgacatggtcatcgagcacctgcatcctgcggtcggcaaggccgagctggatgccgggtacgaagaggtcaactccgacgccatggtctccgccgacagcgccgcctactacgactatcgggacaacggcgggctcgacgccgacctggccaagctccagaagctcgtcgaggaggcatcgtgaccgccatcgactatgacttggagttcctggaggacggccgcaccatcgagctgatctccatcgggatggtgtgcgacgacggccgcgagtactacgccgcgaaccgggacatgcctgtgcggcgaatccggaagcacgcgtggctgatggagaacgtcgtcccgcacctgcccaggggccacggcgacctacggaacagcatgtcgaagcgctggctgttccactacggcgaccctcgtgtgaagacccgcaagaccatcgccgccgaggtggccgcgttcatccaggccaccgacgacgtggagctgtgggcgaactacggggcctacgaccacgtcgcgctcgctcagctctgggggccgatgatcgccctgccggacggggtgcccatgttcacccacgacgttcagcaggaagcccgacgcctcggcttcggctggaacgacctgcccaagcaggagtccggggaacacaacgcgctcgccgacgcccgccacaaccagaccgtgcgccgctggctcgccgggcaagcgtggaggggggcatcgtgaccgccgatgacgtcatccgggcgtgggaccaggccgaccccaccgcgatccaccccctgcggaacgtgtccgaggacgcctactgggagtccggcaagggccaggccgccatgctcgcgtcggtgattcccgacggggtgaaggtcatggacttcggctgcggcgacgggcgcgtcgccatccccatggccgcgcttgggttcgaggtgaccgccgtcgacgcgtcgcagaacatgctcgaccggctcgccgaccgcgaccccgacatcaccaccgtccaggccgacgccgacggcatcgccggacacctcggccgacgccgcatggacgccgtctacacgttggccgtcctcatccaccacagctaccaggactgcctccacatcatcagcaagctgcgggcggccaccaagctcggcgggatcctcgtcctcgactggcccacctccgagacgccatccgaggccgacagctggatcggcgtcaccacctggtccaccgaacagcaagccggcgcgtgcgcggccatcgggctggagcccgtcgacagcgacctcccgtggggcgtctaccgggcagtgaaggtgagctcgtgaccggcgaggtggcgttcgggattctcctcgcccacctggccggggattacctcattcagtcggactggatggcgaacgagaagaccaagcgctgggggccagcctgggtgcacgctctcacctacggccttccgttccttctcgtcacccggtcgcctgccgcgctggccgtcatcgttgtcactcacgcggtgatcgaccactaccgacttgcccgccatgtcgtctgggcgaagaacttcctggctccgcgttcctactggcatccgtggtcggagtgctcggcgacgggctaccacaaggaccgtccggcatggctggccgtctggctgatgatcatcgcggacaacacgatgcacctcgccatcaacgccgcagccgtcacctggctttgaggaggtcccgatgcacgtcctcctcactggggcctccggtttcgtcggccgccacctgcaccgcgcactcctcgaccggggcgacctcgtcctcgggatcgacctcaacgcaaccctcctcgcccgcagcggcgacgccctcgacttcttccgcaccgacggccgccggtgggacctagcgattcactgcgccgcgaacgtcggcggccgggccagcatcgacggatccccgctcgccgtcgccaccaatctggcgttggatagctggtacttccagtggctgatccgcaccggcaccccccgcgccgtctacttcagcagcagcgcggcataccccgtcgagctccagcagcccggcgacatccaccggctcaccgaagacgacatcgacctcaacaaccccgggaaacccgacgccacctacggcctcgccaaggtcacgggggagcggctcgccgcctacgccgaggccgaagggtgccgcatccacgtgttgcgcccgttctcgggctacggcgaggaccaggcggactgctacccgttcccggcgttcatcggccgggcccgacgccgcgaggatcccttcgaggtctggggcgacggcagcagcacaagggactggatccacgtggacgacgtcgtcggcgc

SEQ ID NO: 3227 - DNA, 3290 bp, Unknown
  Kingdom: Bacteria, Phylum: Actinobacteria, Class: Actinobacteria, Order: Streptomycetales, Family: Streptomycetaceae, Genus: Streptomyces
gagtggctgggggcgccggcccggccggcgcccccagccactccccaccgtcgttcggctgcccgatcacggttactccgcccacgccgctcaccccgtttctcttgatcgtggagcggcactgtgccaaacccgcgttatgcgacatgccgtacgcaaacccaccgggtcccggctcggtacgcacccggccccgtggatcccgggcagggaaagcgaggtcaccgcctcccgcggaccgcgcggttcacccgaacgaaggggaagccgagccccctcaccaccacacggctgggctccactcgcccccagcgccccgttccccacccgagcctgacgaagcatcgaacaaggtgccgaccggcgcaccgacggctctcgaacggcgcatgcgaacacgccgtgccccgcgaacgctgcaaccgcaccaggaacccatggccaccgtcgttgctcctggtcacaccccgtgatacacagagtaaccaggcgtatgcgtgacgagcccgaacgagccgcaggtcaggacggtcgacccggtcaaacgtacgagatccgggtaaagagacccgggaaggcgtcgtgcgagcgcggtttcatcagcgaagatagaaggcgactcgtgccggacggcacgggcagcgaactacccaacaggggcggtgacttacatgatcctggcagcagagaagggcgacatcaccaccatcatcggcggaatcgctccggactgggggccgttcgggacgctgggcaacgaggcgcgcatcatgatcgaggtggtgatggccatcgccattctgctctgcctcggcatcgcgatctggggcgcggcgaagcagcgcatcggagcgacggcactccgcgacacgttcagtgcggagcagggcaagggcctgatcgtggcaggactgacaggggtcttcatcatcggatccctggggaccctgttcaccatcgtgtacggaatggccgtctgacccgccgtcggccgtttccctccgggccgtcccagcccacgccccaccgtccgcccgtcgcgcccaccggctgaggttgcgtttccctgatgtcgagtcaccacaccgcgctcaagcggcaaccagcacagctaccgtcgtcctgcgcggatccgcacacgaccgagggagcgaacgcggcatgagtcccggtgacgagcacgactaccgcggcaaggagcaggggggtcgcacggacgacccgtacagcaccctcggcggcacccgtcagacccgcacccgtctccccgacggcgacccgggacaccctcacgcgcgccgccccgtccgcaactcccgctccctcgtgacgatcaccggcatcgtggtgctcctcgtcgctgccatcgccttcgccaaccgcggcggaggcagcgacgacgacgcctccccgggcgccaaaaagcccggaaccacaggaagcgcccccaccgcggccaccggcaccaagcccgtccagggcaagaacggaacgatcgcctccggcttcgcccacgacgagcagggggcgcagagcgctgcggcgaactacgcggtggcgctggggtctgcggaaatgttcaacgccgaatcccgccgcggcatcattcaggcgacacatgacccggcggtgacccgtggtctccaggacagcctggacagcgcctattcgcctgcgttctacaagaacgtcggcctcaatgacgatggcagcacacccactgggctgagtttcgtctctcggaccgtcccggtcggtacgaaggtcgtcaagatgaagaccgatgtcgccacggtggaagtctggtgcacaggtctcgtcggtctggccggggagggctccaccaagccggtcaccgagacttggttcaccatcacgcaggagctcaagtgggtcggcgacgactggaagatctcgtcgtcgagccagacggagggaccgacaccggtcaacggtgacaaccgtgcctccacagctgacgagatggccgctgcggtcgatgcgtacggaggcttcacctatgcccgatagccgccggttccgcctctcctcgctgatcggcgccgcaggtctcgtgcctgccgcgctgatcatcacgacgtcgcgcgcctccgcggctcccacaccgaccccgacgccgacccccggcgagagcgacaacccctgcgacctcatcgtcgggctcgccaaggactactgcgaggacggggagaacgcccgcagcggttcgcgtgctcccaccgacgtcgacaatcccaccgaccccctctcctccctggcccgaggctgcgccgacgccgcctcctggatcgtcggcaagctcagcgaggccgtcgagtccacggccaacgtcgacttcaccaaccccaagttcctccagcagtacgccgtcatcttcgcggcctccaccatcctcaccctcgtcctctggctcctcgccgtagccaagcgagccatccgcggtgtccccctcaccaccgcgatctccgaggccgtcggcttcctctggctcaccgtcctcgcctcggccttcaccccgctgatcctctacacgatcgtctccgccaccgacggcgtcaccgaggtcatctcctccgccaccggcggccagaccgacgtcttcttcggctcgttcgccgaagccctcaagaagggcgaagacatcggcggcggaccgatcatgctgatcgtcgtctcgctcgtctcgatcctcgccgccggcatcctgtggctggagctcgtcatccgcgccgccctgctctacgtcggcgcgctgctcgggatcgtcgtctacgcaggcctcgtcgacaagaacatgtggggccacgtccgccgctgggccggcatcatgatcgcggtgatcatggtcaagccggtcatcgtcatcgtcctcggcctcgccggagcactctccgcgggcgacggccccgacgccttctccgccgtcgtctccggcctctcgatcatcctgctggccatcttcgcctccgccatgatctaccgcttcgtccccggcttcggcgacgagatccagggcgcccgcaccaaccgcaagcaggccaccgacggcgcccaggccgccgccctgatcagctccccggccgccctcgtctcccagggcatcaagacccacagcggccgcaacgaccagaacagcggcggaggcggaggcgcccgccccgccaacccggccagcggcggcgtcgccgcccacagctcccgctccaccggcggaggcggcggatccgccgcgccctcgccccgcagcgggtccgcacccacctccggga

SEQ ID NO: 3228 - DNA, 2366 bp, Unknown
  Kingdom: Bacteria, Phylum: Actinobacteria, Class: Actinobacteria, Order: Streptomycetales, Family: Streptomycetaceae, Genus: Streptomyces
ggtctgggcgtgcaggtcgacggcggccaggctcagcgtccgcgcctcgtcttcgatggcccgcacgagggccgcgccgaccccgtccgcgccgtgcagcagccggcccgtgccgagcgcggtaccgtccgccgcgacggccaggacatgcaccgcggtcgcgtcgtaagcgtcgtactccagctcctcgggcacgtgctgctcgccgacgaagacctccttgcgcacctggaagcaggcttggaggtcgctctcctcgacggccctgcgggtgctgtacgggaagggggcggaggtcactgactctccgcggagatggtgtcgagggcgtgctggaggtcggccggataggtgctggagaactccacccagccgccgtcgctcgggtgctcgaagcccaggcgcacggcgtgcagccactgccgggtcagcccgaggcgcttggccagggtcgggtccgcgccgtacgtcaggtcgccgacgcaggggtggcggtgggcggacatgtggacccggatctggtgggtacgcccggtctccagcttgatgtcgaggaggctggcggcgcggtaggcctcgatcaggtcgtagtgggtcaccgacggcttgccctcggcggtgaccgcccacttgtagtcgtggttggggtgacgcccgatgggggcgtcgatggtgccgctcatcgggtccgggtggccctggacgagcgcgtggtacttcttgtcgacgacccggtcgcggaactgggccttgagcagggtgtaggcgcgctcggacttggcgacgaccatcaggccggaggtgccgacgtcgaggcggtgcacgatgccctggcgctcggcggcgccggacgtcgagatccggtagccggcggcggcgaggccgccgatgacggtggtgccgctccagccggggctggggtgggcggcgacgccgaccggcttcatgatgacgacgatgtcgtcgtcgtcatggacgatctccatgccttcgacgggctcggcgacgatctggacgggagcggccgcctgcggcatctccacttccagccaggcacccccgtggacccgctcggacttaccggccaccgaaccgtccacctggaccttcccggctgcggccagctcggcggccttggtgcgggagaaaccgaacatccgggagatggcggcgtcgacgcgctcgccttccaggccgtccggtacgggcagggtgcggatctcggggtgcgtactcacctgtcgagtatgccttgcgcggaacgctctccgcgcagcccggtcagtccttgtgcacggttccgtcggggtccaggcccttgaaggagaggatcacgatgaggatgccgccgcagacgatggcggagtcggcgaggttgaagacggcgaagtgcttgggggcgatgaagtccaccaccgcaccctcgaacacgccgggcgcccggaagagccggtcggtgaggttgccgagcgcaccgcccaggaggagacccagggcgatggcccacggcaggctgtagagcttgcgggccagccggacgatcaccacgatcaccccggcggcgatgatggtgaagatcaccgtgaacgcctcgccgaacccgaacgcggcgcccgcgttccggatcgcccggaactgcagccagtcgccgatgatgtcgatcggcggctgatgctccagcttcgcgaccacgatcatcttggtgaccaggtccagcagataggccacgacggccacgctcaggagaacgaggatcttccgcttgccccggcccgcgttcacggccgcgtcggcggccgtgctgccgccttcgtccgtgccctcggcatcgggaatttccggcgtaccgatgatgcgctccgcctctgccacgtgagtccctcaacctaggtgcctgcctgaggatgagggtacgacacacctgtgcggatcagccgcgccgctcctgcttctgcttgtcctcgacgcacagggtggcccgggggaaggcctgcatccgcgccttgccgatcggtttcccgcagacctcgcagagcccgtacgtccccgcctccagccgggcgagcgcccgctcggtctgctccagcatctcctgggcgttggcggccagcgacagctcgtgctcacgggtgatgttcttggtgccggtgtcggcctcgtcgtctcccgcgccgtcgccggagtcccgcatcagcccggcgagcgccgcgccggaggcctccagctcgctgcggagccgcagcgtctcactcgtcagcagggtgcgcgcctcggtgacctcctcgggcgtccaggggtcctccccgggccggacggccagctcgtcgggggcggcggcgcgggccggcggcacgggggccgtggcc

SEQ ID NO: 3229 - DNA, 2391 bp, Unknown
  Kingdom: Bacteria, Phylum: Actinobacteria, Class: Actinobacteria, Order: Streptomycetales, Family: Streptomycetaceae, Genus: Streptomyces
ggcgtacccccgcccccacgccgcgcgccccagccgccagccgatctcgatcgcgccgaccggcccgtaatgcgtgtgcggccacggctgcgccccggtgaagccgaggacggtgtcctcctcgtccgtgagggtccacaggcagtagcccagctccgcgtcgtgccgccgctggcgcgcggtgagctcctcgtacgaggacagctccgcgctccgcccgccgaagaactccatcacccgcgggtcgtcgaagacccggtgccaggtcagagcgtcctcgtccgtcggaacacggaggcgtaccacgggggccgaggcatggggtgtgacaggcgctgtcgacatgagggagcccttcggagggttggttcgcaggcccccatagactgcacgggacatgtgccgcgcggcacgcgaattcgagtcttcgggagatccgaccgtgaccgagcccctctccgagaacagcgcggacgtgatcgtcgtcggagcgggcccagccggctccacgaccgcctactacctcgccaaggccggactcgacgtcctgctcctggagaagaccgccttcccccgcgagaaggtctgcggcgacgggctcacgccccgcgccacgaaacagctcgtctccatggggatcgacatctccgaggaggcgggctggctccgcaacaagggcctgcgcatcatcggcggcggcgtgcggctccagctggactggccggacctcgcctcctacccggactacggtctggtccgcaagcgcgacgacttcgacgagcaactggcccggcaggcgcagaaggccggcgcccggctgcacgagcgctgcaacgtgggcgcgcccatcagggacgagcgcaccggccgcatcaccggcgtcgaggcgaagatcggtgaggagaagaccccggtcaccttccacgccccgctcgtcgtcgccgccgacggcaactccacccggctctccgtggcgatgggtctgcaccgccgtgaggaccgcccgatgggcgtcgccgtgcggacctacttcacctcgccccgccacgacgacgactacctggagtcctggctggagctgtgggacaagcgcggcgccgaggaccgcctgctgcccggctacggctggatcttcggcatgggcgacggcacctccaacgtgggcctcggcatcctcaactcctcctccgccttcaaggagctggactggcgcgaggtgctaaaggcctggtgcgcctccatgccggaggactggggctacaccccggagaacatgacgatgccgatccgcggcgcggccctcccgatggccttcaaccgtcagccgcactacaccaagggcctcctcctcgtcggcgacgcgggcggcatggtcaacccgttcaacggcgaaggcatcgcgtacgccatggagtcgggccagatcgcggccgacgtcatcgtccaggcccacgcccgcgccacccccgcccagcgcgaactggccctgaacaactacccgaaggtgctcaaggagacctacggcggctactacacgatgggccgcgccttcgtgaagctgatcggcaacccgaagatcatgaagctcgccacccagcgcggcctgacccacccgctgctgatgaagttcaccctgaagatgctggccaacctgaccgacccgcggggcggcgacgcgatggaccgcatcatcaacggcctgtcgaaggtggccccgaaggcctgaggccggcccggggagggaggccgcccggcggaccggaccagccgccgggcccggcgtcccccgtccggggagaggaccgcccggctgaccacgcacgtccgcggcctcctccgacacccccggatcccggcactccgcctcacaccgggggttaatccccgactccccaggtgatcgtgtgcgatgatttgcgcgccccccggtcaccggcagcccggaccggccggcacccgcccccgcccgcagcggcggcacgcggtgcgtaccactcttcttgacgcacgctcacaccgaacgcaggccagcggggtacggaacaagccgatacagcgctgctcgaccccaaggacagacagccatgaccaccgcctccctgccccagcaccacggtctcttcctggagccccgcttcgccgtggacccgaccgcgccggacgacgacgaggacttcgacgcgccgtacgacgcgccgcccgcgcccaccacctcggccaaggagccggagcggaccaaccgccgcccccgccgccgctgatccggacggcggccctccggcccggaaaaccgctggaggccccgccgcccggcaggtagcctctccgtcatggccagccccgagtccgacagactccggccaccggtgcgccggtggccggagtctgtcg

SEQ ID NO: 3230 - DNA, 792 bp, Unknown
  Kingdom: Bacteria, Phylum: Actinobacteria, Class: Actinobacteria, Order: Streptomycetales, Family: Streptomycetaceae, Genus: Streptomyces
ggcggatggagtcgatggccccgctggggaggaccgcggggatggtcaggacggtcgggacggcaagagactcaccccgcgccaggcccggcggttgcggatcgtgctctcctcggtgggcatggcggcgatggccctcgtcctcgggctgcgcatcgcgagccgctcgtcggtcctcgtggtcggcgtctacgggctcgctctcatcctgtgcggcgtggtgatcgaactgagcaggaacggccgcacccggctggccagctggctgctggggacgggactgctggccgccgtgggagcggactggctgctgcttccctgaggcggcggcccggcaacactgcggtctcagatcagcagcagttggagtccgccgatcaccgtcgcaccgatgacgatccggtcgaagaccttctggttgatccggtcgacgcacgcccggcccaggtaggcgccggggaggacgaacagcagcagacaggcgtcgagcagcagggagcgggcgtcgatcaggccgaggcccacgctgaacggcaccttggacacgttcaggatcaggaagaaccaggccgaggtgccgaggaagccgagcttgcggaagccggccgagagcagatagagcgacatcaccggcccgccggcgttggcgaccatcgtggtgaacccgccgagaaccccgtaaccgcgcgcggcggtccgaccggtgcgggtggcggcttcactgacggtgccggcgccactccctgccccggctccgccgtcggcccgtgcggccgccgcggtcccggtccc

SEQ ID NO: 3231 - DNA, 7380 bp, Unknown
  Kingdom: Bacteria, Phylum: Actinobacteria, Class: Actinobacteria, Order: Streptomycetales, Family: Streptomycetaceae, Genus: Streptomyces
  misc_feature (386)..(387): n is a, c, g, or t
ggcgggggcggcagctgaccgggccgccgtcgcacggtcaccgaaagtgatgcggcaccgggcgtccggagggtgaactccctccgggcgttcttttgttgaacgacgcggacgttttcggttgaacaagtgaacccgtgggcccccggggggatggaaaccacggcaagttgggcgaaaacgctgtgggtgggtctacttcgtgattccctcgttgaagagaacaatcagccctcggaccccagttggaccagatcgggcgctccccacctcccacgcgcagtcttccgggggcgtcctgctgtccatgtgtccatgtgtgtttgcggagcccacccatgctcaccaccctccagacggcctattccgatacccgcgccgccganngacctccggctcggcggcgccgaactccagttgaggctgctcggcgcctcccaccaggtcctcctccaggaggaccgcggagtctgttccgagaccgtggcctgtatgcccggcagcagcacccccctgcccctcggcgtcgcgaagcggctcggggactgggagtacgaattcgcggcgcgcgtcgaaaccctgacgcaggggcagttcgccgggcgggcacaggagttgctcgccctggtgagcgaccacccgcacggcctggcgggcaccttccccggcagcccgtacgccttcaccgcgatgctcgcccagcgcaccgagggccaggtgcggtggcgcacctggcacgcgtacccgcaggaggggcagttggtggtgacccggaccagggtgggggtgcggattcccgcgtccgtgggctgaccggcaggtgcacttacacccgtgtgggtgacaggccgcgacgaatccgtgacgtagcgttcgcaacatgatcgaccagcagacgtcgctgcgagggggtgcggcgcggcttcccgtacggccgaggaccggccggttcctcgtgctggccgcggtcttcgtctgcgccgcctgcggtctcgtctacgagctcgaactggtcgcgctcgcctcctatctgatcggtgattcggtcacccaggcctccgtcgtgctctccgtgatggtgttcgcgatgggcatcggctcccttctcgcgaaacgtttgcgctgccatgccgccgtcggtttcgggatggtcgaagcggccctcgcgctgatcggcggctcctcggcgctggtgctctacgcctcgttcgcctggctcggcgactcgcagtacgccctggtcgggttctcgctggcgatcggggtgctgatcggcgcggagatcccgctgctgatgacgctgatccagcgcgtcgaccggcaggacgcgggcggggccgtcgccgatctcttcgccgccgactacgtgggcgcgctggtcggcgggctcgcgttcccgtttctgctgctgccggtgctggggcagttgaccggtgcgctgttcaccggcgcggtcaacgccgcggcgggcggcgcgctggtcctgtgggtgttccggcgcgacctcagctcccgttcccggtggctcctcgtcctggtcaacgtctcggtgatcgcggtcctggccacggcgacggtgctggtcgacgacttcgagcgggcggcgcggcgggcggtgtacggggaccaggtgcgggtcgccgtgcagaccggggtgcaggaggtcgtcctgaccggtgcggaccgcgattccctcgacctctatctggacggccggctgcgggtcagcgcccgcgacgagtaccgctaccacgaggcgctggtgcaccccgcgatgaacgggccccgcgcccgggtgctcgtcctcggcggcggcgacgggctcgccgcccgcgaggtgctgcgctaccgggacgtccgctcggtcaccgtcgtggagctggacccggccgtcacccgactggcccgcacggaccccgccctctccgagctgaacgaccacgccttccgcgactcccgcgtctcggtggtcggggcggacgcgttcccctggctccgggccgaccgggggcgctacgacgtggtgatctccgaccttccggacccgggcatcaccgccagtacgaagctgtactccgccgagttctacgggctggtcgcggaggccctggccccgggcgggcggctcgtggtgcacgccgggccgctgggggcccggccgcagaccttctggacggtggaggcctcgatgcgggcgggcggcctcgcgacccgtccgtaccgggtcaccggccggtacgcgggcctcgccgcgagtccggaccggggcggcggcgaggaccgggagcgggaggactggggttttctcctcgccggcgcggacgcggcaccgcggcccgcgctggccgacggagggccggtaccgcggtcgctgggcggccgggaactgcgcgagggggcgcgggcggcggacgacgcccggctgccggggctgatcccgtcgacgctgatccatccgcggtactgggaggacgtgtgagcccgcacgggggcgcggccggggggcttcccggcgcgaggcccggctttcggcggacggaagcgctgacgtccgggccggggccgattaggctcggtttccatggagcatgaggtgttcgttccggttcccgtcccgactctgctgcgcgcgctgggcgatcccgtccgggtcgcccgttgcgttcccggcctccagcaggacgccgacgcgtcggcgtcacccctggcgggccggctgaggctgcgggccggcggccacaccatcacctaccggggcgagctgaggctcaccggcccggaaggccccggcggtgcggaaggtcagcgcttctcggtgaccgggcagggcgtcgaggcccggggcaccggtgcggtcgagctggccctgaccatcggcctcacggaggcggacggcgggacggcgctcgcctacagcggcacggcgagcggggacggacggctggtcgagctggaggagggcgcggcgctcgcggccgcccaccggctcctggaccgcttcacccagcagttggtgacggagtcgctggcggtgcgggacgaggacgcgggcgagaagagcggcggcggcgacgggaacggtgcggtggccgccgaggggcttgagggcgacgaggacgcggccgacggcggcgggggcgaaggccgctctcccgaggcggaggccgaggcggaggcggagatcgaagaggagacggagatcggggccgaggtcgtcgatcccgatacggaggagtccggttccgtgttcgactcgcccgtgccgccgccctcgctcgatcccgtcgccggggtggagttcaccgttccggacgaaccgcccgccgaggccgcgcacgcccgccgcaccatgatcgggcgcagcgccgaggaggtcgaccacgcgcctccgaggggccgctacgcccccgtgccctccccggaggcgggcggtgcgagcacgaccctgcggtgggtcgctcccgccgccgccctcgcgctcgcctccgccgtggtgctgggccgcgcgttgcgacgccggaggtagcgggcgcggaggcgggggcgggccagtagggtcgtcgggtgagcaggagcgaagagaacgtcaggctgaccgtcggcgctgccgagttgaccgtcgaccccgtgcacggctgccggatcagcagcctgcggatcgggggcgacgaactgctccggcagggcgagcggtacggctgcttcccgatggtgccctggtgcgggcgcaccgggaacggggagttccgcaatggcgacgagctccaccggctgccgctgaactccccgccgcacgccatccacggcaccggccgggacacctcctgggaggcggcgttcacggccgccgacctggaagaggggcgtgccgctttctactacgacctcgccgagccctggccgtaccggggccgggtgacgcagaccttcgagctgaccggggagtcgctgacgctgggcctcgccgtcgagacgtacggcgactccttcccggcccaggccggctggcacccgtggttcctccgcaccatcgacggcgtggacgccgtgctgtccttcgacgccgcctggcaggaggagcggggcgcggaccatctgcccaccggccgccgcatcgaccccctgcccggtccgtgggacgactgcttcggcatgcccgacggggtggacgtgcagctcacctggccggagcggctggagctggcggtgaagagccgcagcgagtgggtggtcgtctacgacgagcaggacgaggccgtctgcgtcgagccgcagtccgggccgccgaacgggctgaacaccgctccccggctggtgaccccgatcgatccgctggagatcacgacgacctggagctggacgcggctctgagccggtccccggccgtaggcccggcccgtaccgcttaccctcgtggacatgactgacgtacgcgctgacctgctccagcagatcaaggacaaggccgtggtgcacggcaaggtgaccctctcctcgggtctggaagccgactggtacatcgacctgcgccggatcacgctggacggcaaggccgcgccgctggtcggccaggtcatgctcgacgccaccgccgagctggactacgactgcgtcggcgggctgaccctgggcgccgacccggtcgccacctcgatgctgcacgcctccgccgcccggggtaagagcctggacgcgttcgtcgtccgcaaggcgcagaaggcgcacgggatgcagcgccggatcgagggcaccgacgtgaagggccgccgctgcctggtcgtcgaggacacctcgacgacgggtggttcgccgctgaccgccgtcgaggcggtgcgcgaggcgggcggcgaggtcgtcgccgtcgccgtgatcgtggagcgcggtgccgccgcggccatcgccgaggccggtctgccgtacatccacgtctactcggtggccgatctcgacctgggctgaacccgggacggacggtttcacgtgaaacagggtccgccgagtggagccggatgaggagtctgggaagatgggggcgacgatgacgtcgcccccaggtcagggactcaaagcctgcacacccgcacatcccaaggagcggtcagatgcccatcgcaacccccgaggcgtacgccgagatgctcgaccgggcaaaggcgggcaagttcgcctacccggccatcaacgtgacctcgtcccagaccctgcacgccgccctgcgcggtttcgcggaggccgagagcgacggcatcgtccagatctccaccggtggtgcggagttcctgggcggccagtacaacaaggacatggtcacgggtgcggtcgccctggccgagttcgcgcacatcgtcgcggccaagtatgacgtcaccatcgcgctgcacaccgaccactgccccaaggacaagctggacggttacgtacgtccgctgctcgacgtctccgcggagcgcgtcgccaaggggctgaacccgctgttccagtcgcacatgtgggacggctcggccgagaccctcgccgacaacctggccatcggccaggagctgctggccaaggccgccgccgccaagatcatccttgaggtcgagatcaccccgaccggcggtgaggaggacggtgtcacgcacgagatcaacgacgagctgtacacgaccgtcgacgacgcgctgcgcaccgccgaggcgctcggcctgggcgagaagggccgctacctgctggccgcctccttcggcaacgtccacggcgtctacaagccgggcaacgtcgtgctccgtcccgagctgctgaaggaccttcaggccggcgtctccgagaagtacggcaagccggccggcagccagccgttcgacttcgtcttccacggcggatcgggctccaccgccgaggagatcgccaccgcgctggagaacggcgtcgtgaagatgaacctcgacaccgacacccagtacgccttcacccgcccggtcgtggaccacatgttccgcaactacgacggtgtcctgaaggtcgacggcgaggtcggcaacaagaagacctacgacccgcgtacctggggcaaggccgccgaggcgggcatggccaagcgcgtcaccgaggcgtgcgggcacctgcgctccaccggtacgaagctgaagtagtcacccgtccgcacggacgtacggtgtcgggcccggtcctccttcagggggccgggcccgttgccgtgccgggagagagaagaggccccgctgtgggtgcgacttacgatttcgacaccgtcgtcgaccgccggggcacctggtgcgtccagtgggacggggtcgcggaccggttcggggtcgacgggctgctgccgttcaccatctccgacatggacttcgccacggctcccgaggtcctggccgcgctccgggcccggctggagcacggggtgttcggctacaccacctggcagcaggacgacttccgctcggcgatagcccactggtacgcgacccggtacgacaccacgatcgacaccgggcagctggtctacggcccgtccgtgctcaaccagctctcccagctgctgcggatgtggacgggggagggggacggcgtggtcgtccacacccccacgtacgacggcttccgcaaggcgatcaccgggctcggacgcgagctgcggggggtgccggtgggggacgaggaggcgctggagcgcgagctgtcccggcccgacgcgaaggtcctggtgctgtgctccccccacaacccgacgggccgggtgtggacgggcgacgagctggcgcggacggccgcgctggccgagcggtacggggtcgcggtgatcagcgacgagatccacgcggacttcgtgcacgagggggacgtggggcgcgtccatgtgccgtggacgcgggttgcgggcgccgggcggtgggcgatcgtctcctccggatcgaaggccttcaactttccggcgctgaccggttcgtacgggctgatcggcgatccggccgaccgggcggagtacgtgcgccggatggagacgggggaggggctggcgtcgccggccgtgctgtcgttgaccgcgcacatcgcggcgtaccgggagggcgcggcgtggttggacgcggtacgggcgtatgtggcggggaacctgggtcacgtggcggagcggctgggcgaggccttccccgagctggggtgggagacgccgcaggccgggtatctggcgtggatcgatctgcggccgctgggggtggacgacgaggcgttgcagcgggtgctggtggagcgggaaggggtggcgatcatggggggttccgtttatggggcgcccgggttcgtccggctgaacgtggggtgtccccgggagaaggtggtgcggggggtttcggcgttggtgcgtgcggtgggggc

SEQ ID NO: 3232 - DNA, 7146 bp, Unknown
  Kingdom: Bacteria, Phylum: Actinobacteria, Class: Actinobacteria, Order: Streptomycetales, Family: Streptomycetaceae, Genus: Streptomyces
  misc_feature (386)..(450): n is a, c, g, or t
  misc_feature (842)..(843): n is a, c, g, or t
ccggtccgtacggaccgggtggaggtcgccggctggcagttcgacgtgctcgacatcgagcatcaccgggccgaccgggtccggatcagcgcgcccgcaccggcgccggccctcgtggaggaggacgcccgatgaccgccgtacagctcgccatcggcgcgctcaccctcctcaccaacgcgttcttcgtcggcgcggagttcgcgctcatctcggtccgccgcagtcagatcgaaccgcaggccatgaggggcagccgacgcgcgaagagcgccctgtggggcctcgaacacctgtcggccgccatggccaccgcgcagctcggcatcaccatctcctccctggtgctgggcgccgtcgcggaaccggccatcgcccatctgctnnnnnnnnnnnnnnnnnnnnnnnnnnnnnnnnnnnnnnnnnnnnnnnnnnnnnnnnnnnnnnnnnctggtgggcctgacccgggcgctgcggccggtcatcttcggcatcaacgccttcgccaacatgctgctgcggctgctcaaggtcgaccccaaggacgaggtcgcctcggtgttcaccgacgacgagctcgtgcggctggtcaaggactccagcgacgcggggctgctggccccggccgacggggagcgactgcgggacgcgctggagctcgggacccggccggtcggcgaggtgatggtcccgctgaaccggaccgtcaccgtcgacctgggcatcaccccgcagggtctggagcgggccgccgtcgcctcgggcttctcccgactgccggtcaccggacccgacgacgggctgctgggctacttccacatcaaggacgccctcggcgtcgnngtcatcggcttcgtgaccatggaggacgtactggacgagttggtgggggccgccgcgctctgaccggcccggcggtgaacaccaccgcgcgaagcggaagaagaggcggcccgtcgcacgacgggccgcctctcacgcttcccggcggaggactccaccggtcccgcccgagcgcgtaagctcggcgaatggccaagtacttcgacgtgcaccccgcaaatccccagccccgcaccatcagcacggtggtcaacagcatccggtccggtgcgctcgtcgcgtacccgaccgactcgtgctacgccctgggctgccagttgggcaaccgtgacgccctcggccggatccggtcgatccggaacctcgacgacaagcaccatttcacgctggtgtgccacgacttcgcgcagctgtcgcagttcgtccgcgtggacaacgacgtgttccgggcgatcaaggcggcgacgcccggcagctacaccttcatcctcccggcgacgaaggaggttccccgccagttgctgcacccgaagaagaagacggtcggcgtgcgcatcccggaccacgtcgtgacccaggcgctggtcgccgagctcggcgagccgctgctctccagcaccctgctgctgccggacgaggaggagccgctgacgcagggctgggagatcaaggagcggctcgagcacgaggtggacgccgtcatcgactcgggcgactgcggcaccgagctgaccacggtcgtcgacttctccggcgacgagcccgagatcgtacgccgcggagccggggacacgtcccgcttcgagtagcccgtccggcggccggacccgccgcgccctcggtgtgcgctgtccgccgtaccggccccgatcgatccgcccgtcgcccttcgggtccggttccgcccgcgcggcccctccccggtgcgtgtcaccacaacggtggaactcggatccgccgagcggtgaggcccgccccggcccccggggaggggccgggagccttttccgaagcggcttcggcccaccgccggagggggcgggccggggatgcgagggtgcggggcgcgtcgcagggtggacccatggcaaatcccccgatcgtcatccaccgtccgaccccctcgggcggccgccgggtgaccgtgcactacgaaggccgggacgagatactcgggctggcccacagcgaccacgacgtgatcgtgttcctgaacgaggccggcctcgaagaagcggaccggatcctcgacaacccggtctgggtggagtggcgcggcgggcgggcccaccgctacgaggcggcctgaggggccgcaccacccacacctcccgcgccgcgcagcccgtcgaggagggccgaaaccgtctcctcgggcgtctgaccggatgtgtccagccacagaccgatacggggtgttccgctccgcagatacgcgtcgaacgcttcgaccgtccaccccccgtaccccgtcttcaccctcgcctcctccctctcgcgcacggtcccgggtgagggggtgagcacgacgacatggagcggacgggtgcggaccctgccgatgtagcggggcagatcctcgccgaggacgatgtcctgcacgacggccgtgaatccgtcgtccgcgtaggtgtcggccacctgtgccgagagccgctggcgcaggtcgagctggctccgtgcctcctccgcctcgtcgggtgtcatctccgcacggccggagacgatcatgcggcggaagacgtctccgcgcacatggaccgctcgtggcaggctctccgccaggagttgggcgacggtggactttcccgcggccatcactccggtgatcagtacgacacaggggccgaggtcggcggccatccggttctcctcctcgttcgatcgtgcggtcggtgtcacgtcgtgcccgccggggtggactccgggctcccgaacagttcgcggacctcctcggcgtcggtctcccgcagcgcgtcgtccagcaggatccagcgggtgacgcccacggattccaggaacggcagatcgtggctggcgatgacgagcgcgccctcgtaggactccagggcactcgtcagctgccgcacgctggccagatcgaggttgttcgtcggctcgtccagcagaagcagttgcggggcgggtgcggcgagcatcgtcgccgcgagggcggcccggaagcgttcgccacccgacagggtgcccgccggctgctccgcgcgggcccccttgaagaggaaccgggcgagctgggagcggatctggttgtcggtggtgcccggggcggtgcgggcgacgttgtcggcgacgctcagcgcgtcgtcgaggacgtccagccgctgcgggaggaacttcagcggcaccgccgccgtggcctcccccgttttcggtgcgagctccccggtgagcgcccgcagcagggtcgtcttgccggctccgttgcggccgaccagggcgatgcgttcgggtcccttcacctggaggctgccctcgcgcagccgtccgtaggggaggctcaggtcccgtacggtcagaacggtgcggcccgcgggtaccgcggtgtggggcaggctcaccttgatctcggcgtcccggcgaatggcttcggccgcttcctccctgcgctcgcgggcctcgtcgaggcggtcctcgtgcaggccgcgcagccggtccccggactcctgggcggatcgcttgcgttccccggcgacgatgcgcggggccttccgctggccgtccagcttcttgtcgtggcgctggcggcgggccaccttgatccgggtctcctccagttcgcgctgctggcggcgtacgtcggcgtcggcggcgcgcagcatccgcccggcggcctcctgctgggtggcgagggcctcctgataggcggaccagccgcccccgtaccagttgaccgagcccgatcgcagttcggcgatgcggtcgacccgctccagcaggtcccggtcgtggctgacgacgaccaggatcccggaacgccaggagtcgacggcgtcgtagagcctgcggcgggcgaacaggtccaggttgttggtcggctcgtcgaggaggaggacgtccggacgttccaggagcagcgcggccaggcccagcaggacggtctccccgccggacaactgcccgacggtgcggtccagctcgacggcgccgagcccgagggagccgagggtggccagggcgcgctcctcgacgtcccagtcgtcgccgaccgtctcgaagtgttcctcccgtacgtctccggactcgatggcgcgcagggcggcccgccgctcggcgatgccgagggccgcgtcgacgcgcagggtggtgtccagggtgatgttctggggcaggtaggcgaggtttccgccgaccgtgacggacccctcagcgggttgcaggagtccggcgaacaggcgcagcagggtcgacttgccggcgccgttggctccggccagaccagtgcgaccccgggggacggtgagggagagcccgtcgaagaggttcgtaccgtcgggccaccggaaggtgaggttggaagctgccacggaggcgccgggcgcggtgggatggctcatgtggttctcgcagtcggaagcgggaggaaaggggggcttcgtatgcgaacagcacgcggcgacccggcccgggggccggaaagtggtgggaagagcagtcctgcgaaggtgaggaacggctcagcaccgaggtcgcatccacgcggaagtcacgggcggcagaaatgccggcagcgtcgtgaccgtgtacgggccagggccgtaccgcgcgatgatcgcggacctcagatgcgcaacgtccacctctatcggagacaacaggacgcgctcagcgtagccgaggatcttgccgcgcgtcgagcggaattgttcagggagcgttctgcggagccggcacaggggaggtggtggacgcgggggtctcctcgtgctctgcggggtcagcggggttccgctggccgggcagttgcacgccgggcggcacgacgggggtccgccggagcgcgagagtgccgaggacggcggcgaggccggccaggacgaatccgtagggcggggtggcgcccatggggtgggtctcgtacaccagcgccgccgagagcacgatcaggacggcggagaggcggccgtactgttcggtcgcggcgacgacggccatgccccacagcaggtaccagggctggaccatgggcgagagggcgaccaggacgagcagcgagaggcccagggcatgggccggtgacacgctgccccgcagcgcacgccgggccagcacgacgatcacgccgagcgctgccgcaaggcccagggtctggacggcggacttgaccggctccgcgtcgacgcccaggagcaggtgggccagctctcccagtccgaggccgatgtcgctggtggcggagagcgcggtgtggatgttcgcggcgacgccctgggtgtggagccagccgaatccggtgccgctgatcagcgtcgcccctccggcgacggcgcaggcgatcaggccgggcgcgagcagtcccttggcccagcggcgccactgggggccggtcgcggacgcgtgcacgagaatcccgatgaacaggagcgccacggccgccggtgacttcaccatcatggcgaggccgaccagagcgctccccgcgatccatctgccgcgcagggcgagcaccaggcctgcgagcatcagcccgatcatcagcccgtcgttgtgcacgccgccgaccacgtgcatcagcagcagcgggttgagggctcccagccacagggcgcggctctcgctgcggccgtgttcgcgcgccaggcggcgcagggaccagacgatcagggcgagggagacgagcgcgacgatccgcatcgccaggacggcggggacgatcgttccgccggtgagccaggcgacggcagcggagagcagcaggaagagcggtccgtacggggcgggggtgtcgcgccagtggttgccgacgctcgcggcggcgtcgccgccgattccgccggggtccagggcggaggggccgacggtgtagacgtcgtgcccttcgatgaccatcgctccctgggcgatgtagctgtagacatcggcgctgtagagcgggggcgcgagcaggaacggggcagtccaccaggcgagggtgacgagggtctcgcggatggtggaggcggtcctgccgtactgccaccaggccacgacgagcacggtcagtccggcgtaggcgaggacggccgccgccgccttcgtggcggacccgtggtcggtccacaggccccaggggtcgtggaccggcagctttccggcgaaccagccgccgccgacgatcgccagagatcctgccgtacccagccgacggtgcccgaccgcgctcaaagcccacatgaccggccaacctatcggacggcgcggcccggctcgcagtccgctccttcggcttgcccggcgttccgccgggagcgacaccgtgccgcatcggctcccggccggccgtcgggtcgttccgcgcgacggggttcaacgccgtgcccgcgtaaatctgttggcacccggacgcgtgcgtgccaggcttcacccatcaccaaggggcgtagctcagcggccagagcggcggtctccaaaaccgtatgtcgcaggttcgattcctgccgcccttgccatcaccacccggcccttcaccgcacgtcgccccgccagtcccactggtgactgtccggcgaccgcgggccgtactcggcacgtcctccgggcccgtaggcgccgatctcggtgaccagcccgacgccgtcgcgcagctccgcctcgccccagccggtgacgtcgagcagcagcccgtcgagcgggccgccgaccagctctcggtagtcgtgacccggcctcggcccggggcgggggtcgtcgtggtcggtgccgtacacccgtcgctgcctcatcagctcgtccatgcgggcagcatcccaccgggcactgacaacggctcggtacgagggtccatccggccagcgtccgccgcgtcccgccggtccggaccggcgggacgcggccgccggaaatgggcgcgcgcccgcccgtcggccgtgacacgctccaccgatgaccctcccaccgcgtctgatcccgctgctggagcagttcgacttcgcctgcgagcggctcctcgcccgcctcgccggtcccgccatggacagcggcaatggcgtcgacatcggcgtcacgccgctgggcgacgacgaacacctctgggaacccgtgcccgactgctggtccgtacgccctcgcggcgaccgccccggggcg

SEQ ID NO: 3233 - DNA, 2408 bp, Unknown
  Kingdom: Bacteria, Phylum: Actinobacteria, Class: Actinobacteria, Order: Streptomycetales, Family: Streptomycetaceae, Genus: Streptomyces
gtgaccgggcacgggtccaccgtcgccgagcgccgcacggccgccatggccgacgccggggtgcagtggacccgtgcccggtcacggccggcggggactcgggcacgatccggaacggttcgcccccggtgtgccagtcgaccgtcccgatcggccccgtgtacgccgtcccgatcggcgcggtgtacggatcggtcgtcatacggtgaaccccgtcggataggggtccgtggggtcgagcaggtactgcgcggtcccggtgatccaggcgcggccggtgacggagggcagtacggcgggcctgccgccgaccgtggtctccgccaggatccggcccgtgaagcgggagccgatgaaggactcgttgacgaagtcctgcccggtcttcagcagtccccgcgcgtgcagttgggccatccgggcgctggttcccgtcccgcagggcgagcggtcgaaccagccgggatggatggccatggcgtgccgcgagtgctcggcggtcgagccgggcgcctccagatagacgtggtggcagacgtcgatcgcggggttctccggatggaccaccgggttccgcgcgttgatcgcccccatgacggccaggcccgcgtcgagcagccgtcccttctccgtccggtcgaaggggatgccgaggtcctcggtgcgcacgatggcgtagaagttgccgccgtacgccatgtcgtagcggaccgggccgaacccctcgacctcgacgacctggtccagcgcgtggctgtaggaggcgacgttctccagggtgacggactccgcgcggccgtcgcgcacggcgacccgtgccgtgacgaggccggcgggggtgtcgaggcggatgagcgtctccggttcgaccgcttcgaccatgcccgtctccacgagcaccgtcgccacgccgatggtgccgtgaccgcacatgggcaggcagccggagacctcgatgaacaggacgccgaagtcggcgtccggccgggtcgggggctggaggatggctccggacatggctccgtgcccgcgcggctcgcacatgagcagggtgcgcagcccgtcgcgctgcgccaggaaccgctgccgtcgctcggccatcgtcgcgcccggcaggacgcccaccccgccggtgacgacccgggtcggcatgccctcggtgtgcgagtcgaccgcgtggtaacagaccgtggagcgcacgtcagttcacccccgcgtcgatgagggcccgggtggcggcgcggacggcggtctcggtctccgggtccagggcctgccggggcggacggcagaggccgccgatgcggccgatcatgtcctggccgagcttgatcgcctggacgaactcggtcctgctgtcccagcgcagtacggaatggagctgccggtagagcgggagcgcggtgtcgaggtcgccggccagcgaggcgttgtagaggtcgaggcaggcgcgcgggaagacctgggggtagccggcgacccagcccttggcgccggcgacgccgacttccaggagggtgtcgtcggtgccgacgagcaggtcgagtccgggggcgagttcgttgatggcgtaggaccggcggacgtcgccggagaactccttcacgcccacgatgaatccctcggcgtgcagcttggcgagcagctccgggcgcaggtcgaccttggtgtcgatggggttgttgtaggcggtgacggggagtccggcggaggccaccatcgcgtagtgctccagaacggcacggtcgtcggcccggtaggagttgggcggcagacacatgacggcatggcagccggcgtccttggcgaaccgcgcgtgccgcctcgcctcgatcgcgccgtacgctccgacgcccggcatcacggtgaagccctcgggggcgttcgccacggcggtctccacgacgcggtcgcgttcctcgtacgtcagggtctggtactcgcccagcgagccgttcggggcgacgccgtgcaggccctgttcggcgagccaggcgacattgtccccgtaggcaccgtgatcgacggcgaggtccgggccgaacgggagactcgtcgcgacgatgacgccgtgccagggcatgcgggcgggaaggggggtgcggtccatgggaactcctcagctgggttcggcagtgggctcgccggaatcggcgagcgcaccgagggtgacgggggtcgcgatcagccgctcggcgggggcgtacggctggtcgccggagacgaggcagtgcacggcgggcccgcacatccggccctggcaccagcccatgccggctctggtcagttgtttgacctgccggtggtcggccgccgcgtcatcggcgcgggcggcacggaccgctcccgcggtgacctcttcgcaccggcagaccggtgtgtcgtcggtcagccacgcgggccaggcc

SEQ ID NO: 3234 - DNA, 2020 bp, Unknown
  Kingdom: Bacteria, Phylum: Actinobacteria, Class: Actinobacteria, Order: Streptomycetales, Family: Streptomycetaceae, Genus: Streptomyces
cctcggcacctggaccctgctcaccctcgcccgcacccgcgacccgaagggcctgcgcgcctgggcgggcggcttcgccgagggcgtccggaccccgtgcggcgagcggcgcccgatgcgctggtccacggtgtggcagatgacccggctgggccggccgccggtcatctgacagggggaacaccgcgccgaagccgtgcacgggccgagccgccccggtggggcgcgcggcggccggggccgggtgaagcggcagacgagtcgggctgtacgccgggttctgtctcccggtcgcctcgcggcggccggggagacggccatccatctaggaccggcattgctgccggcctcgtgcggtctacccgtgaactcgggcgagcagccctcgaacgttcacgcagggccgtcccatttctggggcgtcccctcttgaccttgctccgggtggggtttacctagccgcctgagtcacctcaggcgctggtggtctcttacaccaccgtttcacccttacccgggaccgaggtcccgggcggtctgttttctgtggcactgtcccgcgggtcaccccgggtggccgttagccaccaccctgccctgtggagcccggacgttcctcgggaggaccccgaaggatcctcacgcggccgtccgcccggctcgtctgccgtgccgcacatactaccgggaggagacaccgggtcgaggcgcccgggacggtgcttgaccttgtcgcggcgtcaacgtttctactggccgcatgcgtatcggagagatcgccgcgctcgtgggagtcacttcccgagccgtccggcactaccaccacatcggcctcctgcccgagcccgcccggcaggccaacggctatcggacgtacacaggcggcgggcctgcgggcggcgcgggtggcggtgtgggcggtgctgcccggggaggtcgcgctggcggtctgtccggtggccggggtccggatacccggtgccgttctgctgggggccgaggcgctggtcgtgggggtgctcgcgctggaggcgtacgtgatgtggccgctgtacgcggcacgtcggcgggccggcgacacgcggcgggaggccgggctgtccgcggtgcgtgccttggtgccggtggccgtgcggcggctgctggtgcacgagttcaaggcgctgcacagtctcgggctgtgggtcctgcgccgccgccaccggattccggaggggacccggccgctcccgtacaccgaaccgcagaccgggatcatgtgggcgttcgtcttcgtctccgtcgtggagaccgtggtgctggccctggtgatcccctggccgctggtccacacgatcctgctcgtggtggacgtgtacgggatcgtcatcgtcctcgccctgcaggcggcctgcgtgacccggccgcacctcgtggaggcggacggttcgctgcggctgcgctacggcgccctgttcgacctgcgggcgcccgccgccgtgatcgccgccgcccgggtggagcggcgcttcccgggcggggggctggtccgggtggacgaggacgggacgctcgatctggcggtggggagccggacgacggtgaccgtggaactgacggagccggtggagttcgtgcggccgctcggccggcgcgggagcgcccggacgctccgcttccacgccgacgacccacgggcggcggtcgcggcgctcacgaaggccacgaaggaccggacagcgccctccccggtcgcgtcggagcagacagcaccgactgccctcacgccggagcgaacagcaccgtcttcgacgccggacccgcctgcgtgagccggacccgcagcggctcccccagcgggagcggggccgtgccgccctcgatccggccgacgatcgccgggtcccggaggtggaccgtgccggcggcggggtcgcgttcctggatgtcgacgacgtacgcgtcgaagagctcgcccacgcgcccctccagcagcgccgcctcgaccaggtcgacgcaggaccgctccacggtgccggcg

SEQ ID NO: 3235 - DNA, 15307 bp, Unknown
  Kingdom: Bacteria, Phylum: Actinobacteria, Class: Actinobacteria, Order: Streptomycetales, Family: Streptomycetaceae, Genus: Streptomyces
gaggcagcgggtgaccagggggcgcagggcgtcggggaggcggctgaggtcggggtcctcgtggacgatgcggtagaggacggcgtgcgaggggccgtcgccgtaggcgggtgcgccgatcgcggcgtaggcggcgatctggccgagggcgaagacgtcggtggccggggtgacggtacccaccgccgcctgctcgggtgacatgaacgccggggtgccgacgctgacgccggtgcccgtgagggcggtcgtgtcggcggcccgggcgataccgaagtcgatcacccgcggcccgtcggcggccagcaggacgttcgcgggcttcagatcacggtgcacgatccccgcaccatggatgaccccgagcgcctccgccaccccgacggtcagcaacagcacactccgcaacggcagcccgccgtgccgggccaccgcgtgcgcgagcgagggacccggcacataagccgtcgccagccacggctgcgccccctcggtgtccgcatcgatgaccggcgccgtgtacaggccctgcacccgctgcgcggcccgaacctcctgctcgaaacgccgccggaactccggatcctcactgaactccgcccggatcaccttgatcgcaagaggacggccaccgggcgtgtacgagagatacaccttgcccatcccgcccgcgccgagcacggcggccagccgataaccccccacaacagccggatcgtcggccttgagcggctggaacgggtcggtcgaaggtgcgctgctcataaggaaccatccccctggtcacggcagtccggagcctgcacacgccccgaagatcagacgagagcgtaccgaatgccggggcgggtccggggcctggccgcttcgcagaggtgacacggcggcgtacggtccgtaccgggggcgggccgcacacccttccggcgcggcggctggccctcccggggtgctgacgtccccgggacggcgcctcacccggtgacgatgccggcgaccaggttgatcgtggtggccaggatgctcgcgccgaagacgtacgacagcaggcagtaccggcatgaaccgggccgacatgcgcgaacgcgggatcccggacatgggacccgtcgacatcacgagcacggcgaaggacggcagcgagaggttcttgaacggctgcacggcgatcccgtacgacatcccgcgcgactgcgcggccggctacatgcccgagatgaacgtgctggtcgctctgggcgactacagcacccagagcgaccagccgatcatgaagcatgtcagggtgacgatcgtcccggccgccgcctgaccgtacacccgtcgatcttctccgcgtccgggcggcggggcatgccccggccgtgaccggtctcggggtcgtcctcgacctctccgttcgacttgtggtggcgatgggtcatcggtcactcctcgccggcgggggttgcgtcagccgcggcggcctcgggggtcttcgcggcgccgtcgcccttgcggatcgtgcagtgcagggagtcgtcgaccacgtcggcgacgatcgtgtccccggggtcggcctcgccgccgagcagcagggaggcgacgcggttgtccagttccgtctggatcgtgcggcgcagcgggcgggcgccgaactccggctggtagccgtgggcgacgagaagctccttcgccgcttcggtgacctccagcgtcattccctgggcgtgcacgcggtgcttgctgcggtccagcaggtgcccgacgatctcggacaggtcggcctcggtgaggctgtggaagacgatgatgtcgtcgatgcggttgaggaactcgggcaggaaccggccccgcaggtcctccatcagctcgtccttgagctcggcggcgtctccccggtgggcgaggatgcggtgggcgccgatgttggacgtcatgatgacgacgcagtggcggaagtcgaccgtacggccctgtccgtccgtgagccggccgtcgtcgaggatctggagcagcgtgttgaagacgtcggggtgcgccttctcgacctcgtcgaacagcaccacgctgtaggggttgcgccgcaccttctcggtcagctggccggcctcgtcgtaaccgacgtatccgggcggcgctccgacgagccgggcgaccgtgtgcttctcctggaactcgctcatgtcgaaccggaccatgcggtcgtcgtcgccgaacagcagctcggccagcgtcttggcgagttcggtcttgccgacgccggtgggcccgaggaagaggaacgagccgacgggcctgttcgggtcacccatgcccgcgcggttgcggcgtacggcttgggagaccgcggtgaccgcctcgtcctggccgacgatcctggcgtgcatctcctgctccagtttgaggagcttctccttctcgccggcggtgagccgggagaccgggatgccggtgcggcgggagacgatgtcggcgatgtcggaggccgtgaccgagacgacgccctcgcggcgttcctcgatcccggcgagttccccctccacctcggcgatctgccgcttcagcccggaggccttctcgaactcctcgccggcgacggcctcgtccttctcgcgccgcagcttggccaggcggtcctcacggctgacgacctcggtggagcggttcgcgctgcgcagccgtacgcgggccccggcctggtccatcaggtcgatggccttgtcgggcaggaagcggtcgctgatgtagcggtcggacagctcggccgccgccgtcagggccccgtcggcgaagcggacctggtggtgggcctcgtacgcgtcccgtagcccttcgaggatctgtacggtctcctcgacggtcggctccgggatcaggacgggctggaagcggcgctccagggcggcgtccttctcgatgtgcttgcggtactcgtcgatcgtcgtcgcacccacgacgtggagctcgccgcgtgcgagggcgggcttgagcatgttgcccgcgtccatcgagccctcgcccgtcgcgcccgcgccgacgaccgtgtggagttcgtcgatgaagaggatgatctccccgctcgcctgctggacgtcctcgatgaccttcttcagccgttcctcgaactgtccgcggtactgggctccggcgaccatgccggacaggtccagggagacgacccgcttgtccttcagcgtgtcgggcacctcgcccgcgacgatgctctgggcgagtccctccacgatggcggtcttgccgacgccgggttcgccgatgaggacggggttgttcttggagcgccgcgagaggatctcgatggtctgctcgatctcctcggcccgcccgacgacggggtcgagcttccccgccttcgcctcctccgtcaggtccctgccgaactcgtccagggtcgtcgagggctgcttccccccgccggaagccccgttcccgcccgccgcccggtccgtggcgccgcgcagcttccccacgtccaggtcgtccgcgcccaggaagcgggaggccccggagtccgcgtcgtcgacgagcgcgcccaggatgtgctcgggaccgatgtaggacacccccgccgcctgcgagcgggcgtaggcggcggtgagggtccgcttggccgccggggtgagtccgggctcggcggagggttcgcccgcctcccgcggcagcacctcgtcgagctgcccggcgagggcgtcggggtcgaccccggcccgggagagcaggccgcgcgagggttcgacctgcgtcgccgcccacagcaggtgctcggtgtcgagatccgccgttccgtcgtcggccgccttgctcgtggcccgacccagcagttcgtgggaggactccgtcagcagccgcccgatcgggacgcgctgcacggccggcggcgacgacgcgggcgacatgccgaagaaccggttcaacaggtcactgaacggatcggacggaccgaggggtgaaccgaacgccatcgacatgtcagctccagggaggcggcgagggggctctcccactcaaacgcgatgtccaccgccccgcaaacggaaccggacccggccgcctgcccggccgggaacgggctactccgccatctcgtacgcccccgacagcgcctcgacgcgctcccagatccgcgccgaacgggccgcgtcgacgacgggacggcgtaccgcgcccagcgcccagctctgctgctcctcggtggcggagtccttgccgtgcagctcgacggcgtgtgcggagaagtcgcgtacgagcacggcgaacagttcgtccagcagttcctggtccaggccggtcagccgggcctgctccaggatcagctggccgtggacgacgagcgcgaacagctggccgacggcgaggaggaggtcgaggtcgcggctctgcttctcgtcgggggcggccgtctcgacgaaggcgcacagggcgtccgcctgctcgcggaagcgggcgacgttcggcacctcggcgtacgcgtcgaacgcggtgcgccagtcgtggaagcgtacggagccgaggccgcgcgccggtccctgccggaagaggaacgcgtcgtcggcggcgtcgaggcgggtcgggacggccgggtggtcgaccgggttcagcaggtggttgcgcatgaacttgaggatcagtgcgaggttcacgtggaccgtgccctccagcttcggcaggccccggatctcgacggcggcctgggcgaagtagttgtccttctcgaaacccttggcggcgatgacgtcccacatgaggtcgatcaccttctcgccctccgtggtcaccttcatcttcgtcatcgggttgaagagcaggtagcggcggtcctcgggtccggcggagcggaagtagtcgacggcgcggtcgctgaacagcttcatcccgacgagccgcacgtaggcgtcggtcagctcgcggcgcacgtgcgggaaggcggtgacgggacggccgtagaggatgcggttgctcgcgtgggtgacggcctcgtacatcgcgtgctcgcagatgccgatggaggcggtgcagaggttgaacttgccgacgttgacggtgttgagagcggcgtcgaaggcggcgcggccggtgtgcaggatgtcgtcgggggccaccgggtagccgtcgaggcggaactcgctgacgtacttcgaggagtcgacgacgttcttcaccaggtggtacgcctcgtggcggctgtcggccgcgaagaagacgtaaccgtcgggtccctcgacgtccgtgcgccggccgaagacggagacgagaccggcggcgttgccgttgccgatgtagtacttggaaccggaggcccggaagccgccgtcgacctcgctgtccggctccagcagcatgtcggtggagtagatgtcggcgccgtgggtcttctcggagagaccgaaggcgaacacctcaccccgggagaggagttcggccgcccggtcgcgggccgcggcgttgtcgctctgccagaccgggccgagaccgaggatggtcacctgccaggcgtaccagtagtccaggccgtagaacccgaagatctcgttgagtgcggcgatgcgggcggtgtcccagcgccggtcatcgttcccggcgttggaggccggggtgaggaaggtggcgaacagtccctccttcgcggagaaggcgaggaagtcgcccagccaggcgcgggagcggtagtcctcgatcagccggcgcttgccgcgctcctcgaaccagtcgacggtggcgcgcagcagcctgcgggtctccgggtcgaagtgctgggggtcgtaggtacgcgggttgaacagcaaggacgcggactcagccatggcggtgccttccgggaagggtgagggttctggtggttgcggggacggcggccggggcgccgttcagacgtccggccccgaagccgcgagccggttgagggtgtcgagtacgtcgtcgagccaggcgatcgtcatgcgctcgtacgcgatgccgccgcgcagcacgacgtgttggagctcctggcccgcgtccggcggcacgggggcgtcgggcccggtgaagtcgcgctgttccccggcgaggtagtgcgcgagccggtcccggtgcacctgatggtgccgctcgacctcgcggatcagggcggccgggtcgtcgaaggccgcaccccggatcttcacggcgaggtcgtgccggaggctctccggttcgatcggcttgtgcagccacgcggcgagggccgagcggccgggcgcggcgacgctgtactccttcttgtccggccggccctgctgcggcacctcacggacgaggagcaggccgtcggtcaccatgcgcccgagcacccggtagatctgctgatgggtggcggtccagaagtacccgatggaccgctcgaaccgccgggacagctcatagccggagccgggctgctccagcagggagacgaggatcgcgtggtcgagggccataccgcgatccttctatgcaactcgttgcatagacaagtcgtggagcccgggtgagacacggctcacccgggtcggggcgccctcaccggtaagatcgggagggccactggcgccacgccgctccctccgtgccgacgagcctgatgggtccacgccgcgcccgggaaggcgcgctgaatgacccccgaaccatcatgaagcgccgattcccggtgccctcgcggcctaccacgagcgggacgagctgggcttctcgccgccggccacgagtgggcccggggcgcctacttcgccgagagggaggacgtacgtacccgccgcgaacgccgtgggcgcacggacgggtcagggggacttggccgagcgtcggtcgaggtaggaggtcaccggggccgccgccgcgccgtggaccacgacggagatcaggacggcgaagacgacgaccgcccacatctccctctcgtacggcccgaattcgccctccccgaaggcgtaggcgagatagaagagcgagccgatgccccggatcccgaagaaggcggcggccgcgcgctcgttcgggcggcccggaccccgcaactgggcgagccagcctgcggccgggcgaatgaggaggtggagcagcacgccgaccgccgcacccctccaggtgagccgggccaggccgccggaagcgacgaaggcgcccacaccgaagaggagcagggccatcaacaggcgttcgatctgctccacgaaggcgtgcatcacctggtggtagccgtggctgtgctccgacctgcgcagcgcgcacgcggtggcgaacacggcgaggaagccgtacccgtgcagagcctcggtgactccgtaggacaggaaggtggccgccagcgccacgaacccctcgccctgttcggcgagccgcagcggcctggcgcgggaccggaagagcacccgtcccagcaggagaccgatggcgaggcccaccgtcacgcccacggagatccggacgagcacgtcgctccagacccagtgcgtcagccagcccccggcccagctctccccggcggcggcgagggcgacggccgcgaggacgaacgggaaggcgaggccgtcgttgagtccggcctcgctcgtcagcgcgaagcggacctcgtcctcgtcctccttctcggcggaaggctcccccacgcgcacctcggacgcgagcacggggtccgtcggcgcgaggaccgcggccaccaggagcgccgcggacaccggccagccgagcagcgcccagacggccgacgcggtcgccacgatcgtcagcggcatcgccagcccgagcagtcgccaggtagcggcccaggaccgccacccgaaagggcggtcgatggccaggcccgctcccatcagcgagatgatcacgcagagctcggtgaggtggtgcgccctgacgcggtcggcgaccgggtcgaccgcgggcagcggcagcggcgtcaggtagaggagtactccggcggcgaggaagacgatcggcacggagaccggcaggcgggagagcatccgcggcagcgccgcggcgaggaaggctccgatgccgaggcacgcgtacaccgcaccttcggtggtgatcgacacgtgcggtgtcaccctcctgtcgtgtcgtcaggccaggtcccgggaaacggtctcgttccaggtgcgggagaagacccggcgaccgtcttcgtagccgtccagggtggcgtcgacggtgaactcctccgcgttcgcggtcaggacggtgctggtctcgacccgcacgtcccagtcgggccgggagaacctcatggtccacgcggaccggccgctcggggaggtgaagtcgtcggcgacggaggtgtacctctcgcacgcccgcagccccacctcgatgccgttctcctcgtaccgctgcgtaccccggtccttcacgatgtcgagggccgagtggtagtccaccaggctcctggagacgttccaggcctgctcgggctcggtcagccgggtgacgggcggcggtcggcacccctccggctccccgaagtccgcctggggcatgccgtccggctcctcggtggggcgtacgggcagaaccagctcaccgccgtcctcatggacggtgagcaggacgggctccggcgccggccacaccaggggccagtacgaggtcgagagggagagccggacgcggtggccgggcgggaacgcctgcgcgaccccgttcagcgggatccgggcgtggtagcggcggccgggttccagtggccgggggtgctcatcgctctcgcggtgggtgaggttcagtacgccgtacgtgacgcgggtggcgcggccgtccggtgcgacgtcggagatcctggcggtgatctgggcgacgggggcggaggccgacacctccaggtcgacggagggcgagccgaggatctccatccgctcggcgagcggttcggtctcgaagaccagggagccgccgtcctcctcacgctggtcgtagggcaggtcgggcggcgcgttgtaggacgcccacttgccggcgaactggccgacggagagcggcgaccggaccgtacgcgtacgaccgttcacaggtggctcctcgtcgtccgccgtcacgatcgcggagccccgcagcgggtgcgccacttcgttgatccgcggtgagggccaggagggctcggcgacccagcggccgggtcgctcctcgtacgacgtggacggcgggacgctctcctgcatccaggccctgagcatcggcccctccatgaccccgttgtcgacgcccttgagccagtggtcccaccacttgacgacttcctggaggtaaccgatggccgggccgggctcgccgaggtgcggcagcttgtgggaccaggggccgatcagccccttgcgggggacgtccacgttggccaggagccgggtgacggcgttggagtacccgtcggcccagccgctggacgcgaggacggggcaccgcagccgcgcgtagtcctcgttgagcgaggcgtgctgccagtaggcgtcgcggtgcgggtggcggagccattcgacgacccagggccgggcggcttccagccgttcccgccacatgtctcgccaccgctcccccaccaccgcggggtcgggcgggcaggtggcgtacgcgaacatcgtgccggcttcggcgaggttgtcggagagcatggcgccaccgaggtagtgcatgtcgtccgcgtagcggttgtcggtgaacgaggcgatgacgatggccttcaggctctcgggccgccgagccgccgtctggagcgcggcgaaggcaccccaggagatgcccatcatgccggtccttccgtcacaccagggctgggcggcgacccaggccagcacctcttcggtgtcgcgctgctcctgctccaggtactcgtccagcagcacgccctccgactcgcccgtcccccgcaggtccacacgtacacaggcgtagccgtggcccgcgatgtacgggtggtggatggcgtcacgggtcgaggtgaggtcgttcttgcggtaggggatgcactccacgactgcggggaccgctcccccgtcggacgaggcgggccgccagatcctggccgacaggcgcaccccgtccgtcatggtgatggtgacgtggttctcttcccgcgtttcgtacgggagttgctcgacgtatcgcatacgggcggcggcttccttcctgacgtcgggtccggtcggggcgggtacccggggcgtcacgaagaattccggccgcgcccgcccggttccgtctcgtcgaaactcaggccgagggctgcgacgcacgcgtcgaacttgcggcgcaggtcgttctcgtcgtcgccgccggtgaagatgtgggcgacctcgtagctgtagctgtcctggcccttgaccgaggagagccgctggccctcggaagggaccatgtcgatgtggacacccgggatctcccgctcgatggcggcgatctcgtcggcggtcggcacctggtggacgcgcccttcgccgaaccagcggtagtaccacttggcggccatcctgtagcggcctccgccgggcggcagggcagggtcgccgcccagggcgagccggaacatccggtggtggttgggcacaccgtcgacgaacgcgaacaactccgcgtgcgactgggagtgccgggggttgatctccagcaggctgatgtcggcggtcttcgggtcgtagaagtactcgatgctgaaggtcgcggcgtccatgccgatctgtcgcatggtgcgttcgctgacctcgtgcagccgctggatcaccggggccgggagggcgctggggtactggtggcgcaggaacgacgaggagtcggggtagttgatcgaatcgagcacgccgtagacggtgacctcgccccggtgcacatatccctcgacggccacctggataccggtcatggcctcctcggccagacagacctgcccgccgactcccgccatctccggcggcagttccagaagatcgagtacggcttcgaagggctttcccacccgggctatcccgccgcgtatctcctcgaccgccgtccggaactccgtcatgtccgagacgccgaacgccagctcggaggagtaggccagcgcgggcttgagccacatggggaagctcatgccgtccggtggccgcggatcgtcgctgtgcagatccacccggccgaaacgggggtgttcgtcgatgaccttctgctgctccagccggctccagtacttgtgctcacacttgaccacggattccaggctggtactggtcgtgccgtactccctgctcagcatgggtacgagggtgctcacgggaaagtcccagtagccgacgatcgcgtcgatgtctccctcgtgcgcgtcgagcacggcacgtgcgcgggccatcagctcgtcgacggtgtggctctcctcctgcagctccttgatgctgagcagcggatggagacggtggccgtcggcgtccggaacagcctccagggtccgcagattcgcctcgtccattccgatgacgaatatgttcttgcgccgatctcggggcacaggatctcctctcgtgcaggtcgtccgggatctgcgccgtgtacccctgcgcgcgagttcaaacgcgatgcaccgaacagcgggccgaaaagggcgacttcccttcgaggatgtcgcggccccgggaattcagccccggggccggatccggccctcgggcgggacctcgccggtgatgctggcgatcaactcggcgcagagttcgcgcagtttgatgttgcggtgctgcgatgccgtgcgcagtacgtcgaaagccttttccggggagcagcgttgctggccgatgaccacgccgatcgcctggtcgatggcggtgcgcgatcgcagggcggcctccagatcggcggcgaactcctcggtgtccgcgatgcgctgggccagcgcgatggccccggtggcctgcgcggtgagcagtctcagcgccgtcaggtcggccgtgtcgaaggcgtgcggcaggggcgcgtacaggttgagggcaccggccgtgtggctgtggggcgcgatgggcagggacagtgacgaccgggcgccgcataccgcggcgtaggcggggtagtcggcccagcggctctcccgcagggtgtccggcacactgacctcgcggccggtgcgcatcgcctggaggcagggaccgtcgtcctgcccgtactgggcctcgtccagcttcgtggcgctggctcccacgctggagacggtgacgggacgtcccttccgctccagggtgataccgcagccgtcggcctcctccaccagggcgagggcgctaccggcgagggcgtgcaggaattcgtccagcgacttcgtctccaggagcagcgcggtcgtgtccggcacctcggccacgggcctgtcagtcatgatcatctcgttctgggcggtgacccgcctccggaaagggcggggcagagctgggcggcacggtccgggccgccgggacggggcagccgccacctacgcaccggcgccgagcgggctccgggcgtggggcggtgagggagtcagatggtgccgcgggacggccgacgaggggcgggcgtgccaccggccgtcgtgagaacggccgtcggcggggtgtcggcggggcgggacctcgtcgcgggaggcctgctgcgggccgcccgtgcaggagcgcgcggggcgccgaaagtaccggtggccggagccaggaggacggtgcggcgacgaggacagcggttcacgggacactccacggaggcaggaagaattctcaagggccgtttcctgacctccagcccttcattatgccctctcgcccggcgcggcccggcccggcctgtccgtccggatcagcccgctcggcgtccgccgcgtcaacgctcccccgggaagcgggggcgggaggtgtcggcgtacgggccggtcggcccctccgcgggactgccggaggacgccgcactgtgccggtcgccgcgcgtcccctccggggacgcccgcgattccggccggcacccccggctgcgtgactccgcgccctggagggtgggcgcgacccgcagtacgcggttgagacccgcggcgctcagcgcctcgcgggctgtgacgtgcccggccaccacggccatcgggaccccgcgttcctcgcaccgcccccgtacgcgcagaagcagtcccagggcacgcggtgtgagcaggggggtgcggatgtccacgatgaccgcccgggggccgcagcacggcagcaggcgggtgatctcgcgttcgatcgccgactcgttgtcgaggtcgaccgcctcacccagttctacgaccaggtgcgcggcgtcgaggtggtaactgagcaggaacatgggcactccaggtgagcaggactgagagcgcggccgcttcctgacctcggtatcgcgcgtatgcccgccccgcgacgctcgacacctgttgtccacggccgcccatggcggcaggggtggaaacggcgtccacgccccgggagcggcgcgtcgcggcccgtacagtgcgatgctggtcacagagtccaggcccggaaggaagtgaccatgaccgacgacggaatgctcgttccggggcggccggacctcgtttccctcctcctggaaaccgacaccctggacggattcctccaggccctggcccggagcgcgctggatctgtcacccacggcggacggctgcggtgtcacgttggagcgtcagaaccgcccgctgaccgtggcgagcgcgggcaccagcgccccgctgctggacgaggcccagtacggccaggacgacggcccctgcctgcaggccctgcgcgaggggcacgaggtcagcgtgagcgatatgcgcgaggagaaccggtggaacggctaccccgccttcgcggtcgccgccggcacccagtcgtcgctgtcgctgccgatcgcggcgcgctcccacacggcgggcgcactgaatctgtactcgcccaaggagaacggcttcgccgacgccgatctggacagtctgcgcgccctcgcggcccaggcgaccggggccgtcgcactggcccagcggctctcggacgcgcagaccttcaccgccgacctggaggcggccctccggtcccgtacggtgatcgaccaggcggccggaatcgtcatgaaccagcggcgttgcacgtccgaggaggcgctccggaccctgcgcaccgcgtcgcagcaccgcaacgtcaagctccgcgatctctgcgcgcagctggtcagcagcgtctccggcggccctccccccggtgactcccgtctgcgcccccgcccgtgacccggcgacgccaggagcgacaggacggcgccgcagggcatgtttggcttccgctgcgggagtactcctccaccaggtatccggcgtacgcggaactgaggcgccggccggtcggtaaaacagccatcggcgccgtccgccgccttcgcgtaggccactcctgagcacgcctccgggggcggcatcgcgacgtgcgttgtttagtggaatccgtacgggaaacgcgttggacgctctggaaaagggcgcgtcgccgcgtcgtcggcggtgcgattccgggcccgacgcccacggaagagagtggaggagcacatcatgcccgctggatccaacaagaagcgcgagcggcagtacgagcacatcaaggagagccaggaggaacagggcgcttcgaaggggcgcgcgaaggagatcgcggcccggaccgtgaacaagcagcgtgccaggtccggcgagtcggagacggcgagcaaaacctccacgcaggacaagaagtccgcctatcagcgcggcggcgaacgctcccacaagggcgcgcagggtcccacgaaggaccagctctacgaagaggccaagaagaagaacatcgacgggcgttcctccatgaacaaggaacagctccgcaaggccctcggacgctgacgcccggcggactctcctcgacgctcaggaacggccgcccacgacggaggaacaggacatgcccgcagacgcacgcggcgacgatgtgtaccagccgcaggacgacgacggacaggatccgccgaacgacgagctcgacctggagaacacgctcgacgaacgggatctggacgaccggatggaggagggctactcccctccggagcgccccctgggcgtgaccaagttcggcacgacgggtgcggaggagcgccgcggagagtccctggaccagcggctcgcgcaggaggtcgacgacgtggagacgcccgtcggcgacggcatcggcgacctctccgagggcgagggcgaacccctggaagggtccgaacctgagccacgggcaggccggctgaatgcggcggacgacgccaccggacgggagaacgacgtcttcgccgaggac

SEQ ID NO: 3236 - DNA, 4125 bp, Unknown
  Kingdom: Bacteria, Phylum: Actinobacteria, Class: Actinobacteria, Order: Streptomycetales, Family: Streptomycetaceae, Genus: Streptomyces
ggctaccgcgggggacgggttggagcggcctctcgtgttgtgggccccgtcactgccatacttaccaagccgtaggttacggaaccgtagccacggccgtccgcgcctcctccctcaccctcagaggtatccccccatgccgagcactccccatgtgatcgacgagaccgagccgcccggggccgccgaggcctcgctgccccccgccacgctgggcggagacaagaagcggtcgatcgagcagttcgcgctgctggcgttcatcgtggttccgttcgtggcgctggtcgcggcggtgccgctggcgtggggccggggggtgagctggctggacctggggctgatggtggcgatgtacttcatcggctgtcacgggatcacgatcggcttccaccggtatttcacgcacggttcgttcaaggcgaagcgtccgctgcggatcgcgctggccgtgatgggctcgctggcggtggagggacccctggtgcggtgggtggccgatcaccgcaagcaccaccggttctcggacgcggagggcgatccgcattcgccgtggcggttcggggagagtctgccggccctgatgaaggggctgtggtgggcgcacatcgcgtggatgttcgacgaggagcagacgccgcagcagaagtacgcccccgacctgatcaaggacccggcgatccggggtatctcgcgccacttcctctccttcacgattctctcgctggcgattccgccgctggtcggcggcctggtgacgatgtcgtggtggggtgcggcgacggcgttcttctggggttcgctggtgcgggtggcgctgctgcaccatgtgacctggtcgatcaactcgatctgtcacgcggtgggcaagcggcccttcaagtcccgcgaccggtcggggaacgtgtggtggctggcggtgctgtcgtgcggcgagtcgtggcacaacctgcaccacgcggatccgacgagcgcccggcacggtgtgatgaagggacagatcgactccagcgcccggctgatccgctggttcgagaagctgggctgggccacggacgtgcggtggccggatgccgcgcgtatcgactcccggcgcacgtccgcaccggccgacgcggcatgattgacgacgtggcgaccgacggcagcacgagcagcgagaagagcaggacctccccctcccgccgggcccggcgggtccggatgacgggcaaggagcgccgcgagcagctgctggacatcggacgcgccctgttcgccgacaagggtttcgagggcacatcggtggaggagatcgcggcgcgtgccggggtgtccaagccggtggtgtacgagcacttcggcggcaaggagggcctgtacgccgtggtggtcgaccgcgagatgcgccagctgctggacatggtgacgggggcgctcacggcgggccacccgcgcgagctgctggagcaggcggcgttcgcgctgctggactacatcgagtcgtacacggacggtttccggatcctggtgcgggattcgccggtggcgcagtcgacggggacgttcgcttcgctgatcagtgacatcgccacgcaggtggaggacatcctgggcctggagttcaaggcccggggcttcgatccgaagctggctccgctgtacgcgcaggcgctggtgggcatggtggcgctgacgggccagtggtggctggacgtgcgcaagccgaagaaggccgaggtcgccgcccatctggtgaatctgtgctggcacggcctggagaacctggaggcgaagcctcggctgatagggcaccggaagagctgaggagcgggccggtcacacctccggctccaggaactccagccggttgcccaccgggtcgtgggcgtggaagcggcggtggccgggaagggcaccgtcccactcgacgcggacgccgtgggcctccaggcgggcggcgtacgcctcgatgccggtgacgcgcagcccggggtgggccttcttcgcggggtggaagtccttctcgacgcccaggtggagctggaccgggccggaggcgaaccagcagccgccccgggcggcgagcaccgggggtttcgggatctcggtcatgccgagggcgtcggcgtagaaggcgcgcagggtgtcctcggagccgggcggggcggcgagctgtacgtggtcgacggcggcgatacccaccggagcggtcacggcttctccttgcgggcgaccgcgaagacgcggcggaacgggaagaccgtgccgtagcggccgggagggtaggcctcgcggagcaggtcgcggtattcggtgaggaacgcgtcgcgggccgccggatcgtcggccagggcggtgaggacgggacgcagggcggtgcccttgacccagtcgaggaccgcgtcgtcgccgtgcagggtctggaggtaggtggtctcccagacgtccgccgtgcagcccaggtcccgcagccgggtgaggtagtcggtggggtccaggaccgaggcggtgcggtcgccgatgccgtggagcagggggcgccagcggtcggattcacggaggccggccaggagggtgtggctgggtgcggtgaagttgccggggacctggaaggcgagggtgccgccgggggcgagggcgtcgagccagcggggaaagtgttcggcgtggccgggcatccactggagcgcggaggtggagacgatcaggccgtacgcctcggtgggctcccaggtcgcggcgtcggcctcggcgaagtcgagcagcggcggccgggcgtgggcggctgcttcggccagcatctcgcgcgaggtgtcgtagccggtgatccgggcgtcgggccagcggtccgcgaggagggcggtgacgttgcccgcgccgcagccgaggtcggcgatgcggggtgcggggtggccggggaggtcgccgatgcgggccaggaggtcgtggaaggggcgggtccggtggtccgcgtgacgcagatactgctgcggatcccaggcgggccggtcaggtgcgttcatgggtccaggatcacgccgaaagtttcttgatgtcaagacacttgaattcaagagacttcatgtcgagggaccctctacactgatcgacatggaggacgaggtcgaccgactggtcgctgcatggcgccgagagcgccccgacctcgacgtggaaccactcgaggtgctcagtcgcgtctcccgcctggcacgccacctcgaccgggcccgccgcatagccttctccgagcacaacctggagccgtgggagttcgacgttctgacgtcgctgcgccgggccggagccccgtaccagctctcccccggacagctgctcacccagaccctggtcacctcgggcacgatgaccaaccgcatcgaccgcctgaccaagaagaacctcgtcgagcggctgcccgacccgagcgaccgacgcggcgtcctcgtccggctcacggccgaggggcgcgacaaggccgaccagtcgctggccggactgctcgaccaggagcgcgccatcctcggcgagctctcccgccagcagcgcggcgaactggccgggctactgcgccagttgaccgccccgttcgacaacattccctagcgtgggttcggcggggccgacccccgcccggcgggccagcgccaccgccgccagcgtcgagtgcaccccgagcttgcccagcacgttctgcatatgggtgcgcaccgtgtgcggggacaggaacagccgctccgcgaccgccttgcggccgagccccgccaccatgcagcgcagcacctcgcgctcccggggagtcagcgactccaccagccgttcactctcggtgcggtgcttgcgggcggcggtcagctcccgcagtacgccggtgagcagtgcgggcggcagatgcgtctcgtcgcgcagcactccccgtatcaccgccagcagccgctgcagcgagcagtccttggccacccatcccgaggcccccgcctggagcgcccgtgcggcggcccgcgcgtcgtccttctcggcgagcaccaccgaccgtacggcgggccggcccgaacggaccccggcgaccagggagataccgtcgacgacgcccgtctcctcctgccggggcacggggacgacgtgcgccccgccgttcgtcag

SEQ ID NO: 3237 - DNA, 1065 bp, Unknown
  Kingdom: Bacteria, Phylum: Actinobacteria, Class: Actinobacteria, Order: Streptomycetales, Family: Streptomycetaceae, Genus: Streptomyces
agccgggccagggcgtgggcggcggagacgcagcgttcggggtcgcggtggttgagcaggagcaccagcgcctcgaaggcccgccggtcgcccgcgcagccgagccggaaggcggctatctcgcgggcccacagggggcggtgcggctccacgaggacccgcgccagctcctccgggtcctcggcggcgacgagcagggcgtactgcggcgacccggccgcctcgggttccagccggtccatgagtgaacggaactcctcatccatgacgctcagcgtatcgacggacacactccgtacggagcggcatcggggagtccatgtggcccagggcacaaggatccaggggtggcgcgctcgttactcgccggttactctcatctgagcgggacacactccccgcaggctccggtggcctggtgacgcagccatccggagtgcttgtcggttcggcttttccgtgcgacgcgactccgggacagagtccgtcacccccacggccgggcgcgctccccgcgcgccggccccgtgctccacgacacgcagcttccgtacgccacgcgccgctccctcatcgccgcgcgttccgtgctcccacagtcgtcactcaccctggagtcccctgatggacacctctctctccaccatcgccgtcgtcggcctcggcaccatgggcaccggcatcgccgaggtcctggccctggcgggccgcgaggtcatcggcatcgacatcagcgaggcggccgccctctcggccgtcgcctccctcgaagcgtccaccgcgcgggccgtgggccgtggacggatcaccgagcaggagcggacggacgcactggcccggttccgtacgtccgacgacctgcgcaacgccgccgatgccgaactggtcatcgaggtggtgcccgagacgtacgagatcaagcagcaggtgttccgggagctcgacgcgatcgtctcccccaccgcgatcctcgccaccggcaccaacgccctgtcggtgacccggctggccgccgagtcccagcaccccgagcgcgtcctcggactgcacttcttcaacccggcg

SEQ ID NO: 3238 - DNA, 6748 bp, Unknown
  Kingdom: Bacteria, Phylum: Actinobacteria, Class: Actinobacteria, Order: Streptomycetales, Family: Streptomycetaceae, Genus: Streptomyces
ggaccggagccgtgtccgtcctcgcctgcggcggggccgcggtcggcctgctgctgcacgcggccttcgcgctctcccgggcctccgcccacacccggacctgagccggcccccaccgacgtaccaccccgcaccaccaccccggacgtaccaccgcaccactcactccgaccgttccaccgcttcaccgatccactcccgcggagccgacgccgcgggctcgtccagcaccgcacgaccgactcgatgacctaggagaaacccgccatgaccccccaatcccccgcaccggcagtgagccgtcggcaccgaggcggtgcgcgatgagggtgctgctgctcggagccaacggattcctcggccgcttcgtcgccgaccgtctgctcgccgacccggccgtccacctcacggcgctcggccgcggcgacgacgccgacgtccggttcgacctcgcgggaggcagtcccggggcgctcacccgcttcctcgacgccgtccaccccggagtcgtcgtcaactgcgcgggtgccacgcgcggcggtgcccgtgatctcacccgccacaacaccgtcgccgtcgccaccgtctgcgaggcgctgcgccgcagcggctgcggtgcgcggctcgtgcaggtcggctgcgcctcggagtacgggccctcgcagcccggatcctccaccgccgaggacgcggtaccgcgccccggcggcccgtacggcgtcagcaagctcgccgccaccgaactggtcctcggctccggcctcgacgccgtcgtcctgcgggtcttctcgcccgtcgggcccggcaccccggccggctccccgctcggccggctcgcggaggcgatgccccgggccatgcagtccggcgacggcgagctgaagctcagcggcctcggcgtgcagcgggacttcgtcgacgtacgggacgtggcgcgggccgttcacgccgcctcgctctccgccgcccagggcgtcgtcaacatcggcaccgggcgggccgtccggctgcgcgacgccgccgccgtcctggcgagagtcgccgggtacgcgggtgccctccacgagctggactcgccgcccccgcgcctgcccatcggggccccgcgcacctccgccgagtccgtcatggagcacctctcggccaccccgtccccgtatcccgacggctgcggggtctggcagcaggccgacgtccgcaccgcgcgggaccggctcggctggcggccccggatcaacctggaggagtccctcgcggacatctggatggaggcggcgtgccgtatctgaccgctccggccgacgcccgccgcaccgcgggcggtgaacagctcggcttcggcgtccccggctacgcccacccgctgctcgcccccgccgaatgggccgaactggcccgtcccggcaccccgctgcactgggccgtcctcaacatcgcggacggccccggctcccggcccgacccgcactgcctggaggcggcgggcaggctgcgcaacgcccgtgaacgcgccctgcacggcgagtccccggacgacaccgtccgggcctccggcggcaggctgctcggccacctcgacctcgcccacggcgagcgaccgttcgaagagctgatcgcggacgcccggtccttcatcgactggtaccgcatcggcggcttctacctcgcccggtgccccaccgagcgggccggtctgcccgccgtccgccgcctcaccggtacgctccacgccctgctggcggagagcgacagcgcggacgacgggggacggctggtgctgggtcacggcacgcacccgtatcccgggtatgcggaggcggccgaccaactggtcaccttccagggtccctggaccgactaccgctggtcccaggtggccgagtggacggccgactatccaccggagcggttcgcccacttcgtccacggcgtcccccgcacccacctggaggaggccatgcgcgtcgcccgctggcagggcgcggggacgatcttcttcaccgaccgggacgaccgaagcggacaaagcgacccatttgcgacgctgcccaggtactgggacgaaatcgtctcgcggatcggaccgggtatctcggaatgagaaggggcgtggcagtgttacggggagaacaaccgtacgtagtcgaccgtaagaagtcggtctacgtagaatccgaccacctgcattgttgaggttcctgtgtcgctgccacccctggtcgagccagctgctgagctcaccgtcgacgaggtccgcaggtactcccgccacctgatcatcccggatgtcgggatggacggacagaagcgcctgaagaacgccaaggtgctgtgtgtcggcgccggcggcctcggctcgccggccctgatgtacctggccgcggccggtgtcggcacgctcggcatcgtggagttcgacgaggtcgacgagtcgaacctgcagcgccagatcatccacagccaggccgacatcggccggtccaaggcggagtccgccaaggactcggtgctgggcatcaacccgtacgtcaacgtggtccttcacgaagagcggctcgaagccgagaacgtgatggagatcttcgcgcagtacgacctgatcgtggacggcacggacaacttcgccacccgctatctcgtcaacgacgccgcggtgctgctgaacaagccgtacgtctggggctcgatctaccgcttcgacggccaggcctccgtgttctggtccgagcacgggccctgctaccgctgcctctacccggagcccccgccgcccggcatggtcccctcctgcgccgagggcggcgtgctgggcgtgctctgcgcgtccgtcggctccatccaggtcaccgaggccatcaagctgctcgccggggtcggcgacccgctggtcggccggctgatgatctacgacgccctggagatgcagtaccgccaggtcaaggtccgcaaggaccccgactgcgcggtctgcggcgagaaccccaccgtcaccgaactcatcgactacgaggccttctgcggcgtcgtgtccgaggaggcgcaggaggcggcgctcggcgcgacgatcactcccaagcagctcaaggagtggatcgacggcgacgagaagatcgagatcatcgacgtccgcgagaagaacgagtacgagatcgtctcgatccccggcgcgaagctgatcccgaagaacgagttcctcatgggtaccgccctccaggacctcccgcaggacaggcgcatcgtcctgcactgcaagacgggcgtccgcagcgccgaggtcctcgcggtcctcaagtccgcgggcttcgccgacgcggtgcacgtcggtggcggcgtgatcggctgggtcaaccagatcgagcccgagaagccggtgtactagagcgttccgtacggcatccgtacggcatccgtacgaagggaggggccggtccgcgcggaccggcccctcttcgtgcccggtctcccgggcccgtggctacgaacaggtcgtgccgtcctcggggaccttcccgtccaggaagtagtcgtcgatcgtcgaggtcacacagtcgttgccgccgtaggccccgtggccctcgcccttgttggtcagcaggacgccgacgtccttgcccagctcgtccgccatccgccgcgccccctcgtacggggtcgccgggtcgccggtcgtccccacgaccaggaccggacccgcgcccggcgcactggtctccggcgtctcgttctccccctcgaccggccactgggcgcaccagcccgcggtgtcccaggccaggaacgggccgaagaccggtgacagcttccggaactccggcagcagcgcacgggcctcgtccacggtgggacgggacgtcgagtcggcgcaggagatcgcccgctgggagtggttctgggtgtcgtaacgcccctgctcgtcacgtccgttgtacgagtcggcgagccggagcagaccattgcccgtaccgttgttctccgcctcgtcgagcgcggccgtcagcgcgggccagcccgactcggagtacagcggggtgacgatgccggtgatggcgagcgactcgctcagctcacggcccgagtcggtcggcagcgggctccggtctatgcgggccagcagccgggcgatgcgctcggatcccgtcttcgggtcctggccgcggtccttgaggtagttctccagggcgcgctggaagcccgtggtctggttccgggcgtgcccggtcccgtcggccgtcgggtcgacgaccgcgtccagcacggtgcgtcccaccctgtgcgggaagatgtgcgcgtatgttccgcccagttccgtaccgtaggagaagccgaagtaggacagcttctcgtcgcccaggacctcgcggatcaggtccaggtcgcgggcggcgttgaccgtgccgacgtgcggcaggatcgcgcccgagcggcgctcgcagccggcgccgaagtccgcggcgtcctcgatgaacgccgtctcctcggccgccgtgtccggagtcaggtcgacgctccggtgggcctgctcctgctccttgtcggtgcggcagcgcaccccggagctggccgcgaccccgcgcggatcgaaactcaccaggtcgtagcgggagttgagcttcgcgtacgcatcggccgagcgcggcagcgtcccgacgccggatccgccgggcccgccgaagttgaacagcagcgagccgagccgccgacccttgtcgcgtgcctccttgcggaccagcgcgatggagagcgtctctcccgacggctccgcgtagtccagcggcacgtccacgctcgcgcaacgccaggcggaaccgggggcctcaccgccctgcggtgccgggcagcgcttccagtcgaggcgctgcgaggtgagggcggagggcagccttggcgtcttgggggagtccttgaggtccgtcggcgtgggtgcggcggaggcgccggcggggcggccgtcggccggatcgctcgcctccggctccgacctcaacaggccgcagccggcgagcagtccggccgcgaagagggctgctcctgtcctgacggcggcccgatggacacggcggtgcgcacgcatgatccggcttccctcccctaggggggtgtcgtgcccgaagccggtggcgacgcgacgggcggctgtgatgtgcggccatgctaaccgccttgcacagcacgggagtcgggggtccgggtcacccgcagacggtgccggacttcggcaccgtaccgttcaacagatagccgtccaccgtccgttgcacgcacgcgtccttgctgttgtacgccccgtggccctcgcccttgtaggtcagctcgacaccgacacccgtgccgagctgctccaccatcgccttcgcgcccgcgtacggggtcgccgggtcaccggtgttgccgatgaccaggaccggggcggagcccggggcgctgacgtccggggtctcccaggcgcccgccaccggccagccggtacagctcatcaggccccagcccaggtagtccccgaacagcggggacgccttgcggaacgcgggcagcgccgccttcgtctgctccagggagaaccgctccttgctgtccgcgcagttgatggagatgttggcggcgttggagttgtcgtaccttccgtcctccgagcggccgttcagggaatcggccagggcgagcagcagcccgccgttcccgcctcccgcctcgtccaggccctgctccagcagcggccaggtctcccgggagtacagcgcggacgcgatgccggtggtggccagcgtctgcgtcagcgcccggtcgccgagcccgtcgatgggctcctcctccagctcgcccagcagatcggcgatgccctgctcgacctcctgcctggtggccccgggcagcgcgcagtcgtcgcgttccgcgcagtcctccgtgaagttgtccagggcgagctggaagccctgggcctggccgatggaggactgctcggcgtccttcgtggggtcgaccaccgcgtcgaagaccgcccggccgaccttgtccgggaagaggtgggcgtagacgccgccgagctccgtgccgtacgagatgccgaagtagtgcagcttgtcgtcgcccagcaccgtgcgcatcaggtccatgtcgcgggcggcgttcgtcgtgcccacgaaggggagttcggggccggagttctcctcgcagtccgcgatgaagtccttctgtccctggacgaactgcttctcctcggccgcgtcgtccggggtggagtcctcctggtagaaggcgtcgagctgggcgtcgtccgcgcactggacgccctcgctgcggccgaccccgcgcgggtcgaagctcaccaggtcgtaccgggtgcggagcttgtcgtactcggtgccgaacgcgggcagcgtcgcgacgccggacgcgccgggtccgccgaagttgaacaccagcgagccgatccgccgcttctggtccttggccttcgcccgcaccaccgccagctcgatcgtgcggccgtccggctccgcgtagtcgaggggcacgtccatgaaggagcactcccacaccacgccgccgggcagcggggacggcgactcgccgccgccctgggccgagttcgggggtggacacggggaccatgcgagctgttgggacgccaggtcgtcggcggtggaggacggcgaggcggtcgaggccccggtgggcgtcgaggacccgtccccgtcgccaccgtccgaacaggcggccagcggcagcagcacggtggcggtggcggcga

SEQ ID NO: 3239 - DNA, 3827 bp, Unknown
  Kingdom: Bacteria, Phylum: Actinobacteria, Class: Actinobacteria, Order: Streptomycetales, Family: Streptomycetaceae, Genus: Streptomyces
cgacgcgccttcgacgacggcccctggccgcacaggcccgtcgccgagcgggccgcgctgctgcgccgggtcgccgagctgctccagcgtgaccgcgaggagatcgcgatcaccgagagccgcgacaccggcaagaccctcgaagagggccgggtcgacgtcgacgacgtgacgaacgccttccgctacttcgccgacctcgtgatgaacgagagcggcggccgggtcgtcgacgcgggcgaccccgacatccacagcatcgtcgtccacgagcccgtcggcgtctgcgccctgatcgccccctggaactaccttcgtgctgaagcccagcgaggtcaccccgctctccaccgtccacctgatccggctgctctccgaggcgggactccccgacggcgcggccaacctcgtcaccggcgcgggcgacccggtgggtgcccggctctccgagcacccggacgtcgacctggtctccttcacgggcggtctcgccagcggtacgaaggtggcccaggccgccgcaccgactgtgaagaaggtcgccctggagctcggcggcaagaaccccaacgtggtcttcgccgacgcctgcgccaccgacgagggcttcgacaccgccgtcgaccaggcactgaacgccgcgttcttccacagcggccaggtctgctccgccggtgcccgcctgatcgtccaggacgcgatcagcgagcggttcgtcaccgagctggcccgccgcgccgacgccatccgcctcggccggggcaccctcgacggcgtcgagtgcggccctctcgtctccgcccagcagctcgccaaggtcgaggcgtacgtcgcctccgcccgcgaggagggcgcgatcgtccgggccggcggcgaacgcccgaagcccaacgacgtacggcccgagggcggctacttctaccggccgaccgtcctcgacggctgccaccgcgagatgcgggtggtccgcgaggagaccttcggcccgattctcaccgtcgagaccttccgcaccgaggaagaggccatcacgctggccaacgacaccgactacggcctcgccggcgccgtctggacgaccgacgcgggccgggcccgccgggtcgccggacggctgcgccacggcaccgtctggatcaacgactaccacccctacctgccgcaggccgagtggggaggcttcgggaagtccggcacgggtcgcgagctcggcccgaccgggctcgccgagtaccgcgagtccaagcacatctaccagaacctgaacccgcgcccccagcgctggttcgccggctgacgcctgcggggaccggcccccctccaggggagacgtccggtcccgcccggctgttcgcagcaccacgtacacgcacgaaccttgcagaaggagcagtgaccgatgccctccaccccccgcagcaccgcagtccccgacggctccgcggccgactacgtgatcgtcggcggcggcaccgccggatcggtcatcgcctcccggctcaccgaggaccccgacgtcaccgtcaccgtcatcgagggcggccccaccgacatcgaccgtgacgatgtgctgaccctgcgccgctggctcggcctgctcggcggcgacctcgactacgactaccccaccacggagcagccgcgcggcaactcccacatccggcacagccgggcccgggtcctcggcggctgctcctcgcacaacacgctgatcagcttcaagccgctgcccggcgactgggacgagtgggccgaggccggcgccgagggctggggtgcggccgcgatggacccgtacttcgccaagctgcgcaacaacatcgtcccggtcgacgagaaggaccgcaacgccatcgcccgcgacttcgtcgacgccgcccagcaggcggccggggtcccgcgcgtggacagcttcaacaacaagcccttccacgagggcgtcggcttcttcgacctcgcctaccaccccgagaacaacaagcgctcctccgcctcggtggcctacctccacccgcacatcgaggcaggcgaccggcccaacctgcggatcatgctggagacgtgggcgtaccggctggagttcgacggcacccgcgccaccggcgtacacgtgcggacgaaggacggcgaggagatcctgctgcgcgccgcccgtgaagtcatcgtctgcgcgggcgcggtggacaccccccggctgctgctgcactccggaatcggtccgcgcgaggacctggccgcactcggcatcgacgtacgccacgatctgccgggcgtcggcgagaacctgctcgaccaccccgagtccgtcatcgtctgggagaccgacggacccatcccggagaactccgcgatggactccgacgcgggactcttcgtccgccgcgaccccgaatcccggggcccggacctgatgttccacttctaccagatcccgttcaccgacaacccggagcgcctcggctacgagaagcccgagcacggggtgtcgatgaccccgaacatccccaagccgcgcagccggggccgcctctacctcacgagcgccgaccccgaggtcaagccggccctggacttccgctacttcaccgacgaggacgaccacgacggccgcaccctggtcgacggcatcaggctcgcccgtgagatcgcggccaccgaaccgctggcccactggctgaagcgcgaggtctgtcccggtcccgaggtcacctcggacgaggacatcagcgagtacgcccgcaaggtcgcgcacaccgtctaccacccggccggtacctgccggatgggtgcggccgacgaccaagaggccgtcgtggacccgcagttgcgcatccggggactggaaggcatccgcatcgccgacgcctccgtcttcccgaccatgcccgccgtcaacccgatgatcggcgtcctcatggtcggcgagaagtgcgccgaactcctcgcggaccgggcgcgtgacaccgcgccggtcaccagcaccagcaccggaggcgatgtccgatgaccggaaccgagaccctcaaggccaccgggagcgccgggagcacggagaaccccgtgttctccgtacgcaacctctggaaggtcttcggccccaaggccgaccggatccccggcggcgagcacgccgcgctcccgcccgccgaactccgtgaggccaccggctgcaccgccgccgtgcgcgacgtctccttcgacgtccgcaagggcgaggtcttcgtcgtcatgggcctgtcgggctccggcaagtcgaccctcgtgcgctgtctgacccggctgatcgaacccaccagcggcaccctcgccatcgacggcgaggacgtcctcgcgatggaccgctcccggctgcgcgaactgcgccgccaccgcgccgcgatggtcttccagcacttcggactgctgccgcaccgcacggtgttggacaacgtcgcctacggcctggagatccagggcctcgggaaggccgaacgccgtacgaaggcagccgagttggtggcgaaggtcggtctcgcgggtctggaggaccgccgcccctcgcagctctccggtggccagcagcagcgcgtcgggctcgcccgcgcgctcgccgtcgatccgtccgtcctcctcttcgacgagccgttcagcgcgctggacccgctgatccgccgcgagatgcaggacgaagtggtccggctgcaccgcgaggagggccgcaccatggtcttcatcacccacgacctcagcgaggcactgcgcctcggcacccggatcgcgctgatgcgcgacggcggcatcgtccagctcggcgcccccgaggagatcgtcggctcgcccgcggacga

SEQ ID NO: 3240 - DNA, 5545 bp, Unknown
  Kingdom: Bacteria, Phylum: Actinobacteria, Class: Actinobacteria, Order: Streptomycetales, Family: Streptomycetaceae, Genus: Streptomyces
ctcccccactgctccccaggttctccccagcggcagcccccagaccttgcctaatcagcatcgcccgcaccagacagctggcccggacggtacgtttctccgctgcgggccgcagccctttccttcgcgtcctcgatctgcagcacgcactcggcgcacgctcttacatcctggaggccgccagcaggaggccggatggttttgatgtgtgcggtttcctgagccccacgcgccgggtggcggaagcacagcccctcctgccagtcgtagaggtcgagaatctgctgagagtccatgggtcttcccctgtcgtgcctgctgatgagtcgcgatggttccctcctctctcggcgagaaccgtggcgtgagcgccgaagccgggctgatatatcaggctgcacggcggcttcgtaagttcgaacttcactcgatgatcattgatcgacgtaagaggttcggatggcagaagcggcgtatcggcgtatcgccgccgacattcgccgtcgcatccgggccggcgagtgggccgtgggccagccgttgccgtcgcgccgcgagatgggcgttgagtaccgcgtccacgagcagacgatccgcctcacctacgacctgctccgcaggagtggcgttctcgacggagagaaggggcgtcacgtcaccgtggcgcatcctcctgctgtgcgtactctcacgaacgcggatctgccgtggccgtacagcagcgagacgaccgacacgaggccgcggcccgcgactgaagacctggctgcccggctcgatgtccgaccgggggtgatgctgcaccacgagacggtggagtgcctcgaccccggcgggcattcggcgatgatcgtgtcgtcgtggtggcgtggccagcgcaggccgcacaccagtcacgtggtcgaggtggggacggcgccgctcaccacggagcaggcccacgccctggggctgctggtggacatgacggcgtttcggctggtgcggactcgcctcggtgaggacggcgctccggtggagactgctgatctcgtcctccccatcgatcgctggatgattcgtttgcgcagccggtgacatgctccggctactgactctggggtcagtcagcgttatcgagccttgctcacttttgaccaaaaaactagtgtccgacggcaactcttgcactgaccaatcgtcagcgtcaccgcgcgtataaccgcaggcccaagccaaggaagcccttacctggccagccgtcggggaccaccccggagcggcacccgggtggccggatacggtcggcacactggatcccccaccgggtgcatccagtcatccgggcgggcaccggacatcgagtccgaccggtcgacacggaccgcagtccgctgatcgaccggctggtcgcagcgggcgcagatcatggccggccgcccgcagccgcatcctccagtgcggcccggagggctgccgtgtcggtgaggagcccgtcgtcgccggggcagatccgccagtgcgggccaggccccgaggtgcgtctcgcgggcgggaacaccacgtgggcgccggtcgaaaggatccgggcgccgggtacatcggacggcttccatccggcaccgccgccgggcgcgatgaagaagtacatgcacccttcgtgggggtcctggagggcggccccggatcggctgccgaggatggcgacggcgtcgctaccgacgctgcggggcacgcggacggcgtcccaggtgtcgccggccgcttctaaccggcagctcttgatcgtggtcgtggatggcatcggatgctcccgggtggctgggtgatcgtccacctaggttggcccgcacacggcgcctttccgagggctttcagaggactcttgctgtcgcagaagaggactttcatgcgcccttcaggggtacgactggccagccggaggacgtgctgtgaaactggcggaacttgtcgcgatggaggaccagcgtgccgccgaagcccagcaacacccgactcaagtccgcccgcctcgcagcgggttaccactcccagcaagccctcgccgacgccctcggcgtcggggtcaggcaggtccgccggtgggagtccgaagccccgccgtggccgcaccccgacctgcagcaggctctcacacgggtactcggtcaggatctcgaagcgctcgggttcaccccacccgccggccacgacccggtgcgccgcaccctcatcaccggtaccgccgccgcggtcggcctcgccgccgtcccgtcccaggccgcggccatcatccagccggcgtccgtagccgccgactacgaagccgtcacccggtcgcaccggcgcctgtactggtccgtcgccccggccaccctgcacccggctgcggttgcgcacgccaccctcgggtgtgcgcttctccctgagtcggctggccgcacacggcaggcggtggccgcagccctcgcggagacgtggctgctcgccgggcgcatcgagttcttcgacctgcgggaagccgaccgggcgggcatcacctggcatcgggcactgcaggccgccggtgaagcggacgacagtctgctgggggcggcgatcctcgcccacaccgctttcatccccgcctgggtggggcggcgggacaatgcggtggagcggatgactgcggcccgcacctacgcccggcgcggtcccgcctcggcggagctgctggcatggctggacgcggtcgaggccgagtgcgagacccggtgcggcaacacgcagacggctctgcacctcctcgggcacggcgaggacgtcctggccgcaggcagccagtacgagtccccgacgtggctggactggttcagcccggtgcgcctggccgcattcaaggggaacactcagttgaaggccgggcacctgccgcaagcgcgggccaccctccagggtgtgctggacagcctgtctgcgccggaggagaagcagcggtccgtcatcctcggcgacctcgccgcggtcgaggtggcggccgggaacccggaggcggcgtgcgggtacgcgtgcgaggccctcgaccagctggaggccacctggtacgcgacgggcatggaccgggtgcgggaggtgcgccgggcgttggtcccgcaccagcatcagcagtgtgtgcgggaccttgatgagcggctgtacgggtggtcgacgactgtcagtgcccttgctcgttgaactgcttgatcagcggggacagttcgaggaggctctccacccggaaggtggggagcttctccgcttcctcggtgttccactggatggtggcccaggggccgcggcggatgagagcggtgtgcatgcctgcggcggcgccggggcggaggtcgttgtcgacgcggtcgcccacgtagaggatctcgccgggctcggccgggacaaccgcggcgacacgcacgaagaactcggggtcgggcttggaggcgccccagtcgtcggacgtgccgatgaggtcgacgtcgcgggtgaacagctcgcggaggatcccgccggcgcgcaccgtctggttgcctgcgatgccgagccacagcccgtcagctcgaagggccttgaggctgtcgcggacgtcggggtacaggtcagattcgtcgaagtgctcgggttggccggctgcggctcgggcgtcgcgctgctcgtacaggtcgaagccgggctggaactcttggaagacgtcccggtagtcgcggccttgggcgatgacggccccgaacatggcggcgaaggtgtggcgggggacgcccaaccagtcggcccaggtgccgtactcccgggtttcgtctaccaggcactcgccgacatcgaacacgactgcacgaatcatgtgggcatcctacgagctgcgggccgggctgattgtcggtgcccgcccgtaggctcggcgcatgccttctcctcctgcccagccgccgtgtgcccggtcgctgtcgacggtgaatgaggagatccgggggctgcaggtggacggcgggctggtgtcgccggagggccgctgccggtatgaggagttgttggtggagtgggctgcggctgtgcgcggcgatgtcaccgaagcggcgtgatcgcgttcgaggatcctcgaaagtgatgccctgacctggctttttcctgacagcaggaagaagcacgaacgcccgccctccacgcgagggcgggcgtaaggctaagcgtctccggggccggtcccgttcggtggacgtccccctgctggggcacctcgcgggtccgacttccggcaggcgcggcccgcccggctatgagccgacaggtgctcgggtgccacggcttcccagaagcagacgagcgggtcaccaccaggatagccaacggccgcccagtcggacggccgtggattgggggcggtgtttctccggggatgatccgggaggcgtaccgcagaacctcctgccgccgaagcggcccacgaccccagcatggcagacggcccgctgtcagacccctcgtttaggatccggccgtggcgaaaccgagtgagaacctgatcgaactgtgccgggctgctgtcgaggcgcaccgtgtggcaacagcccagccgtacaccccggagggctggaagccgtggatggatgctgcggaaacgttccaagctgcggtgacagccgaagcagaggcggccggggagaaccggttcaagctggagcaggtggcgaagaaggccgtgctgcaccccgaggacgcttcggacggctgaggtgaccttccgctggcgggtccgttagcgggtcatgacgaccttcgcagaggcccataacgccgcccagaccgacgaggacgcggtgtacacgctgtgcttcacgaagcgcgagctgcgggcggcgctcaacgtggtacggccggacggttcaccgtccccggcggacaagcaggccgccgccgcactgttcaagcggctggccgatcgactgggcgctcctaccgattagccccggaagcagccccgcccccgtcccgggagcagccggggtgggggcggtaagcaatccccttgttcgcgggccctgcgggtcctgggggttgatgtgacaagcctacgggcgggcgttggcaacgtgggctcgatcagccccggcgtggcgagtcagccggtcttcagaccttcctgccagaaggggctcttcgcagcccgatcccactcgcggtccgtgaggcggcccgctcgggtcatgggctccagggcctcggcggctaccgcgagcgcccggcgggcgtcgacggccatcttcacccgccactctggcacctccaccaggtggtcatgccggtcgagctgacgcagggcgcggtcgacgttcgggtacgggcggtgcgtcacggggactcctcgctgcgggcggtgggcggcaggctgacggcgggcggtcgcggcggcgggtcgactgcaaggccgagcctcaccgtcttcccgtcgcgttcccagagcacccggacgcgcgggtcgtttgtctcgctgatgccgcagtcgttcacggtgtcctccttggggtgcccccgtcgacgggggcaccccaaggag

SEQ ID NO: 3241 - DNA, 2026 bp, Unknown
  Kingdom: Bacteria, Phylum: Actinobacteria, Class: Actinobacteria, Order: Streptomycetales, Family: Streptomycetaceae, Genus: Streptomyces
gaccagctccagacctggggcgagcgggtcggcgcgcgcacggtccgcgggcccgagggcggcgacccggcgtcgatcgcctacgacgcggtcaaggaaggcatcgccgagggcgcggacgtcgtcctcatcgacaccgccggtcggctgcacaccaagaccggcctcatggacgagctgggcaaggtcaagcgcgtcgtggagaagcacggcccgctggacgagatcctgctcgtcctcgacgccaccaccggacagaacggcctcgtccaggcccgggtgttcgcggaggtcgtggacatcaccggcatcgtcctcaccaagctcgacggcacggccaagggcggcatcgtcatcgcggtccagcgtgagctgggcgtaccggtgaagctgatcggcctcggcgaaggggcggacgacctcgccccgttcgagccgggcgccttcgtcgacgccctgatcggcgactgacccacctcgcatccggtacggcggacgggcggcggctcctgcgaggagcctgccgcccgtccgccgttcccgtgccgcctaagagcggtggcagacgtacgcgagagtccccagcagcagccgcgcctgcgggggagcggccgccgtgtccagcagcgggggccgcagccagcggaccgggccgaggccgccgaggtcggagggcggtgcggtgatgtgcgtccccgggccgaggccgcgcagatcgaggcccgcgtcgtcccagcccatccggtagagaagctcgggcagctcggcggcggcaccgggggcgacgaagaactgcgcccgcccggtcggcgtcacggcgaccggccccgacggcaaccccatccgctccatccgcaccagggcgcgccgccctgcctgctccgcgacctccaggacgtcgaaggagcggcccacggccagcagcatcgccgctcccggcgtctcggcccaggcgtccgacgcacggtccaggccggtgcccgccggaacctcccgggcgaagtccagcgggtgggctcccggtgccgggcaggccggtgcgccgcacgagcaggagccggcctcggcccgtgctccgggcgtcaccgcccaaccccacagccctgtgtactcggccacggccgtgccttcggcgaagcggtggcgtcgccgcgcaccggatcgcatctcccggatgccgccgatcgtgaagcccataccccctccaacgggtccgactcgtcggtggttacgacccgcgtagctcgggtaaccctccgtcgctgaaactcgatcgagtggcgtgcgcggtagtgcgaaagggagtgcgccacggtgtgcgcgcccccgaatgcttccgtccgcttgccctcggtcctggtcgcccaagtcaagcgcgcgcggcggcagtcgggttcattcgaaggggtggcgaatggtggcgtttcttcaatccccctcgcgggaggggtgatcgtaggattaccgtcggtacacgaaccctgggagtatgtgcacccacgggtatgccgcaggcaacccgatttcctgttcgacggcatcggcgatgtcgatgggtttcaactcccgcacggacagcaccgatgcacggcattctgataatggttcgcgcgatgaggtttcggcgggatgggggcgttccagtgagtggcagcggcgcaggcgacacggatgccgggaagcgccccaacgggcagttgggatcgtggttcgtgcgcagcggctggtccaagggcgagctggcgcgccaggtgaaccggcgggcccggcagatgggcgccctccacatcagcaccgacacctcccgggtgcggcgctggctcgacggggagcagccgcgcgagccgatcccgcgcatcctctccgagctgttctcggagcgcttcggcaccgtcgtcgccatcgaacagctcggactgcgcaccgcccaccagtcaccctcggtggccggagtcgacctgccctgggccggcccccagaccgtcgccctgctcagcgagttctcccgcagcgacctgatgctcgc

SEQ ID NO: 3242 - DNA, 6915 bp, Unknown
  Kingdom: Bacteria, Phylum: Actinobacteria, Class: Actinobacteria, Order: Streptomycetales, Family: Streptomycetaceae, Genus: Streptomyces
gtcgaggctccggccgccgccgaggccccggccgccgacgcggacgccgagcaggcctgacacccgtcacggctgctgacggcgggggccgacgccacaagcgtcgcccccgccgttcacccgtagatctttcagacttcgagagagacataaagactcatggcgaactacaccgccgctgacgtcaagaagctccgcgagctcaccggcgccggcatgatggactgcaagaaggcgctcgacgaggccgacggcaacgtcgacaaggccgtcgaggcgctccgtatcaagggccagaagggcgtcgccaagcgcgagggccgctctgccgagaacggtgccgtcgtctccctcatctccgaggaccagacgtccggcgtcctcctcgagctgaagtgcgagacggacttcgtcgccaagggtgagaagttccaggccgtcgccaacaccctcgccgctcacgtcgccgcgacctccccggccgacatcgaggcgctgctcgcctccgagatcgaggccggcaagaccgtccaggcgtacgtcgacgaggccaacgccaacctcggcgagaagatcgtcctggaccgcttcgcgcagttcaccggcgcgttcgtcggtgtgtacatgcaccgcaccatgcccgacctgcccccgcagatcggtgttctggtcgagctggacaaggccgacgccgacctggccaagggcatcgcgcagcacatcgccgccttcgctccgaagtacctgtcccgcgaggacgtcccggccgaggtcgtcgaggccgagcgccgcgtcgccgaggagaccacgcgcgccgagggcaagcccgaggccgcgctcccgaagatcgtcgagggtcgggtcaacggcttcttcaaggaagccactctcctgggccagccgtacgcgctggacgccaagaagtcggtccagaaggtcctggacgaggccggtgtcaccctgaagcgcttctcgcgcatcaaggtcggcatctgagtccgtccgggcgaacagcaccgaacccgataaggtctggtgcagtcgacggccgcacccacgccggacgaccgcagatctgacgaggaggccattgccgctgtagggacaccagacccaccggcaatggccttcttcgtatgtgcacgaggagaatttccatggacaagggcgcggacgccattcaggccgacggcaagggcgacgacgacaagggttccgggcgcttcatgctgaagctctccggtgaggccttcgccggtggcggcggactcggcgtcgaccccgacgtcgtgcacaccatcgcccgcgagatcgccgccgtcgtacgcgacggcgcccagatcgcggtggtcatcgggggaggcaacttcttccgtggcgccgagctccagcagcgcggcatggaccgggcccggtccgactacatgggcatgctcggcaccgtcatgaactgcctggcactccaggacttcctggagaaggaaggcatcgactcgcgcgtccagaccgccatcaccatgggccaggtcgccgagccgtacatcccgctccgcgccgtacggcacctggagaaggggcgcgtggtgatcttcggcgcgggtatgggcatgccgtacttctccaccgacaccaccgccgcccagcgcgccctggagatcgacgccgaggcgctgctcatggggaagaacggcgtggacggggtctacgactccgacccgaagaccaaccccgacgcggtgaagttcgacgcgctggagtacggcgaggtgatcacccgcgacctgaaggtcgccgacgccaccgccatcacgctctgccgtgacaatcagctcccgatcctcgtcttcgagctgaccgccgagggcaatatcgctcgcgcggtcaagggtgagaagatcggcacgctcgtgagcgacgcgagcacccgggcctgacggccccccaggatggacaacggcctgccggtcggacaccgtgcaggtgaggacgcgacgcaggacccgcagggccaggcgatgacgacgccgggcccacccaagacacgcaggagcacgtggtgatcgaagaaatcctcctcgaggccgaggagaagatggagaaggccgttgtcgtcgcgaaagaggacttcgccgcgatccgtaccggccgcgcgcacccggcgatgttcaacaagatcgtcgccgactactacggcgcgctgaccccgatcaaccagctggcctcgttctcggttcccgaggcgcggatggccgtcgtgacgccgttcgacaagaccgcgctgcgcaacatcgagcaggcgatccgcgactccgacctcggcgtcaacccgagcaacgacggcaatatcatccgggtgaccttccccgagctcacccaggaccgccgcaaggagtacatcaaggtcgccaagaccaaggccgaggactccaagatctcgatccgctccatccgccgcaaggccaaggagaccctcgacaagctcgtcaaggacaaggagtccggcgaggacgaggtgcgccgcgccgagaaggagctcgacgacaccaccgcgaagtacgtcgcgcaggtggacgagctgctcaagcacaaggaagccgagctgctcgaagtctgatgaacgactcttcctggggtgccccgcaaggagccggttactggggcacgcccgagatgagcgctgccccggcgggtcctgcccacgatgtgcatggcgcccagcagactcggcccatgcccaacgtgccggacgttcccgacgcaggtagagacgcacagagccgcgacgaccgggacagggatgccgctcacgtcagcggccccctgttccgtgacgagaagccgcaggagcccatgtccaccccgctgccgcacccgccgcagaagaagcgcgcggggcgtgatctgcgcgccgccataggggtgggcgtgggtctcggcgccgtcatcggcgtctcgctcttcatcgtgaaggccgctttcatcggcgtgatagtggcggccgtcgtcgtcggcctctgggagctcacctcccggctccaggaacgcaagggcatcaaggcgcccctggtgccgctggcagtcggcggggccgcgatggtcatcgccggctacgcgcgggggcccgagggagcctggatcgcgatggccctgaccgctctcgcggtgctggtatggcgcatgaccgagccgccggacggatatctcaaggacgtcacggccggggtcttcgcggcgttctacgtacccttcctggccaccttcgtcgccctgatgctgacggcggacgacgggtcgtggcgggtcctgaccttcctcatcctcaccgtggtcagcgacacgggggcgtacgcggtcggctggcgcttcggcacgcacaagctcgccccgcgcatcagccccggcaagacccgcgagggcctgctgggcgcggtcgccttcgcgatggtcgccggcgcgctgtgcatggagttcctgatcgacggcggcgcctggtggcagggcctgctgctcggcctcgcggtcgcggccagcgccaccctcggcgacctgggcgagtccatgatcaagcgggacctcgggatcaaggacatgggcactctgctccccggccacggcggcatcatggaccggctggactcgctcctgccgaccgcgccggtcgtatggctgctgctggtgctgttcgtcggctccggctgaccgcctcggcgtcccggcaccctgtcccacctgcacgtttcgcgagtgagggtccgtcgtccacagggcggcgggccctcacccgtctgtctgcgacactggatgaaccatgcctaagcccggagaactggcggcgatccggcattgattggcccctgaccagcacgtttggtgctcgacaggggccgttcccgtgctactgggccgtctctgggccgtcagccacgtcgggggagggcaagaacagcccgtcaatggcgttccgggtgcgctcctgactcgacggcatgaggtgcgcgtacacccgcagcgtgagtgcggggtcggtgtgcccaaggtactggctgaccgccttgatgctctcgccagcgtccagcaacaccgatgcgtagaagtgccgaagcgcgtgcatgccgtgttcgcgggcggactcgtacttcccgtcccgggcgctcgggatgaggccagccagcgcgagggcaggcttccattcctggatgttgaagttgctccgccagacgactccggacgcggtgttcgtgaacaggagacgagccgtcaccttcgggccgtcaggcttccgccacggcagggtgacctcaaccggcttgcagttgtccatgtgcgctcgcacggcttcggccaccgaggacgggagcgggacgtctcgctccttgccgcacttcggcggggcgaacacggccttgccctggatgagcttcacctgccgaacgacccgcaggatgccctcctcgaaatcgaccgcatcctcagcgaggcccacgatttccccctgccggagcccgcagccagcgcctgtgtccaccatggtccggtagcgctcaggaagggcttggcggaccgcctgcacttgtgagggcagccacggggtgacccgccgccgttcgaccgatggcgggcgcacggacttcgcggagcatgggttgcgggggaggagaccgtcgtcgacggccgcactcagtacggctcgaacgtcgccgtagatgttgcgcgcgtacgccccgctcacgcccgggttggactcaagggcgctcaccaggtcgcgaaggtgttccggccggaaggagtcgagcgggcgcgacccgaggatggggaaggcgtgcaggcgtagccgctgctcggtgacgatctggctcgacaggtccgcgctgtgtgccttgagccacttctcggcgtagcccttgaacgtgacccgggctgcgcgcgggtcgatgtactggcctcgggacatgtcggaagcgacgttggtcagccagttctcggcgaggcgcttctgtcggtccgggaaggacttggacttctcggtgccgtcggggccgacgtagcgggcgcggtagcggagtccggagccatagcggtcgctcttgaccctgcgggtcttgccgtcgggcccggattcggtcttgtaccagcggtcttggatgtggccagccacagggggctcctcggggatgcagcaggggcgcgaccggtggtcgcgcccctgcgagtggttgtggtgtgggtcaggccgcgtcgtggtcggcttcggtgagcgcgttgatccaggcgtggacggcgctggggtcgtagcggaggtgcttgccgatacggaagccgggcgggccggtgcgcttcttgcgccaggcgtagacggtttcgagcgggacggagaggagggcggcgatgtcctcgggggtgaggtagcggtcggggaggccgccccggagggtggcgcgggggtcgggtttcggtgccacgggatctccatggggcggcgatgggcggcgtggttgtccgaggtgtggatttctgcgtcaccgcgtcacccgcgtcacctaaggggtgtgacctgcggttttgggtgacgcagcctggtgggtgtgcgtcacccgtgcgtcaccgtctgcgtcaccgggtgacgtgggggtgacgcgggtgacgcaggggtgacgcaggattcggcgtctgcgtcaccccttccggtgcaggtggggggccgttttccgtcccgggtgacgcaggtgacgcagacgttccctacttaggaaaagaaggggggtgtctgtagtaggggcggtgttcttcaggcgaagtgaggggcccttcgggcacgcctcttgggcggcgttccgccgaacagcaagaggagcacccgtcggcgtggcgcggggtgctcctcttgcttgtccccgggggtgaccggtggggtcagaacgccgccgcctgctccggctgctcagggggcggggatgcggccgggcgggtcatttcgaggtagcggcctgctttggtgcgtccggtgtcgatgaggacgccccgggcggcgagggtgggttgcaggcgcttgagacggtcggagagcaccttgcccgtggtcggccaccctttcggtaggggtcgtagctcctcgccgctgtagaggcggctcagggcactcagccattccgtggacgtcatgcgctgctcgcggccggggtcgagggtgtcggcgtgctggaggacggtctgcgcgagcaggtcgccttcgatgacgtcgtcgttcaggtcgtccaggctggcccggtacgcggtgagcgctccgaggccggtggcggtgtcgagttgggcgcagaggtgggcgaagtccgccatgcgcagatcggtcggggtctccgcgtcggtggcccggaccttgacggtcaggtcgaggagcgagccgaggacgacgggcagtacctcttcgtactccgcccagagttccgcttctgtcctgcggacggtgggccgctccagccgcaggggcaggaggcgttccgcgaggtcggggcggaggatgccgacgtcgatgccggtcaggagcagggggcggcggtagcgggcccggtgcacgtccccgtcggtgaacagcgcccgtttgacggactcggctccggtgacgatgcagcacatggcgtcggacagggccggtgtcatgtgggagaggttgtccagggcggtgacccatccggcggccacggccgcgatcaggttctcctcgtcgttcggcgcccggcgcaggtccccgctcatcccttccacgatccgcaccagcatcctgcctccggtcgacttccccgcgcccttcctcaccggcccccagggcgcggggacgtcgaccggaggcaggatgctggtccggatcgtggacgggatgagcggggacctccgccggcccccgaacgaccaggagaacct

SEQ ID NO: 3243 - DNA, 2560 bp, Unknown
  Kingdom: Bacteria, Phylum: Actinobacteria, Class: Actinobacteria, Order: Streptomycetales, Family: Streptomycetaceae, Genus: Streptomyces
ccaccggctcggccaccgttgaccagcccctttcgcgagcactcttctgcgtgggggacacttaatcaccagtcgtatgtgttgatcatggaggagccacccgtggagttcgacgtcaccatcgagatcccgaagggttcgcggaacaagtacgaggtggaccacgagaccggtcggatccgcctggaccgtcgactcttcacctcgaccagctacccggccgactacggcttcgtcgagaacaccctcggcgaggacggcgacccgctgcgacccgctggacgcgctggtcattctggacgagccgaccttccccggttgcctcatcaagtgccgtgccatcggcatgttccggatgaccgacgaggcgggcggcgacgacaagctgctctgcgtcccggcgtccgacccgcgggtggagcacctgcgcgacatccaccacgtgtcggagttcgaccgcctggagatccagcacttcttcgaggtctacaaggacctggagccgggcaagtccgtcgagggcgccgactgggtcggccgtaccgaggcggaggccgagatcgaggcctcgtacaagcgccttgaggcccagggcggcgcgcactgacgtccctcttccggttccgtttgtgggccggacggccgtcttcgaacgggcggtacaccttcgcgggtgtgccgcccgtttcgctgtccgcacttctgcgcgtgcggggcccatgccggtggccatactgggcacacgtgcggcgggagagacacccagggattgtgcggtcgaggaggaacgaggtcgagtggtggcggaatcgggcggtcctgaggaccagaagccccagtccgacgaggcgcggagcgctttcgctccgcccgcggggacgagtcagccggcgtcgccgcccgaggaggaccacccgacgtcggagttcgcgctgccgaccggcgtgcaccaggaccaggccggtccggccgcttcgagcggtggctccgggagcggtacgaactccgacacgttgagttccgctttcaccccgccgagcacgtacaacgcccagcagtcgccgcccgcgttcactccggcgcagggcattccgatggtcaggctgaccaaggaggcgccctggcaggaccggatgcgcacgatgctgcggatgccggtgaccgagcgtccggccacggaggcgatccagcggaccgacgacgagacgggtcccgccgtgccgcgggtactcgacctgacgctgcgtatcggggagctgctgctggcgggcggcgagggcgccgaggacgtcgaggcggcgatgttcgcggtgacgcggtcctacggtctcgaccgcagcgagccgacggtcacgttcacgctgctgtccatctcgcaccagccgtcgctggtcgacgacccggtgacggcgagccgtaccgtacgccgccggggcaccgactacacccggctggcggccgtgttccggctggtcgacgacatcacgagcacggacaccgagatctcgctggaggaggcctaccggcggctcgcggagatccgccgtaatcgccacccgtatccgggctgggtgctgacggcggccgccgggctgctggccggttcggcttccgtcctggtcggcggtgggttcctggtgttcctcgtggcggcggcgggcgcgatgctcggcgaccgtctcgcgtggctgtgcgccggccgcgggctgccggagttctaccagttcacggtggccgcgatgccgcccgccgcgatgggggtggcactgacgctgacccattcgacggacatccggccgtccgcggtgatcaccggtgggctgttcgcgctgctgccggggcgggcgctggtggcgggggtacaggacgggctgaccggctactacatcaccgcctcggcccgcctgctggaggtcatgtacttcttcatcgggatcgtcgcgggtgtgctgatcgtcctgtacctggggttgcagctgggggccgagctcaatccggaggcgcggttcacggcgtacaacgagccggtgatccagatcctggcgtcgatggcgctgagcctggccttcgcggtgctgctccagcaggagcgctccacggtgctggcggtcaccctgaacggcggcgtggcctggatcatcttcggggcgatggcccggaccggaggcatctcgccggtcgcggcgacggcggtggcggcaggtctggtgggtctgttcggccagttgttctcgcgctaccggttcacctcctcgctgccgtacatcacggcggcgatcgggccgctgctgcccggttcggcgacgtacttcggtctgctgggcgtggcgcagaacgagctggacacgggcctcgcctcgctgtcgacggcggtcgcgacggcgctggccatcgcgatcggggtgaacctggggagtgagatctcacggctgttcatgggggtgccgggcgcggtcggcggggcgagccgccgggcggcgaagcggaccagggggttctgagcgcggggccgcgcggggcccgtgcgcaccacgcgcggctgcgcgccccgtacctccac

SEQ ID NO: 3244 - DNA, 5279 bp, Unknown
  Kingdom: Bacteria, Phylum: Actinobacteria, Class: Actinobacteria, Order: Streptomycetales, Family: Streptomycetaceae, Genus: Streptomyces
  misc_feature (5127)..(5128): n is a, c, g, or t
acctgctggtcgctctgacgcgggagcgcgccaccgccaccgtgctggtcacgcacgatccggcgcacctggagcggatggaccgcacggtgacgatggacgacgggcggctgaccgtcccggccgcggtctgagcccggaccccgggccaggggctctgccatcgaccacttgtcgttgcggccgggccgcggccgccacgaggggtggccgggaccgtgcgggctcagccgccgttcgtgccgttgctcgccagtgcgtcggacagctctcccgcgatctgctggaggatcggcacgatccgctccgtcgccgcctccgtcacccgtcccgccgggcccgagatggagatcgcggccgaggtgggggagttcggcacggagaccgcgaggcaccgcacgccgatctcctgctcgttgtcgtccaccgcgtacccggcgcggcgcaccagctccagggcgtcgaggaagccctccggggtggtgatcgtcttctccgtggcggcgggcatgccggtacgggccaggagcgcgcggacctcgtcggcgggggtgtgcgcgaggagcgccttgcccacgccggtcgagtggggcaggacccggcggccgacctcggtgaacatccgcatggagtgcttggacggcacctgggcgacgtacacgatctcgtccccgtccagcagcgccatgttcgccgtctcgccggtctcctccaccagtcggctgaggtaggggcgggcccaggttcccagcagccgggaggcggactcgccgagccggatcaaccggggtcccagcgcgtagcggcggttgggctgctggcgtacgtatccgcagacgaccagcgtgcgcatcagccggtggatggtcggcaggggcagaccgctgctcgcggacagctcgctcagtccgacctcgcccccggcgtcggccatccgctccagcagatcgaaggcgcgctcaagggactgcaccccaccgctggaaccggagggcttggagtcggctgtgctggcgtgggacggcggcacgtcaacggtcctttcgaagcggaaggcaaggcagcagcctaccgggcggttcccgatcggcccacagctccccggtcggcgtcgatgccggtcagggactgttttgtccgggtgccgacggtcggtgcggacggctcggcgccgcctctcctggcccatgctacgttccgcagttcgaaatatgacttttactttgtggaaacctccagtcgggcggcaggggtggccccgggggtcgtcgtggcggaaggtggggtcttgacgagggcgattcccgcgtgaagactccatcgaaagcttcaacagttcgttgaattcctgctgtgatcattgctggagtgaaggagcacgggtgtccggtccggacgtgaacctgatactgcgctcgacgcgcgtcgtcacccccgaggggacccgcccggcggcggtcgccgtcgcgggcgggacgatcgacgcggtcctgccgtacgacaccgaggcacccgcgggcgcccgcctggaggacttcggcgacgacgtcctgctgcccggcctggtcgacacccacgtccatgtgaacgatcccggccgcaccgcgtgggaaggcttctacaccgccacccgcgcggccgccgcgggcgggatcaccacgctcctggacatgcccctcaactccctcccgccgaccaccaccgtcgagcacctgcggatcaagcagcaggtcgcggcccccaaggcgcacgtcgacaccggcttctggggcggggcgatcccgtccaacgtcaaggacctgcgtccgctgtacgaggccggcgtcttcggcttcaagtgcttcctgtcgccctccggcgtcgaggagttcccggagctggaccaggagcagctggcccgctccatggccgagatcgccggattcggcgggctgctcatcgtgcacgcggaggacccgcaccatctggccgaggccccgcagcgctccggccccgcctacgccgacttcctggcctcccgcccgcgcgacgccgagaacaccgcgatcgaagggctcatcgcccacgccaagcggctgaacgcccgcgtccacgtcctgcacctctcctccagcgacgcgctgccgctgatcgccgccgccaagcgcgagggcgtccgcgtcaccgtcgagtcctgcccgcacttcctcaccctcaccgccgaggaagtgccggacggggcgacggagttcaagtgctgcccgccgatccgcgaggccgccaaccaggacgcgctgtgggccgggctcgccgacgggaccatcgactgcatcgtctccgaccactcgccgtgcaccaccgacctgaagaccccggacttcgcctccgcctggggcggcatctcctccctccagctcggcctccccgccatctggaccgaggcccgcaagcgcggccactccctggacgacgtcgcccgctggatgtccgcagcccccgccgagctggccgggctgacccgcaagggagccatcgaggccgggcgcgacgccgacttcgcggtcctcgcacccgacgcgaccttcaccgtcgaccccgccgagctcttccaccgcaaccaggtcaccgcctacgccgggaagaccctgcacggcgtggtccgttccagctggctgcgcggtgtccgcatcgcctccgacggcgtcctcgccgagcccgcgggccgcctcctcgaacgcgaccactgaccgagctcaccggtccgctcctcgaacgcgccctctgaccgtgctgaccgtgcccgaaaggaacctgaccatgacggacgccgcgataccgcgcttcaccggcgacgcaagcccctacgcgggcggcgacccgtacgccgaccaccgcaccgccgacttccccttcacccacctcgtcgacctggccgaccgccgcctcggggcgggggtcgtcgccgccaacgacgagttcttcgccgagcgcgagaacctcctcaagcccgggcccgccgtcttcgaccccgagcacttcgggcacaagggcaagatcatggacggctgggagacccgccgtcggcgcggagtcagcgccgccgaaccccaccccaccgccgacgaccacgactgggccctcgtccggctcggcgcgcccggcgtcatccggggcatcgtcctggacaccgcccacttccgaggcaactacccgcaggcggtctccgtcgaggcggtcgccctgcccggctccccgtcccccgaggacctcctcgcccccgacgtgaagtggacgacgctcgtcccccgtacggcggtcggcggccacgcggccaacgggttcgccgtcgacgccgagcagcgcttcacccacctgcgggtcaaccagcacccggacggcgggatcgcccgcctgcgcgtgtacggagaggtcgcccccgaccccgcctggctcggcgcgctcggtacgttcgacctcgcggccctggagaacggcggccaggtcgaggacgcatccgaccgcttctactccccggcgaccaacaccatccagccgggccgctcgcggaagatggacgacggctgggagacccgccgccgccgcgaccggggcaacgactggatcagctaccgtctcgccgcccagtccgggatccgggccgtcgagatcgacaccgcctacctcaagggcaactccgcaggctgggcgagcctttcggtacgggacggcgaggacggggactggacggaggcccttccccggacccggctccagcccgacaccaaccaccgcttcgtcctggacgggcccgtccgggccacgcacgtacggatcgacatcttcccggacggcggcatctcccggctccggctgttcggatcgctcaccgacgagggcgccgccgccctggcggcccgtcaccgggagctcgggggttgatccccgaccccgcccggcacctggcacaccgcgatcgcagggggatcgcggtgcgtccggccgatcctgttacgtgagggtatgtcacgctggtcgaggtgcggcgagcaggtcctgggggccgggcgtcgcaccttcagacgtcctcgaccaggagccaccatgatcttcatcgccgtcaagttcaccgctctcgaccccgaggagtggctcacccggctggacggcttcaccgtcgccacccgccgcgagcccggcaacctcttcttcgactggtcgcgcagtgtggagaaccccaaccagttcgtcctgctggaggccttcgccgacgcggcggcgggcgaggcgcacgtgaactccgaccacttcaaggcggcgatcgcgacgatgtcggagctggtggccgaggtccccgagatcatcaacgtcgaggtggagggcaccggctggtcccggatggcggaggtcaccccgcgcaaacgctgatccaggcgctagaactcctcgtgggactccgggtcgccgccgaaccgccgctgccgcccggacgcgatcgtcgtcagctcctgcgccgtcagctcgaacccgaacagatcgaggttctcgcgttgccggcccgggtccgccgacttggggatcggcaccgcgcccagctgggtgtgccagcgcagcaccacctgcccggggctcaccccgtggtcctcggcgacggccacgatcgagggatcctccagcacctcgcggccccgggccagcgggctccagctctccgtgacgatgcccttcgccgcgtgcaccgcccgcagctcctcctgcgggagcagcggatgcatctcgatctggttcaccgagggcagcacgcccgtctcccgttccagccgctccagatgggcggcggtgaagttggagacgccgatcgagcggacgagaccgtcctcgcggagccggatcatcgccttccaggtgtccacgtacttgtcgacgtgggggagcggccagtggatcagatagaggtcgacgtactcgacgcccaggcgggaccgtgactcctcgaacgaggcgagcgtctccgcgtagccgtggtgccgtccgggcaccttcgtggtgacgaggacctcctcgcgggggaccccgctgcgggcgatcccccggccggtgccggtctcgttgccgtagttgagggccgtgtcgaccagccggtagccgatnncggcctcctcggccgccgcgtcgtccagggggtaggtgccgagccccaccgcggggagccgcgtgccgtcgttgagcgcctgaaccggtgtgccggacatgtgctggtcccgtccttcccgtcgctgcccccgtcccggccagcgtagggg

SEQ ID NO: 3245 - DNA, 1708 bp, Unknown
  Kingdom: Bacteria, Phylum: Actinobacteria, Class: Actinobacteria, Order: Streptomycetales, Family: Streptomycetaceae, Genus: Streptomyces
cctgctggaccgcggccccgccggggccgcggtccagcaggcggacgccgagcatccgctccaggcgctggatcgactggctgagtggcggctggctcatgccgaggagctcggccgcccgtccgaagtgcccttcccgggtcacggtgaggaactgctccagcagccgccgggacagtgcaatatccccaggcctatcgttcatgccgcaatcatatattggacagacctggacgtacgggtgtggactggaccgtgcacggcccgtgggatgccgccgcagtccgaccccgttcggcccgtcggcttgccgtccctccgggcagcccctctccgggaatccgttccgaggacggaccggggccgggctctcctgtccttctgattcctctggggtgatcttcatggcgatcgtgacgatcgtcggggccggtgtcatcggcatctcgtgggcacggctgttcggcgaggcgggctgggaggtccggatcaccgatccgcggcccgacctggccgaggtggtagcccgcgacctggcgggcttcgaggtgacggcgaccggcgacctggccgccgcggcggccggcgccgacttcgtccaggaagccggacccgagcgcaccgacgtcaaggagcggatactcggcacactggccgcgcacacggcggacggcgtggtgctggcctcgtcctcgtcctccctcctgccctccgtgatcgcgaagggcaacccggcggcggaccggatcgtgatcggccacccgttcaacccgcccgagctgatgccgctggtggaggtggtgcccggaccggagacctccgccgcgacggtggaccaggccgtggaggtgtaccgcgggctcggcaagctgccgatccggctgaagaaggagatcccgggcttcgtcggcaaccgcctgcagaaggtcttcaacgaccaggccacccacctggtgcagcaaggcgtcatcgacgtgtcggacctcgacgacctggtccgcgcctcgctcggactgcgctgggccaccatcgggccgttcgagagcggcaccctcggcggcggaccggccggcatgcggcacctggtggagcacgtcgggtcccagctgaccttcgagatcggcagccccgaccccgccggcatgggcgaggtcctcgacgcggtcgaagcggcctacggcaccggcgagcaggcataccggcgcctcgccgaactccgcgaccggcgcaccagggccgccctcgccccgctggactggcccgagcccccgaccggcgccaccgaaggaggccggaagtgaccgcggccggagcgaccccgaagcgcctgctggcgctgcagctcgtcccgggccgggtactggaggtggacaccgccgacggccgggtgcgcaccctggtcgaggacgccggggactccccggacggcgtggtcgcggtggacggcgccatgtactggaccacgatgggcacgcccgacgacgtcgaccccggcaccccgggcgagggcagctacgacttctcccgccgcaacggcggcgtccacacctggagcccgggcggcccgcggcgcgacctcgtcccggccggggcgatgaccaccggcaagcagctcacctccgacggcgcgggtgccctgtactggtgcgaccgcgagggccaccgagtcagccgggtacgcaccgacggcagcggcctgaccgacctc

SEQ ID NO: 3246 - DNA, 2382 bp, Unknown
  Kingdom: Bacteria, Phylum: Actinobacteria, Class: Actinobacteria, Order: Streptomycetales, Family: Streptomycetaceae, Genus: Streptomyces
cgtagcgggcgtaggcggcggtgcggacgggaccgccgaggatcgcggccgcgtagtggaccagcggaacctcggtgacgagggtggagaccgcggtggcgtgcacggcatgggtatggaccacggcggcggcgtcggtggagcggtagaccgccaggtggagggggagttcgctggtcggcccgaggtcgccgaggacctggcggccttccaggtcgacgccgaccgcgtcccgggggccgagccggtcgtacggcaccccgctgggcgtgaccaggaccaggtcgccgacgcgggccgagacattgcccgaggtgccgacgaccaggccgtccgccgcgctgcgacgggcggtcgcgacgacgtcccgccaggtccggccgacggattccgggtgttgctcgctcatggggcgagcgtagggcgcaggacgcgcaaccggaacgtcacgggggaggtgacggaggtctcttccgggtgccgaacagccgttcaaaatgttcgccaactcgtggcaaagggcagtccacgtcccaccccacaggcgtcacgcagcccctcccggacacaagcggagggaacgcactccgtttggggtcaccgcaacgccctgcccagttcatcttccgttcatccaggttgcctacggtccacgtgccactgacgtcgaacgattgcctgggtaaatggaacacatcacgctgctgcttgcgattgtggtcgtgacagctctcgtgttcgatttcacgaacggtttccacgacaccgccaacgcgatggcgacgaccatctcgaccggcgccctgaagcccaagacagcggtggcgatgtccgccgttctcaacctgatcggcgcgttcctgtcggtggaggtcgccaagacgatctccggcgggattgtcaacgaggacggcctcagaaccgaggtcatcttcgcggcgctcgtcggcgccatcctgtggaatctcctgacctggctggtcggcctgccctccagctcctcccacgccctgttcggcggtctgatcggcgccgcggtcatgtcggccggctggtcctcgatcaacggcggcaccgtcgtcaccaaggtgctgctcccggcgatcgccgctccgctcgtcgccggcctcgccgcgatgctggccacgcgactgacgtaccggatcaaccggaacgtcaccgacgagggccaactgaagtcgacggccaagggctaccgggccggacagatcgcctccgccggtctcgtctcgctcgcccacggcacgaacgacgcccagaagacgatgggcatcatcaccctggccctggtcaccggcggcgtcctcgcccccggctccaacccgccgctgtgggtcatcgtctccgccggtgtggccatcgcgctcggcacctacctcggcggctggcgcatcatccgcaccatgggcagcggcctgaccgacctcaagccgccgcagggcttcgccgcgcagaccagtgcggcgaccgtcatcctggcctcctcgcacctcggcttctcgctctccaccacgcagtcctgctccggcgccgtgatgggcgcgggcctcggccgcaaggggggcgtggtccgctggtccaccgccaccaggatgttcgtggcctggggtctgacgctgccggccgcgggcctggtcggcgcgggcgccgagttcctgaccaagcagggcacctggggcatcgcggtcaccgcgatcctgctcgtgggcggttccttcgccatctggctggcctcgcgccgccagccggtcgaccacaccaacgtcaacgacacggccgggggcgacgacgagccccagggcgtcgtcaccaccgccatcgccgcggttcagccgccgcccgtcggcggcccggcctccgacctcatgaccaccattccggccccggccccgtcgcccgacgacccggcccggccgccggccaaggtgtaaggaaagatccgcatgaaaatcgactgggcagctctcgcctccgtgttcggtgtcagcctcgtggtcaccgtcgcgctggtcggcctcttcaccctgggcatcgtcgccctgtccaagcagtccgccacggcgggaagcagcgccgccggcgggtcggtcgcgctggcccgcaccggtgcgtacgcctgcttcgcgctgtgcgtcgccgctgtctcgtacgggatctacctgatcgtcgcctgaccccgtactgcgctctccttcgggccggacacaccctcgtgtgtccggcccgatgtgcgtctgcgcacagtggagcctcgcaggtcaacagcgagttgacggttgttcgcggggcgtggtggactgccggagccatttacggcgacagcagaggaagccggtgcgaatccggcgcggtcccgccact

SEQ ID NO: 3247 - DNA, 9974 bp, Unknown
  Kingdom: Bacteria, Phylum: Actinobacteria, Class: Actinobacteria, Order: Streptomycetales, Family: Streptomycetaceae, Genus: Streptomyces
ccgagcggccggcggtcaccgtcaccccggccccggccgacgtcgaccagcacgccgcctgggtggagaacggttccgccgcctccgccgcgcaggccggccgggcgaccgcgctgcgccgggtcaccgtgccggcacagtcgaccggtccggtccggctcgctctgctcgacctcgccatgccgagggacatcgacggcgccgcccaccgcatcgacggtgtgcgcctcgtcgacatcgagtcgctcgccgaggcgtccgccgacgccccgatggccgccgatgtggaccgggtccgcaccatcgtgtccgacgaggtggccgccttcggcgccgcccagcgcgccgcgcacgtcgcaccgaccgtggtcgccctgcgcaccatggccgccggcgtggtcgccggcgagatcgcccggctggacggccgccttcccgacctggacgagaagcagcgcgccgagatcacccagaccgtgcgccgcgtcgtcgacaaactcctgcacgcgcccaccgtgcgggtcaagcagctcgccagcgagcccggcggcgccgggtacgcggacgcgctgcgagaactcttcgacctcgacccgcagacggtggccgccgtctcccgggcagacctgaacgacccgaatagagggcggtcatgaccgacaactcatccccgggcgcgcggaactccgcgccgctccggctgggcacccggcgcagcaagctcgccatggcccagtccggactcgtcgccgaggcggttcgcgaggtgaccgggcgcgccgtcgagctcgtcgagatcaccacgtacggggacacctcccgcgagcacctggcgcagatcggcggcaccggcgtgttcgtcgcggccctgcgcgaggcgctggcgcgcggtgaggtggacttcgccgtccactcgctcaaggacctgccgaccagccagcccgacgacctcgtgctggcggccgtgccgcagcgtgaggacccgcgcgacgcgctgatcgcccgggacgggctgaccttcgagcagctgcccgacggcgcccgcgtcggcaccggttcgccgcgccgtatggcgcagctcaacgcgtacgcccgttcccacggactgcggatcgagaccgtccccatccggggcaacgtcgacacgcggatcgggttcgtgcgcgacggggagctcgacgcggtggttctcgccgccgccgggctcagccgtctcggccggagcggtgaggtgaccgagttcctgccggtcgacaccgtcctgcccgctcccggccagggagcactggcgatcgagtgcgccgcgtccagcgccgacctcgccgccgcgctcgccgagctcgacgacccgtacacccgggccgccgtgaccgccgagcgtgccctgctcgccgccctggaggccggctgctccgcacctgtgggtgcgctggccgacctcctggtcgacggacaggttgtcaacgaactgcgcctgcgcggagtcgtcggtaccaccgacggttcctcgctcgtacagctgtccaccaccggtcccgtccccacgtcgcacgacgacgcggcggccctcggtcgcgaactcgcggccgagatgctcgccaagggtgcggccggtcttatgggggagcgagcactttgagccccaccggccccgccgcatccgactttccggtcctgtccgcacagggtcaggtcaccttcctcggcgccggtcccggcgacccgggactgctgaccctgcgcgccgtcgaggcgctcgcgagcgcggacgtccttgtcgccgagcccgatgtgctcgacgtcgttcgcagccatgcgcgggcaggcgtgagcacgcctgagctgaccgtcgttgacaccccgtcaacaaccgtcggtgtacccgttctcagggatgcggccaatcttgtcatggaggccgcgaagggcggcaggcgggtggtccgtgcggtcgcgggcgacccgggcctggacgggaacgcgggggcggaaatgctcgcctgcgccgccgccggggtgcccttcgaggtcgtcccgggcgtcgcgaacgccgtcggcgtctccgcgtacgccggggtgccgctgcgtgacgcgcagggtgcggacgtccgcttcgtcgacgcccgtacggcctccgaccggtgctggagcgaggtcggcgcgagcgacgcgaccgccgtcgtctccaccacgctggactcggtggccgccgccgccggtgagctggtctccgcgggccgcaagcccgacaccccgctcaccgtgacgatcgcgggcaccaccacccgccagcgcacctggacggcgaccctcgggacgatcgcccaggtcctcaagcaggccaaggtgctgccctcgcccgagggccaccggccggtcatagccgtggtcggagagcgcagctccgccgcccagcgcgaccagctcgcgtggttcgagtcgaagccgatgttcggctggaaggtgctcgtcccccgtacgaaggagcaggccgcgtcgctctccgaccagctgcgttcctacggtgcggtgccgcacgaggtcccgacgatcgccgtcgagccgccgcgtacaccccagcagatggagcgcgcggtcaagggcctggtcaccgggcgctacgagtggatcgccttcaccagcgtgaacgccgtcaaggcggtccgggagaagttcgaggagtacgggctcgacgcccgtgccttcgccggcatcaaggtcgccgccgtcggcgagcagaccgccgcggcgctgatcgacttcggcgtgaagccggacctggtgccgtccggcgagcagtccgccgccgggctgctggaggactggccgccctacgacccggtcttcgacccgatcgaccgggtgttcctgccgcgtgccgacatcgccaccgagacgctggtggccgggctcatcgagctgggctgggaggtcgacgacgtcaccgcgtaccgcacggtccgcgcctcgccgccgccggccgacacccgtgaggcgatcaagggcggcggcttcgacgcggtcctgttcacctcgtcctcgacggtgcgcaacctggtcggtatcgcgggcaagccgcacaacgtgaccgtgatcgcgtgtatcggccccgccacggcgaagaccgccgaggagcatggcctgcgggtcgacgtgctgtccccggagccgtcggtgcacaagctcgccgaggcgctcgccgccttcggcgcgcagcgccgggacgcggcgaaggaggccggtgacccggtgacccggccgagcgagcggcgcccgggtgcgcgcaggcgtcggacgacgacgtagtggtacgagggtgagcgggcccggtcgcttcggcggccgggcccgccgccgtctccgggccggccggccgggtcggtggccgggcctgtccgcgggcctttcccggcgcgggtgtcggtaagaccgtgccgcgtgcgggtctatcgtcgaaggatgactgcgtacggaaacttccccggctcccgcccccggcggctgcggacgaccccggcgatgcggcggatggtcgccgagacacggctcgaccccgcgaacctgatccttcccgcgttcgtgcgggagggcatcgactccccggtcgccatctcgtcgatgcccggggtgcaccagcacaccctggacactctgcggaaggcggccgtcgaggcggtctcggccggcgtctcggggatcatgctcttcggtgtgccggaggacgagaagaaggacgcccggggcacggcgggcacggacccggacggcatcctccaggcaggcctgcgcgcggtccgcgaggaggtcggcgacgacctggtcgtgatgtcggacctgtgcctggacgagtacaccgaccacggccactgcggagtcctcgacggcgacggccgtgtggacaacgacgcgacgctggagcggtacgcggagatggcccaggtccaggcggacgccggagcgcatgtggtgggccccagcgggatgatggacggccaggtcggcgtggtccgcgacgccctggaccagaccgggtacgaggacgtgtcgatcctcgcctacaccgcgaagtactcctccgccttctacggccccttccgcgaggccgtcggctcctcgctcaccggcgaccgcaagacctaccagcaggacccggccaacgcccgcgagtcgctgcgggagctggcgctggacctggaggaaggcgcggacatggtcatggtgaagcccgccggaccgtatctggacatcctcgccaaggtcgcggagtccgtggacgtgccggtcgcggcgtaccagatcagcggcgagtacgcgatgatcgaggccgccgccgagcggggctggatcgaccgggacaaggcgatcctggagagcctgaccgggatccggcgggccggggcgcagatgatcctcacctactgggcgaccgaggccgcgcagtggctcgggcgggacgcgcggcgctgagccggtccgctcggcctgttgtggttcacggcccaccggctccggtctcctggagccggtgggcctccttgatggcgaagcgggcgctgtcccgtacgagcgggtcctcgtcggcgcgtgcggtggtgttcaggaccgtggcgacgaccggatcgtccgtgtagggcgccagcgacatcgccgcgtactggcggaccagctcctcctccgggtcccccagggccctgagcagggcgcggcccgctgcgtggcgcagagcgggatcggccggaggccacaggcgcaggacggtggcgctctcgacgcgggcgaggtcgtattcgcccgcgtcggcgacgaccgagacgaggaacggcagcgcctgggcgttggcgtccagctcggtgatgatctcgcgcttgcggtcgctgtcggcgggcagggagcggaactcggctatcaggcgttccgcggctgccgtcgcctctgtggtcgtgaggttcgtgtcgttcatgggggtggacactttctgtcagggccagtcgaccagtgccatgaatgctacgaaagcgaccaccacgacggtgggggcggtgagcgccaggcccacgcgccgggcggcgtagcggagctggtgggggacggcccaggcggcgaccagcacgatcagggcgaggatcaggccgacgcacaggacggtccacgcggtcatgtagctgtcgtggaagcggtcggccaccgcgccgttgcaggagccgcactccatgggcgagagcgcgccgtagaccagggcgagcagcccggacggcacggtcacgaccgaggagatcagcggggcgatccaggcgtggtcgtggggcgtctcgtcggggccggccgccggggtgctgccgccgtcgtggctgttctcgctcatgcgtccgagtcaacctccgggtgcggcctgccgcatgagtacgagggctcagtccgcggcggtcctgtcggcgcgggcctccgcccaggcgtgcgccgccgccagttgtccgtccgtgagggccgggccgacctggtccgggtagtggaacgcgtagtgctcgcgggcggccttcaggccgatcgcgcgggccgcgtcggtgaggcgggggtcgtcggcgacctcctgggcgcgccgcagccagctgtggctgcgtgggtcgacggcgtagtgccagagcggctgggcggggtcggccaccccgatcaggacccggtgcaggacgtactcgcggacgccgcgctgtccgatcagccgctcggcgacgagcagggggtgcgtgccgtcgagccgggcgcggagcagcacccaggtcatcaactgcccgttgtcgtccgcgccggagaccacgaagctccacagttcggcggccttcgtctcgtccggtgcgccgaggtgggtcagcagccggaccggggccttccagagcggcttgggcttcgcccaccaggccagcatcgcttcggcggccgggtggcccagatcctgggcgaggcaggtcagggtgaccagggggtgacgccactcggtgtaggtggtgcggtactgcttggtcagctccttcttccagcgcggcaggagtgcgtccagctcggtttcgcccgcctcgccgtgggtgtggagcagttcgaggcagaacgcgatgccctggatgccggtggacgggtcggccacccggtcgcgcagccaccggacgtcggcgggggtcagggtgcggtagtggtggtagatgtcgcagagcctgccctcgtaaccggtgaggtcggggccggtgcccgcgagcagttcgtcgcgggcggcctcgtagcggtcggcggcggtgagcacctcggcctcggtgccgccggggtgctgggccgcctgttcccgtacgtgggcgacctggtcgtccgcccttcgcgtggccgccacgcgaagggggcgcggcaggtcgtcgtcggtggcgaggcggacggcggtgagggccgcgaacgcctgggcggcgtcgcggtccgccgtcggccgggcggcggtccagtcctttgtgacggcggcgctgagtgcggcgaacaggctgctcagggaggcctcgggggcgtcgtgcgcggtcaggtccgcggcgagcagggcggcggaccgtacggggtcgggctcgtggaccgcccggtgcacgtggagccaggcgcggatcgcggtgcggtggccggcgagcgaccactcgcgcaggacgtccagggcccggggggagggggccgcgccgagggagtcggacgccggggggccgaggaccgccaccgtgtcccagacctcctcgtggtcgtggcgcagcagcgcgtccagcagcgccgcccaggcgggccattgggtgagccgtccggcgtactcctcccgccaggccggcagcagccgtgaggtctcctcggggttcagcgcctgtcgtgactccagtgcggtgacgaatcccgccgtcccggacagctccaccggatcgcgcagccggtcgtgcagccaggtctcctcggcggcggtcagcgggtcgtgctccccggtacgggcggtcctgccgcggggcgtgccgaggcggtcgaggaactggcggacccctgcggtgtcttcggggtcgggcagtccgtcggcgtccgtcgccgtgaccttgtcgagccggaacgcgccctcggggccgccattgaggatccggtagccgtgcgggccgtcgccgaggcccgcggcgacggtggcgtggtcaccgccccagtgcacgtacagctcgccggtcaggccgccggagcggtcgaaggcggagtgggactgccagtgccagtaggcgaaggaggtgctggtggcgagggaccgggtcgcgaacatctcggccgcgtcctcgtggccgtcggactgggtgtagcggctccgggtcggcggcgggaggacggcgaagccgtcgccgccgagcgtgcgccaccacttcttgatgctgctgaggtccgaccgctgcccggccggaaggcccttgtccgatgccatcgtgtcccgtcccgtcgtgcctggtcccgctgcctccggtcccggctggttcagtcccaccagaacgaccacgcttcctggttgagcaccgccttctcggcgtagacgccgaggtcgtacggcggggactggtcgatgttgtccgggcagaacgcgtagtgctcggcggccagggcgcgggcttcttcggcggtggagggcgggcggcccacggagacgatcatcgtgtcgaagccgagcaccacgacccgggcgtcgtaccggtcctcccaggagcggaggaccgcgcagagccgggccacgtcgttctcgtggttcatcgggcccgaccagccgatcgccgccggtatgtcggcgctgcggcgggccgggacgagagccatccgggctccgccgagccattcgtcggcgtcggcggcgatcacacccgcgagtcctgcggccgccacgtcggcgtcctcggccgcctcacgggcggggacgggcgcgaggccgggccaggagccggggcccccggagccgtcggtgtccggcccggtcccgtccgtgtccgatccggccttctccgggctcacctcgtcggccgcgttgtccgtccagtagcccgcgagcacctcgtcggcgtcgtggtcgccgggatacgacgtgtcgtccgggcagaggtcccactcctcgggccactggtcgcgtcggccgcccgtgaccagcaccggcagcagcccgagcggcctcccggccgctcgcagcctcgaccagtcgcgcaggtcggccgggccgtccgcgtaccagagcagcggctcgtgccaggggccgtccagcgtggcgtccaccagggagccgggcgggaggtccaggccggaagtggccagggaagggagtggattggggagcgtcgccatggtggggagcctaggcggcaccactgacaacgtcccggccgcacccctgtcgcccgtgcgctattgccggtgcggaaggggaggcggtacgggacactcggccgggtgatcgtgatgcaacccgtcctggagacctacgcacccgacggcttctccctctggcccgttgccggaggcgagccgtcgcggttcacggcgttgagcggaaagctcacttccgccgaggtcgggacggcgctgatgctcatcgcccggtgcaacgacatcgaccccgatcccggagcgggggacgaccgaccgccgcgtccggccgacccgctcgcgtccttcctgcacggcctgctgacgttcgacgacctcttcgccgccggtggcctgcgggtcgtggacggctcgaccggcgtcaccctgctccccggctgctgcaacgggctggaggactggcgtgatctgtactcggtcctcgacggcaccggatgggcctacctcgggcacgaccccgaccccgtcgtcgaactggtcggcgacaccgtccggatggtcgtggatgccgagcagagcgacagcccggtgatcgagttgtccgccgtcgagttgcgccggctgctggacggggtcggacgcgacctcgccgccttcctcgccctggcgtccgactgggtccgccgccacctgcccgaccatgccgaacccgtcgtcggcgcactcgtccgcgtcctcgccgtacccgcgaacggcgggaccgagcgagcctcttgaccgccgcgaccggcccggggtccgaaagccggtgcggggcgggggtggctggataatgatgtcgggcatgagtttgtacgtcgatgatcccgcccgcctcggaaccacgcgcctctccgacgggagggtgctcggctgggccgagtgggggccggaggacgggctgcccgtcctgctctcccccggggccgcgaccagccggtggctcgggatcggggccggggccgtcgagaacgagggggtccggctggtctcggtggaccggcccgggctcggggtctccacgcccgcgcccgaccggaccttcagcgacttcgtggacgacgtacgggagttgaccgcgctgcgcggcctgggcccgcttccggccatgctcgggaactcccagggtgcacccttcgccctcgcctgcgcggcggcgggcgtcgtctccgcgctcgcgctcgtctcgcccgccgacgaggtcgcggcccccgagttcgccgccgccctgcccgacgatctgcgcggcgtggtcgcgcgggtggcggaggacccggtcggggcggagaaggtgttcgccgggttcgacgcggacgggatgcggcggatggttctggccggaagtccggcgtgcgatctcgccgtgtacgaggatcccggtttcgccgccgcctacggccgtgccctcgacgaggcgttctcgcagggcgcggcggccgggtacgcccgggacgccgtgctcgccatggggcgctggtccatcgacctcggcgcgatcaccgtcccggtcgaggtctggtacggcgaggaggacgtctcccactcgcccgacctcggccgccgactcgtctcccgtatccccggggcgcggc

SEQ ID NO: 3248 - DNA, 2422 bp, Unknown
  Kingdom: Bacteria, Phylum: Actinobacteria, Class: Actinobacteria, Order: Streptomycetales, Family: Streptomycetaceae, Genus: Streptomyces
ggtacgcggcggacgcgcggctggcggagtccgcgcgtccgccgcgtaccgaccccggccggtggaggcccacgctccgggacgatctggaggacgtggcggcgcgggccggactgaagccggacggttcgggccgggtgtcctgcccgttcggttacgcggacgtgaacagcgcggtgcgcggacttctgtccaccgggctcttcgacgccgcggtacgggccacggaccgctcccaggtggagaaggaggtcgcggaggccctgcaaccgcaccggcggcaggacggcacggtgtggatgccgaacgtcttccgctatctggtctgcgtgacctgagcgatccgacagcgcgacacgcgtaaggggcgcccttgagaaaggacgccccttacgcgtggtgctagctcgcgctacatgaacttcttgaactcgtccggcagctcgaagttcttgtcctcctgggcgggcaggccgaacgcgccgccctgggccgcctgctctcggcgctccgcggcggctgcctcctcggccttgcgcttcatggggttgccgctcttgcgcttgcccttggcctgcttgacctgcttcttctgacgaccggccccgccgcccatgccgggcatgcccggcatcccgggcatgccgccgccctgagccatcttcgacatcatcttgcgggcctcgaagaagcgctccaccaggctcttgaccgcggagacctcgacgcccgaacccttggcgatacgggcccggcgcgagccgttgatgagcgtcggctcggcgcgctccttgggggtcatcgacttgatgatcgcggcggtgcggtcgatgtcgcgctcgtcgatgttgttgatctggtccttgatctgccccatgccgggcagcatcccgagcagcttggagatggagcccatcttgcggacctgctccatctgggacaggaagtcgtcgagcgtgaagtccttgccgcccttgctcgacgacagcttggaggccattttggcggcctcttcctggctgaacgtcttctccgcctgctcgatcagggtgagcaggtcacccatgtcgaggatgcgggaggccatccggtccgggtggaacgcgtcgaagtcctccagcttctcgccgttcgacgcgaacatgacctgcttgcccgtgacatgggcgatcgacagggccgcaccaccgcgggcgtcgccgtcgagcttggagagcaccacgccgtcgaagccgacgccgtcgcggaaggcctcggcggtgttgaccgcgtcctggccgatcatcgcgtcgacgacgaagaggatctcgtcgggactgacggcgtcgcggatgtccgcggcctgctgcatcagctcctggtcgatgccgaggcggcctgcggtgtcgacgatgacgatgtcgtggaccttggccttcgcgaactcgatggagtccttggcgacctggaccgggtcgccgacgccgttgcccggctcgggggcgtacaccgagacgccggcgcgctcggcgacgacgctgagctggttgacggcgttggggcgctggaggtcgcaggcgacgagcagcggggagtggccctggcccttgagccagaggccgagctttccggccagcgtcgtcttaccggcgccctggaggccggcgagcatgatcacggtgggggcggtcttggcgaaccgcagccgccgggtctcgccgccgaggatggagacgagctcctcgttgacgatcttgacgacctgctgggcggggttcagcgcctgggagacctcgacgccgcgcgcccgctccttcacgttggcgatgaaggcccggaccacgggcagggcgacgtcggcttccagcagggcgatacggatctcgcgtgccgtggcgtcgatgtccgcctcggacaagcggcccttgcccctgaggttcttgaaagtcgcgctaaggcggtcggagagagtatcgaacacggcgctcgtcggtcctcagggtcgggggcggggcaggtcagtcgccctccagggtatccgtcccccggagaacgccaagccctcgccctgatacggagccgggcaagggcgtgatgtcggggttccgcgggtcagcccagcgccttctccacctcccgggcgacctcggcggcccggtccggggacagcggttcgccgtcggtcccggtgacgtagaaagcgtccacggcgttggcgccgagcgtggagacatgggcgctgcgcacccgtaccgcgctctgttccagggcccggccgatccggtgcagcaggcccggggcgtcctgggcacggacctcgatgacggtggcgcgccgggagcccgcggcggccacggtcactcgcggcggcggggccttcacgccgcgccggcgcgggtaggcggcctcgcgctcggcgaggcgggcccggatgtccagggag

SEQ ID NO: 3249 - DNA, 9369 bp, Unknown
  Kingdom: Bacteria, Phylum: Actinobacteria, Class: Actinobacteria, Order: Streptomycetales, Family: Streptomycetaceae, Genus: Streptomyces
cgtctccgccgtgcggggtcggcggccaggaggcgggtgtggccagcgggggatcctccgtaccggtctccgaggagtcggcaggagggcgtccgtcctcgtggtcggtccggcgcatgtgcctgcggatgttctccgcggcctccggccggcccgccgcgtgcgacgtacgcgcgaggcggtccaggaacacccttgtctcgtccgacccctcggtgaacccctcgctgtccagccaggcggtcaggagatcggccggaggttcctgccccgctgccgggcggctcgggctatggcccggcggggtctgcccaccgtccggctccgggtggtcgaatccgctcatcggctccccttccaccggcttcccgcggccccggaacagatcccagtactcctctgggatctcctcatcattggcggcggcggacaggaccgtcagaggagcgatcatgtccaccgcacgctcgatctggtcgtcgttgcgggccatccaccagaccaccgcgctgccggggctccgtagaacgtcctcccccaggtactccctgaggttacgctcgtgctgccgtcggctctcccaactacccatggctttgcgcagcccgtccagctcttccaggtgctctcggtccctgggccgcaggaccagccggatgtccgtggcgaaggactccaccagccccgaaccgtcgaggcccgatgttcccagcagtccctccagcgagcgctccaggaacgtgcaccgaccggggttctcggtcagcgtcatgctctccacacgctgcaggacggacgtcgcggccagggctgccgggttgccgtgcgacgaggggctgaggctcccggcgggccgccaccagactgaggcggagaacaggaaggggcagtcctcgacggcgctctggacgggcacgaccacaatcgacgtctcctggtaggggacttcgaccgggggctccggaacagactcgtccaagtccaggtcctgggccgtgggacgtgtgccctccgcacgcgacacccgcatatcgatcagcagagcaccggcgatgagcgcaggcaggaggaaccacacccagagcggacggccgagcgtgactcccaccaccagcgtggtggcaacgacgccgccggacatgaggcgcgtgatgtgctgggtactcatagtccttcccctatccctcgcgcacccgaagcggaggtgaggcctccgactccttgtgcaaggtcgatttcccggcagaaccggtcggcggtccgcgcgcggtcgtcgcactgggcccggagcccctcaggcatgtcgacgggctccgagtcggcccagtcgcacgtcgtcacatagagctggttcaacaggtcccggtctccgtaggcagccagcagcaacgcgttcaggacctcctcccccgcctgccgcagcgtcagggcggcgagccagcgctgcaccggagaggaccaggcgcgcgccggcttccccgccatcacggcccgccaggcaaagacgaacgcctgccagggcgggtggacgcgcagttcggcagggtcgagcagcgccagaagtacttccaagccgccgtccgccggtctcgcccgcggcagaaggcggtgcaccagacgcccgtacagctggcggttgccgcgtgccagctcgaggagcgcggagcgggccgccgccttgatgtcttcggggttctcctgccgcagcgcgagatgcctgagccggaccatggcctgctccgggtgcgtgacggccatcacctgccggcacacgaccgtcagcactcgcgcgagatcgggcgctaagcgcgccgtcgtcacccactggtagacgtgcgagcggaagcgcgacccgtaccgttcgtggctcaggcccagttcgagcgccgccgcggcctcggcccgcagtcggccctgtaccaagggttgggtccatctctcgatgagcaggtgcagatcatcgggtcggtcggtccacagggcctgttccgcgaaacgggcgaccagacgcgcgcggccctccgccccgaggccgggaagctccatgcattcgcccacccagtcccggaagtccgcgcgaagatcgggaaagttctcccagaagtgccgtctgaccgcgtcgtcgtaagcgagcctgacgaaccgcacccgcccgtcgtcctcccgggccagggacaactcctcgagccgttcgcccagacccgcccgagccagtctgggcgtttcgtcctgagggtgccccaggacgcccaggaggctgtacgcggcgctgagcaccgtgtccgccggtccgccactcgtcatgctcgccgcgagcagcagtgctcgttcctctgcgcctcggtgctgccgcagctctccggccacctgctgcgaccagttggtcgcggcggccacggcctcgtcccgccagtgctcgaaattcgtgccaccgccggcccggtcccgggcctggaccaccaggcctgccaagcggtccagctcccacatgggagcggtcccgaacagatggggcaggtcaccgtggtccagctgctcgtgctcgaacctcacgccccgcaccctcagatgccgactgaagaccgcccgcccgctcggccgttcgaggtgcacggccaatggggcgagttccgcatcgagcatccattccaggccggacggagtcacggtgaccagccgggcaccgctctcctcgaccagcgcgcggtaggacatgagcgtgcgctgagcggccgggtagtcgctgtcaccgatgctcgacaggtccagcagatagcggtcgtccggcgaagggtcggggagctcctcctccctgaccgtgggcagttcctcgatgcggctgccctgcaccgacgcctccaccaacagcatggtcgccgtggagcgccggccgatcccgggcgggccttccaagagcaccactgcaccgggccgcgccagccggtcggccgcccgggcgtatccgcccggccatacgaagcacttggcgagccgccgccgatgctcgcgtacgatctcccgccgatcgaccccggccctgaccaggggttcacgcaggccgatcgagtagtagtaggtgttgcgctggtcaccaccgccgctgtgcaccggtccctgcgggtcactgatcgacgtgccacccgtgccggtcaacgttcctcgtccacaggccgcccgttccggtccgccctctgccggacttccccatggttctcgcccacgtactgcacgttgcttccgtcgccggagatacgcgggcccaggtactgctcacgcgcctgatacaggtgcccgctcccggtgtggaccgggccctggggctcgctgacgaaggttccggagaagtccccgttaagattgccgatcccgccgcgctggcggtgcttgatcaccctggcatgcctcggggcgtctccggccccgtccctgtcggtaccgcggtcgtcggccgacggtgctgaacgggtccggtagccgttgctccgcgcggcggctcccagttcgggcagcagctccacgaggtcgtcggccagccccgtcaggtcggcgtccgcgttgcggtggctgagccgccggtactgacaggaggccagggcctcgatgtcgccgggaaggtcgtcggggcgcagcctcttcgcgccaccgaccagcagagggatgaccacggccccggtctcgagcgcttcccggatctcccgccgggtccagtcgtcctcgtcctccaaagggctccggccgccgggggctcccggctccagccagcggggccccatgacggccagcagcacgctgctgcgccggactgcggtgagcagttcctgggggaaccggcttcccaaccggatggacttgctcgcccggaagacaccgtcgttgccgaataccctggaaagttccctttccacgagtgtggcggtggcttcctcgtcgttggttcggtaattcacaaagatcaaaggcacgcggaattccgtttctgtgtgatgatcccattcgcgctggaaaggcaagcgatgccaaggggatgccgaaggccggagccggatgggcggaaccgaatggtctccccggcatgaaggaaagcggccgaattgctgtgcggccgagactactgtggccggaaacagtcctcagcgaccagcgccgagtacgttggcgagtgccggccggagtccgcgcaccgccgggtttccgcggaaccgtgaccattcacggtccagccgacgcacgtccgtacggatggtggccgagggaacgacgctcatgaaagccagcagttcgcgagctgtttcgcaggaccgctcgatctcacccgacgcggcgagcgccagggcatgacggaggccgtaccgcgcgcgggcgttcagtgcgtggggtgcgatgcgccggcactggtgctccagcatgtcggcagacggtcgggggcggcccaggtcgtagaggcaccacccctccaccatcgataccgggtccttgagttgggtggtgccgagcaccgggccgcccgatgggtccacgtcggccgccagaagatcgcgcgcccgttccagcgctcttccgcaggccctttcgtcaccggcgagggcatgcccctgggcctcgcgctgggccgccagacctctgatcctggggggtgcggcgctacgctgagcctgtcgggcgagcgcgatcgtccgggacgcgtccccgtcgtagtaggtgacgagcgcacggcggaccagcgcataggccgccaggtgcgtgtccccaccggcctgagccagctccaccgcctcggccgtggcgcgcagcgcggtggtctcgtccccgttctcctgagccatccacccgatgtactcggcgaagcgggaggcggtgatcagcaggccggcccgggaggatccggtggtgcgggaggccagcgtcgtgacggtggaggcctgcgagcggaggacgggcagcatcgcggcgggcgcaaggctctggcccaacctcttcatctggtgcagctgttcctggaagagggcgcctggcggcaggtcctgatcgccgacatgaccggtcccgcccccgtccgccatgcgggcggcgagcagggagcccacccctgtgacgatcacccggcgccgcgcgggcctccgcctgcttccggccgactgatcctctgcggagaacagtcggcgcaaccgtccgccggcatcgaagtaggcgtcacagcactgggccagattcatcgtggggggattcgcaccccgctcgatcttggagagatgcccggtgctgtaggtcgtgacctccgccagctgcttgagcgtcattcccgcgtcctcacgcagccgacgcagctccgcaccgaaacgtaacgggacgtccatacccccacctttcccacagcctgtacggccgaattacccctcggccgcctcctgaagaagattctggcacggtcgcgcgtcgttcagccggataaagctaagtttcatgtttcctccttctgttcgggaacggcaaaccggggcgcagcacatggcccgtgttcgactgcggctcgaaatatggcgttcgactggcaggatccttctgacgccgattccgcaccccgtctcttcagagatgcgaaatatcgggttccgcatcgcacgatttccgtgattaccccttacggccgagccggccgacctcgcccatctggccgagaccgaggcggctctgcgctcggccgtcgacacctcgtcccgggttgccgccgcccgccacgcaatggtgtggcaaggctgagcaccgatgaacgccaccccgcggcggcacaactccagcgtctcgtgcgtgaccacgccaccggcgccgccccggcctccgctgcccccggcgtcatcgccggggagaacgtgcggctccaggccgaccgcggctcgctcgtggtgggcgtggcgaacggggatgtgcacttcacttccccttttgcccgggtccggcacaggggctgaacggaccggctgactcaggcccacccccctgcgaacggatcacgcgggcggtgccgcgccccgccggagacgggaccatggcatgtcatcgcatggacaccgaagtgcgcggtcgtctgctcggcggtcacccccgggccgcggtccctcgcgccccgcgcatcatcttggcggaattcttccggataaagcttgggcacagcgacatccttcccacctgccctacagggcaggccagtcgtcacgctgccgaccgaccgctcatcggccccagccgggcgcccgccccatcgccatcccacgccttttctggcacaacagccaggtttcccacggcggcccatgtcccgccacgaccgcctgacagccgacctggcggccacaagaccgcgctggcaagaggcgtggcaccaagagtatggtctcttgtatggcgacgaagaaggtgacagtcacgattcccgaggatctcttggacgagatccgtgcggaggcggcagaacggggcatgtcggcgtacgtggccgaggctctgcgcttcaagcgcgaccgggaccgactgcgggaactgtcggactggctgcaggaggaacacggccctctcaccgaagaagagcgcagcactgcgctcgaagagctggacgacctcgatgccgagcacaagcgccgacacgcaacccgaacgcacgacggagaagccgcgtgaaaaagcggtccggcgagcccgggcagcgaccgctgcgcgtattcgtactcgactgcgaagccttgtcccttgccgtgcgcggggaccggaagatgatcgcgtggctcgacctcgcagcccggggtgaagccgaggtggtcacgtctccgatgacgctggtcgaggcgtacgacggaagaaccaccgagaagcgctgggactgggtgctttcccggctcgaggtcgccgacatcgggaaggacgaggcccgccaggcccgccacctgctggcagacgcaaatctgcacggccacaagtacgcgatcgacgcgatactcgccgttgtcgcgcgtcggcaaaaggggcaggtcaccgtcttcacctcggacgtcgacgacctggtgagactggtcccggggtcgatcgtcgtcaagaaggtatgacccgttcctccgttctcagtgcgaaggccccgaccgggaaaccggtcggggccttctgcgttctcggaacggcctcggcggggttcagcggcacaaggcggtgtccaccgcgtgttcgaggcttcttcgggctgcctcgccggtgagctgcacggtgaccgcgacgttggcggcgcggccgtcctcggtgacgccgccgcgggtctcgtaccccgggaagctgccgccgtggccccaggacaggccgccgcacggcagtggcctgctgacgagtcccagaccgtaccgggcgcccgggccgaaggtcgcttcggccgggacggtggagcgcattcgggcgagctggggcgcgggcaggaggcggccggtcaggagcgcggtgaagaagcggttgaggtcggagttggtcgagatcatctgtcctgccgcccagccccaggaagggtccatctccgtgatgtcgcgcaggggcatatccgccgactcctggtagtagccgtgcggatggggctctcggatgctcgcgtcgccgggagcggggaagtaggtgtggcgcagcccgatgcgcttgatgatgcgccggtcgatctcgtcggcgagcgggcggccggtgaccttctggacgatcaggccggcgagcacgtagttggtgttgctgtatttccagcgcttcccgggggcgaagtccgccgggtgccggagtgctgtggcgagcagttcacggggggcgtagtaccggacgtcgtccccgaggtggctggtgtactcggggagtccgctggtctgctggaggaggtggcggacggtgatgcggcgtccgtcgatccccttccctcggacgaggccggggaggtaggtgtcgacgaaggcgtcgaggctcacccttcgctccgcgacgagctggagtacgacgaccgcgacgaaggtcttggtgttgctgccgatccgcacctgcccgtcgacgggtaccggcgcgcctgtggccagatcaccgacccctgcggtgtaggtccggtcgcggccggacgggtccttgacgctcgccagcgcggcgggcgtcccgccgtcgcgcaccagcgcgttcaggctctgctggacggtggccggcccggccgaggcggcgggcgggaccagggccagcggtgtcatgagcccgacggtcatcgcgaccgcggcgggcaggatctgtcgccgggtgccgtgctgccggccggccggccggaatactcgccgttcctctgcacgcatgagtcgactcctgagggatcggtgggctgttgttcggggtgccggttgcgtgattcagccgcacagggccctgtccacggcgtcgctgacgtgccgtacggccgccttgtccgtcgggatgctggtgaccgcgacgttggcggcgcggccgtcctcggtgacgccgccccgggtctcgtaccccgcgatgtcgccgccgtggccccagtagacgccgccgcaggacaggggcctgctcgtgagtcccagcccgtagcggaggccggaggtcccggcggggacggtcgtgcgcatctcggcgagctgggcagccgggaggaggcggccggcgaggagcgcggtgaagaagcggttgaggtcggagttggtggagatcaactggcccgcggcccagcctgcggaggggtccatctccgtgaagtcgcgcagcggtccgtccgccgggctgcggtggtagccccgggggtgcggctcccggagggtcatctcgccaggggcggggaagtacgtgtggcgcagcccgatgcgctggatgatgcgccggtccatctcctcggcgagcgggcggccggtgaccttctggacgatcaggccggccaggacgtagttggtgttgctgtacccccaggtcttccccggctcggcgtcggcagggtgatcgagggcgagggcgagcagctcgcggggctcgaagtaccggttccggatctcgtcgtcgtcgaggtggacgccgtaatcggggagtccgctggtgtgctggaggagctggcggacggtgatgcggctcccgtcgatgccctctccgcggacgagaccgggcaggtaggtgtccacgaaggcgtcgaggtcgatctttccctcggcgacgagctggagtaccacgaccgccgtgaacgccttggtgttgctgccgatccgcacctggccgtccctgggcaccttcgcaccggtggtcaggtcgccgactcccgccgtgtaggtgcgggtgcggccgttccggtccttgacgctcgccagcgcggcgggc

SEQ ID NO: 3250 - DNA, 2736 bp, Unknown
  Kingdom: Bacteria, Phylum: Actinobacteria, Class: Actinobacteria, Order: Streptomycetales, Family: Streptomycetaceae, Genus: Streptomyces
gacatcgggcggccgcccgaacacgacctgcgccggatcatggacgccatcctctacgtcgaccggaccgggatcccatggcggtacctgccacgcgacttcgccccgtgggaaaccgtctacggatacttcgccgcctggcagaaggacggcgtcttcgaccagctcaacggactcctgcgacggctggtccggaaggccgagggccgagacgccgagcccagcgcctgcatcctcgacgcccaaagcatcaagacctcggccaacgtgcccgcggccggccagggcatcgacgcgggcaagaagatcgcgggccgcaaacggcacatcggcgtcgacaccgtcggcctcctgctggccgtgctggtcaccgccgccagcgtctccgacaacgccggcggaatccgcctgctctcgaacattgccgaaggccaccctcgcgtcacgaaggcgtgggccgacagcggctaccgcaccaaggccatcgaccacggcgcccgcctgggcatcgacgtcgaagtcacccgccgcgaccccgcccagaagggcttcaaggtgattccgcggcgctgggtcgtcgagcggaccttcggctggctcatgcaccaccgccgcctcgcccgcgactacgaaacccatccacaccgctccgaagccatgatcaacatagcgatgatcgacctcatgagccgcagactcacccgcgaatcgacccacaactggcgcgacagctgaacggcggcagcgtcgggctcctgcgaatcacagcaggtagggccacaggctgacgctgttccgctccacactgatctcgacccacgtcccatcgacagcagccgatggcggcgggtcggcgaggtcgaacaggatatgggttccagctacttccagcatggctccgccatcgcccgtcaggcccagccgcccccgaaagacgatccgaccgccttcctcctcatccaccccgggtgaaaatgaagtggccggtcgagtgttgccgccccaggccacgtcctcttcaacggtccactccacatgatgttcgcggcccactcccgtcggatcgccgcgccagaacgccgcagcggcacccacctccgagcgcaccctaaccgtcgcgcgcccgtcggcgacctgccccaccgcttccacttggaccaacaccccgcaatcatccacgacagcactgcgttgccaaacactcctgccaggacaaaacgctctttagaagaaccccagcttcttggggctgtaggaaaagagaacgttcttcgtctgctggtagtgctccagcatcatcttgtggttctccctgccgatgcccgactgcttgtagccgccgaatgccgcatgcgccgggtaggcgtggtagcagttcgtccagaccctgcccgccttgatcccgcgccccgcccggtaggccgtgttgacgtcgcgggtccagactccggcccccagcccgtacagggtgtcgttcgccgtgctgatggcgtcgtcgaagtccgtgaaggacgtcacggccacgaccggaccgaagatctcctcctggaagacccgcatccggttgtccccctcgaagaccgtcggctcgacgtagtagccgcccgccagctcgccgccgtgctcgacgcgccggccacccgtcaggatcttcgctccctcctgctggccgatgtccaggtacgaaaggatcttctgcagctggtcgttggaggcctgggcgccgatcatcgtgtcggtgtccagggggtggcccggcacgatctgttcggtgcgggcgatgcccgcctccaggaacgcgccgtagtggccgcgctgaatgagagcacgtgacgggcacgtgcacacctcgccctggttgagggcgaacatggtgaaaccttcgagcgccttgtcgaggaagtcgtcgtcggcgcgcgagacgtcgtcgaagaagatgttcggcgacttgccgcccagctccaacgtcaccggcttgatgttctcggaggcgtactgcatgatcagccgccccgtcgtggtctcgcccgtgaaggcgatcttcgcgacgcgcgggctggaggcgagcggcttcccggcttccgctccgaagccgttgacgatgttgacgacgccgggcggaagcagatccgccaccaggctcagccagtagtggatcgaggcgggcgtctgctcggccggtttgagcaccaccgcattgcccgcggcgagcgccggagcgagcttccaggtggccatcaggatgggaaagttccacgggatgatctggccgaccacacccagcggctcgtggaagtggtacgcgacggtgtcgtcgtcgatctcgctgagcgaaccctcctgggcgcgcagagcccccgcgaaatagcggaagtggtcgatggccagcggaatatcggccgccagcgtctcccgcacgggtttgccgttctcccagctctcggcgaccgccagctcctcgaggtgagcctccatccggtcggcgatcctgttcagcaccgaggcccggtccccggcggacgtggtgccccagcccggagccgccgcatgagcggcgtccagggccagttcgacgtcctcggacgtgccgcgcgcgatctcggtgaacgggcggccgttgacagggctcgggttctcgaagtactggcccctggcgggcgggacgtacgcgccgccgatccagtggtcgtagcgggacgcgtacgtgacgatcgcaccctcggtgcccggcgcggc

SEQ ID NO: 3251 - DNA, 4054 bp, Unknown
  Kingdom: Bacteria, Phylum: Actinobacteria, Class: Actinobacteria, Order: Streptomycetales, Family: Streptomycetaceae, Genus: Streptomyces
gatcgcgaagtacttcgcgacgtcgttggcgatggagaaggtggtcaacgcaccccgggtgatgaggagttgtttgccgatctcgacgatctcgatgagtttggtggggttggagtcgaggtccaccatgttcccggcctccttggcggccgaggttccggtgttcatcgcgacgccgacgtccgcctgcgccagcgcgggtgcgtcgttggtgccgtcgccggtcatcgcgacgagcttgcccccggcctgttcccgcttgatgagggccatcttgtcctcgggcgtcgcctcggccaggaagtcgtcgacccccgcctcctcggcgatcgccttcgcggtcagcgggttgtcacccgtgatcatgaccgtacggatgcccatgcggcgcagctcgtcgaaccgctcccgcatgccctccttcaccacgtccttcaggtggacgacgccgaggacccgcgcgccgtccgcgtcctccacggcgaccagcagcggcgtgccgccggcctgggatatccggtcggtgagcgcctgcgcgtcctcggagacggcgccgtcccgctccttcacccaggcgatgacggagccggtggcgcccttgcggaccttccgtccgtccaggtcgacgcccgacatccgggtctgcgcggtgaactccacccacgcggcgcccgtcagctccccctgggtccgctcccgcagtccgtacttctccttggcgagcacgacgatcgaccggccctccggcgtctcgtcggcgagcgaggagagctgcgcggcgtccgcgagcgtgccctcggtgacacccctgaccgtgaggaactcggccgcctggcggttgcccagggtgatggttccggtcttgtcgagcagcagggtggacacatcgcccgcggcctcgaccgcgcgccccgacatggccaggacgttgcgctgcaccaggcggtccatgcccgcgatgccgatcgcggacagcagcgccccgatcgtggtggggatcaggcacaccagcagcgcggcgagcacgatcagcgacgtctggtcgtccgcgccggcgtagatcgcgaagggcttcagggtgaccacggccagcaggaagacgatcgtgagggacgccagcaggatgttcagggcgatctcgttgggcgtcttctgccgcgaggcgccctccaccaggttgatcatgcggtcgatgaaggtctcgccgggcttcgtggtgatcttgacgacgacgcggtcggacagcaccttcgtaccgccggtgacggccgagcggtcgccgccggactcccggatgaccggggcggactcgccggtgatcgcggactcgtcgacggaggcgacgccttccacgacatcgccgtcgccggggatggtgtcgccggcctcgcagaccaccaggtccccgatgcgcaggtccgttcccgcgacccgctcctcgtcaccgccgacgacccggcgggcgacggtgccggtcttggccttgcgcagggtgtcggcctgggccttgccccggccttcggcgaccgcctcggcgaggttggcgaagacggtggtcagccagagccaggcggtgatcgcccagccgaaccagtcggtcgggtcggtgagcgccaacacggtggtgaccaccgagccgaccagcacgacgaacatcacgggtgacttgaccatcacgcgcggatcgagcttgcgcagcgcgtccgggaacgacttcagcagctgctgggggtcgaacagcccgctgccgacccggttggcggctccgtggccgtcggccggcggtatgtctccgtgcggagcgcgagtgggggtgacggtgctcatgaggcgagcccttcggcaagcggacccagcgccagggccgggaagtaggtgagtccggtgatgatgaggatcgtgccgacgagcagccccgcgtagaggggtttgtcggtgcgcagcgtgcccgcggtctcgggcaccggcttctgctcggcgagcgaaccggccagggccaggacgaacaccatcggcaggaaccggccgagcagcatcgcgatgccgatggtcgtgttgaaccactgggtgtcggcgttgagcccggcgaaggcggagccgttgttgttggcgccggaggtgtaggcgtacaggatctcggagaagccgtgcgcgcccgtgttggtcatcgagtcggctggggtcggcagggccatggcgacggcggtgaagccgagcacgagggccggggtgacgaggatgtagcaggccgcgagcttgatctggcgggtgccgatcttcttgccgaggtactccggagtgcgtccgaccatcagcccggcgatgaacaccgcgatgatcgccatgatcagcatgccgtagaggccggagccgacgccgccgggagcgatctcgccgagctgcatgccgagcatggtgatgccgccgccgaagccggtgtacgaggagtggaaggagttcaccgcgccggtcgaggtcagcgtcgtggcgaccgcgaagatcgacgagccggcgatcccgaagcgggtctccttgccctccatggccccgccggcgatctcgaaggccggtccgcggtgggcgaattcggtccacatcatcagcgccgtgaaaccgatccagatgacggccatcgcgccgaggatcgcgtacccctgcttcagcgatccgaccatccggccgaaggtccgcgtcagcgcgaacgggatcagcaggatgaggaagatctcgaacaggttcgacagggggttggggttctcgaaggggtgggcggcgttggcgttgaagtagccgccgccgttggtgcccagctccttgatgacctcctgggaggcgaccccaccgccgttccactcctgcgtaccgcccatgaactgtccgacctggtggatgccggagaagttctggatcgccccgcaggcgaccaggacgatcgcgccgatcaccgagatcgggatcaggatgcggacggtgccgcgcaccaggtcggcccagaagttgccgagctcacccgtgcgcgaccgggagaagccgcgtacgagtgccaccgccacggccatgccgaccgccgcggacaggaagttctgcaccgcgaggccgccggtctgcacgacgtggcccatggcctgttcgccgtagtaggactgccagttggtgttggcgacgaaggacgcggcggtgttgaacgcctggtccgggtcgatagaggagaagcccagcgaaccgggcagcgagccctgcacccgttgcatcaggtacaggaagagaacgctcaccgcggagaaggcgagcactccgcgcagataggcgggccagcgcatctcggcggccggattggcgccgatggccttgtacagccacttctccggcaggtagttcttctcggaggagtagaccccggccatgtaatcgcccagcgggcggtaggcgagggcgagggcggcgatcagggctgtgagctggagcagaccagcgacctggggactcatttccgtactcagaacctctccgggtaaaggagagcgagaatgagatatccgagcagggacacggccacgacgaggccgacgacattttcgacggtcacagcttggtcaccccccgggcgatgagagccaccagcgcgaataccgcgatcgtggtggcgacgaaggccaggtcggccatcgcgagctcctgattgacgtgaggaatggaatcggccgttcggccgatacgagcaaacctcgacttcatcccggcgataagccaccttgacggggtccatacgaataccgggaaacccttgacgtccgtctgacgcggccgaccggccgttcggcacgcggctggggcccgtacagggcgggccgcgggttgtcgctcatgcccccgtcgacggccacgagcatgttcgggccggtgtgcttgacggagaggacgcggtagagcgccaccccggccggggccgcgatcgcccgcccgggttcgacggccagcctcggcacgggcaggcccgccgccgcgcaaccggtggcgagttccgcgcccaggcggcgggcgagggccgtcaggt

SEQ ID NO: 3252 - DNA, 6625 bp, Unknown
  Kingdom: Bacteria, Phylum: Actinobacteria, Class: Actinobacteria, Order: Streptomycetales, Family: Streptomycetaceae, Genus: Streptomyces
  misc_feature (462)..(475): n is a, c, g, or t
ccgcccgtggcgccgcccgcaccgcgaactactcggcgaacaaggcgatggactccgcccgctccgccctcaggtcgtcctacagcgcccagtcctcggccgccagcgcccgtgcgtccgcgatcgcggcaggcaaggacgcggctaccgcggcggctgcggccacccaggccaggcagatcgccgcggccaagcgtgaggccgaggtcaaggcggccgcgaaggcggctgccgagaaggcgcgccaggagcgggaggccaagaccgacccggccgactcgggcaccaacgaccagatcaaccccaacggcaccggtgcggacgccgacgaatggtggaacgacgccggcttctacgccgacgcgttcaacgcgatcagcgtcggcgccgggttcctggccgcaggctgcgccctcgcctccttcgtgttccccccggcagccgcggccgccggcttcttcnnnnnnnnnnnnnnggcgccgcggacaaggcgctcggcggcaagctcatcaagcccgtcgtcggcaagatcgccgacgtcggcgaggacgtcgtgtccggggccaccaaggtcctgtcgtccatcttctgaccacccggcacggatggatccgcacccggcggccgtgcggcggcccggccgcccccccggatcttcctcctccaccacacagagagaagccatgacctcgacacgcatcagatgggtgctgctcgctctccttctcacggccaccctcaccgcgaccggtacggtcggcgctcccgaaggccacgccgcaccggtcggtacgacttccaccaaggcggtggccaggaccgcggacagtggttccgccgctcccgccacgaccttgcagaccgcccccgtcgtcgccgaggactcctgctcccggttgcccgccgccgcccgcgcgacggcacccgacgccgtcatcgcatgtgtgagagtggccggcgggacgggtacgacgacccgcgcgaaggccgctgcgacagctccggccgccgtcggcctcgctgccgacgaccccgggggcgacggcacggggaccgagttcgagccggacgccgacgaccccgagccgcccccgccctcgtgttcggtgacgagcccgggaaactggagttggagccgcaccggcggtatgtgcctgaaggccgtcgaggtcacttatctcctccacgacgcgaacggcaagaccatcggcaccggcctcatcgagttcaactccacactcgccacctcctacaagtccctcgacctcaacgagacgatcaccgccaagcttgtccgggtcaccggtgatgtgaagagcctcgtggtgaaaatgcaggtgggttgcggagccggctgcaggacggtgacgaagcagccgtggtacagcgctgccgagatggcacccggtacggagaaaaccggaatgaccaagtacagcggcgacgccttcgcggcgaacaccactcgttcctcgttcggcatcgactacaaggtgtacgtgacgatgcccggagcgacgccggtcgacaccaacgcctcctggtccagccccgcgaccggcaagatccgctgtgacaaggagcagccccgtctgcgtggctgcgtcataccgaccgacgacatcccgacgttgagctactcgaagtcgcatgagaaatacggaatcgtcgtgccgatctacgaagagatcatgaagcgccggggtaccgacattctgcacgcggtcaatcagaccaaggcgaacgccaatcgcgcctcgacctgcacgcctttcaccaacctgtacccgggacagaccggcatggacagctgcgacgagttcccgcccgccagcaccgaggaaggcggtcaggacggcgacctgtgcgccgaactgactcctcaggtggtgaacggcgtgtggtccgccccggcgacctggcccacgcgcccggcctccggcaacgagacctgcctgcggctccacatcacccagcgtgccaacagctcggcgggcggagtcctcggctcccttcgcaagtacgagcgcctcgtggacggtgacgctttccgcatcgagttcacggcatagcgctgacggggtgtcctgccccgtaactgatgcggcccgcctgtaccaggcatcatgaaccgggctcctcgccgcgacctgctcgctgcggggagcccggaaggatcaatcccggcagccgatgccgggcgcgaacgacggaggcagaccatggcggcaggcacggacgcacgttcgctcaactgggcgaaggccgggatgtgcgtcactttcacccgaaggctgggtcctgacgaggtgttcgcccggtacggggccgatcaccggcaggcacgtctgctcgatgcggacgaggccgcggatcttccctcgggcgactccggcgacggagcggtttcgctgctgcgctccgggaggctcggcgactggaccttctgcgtcgaggaggacggtgtcgtcggatcctgggaccagccgctggcggctctttcccgcggcaccgagacgtacagcgtgctgaccaccgaaggacttgacgtcttccagtactggcgcgatggcgaatgcgtcgagaatttcgagcccggcacggagcacacccgacccgagcggaccggatcctggtgggaccgggtggaagcggccctgtccgcgcacgagggtgaggacgccgggatggcgccggtggtggccctcgtcctcgaccacctcggcatcaccttggacgacgccgccctcgccggtccctggcccagtctgacgcttgccgaggacgacgcgccgtcggtaccgaggggtgacacctacgcgggagaaggaccggttccgccccagcagccgaccggaggatgagcgggcgtcacccaccgcggccgttcgacgtcaccgtgctcaccgaaggggacgccgacggaaaccgggaacccggggaggaccggacggaatcctgatccagtgaggatcagctgaccggcgtcgcctgcggcaccggctccaactgccaccactggaagggggagtcggtgtcctcccactgctgaaccgcgccccctgcctcggtggagcggtcggcgacctccatgacgaggccgctgatgaagctcaccagcgtcaccgtcccgggcgcctccgggtgctgctcgatcagccactcctgggcgccgaagttgttggccttccactgctggatccgggtgccgttcgccgtgtcggcgttcgccacgtccagccgcttcccgctgtgctcgttgaccaggtggaagagggccgcgccctcgtgcaccggggtaagccgccacacctgcgcggccgtcccgtcgtccgtaccctgctggacccgggccccactgcccttggccgcgccgtacacctccagcaccagcttgctgccgacgttgcgcaggcggtacggacccgcctcgacgacgggcgcgagttcgccgctcatgttccctgtctccccgattcgacgtgtgtgactgccgccggcgcaccggctgacgacggcgcccccaccgggatcacggtgggggcgccgtcggggggacgctcaggcgccgaggttgaactccgccgggtcgggaccgagccgcttgccctcgtccagggcggcgaaggcggcgaggtcgtcggcgtccagctcgaagccgaacacatcgaggttctccttgatccgcgagggcgtcacggacttcgggatcacgatgttgccggtctgcagatgccagcgcagcaccgcctgggcgggcgtacggccgtgcttccgggcgatggcgacgaccgtcggcacctccagcaggcccttgccctggcccagcggcgaccacgcctcggtggcgatgccgtgttcggcgtggaaggcgcgggactcggcctgctggagctgcgggtgcagctcgatctggttgacggccgggaccacggaggtctcggcgagcagccgcttcaggtgctcggggtggaagttcgacacgccgatggccttcgcgcggccgtcggcgaggatcttctcgaacgccttgtacgtgtcggtgtacgcgtccttcgcagggaccggccagtggatcaggtacaggtcgacgtagtccaggccgagcttgtccagcgaggcgtcgaaggcgcgcagggtgctgtcgtggccctgctcgctgttccacagcttcgtggtgacgaagagctcgtcgcgggcgactccggagccggcgatggccttgccggtgccggtctcgttctcgtagatcgcggcggtgtcgatgctccggtacccggtctcgatggccgtggcgaccgccttctccgcctcgtcgtccggcacctgccagacaccgaaaccgagctgcggcatgtcgaggccgttgttgagggtgatggaggggacctggctcacgagcggtcgatcctaacgtcgtcgatggataactccccacgacaacgaccgggcgggcccaggcattcccgcgccgggtgccccgccggaccggccgcccgtaccgccgccgggtcagtggtacagcgcgtcgacctcgaccgcgtacgccgtctcgatcgccttgcgcttcagcttcagcgagggcgtcagcagccccagttcctcggtgaacggatgggccaggatccggaacgtacggatcgactcggcctgggacaccgccgtattggcggccaccaccgcccggcggacctccatctccaggtccgggtcccgcaccaggtcggccgggccgagcggggtgcggccctgcatcgacagccagtggtccacggattcctggtcgacggtgacgagcgccgcgatgtacgggcggtcgtttccgacgacgatgcactgcgccaccagcggatgcgcccgtacgcgttcctccagaccggccggggagacgctcttgccgccggacgtcaccaggatctccttcttccgcccggtgatcgtcagatagccgtcctcgtccagcgcaccgaggtcccccgtggcgagccagccgtcccgcagcaccgtccgggtggccccggggttgcccagatagccggagaacacgttcggcccgtgcacccagacctcgccgtcgtccgcgatgtgcaccgacgtccccggaatcggctgcccgaccgtcccgtaccgggtgcgctcgggaggattcgccgtggccgccgcggtcgactcggtcagcccgtatccctcgaagacgctcaccccggcgcccgcgaagaacagcccgagccggcggtccatgcccgagccgcccgacatcgcgtgccgcacccggccgcccatcgcgtcgcggaccttcttgtagacgaccttctcgaagaactggtgctgcatccgcagcccggccgagggtcccggaccctctccgaacgccttctgctccatggcttcggcgtacttcaccgcgatgtcgacggccttgtcgaacggcccgtccctgccctccgcctcggccctgcgacgggccccgttgaacaccttctcgaagatgtacggcaccgccaggatgaacgtcggcctgaacgtcaccaggtccggcatgagcgcgttggcggacagttccggctgatggccgagcttgacccggccacggaccgcggcgatctcgaccatccgcccgaagacatgggccagcggcaggaagaggagggtggccgcctcgtcgccgggcttggagtggaacaccggctcccagcgcgtgaccatcgtgtcgctctcgaacatgaagctcgcgtgggtgatcacacaccccttgggacggcccgtcgtccccgaggtgtaaatgacggtcgccacggagtcgggcgtcaccgcgcgccggtgccgctgcaccacctcgtcgtcgatgcccgcacccaccccgaacagctcgtccaccgctccggcgtccaactgccacagccgcttcaggtgcggcagccggtcgatcaccgagccgacggtcatcgcgtggtcctcgtgctcgaccatcaccgccaccacctcggcgtcgtgcagcatccacaggacctgctcggcggaggaggtcgggtagatcggcaccgactgggcccccacggtccagagcgcgaagtcgaagagcgtccactcgtagcgcgtacgggacatcagcgcgacccggtcgccgaaccgcaccccgtgcgcgatcagtcctctggccagcgccagcacctgatcgcggaactccccggaggtcacatcacgccactggccaccggcgtccttgcggccgagcgcgacgtggtgcggatcgtcctccgcgtagtcgaagaccacatcggccagaccgccgacctgaggtgccgccggcatgggtgggacagtgaaatcgcgcaatgacatgctcctcgtggcgctccgcacagcgccgcgacgctaccccaagcgggggcccggcgggaggggcccggaccctccgcactgcctgccgtccgcccaggtcaaccgtcgatatccggccagatgggcaaggctcgggcgtcccgcagggtcagttctgactgaggggtaagcagctcgcgccggaatctccaccgaatccgaccgctgcggccactgccggtccgcggagcggctaggatcctgccccgccgccggccccgcggtgcagccggtcgccgcccgc

SEQ ID NO: 3253 - DNA, 3375 bp, Unknown
  Kingdom: Bacteria, Phylum: Actinobacteria, Class: Actinobacteria, Order: Streptomycetales, Family: Streptomycetaceae, Genus: Streptomyces
  misc_feature (3043)..(3176): n is a, c, g, or t
ctggaggccgcccgatcggccctgagcatgaggagcccccggtgaccgcaccggtcttcgtcgtcgaacggatgcccgccgggcctgagttcgtcctggagggacccgaaggacggcacgccgtctccgtcaagcggctcaagaccggcgaggacgtcgtcctcaccgacgggctcggccactgggcggagggcgtcgtgcgcgccgccgagggcaaggaccggctcacggtcaccggcctcgacagcatccacgaggagcccgcgcccgccccgcggatcaccgtcgtccaggcgctccccaagggcgaccggggcgagctggcggtcgagacgatgaccgagaccggcgtcgacgcgatcgtgccctggcaggcggcccgctgcatcacccagtggaagggcgagcgcggcgccaaggccctgtcgaagtggcgcagcacggcgagggaggcggggaagcagtcccgccgggtccgcttccccgaggtgaccgaggccatgacgaccaagcaggtcgccgccctgctcgccgccgccgacttcgccggggtcctccacgaggaccgcgaccacgacagcacccccctcgccaccgccgaactccccgccgagggcggaatcgtgctcgtcgtgggccccgagggcggcgtctccccgcaggagctggccgccttcgccgaggcgggcgcccgcccctaccgtctcggccgcagcgtactgcgcacctccaccgccggtactgccgcgaccgcactgctgctgggacgcaccggccgctggggatgagccgggggtccggcggatcctgaccggggcagccgggagcccaccggccgggaccccggcggtacggggtccggcgatagcatgcccctgtactgatcaccagagaccgttccgatcaccagcgacgaggaggcccggccatggcgggagagccgcagtccgactgcctgttctgcaagatcgtctcgggagacatcccggcgaccatcgtccgcgagagcgagaccaccgtcgccttccgcgacatcaacccgcaggccccgacccacgtcctggtcatcccgaaggtccactacccggacgcggcctccctcgccgccgccgaaccgctcatcgccgcggacgtcctgcgggaggccggacaggtcgccgccgacgagaaggtcgacggcagcggctaccggatcatcctcaacacgggctccggcgccggccagaccgtcttccacgcccacgcgcacgtcctgggcggccgcggcctccagtggccccccggataacggagtcccgcgccatgtccgtacgcgagctggtggtgctcggcaccgccagccaggtccccacccggcaccgcaaccacaacggctacctgctgcgctgggacggcgagggcatcctcttcgatcccggcgagggcacccagcgccagatgctgcgggccggggtcgccgcgcacgacatccaccggatctgcgtcacccacttccacggcgaccactccctcgggctcgccggggtgatccagcggatcaacctcgaccaggtgccgcacccggtgaccgcgcactacccggcgagcgggcagcacttcttcgaccggctgcggtacgccaccgcctaccgcgagaccgtcgagctgaacgaggccccggtcgccggagccggcggagtcctcgccaccgcccccgcgtacaccctggacagccgcaggctctcgcaccccgtcgagtcgtacggctaccgcctcaccgagcccgacacccggcgcatgctgcccgccctgctgaaggagcacggcatcgccggaccggacgtgggccgcctccagcgcgagggcgtcctcggcggcgtcacgctggagcaggtctccgaggagcggcgcgggcagcggttcgcgttcgtcatggacacccggctctgcgacggggtgtacgcgctcgccgagggctgcgacatgctcgtcatcgagtcgaccttcctcgacgaggacgagaagctggccgtcgaccacgggcacctgaccgccggacaggccgcccgggtggcgaaggagacgggcgtccgccacctcgtgctgacccacttctcccagcgctacggcgacccggagctcttcgagacccaggcccgcgccgccggcttcgacggcgaactcaccgtcgcccaggacctgatccgggtcccggtccccacccggcaccactgaaccgaccccgcgttttcccatcagcaccaccgtttgcgagacaccgtgcacctccccaaggcagaactccacctccacatcgaaggcaccctcgaacccgagctggccttcgctctcgcggagcgcaacgaggtggccctgccctacgccaccaccgacgaactgcgcgccgcctaccggttcgaggacctccagtccttcctcgacctgtactacgcgctgatggccgtcctgcgcaccgaggaggacttcgccgaactcgtcgacgcctacctcgcccgcgccgccgcccagggcgtccggcacgccgagatcttcttcgacccgcaggcacacaccgcccggggcgtcccgatcggcaccgtcatcgagggtctcggccgagcgctggagcgcagcgaggagaagcacggcgtctccacccagctgatcatgtgcttcctgcgcgacctgtccgccgaatcggccctcggcaccctggacgcggcgaagccgtatctgcaccggatcagcgccatcggcctggactccgccgaggtcggccacccgcccgccaagttccgcgaggtgtacgaggcggccaccgcactcggcctgcgcaaggtggcccacgcgggcgaggaggggccgccggagtacatcagggaggccctggacgtcctcggcgtcgagcgcatcgaccacggactgcggtgcctggaggacccggagctggtggagcggctggtcgccggccgggtgccgctcacgctctgcccgctgtccaacgtcaggctgcgcacggtcgacaccatcgaggaccacccgctgccgcagatgatggccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgaccacgacgaggagcgccgggcgcgctacctgtccgaggtcgaggcgtacgcgttcgactgaccggaaccgccgtccgggccggccgtccggatcgcgctgcgcaccagccgcctgcgccgcagggccggtacccgcagctccgtgacggcctgctccggtgagccgagcttcggcaccgcgccggacaggct

SEQ ID NO: 3254 - DNA, 5725 bp, Unknown
  Kingdom: Bacteria, Phylum: Actinobacteria, Class: Actinobacteria, Order: Streptomycetales, Family: Streptomycetaceae, Genus: Streptomyces
gaaccacactcgtccgccgaggtgtgggtgccgttctgcccctggctctggccggggcgatgggcgtcgcgctgctggtgcagccggcccaggcgcagccgaactccccttcggcagccgcggcatcgaacgcgtcccagccatcccgccccgccggttcggccgaccccgcgccgcaggcgcagcagttccccgcagcggacgccgaccaccaggcgaagagccggctgaaggcgtcccagctccccccgctgagcgccgacaagtcccccctcaaggaggcctacggcgagcacgacgccccgtcgaagcagggcgcgggcaagaagtccacggcgaaggcggccgccgcgtgcgacccggccgacttcaccggccgcaccggaagcgaactggtgcgattcatcaaggcgtccaccacggactgcgtgaacaccctgttcagcctgactggcagcaacgcccaactggcgttccgcgaagcccagatggcctcggtggcctatgcgctgcgcgacaacgccgcctcctacccgggtgacgggagcaccggcaccccgcagctcgtgctgtacctccgggccgggtactacgtgcagtggtacaacccggacgtcgtcggaccgtacggccccacgctccagaccgccatccgctcgggcctcgacgcgttcttcgccagcccccggtcgcgcgatgtcaccgacgccaacggcgacacgctctccgaggccgtcatcctgatcgacagtgcccaggagaacgcccggtacatcgccgtcgtcaagcggatgctggccgactacgactcctcctggaacgcgtcctcacggatgctcgccgcgctcaacaacgtgtacacggtgaccttccggggccaccaggtgcccgcgttcgtcagcgccgtcgagtcggacccgagcctcatcgactcgctgcaccgcttcgccgccgaccacctcacgctgttggagggcgaccacgcgtacctgacctccaacgccggacgtgaactgggccgcttcctccagcacacgagcctgcggggcaaggtccgcccgctggccaccgccctcctccgggacacctccatcaccggccccaccgccccgctctgggtgggcatagcggagatggccgactactacgacaaggcgaactgcgccacgtacggggtctgcgacctccaggagcgcctcaagcgcgaggtgctgccggtccgtcacacctgtagccccagcatccgcatcctggcccagcagatgacgtccgccgagctgagcgccagctgcaccagcctcatcgagcaggacgcctacttccaccggatcgccaaggacaacggcccggtcgccgacgacaacaacaccgccatcgaggtgatcgcctacgactccagcgccgactaccagacctacgccggcgcgatgtacgggatcgacaccaacaacggcggcatgtacctggagggcgacccctccgtcgtgggcaaccagccccgcttcatcgcctacgaggccgagtggctgcgaccggacttccacatctggaacctcaaccacgagtacacccactacctcgacggccgcttcaccatgcacggcgacttcgccgacaacatgaccacccccaccatctggtgggtcgagggcttcgcggagtacatctcctaccactaccgcgaggagccctacaccgcggcgatgaccgaggcgggcaagggcacctacgcactcagcaccctgttcagcaccgactacagccacgacaccacacgggtgtaccgctggggctacctcgccgtgcggtacatgctggagaagcaccccgccgacatggacaaggtgctcgcccactaccgcgcaggcgagtggagcgccgcccggacctacctcaccggcaccgtcggcacgcgctacgacagcgactggaagacctggctcgccgcatgcgccgccggtgactgcggtggcggcggccagccgggcaaccaggctcccaccgccgagttcaccgccgcggtcaaggacctgacggtcaccctcaccgaccgctcgaccgaccccgacggcaccatcgcctcccgttcctgggacttcggcgacggcaccacctccacgcagaccagccccgccaagacctaccgcgccgcgggcagctacaccgtccggctgaccgtgaccgacgacaagggcgccacggccaccaccacccggacggtcaccgtgaccggcggctccaccgtcggcgagtgcaccgaccccgacatccgcgtgctgggcaagaactgccgccgcggcaacgtctccgccaccaccggcaactacgcctaccactacctctacatcccggccggcaccacccagctgaagatcaccgtcagcggcgggaccggcgacgccgacctctactacagcaacgcgaactgggcgaccaagggggctcacaccaaccgggccaccggcgccggcaactcccacaccctgacgatcagcaacccgccctccggagccaactacatcagcctccacgcggtcgccgccttcagcggcgccaccgtcaccaccgaatactgacccgctgcttcacctccggccggggccggcgccgatggcgccggccccggctctgccgtgtctcccacgacccgggaaacgagccgggcagcgcccggcggcgggacgctccatgggcaccgggacgggtgatcgccggccgaagggcgttgtcagtgcctccccatagagtcgaagcgtcactcgggggagcaccggggagcaccggacgaaggagcagaaccatgtccgccaacaggatccagcacaaggtgaatcacgtcgctctggtcgtggacgcctcgggttccatgtaccagcaccagagtcagctcatccgtgtcgtggacgagttcgtggcgggactgaaggccgagtcggacagcctcggccacgagacgcggatcagcctctactccttcgaccaccgggtggagaacctggtctgggacatggacgtgaagcaccttccgtccatgcgggggctgtacaaggtcaacaacggcgccaccgccctcatcgaggcctcgctgaagtccctggacgacctggggcacatctgggaggagtacggcgagcacagcttcctccagatcgtggtgacggacggcgaggagaacgcctcgggcggcgaccgtcgccacgacggcgacatgaccatcctcggcccctggctcgaccggatcaccgcgaagatgaacgggctcccggggcactggacttccgcgatcctcgttccgaactccctggcgaagcgcaccgcacagaactacggcttcccggccggcaacatcgccatctgggacgcggactcccagaagggcgtcgaggacgcgatcggcaccgtgcgcgccgccgccaccagcttcctgcgcggtcgcgagcagggtgtgcgcggcacgaagaacctgttcgccgtcggccaggacatatcggtcgacgaggtgcgggccaacctcgaaccggtagcgaccgacaagtaccggctgctgaaggtcgacaaggagatggagatccgcgccttcgtcgactcccatccgggagtcacctacgaacgcggctcctgctactaccagttgggcacccgggttcaggtgcagcccgacaaggaggtcatcgtcgtcgagaaggacaccgaccgcgcctacacgggcgaggcggcgcgcaacctcctgttcggcgccggagtccgggggaccgtctccgtgaaggccggcaacaaccccaagctggaggtctatgtgcagagccgttcggtgaacaggaagctcaaggccgatacgcgcctgctcatcatgctctgacctcggccggaggttcagcccgaggccgccggcaccgaggcgtccgtcgccaccgacacggcgagcaggcccagggccgtgcccatcagatagcgctgggcgcggagccaggaagggcggcgggcgaggaagacggcgatggctcccgccgccaggacgatgcccagattgacggtgagggccaccgcgatctggacggagcccagcaggaatccctggagcaggacgcttcccgtatccaggctgatgaactgcgggatgagggagaggtacatgatggcgatcttcgggttgagcagattcgtcatcaggcccatcgtgaacagtctgcgcgcggagtcgtgcggcaggtcctcgggtgcgaagacggagacgcccccgggcctcagagcggtccaggccaggtaggccagatagcccgcgccggccagtttcacggccacgtacagctcgggcaccgcgaggaagaccaccgaaagaccgagattcgtggccagcagatagaccaggaagcccacggccacgccgcccagggacaccactcccgcgcgccgcccctgggtgatgctccgggagacgagatagatcatgttcgggcccggggtgagcaccatccccagggcgaccagcgcgacccccagcaccccgctcagctccaccatgctcgtccgccgctctgttcaggtggcgccggatggtccggcgccctgcgcgccgaccgtgcggctcggtgcaatcggagtctagggtcgtcgttctgctcggttcaataggggacattgcactcggtgcaatgttgtggttgggtgccgctcatcagggattcggtgccgttcaccagggaggtgcagcgcgtgaaggacttccggtccgtcgccgacgcggtggcggaggacatcgccgcagggcggctgaagggtggggaacggctgcctccgcagcgggagttcgcccggcggcacgccatcgccgactccaccgccgcccgcgtctaccaggagctcgcccgccggggcctcaccgtcggccaggtcggacgcggcacgttcgtcacgggcgcgcccggcgctcccgctcccgccccggccctttccgagcccgccgacagccggatcgacctggagctcaaccaccccgtcgtccccgaacaggccgggctgctcgccgccggcctggagaaactggtgcgctccgaccgcctggagtcggtgctccgcccggtcgggcccgccggtacccccgccgcccgcgaggcggccgccgatgtcctcgcgcgcgggcgatggcggcccgacccggagcggatcctgttcgccggcaacggccggcaggccatctccgccgctgtcgccgcgctgacccggccgggtgcccggctgggcgtcgaggagttcacctatccggtgctgaaggccatcgccgcccggctcggtgtcaccctcgtgcccctggccatggacggcgacgggctgataccggaggcggtggaggaggcgcaccgcgcggagccgctgcacgccgtctacgtacagccggttctccacaacccgctgtccctcaccatgtccgcacggcggctcgaccacctggccgacgtgctgctgacctcggggatcgacgcgatcgaggactccgtctgggccttcctccgggacgacctgccgcccctcgcctcgcgggccgccgagcggaccgtcctcgtcgacagcctctccaaacggctgtccccggggctgtccctcggattcgccgtggcccccgccgctgcggcgggccggctcgcgggggccctgcgctccggaggctggacacccatgcgcttccccctggaagcgatggcgcgctggcaggcggacggcgccgtcg

SEQ ID NO: 3255 - DNA, 3496 bp, Unknown
  Kingdom: Bacteria, Phylum: Actinobacteria, Class: Actinobacteria, Order: Streptomycetales, Family: Streptomycetaceae, Genus: Streptomyces
accacggagatctggccgtccggcgcggtgctggacgagtcggaccgtacggccctggtggaagccgcgctggagatgcgcatcgccgccggccgcagctcccgcaagttcgagtcggctttcgcccggcggctgaagcgccgcaaggcccacctcaccaactccggttcgtcggccaacctgctggccgtctccgcgctgacctcgcacgtcctggaggaccggcggctgaggccgggcgacgaggtgatcaccgtggcggcagggtttccgaccaccgtcaacccgatcctccagaacggcctcgtcccggtcttcgtggacgtcgacctgaccacctacaacgcgacggccgaccgggtggcggccgcgatcggcccgaagacccgggccatcatcatcgcgcacgcgctgggcaacccgttccccgtcaccgagatcgcccaactggccgaggagcacgacctgttcctcatcgaggacaactgcgacgcggtcggctcgctgtacgacgggaagctcaccggctccttcggtgacatgaccaccgtcagcttctacccggcgcaccacctcaccatgggggagggcggctgcgtactgacgtcgaacctgagcctcgcccggatcgtggagtcgctgcgggactggggccgggactgctggtgcgagcccggcgagaacgacaagtgcctcaagcgcttccagtaccagatgggcaagctcccggccgggtacgaccacaagtacatcttctcccacgtcggttacaacctgaaggcgaccgacatccaggcggccctgggcctcacccagctggacaagctggacgacttcatcgacgccaggaagcgcaactggcggcggctgcgggacggcctggacggcatccccggtctgctgctcccggaggccaccccccgctccgacccgagctggttcggcttcgtcctcacggtcgaccccggagcgccgttcagccgcgccgagctggtggccttcctggaggaccggaagatcggcacccgtcggctgttcggcggcaacctgacccggcacccggcctacatcgaccagccgcaccggatcgtgggagagctgacgaacagcgacatcatcaccgaccagaccttctggatcggcgtctacccggcgctcaccgacgagatgctggactacgtcaccgcctcgatcaaggagttcgtcgccgcgcgcgggtgagccgcgccgccgcgcgcgaggacacccgccggtcttaccctcacgccttcgtgcccggccccagcgggccggtgcaccgcatccagggagcttctgatgctttccccacccctccgaacccagctccgggcacgcacggacgtgcgtctgccgtcccgcatcgcgctctccgccgccgcggcggaaggcgtacagctgtccaccggggagttcgccggatggctggccgagcgcggccgggtcaacgagttccgcgtggaccgcgtcctgttcgcggagctggacggctggtcgttcgacgagcacaccggcaacctcggacaccgcaccggccgcttcttcaccgtcgaaggcctgcacgtgacggagcgggacggcccctacggggacggcccgtacgccgactggcaccagcccgtcatcagacaggccgaggtaggcatcctgggcatcctggtcaaggagttcgacggggtaccgcacttcctgatgcaggcgaagatggagccgggcaaccccaatctgctccagctctcgcccacggtccaggccacccgcagcaactacaccaaggtccaccggggcgcggacgtgaagtacatcgagtacttcgccggccccggccgcgggcgcgtcatcgccgacgtgctgcagtccgaacacggctcgtggttctaccggaagtccaaccgcaacatgatcgtggaggcgacgggcgaggtggagctgctcgacgacttctgctggctcaccctcggccagatcagcgaactgctgcaccgggacaacgtcgtcaacatggacgcccgtaccgtgctttcctgcctgcccgccccggacaccggcgccggagcgctgctcagcgacaccgaactgctctcctggatcaccggggaacgcgcccggcacgatgtgcgggccgagcgggttccgctcgcccgcgtcccccgatggaagcgcggcgagagcgccatcgagcacgaggaaggccgctacttccgggtggtggcggtctccgtacgcgcgggcaaccgcgaggtcaccgggtggacccagcccctcttcgaaccggtgggccgaggcatcgccgcgttcctcacccgggagttcgacggcgtgccccacgtcctggcgcacgcccgggtcgagggcggcttcctcgacaccgtcgagctgggccccacggtgcagtacacccccgagaactacgcccacctcgccgtgggggaccggccgcgcttcctggacacggtgctgcgggcggccgaggaccgcatccgctacgaggccgtccactccgaggagggagggcgcttcctcaacgccgagagccgctatctgatcgtggacgcggacgagtccgaggcaccgcaggacccgccgcccggctacgcctgggtcaccccggcgcagctgacgtccctggtccggcacagccactacgtcaacgtccagggacgcaccctgctggcgtgcctcaacgcgagcgcgggagccgcccgatgagcgatgcggtacgcatcggggtgatcggctgcgcggacatcgcggtgcgccggatgctccccgccttcgcggccggcgcggacaccgaggtcgtcgcggtcgccagccggtcgccggagaaggcgcaccgggtcgcggaacgcttcggcggcctggcggtgcggggctacgccgagctgctggagctggcggaggtggacgcggtctacgtaccgctgcccgccgcgctgcacgaccggtgggtcgaggccgcgctcgacgccggcaagcacgtgctcgcggagaagcccctgacgacggacgcggcccgcaccggacatctgctcggcctggcccgggaccgggggctggcgctgatggagaacgtcatgttcgtgcaccacccgctccacgcggccgtgcggagcctggtggccgacggcgtgatcggtgaactccgttccttccacgcggcgttcaccgtcccggcgctgccggacacggacatccgctaccggcccgagctgggcggcggagcgctggccgacgtcggcctctacccgctgcgagcggccctgcacctcctgggccccggactggaggtcctcggggcccagctcacccgggggtccggccgggaggtggagacctcgggcgcggttctgttgcgcacccccgagggggtcacggcccagctcaccttcggactggagcacgcgtacctctcccggtaccagctgtgggggagtgccggccggatcaccgtggaccgggcgttcaccccgccggc

SEQ ID NO: 3256 - DNA, 4865 bp, Unknown
  Kingdom: Bacteria, Phylum: Actinobacteria, Class: Actinobacteria, Order: Streptomycetales, Family: Streptomycetaceae, Genus: Streptomyces
gcctcgacgtcgaggccgtcgccacgctggacgcctcccagctcgcggtggccgaccggatacccgacaacgtccggaccgtcgactacgtcccgctgacggagctgctgccgacctgttcggcggtgatccaccacggcggccacggatcgttcggcgccgccctggtcaaccggatcccgcagttcgtcgtgatggaccccggctaccccatggaagcgccgctcacgggccggttcctctccgagagcggagtggggacgggagtgcgcgtcgaccggcacaccggcgccgaactgcgtgcgggactgtcccgcctgctcaccgcgccgtccttccgcgacgccgcggcggagctgtacacggacctgctgaccgctccggagccgagcgagatcatccccgtcctggagcgcctcacccggcaccaccagagccgggactgaacccgccaccttcccatcgtccccaccgcgccagggagccaccgcgtgatcaacgtcttccagccgagcctgggcgaggcggaactcctcgccctgtccgaggtcttcgcttcgaactggctgggccacggaccccgcaccgacgagttcgaagcacgcttcgcggaccacatcggggtcgagccggaccggatgctctttctcaactccggcacggcggggctcttcctcgccaccgagctgctcgatctgggccccggcgacgaggtcgtactgccgtccgtgagcttcgtggccgctgccaacgccatcgccgcgaccggcgcgcgtcccgtcttctgcgacgtcgacccccacggcctccacccgaccatggagcacatcgagcgcgccatgacaccccggaccagggccgtcatcgtgctgcactacggcggctatcccggagaggtcgcggggatcgcggccctgtgccggcagcggggggtcccgctcgtcgaggacacggcctgcgccgtggcctccacggtcgacggcaaggcgtgcggcaccttcggtgacatcgccctctggagcttcgacgcgatgaaagtgctggcgacaggtgacggcggcatgctgtacgtccgcgatccgcagctcgcgcgccgcgcccaggtcctcgcctaccacggtctggagcaacccagcggcttcgcccacgcgaaggtgtccgagcggtggtgggaactcgacgtacggagcttcggccgccgcgtcataggcaacgacctgaccgccgcgatcggcacggtgcagctcggccggctgcccgccaacgtcacccggcggcgcgaggtggcgaccgcctacgacggcctgctcgcggacactcccggcgtacgcctgccgcccccgctgcccgaggggcaccgatcctcgtactacttctactgggtccagatggatccgctcatccgtgaccgggtcgcggccacgctgctggcccaggacatctacaccaccttcaagtacccgccgctgcaccgggtgcccgcctacggcgcccggcccaccgacctgcccggcaccgacctggccaccgacagcacactcctgctccccctccaccaggcgctgagcgacgcggagacccggacggtggcgaacgcgctgtgcgaagccgtcacccaccacctggcgctggccggggcctgacgcactccgacgggattcagagggaggcgcccgcctgtgggcatcgacgagacagccgttccaggtgcgtacgcgcacgtacccggccgggcggcacgccccccgggcgctccggcccgcaccgctccacgggaggaacggccatgaaggcgctgatactcgccggggggctcgggacgcggctgcggccgttcaccgagaccatgcccaagcagctgatacccatcgccaaccagcccgtactcgaacacgtgctggagaacctccgcgcactggacgtacgggagatctgcgtggtcgtcggcgcgtggggacccgacatcgcggcacggatcggcgacggatcgcggttcggcgcgcggatcacctacctcacgcagcaccggccgctgggcctggcgcactgcgtggccatcgcccgtccgttcctcggcgacgacgacttcgtgatgtacctcggcgacaacgtcgtgcaggacggcatagcggggccggccgaggagttccgggcccaccgctccgaggcgcacctggtggtggccagggtcgccgacccccgcgccttcggagtggccgagctggacgcccgcggccgggtccgacggctggtggagaagccgcgcctgccgctcagtgacctggcgctcatcggcgtctacttcttccggcccgccatccaccgggcggtcgccgcgatcaccccgagcgcacgcggcgagctggagatcaccgacgccgtccagtggctggtcgaccggggggactcggtcacggccggcgaatacaccggctactggaaggacaccgggcgcgtggaggacgtgctggactgcaaccggcgtctgctggacaccctgacccggggggtccacggaacggccgacgccgccagccgcctgaccggcccggtgcacatcgccccgggcgccacggtacggcgctccgtcatcaccgggccggtgatcatcggccccggctcccgcgtcgaggactgccgtatcggtccgggcacatccatcggcagcgactgtgtactgcgcggcaccgagctggagaactccatcgtgatggacggcgcgtgggtgacggaacggaccggcgcgagcgacctgctcatcggccgctcgatgcggatcggctccggcccgccaccggtgccactgcccgcggaactggctgcgaacggcgcgcgcgcaggaggaacccgatgaggattctggtcaccggcggggccgggttcgtcggctcgcactacgtccggacgatgctggcgcaggggtacccgggctacgatcgggccgacgtgaccgtgctggacaagctgagctacgcgggcaacgccgagaacattccgatcggccacccccggctgcgtctcgtcaagggcgacatctgcgacgcgccgctgctgaacgaactgctgcccggccacgacgccgtggtgcacttcgcggccgagtcgcacgtcgacaggtccctggacgcccccgccgtcttcacccggacgaacgtggtgggcacccagaccctcctggacgcctgcctgaacgccggggtggagcgggtggtgcacatctccacggacgaggtgtacggcagcatcggcgagggctcctggcacgaggagtcgccgcttctgcccaactccccctacgccgcttccaaggcggcggcggacctgaccgtacgcgcctactggcgcaccttcggactcgatgtgtcgatcactcgctgctccaacacctacggcccgtaccagcatccggagaaggccatcccgcgcttcaccaccaacctcctggagggcgagccgatcccgctgtacggctccgggcggaacgtgcgcgactggatccatgtggacgaccacgcgcgggccgtccagctcgtgctgaccaagggaatcgcgggtggcatctaccacgtgggcggcggccacgagctgaccaacatcgagctggcggagcagctgatcgccctgtgcggcgcggaccggtccatgatccggcatgtgaccgaccgcaagggacacgacctgcgctactcgctggacgggtccaaagcccgcaccgagctggggttcacgccgcgggtcggcttcggcgaaggactggccgccaccgtcgactggtaccgggagaacacggcgtggtggaaggccgcgaagggccaggcagcggacacggaggaccggtcgtgaacgacgagcacaggacacgggtcctggaagaggcgcggaagcaccaccagagcgtgcgtgattccggggagttcgtgccggggaccacggagatctggccgtccggcgccgtcctggacgaggacgaccgcgcggccctcgtggaggccgccctggatctgcggatcgccgccgggccgctctccaaacgcttcgagtcggagttcgctcggctgctgaagcgccgcaaggcccacctgacgaactccggctcgtcggccaacctgctggcgctcaccgcctacacctctccgcacctgggcgaacggcggctgctgccgggcgacgaggtcatcacggtcgccgccggattccccaccacggtgaacccgattctgcagaacggcctggtgccggtcttcgtcgacatcgagctcggcacctacaacaccaccgccgaccgcgtcgccgcggccatcgggccgaagacccgcgccatcatgatcgcgcacgccctcggcaacccgttcgaggtcgaggagatcgcccgactcgccgcggaccacggtctggtcttcgtcgaggacaactgcgacgcggtcggcaccacctaccgcggccggctgaccgggacgttcggcgacatcagcaccgtgagcttctatcccgcgcaccatctgacgatgggcgagggcggcatcgtgacgacctcggacctcaaggtcgcgcggatcgtcgaatcactgcgggactgggggcgggactgctggtgcgaaccgggccacagcgacacctgcctgaagcgcttcgaccaccagctcggcgcactgcccgccggctacgaccacaagtacatcttctcccacgtcggctacaacctgaagtcgacggacctgcaggcggcgctcggcctgtcacagttgcggaagctggacgggttcatcgcggcgcgccgccacaactggcggcggatgcgcgagggcctggacggcgtacgccatctcctgctgccggaggcgactcccggcagcaggagatggcgt

SEQ ID NO: 3257 - DNA, 5723 bp, Unknown
  Kingdom: Bacteria, Phylum: Actinobacteria, Class: Actinobacteria, Order: Streptomycetales, Family: Streptomycetaceae, Genus: Streptomyces
gcagtcctgcatgacgtcgggttcgccgacgtcatgcaggactgcgtgctgtcgagcgaggccacctgcatcagcagcgtgaacaacgccatctcgcagatgaacaactccctgcccggcagcctcgattcgctctacgacggcatccgggcccgcgccccgcaggcccaggtcgtggttctcggctacccgcgcttctacaagctggccggcagctgcttcgccggactcagcgaggccgaacgcgccgcgatcaacaacgcgtccgacgtgctgaacgacgtcatcgccaagcggtccgccgacgccgggttcaccttctccagcgtggtcgacgagttcaccgggcacgagctgtgctccggcgctgcctggctccacagcgtcacggtgccgatctacaactcgtatcaccccaaggccgcagggcagtcgggcggctatctgcccgccttccgctcagtggtgtagctcggccctgtagctcggccgtgtagctgctgcgcgatgcagttacgtggtgcggcagcgtggtggtgggtccgcggagcggctccgctcacggaacggcggttcaccgggtgaccggtggaccgccgttctcagtagcgctcgaccaggtgctcgcggccggccggtggctcgtacgactcgggccagaagtccgtcaccccggtgatcagaccctcctcgtcgaacgtgaagaagtggatggcgtccatctcctccggcggttcccccggctgatccgccgtcacggtgaacccggtcctggcggcggcctgccggccctccgcgtcggcgacgatccgctcgaccctgacgtgccagtcgcccggatactcctggttgaaccggagataccgctccttgccgaggatccgctcccgcgtctgcggcaggtcgtacaccacgccctcggcgagggtctccccgaacgcgctccagtcgcgcgcctcggccgccgtccagtacgcctcgaccgcgccgcgcagcgcggccgtcgtcgtccccggcgtggtcctggaagtcgtaccgggcgtggctccgcccgccgttccacctgtcgtgtcggtcatggaaacgagtgtgtaccccaccactgacaatcggccggagcagccccgaggagccctccggcctgcgactatccctgatgcgcagcgggacgcgatgccttgatcgagtacatcagcgggatcctcggccggccggccgggaagcggtagtggccgtccgcgtggcgctccagggggccgaaccgctggacgagcgtggaatcgtgctcgtggaggaactcgatccgcaggcccgccgcggcgagcgccgtcaccacccggcccaccgggtgctgccactcgacgctgcggttgtgcacggtcggcgcgtcgaggtcggcgtacgtgcccggcgtctcgtccacccaggcgtcgcggctgaagtagtcgtcggtgaccaccgaaccggtctcgtccatcgagtcggtcagcggatggaactccgcgaggtagaggaatccgccgggcgcgaccagcgaggcggctgtctcggcccagcggtcgaggtcgggcagccagcccagcgcgccgatgcccgtgtagacgatgtcgtacgcggagtcggggacggcggccggtgcgtcgtacacgtcggccgcgacgaacgacgcccggtccgggcccagttccagcgacctggccagggaccgggcggtctcgacggcgggctcggagaagtcgaggcccacgacctgcgcggcgccgcgccgcgcccaggagagggtgtccaggccgaaatggcactggaggtgcagcagggtcttcccggtgacgtcgccgacctcggccagctcgaaggcgcgcagcacgtccttgcccgccaggaacgcgtccagctcgtagtagtcgctcgccacatggatcggcacgcgttcgtcccagcgcgcgcggttggtgtcgtgccagtcgtcaggagtcggggagtacatgtccggaaagctatccagggggtgggagtggtgcgaggggttattcggcgctctccgatcccgtgagcgcggagtacgcggagagaaatggtccaggaaacgccacccgaaccgctcgatcgcgcggtcgtccgcaaggagcacgtcgttcgcctttcgatccggaccaggaccccgatagcgagcggaatcctgttacgggcccggcgcccggatcgggttggatgggggtatgacgactgatgcagcagctgtgcccgactgggagatgcggttccgtgcgcctcgcgtctccctgcccgactgggccgaggacgcccccgaccgcgcgctgttcgtctccaacgccaccgggacctacgagctgtacgcgtgggaccggtcgagcgggcggcagcgccaggtgacggaccggccgaacggcacgacggacggcgtgctgacgccggacggcgaggccgtctggtggttcagcgacaccgacggcgacgagttcggggtgtggatgcgccagccgttcggcggcggggaggacgagccggccgccccgggcctcgctccctcctatccggcgggcctggccatcgggcgggacggttccgcggtgatcggccgctcgaccgacgaggacggcacgacgatccacctggtgcggactccgggggccgaacccgtcgagatctaccggcaccgggagtccgcgggggtcggggacctctcccacgacgggaccctgatcgcgctggagcacaccgagcacggcgacgcgatgcactccgcgctgcgcgtggtgcgccccgacggctccacggtggccgagctggacgacaccgagggcggcacgaaggagctgggactcgccgtgctgggcttcgctccggtggccggggacacccggctcctcgtcgggcatcagcgccggggccgctgggagccgatgatctgggacccggtcgcgggcacggagaccgcgctgccggtcgacctgccgggcgatgtgggggccgagtggtatccggacggctccgcgctgctcgtcgagcacagcttcgaggcccgcagcgagctgtggcggtacgagccggggaccccggagcccgtgcgcgtggagacgcccgccgggacggtgtcgggcgccacggcccgcccggacgggacggtggagtacctgtggtcgtcggccgagctgccgcccgtggtgcggtcgacgagcggcgcggtggtcctggacccgccgggcgcgaaggcaccgccgtcggtgcctgtcgaggacgcgtgggtggagggaccgggcggcaggatccacgccctcgtgcagaggcccgccggtgagggtcccttccccacggtcttcgagatccacggcgggccgacctggcacgacagcgacgccttcgcctccggccccgccgcctgggtggaccacggcttcgccgtcgtgcgggtcaactaccggggctccaccggctacggccgcgcctggacggacgcgctgaagcaccgggtcggcctgatcgagctggaggacatcgcggccgtgcgggactggtcggtggcgtccgggctcgcggacccggagcgcctggtcctggcgggcggttcctggggcggctatctgaccctgctcgggctcggcacccagccggactcgtgggcgctgggcctggcggcggtgccggtcgcggactacgtcacggcgtaccacgacgagatggaggccctgaaggcgatggaccgcacgctgctgggcggtacgccggaggaggttcccgagcgcttcgaggcctcgtccccgctgacgtacgtcgacgcggtgcgcgctcccctctacatctcggcgggcgtcaacgatccacgctgtcccatccgtcaggtggagaactacgtggaccggctggcggcgcgcggcgcggtccacgaggtgtaccggtacgacgccgggcacggctcgctggtggtggaggagcggatcaagcaggtgcggctggagttggagttcgccctgaagcacctggggggaggcgccgtggtcggcgctccggggccggaagcggcgtaagaaccggataaatggcggaccccgctccgggaacccggggcggggaaccgtacctttgaggggtgtaccggttcctgctgaccccgcgatggtgggggatcaacctcttcgtcgtgctggccatcccgttctgcgtgttcatgggcacctggcagctcggccgcttcgaggaccgcgtgcagtcgcatgaacaggcggagaagcagcccgatcccagcacccgggccgcgaaacccctggacgagctgctgcccgtcgacaaggtgacgtccggccgcccggccgtcgccaccggcacgtacgccgaccagttcctggtgcccggccgcgagctggacgaccgtcggggcttctacgtcctgaacatgctgcgcacggacagcggcaaggccctgccggtggtacgggggtggctgcccggttccgcgaccggcgcccgggtgcccgccgcgccggagggcgaggtcacggtgaccggcgacctccaggcctccgagaacacccacagcgacggcgtcgacgtccggggcgggctgcccgggggccaggtcggcatgatcagcgccgcgaccctggtgaacctcgtgccgtacgacgtgtacgacgcctgggtgacgcttcccgaggccgaggcgggcggtacgggcggtgcgatgaagccggtgcccgcggcggcccccgagggcagcggcctcgatctgaaggccttccagaacctggggtacacgggcgagtggttcgtcttcgccggcttcgtgctcttcatgtggttccggctggtacgccgcgaggccgaggccctgcgcgacatcgcgctcggcctcgtcccggaggacccggccgcgaccccggccgcggacccggcctcgccggaccgcgacgtggcgagcgcgcccgtacggtagccggactacgacgtggcgagcacgcccgtacggtagatcgtgcccgagcaggcgttggggatcttcgtctccgcggtgggcgctcccgcctccggggtgtgcgtgacagcgacgctgccctccgccgtgcctccgccgtcctcgtgcagcgcctgcgtatcgacgccggagggctgatcggtgcctccctcgccgaccgatccgcccgccccgtccgccgacggtgtcgggctcggtgagggtcccacggtcggacaggtgtcggtcggcacccaggcgaaccgcacctcgtacgccatggccggcttcaacagcaccgttcccggctcctgcgaggggtcgggcagcccgggggccgcgtcgcccgcggcgtgctggaccacgccgatcttcagcgggtcggccgcgccgatggcggtgaagcccaccgtgccgttgctgctgaccgtgcagtccgtgccggacacgttggcgatcttgaagctgccgtagaccgtgccgtcggctcccggtgcgtcggtccccgcggacgcgacgccgagctggctcgggtcgcagaccggcagggaggcgaaatcggcgctcggtgagtcggtcgcctcacccgtcgccgcgccgtcggggtcgctgccctcgccctcggtgggactggggtccgggtcggcctcgcccgcgctgccctcgctctcccgctcggtgggctccacgctccgccggccgggcgcctcggggccggtctcttccccgttgccgccctgggcctgctcgccgt

SEQ ID NO: 3258 - DNA, 3865 bp, Unknown
  Kingdom: Bacteria, Phylum: Actinobacteria, Class: Actinobacteria, Order: Streptomycetales, Family: Streptomycetaceae, Genus: Streptomyces
gcctcggcgggtgtgaggggggtgtccagggcggggacgccggcccggtgggcgaggaggtcgcggacgaggacacgttccttgccgttcgtcttgaactccggccagtaggtggagaccggtgcgtccaggtcgacctgcccgcgctggtggagcagcagggggacggcggcggcgatgcccttgcccgccgagcggacgatctggacggtgtcgacggcccatggttcgacgccgtcgacgtccctcgtaccggcccacaggtcgacgaccttgcgcccgtggcggtagacggcgacggccgcgccgcgctcaccgcgctgctcgaagttacggacgaacgcctccgcgaccggttcgaacccgggcgcgaccgtgccccgtacatccacatccgctttcgcggtcgtggcgctgggcccggtcgtcgccccggacccggtcgtggccacggtcccggccgcttccgtgcctgtctcgggcctgttgcccggctccgctcccctgcctgatcccggttccgcttccgcgcccgccgtcgtgctcactcccgcgctcccgctcatccccccatggtgcacgtcccggcgggctgttcggggggcgggtcaccgtgaccaccgggctgtcacgacctgtttacgccgacggaacgctgacggagcgcgggtcgaagccgaacggcagctccagccggtgggaacgcatcagcttctcgtcgcagaggaggtcctgcgtacggtcgtcggcggcgatgacgccgtcgctgaggatgacggcgcgcgggcagagctccagggcgtacggcaggtcgtgggtgaccatcagcacggtgacgtccaaggagcgcaggatgtcggccagttcgcggcgggaggccgggtccaggttggacgagggttcgtccaggacaaggatctccggctccatcgcgaggacggtggccacggcgacgcggcggcgctgcccgaaggagaggtggtgcggcggccgggtggcgtactcctccatgccgacctgcttcagcgcgcgcaggacccgctcctccagctccgggccgcgcagtccggcggtggccgggccgaaggcgacgtcctcgcggacggtgggcatgaacaactggtcgtcggggtcctggaagacgatgccgacccggcggcggatctcggccagattccgtttggcgaccgggagtccggcgacccgcaccgtgcccgagccggcgtccaggatgccgttgaggtgcaggacgagcgtggtcttgcccgccccgttgggaccgaggagcgcgacgcgttcgccacggccgacggtcaggttcaccccgaagagggcctggtgaccgtcggggtaggcgtaggccaggccgctgacttcgagcgacggggcgtcatccgtgaaggatttcgtggaggaggtcacagggtccatcccagcagacagacggcgagggcgagggcggggagggccgccgcgtacgcccactgggcgcgggtggcggtcacctcgtcgatgacgggcacggcaccggtgtagccgcggctgaccatggcgaggtgaacgcgttcgccgcgttcgtaggagcggatgaacagggcgcccgccgatgccgcgagcacccgccactgccgtacgccgcgcgcctcgaagccccgggagcggcgggcgatcgacatgcgtcgcatctcgtcggtgacgacgtccccgtaccggatcatgaacgaggcgatctgcacgagcagcgtcggcagcttgaggcgctggaggccgagcaggacggcgcgcagttcggtggtggacgccagcagcaccgaggcggcgacgccgagggtggctttggccaggacgttccacgctccccagaggccggggacgctgacggagacgccgagcacacccgtctgctcgcccggcaccacgaacggcatgagcagggcgaacgcgacgaacggcacctcgacgacgagccgcttcagcaggaagccggcggggacgcgcgacacggcggcgacggcggccagcagcgccgcgtacagcccgaaggcccacatcgcctcgcgcggggtggagacgacgacgaggacgaagcagaagacggcggcgagcttgcagtgcgggggcaggtcgtggaccggcgagtgtccgtgccggtagagcttgtgggcgtggcccgcggccatatcagacgtgtccgtggtcgcggtcgtgaccgctgtcgtggtcgtgaccgcgggaggtggtgccgtgatcgtcctcgtggcggcggcggaccacccagaacacgccggtaccgacgacgacggtggcgctgacgccgatcactccggcgagaccgccggagaggcgggcgttggcgatgtccccgacgccgtagtcggcgagcggggagtcggccgcaccgtgctcctcggccttctcgtcgatgccctggtcggcggcgaccttctccaggccgtccgggtcggcggatgcgtagaaggagacgaccccggcgagcaggaacgcggagaccagtccggtgatccagattccacgggtggagcgggccgcggccgccggttcgggttcgcgggtggcggcgggggcgtcgaccagttcgccgtcgacgcggagcttgagaggggcggcgataccgctgacgccgtggacgaggtcgggccgcacggccaggaccgcacccacggtcagcgcggtgatgaccgcctcgccgatgccgatcagggtgtgcacgccgaccatggccgtgaagaccttgccgatcgggatgtcggtggtgccaccgatccagtagagcagcgtgaaggcggcggccgcggccggtacggagaccagggcggcgacgaaggcggagacggtggccgaccggcgggtgcgcgggagcactccggtcagcagccggaacaggccgtacgcgacgaggacggtgaccacgcccatgacggtgacgttgacgccgagggcggtgagaccgccgtcggcgaagaagatgccctgcatcagcaggaccaccgcgacgcagagcacccccgtggagggcccgaccaggatcgcggccagcgccccgcccatgagatgcccgctggtgccggccgcgacggggaagttcagcatctgcacggcgaagatgaaggcggcgacgagcccggcgagcggggcggtgcgctcgtccagctcgcggcgcgcgccgcgcaggctgacggctaccgcaccggcggcgaccaccccggcggccacggagacaggtgcatcgatgaaaccatcgggtacatgcatgggaggctccgcttcctgcggggtccgcgggtctccacgcccctgcggacgaggtcctgcgggcggggtcatgaacccatcaataatagtgccctcctgcgaactgtgcgcaagagcagaagcccagcaagtggatcgggctcatcgtgccacttccgtaaaatatgggacattagaggacagagctacacatacaggaggagccggcccatgtcccccgtgatcgaagtacatgcccgcgcccggctcatcaccgatggccctctgacccgcccggtcccggtcgacctgcgctacgacccggccgacgaccggcgcaccgtccacatcggattgcccgacggcaccgactgggcgcttggccgcgacctcctggaacgcggcctgcgcaccccgatcgagcgcggtgacgtccgcgtctggccgtgcggccgcacgcagctgatcgtggagctgcactcgacggacggggtcgaggtgttccagttcgagatccggacgctgatccgtttcctcgcccgcacccgcgcgcagacaccggccaccccgccggagaccggccgggagccgcagaccccgtccgtcgagtgca

SEQ ID NO: 3259 - DNA, 1081 bp, Unknown
  Kingdom: Bacteria, Phylum: Actinobacteria, Class: Actinobacteria, Order: Streptomycetales, Family: Streptomycetaceae, Genus: Streptomyces
ggccggcaccgccgccaccccggtgaacacggcggcggccgcaccggccaccaccgctcttcgcgccgttctcttcacgtcgagcccgtcctttccctgccccggcccgagcgcgcaggcgcacgggaccgaggttcgtcctcgcggtcgactgtgggacccgggacggccgtacgtggttgtgcgcggtgcggcaacgatttgatcacccgcgggccgcgaggcttcccgtttacgggacccgggccaccgccacgtagatgccgctgtgctcctgggccggggcgggcgtgccgttgaaccactcgggagccttcaccaggccgggtgcgacgacgtccaggccctcgaagaaccgcgagaactcctcacgggtccgcagggccaggtggatgccgcccttctggtactcgtcctcactctgctgcccgagctgctggttcacgtcggacgcgccctgggacagcacgacgtaactgccgggggccatggcgctcgtgaacgtacggacgatgccgatcgggtcctcggcgtccggcagcgttgtcgcagtagacgacccgcgcggaggggcggatctcctgggccgtctggtgcaggttcggcgcggtgggaatgcccgtcccgatgtcctggaactgcgtcacgccctcgtcggccagccaggccgtcgagcggttcatgaaggcccgctgctggtgggcgccgatcttcgcctcgatgggcaggagttccgccatcgcctggtccaccgggtagtcgtccttgcccccgaggagcgcgtcgtagacccgggccgagtggggtttgccggtgtcgatcggaggacggggcgtcgctgccgtcatgccggactcctgacacacgtggtgtggaccattcggtcgacgcagtctgccacagcaaccccggtccgccggagggttgttcgggctccggagcggcgtgccgcgcccgccccgcgtggtctcttcaccgcgcctcgtgctcggcgcgccgggccgccgcgttgaccccgcacgccgtgcgcgccgaagatcgctggtgtgaaccccccttctgacacaccaccgcccccgcc

SEQ ID NO: 3260 - DNA, 852 bp, Unknown
  Kingdom: Bacteria, Phylum: Actinobacteria, Class: Actinobacteria, Order: Streptomycetales, Family: Streptomycetaceae, Genus: Streptomyces
gaggatcttgaagacctcgacggtgtcgtcttccttgaccgcctcgacgtactccgtgctcaggaagttgaacagcgccgtcggactgccgtcggcgagcgccgcctccgccttcgccttgaccgcagggccgggctgctggccgaggatcgtgaagaccttgacgcggttctcctcgacggaggtgtcggtcacgccctgttcgaggaactggctcgccgcgtcgggatcctggctcttcagcgccacatgggcgcctgccgcgacgtccggtgccgccatctcggccagcgccagaaccgtctcgcggtcatcctgccgctgggccgccggccggtcgacgtcgatccagttgaggatctcgtagtcgccggcggcgagggcgaactccgccgcctggcgcgtccatgtgccgtgactgtcaaggagcttgaccgccgcctcgcgacccgaggacacggcaccggtctcgtccccggcggtgaaggcctcctgagcccgcgcgatcaggtcgcggatctcctgggccgtctggtcgctctgggtgcgctgggtctcgatccgcttcagggcctcctgctcctggatggccttgagccgggccgcgatgatgccgacctcggtgtcctgctcgatacgggtggcctcggcctcccgggccgccgcttccacgtccgtcgcctcctggacggcgtcggcggcggtggtggcggccttcatggcctcttcggcgaagacgcgggaccgcgtcgcgagttcgatcgcctgcccggcgtacttggccgcctcttcggcggctgcggcggccttgtcggcgtgatcggctgcggagttggccgcccggtgcgccgc

SEQ ID NO: 3261 - DNA, 4071 bp, Unknown
  Kingdom: Bacteria, Phylum: Actinobacteria, Class: Actinobacteria, Order: Streptomycetales, Family: Streptomycetaceae, Genus: Streptomyces
ccgacgacgcctccgacctgcgaggaatcgatcagcccaccgccatcttcaaggcggtcaagccggccgggccggccgaccgggtcgaccaggcgacgaccgcgctgaagcttccgccgcgcgagaacaagcccgcggacgagcccggcgacaagcccgggagcaagagcgagaacaagcccgagagcgacgccgagcgcacgagcaccttcgtgccgctccgctccgacgccgtacggtccgcccccgcgccccgcaagccggagcccggagccggggcagagacgcccgtgcgtaccccggaggcccgggaagccgcctctccggcgtccccggcacccgccgcgccgtcctgggcggcggccgagcggacccggcagcagccgttgccgccgaggccgccgctcgacctgctcgccgagctgacgaacacgccgccacccccggagactccggtgcggacggctgtccgacgggtcaagatctggaccccgctggtactcctcctgctgatcgtctttgcgatcgtgcaggtgatgcgcccgctgccggagccctcgcttgagctcacggcgaagccgacgtacaccttcgatggcggcgcgacgaagctgtcctggccgggccaggggcagtcggccgtgatggtcgacggcgtcgggtcgctcgggtccgagggtgcgcagaagcccgccccgatcgccagcgtcgcgaaggtcatgaccgcctacgtgatccttcaggagcaccccctcaagggtgacgaggagggcgagacgatcaccgtcgaccagaaggccgaggacgagtccaagcggcccgacgagtcgacggccccgctgaccaaggggcagcagctcagccagcgccagatgctccagctgctgatgatcccgtcggggaacaacgcggcgcggctgctcgcccgctgggacgcgggttccgaggacgcgttcatcgacaagatgaacgacgcggccaagaagctcggcatgaccgggtcgacgtacacggacccgagcgggctggagaagaccacggtctccaccgccaccgaccagctgaagctggcccaggcggtcatgcgcaacgaggtcttccgggggatcgtggacatgcccgagatcgagatcgagggcatagacggcaagatctacaacaacaacaacctcctgctgcagccgggcgtgagcggcatcaagaccgggtcctccacccccgccggcggcaacctgctctggtccgcgaacaccaaggtcgacggcaaggtgctgtggatctacggagcggtcatgggccagcaggccggtaccggccgggtctacgacagcctggagctgtccctccagaacagcctgaagctgatcaaggacgcgcaggaggccgccacctcggcgacggtggtgaagaagggcgacgtcgtcgggtacgtggacaacgggttcggcggacagaccccggtggtcgccaccaagaacctcaaggcggtcggctggtccggcctggaggtcgagctgaaggtcacggacaacggcaagggcatcgaccacgccgcgaaggccgggagcgaggtcggcatggtgaccgtgggcaccggcaccggaaaggtcacggcgccggtggtgttgcagagcgatctgaccgaaccggccttcggcgacaagctggccaggatcggctgagacaccggagcgggggaggggcgggcgacgccgtcggcctctcccccgcttatgacagagatacgtgccgggggtacgtgttagcgtccccggacaactcagggacgctgggacgcgtccttgaggaggtacggggccggcggaggacggggagagccgtagtgaccaccgcggagccgaagcccggccgcgaggcggacgagaccgcagggaccgggggcgacgccctgcacgtccgtgtgccgtccccccgtgtcccggagtctccggacacccctgagtctccgcattccctccagcctccggactcccgtggttcccccggggcccctgaccctggttcccccgtgacccctgattcctccgtggccgctgggccccccgggcccacggaaccttccgggtccgcaggtcctacggcgcaacccgccgctcccgagacgtcgtccgccagggcccgccggctgctgcggcaccccgtcaccatcgcgacagcggcggccgcggtcgcccaccttctctggttcttcttcttcgccaacaccggcggcgacatcgccgcgcaggacgcctgggccgagttcgtgggccggcaccccggtacggcgtacaacctggcctggtacgggggcatgcaccccgtctcgtacagcgtggtctcgccctacctgatgtcgctgctcggcgtccggacgacgatgatgatcgtcggcacggtctcctccgcgctgaccgcgctgatcctcgtgcgggtcccggccgtccgcaatccgctggcctgttcgctcgccggggtcttcgcgttcctgtgcaacgcgctgtcgggccgggtgacgttcgggcttggcatgatgttcgccgtcggcgcggtggccgcggtgttctgctggccctaccggtggcggtacaagcggtgggccaaggccgccgtcgccgccccgctcgccgcgctcgccaccgcgtccagccccgtcgccggactcttcctgggcgtcgtcgcggcggcgctgttcctccacagacggcgccccggcgcctacgcgatcgggctcgcaccggtggtcgtggtggggttgtccgcctggctgttcccgttctcgggtacgcagccgatgtcgctcgggacgctgtcgctgccgttcgtcttcgcggtcctcgtgtacgtcctcgtaccgcgcgactggagcacggtccgcaccgccgccgccgtctacgggctcggcacgctgctcacgtacgtcatcgactcgcagatcgggtcgaacatcacccgcatggcgatgctgttcgccggggtggcgctgctcgccgccctgccgtacacggtgccgcgcagccgccgctggtacgccctggtcctggccttcgtgggcctcaacttctggatcggattcaagggcgtcgacgacatcgtccggaccgcgcccgccgcgtcctggaaccgggaactggccccgctgatcaaccagctccagcaggtggaggcggagcgcggccgggtcgaggtggtgcccgcgagcagtcaccgcgagtcatcggcgctcgccccgtacgtcaacctggcgcgcggctggaaccgccaggcggacatgaagcgcaacccgctcttctacgacgacacgctcgacccggtgaactaccgggagtggctggaccgctgggccgtccactacgtggtgctgcccaaggaccggcccgacaacggagcgatccaggaggcggagctggtcgagcaggggcagccctacctccgcgagatctggggcgacgcgaactggaagctcttccgggtcctggacccggtgccgctcgcggacccgccggcgaccgtggagcgggcgggcgcggacgagctgacgatcaccgtgaagtcggcgggccgggtgctgatccggatcccgtacacgcgttggctcgccctcgtcgacgaggagggcaagagcgtggagcgcccgcaagagaccgaggagtcgaaggagcggtcggaggcggacgagaccgcgccgaagacctatctcaacacccacggctgcctgaacagggtcgaggagggcccgtacggcgacgagtggaccgaactgctcgcgccgcggccgggcgtgtaccggctggcggccccgtaccagctccagccgggcacgccctgccccgaagaactgagctgagcccctccggccacccgctccgtcttccgctcgtcttccgttcggtgtcccgtgtacgggccatcgtgtgcgggatctccctctgcggacagcgccctggcaaggtgtcctgccatgacgtgccaacactgcggcggcgggcgccgaggcgcgctgcccggaatggtctgccccggctgcggtgcggcggcgtccctggtgcccggcgcggacggttcctgggt

SEQ ID NO: 3262 - DNA, 704 bp, Unknown
  Kingdom: Bacteria, Phylum: Actinobacteria, Class: Actinobacteria, Order: Streptomycetales, Family: Streptomycetaceae, Genus: Streptomyces
atccccctggcggagctcctcgcgcgccaggagctccgccagggggatgggcggagtcggcggaccggggagtggggtcgtccgcgtggggcccgtggaagagttcggcatggacggttcatccattcagtgcgtcgagaatggaggaaacgtacacttcagcgtcggctttcggccacctaccgtcttcctcgcacgtacatctgtttgcgcgagacggagggaagcccatggctgtcgattacgccgtgatcgtcgtctacctggccggcatgctcgccatgggctggtggggcatgcgccgcgccaagtcgaagagcgagttcctggtcgcgggccgccgcctcgggccggggatgtactccggcaccatggccgcgatcgtcctcggcggcgcgtccaccatcggcggcgtcgggctcggctaccagtacggcctctccggcgcgtggatggtcttcaccatcggcctcgggctcctcgccctgtccgtcttcttctccgcgcggatcgcccggctgaaggtctacaccgtctccgagatgctcgacctgcgctacggcggtcgggccgggatcatctccggcgtcgtgatgtgggcgtacaccctgatgctggcggtcacctcgaccatcgcgtacgccaccatcttcgacgtcctcttcgacgtggaccgcaccctcgcgatcgtcctcggcggcgcg

SEQ ID NO: 3263 - DNA, 10237 bp, Unknown
  Kingdom: Bacteria, Phylum: Actinobacteria, Class: Actinobacteria, Order: Streptomycetales, Family: Streptomycetaceae, Genus: Streptomyces
gagggccttccgctcggatccggcctgatccgagcggaaggccctcggcccctcacagggccccggcgccgtcgctgagcgcaaggttccgcccgggaaacaggcgggatgcggccgggtaacacctcccgcccacgctcagggcatgaggacaaccgacggaggccactgagatgccggagcccaccaccccgaacgccctggcgcacaccgccgctccgacgatcgtggtcgtcgggcacggcatggtcggccagcggttcctggaggccctcgccgaccgcgggctgaccccggcggccggcgccgcccgggtcgtcgtgctctgcgaggagccccggcccgcctacgaccgggtgcgcctcacctcgtacttcgacgggcggagccccgaggacctctccctggtggagcgggacttcatggaacggcacggcttcgagctgtgcgtcggcgacccggcgaccgccgtcgaccgggtcgggcggacggtgaccgcacggtccggggcggtgttcccgtacgacacgctggtgctggcgacgggctcgtaccccttcgtgccgccggtgccggggaaggacgcccggggctgcttcgtgtaccggaccatcgaggacctgctcgcgatcgaggagtacgcgaagggcgcggccaccggtgcggtggtgggcggcgggctgctcggtctggaggcggccggggcgctgaaggggctcggcctgagcactcatgtggtggagttcgcgccccggctgatgccggtccaggtggacgagggcgggggtgcggcgctcctgcgcacgatcgaggacatgggcctcgcggtgcacacgggggtcggcacgcaggaggtgctggcgggcgcggacggcgcggtgaccgggatggccctctccgacggctcctcgctcgccgtcgatctggtggtcttctcggcgggcgtgcggccccgggaccagctggcccgggagtgcggtctggctgtcggggagcgcggcgggatcgtcgtggacgaggagtgccggacctcggacccggcggtgttcgcgatcggggagtgcgcgctggccgccgacggccgcgtgtacgggctggtcgcgccgggttacgagatggcccaggcggccgccgaggtgatcgcgggcggccggtccgcgttcacgggggcggacctgtcgacgaagctgaagctgctcggggtggacgtggcctcgttcggcgacgcgcacgggacggccgaggggtcgctcgacgtcgtctactccgacgccaggtcgggggtctacaagaagctggtgatcgggcgggacgggacgctgctgggcggcgtgctggtcggggacgcggaccagtacggcacgctgcggccgatgacgggaacggtgctgccggtcgcccccgagcagctggtactgccggccggggcgggcggaccggtggcgctcggcccctccgcgctgccggacgaggcggtgatctgctcctgccacaacgtgaccaagggcgcggtctgcgagcacaccacactgcccgaggtgaagaagtgcaccaaggccggtacgggatgcggaagttgcctgaaggtgatcggtcagctgatgccgccgcccgaggacgcggggctgtgcggctgcttcccgtacagccgcagcgagctgtacgagatcgtccgcaccctggaggtcacctcgttcgcggagctgctcgactcgcacggccgcgaggccgcgcgcggcggggacggctgcgaggtctgcaagccgacggtcggctcggtgatcgcctcgctcgcaccgaccgtgggcgcgagcggctatgtgctggacggcgagcaggcggcgctccaggacaccaatgaccactttctggccaacctccagcgcaacgggtcgtattcgatcgtgccgcgcatccccggcggtgagatcaccccggagaaactcatcgtcatcggcgaggtggcccgcgacttcggcctctacacgaagatcaccggcggccagcgcatcgacctcttcggcgcccgggtcgaccagttgccccagatctggacccggctggtggacgcgggcttcgagtccgggcacgcgtacggcaagtcgctgcggacggtcaagtcctgtgtggggcagacctggtgccgctacggcgtgcaggactccgtgaggatggcgatcgaccttgagctgcgctaccgaggcctgcgctccccgcacaagctgaagtcggcggtctccggctgcgcccgcgagtgcgcggaggcccggggcaaggacttcgggatcatcgccaccgcccagggctggaatctgtacgtcggcggcaacggcggggccaccccgcgccacgcggacctgctggcccaggacctctcggacgccgaactggtgcggctgatcgaccggttcctgatgttctacatccgcaccgccgaccgcctggagcgcacctcggcctggctggagcggatcgacggcggcctggaccacgtgcgggacgtggtcgtccacgactcgctgggactctgcgaggagctggagcggatgatgaccgaccatgtcgccggataccgcgacgagtgggccgagaccatcaacgacccggaacggctgcggcgcttcgtcacgttcgtcaacgcccccgacgcccccgacccctcggtgaagttcgttccggaaagggaccagatcaagccggatctggaactgctcgcgggacccgtactcgccgtccgcaccctcgaagggaccgcatcctgatgaccaccgcgacgatcacgacagcgcagggcaccggattcgtccggctcgcccacggaacggactggctgacggtctgcgaccgggccctgctgatccccgggcggggcgttgcggtgctgctgccggacggggaccaggcagccgtcttcatggaccgggccggtcaggtgtacgcgatcggcaaccgggacccgttcaccggagcgtacgtcctctcgcgcggcctgctcggctccgcgggcgggcggccgttcgtggcctcgccgctgctgaagcagcgcttcgacctggcgacgggcgcgtgcctggacgacgaggcggcggcggtgccggtcttcaccgtacggacggactgaccggtctcccggcggaggccgccaggtcggggaaggcggcctgtgcaactcctccgccgcccgttcacctgctctcgacgctccgtcaactccgcactcctacagtcctgacgcgcgacccgccggtccgtccggagcggcgggcccacactcatgcgtggagtgatcgtggaacgtcggaccttcttgcgcactgcggtgatcggcagctcggcggccgccttcggcggcacgctgtggcggggcgccgccttcgccgacccggcccagccggcccccggcccgtacggcgcgctccaggccgccaacggcaacggcatccagctgcccagcggcttcaccagccgcgtcatcgcccgctccgggcagaccgtgcccggcacctcctaccgctggcacagcgcgcccgacggcggggcgacgtacgccgacggctcgggctggatctacgtctccaacgccgaggtgtccccgagcagcgggggcggggcgagcgcggtgaagttcgactcctcggggacggtgacgtccgcgtaccggatcctggccgatacgaacaacaactgcgcgggcggcgccaccccgtggaagacctggctgtcctgcgaggaggtcacccgcgggtatgtgtacgagaccgacccctggggtgtgaatgccgccgtgcggcgtccggcgatgggccgcttcaagcacgaggccgccgccgccgacccggaccacgggtacgtctacctcaccgaggacgagagcgacggccgcttctaccgcttccggcccacgacttgggggaacctgtcgagcggcacccttcaggtgctggtcgcgggcacgggcacctcgggaccggtgacctgggcgaacgtccctgacccggccggctcctccacccagacccggtaccaggtgtccggggcgaaggtcttcaacggcggtgagggctgcttctacgcggcgggcacctgctggttcaccaccaagggcgacaaccgggtgtgggcgtacgacgcgaacacctcgtcgatctcgctcgcgtacgacgactcgctggtgtcgggcggctcggctccgctgaccggcgtggacaacgtcacgcggtccgggtccggggacctctacatcgcggaggacggcgggaacatggagatctgcctgatcacgccggacgacacggtggccccgttcctgcggatcaccggccagtccgggtcggagatcaccgggcccgcgttctcgccggacggcagccgtctctacttctcctcgcagcgcgggacgagcggaagctcctccggcggcatcacgtacgaggtgaaggggcccttccgcggctgacgcggaccccacgtgcgccggtccccgtccccccggcccggcgcacgtcctgcggctcagccctggtccccggcggcagcggccgggtccatccagatgacctcccagatgtggtggtcggggtcctggaaggaccggccgtacatgaagcccatgtcctgcgtctcgcccgccggcgagccgccggaggccagggcggcgtccgccagccggtcgacctcctcgcggctgtcgcagctcagggccaggatgacctcggtggtcttcgaggcgtcggcgacatccttcttggtgaagtccttgaagcgcggttccgtcatcagcatggcgaagatggtgtcgctgatgaccagacaggccgtcttgtcgtcgctgaacgccgggttgaagccgtagccgagcttcccgaagaagctcttggtggtctccaggtccttcaccggcaggttcacgaaaatcatctgagccatggtcgtttcctcttcctctgtcccgtggcgccgcggtggtccaccggcgctttcgatggttggaccacggggccgcgcagaactcatcggcgtacgacagaagatttgcacggcccactgacaacggcccccggacagccctcagggcagggcgagcggagctccgccgcgcagcagggagccgccgagcggggtcagcgtgtgcaggaccgagctgccgtggcgcagcgtcaggaccaggcccgcctcgcgcagcacggaggcgtgctggctcgcggaggccagcgacaccccggcccggcgggcgagttcgctggtggtgcagccgttgccgatggaggagaggacggccgagcgggtgtgtccgacgagccggccgagccagggtcccggctcggcgaagaccggggctccggggttggccaccgggtagacgagcaccggcgggagcgacgggtcgcggtagaccacgggcgtgccccggcagaagaaggagggctggagcagcagcccgcgcccgtccagatacagatcgcggtcgaacgggtagtccgcctccagcacgggcggacgccaccggatcatcggcggcagcgcggccaggagcccgtccgctccgccgtccagcagggcccggccacggacggcccggtccgcctcgacgctggcccggatgtgcggccagtagggctccacggccgcgtggtggtagctgcggagggctccgatgagccgggcgagcggctcggcacggccctccatgagcgcggcgggcagcgccgcgctcgctctccccgctccggggtcccgttgacgcgggccggcggacaggccggcccgctgccgtatccgcccggcggccagcagctccagctccgcgtggacacggtcggcgggggtgtcgcgcagtgcctcgattccgacgtcgagcccgaaaggctcggcgccctcctgggagggcgtcagaaaatccgggaaatagccgcggggcgggacgaccgccgccagcagctgtgcttcaccattcaaccgcgctcgggattccgaacgccattttccgaacaccgtcgaagcacgccggtccctgatccggtgaaaactgagaatggtttcccacagtgcgtccggcctcgtggccatccgcacccgcgaaaggtccagcctggacacatggatacgcagcaccgctcccccacctgttgcatccgcaattgcccccaccgaagggtatgcggaccgtcacaggaggtcaccacggggtttcggccagaagtgaaaggtctcgccccgttccgcttcagccgaaaagctgtacggcgtcgggtacgcatccggtgcccaccggatgagcacgtgaaggccgtggggggctttgtgtgttcggcggcggtgggcgacggtgcggctccgtacccgacgggggtaagccgggtgcggtccatgggtggggatccatggaccgcaccccggtccccggggctacccccatcccgaatttctttgcgcattaaacgaagcaatgtgctctgcgccacattccttgcgcggcattcggtgcgcgatcctgatgatttcccggtaccgccggtcatttccgcacacgccacttccgtaccgccggtcgcatccggtcagcacgggacgaagcggcggcacccccgcacagggtgccgccgcttctcggcggggccttgaggccgtggtcggtgggcagggctgttcgtgcagccctgcccatgaggatccgggctgttcgtgcagcccggacccggagcccgggtcagcggctgtcgctgccccgggactcggctgcggcccggccggcctcaagacgggcgaccgggatgcggaacggcgagcaggacacgtagtccaggcccacctcgtggaagaagtgcaccgactccgggtctccgccgtgctcgccgcagacgccgagcttgaggtccgggcgggtggcccggccggcctcgacggcgctgcggaccagcgcgccgacgccgtccttgtcgatcgtctcgaacggggagaccccgaagatgcccttctccaggtacgcggtgaagaacgaggcctccacgtcgtcgcgggagaaaccccacaccgtctgggtcaggtcgttcgtgccgaaggagaagaactgcgcggcctcggcgatctggcccgccgtcagcgcggcgcgcggcagctcgatcatggtgccgatggtcagcttgaggtcggtgccggtggcggcctggacctcggcgatgacccggtcggcctcctcgcggacgatctccagctcctggaccgtgccgacgagcgggatcatgatctcggcgcgcgggtcgcccttggcgttcttgcgctgggcggctgcctcggcgatggcccgcacctgcatcgcgaacaggccggggatgacgaggcccaggcgcaccccgcgcaggcccagcatcgggttctgctcgtgcagcttgtgcaccgcctggagcaggcgcaggtcgttctcgttggcgtccttgcgggactccgcgagcgcgacgcggaccgacagttcggtgatgtcgggaaggaactcgtgcagcggcgggtcgaggaggcggacggtgacgggcagtccgtccatcgactcgaacagctcgatgaagtcggccttctggagcgggagaagagccgccagcgcgctctcgcgctcgtcgtcggtgtccgcgaggatcagcttctcgaccatctcgcggcgctcgccgaggaacatgtgctcggtgcggcacaggccgatgccctgggcgccgaagcggcgggcccgcagcgcgtcctcggcgttgtcggcgttggcccgcacgcgcagccggcgcacccggtccgcgtaggccatgatccggtgcacggcggcgaccagttcgtcggcgtcgtcggcccccgcgtgcatccggccctcgaagtactcgacgaccggggacggtacgacgggtacctcgcccaggtagaccttgccggtggagccgtcgatggacacgaggtcgccctcctcgacgacccggccgccgaccgtcatccggcgccgcttggtgtcgacctccaggtcctcggcaccgcagacacaggtcttgcccatgccgcgcgccacgaccgccgcgtgcgaggtcttgccgccgcgcgaggtcaggatgccctcggcggcgatcatgccttcgaggtcgtcggggttggtctcgcggcggatcaggatgaccttctcgccggagcgggaccacttgatcgcggtgtacgagtcgaagacggccttgccgacggccgcaccgggcgaggcggcgatgccccggccgagcagttcggtcttcgcctcgtcgtcgaagcgcgggaacatcagctgggcgagctgggcgccgttgacgcgctggagggcctcggcctcgtcgatcagcccctggtccacgagctgggtggcgatccggaaggcggcgccggcggtgcgcttgccgacccgggtctggagcatccagagctggccgcgctcgatggtgaactcgatgtcgcagagatccttgtagtggttctccagggtctccatgatctgcatgagctggtcgtacgacttcttgtcgatcgactcgaggtcggcgagcggcaccgtgttgcggattccggcgacgacgtcctcgccctgcgcgttctggaggtagtcgccgtagacgccctggtggccgctggccgggtcgcgggtgaaggcgacgcccgtgccggagtcgggacccaggttgccgaagaccatcgagcagacgttgacggccgtgccgaggtcgccggggatgcgctcctggcggcggtagagcttggcccggtcggtgttccacgagtcgaagaccgcgtttatggccaggtccatctgctcgcgggcgtcctgcgggaacacgcgtccggcctcggactcgacgatcttcttgaactgcttgacgagcttcttgaggtcggccgcggcgaggtcggtgtcgacctcgaccttcttcgcgtccttggccgcctccagcgcctcctcgaagaggtcgccgtcgaccccgaggacggtcttgccgaacatctggatgaggcggcggtaggagtcccaggcgaagcgctcgtcgccggactgggcggcgagaccggccaccgaggcgtcggagaggccgatgttcaggaccgtgtccatcatgcccggcatggagaacttggcgccggagcggacggagaccagcagcgggtcgtcggcctgtccgagctgcttgcccatgcgctcttccagcgccgtgaggtgcgcactcacctcgtcgcgcagcgcggtcggcgcgtcaccgctgtccaggtagaccttgcaggcctcggtggtgatcgtgaagcccggagggacgggcaacccgagattggtcatctcggcgaggttcgcacccttgccgcccagaagatccttcagatccttgttgccctcggtgaagtcgtagacgaacttctggggatctttgttttccgacacgggtctcgactcctcgaggacgcggtggctgccctgacggcgaggaacatacccagatcgaaggtggatgggtacgtccacttggtcgtcatacggccgcaaccacccgtccgccagcagatcgaaaggctcgcccggccgaagcacctgacgttccgctttcacctcctgaatacggcatggccgaaacttgacctgatccgctcaggcgagcggatcactcgccaggtgagttcacttctcgaatccagcagggtggcactgagtgccacgtcttccagaagtgcagtcacgctgaaaacgctcatctgagcggaaccccgatcaagggtggcgtgaatcacgcccgtttcggaccccgcatttcaggatccggacgcctcaggcactccccgagcaccccgaggtccacctcttccaggctacgggcgaaggtccgtccccgcgcgggctccaccggcaacagcgagggcaccaccagcacggcgcagcccgcggcgtgcgcggaggcggtgccgtccggggagtcctcgacggcgacgcaggccgaggccgggacgccgaaccgggccgccgccgccatgtacgggtccggatgcggcttggtccgtacggtgtcgtcggccgacagggtgaaggtgaaggccaccccggccagcgaccccgccaccaccgcgtccaccacactccggggcgatgcgctgaccagggcgaacggcacccgggacccttccagtgcggccagcagcgcggcggcaccggggcgcagcggggcacccgcgtcgaccttgcggaagaaggacgcggtcagctcggcgg

SEQ ID NO: 3264 - DNA, 6359 bp, Unknown
  Kingdom: Bacteria, Phylum: Actinobacteria, Class: Actinobacteria, Order: Streptomycetales, Family: Streptomycetaceae, Genus: Streptomyces
gagcgcgatggcttccagctcccgcgcgagcgacccccagaacgggttcgccacggagggcacgatcaggccgatcaccttgatccggcctgtgcgcagcatgcgcgccgcacggttgggccggtagctgaggcgctcgatggtctgctcgacacgggccagggtggccgcctgcatacggtcggtgcgtccgttgaggacgttggagaccgtactcgcggaaacacccgcagccgccgcgacctgatggatcgttaccccgctcatgccacctccggttcgaaactccctgacgaccatagtgtatcgatttactgaagtctctctaccgatacacccgttaacttgctcgaaaaattcttgtgcaccacctgttgacgccgctccagcggcattcctagtctcagtgcatcgatttaccagcacttcccagccatggctgggactgcctcactggatcgatccacaaactccgcctcaaaaggggtgcctcatggaactcaacagacggtcgctgctcgccgccatcggtgcgggcaccgccgccgcgctcacgggctgcggcaccggcacctccgcggccggctccgccgacggacccgccgagggcgagatcaccctcctcaccccgatctacgagggtgcgaagggcaagacactcctggagggcgacaccctcggcgggttccggaagaagtatccggacgtcaaggtgaacgtggactacaccacgtacgcccagctcaacgagaagatcaccaccgggctcgcgggcggcctgctgcccgacgtgctgatgatgggggtcggctggatcccgccgttcgccgccaagggggcgatcgctgaactgccggagaagctggcacaggcccacgactacgagaagcgggtgctggagccgtcccgccacgacggcaagctgtacgccctgccggtcgtgctcgacacccgcatcgtggtgtaccgcaaggaccacttcgccgaggcgggcatccgcaagacgcctgccaactggtccgaactacgagccgtcgcgaagcagttgaccacgaaggggcgggtcgggttcgaccccttctccatcgatctgcgccagtgctgggagaccttcctcttcgccaacggcggccagctgttcagcgcggacggcaagaagccgctgttcaccgacgcccgcggggtggaggccctccagttcttcaaggacctggtggccgacggctcggcggacttcgcacgcaagaccgccgccggagcgccgtcgaacgtgcagaccggccaggcctcgatgatgatgacgaccagcgcgctctgggtccaggtcaaggagcagaatccggagctgatcgagcaggacaagctcggcgcgttcgtcctggccaaccgcaagcccgcgatgctccagggcggcacgctcgtcacccagtcggcgagctccaagcacccggccgcggcccgtgcgctcgtggagtggctggccactcccgaatcgatcctcggcgcggcccagcagcgcggttcggtgcccgggctgcgggatctggacgacaccggttacgtcaaggagaaccagttcgtcgacctctccctgaagaacctccagcacgcggcgtccgagggcggcaccgccgcctggatggagatccgcgagaagatcaagccgacgctggagcccgcgatcgtgggcggccagtcggcgaaggacgccatcgcggagctcggccggctcgccgaggccgccatcggccggatgtgaggacccgtcactgtgggagcgacatccgtattgaaggcgcggcccgtgcggccgcccgcacctcctgaatcggcgccgacccggcgcacccgccggacccccacgggccccggacgccgacggcgccgggccggcatgctcatggtggcgcccgcgctgctgcacgcttcgctgtggatcggcctgccggtgctggcagcggtggtcctggcgttcacgaagtacgacgtactgaccgccccgcagttcgtgggtctggacaacttccgggacatgctggacgacgcggtcttccgcaagtccatcgtcaacaccgtcgtctacaccttcttcaccgtgccgttcggcatgctgctgggcctgctgctggccatggccctgcacaccggcctcaaggcacgcggcatcttccgcaccgcggtcttcctgccgcaggtcacggccacggtcgccatcgccctggtctggctgtggatctacaacccgggcaacggcctgctcaacgcgctgctgtcgttcatcggcatcgacggcccggcctggctctcctcgacgacgtgggcgatgccctcggtgatcctggtcggcatctggcagggcatcggcatgaagatgctcatctatctcgccgcgctccagtcgctccccagggagttgtacgaggcggcgtcggtggacggcgcgtcgaaggtccggcagttcttctccatcacgctgccgctgctgaagcccgccacgttcttcgtgctcatcacgtcgatgatcggcgcgttccagtccttcgaccagatctacatcctcaccgacggcggccccgccaacagcacgacgatgatgacctacgagatctacaagtccgccttccgggagttccgcgtcggatacgcctgcgcccagtccctggtgctgttcgtgctgctgatgggcttcaccctggtcaaccggcggatcatgggaggcacccgtggccacagttgatacgcggaagccggcagtcccgagcaccgcgaagccgcgggagcgcggcggccggcggccggtgtccccgggccggatcgcgctctacatcacgctgtcggtgatctccctgctgatggtggtgccgttcgtctggatggtgatcacctcactcaagtcaccggtggagatcgcctcccaggacgccggactcctgcccagcagctggcagttcagcaactacgtcgacgcgttcgaggcggccccgttcgccacgtacgcccgcaacagcttcatcatcgcgatcagccacaccgtgctgaacgtcctggtcgcctccatggccgggtacgcgctggcgcggatcaggttccgcggcagcgaggtgatcttctacctgttcatcgcggcgctgatgatcccgacgtacacaaaggtgctgccggagttcctgatcgtccgcttcatgccgctggccggcgggaacgacatcctcggccagggcgggagcggctggctcgacacctggtgggccctgatcatcccgggtgcggtgacgccgttcgcggtcttcctcttccgccagttctacctcgatctgccggtggagctggaggaggcggcccgcctcgacggtctaggcgagttccgcatctacgcccggatcatgacgccgcaggtcaagccggcgctcaccaccgtggcgctgctgaccttcgagtcgtcctggaacaacttcctgtggccgctgctggtgacccggacggacagtctgcgggtcatccaggtcgggctctccgtcttcaagacggagaacggcacccagtggcacttcctgatggccggcaccacgctcgccacccttcccatggtccttctcttcctcatcggccagcgctacttcgtgcagggcttcgccaccgccggtctcaagtgaccggcccccggcccctgtggccgggcaccgaatccggtcccccgcggccggaaaccgaaagggcttcacccatgtctgctgatcttcagggctcccgtgcgctggtgacgggggcggggcacggcatcggccgcgccatcgctctcgccctggccgaggccggcgccgacgtcgccgtgcactaccactcctccgccgaccgcgcggccgacacggtctcggcgatcgaggcgctgggcaggcgctccaaggcgttcgccgccgacgcgaccgtgaccgcggacgtggaccgtctggtcgaggaggcggccggcttcctcggcggactcgacatcctggtctgcaacgccggtcacctcgtcggccgctcgaccatcgccgagatgagcgacgaacacttcgaccaggtgatctccaccaacctgtcctcgacgttccgcacggtgcgggcggcgctgccgcatctgaagcggtccccggccggacgcgtcatcaccatgtcctcgctcgccgcgcacaacggaggcggccccggctcggtggcctacgccgccgcgaaggcggggatccgcggcttcaccaagggcctggccaaggagctggccgggaccggcatcacggtcaacgcggtcgcgccgggcttcatcaagggcaccgccttccacgacaccttcaccgcgccggcggcgcaggaggccatggaagcgggcatcccggtcggccgggcgggcacccccgaggacgtggcgtccgccgtggtccatctggcctcgcccgcttcgggcttcctgacggcgaccacgatggacatcgacggtggcgtatggccgcgttgaggcggatcgcgcggcagcgcggcggctggtggcacgcgtacgtctgtccggcgcacggggtggagctggagcacggcgatctcctcgccggggtgttccccgagggcggtgcgcggtgtgcgcgcggctgccgggtggacagcgaagcggtgcgcggcgcgtggctggtcctctcgcaccaggcctgggcccgtcgcctgcgggtgctggcgcaccggggcgagcgggcggaggcggtggagcggctgggtgagtacgcgggcctgtacgccgagctggccgccgaccgccacggagaggcacaggcctggatgctgcgcgggcggctcttccaccaggcgctgacggacgccatctgggcggtgaacgtcgggcacgcggtgatcacgctcgcggagaaggagaccggggacctggcggcggtgctgccgctgctggaggcgctggacgaagccgcgctggaggcccgggacgtgctgaccgcccagggacacctggcctccaactacacggcgtggctgaacgcggccggcgtcgctgcgagccgcgcggcggcggccgtccgcggcacggcctgggagggcgccggttgctggctggagggcgagcacgggctgtacgcccatctgcgcgtggccgtcgcggacgacggctgggagtgggagggcagtacctactaccacggcttcgtgctgcgggccgcgttgctggcgctgcgctccaccgccccttccgcgctgccgaccgacgtggtgggcgtgctggccgggatgacggacgtgctggccgccgtcgcgacgccgggcggtgtgctgcccgccctgcacgacggcccctaccggcgcgacgccctcggtcttgagtggctggaactgatcgcgctggcacagcagtcggtgccctcggacgcgctggaggcggtggcggaccgggtccgtgcggagctcggcgaggcggacgacgctctcgaccgtgagctggacggctggttcgccgggccgccgctcccccggcgggccgcttccggcccggtcaccgtgttcccctcgaccgggtacgcggtgctgcgggcggcggggatccacgcactggtggacttcggcccgcacggcggatcgcacgggcaccgggacaagctctcgctgtatctgtacggcgacaccaccgcgtggcagccggacccgggccaggtgccgtacgcgcacccggacttccgcgacctgtactcctcgactgcggcccaccccgcgttccgggtggacggcgccgagcaggccgagtgcgccggtgcgctgacggcggcggacgccgtctcggtgaccgccgaggtgacggaggcgtacgagggcgtccgggcggtccgccgggtggccgtcggcccgtgctatctggtggacctcctgacggtggaggtcacgggccgggaggacccccgcgtcaccgcccaactgcggcccggcaccgcgctggacgtgcaggtgcaggcggcgggcccggtgcgcaccacctggtacggggacgagacgctgcacggctggcacacacagagcgccggggtgccggtgcgtcctttcacgctgccgggtcccggtccggcggacgacccgcagcgcacccggacccgggtcgacttcacggccgacgccgctcacgtcgtcttcgcctcggtctaccaggcggcgtcggcgggccccgcggtgagcgaggtgcggctggacggtacggagctgaccgtggaactggcggacggttcgaccgcccgcttccggacggagggctgagccgtgctgctctcggcgaccccgccgcccggcccgcgccccgcacaggtgacccgggtgcgcgaggaggcggcccggcaccgcgggct

SEQ ID NO: 3265 - DNA, 4130 bp, Unknown
  Kingdom: Bacteria, Phylum: Actinobacteria, Class: Actinobacteria, Order: Streptomycetales, Family: Streptomycetaceae, Genus: Streptomyces
gcgcacgtcgggtcggcacacgtcgggtcggcacgcgccgggtcggcgcacgtcggcccgacccgctcagccggccggcgggaagccgttgcggcgcgcgaacgcgacggtcaggacggatgcggcgagcagggcggccgccgtccacggcaacgctccggttccggcgccggtgaggaccactccgccgagcagcgatccgccggccataccgatgttccaaccggtgacccacagggagttggcggtgtcggggtcctgcggcgccgccctgactcccgcggtctgcatcagcgtcgggatgccgccgtgcgtcccgccccagaggagtgcgccgaacaggacggccgccgtgctgtgcgcgaacaggccgaaggacgccaggcacagggtggcaacggccagcaggacgagcgtcgcggtgcgcagccgacggtcggccgtgactccggcgatccagacgccgcccatggaacccaggccgaagacgaagagcacggtgccggtactgacgtccagttccgcgtgttccacgaacggcgcgatgtaggtgtagagcacgtagaagcccaggacggtcgcgatcgaggcggtgttgatggcggcgatccccggcgttctgatcgtggccgccagaccgccgccgcgccgcgcccgctctccggcaagctgcgggagccaccggagcgccgcggcggccagggcgagggccagcccggtgagcagcccgaacgtccagcgccagccgatgagtccgccgagcgcggtgccggccggaataccgagcgacagtccgacggtcatccccgccagcgcggtggcgatcgccttgccgctgcgctcgggggccagccgtgcggcgtaggcggggaccatggcccacagcagtccggcgaacactcctgagaccacgcgagcaacgagcgtgagggcgaagtcggcggacaccgcggtcacggcgttggtggcggcgaagccgaggagcagcgccagcagcagggtgcggcgcggcacgatcagcgtccaggccgtgaccggtatcgcggtgagggcggcggccagggcgtagacggtgaccagcagtccggcgcgggcttcggtcacctgcaggtcagcgctcatcacgggcagcacgccggccggcagggcttcggtgaggatggtgacgaaggccgcgccggccagcaccaggagtccgcccagaggccatcgtgaggcgtcgggcgaggcgtcgggcgaggtgcccgggacgtgggaagggtgagtggttgaggacatgcccggacggtaaaaccctcacgcttacggcagggtcaagccgccggcctcccggccgtctccccgccctcggcagcctgggcggcggcccgcgcggcccgcaggtaggcgtcgatggcaccccggttgcgggtgaggcaccggatgcgacggtcgagctgttcccgctcggccgccacctggtcgagcatctgcgtgcagggcacctcgggcagcagatccgccggaccgtcgaggtagggcaggatgtcgcggatgatccgcgtgggcagtccgcattcgatcagcccgcggatctgccggaccacctcgtccgcgccgtcgcagtagtcgcggtagccgttgccgccacgcgcgggccggatgagcccctcctcctcgtagtagcgcagcgcccgcacgctgaccccggtcagccgggacagctccccgatcctcatgtgacccactccacgaacagctccggttgaccctcacgccaacgtgagggttctacgctactgccacagacgcccctcgaaatgacgacagacccgggctgcggcccccgccgcccggttcggcatggcgatccgggtgaaggcacccggttcggcatggcggtccgcaacgagcgactaccgctcgtagacgaccgtcaccggcgcgtggtcgctccagcgctcgccgtgcgtggccgcccgctccacccaggccttcaccgcgcgcccggcgagacccggggtcgccatctggtagtcgatgcgccagccgctgtcgttgtcgaaggcacgcccccggtacgaccaccagctgtacggcccctcgacatccgggtgcagcgcccgcacgacgtccacgtacgcggcctcctccaggacccgggtcagccaggcgcgctcctcggggaggaagccggagctcttgcggttggccttccagttcttcaggtccgcctcctggtgcgcgatgttccagtcgccgcagaccacgacctcgcggccgtccgccgccgcgcgcgccttcagcccctggaggtaggggaggaaggcggccatgaagcgctccttctcgacctgccgctcggtgccgacctcgccggagggcaggtacagactggcgacggtgacgccggggaggtcgatctccacataccggccgctcgtgtcgaactcctccgccccggcgaccccgaagccgccgaagccgatctgagtccgctcgggagcctgccgcgagtagagcgagacaccggcgcgccccttggcggcggcgggcgcgtggacggtgtgccacccctcgggggcgcccacgccttcgggcagctgggcgagctcggcccgcacctcctggaggcagaccacatcggcgtcggtccccgccagccactcgacgaagcccttcttggcggcggcgcggagcccattaacattcacggaggtcactgtgagcaaaacatgctccccatcttcacgagctttcggaggctgcccagcacaccgaccgaggtcactgtcagcatcccgaaacagtacccactccacccctacgcacagatatacgatgctcagcatgcttattcactctcggcctttcgaccaccccgacgccgtcaaactcaatgaccaggtgcagctcgaatacgccgagcgctacggcgacgagggcgatgtcacaccgctcgacccctcgatgttccttccgccgcgcggcctgtacctgctcgcctacgacgagcaggaccggccggtggcgaccggcggctggcggacccaggaccgcaaccccgagggctactgggacggcgacgccgagatcaagcggatgttcgtgatacccgagggacgcggcaggggcctggcccggcggatgctggccgccctggaggaggacgcccgcgccgccggccggctccgcatggtcctggagaccggcgaccagcagcccgaggccatcgccctgtacacgtcgagcggctacacggtgtgcgagaagttcggccactaccgggagtacgagagcagcatctgcatggccaagccgctccagcagcccggagcctgaaccggccccggcggcaagggccgccagggcaacgactgtccggggtgacggccgccccggcagggcggccgctcaggcgcccccgccgagcaccaggaccacgtgctcgtcctccccgtgccgcaccgtgccggtcgccacgaacccgcacttctccagcaggcgtatcgagccggtgttctcggcggcagggtccgcgtacaacgggcgtgccgtctcccgctccaggaacgcggtcaacgcccgggttccgatgccccggccccagtagggacggccgaaccaatagccgatgtagcgccgctccccctcccaccaggcgacgatgttccccgccgtcccgccgtccacgacgaccgtctgcacgaagttggcggggtccccgagcaccttcgacgtccagtgcgccatgaacgcctcccgctcccgcggagggaagcgcgatctgcggaccgcctccgggtcgtgctcgtacgcgagaaacgcttccagatccgctggttcgacatccctgagccgcacgtcgttctccatgccgaccgagtctggcacccgccactgacaaccggcggcccggccgctcagcgcggggtggccagcacctgggtccagtaggggccgcgcggggagtcggcgatgcccacgcccacgtggacgaagtcgcagttgaagatgtcgtcgtcgcggccgggactgttgcgccactcctcgacgaccgcggccggatcgctcatgccggtcgcgatggtctccccgacggccgaccagtcgtagcccgtggcgtcgacccggtcgcccgcgccgcggcc

SEQ ID NO: 3266 - DNA, 1575 bp, Unknown
  Kingdom: Bacteria, Phylum: Actinobacteria, Class: Actinobacteria, Order: Streptomycetales, Family: Streptomycetaceae, Genus: Streptomyces
gggcgcggagatctcccgcgccctggtcggggcggtccgcgaggccgccctgcacaccatcgagaacgccctggtcctggagctgctcacggacgccgacggccgtacggcgggcgtctcgctgcacgtcatgggcgagggccagcacgacggcgtcggcgcggtccgggccccctcggtcgtcctggccaccggtggcatgggccaggtcttctccgccaccaccaacccccccgtctccaccggcgacggggtggcgctcgcgctgcgggccggggcggaggtctccgacctggagttcgtccagttccacccgaccgtcctgttcctcggcgcggactccgagggccagcagccgctggtctccgaggccgtacgcggcgaggggcccgacgccccccggctgtggaccctcgtcgacggagcgggccgcctcggcatcgcctgcgccgcccccgtgctgcgccacgtctaccgcgagacgtcctcctcacacctgcggggcagggccgcccgcgccctggccgccaccgacccgtcctacgcgaccgggttcgcggtggagtgcctctgggactgcgaggagaccacccgcgaggtggccgccctgcacgccgagaccggagacgtccgcgtagccgaacgcctgcgccgcctcgccaccgacccggccgaggaggccgaggtccagacggcggtacggagccggatcgggccggacgcaccggccctctgaccgcggtcccgggaggaggggcgttgtcagaccctcctcctaggctttgcggcatggacatcaacgagtggtggggactcgtcgaacaggcccgcgcagcggcgggggaccgggcggacgaccgggacccgcccgacgaccccctgcccggagcgctgaccgacgtgctcgcggccctggagccggaacggatcgccgccttcgccgtcaccgcggtggacgtgacccggtccgcgtaccgcaggcccctgtggaacgcggcgtatctcatcgagggcggctgcggcgacgacgggttcatggacttccgcgacgggctcgccctgctcgggcgggagaccttcacccgggcggtggccgatcccgactccctggccggactgccggtggtgatccggatgagccggggggagagcggctggatcggatacgagtccctgaacaccccgacagccgaggcctaccgccgcctccggggtgagaccgcctccctcgacgccgccgtggaagcgtctctgcgcgaccgcatacgcccggccggcccggcgggggagagctgggacgccgaggacgccgacgcgacacgccggtatctgccccggctggcggcgctcttcctggactgaacgcttccccggtccggccctcgttcccgcgcgcccacagccttccgagtccgcgcccgccagtcttccgggtccgtgcccgcagtcctgcgagcccgggtgcgcgggcacagaatggcgccatgaccggacgctgggagttctggatcgaccggggcggcaccttcaccgacgtggtgggccgccaccccgacggcccaccacgtcggtgaa

SEQ ID NO: 3267 - DNA, 10481 bp, Unknown
  Kingdom: Bacteria, Phylum: Actinobacteria, Class: Actinobacteria, Order: Streptomycetales, Family: Streptomycetaceae, Genus: Streptomyces
  misc_feature (310)..(311): n is a, c, g, or t
  misc_feature (684)..(685): n is a, c, g, or t
tcccccgcccgtcgtcggcaggggcgccgccctactgcgggggcagctccttcagttggatgttgcggaaggacacctggtcgtcggctccgtggttctggaggccgatgtagccgtccttcagactgcgggccgggtcggtgttggtgaagtcgttgatcttcgctccgttgaggaagatctgcagacgttcgccctggaccttgatctcgtagctgttccactggcccggcggccgcaggacgcggtcacgggccttgatgttggcggacttgaaggtgtagacggcgccggtcgtgcggtcggcggnncccgttgttgaccgccgaccaggggtcgtcggactccgggaagcccacgaagacaccggagttgtcgtcaccggtcatcttccagtcgagcttgagcgagtacgacctcagttccttcgcctggtaggtgaggaggcccatgccgccctcggagtgcagggcgccgtcactgacggagaacttccccgggcccgcctgcttccatccctccagcgtcttgccgttgaagatgggccggtagtccttgtccggcttgcagtcggccttgacctggccggtggcgtagcgcaggccgcccagcacgtgactgcggaaggccggctccgcgtaggactccttggtgtggccgaggccggtgtagaaggagcggccnntagttgtaccactcgtcggtgcgctgccactcgtcgtcgaggtgggcggtggcagggtggtcgtggtcctcgacgcggacggtggcgggctggatctgcgggtgggagtcgaagtaggcgccgacgaggccgccgtagaactcccagtcgtactcggtgtcggcggcggcgtggatgccgacgtagccgccgccggtggcgacgtagttctcgaacgccttctgctgctcggcgttgaggacgtctccggtggtggagaggaacgcgacggcgtcgtagcgggccaggttgctggtggtgaactgggcggcggactcggtggagtcgaccgtgatgttggtctgcttgccgatctccttcagggccgcgatgcccgtggggatcgagtcgtggcggaagccggcggtcttggagaagaccaggacgcgcttggcggccctgtcgacgggggtgttggacagttcgaagtcgtcgacgtcgtagagcgctccgtcgccgcccttgaagaccaggaagagttccgtctgcttcttgggcgcgccgcgcagcgggatgtcgatgtcctggaaggtgtcccagctgccggtcaccgggacgggtcccgagccgaggatcttgccggtgggcgatccggcgcgcacttcgaggaagccgccggagccggccgaggagacgcgggcggtgagcttggtggtgccgcccaggacgtacgtcttgaaggagatccagtcgtcgttgtggatgtcgccgacggtcttgccgccgtgggcactggacttgctcggggtggtgacgccggaggcggcgtcgaagtgctcggcctgacggtgcttgggctggagccgggaggcgtccttgccggtcagctcggcctggccgccgccgccgttgtcggtgtaggaggcggagatgccgccgtagatgttggcgttggggtcgtggccgccttccatggcggtcttgatggtgccctcgcagccgtgctcggtggtgatgtcgtggccgtggctgtcgtggcccagggtgaacttgacctcgaccttggtgcagtcgatggtcccgtcctccgggtcgctgacgttcaccttgaacggcacggcgtcaccgaactcgaagagctgcccgtcctcggggagttccagcttcacggtcggggcggtgttaccgacggtcacgtggacgctggccgagccggtgcggccggtcgggtcctcggcggtgagcgtggcggtgtaggtgccgttcttcttgtacgtgtacgtcgggtcggcggcggtggaagtgccgccgtcaccgaagtcccagtggtaggtgagcgggtcgtcgtcgccgtcggccgtgccggccgaggagaacttcaccttcaggggtgcggtgccggaggtcttgttcgccgaggcctcggcgatgggtgagcggcctccggtggcgttctcgatccggtagagcgcggagttctcgtcgccgccgaaccaggcgaggccgtagtcgaggacgtagagggccccgtccgggccgaaggccatgtccatgatctgcgtgccggaccacggcacgtcgttgatggactggacgccgccgtcggcgtcctgctcgatgcgcttgatccaccggcggccgaactcaccggcgaagaagtcgccgtcgtaggcctcggggaacttcaccggggagtccaggtccgcgtcgtagcggtagacgggtccgcccatcggggactcggagccggtgccgaactcgggcacggatccgccgtcgtacgggatccacgcggcctgggccggcgggaggtcgacgagcccggtgttgtgcggcgactcgttcttcggagcggcgcagtcgaaggcggcgcccgatgccttggtggcgaagtcgtagtcgatgtagggctcgttgtcgccgacgcagaagggccagccgaagttggcggccttcgtcaccttggcgaactcgaccttgccggcgggtccgcgcttggggtcggcagcgcccgcgtcggggccgtagtcaccgacgtacacggtgccggtggcccggtcgacggagaagcggaaggggttgcggaagcccatcgcgtagatctcggggcgcgtcttgtccgtcccgggtgcgaagaggttcccctccggaacggtgtacgagccgtcctcggcgaccttgatgcgcaggatcttgccgcgcaggtcattggtgttgcccgaggtgcgacgggcgtcgaacgccgggttgcggtcggggcgttcgtcgatcggggtgaagccgtcggaggcgaaggggttggtgtcgtcgccggtggagaggtagaggttgccctcggcgtcgaagtcgatgtcgccgccgacgtggcagcacgtgccgcgcgaggtggcgacgtccaggaccttcttctcactggcggtgtcgagggtgccgtcctcgttgaggacgaagcgggagagccggttgacgccctcgaacttcgcgaagtcggcgggggtgccggtctccggtgcgtcgcccgcgggggtgtccatcggcggtgcgtagaagaggtagatcgcccggttctcggcgaagtcggggtcgactcctacgccttggaggccttcctcgtcgtgcgtgtacacggggagagtgccggagatccgggtgttgccggcgctgtcggtgatccgcagctcgccgccgcgcgaggtgtgcagcacgctgcggtcggggaggacggcgagcgacatgggctcgccggtctcctcggcgcccttggccagggtgacttgctggaagtcctccgccacggtctcctcgtgcccggggtgacccgggtgggcggtggctccgggggcggagccgagggtcagggtcgcggcggcgagcaggccgccggtgaacagcgcgagcgatttacggacgcgggtccgggccaggagccgctttctggttctgtgcacgtaggtcctccggagagtgccggttgtacgggcgggtgtagccgtgccgtgccgcgcggggactgccgcgcgtgcgtcaccggagacgggagcgactccggtgacgcgagtcatgtcgtgtacacgaaatggacggtagacctgttcgtcctcgacggaaagcccttgtgcaacaggtaagtcgaacttctgcttccgtcaggacaaaggcgttttcgggcagcgcgaggcagccccgggggctgtggcgttgaaccgggtcaggcccccggggcttggtcgaccgcgctactcgccgccgccgaaggccgcgtcgaaggaggccgacggcgggtcgaagtcgaaccgcttgaggctggcaagcgcttcaggagccccggtcagccggtccatgccggcgtcctcccactccacggagaccggaccctcgtagccgatggaccggagcatccggaagacgtcctcccagggcacgtcgccgtggccggcggagacgaagtcccagccgcgccgggggtcgccccagggcaggtgcgaaccgagccggccgttgcggccgtcgagccgcttgcgggcctccttgcagtccacgtggtagatccggtcccggaagtcgtagaggaagttgaccgggtcgaggtcctgccagacgaagtggctcgggtcgaagttcagcccgaacgcgggccggtggtccaccgcttcgagtgcgcgcttggtggtccagtagtcgtacgcgatctcgctcgggtgcacctcgtgcgcgaagcgcaccccctcggcgtcgaagacgtccaggatcgggttccagcgctcggcgaagtcctcgtagccccgctcgatcatgtgcggcgggacgggcgggaacatcgcgacgaggtgccagatcgaggagccggtgaacccgatgaccgtgtccaccccgaaggcggcggcggcccgggcggtgtccgcgatctcggcggcggcccgctgccgtacgccttcgggctcaccgtctccccagatgcgggcgggcaggatgccctggtggcgctcgtcgatcgggttgtcgcagacggcctggccgaccagatggttggagatcgcgaagcacttcagcccgtacctgtcgagcagttggtgcctgctatccaggtatccggggtcggacagcgccttgtcgacctcgaagtgatctccccagcaggcgagttcgagaccgtcgtagccgaagtcccgggcgtgcttgcagacctcctccagcgggaggtcggcccactggccggtgaacagggtgaaggggcggggcatgggcggcagcctcctaggacgaggacgggaccggggtgtggacggagttcttggcggcgctctcctcgacggcggcgagcacccgctgcacctggagcccgtccgcgaacgagggtacggacggagctccttcggcgatcgtgtggaccacgtcgcgggcctggtggacgaaggtgtgctcgtagccgaggccgtggcccggcggccaccaggcctccaggtaggggtgctcgggttcggtgacgaggatgcgccggaagcccgcggtggcggcgggctcggtgtggtcgtggaaggacagttcgttgagccgttccaggtcgaaggcgagcgagccccgttccccgttgatctccaggcgcagggcgttcttccgcccggctgccatccgggtcgcctcgaaggaggccagtgccccggaggcgaggcggccggtgaagatcgccgcgtcgtcgacggtcacctcgccccgctccaccgtgtcggcgctgccggagagcccggccgacgacccggcgagcaggggcctctcgcgtacgaaggtctcactgacggcggacaccccggtgagcagttcgcccgccaggtactgggcgaggtcgacgatgtgggcgccgaggtccccgagcgcgccggacccggcgtgctcgcgcttgagccgccaggtcagcggcgaggcggggtccaccagccagtcctggaggtaggtggcgcgcacatggcgcagggggccgagccggccctccgcgatgagctgccgggcgtaggagatggcgggcaccttgcggtagttgaatcccacgatcgccacctgcccacgggcggaggccgcttcggcggcccggaccattgcctccgcctcggcgacggtgttggcgagcggcttctcgcacaggacgtgcttgcccgcctccagggcggcgatggcgatctccgcatggctgtcaccgggggtgcagatgtcgatcagctggacatcgtcccgggcgatcagtgcccgccagtcggtctccgcggccgtccagccgtgccgggcggcggcggcgtcgaccgccgcacggtcgcgtccgcagatcgcggcgagagcgggtcgcaggggcaggtcgaagacgtgtcctgcggtgcgccagccctgcgagtgggcggcgcccatgaacgcgtatccgaccatgccgaccccgagcgttcctcgcgcctcctgcggcgccggtgccgggccttgcgtttccgtctcttgactacgggccatgcggacttcctcctcatcggtgtgcggtaacgggccgggggatgcgctctccgcaccccccgtagtcccggtcagttgaagcccgtcggcaggtactggtcgatgttgtccttcgtcacgaccgcggagtacagggtcagggaggtcgggatctccatctcggagaggccgctgacgcccttgctctggcccagggcccgtgccaggtcgatcgcggacgcggccatcgtcggcgggtagaggacggtggccttgatgaccgagttgtcggccttgatggcgtccatcgcggacttggcgccggcgccgccgaccatgatgaactcgtcgcggcccgcctgcttgatggcgcggagcgcgccgactccctggtcgtcgtcgtggttccacagggcgtcgaactgcttctgtgcctggaggagttgcgccatcttggcctggcccgactcgacggtgaagtcagcggcctggcgggccaccagcttgatgttggagtagttcttgagggcgtcggcgaaaccctggctgcgctgcttggtcagctccaggttgtcgattccggcgagctcgacgaccttggcgttcggcttgtccttgagctgctcgccgatgtagtgcccggcgttgagacccatgccgtagttgtcgccgccgacccagcagcggtaggcctgcggggaggcgaagatgcggtccaggttgacgacggggatgcccgccctcatcgcttccaggccgacctgggtgagggccttgccgtcggcgggcaggacgacgaggacgtcgaccttcttgttgatgagggtcttgacctggccgatctgggcggcggtgtcgttggaaccctcggtgatctccagggtgacgtcggagtacgtctccgcccgggacttggcgttcacgttgatcgcgttgagccagccgtggtcggcctgcggtccggcgaagccgatggtgacggccttgcccggcttgtcgtcggcgggggcgctgttgccggcgggctcggtcttcttgggctcgttgctggtacaggcggtgaggagcgcgcccgcggagacggcggcggttccgaacagcagccctctgcggctggtttctggcatgacggtctgacccttcatccggtgggtgcgtaggaggtgcggggggcgtggtgggcgcccgggtgccggggtgctcggtcgctcaggtttccctgccgcgcatggtgcggcgctggacgaggacggcggcgacgatgatggcgcccttggcgatctgctggacgtcgctctggaggttgttgagagcgaagatgttggtgatcgtggtgaagatcaggacgccgaggacggagccgacgatggtgccccggccgccgctgagcagggtcccgccgatgatcgcggcggcgatggcgtcgagctcgtacaggttgccgttggtgttctggccggagccggcgagcacgatcagcatgaaggcggcgatgccgcagcacaggccggacagcaagtagaggtagaggcgctggcggcggacgtcgatccccgcgagccgggcggcctcggcgttgccgccgacggcgacggtgcggcggccgaaggtggtccggttgaggatgagccagccgacgacggtgaccacggcgaacatgatgaccagcggcgggatgccgagaatgtaggagtcgggcagaccgaggtccaggaccgagtccacggtgacgatctgcgtcttgccgtcggtgatctggagggcgagtccgcgcgccgaggcgagcatggccagcgtcgcgatgaaggggaccattcccccgtacgcgatgaggacgccgttcacgagtccggcggcgaggccgacgatgaccgcggtgaacgcgatgcccgcgaagccgtactcctgggtggccagggtcgtcgcccacaccgaggcgagggcgaccatggcgccgacggagaggtcgatgccgccgctgatgatgacgaaggtcatcccgaccgtgacgacgccgatgacggacgcctgggtcaggatcagctggaggttccccgtgtccaggaaggcgtccggttcggtgatgccgccgaccacgatcagggcggcgagcacgccgagcagggacaggatccggacgtcgagccgcagaccgagggccggggtgccaccgcccgacttcgagggcggcgcgccggaggggccggtgagggtccccttgtccggcccgttgtgctgcgccgacggggcgggctgtgtcatggcgtcgggctcccttccatcacgaggtcgagtacgcggtgctcgtcgagctcctgggcgggggccgtgtggaccacttggccctcgcggagtaccagcacccggtcggcgaggcccaggacttcgggcacttcgctggagacgagcagaacggcgaggccttcgtcggccagccggcggatcacggcgtagagctcggcgcgcgcgccgacgtcgacgccacgggtgggttcgtccagcagcaggacccggcagccgcgcagcagccagcgggcgaggacggctttctgctggttgccgccggagagggtgcggacggcggcgtccgggttgtcgggccgcatctgcagctcacgggtggcgctctgcgcggccttccgctcccctccccggtcgatccagccgatccgggcgaagcgggagagggaggagaccgagacgttgcgggtgaccgactcggtcatcagcagggcctgcgccttgcgttcctcgggtgcgaggccgatgcccgccgcgacggcggcgcggacgctgccggggcggagttgcttgccgtcgacggtgacggtcccggtgctcgccctacgggctccgtagatggtctccaggatctccgagcgtcccgagccgacgagtccggcgaggccgacgatctcgccgggccgcagctccaggtcgacgggggcgaactcgcccttgcgggacaggccttggacccggagtacgggttcggcggtggcggcggccggctcttccggacgcggcgggaagacataggcgacgtcccggccggtcatcatggcaacgatgtcgcgggtgggtgtgccggcggcgggcagcccgacggccacggtcctgccgtccttgatgacggtgacccggtcgccgatgcggcggatctcctccaggcggtgcgagatgtagacgacggccaccccgtcggcggtgaggccgtcgacgatccggaagaggttgtcgacctcgtcggggtcgagggcggcggagggctcgtccatcacgatgagccggacgtcgtgggagagggcccgtgccatggagacgatctgctgctgggcggcggagaggtcgccgacgtgccgggcggggtcgatctccgggtgcccgaggcgcgccaggagcgccttggcggcgagacggccctcccccgtgcggacgatgaagccggcgctggtcggctcgtggccgaggaagacgttctcggcgaccgacaggccctcgaccaggtcgagttcctggtagatggtggcgatgcccaggcgcatggcggcgatcggcgacttgagctggacggtttcgccgcgccaggtgatctctccgtcgttgggctggtgggctccggcgagcaccttgatgagggtggacttgcccgcaccgttctggccgaggaggcagtggacctcgccggcctggacctccaggtcgacgccgtccagggcgcggacgcccgggaagagcttggtgatgccggacatggtgagcaggggtggttctggtgccatgacgaatcccctcggcgaatggggtctcccctgctcgggcggtgccgaggggccggggagggccggtgagcggacagggcgcagggctggaggtgccgtggagccggcggcaccgcgaacggctgctgactagtacctgacgagcgagtacctgactggttcctggctgatgtacccgacgagtacctgactagtacctggctgatgccgggtacctgaccaatacggtggtgcgtcggcctctgtggtcaggccggtgagaagaggtggtcgctgatgagccgggccgcgccgatcactccggcggtgggccccaactcgcccagcacgatggggaggttgccggtggccaggggcagcgactgcttgtagacctgggtgcggacactggcgaggaggttgtgaccgaggccggtgaccccgccgccgatcaccaccagaccgggattgaagaagctgaccaggctcgcgatcacctggccgagccggttgccgccttcgcggatcagatcgagcgcggcggcgtccccggcagcggcggcggccgccacgtcggcggcggtgag

SEQ ID NO: 3268 - DNA, 3056 bp, Unknown
  Kingdom: Bacteria, Phylum: Actinobacteria, Class: Actinobacteria, Order: Streptomycetales, Family: Streptomycetaceae, Genus: Streptomyces
gcgggccgacgccctggccgccgcttcccgcaaggcgctcgcccagcagaagaagctggccgaccggcagaagaagcagcgcgacgccgtgcgcgggaagctcaaggaggtcgaggggttgctggccacgctctccgaggagcagatgacccagctcgccggtctcgaacagcggggcgtggacgaggcgcagcgcgacctggtggcctccggggcgctcagctccacccggccgcccacccggcagggcggcgacgccgtcgcgtacgcggtccggcagatcggcaagccgtacgtgtggggggccgagggtcccgcttccttcgactgctccgggctcacgtcccaggcctggtcggcggcggggcggacgatcccccgcacctcgcaggaacagtggaagcagctcccgaaggtgccggtctccgcgctgcgccccggagacctggtgatctacttcccgaaggcgacccatgtggcgctgtacatcggcaacggcctggtggtgcaggcgccccgccccggcacgaaggtcaaggtctcaccactggcgtcgaacccgctgctgggagccgtccggcccgaccccggcggcaccccgctgtccacgtacacgccccccgagctgcccgagggcgcacgcgacggcgcggacaccggatacggcacggacgcggcgccggacgctccttagagggtgtcacggacagacctcggcggccggaccggcggtgcgggtccggccgccgaagcggtgggtgggcgctcaggctccggtgagcgaggccaggtaggcgttggtcttctcgggctcgtagaagaagttctcgaagtccgccgggttgttgaagccgttggcgaagcggtccgcggcgggctggagccggccggcggcgccgatcaggttcagcacgtgctccggcgggacgccgagcatcgcgttggtccacttcgtgacgtgctgcgcggtctcccagtaacggtcgaacgtggactgcatccactccgcgtcgaactccttcccaccgtgctcgacgatcgagtccaggtacgcgttcgcgcacttggaggcggagttggagccctggccggtgatcgggtcgttggccacgacgacgtccgcgacgcccaggaccaggccgccgccgggcagccgcccgatcggcttgcggaccgtgggggcgtagcggccggcgagggtgccgttggcgtcggtcagctcgaccttggtggcgcgggcgtactcccagggcgtgaacctctccatgagctccagcgtcttcgccagatgctcggaggggtccttgatgccctggaaggcgtccagcggcccgcccgggacgccctcccagaagaggatgtcggcgcggccggagagggtgagcgtcggcatcacgaacagctcgccgacgcccggcaccaggttgcagcggaccgcgtcgaactccgggtgctcggggcgcgggcccatgccgtggacgtaggcgacggccagcgcgcgctgcggggcgtcgaacggcgaacgggccgcgtcccggccgaacatggagaccagctcgcctttgccggccgagaccatcaccaggtcgtaggtgcgggagaagtagtccaggtcggagacggccgccccgtggatgacgagctggccgccgcgctgggcgaaggtctccatccagccggccatcttcacgcgctggtcgacggactgggcgaatccgtcgagcttgccgacccagtcgacggcgcgcgaggagtcgggggcggcgacggagacgccgaggccctcgatcttcggggcctgggactcccagaagttcagctggtagtcccgctcgtgctggagcgcggtgtggaacatgcactgcgtcgacatgacccggccggtgcggatctcgtcggccgtgcggttggacatcagggtgacttcgtagcctctggactgcagcccgagggccagctggagcccggactggccggctccgactatgagtatcttccgcatcgcggctctccgttgtgtgtgatccagcgctccgccgctccgtgcggagccgccgagctatgcgggggtggcgtcgagagcatggcccacgagggccaggagcgactcgacgaccgtgatcctgttacgagcgtccatgatcactatcgggacctgcgggggtacggtcagggcctccctgacgtcctccgcctcgtaaccgggcgtcccctcgaagtggttgacggccacgatgtacggcagtccgcagctctcgaagtagtcgagcgcggggaagcagtcctccagccgccgggtgtcggcgaggacgaccgcgccgatcgccccgcgcaccaggtcgtcccacatgaaccagaagcgctgctggcccggggtgccgaagacgtacaggacgaggtcgtcctccagcgtgagccggccgaagtccatggccacggtggtggtggtcttctcgggcgtcgcggagaggtcgtcggtctcctcgctggcctgggtcatcagcgcttcggtctgcagcggcgtgatctcggagaccgagccgacgaacgtcgtcttgccgacgccgaatccgcccgccaccacgatcttggtggcggtgggagcgcgggtgtggtcgagctgccaggcctggagggactcctcggcctgttcccggggccccggctgacgcggggcgaagagcggcgcctcagagacggcggagtccattgagcaccctttcgagcagtgcgcggtcgggctggccggcgccgtggccggttccgtacacgcggatctttccctggtcggccaagtcgctgagcagcacccggacgactccgagcggcatcttcaacagggccgagatctccgcgaccgtacgcatccggcggcagagttcgacgatggcctggagctccggcatgacccgcgaggcgaggttgccgttggtgagttcgcggcgctcgtcgggtgcttcgagggccgcgacgaacgtctcgaccagcaggacgtgtccgaaccgggtgcggccgtactccctcaccggcggccgctcccggttcggacacctcct

SEQ ID NO: 3269 - DNA, 767 bp, Unknown
  Kingdom: Bacteria, Phylum: Actinobacteria, Class: Actinobacteria, Order: Streptomycetales, Family: Streptomycetaceae, Genus: Streptomyces
gggcgacggctgcggcgatgggcagccccggcacgatcgagttggcgaccgcggcgacggcggcggtggtgacgaagacgagggccacggccagcaggaagatcgggcgtctgttggcggcgaactgccgccaggaggtgcgctgcacggtggcgtagagcagcggtggaagcagcgcggggaggatgatctccggcgggatgtcgacgttcggcacgaacggcatgaacgccatcgcgatgccgatgatggtcatcagcaccggcgcgggcagccccagccggtcgccgagcggcaccgtgaccacggctccgagcagcagcaggagcagcagggacatctgttccacgaggtgccttccggagcgtacgggtccggcacaccacgagcggccgaacagggcacccaccctgccacgcggggtccgcgattcggccgataccccccgcttccggcactcaggccgggcggatctcccgccgcatggcccggtgcggcatgcccgcgtcggggaactcggggccgtacgcgacgtatccgagccgctcgtagaagccgagggcgtgggtctgggcgtgcaggtcgacggcggccaggctcagcgtccgcgcctcgtcttcgatggcccgcacgagggccgcgccgaccccgaggccgcgggcctcccggttcacggcgagccggcccagcgacccgacggccgggtcgccgccggtcttcccggccgcgtccgcgccgtgcagcagccggcccgtgccgagcgcggt

SEQ ID NO: 3270 - DNA, 1195 bp, Unknown
  Kingdom: Bacteria, Phylum: Actinobacteria, Class: Actinobacteria, Order: Streptomycetales, Family: Streptomycetaceae, Genus: Streptomyces
gcgtagtaggggtgcatcagctcggccttgtactccttcaccatgcgggtgcgcatggcttcggggtcctcggcgtcggcgatctggcggcggaagatgacgttggccgcgccctccgcgcccatcacggcgatctcgttggtgggccaggcgtaggtcaggtcggccccgatggactgggagtccatgacgatgtacgcgcctccgtaggccttccgcaggatcagcgagatccgcggcacggtggcgttgcagtaggcgtagagcagcttcgcgccgtggcggatgatcccaccgtgctcctggtccacgcccggcaggaagccgggaacgtccagaagggtgatgatcgggatattgaaagcgtcgcacatctggacaaaccgtgcggccttctcggaggcctcgatgtccagcacgcccgccagagcctgcggctggttggcgacgatgccgacgacctggccgtcgaggcgggccatcgcgcagatgatgttgcgggcccagcgctcgtggatctccaggtagtcgccgtcgtcgacgagctcctcgatcaccttgtgcatgtcgtacgggcggttgccgtcggccgggaccaggtccagcaggacgtcgccgcgccggtccgcggggtcgtcactctcgaccgtcggcgggttctcgcggttgttggagggcagcatcccgatgaggtagcggacctccgcgatgcacgtctcctcgtcgtcgtacgcgaagtgcgccacccctgacgtctcggcgtggacgtccgctccgccgagaccgttctgggtgatctcctcgccggtgaccgccttcaccacgtccgggccggtgatgaacatctgcgacgtctcacggaccatgaacacgaagtcggtcagcgccggactgtaggccgcgcctcccgcgcacgggccgagcatcacgctgatctgcgggatgacaccggacgcccgggtgttgcgctggaagatgccgccgtagccggcgagcgcggagacaccctcctggatacgggcgccggcgccgtcgttcagcgacaccagcggggcaccggccgagatggccatgtccatgatcttgtggatcttcgtggcgtgcgcctcacccagcgcaccgccgaagatccggaagtcgtgcgcctacacgaagaccgtccggccctcgaccgtccaccaccccgtgatcacac

SEQ ID NO: 3271 - DNA, 1467 bp, Unknown
  Kingdom: Bacteria, Phylum: Actinobacteria, Class: Actinobacteria, Order: Streptomycetales, Family: Streptomycetaceae, Genus: Streptomyces
cgtcggcggtgtgggcgacggcggtcttcgcgtacgggatcggcggcgaccggaggcccgacccgcgcggttaccgcgtggagtccgactcctgcgcggcggtggagctgaaggcgctcgccaaggcggtgggggagccggcggccgagccgtcgaccgaactggacggcatcgagcaccccgccctccgccgcatccgctgcaccgtcgacttcacggtggcggcggtccgggcgccggacggcgcggaggcctcgggctggtccaccggctatcaggcgtccctcacggccgagctgcacaaggagaccgacccgcgccccgagttcgaggcgagcagcacgctgacggagatcgacgacgtgggcgtggaccgggtggagcgcataccggacctcggtgacctcgcccatctgctgatcatggaggacgagtccatgcgtgtgcaggtggtggaaggcggtgccgtcgtgacgctgaccctgtcctcctggatgtctcctccggacatcgacagcggaaggaacggtctgcccgacgtggtggaccagccggagatgctcgcccaccgggccgatctgatcagcgacacccgtgaggtgatgaaagccctgaaggccggctgaccggccgcccggcgcacgccgaaccggccgccccctgtctggggacggccggttcccgatggagaccgtgaccggattcgaaccggtgtaactcgagttgcagtcgagcccctgagcctctcgggcacacggtcgggtgtggtgcggtgccgctgttacgtccacgacgctacggcccgtcgtccgccgcctcaaggaatccggccgggccgcaacgcgactgccatacgccgttcacacccgggtccgggtccgggctcgggacctacgaccaagggccgagtgcggtacgcacatggacagggttcaaactgctccatgccccttacgctgggcccatgaccgccctcgaaccgcgtgacggcgccgatgccgcacacctcgcgccgcccgcgaccgacgatcactccccggacccgctgtccgacatccccctcgcagccgtcgaaggggtcctcgggcgcacctaccgggcgctcagcatcggcatcgtctccgtggtgttcctcatcgcgttcgaggccacggcggtcggcacggccatgccggtcgccgcgcgtgagctgaacgggatctctctctacgcgttcgccttctccgcgtacttcaccaccagcctgttcgccatggtcctctccgggcagtgggcagaccggcgcggtccgctccagccgctcgccaccgggatcaccgcgttcggcgtcggcctgctgctctccggtgcggccaccagcatgtgggtcttcatcgcgggccgggcggtccaggggctcggcggcgggctggtgatcgtcgccctgtacgtggtcatcgggcgcgcctacccggagcgcatcaggcc

SEQ ID NO: 3272 - DNA, 4504 bp, Unknown
  Kingdom: Bacteria, Phylum: Actinobacteria, Class: Actinobacteria, Order: Streptomycetales, Family: Streptomycetaceae, Genus: Streptomyces
gtccgcatccacgcccaccccgcccgccacgccctccagcggggagcccgaggagccggcggccggcccttccgctcccgcaaaaacgggcccgaagacgccgtccgacgcgatcaccccggccaccgggacgttcacgaagaagcagaaggagtacctgcgggaccgggtaccgaagggcatggacccggccgccgtgctccagaccggccaggagacctgcgacaagctccgctatctggtcaaggccgaccgggacaccgccgtcggcgccatcgcgacggaggagatcccggacgccgcggacgcggtcgccgggctctgcccccagcaccaggacctggtggacgaggcggcgtacgcctatcccgacggcgtccacaccgggaagaggctccggccgggcgcctaccggtccgcctcccccaccgcggcctgctcctggcagatcaccggggccggaggcagggaactgtcctcgggctcctccgacaccggcgtctcccggaagatcacgatcccgacgtccgcccgcacgttcacctccacaggctgctacgcctggctgcccgaaggagccgagggatgaccgcaggaaagccgaagctgccgatagccgtggcgatccccacgaagaacgagggcctgaacatcgcggaggcggtgaaatcggtgctcggccacttcgaggcggtcgtggtggtggactcccacagcaccgacgacaccgccaagatcgccgaggagtgcggagccgaggtggtcacgtacacctgggacgggggccacccgcgcaagaagcagtggtgcctggacaacgtccgcaccgatctggactggatcctgctcctggacggcgacgagcggctcagccccgggctgctggccgagctgcgggagatcttccgggacccggcggccccgaagccggccgcgtacgacattccgctcggctactggttctcggggaagcggctgcgccacggatacaccatccgcaagcggtcgttgaccgaccggacccgctcccactacccggaggtcggggacctcgacgctccgggcatcggtgaggtggagggccactaccagccggtcgcggcgacggtggggacgctcacccaccccatcgagcaccaggacctcgacccggtgaccgcctggttcgaacggcacaaccgctactcggactgggaggcgtggctggagcagcacccccaggtgaaggagcaggtgcgccaggtcaagtcccgccagggacagttgttccacaaggcgccgttcaagccggtggtgtcgttcgcctacatgtatctctaccggcggggtttcctggacggccgggcgggcttcgacttcgcgctggcgatgagcttctaccgctggcagatcgccctcaagtcgcgtgagaagccgttgcgtcgatgagcagcccggtcaccacccacgcctccggcggaccacgtcctcgtaggtccgccggagggtggcggtgacggcctcgatggtgaaccggtcgttcaccagctcccaggcggccttgcccgcctgctcggcggcctccggctccagcagctccaggatcgcgtcggcgaccttgcgcgcgttggccgcgtcctcgccgacccggctgtcgatcacccggcccgcccctgccccggcgacgtcgggggcctgcccacaggtgcgggtgatgacgaccggggtgccgaccgacatcgcctccagcaccgagaccgggaacggctcctcgatcgccggcagcacatacacatcggcctcgcggtcggcggcaaggacctgatcgtgctccagcggaccgacatggtcgagggagccggccacacccagcttccgggcgagtgcgagggtgccggccagcgcgccggtgtccggcccggccagcacgaagcgggcgtccgggtggcgggcgaggacgtgcggcatcgcggagacgaagtcctcgggccgcttgcgctcctggatccgggcgaggaagagcacggtgggcgggcggccggggtcgcgggcgggcttgcgctcctggggacggaccccgttgaccagccgaacggtgcgggtgagcgggacgggggccgcgacatcgttcacatcgacccgctccatctcggtgaggtgcaggacggcgtcggcctcgcggagcaccttgcggaccccgagcaggtcggtgagctgggcgaccttcttctcggtggggtcgatcatgccgtgggtctggacgaccagcggcgtccgggacgcgagggcgaggagagctgcgggcagggtcaccaggtcccgcatcagatggacgtgtacgaggtcggcgccgcgcatcatgcggcgtgcggtgcgcagcagcgtggcggaggtgatgccgctgacctcgaacatcgggagcaggtgccgtgcctggaagagatggactggaactccctccacgcggctgggaagttcaccgtcggggaagccgtcgccgagggccatgacgcgggagtcgtccccggcggcgcgctggaccctggacaggttgaacgccacccgggtcggacctccgaaggcgtggtccggagtgtggagcgtgacaacatgcaggattttcacgagagttcccctcaacctcggccgtccgttcacagcctagtcatcacatcccctcaagtacgttgattcgttagagtgttcagcggttcactgatcggggggcgcatgacgtcggtgcacacgtcggcgcgcacgccgacccgtgggaaaccctccgacccgcccgcgcggccgatcgcctgggccatgctgtcgcgggccctgtccgtgccgctcatcctgggactggtctgcttcctgcccgcggtgatcgccgcccagcccggcagcggggtccgggacacggcgtactggctccagttggtgctgacctgctatgcgggggcacggctggcgacgatgatcctctcgacccggcggcggctgctccagggcgtcttctggatgttcgtgtacatcgcgatgggtgtggcgccgttcgcccaggtggtgatcgggcagacaccgacgccgatggtggggccgcgccaggacctggtgaccgcgatcgcgatgatcctggtggggtgtgccgcctacgacctgggggcgctgctggcgtcgcgacgtccgctgcgccgccgtaccccctccgcacggggctcgggcggagggccggcccgggcgcatccggtgcggctgcgactcctcgtgctgctggccttcgcggcgagcgcgttctacgtgctgaagctgggcgggcccgcggtcttcttctccagccggcaggagatcaacgagaccgtcgcggcgagcggggtggtgacggagggatccaacgtcggctcggcgttcatcaagggcttcggccaggtcccggcactgctggcgctgctgttctacacccgtcggctggccacctcccggcgcgctcggcgcaccccgtcgacggtgctggtgtgggtggcgctggcggcgctgaacctcgtggtgaacaacccgatctccaatgcccgttactggttcctgacggtgctgatggcgttcgtgttcaccgcgttcccgagcagtgcggcgttctaccgcacggtgctgacgacgggggtggtgggggcgctggtggtgttcccgtacgcggacaggttccggtacgaggaggggggacagcggcccgtgcagtcggcctcggtcttcgatccgctggtgaccaaggactacgaccagatggtgatgttcgccaacacgatctcgtgggtggatacccgggggcacacctacggccgccaactgacgggctcggcgctgttcttcgtgccgcgcgcggtgtggagcgggaagccggaggacaccggggtccgggtcgggcagtggatggggctgcggatgaccaatctctcggccccgctgtggaccgagttctgggtcgacctcggtccggccgggatggtcggcgggatggcgctgatcggctacgcggcggcccgcaccgaccgcaggtacgccctcgcggtcacccgggcgggtccgggttcgggcagtgtgctggcgatcgcggctccgttgatcgccggatacaccttcatcctgctgcgcggtccgctgctccaggcggtgggaaagctcgccatcgcggcgctgtgcctggtgctgatcaccacgttcagggagcagcgggcagcgcgtcggcgctgacggtctcccggggcgcgggtccccggcggtggatccgggccaccctgatccaggtcgcgacggctttgcagagcgagcccgcggccagcccccaggcggcgcccgggacacccccgatggcgtaaccggccgcgaggaacgccaccgcggtgagcgagaagacgacctggacgctgagcgtggtgcgcgggtcgagcatgcgcagggccaggagcccgcaggtgccgacggccatcgccgcgtactggctgcccgtcgcggggagcagcgcggcggccgtgggccaggt

SEQ ID NO: 3273 - DNA, 1405 bp, Unknown
  Kingdom: Bacteria, Phylum: Actinobacteria, Class: Actinobacteria, Order: Streptomycetales, Family: Streptomycetaceae, Genus: Streptomyces
ccgccgaacatcagcgagaagctctccagatgctcgcgcaaccgcgccccgtgccgcgccgactcccgcgcgtcgcccgacagatgggcgtcgagcagcggatacaggtgcagcgcccagccgttgtagtggtcgaaggcgcgcccgtccccgtcggcgtaccagccgtcgccccggtaccagtgctccagcagttccagcgcccgctcccgggcccgtgccgtctccgcgtcaccccggcccaccgactccaggaatccggcgacggtgtacgggaagaggtaccagttgtttcccgccggcacgtgccgcagcgcaccccgcagccagtgctccgcccggtcccgcacgtcgggcgtcagccggtcccagagccagggccgggtgagccgcagaccgagggccaccgaggcggactccaccatgggctgtccccgcacatcgtggtccaggatcagcggccaggactccgcgtcgtcccggcccggtgtccgcgtaccggcgtcgagcccggcggcgtaccgctccagcaggccgctcgggtccttgccgcccgctcccgcgacccggaaaccggcagccaggaacgtgcgcgcgtacccctccaggccgtcggagcggacccccgagtgcgacgggggaccgggcaggtcgagccgggcgccgcccggcgtggcccacttccacgcggcggccagcatcccgtcggctgccgcctcccagtgggcacgggtgtaaccggtgtaggggctcgacatgcagtcttccggggggagtccgaagagggcaccaggggagacggtcatgcgggaatcctgagcgactgatcaaagagggtcaatagatcgatcacaagcggactgaatcgatcaaacgctcatcgagggctgggggaggggtgagggtctcgatccgtcggccggaaaaccggtgtgcttaccatctgtcccgacatggacaccatcagcctctggcaactggccgcactcgcggcggcatccaccctcgtcggcttctccaagacagctgtcagcggtgccaacacgatcagcctcgcggttttcgcggccgtcctcccggcccgcgaatcgaccggagtgctgctgccgatcctcatcgtcggcgatctcctggccgtacgcgtctaccgccgccacgcccactggcccacactgctccggctgttccccgctgtcgccgtgggcgtcgtggcgggcaccctgttcatggtgtgggccgacgacgcggcggtccgcacctccatcggcgcgatcctgctgttcatgacgggcgtcaccctgtggcgtcgccggatcgcggagaaggagaccggaaccgagaccgggaccggaaccggaacagagaccgagaccgggaccggaacagagaccgagaccgggaccgg

SEQ ID NO: 3274 - DNA, 654 bp, Unknown
  Kingdom: Bacteria, Phylum: Actinobacteria, Class: Actinobacteria, Order: Streptomycetales, Family: Streptomycetaceae, Genus: Streptomyces
tgtccgccgcaccctgctcaccgcgctggcggcgccgttggccgcgggtgcggtgcttctcgccggggtcgggatgtgggagacggtggccgcgtcccggtccgtcctcgacccgcgtgactacgcccgcctgcgggtggggcaggatcggtccgacctacggaaggtgctgccggaccggcagtcggtggagcggccggcgggtgttggaccggaggaacgaggggtgacgtgcgagttctacgcgatgacggccgaccgcttcgacgaccggtccggagacgtgtaccggctctgcttccgggacggcaggctggtctcccgcgacgcgctgacaccgtgagcgcccgatgacccggccggacacgacccgggcggcggacgagaccacggcgcatacggctccggcggacgcgaccccggcggacgcgaccccggccgggacgatccgggtcctgatcgccgacgacgagcccatgatccgcgccggcgtacgcgccgtgctcgccaccgacccgggcatcgaggtcgtcgccgaggcggccgacggccacgaggcggtggagctggtccgggcgcaccgcccgcacgtggccgtcctcgacgtgcggatgccgcggaccaacggcatcgaggccgcggccgagatccgtc

SEQ ID NO: 3275 - DNA, 894 bp, Unknown
  Kingdom: Bacteria, Phylum: Actinobacteria, Class: Actinobacteria, Order: Streptomycetales, Family: Streptomycetaceae, Genus: Streptomyces
tgggggacggccgtggacacgatggtgccgtcgatggccgccagcgccatgccgagcatgagcgccgccacgacggggcgccggccccggggggtggtgagggcgggcggcgcgtccgtgccgttcccgcccgcgccgggggtggatcccgcgccgggaccggcgccgacgtcggtgcccgtacccgtgtcgcccgcccgtgtgccgtccgcgcccacgtcgctcttgtcgtccgtgccgctcaccgaggttccttccctatgcacgtatcttccggggcactgtctcatccgggagcgtcgaacggggtgggtccggaggaacggtgcggggatcggccggggaaacggccgggtgggggagaggcccccggcggacccctccgctccggttgggcggccgcgccgatcgccttcccggcgggccgaacggtgcccctgacctcgcctccccctgggggacgagtcccctagggggtgccccctcatagtggccagggcccgttcctcccggcggaggacgtggcgacagggggcgtttccttaacctgttcttacgtcgccgctacggcccgccgcaggggggcaggtagggaaaaccccacctgaagactgcgctgggcaccatcgcgccggacaccgtcccgaacccagactcggaccgtacccaatgacgtccagtcatcgaccgacataggagaaataccgtgacaacggctgtgaccattcccaggcacgggggcactggagggcgtacggccgtcgcggcgcgagcgcgtcaggtcctgaaggcgtacggcaccggggagacccgggtcgtcgcgctcgaccatgtcgacgtggacatcgcccgcgggcagttcacggcgatcatgggcccgtccggctccggcaa

SEQ ID NO: 3276 - DNA, 689 bp, Unknown
  Kingdom: Bacteria, Phylum: Actinobacteria, Class: Actinobacteria, Order: Streptomycetales, Family: Streptomycetaceae, Genus: Streptomyces
  misc_feature (455)..(519): n is a, c, g, or t
gcgttcaccctgccccggacgggtggcgacgaggacccggcccacacctcggtggcgtcggccgggccgtccgcctccccgacgacatcggcctcggctcccgcgtcggccaaggccgaacggctggccgcgctgctgccggcggacgtcggggagatcgaggaggtctcgctcctcgcgctcatcaagaacgcgactcccgatcaggcgcggaccatttacctcggtccgctggacgggcagtacgcgttccgcaaggacggcggtgtgggctatctgctgctcactctgatggaccgggaggggttggagaggaagacgggccgcccggccgatccggccgaggacctctgcgctcgcaacggccaggaaccgacccgtgacgactgcgtgcgtgaggtgctgcccgacggccggacgctgacgacatggcacgactcgatggactacgcggnnnnnnnnnnnnnnnnnnnnnnnnnnnnnnnnnnnnnnnnnnnnnnnnnnnnnnnnnnnnnnnnnccggcagcaggtgaagaagctgctgaccggcccggaagtgctgccgaagggctgagcggcggacgccgacccgggggagtgcgccggacgcgcgggagggcggtgcggaccatggtccgtaccgccctcccgtatgcgcgccttacagcaccttggacaggaacgacttc

SEQ ID NO: 3277 - DNA, 3973 bp, Unknown
  Kingdom: Bacteria, Phylum: Actinobacteria, Class: Actinobacteria, Order: Streptomycetales, Family: Streptomycetaceae, Genus: Streptomyces
cgagccactcctcgccgagccgcccgtcgtagctgaccttctcctcgtgctcggcgaggagtggctcgccgcgctgctcccgctgggcaccgacgcggtgaaggcccacatgacggacgcgcccgccctgatcgtggtgttccagcagcgctactggctcggcgaggacggcacgaagcgcaagcactactacgtggacgagtcggtcgggatcgcggtgggcatgctgctcaccgccctgcacctgtccggtctcgccgcgctgatccacaccccgagcccgatgcgcttcctcggcgaggtcctggaccggcccgagaacgagaaggccttcgccgtgatccccgtcgggtatcccgccgacgactgcgaggtccccgacctggtgcgcaagtcgctggaccaggtgctggtggaggtctgagaggccgcctcgcagaaggaccgccccgggccaggccccgtacacagaaagaccgccccccggccggcaggggggccggtcggggggcggtgctcagggggactccgccatggaggcccgggtccggggcgtcgtgctgcggcgccccgggaggacgtcagccctggtgggggtaggtgtactcggtcggcgggaccagcgtctccttgatggcccgggtcagggtccagcgctggaggttctgcggggcaccggccttgtcacaggtgccggaggcacggccgccgccgaagggctgctggccgacgacggcgccggtcgacttgtcgttgatgtagaagttgcccgcggcgtagcggagcttgtccatcgtgtacgccgcggccgcacggtcgcccgcgatgaccgagccggtcagcgcgtagtcggagaccgactccatctgctccagcatggcgtcgtacttgtcgtcctcatacacgtggatcgcgaggatcgggccgaagtactcggtcgtgaagacctcgctctcggcgtcggagcactcgatgacggtcgggcggacgaagtagcccaccgagtcgtcgtaggtgccgcccgcgacgatggtgcaggccgggtcggacttcgcgcggtcgatcgcggccttgttcttggcgaacgagcgctcgtcgatgacggcaccgatgaagttcgtcaggtcggtgacgtcgcccatcgtgatcgagtcgacctcagccgcgaactcctccttgaaaccggagttccagatggaggccgggatgtacgcccgcgaggacgccgagcacttctggccctggaactcgaaggagccgcgggtgagcgcggtcttcaggacggcgcggtcggcgctggggtgcgcgacgacgaagtccttgccaccggtctcgccgacgaggcgcgggtaggtgcggtagttggcgatgttgttgccgaccgtcttccacaggtgctggaaggtgggggtcgagccggtgaagtggatgccggccagatcgcggtggttcagcgccacctcggagacggcgatgccgtcgccggtgaccaggttgatgacgcccttgggcagaccggcctcctccaggagctgcatcagcagcacggcggcgtgggtctgggtcggggacggcttccacaccacgacgttgcccatgagggcgggggcggtggggaggttgcccgcgatggccgtgaagttgaacggcgtgatcgcgtagacgaagccctccagcgggcggtggtccatgcggttccacacgcccggggagttcgccgggggctgctcggcgaggatctggcgcgcgtagtgcacgttgaagcgccagaagtcgatcagctcgcagggggtgtcgatctcggcctgctgggcggtcttggactggccgagcatggtggaggcggccagcgtctcgcgccaggggccggccagcagctcggcggcgcgcaggatgatcgccgcgcggtcgtcgaaggccatcgcgcgccaggccggagcggcggccagggccgcgtcgatggcgtcctgggcgtcctgctcggtggcgccggcgaaggtgccgatgacggcctggtggttgtgcggctgcacgacgttcacacgctcgccgccgcccatccgcttctcgccgccgatggtcatcggcaggtcgatcgggttgtcggcgagctccttgagcttcacctccaggcgggcgcgctccggggagcccggggcgtaggagtgaaccggctcgttgaccggcgcggggacctgggtgacggcgtccatgagtgccttgtctccttggtgtcggcggggtgtgggtcagcccgggggctgctcagcccttggtgaggatcgagcggccgaagaacagcaggttggccggcttctccgcgaggcggcgcatgaagtatccgtaccagtcggtgccgtacgccgtgtagacgcgcatccggtggccctcggccgcgagccggatgtgctcgtcgctgcggatgccgtacagcatctggaactcgtactcatccagtttgcgcccggcctggcggcccagctcctgggcgatggcgatgagacggggatcgtgggacccgatcatcgggtagccctcgccctccatgaggatccgggtgatgcggacgtacgccttgtcgatctcggccttgtcctggtacgcgacggaggcgggctccttgtaggcgcccttcacgatgcgtacgcggctgcccgcggcggcgagcctgcgggcgtcgtcctccgtgcggaacagataggactggatgacgcagccggtctccgggaagtccttccgcagctcctcgtggatggcgaacatcgagtcgagggtggtgtggtcctcggcgtccagggtgacggtggtgccgatggcggcagcggcctcgacgaccgggcgcacgttggcgagggccagctcgtggccgttctccagcgactggccgaacatggacagcttcacggacatctcggcgcgggtgcccaggccgaggtccttcaggcgctccacgagctccaggtacgcgtcgcgggcggcctcggcctgcgcgggggtggtgatgtcctcgccgacgacgtcgagcgtgacctccagacccttgtccgcggcgtcctcgacgatcggcacgacctggtcgacggtctccccggcgatgaagcggtcgacgacctgcttggtgccgggcgcggccgagacgaaccggcgcatcttgtcgctgcgcgatgcggcgagaatcacgggacccagcacggggcacctccacgaatgtacggacgaggggccgtaacggtacgaacgtgaacggaccggtacggcacggataaccaccgtgaaatctagggaccgctccgatcctgtgccatcgacacctgtcacgcatccgtggccgccatctcagacatatgtctgaaggggtgcgagaatggcggagtgacaggcgattaccaggaactggtcgacgagatctcggccctcctcgacgccccggccaccctggagaaccgggacttcggcctggtcgccttcggagcccacgacagcgacgacgactccgcgatggacccggtccgcacccgctcgatcctgacgcggcgctccacgcccgccgtgcgcgcctggttcgaggggttcggcatcacccgggcgaccggtcccgtccggatccccgccgcccccgaggccggggtgttccgggaccgcatctgccttcccgtacgccatcggggtgtcgtcctcggatacgtctggctcctcgacgccgatcccggcccgaccgacgagcggctgaccgccgcgatggaggtcgccgcccgaatcggggcgctgctctccgacgaggcgcgggcaggcgccgacctgtcgcgggagttcggcgcggcgctgacggcgggccccggccggcagcgcgacaccgccgtcgccgcgctgggagaggctctggggcaggacgcggacggtctgcacacggtggtgtgcgtgaccccgtgggtggacgacacgccctcggtacggggggtggcctcggcggccg

SEQ ID NO: 3278 - DNA, 1739 bp, Unknown
  Kingdom: Bacteria, Phylum: Actinobacteria, Class: Actinobacteria, Order: Streptomycetales, Family: Streptomycetaceae, Genus: Streptomyces
  misc_feature (1321)..(1322): n is a, c, g, or t
gtgatgccgaactcctcgtacagccgctcataggcggcggacgcgccgaagtgctccaggctcaccgtgcggcccgcgtcccccacgatgtcccgccagccctgggcgacggccgcctcgacgctgacgcgggcccgtacgtcgggcggcagcaccgcgtcctggtaggagtacggctgctcggcgaaccactcgcggcacggcagcgagaccacgcgcgcgtcgtgcccgtcggcggccagcagctcgcgggcctccagggcgatgtggacctccgacccggtggcgacgaggatcacgtccggcgtcccctcccggcagtcggcgagtacgtacccgccccgggcggccccctcggcggaggcgtacgcgccgtccccccgctccaggacgggcagcggctgccgggtcagagcgaggccggcgggccggtcgtggtgctccaggacggtgcgccagcacacggccgtctcgttcgcgtcggcgggccgtacgacgtcgaggccggggatcgcgcggagggcggcgagttgctcgacgggctggtgggtggggccgtcctcgcccagcccgatggagtcatgggtccagacgtaggtgaccgggagcttcatcagggccgcgagccggacggccgggcgcatgtagtcgctgaagatcaggaacgtaccgccgtaggggcgggtgaggctctgcagggcgacgccgttgaggatcgcgcccatggcgtgctcacggatgccgaagtggagcgtgcggccgtaggggttgccggggaactcgccggtctgcttgctctccggcacgaaggacggctcgccctccatggtggtgttgttgctccccgcgaggtcggccgagccaccccacagctcgggcagcacgggggccagcgcggtgagcacatcgccggacgccttgcgggtggcgatgcccttggggtccgggtcgaagacgggcaggctgtcggtccagccctccggaaaccgccgttcccgcagccggtcgaggagtgcggcacgctcggggtgggcggagcgccactcctggtagccgggctcccaggcgcgatgggcctccgcacctcgctcgacgaccgcgcgggcgtggtgcagcacgtcgtcctcgacggcgaagtcggcgtccgggtcgaagccgagcagtttcttggtggcggcgacctcgtcgtcgccgagcgcggagccatgggccttgccggtgttctgcttggtgggcgcgggccagccgatgatcgtgcgcagcaggatcagggagggccgaccgcgctcgctcttcgcggcctcgacggcggcgagcaggnncctcgatggagatgtggttggagtcgtagaagacgatcagattcccgagctcctggtgtcccgccagtgaactggcctcggacgtcacgccctccatcaggtcgccgtcggaggcgacgacgtacacgtggtggtcgaagggactcgcgccggccggcgcgtcggggtcgaggaggccacgctcgcgccgggccgccatggccatgccgacggcggaggccagcccctgccccagcggcccggtggtgatctcgacgcccctggtgtggcggtactccgggtggccgggggtgatggacccccaggtgcgcagcgcctccagatccgtcagctccatgccgtagccgctcagatacagctggatgtagagggtgaggctggagtggccgcaggacagcacgaagcggtcccggccga

SEQ ID NO: 3279 - DNA, 6741 bp, Unknown
  Kingdom: Bacteria, Phylum: Actinobacteria, Class: Actinobacteria, Order: Streptomycetales, Family: Streptomycetaceae, Genus: Streptomyces
cgccgccaaggcgaaggccgccgccgagaccaaggccgccgccgccaaggcgaaggccgcgtccgaggcgaaggccaaggccgccgcggacgcccaggcgaaggcgaaggccgccgccgacgcgaaggacaaggccgccaaggccaaggcggacgcgaagaagcgcggcaccgaggccgcgaaccgctccaccgcgcgcaagcccgtctacgcgaacaacctggacggctggatccgcgaggccatggcgatcatgaagaaggaaggcatccccggctcctacgaggggatccaccgcaacatcatccgggagtccagcggtaaccgctgggccatcaacaactgggacatcaacgcccggaacggcatcccgtccaagggcctgctccaggtgatccagccgaccttcgaccgctaccacgtggcgggtaccaagaaggacctgtacgacccggtcgccaacatcgtcgccgcctgcaactacgcggccgaccgctacggcaccatggacaacgtcgacagcgcgtactgagcctgagcccagccgtacacacgccggaggccggcaccccgaggggtgccggcctccggcgtcgttccgtcccggcggtccctacttgcgcatgacctcgggctcgtggcgccgcagcaggcgcgcgaccgcgacgccgcagatcacgccgagcgcgagcagcacggcgatgttgatgccccactggctcgcggtgtgctcccacagcgggtcgaggtcggtggggttcttcgggtcccacggcggcatcagatgcgccaggtccagcgtggtgccggccgcggccatcgcccagcgggagggcatcagccaggcgaactgctccaggccgggcgacccgtacacctggaagagcacgccggtgaagacgacctggatgatcgcgaacatgaccagcagcggcatggtcttctcggaggtcttcaccagcgaggagatgaccaggccgaacatcatcgaggtgaagcccagcgcgatgatcgagaggcagatctcgacggccggcggcatgatcaggccctcggcgggcagatcgcgggtggcgaagccgatgccgcagatgatcacgccctggaaggcggtgatcacgccgagaacgatcaccttggacatcaggtacgcggagcgggacaggccggtggcccgctcccgttcgtagatgacccgttccttgatcagctctcgtacggagttggcggcgccggagaagcacatgccgaccgcgaggatcagcatgatcgttccggccttgccgttgaaccgggacggcgggtcgggctcggcgagaccgaactccgccgggatgaccacgctgaccacgcccagcacggcgggcaggatcagcatcagccccatgaagcccttgtcggacgcgatgacggaggagtatctccggatcagcgtccacagctgcgccatccagccctgcggcttcggcgggcgcatctgctgcgggggcggcatgttgaccggctgggccgcgaccgcgtcgatgtcggcggcgtacatctggtagtgctgcgaaccgcgccagcggcccgcccagtcgtagtcgcggtagttctcgaaggcggagaagacgtcggcccagctggtgtagccgaagaagttcagcgcttcctccggcggaccgaagtaggcgacggagccaccgggggccatgacgaggagcttgtcgcagatcgccagctcggcgaccgagtgggtgaccacgagcaccgtgcggccgtcgtcggcgaggccgcgcagcagctgcatgacgtcgcggtccatgcccgggtcgaggccggaggtcggctcgtccaggaagatcagcgagggcttggtgagcagctccagggcgaccgagacgcgcttgcgctggccgccggagagcgaggtgatcttcttgtccttgtggatgtcgagcttgagctcggcgaggacctcggtgatccgggactggcgctcggcctcggtggtgtccgcggggaagcggagcttggccgcgtacttgagggccttggtgacggtcagttccttgtggaggatgtcgtcctgcgggaccagaccgatgcgctggcgcagctcggcgaactgcttgtacaggtttcggttgtcgtagaggacgtcaccctggttggcgggccggtagccggtgagcgccttgagcagggtggactttccggaaccggacgggccgatgaccgcgatcagcgacttctcggggacgccgaaggagacgtccttgaggatctgcttcccgccgtccaccgtcaccgtgaggtggcgggcggagaaggagacctcaccggtgtcgacgaactcttccagccggtccccgaccagccggaacgtcgagtggccgacgccgacgatgtcgttcgcaccgatgagcgcggagccggacttgtggagcggcagaccgttgacgtacgtgccgttgtgcgagccgaggtcgcggatctcgaagcggccgtcgggcgtcgcgtggaactcggcgtggtggcgggagacctggaggtcggagacgaccagctcgttctccagcgcacgaccgatgcgcatgacccggccgagggccagctggtggaacgtggtcgggctgcggtcgccgtagaccggcggcgcccccgcggcaccgccctgtcccggtccggccggatgcccggggctctgctggtgcggcaccttctggtgcgcaggctgctgatgcgggacctgctgctgcggcgcctgcggctgctgccaggcctgctgctgaacgggagcctggtgctgagcaggggcctggtgtgcgggtgcctgctgtccgtgccagcccgcgccacccccctggggctgctggtggggttgcacgggcgcctgctgagcgcccgccgcctgaccgccggcgacaccggcgcccgcggcggggctgaggctcacccggggtccgtcggtggcgttgcccaggtgaagcaccgagccggggccgatttccacctgttggatccgctggccctgcacataggtgccgttggtgctgccgtggtcctcgatgaaccaactacggccgctccagctgatcgtggcatgccgccacgacaccctggcgtcgtcgatcgtcaggtcgccctgcggatcacgcccaagggtgtacgacctggacggatcgagcgtccaggtgttgccattcaattccagtacgagttccggcactccgcgccccactagttgtcccccgtgttacccccgtcgcagggagtctagggatgctgaacatcgtggggaactattccaggaccagtcccctatccgaaagtcgggcgggtgaagagcgcgcggagacctgcgcgaacgcgccgataccggggggcgaaacagtcgcggaacggacgaagtccggatgaacctctggttaccgcccagggaaggttcatcgactgcataacgacagatacgagacagctgacgcggccggacgcaagacccctaccggccagatccacgcgacgtcccgcgctcccgtgccgagaccgcttcccggcacggcggacggtgccgggcgattccgtccggcactcgggacgggcggccggaggagacggcgggaccgatacggtgggagcaccatgagcgcatctcagccacctcagcccctctcgtcttctgagccccctgagcgccgtcgggtcgacggcaccggcggcggaccccctccgggcggcgacgcacccacgcttctcgtcaagatcttcggcaaggaccgtcccggcatcacggccgggctcttcgacaccctcgccgcgtacgcggtcgatgtcgtggacatcgagcaggtcgtcacccggggccgcatcgtgctgtgcgctctggtcacctcgcccaccgcgggcgggaccaccgagggcgatctgcgggcgaccgtgcacagctgggccgactccctgacgctgcaggccgagatcatctccggcatcggtgacaaccgcccccgcggtgacggccgttcccatgtgacggtgctgggacaccccctgaccgcggagtcgaccgccgccatagcggccaccatcacctcgaccggcgggaacatcgaccgtatcttccggctggcgaagtatccggtcaccgccgtcgagttcgcggtgtcggggacagggaccgcggagctgcggacggcgctggcgaccgaggccgcggagatcggcgtggacatcgcggtggtctcggccgggctgagccgccgggcccagcggctggtggtcatggacgtcgactccacgctgatccaggacgaggtgatcgagctcttcgcggcgcacgcgggctgcgaggaacaggtcgcccgggtgaccgagcaggcgatgcgcggcgagctggacttcgagcagtcgctgcacgcccgggtcgcgctgctggccggtctggacgcctcggtggtggacaaggtccgcaccgaggtacggctcacccccggcgcccgcaccctgatccgtacgctgaagcggctcggctaccaggtcggcgtcgtctccggcggattcacccaggtcacggacgacctgaaggaacggctcggcctcgacttcgcgtcggccaacaccctggaggtggtggacggcaagttcaccggccgggtcgtcggcgaggtggtggaccgggcgggcaaggcccggctgctgcggagcttcgccgagcaggcgggggtgccgctggcccagacggtggcgatcggggacggggcgaacgatctcgacatgctgaacaccgccgggctcggcgtcgcgttcaacgcgaagccgatggtgcgcgaggcggcgcacaccgcggtgaacgtgccgttcctggacaccgtgctctatctgctcggcatcacccgtgaagaggtcgaggcggcggacggtctcgtcgactgacggtccggggccgggccgccggtccgggagtcgtacacggtcgcacgcggtcgcacgcagaagggccccggcacaggatctgtgccggggcctgcgcgttcacgtgttcacgtgctccgtggtaccggacgctcagtcgttcggtgtccagtactcggtgagcttgccggccccgtgctccacgctcttccaggagccggggaactccaccacggcgtaggcggccgtggggaagccgtcccgggtcatccgggccagggtgtcgccctcggccgatcccgagagggcgtcggcggccccgtgcatcccggggttgtggccgatgaccagaaggttgcgcacctcgtccggggtctcgttgaacagggcgatcagttcgccgagggaggcctcgtacagcctctcctcgtagacggtccgtgggcgctgggagaattcatggaccgccagcttccaggtctcccgcgtcctgacggcactggagcagagggccagatcgaaatcgatgccggaatcggcgagcctgcggccggccacgggcgcgtccttgcggccgcgctcggccagcgggcgctcatgatcggaagcctgtgaccattccgccttggcatgccggagaaggacgatcctgcgaggtgtctcgacgctcatacacctcagcttcgcatgaaacgcggcctctggcgcagggtgttgacgtgctcgtccggggagttggtgcgctggtccggggctgcttcgcctcagcgggacagcagctcgagggtccgctcgatcagctgtccgagcgcggggtcgccggtcgtggcggcctgggcctgtccggggctgaggatcatcagcagcagcgcggcgaacgccacggcgggcagcgcgatggcccaccagggcagccggatctcgacaccgtccgcggccggtcgatgggacctggtgtgcgtcggtgtcggcatgtccgcctccgtcaagtcatcgggtcgtcaccgaaaaacctacggaccggaggcggcctgccccatccggtgacccacccacttcaccctgaccctgaccccctaggggaaggtggtgctagccccacccctcggggcctcgggcgtcagggcgaggcgatcgtggcgatcacaccgatgaccacggtgatgaggagcatcgccccgagcacgaggagaagcttcttctggccgttctggggattcggatcgagcactggcatgaggtcagtctcgcatctcagcattcgtcctcgatcgtccggtcccggcccgcgaggatcccggccaccatctggggaatcatgaggcccgccatcagggcgatcggcagcccccagcctccgctgtgctggtagagcacgccgacgagcagcggaccggggatcgagagcaggtagccggtggactgggcgaaggcggagagcctgaccacgcccgcgccggaccgggcccgcatgccgatcatggtgagggcgagggggaaggcgcagttggccaccccgaggagcagggcccaggcccaggctccggcggcgggggcgaggtagagcccgccgtagccgatcaggccgcacagtccgaggacgacgacgatggggccctgctgcttgagccgggaggcgacccgggggatgacgaaggcgagcgggacgcccatcgccatggtgaccgcgagcaggagtccggccgtgccggcggagaccccggcgtcgcggaagatctgcggcatccagcccatggtgatgtacgcggcggtggcctggagcccgaagaagcaggcgaggccccacgcggtgcggctgcgggtgatccggagggccggcgcttccggggc

SEQ ID NO: 3280 - DNA, 3325 bp, Unknown
  Kingdom: Bacteria, Phylum: Actinobacteria, Class: Actinobacteria, Order: Streptomycetales, Family: Streptomycetaceae, Genus: Streptomyces
  misc_feature (2645)..(2646): n is a, c, g, or t
gcggctgcgggtgggcgactcgctggacttctggcgggtggaggagatcctgccgggagaactgctgcggctgcgggccgagatgctgctgccgggcctggcctggctggagctgtcggtgcgccgagacgaccggggccggacggtgtacgggcagcgcgccctgttccatccgcgcgggttgcccggtcacgcgtactggtggagcgtgtggcccttccactcggtggtgttcggcgggatggcgcgcaacatcgccgaggcggcctcggccgaggagaagcgccgtgcgccgatggccgacagtggtacagacaactgacgggtctgccgttagggtatgcccggcccagcacaccgcagaccgccgggaggtgcacgcgatggcacgccgactccgtaccgtgggacgggagttcgccgattccgcgccgattcgtctggtgttcgccgccgaggtgtccgcgccggtggacgtggtgtaccgcgcgctcgccgaggatgtcccgtcctggccgtcctggttcaccgccgtcacccgggccacgcccaccgacgggggcgcgggccgcgaggtgcggctgcgtggcggggtgcggttccgcgagacgatcgtggccgccgaaccggacacgtgctacgcctaccgggccgatgagtccaacgttccgggtctccgagccctgctggaggagtggcggctcactcccgaggggtccggcacccgggtgcagtggaccttcgccgccgacgggacgggactgttccgcctggtgctgagcctcgcgcgagcgggggtgggccggtccttccgggacgccgtgcgccgcctggacgcgcggctgacgacgacgccctgagcgacgcgccggagcccggcctcagcagggccaggttccggtggtgaggaagtcgtcgatggcggcggtgtacggggcgatgtccaggccctgttcctccagccacgagtcggagtagtacttgtccaggtagcggtcgcccgggtcgcacagcagcgtgacgacgctgccctgttcaccccgctcgaccatctcggcgatcagcttgaacgcgctccacagtccggtgccggtggacccgcccgccttgcggccgatggcgcgctccagcgcgcggacggcggcgacgctggcggcgtccggcaccttcatcatgcggtcgatggcgccgggcacgaagctgggctccatgcgcgggcggccgatgccctcgatgcgcgagccgcggtcgctggtggcgtgcgggtcgttgtgggtccagccgtcgaagaaacaggagttctccgggtcgggcacgcagatacgggtgtcgtgctgaaggtagtggacgtagcgggcgatggtcgccgaggtgccgccggtcccggcggtggcgacgatccaggcgggctccgggtagcgctccaggctcagctgctggtagatcgactccgcgatgttgttgttgccgcgccagtcggtggcgcgctccgcgtaggtgaactggtccatgtagtgcccgccggtctcggcggcgagggcggcggactgttcgtacatggtgcgcgagtcgtccacgaagtggcactgcccgccgtggaactcgatgaggcggcccttctccggactggtggtgcgcggcatcacggcgatgaacgggacgccgatcagtttggcgaagtacgcctccgacacggcggtcgagccgctggacgcctcgatgaccggcttgccgggccggatccagccgttgcagagcccgtacaggaagagcgagcgggcgaggcggtgcttgaggctgccggtggggtgcgtcgactcgtccttgaggtagaggtcgataccccacgcctcgggcagcgggaagcgcagcaggtgggtgtcggcggaacggttcgcgtcggcctggaccttgcggacggcctccttcagccaggcccggtactcggggtcgctgcggtcgacgtccacggtcgccctggccccgtgcccggccgcgtgctcactggtgtccatgggcctgctcctgttggtcgtcggtccgatgcgcgcgcctccacgatatgcaccccacctgcgcaaacggtcactttgatggtccatagcactgcctttgaccgccgcccgcggggtcggccgcgacgggcggtgcggataagcacccgccgtgcttccgggccctctggcgatccggcccgcggccgggcacactgcacagcaggagtggtgtcgaaggggggcgaatccgctgtggcggacgtcgagttcagtgcgtcgggggtcaggatcgagcggttcaccaggtcgctgaccagggctggtcaggtggtggtgaaggacggccggctgtccctgctcacgagcaacgggcgggagatcgacagcgccccggtgggctcggtcagtgcacgcaagtggtggttcatcgcggcggattccgtcatcgcccgggtgaacggggtgcgctaccggttgacgatggggcagcgcagccgcagacgcgacggtgcggctccgttgcggcgtttcctggagacgctgcgcagtgcgcgcggtcgccgggactgaccggccggtacggaccgggcgggccggttcccgggccgcccggctccgccgcgagttgcggagccgtatcccctgggnncggatcgcgcgacacgagcagacacgacaagagcagagcggattcggcagtcagtcgtccgccgggctccgttcgtttctcttctcttcttccggacctatttcggggagtcgcagccgtgatcagcgagccaagcaggcactgcacggtggagctccaggccctgccgtcgcggatcggtcaggtccgcagaatcatttcggcgcaactgcgctactggcatctcgatcctctgatcgaccaggcggccctgggcgtcaccgagcttctcaccaacgttcaccggcacgcgcagccggacaagtcatgcaccgtcgacatcgagctgctgctcgaccgcctgacggtctcggtccacgaccacgacccgcgcctgcccacggtgaacgaggcggactcgttcgccacgtcgggccggggcctggccctgatcgcggccgtcagcgagagctggggcgtgcggccgatcggcacggccgggaaggccgtctggttcaccctgccggcggccaccggcgcctcgaccctgccaccgctcgcggtctacgggtcgatgaccgacgggccgttcggggccgtgaccatcacccccgacgacatcgtggccgtgcccgccaggtcggccgtcgtcggctgacggaccgggccggagcgcagtggcggcggagcggcttcgcac

SEQ ID NO: 3281 - DNA, 6017 bp, Unknown
  Kingdom: Bacteria, Phylum: Actinobacteria, Class: Actinobacteria, Order: Streptomycetales, Family: Streptomycetaceae, Genus: Streptomyces
cgccgaccacatccgggccaagctgaagacactgctccagatgagcgccgtcctgacctacgcggcctccgtgcccgtggtgaaggtcggccggatcgcgggccagtactccaagccgcgctccaagtcgaccgagacccgcgacggcgtgaccctgccgacctaccgcggcgactcggtgaacggcttcgccttcaccgaggaggcccggatcccggaccccgcccggctgaagcagatgtaccacgcgtcctcctccacgctgaacctggtgcgcgccttcaccaccggcggttacgccgacctgcgccaggtccacgcctggaaccaggacttcgtgaagtcgtccccctccgggcagcgctacgaggcactggcccgcgagatcgacaacgcgctgaacttcatgaaggcgtgcggcaccgacccggccgagttcaaggcggtcgagttctacgcctcgcacgaggccctgctgctggactacgagtcggcgctgacccgtacggactcgcgcaccggcgagctgtacgacacctccgcccacatggtctggatcggtgagcgcacccgccagatggacggcgcgcacatcgagttcgccgcaaggatccgcaacccgatcggcatcaagctcggcccgacgaccaccgtcgacgaggcgctcggctacatcgaccgcctcgaccccgagcgcgagccgggccggctgaccttcgtcgtccggatgggagccgacaaggtccgcgacaagctccccgagctggtcgagaaggtcaccgcgtcgggtgcgaccgtcgcctgggtgaccgacccgatgcacggcaacaccttcgaggccgcctccggccacaagacgcgccgcttcgacgacgtcctggacgaggtcaagggcttcttcgaggtccacaagggcctcggcacccacccgggcggcatccacgtggagctgaccggcgacgacgtcaccgagtgcgtgggcggcggccacgagatcttcgtggacgacctgcaccagcgctacgagacggcctgcgacccccggctcaaccgcagccagtcgctcgacctggccttcctcgtcgccgagatgtaccgcgaccagtagtccggcaggcgggagaattcccggcagtcgcacctgtggggcacggatccatgtgatccgtgccccacagtcgtatccgggcttttgcgccgactgagcgacgggtaaggttaggttagcctcaccgtggaaatcggagcggcgcccgtgaccgacccgcagggaggtgaaccgcatgtacgtctgttcctgcttcggcatcacggaagcgcaggtcaagaagcatgcggacgccggagcctgcacaccccggcagatcgcgtcggcctgcaaggccgggacggactgcggtggatgtgtgcgccgcatccaggccctgctgggccggggcgactgcccccgccgcgagctgctcgaccagcgacaggaacccgtgaccgcctccgcggcgcacccggtcgccgcgaccgtcgcggcatcggccgcggcggctgccgccatcggcgcgatccgggacgtgacgctctccgacgccgcctgaccggcccgcgatccccgggaacagtccccggccccaggggacaaccccggtcagctctccggctgctcgatcagctgggcgatgtagagcggctcaccgagcttctcgaccagctccagctgggtgtcgagatagtcgatgtggtgctcctcgtcctccaggatcgactcgaagatgttcgcggacgtgatgtcgcccttgccgcgcatcacctcgataccccgcttgaggcggtcgatcgcctccacctcgacctggcggtccgcctggaacatctcggtgaccgtctggcccacccgcacatggaagagccgctggtagttcggcagcccgtcgaggaacaggatccggtcggtgaggatctcggcgtgcttcatctcgtcgaaggactcggcccgggtgtacttggcgagcttcgtccacccgaagttgtcctgcatcttggcgtgcaggaagtactgattgatggcagtcagttcggcggtcagctgctcattgagaaactcaaggacctcggggtcgccctgcatggcaaaggctccttccaaccggtgatcgatctggcgagttggccagatcctcgcaccgcacccagcggccgtccagtaagtgcacgcttagtacgagttgcccggatggggtgctcccctggtcatgaccacccctgcctgtctgtcaccatggaggcatgggtcagccggaaagccgggaaaaccgcgagacagagcagtccgagcttccgccgggacagcgactgcagcgcggatggccggtcacccactacgggcccgttcccaagttcaagcccgaccgctgggagttccgggtcttcggggccaccgccgacggcgacaagcactgctggaaccaccaggacttctcggcgcttccgttctcctcggtcgtcgccgatctgcactgcgtgacgaagttcagcatgatcggcgccgaatggggtggggtccccgcccgtacggtcctcgaactggcgccgcccgcccccgacgccacccatgtgatggtctgggccgaatacggcttctcgtcgaacctgcgcctcgacgacttcgcctccgagcgcaccctcttcgccacccacaaggacggcgaactgctcaccgccgagcacggcttcccgctccgcctcgtcgtcccgcacctgtacgcctggaagggcccgaaatgggtccggggtatcgagtacatgacggcggaccggcgcggattctgggaggagcggggctaccacaacatcggcgacccctgggacgagcagcgctactcctatcaggaggagcccggggacggccccgaactctagctccgacgggtgtcccgcagctccttcagccgggccacgtccgccgtgtgcccctccttgccgccgggcgtctcgatgatcagcggcacgccctcggtcgccggatgcgcgaacagctcccggaagggctccgccccgatgtgaccggcgccgatgttctcgtgccggtccttgtgggcgcccacgacgtccttggagtcgttggcgtggatcagcttcagccgaccctcgccgaccgtgtccaccagcaggtcgagcgtctgccgcatccccgaggggccggccagatcgtgcccggcggcgtagatgtggcacgtgtccaggcagatgcccagcttcgggtgggagtccagcgcctcgaagtacggaccgaagtcccaggtccgcgagcagagcgaggagccctggccggccgtcgactccagcagcagatccggggagtcgtcgtgggtcagctcgtccagcagcgggcgcatgtgctcgcgcacctgggacagcgcctcggcgcgcggccgtccgccggtcgcggagccggtgtgcaccaccacgcccagcgcgccgatctcgcgggcccgccgcagtgagtggcgcagggactccacggacttctcgaccgtcgccccggtgtgcgagccgaagttgatcaggtacggggcgtggacgtacgccgggatcgaggaggcctcgcacgcggcgcggaacagctcgtcctggaccggattcccggtcggcgtcgcccagccgcgcgggttggccacgaagacctgcacggtctccgccgccagctcacgggcgtactccaggccgaccttggcgagaccgccggccacggggacgtgtccgcccacggggttgcgcagggagtgcatccggtctagagcccctttgtcctgatagtgatcgtggacccctccggggcccgttcggcgccgtccaccgactggctcgcgatcgtgtcgctgaaggagaggaacggccggtcgaccttcacggtgaaccccgcctcctccagggtgctccgggcctcgtccacgtcccggccggtgacgtccgggacgaccagcatccggggtcccttggagacggtcagctggaccgtgtcgccctcggcggcctcggcgccctcgccgggcgactgctcggcgatgtcgccctgggcctcgggggagttgacccgtgcgggcagcacgtcggccttcagtccctgggcctccagctcggcggtggcggcttcgatcgagagcccggtgacgtccgggacgtcgacgggagcgcccttgctgacgacgagcgccacggccgtgtccggggtgcggtcggtgccggcgcggggatccgtgcggatcaccgcgccgcgggcgacgtcctcgctgaactccctggtcaccatcccggggaccagacccaccttcttcagggcccgccgggcgtccgcgagggagccctccgcgacatcgggcacccgcacgatctccggaccccgcgagacgacgagcttcaccgagccgttgccccggatccggtcacccgaggcggggtcgctgctcacaaccgagccccgctcgacggtgtcgctgaagacccgctccacgcccttcagcccgagcccctcgtccgagagccgcttctcggcggtccgctgggtctggcccagcagggaggggacctgggtgaactgcccggagttgatgtaccagacgcccgtcccgatgccgagcgtcagcagtacggcggtgagcgccatgatcagcttgcggtgcggcccgccgaacggaccgcgacggccggtcccgcgccggggagcggcggtccctgcgggcggcatctccagtcggctggtgcggtgcacgccgtcgccgtccgccgggagggcccgcgggatcacgctcgtacggtcgtccgcgccgtcatgggcatccgacagggcccccggcggtacggcgtccagctcggcgtcggtcagcgcggcacgggcctcacgggactcggccagcagcagcaccgcgtcgtgcgggcgcacctcgggattgcgggcggtcgcgctcgccaccaggctgtccagcgcgaccgggagccccggcacgacggcggacggggccgggacgtcggagttgagatgccggtagatgacctgggcggcgttctcgccggtgtggggcttggcgccggtcagcatttcgtagagcacgaccccgcaggcgtacacgtcgctgcgggtgtcggcggtgccgtgctcgatctgctcgggtgccagatacgacacggtgcccagcagggagccggtcgtgtcggtggccgtgccgaccgccctgaccaggccgaagtcggcgaccttcacccggccgtcgtccccgatcaggacgttctccggcttcatgtcacggtgcacgaaccccgcgcggtgcgcggcgccgagcgcggcgaggaccggctccaggatgtccagcgccgcccggggctgcagggccccgcgctcgcgcagcacgtcgcgcagggtgcagcccgccacgtactccatcgcgagatagacgtacgcgccctgggcgccctggtcgaagaccgcgacgacattggggtgcgccaggcgggccaccgacttggcctcacggatgaagcgctcgacgaacgagacgtcggtggcgagcgccgggtgcatcaccttgagggcgagcacccggtccaggcgggtgtccacggcccggtagaccgtggccatcccgccgacggcgatgcgcgcctcaatgcgatagcggccgtcgagcagctgcccgacgagagggtcctggagggtcatgtccaccccgagagtctacgagccgtcgccgacaccccggacgggcgagggcgttcccggggccgttctgcagccgatccgtgacagggacacgcactgcggccgcgtgcccgcccacccgggggcgatgcaagcgcctccggcgatcgaggagcaggggtcccggggacggcgcccccgaacccgtaccggctctcagaacgccggccgctccgggtccagcgccgcccggccgtccaccggggatgacgcccgggcgaagtgacggcgggggatgcggcccgcgcggtgggccagtcgcccgcctccaccg

SEQ ID NO: 3282 - DNA, 8462 bp, Unknown
  Kingdom: Bacteria, Phylum: Actinobacteria, Class: Actinobacteria, Order: Streptomycetales, Family: Streptomycetaceae, Genus: Streptomyces
ggcctctccgccggtgctgctcaggcccgtggtggccagcgcggcacccgccagcgcgatccccgcagccgccgcccgccgctgtcggcgcagcatccggcgcagccggtccgcgccaccgccccgcacgcggaggggtccgaacggccccaccccgcacggcgcgggcaccggcgccggagacggtgaagggcaccgggacaagggtcgggacagggacgccgaggcagaccgggaaggggatcgagacgggaaagtggacgtggacgtggacgtgggcatcggcgtggatgtggacgtcggcgtgggcacggacagggacgtgtgcgtggacgtggaactgggcgtgggcacggacgtggacgcgtgtgtggacatggcaccacctggattcgggcggacgagggcaagggaaaggggagtccggaccggttgatccggccgaactcccctcactttccaccgtccgcgcagattccgctgaggcctgtggacagtccccgcactggggataactccgtcacccgttccggcgacgcccgccctgccgaagcagcggcgatccccgctacggcagggcgatccccgtgtcgatcccgtccagggcgtgggcgcacgtgcagttgcggtgctcgttcttcggcagcccggccaccgcgtcgaacagtaccgagcgcagccggtccacgttggccgcgaacacctggagcacctcctcgtgagagacaccctcgcccgcctcggcccccgcgtccaggtcggtcaccagggtcatcgtcgtgtagcaaaggcccagctcacgggcgaggaccgcttcggggtgtccggtcatgcccacgaccgaccagcccatcgccgcgtgccagcgcgattccgcgcgggtcgagaagcggggaccctcgacgaccaccagggtgccgccgtccaccggctcccagtcgcgtccgcgagctgcggcgagcgcggccttgcgtccctcggggcagtacgggtcggcgaagcccaggtggaccacgttcggcacggtcccgtcggcccgggtctcaccgtcgtaaaaggtctgcacgcgggccttggtgcggtccaccagttggtcggggacgagcagggtgcccggcccgtactccggccgcagcccgcccaccgcgcacgggccgagcacctgccggaccccgacggagcggagcgcccacaggttggcccggtagttgatgcggtgcggcggcaggtggtggccgcgtccgtggcggggcaggaaggccacccgccggccgccgagctcgccgaggaagaccgagtcgctcggcttcccgtacggggtgtccacggagacctcggtgacgtcctccaggaaggagtagaagcccgagccgccgatgacaccgatctccgcggaactcccggtacccgccgtacccgtaccggagcccgtttcgtcaagtgcgttcgccatgcggtcaccgtatccggaggagtgtttcccgggacgaacgcccggaccccgccgagtggtctcggcggggtccggtgaaaagcaggtggtgcgtacgcgggctaggcggcggacgtaccgctcgacgaggccggcgcggaggccgacgacgaggaggaggcggacgaagaggacgacgatgcgctcgccttcgtgtccgaacccgacgacgaggacgacgcggagtcggacgacttcgaggccgtcgtcgccggcgtgctgctcgacgaggagccgcggctgtcgttccggtagaaaccggaacccttgaagacgatgccgaccgcggagaacaccttcttgaggcgtccgtcgcagctcgggcacacggtcagggcatcatcggtgaacttctgcaccgcctcgaggccctcgccgcactcggtgcactggtactgataggtcggcacttgctcctcctggcactctcactcaatgagtgctaacgacgctccatactgacgtattccgttgaatcagtccaccgtgaccggctcgcggtgaccgatcccacgtgcgacggtgcgtcccgaggacttcggattcagccgcgaacgcagggccagcagggtcatcagggccagcgcggttccggccagaggcaccaggaaaccggtgctcgcaccgtgggcgtcggcgagttgccccgccacggtcacggccgccgcctgtccgagcgccacggcgcccgtcagccaggtgaaggcctcggtgcgggcggtggcgggcaccagcgcttcgaccagggtgtatccgctgatcagcgccggagcgatgcagaggccgaccagcaggccgagcccggccagcagcggcgccgagtgcacggcccacaggccggacgcggtcagggtcagcgccacgtacccgacgatcagccggcggcgcgggctgctcttccaggcgatggctccgcaggcgatgccggccagcatgttgcccgccgcgaagatcccgtagaggacaccgttcgcaccggggtggccgatctcctcggagaacgcggtcagcgagacctgcatcccgccgaagaccgcgccgatccccaggaaggcgacggccaggacgcgcactcccggcacggagagcgccgaggcgtgcggttcggcagcggtggccgcgttgcgaggcgcgggctgggtggcacgctgcgcggcgaagaacaggccgccgaccagagtcagagcggcttccgtgatcagtccggccgccgggtgcacgccggtgcacagtgcggtggcgatcaccgggccgaggacgaaggtgaactcgtccgtcaccgactcgaacgcggcggcggtggacatcagcggagaggcgggccggtcgggggtcgcccccagcatcgccgcccagcgggcccgcaccatggggccgatctgcggaatcgaggcgccggtcggtacggcggcgacgaacagcgcccacaggggtgcgtccgccagcgccagtacggtcagggcgctcacggaggcggcgtggaggaggacccccggcagcaggacggcgcgctgaccgaagcggtcggcgagcttgccgctctgcggggcgaacagcgccatggcgacgccggagaccgccgcgacggcgcccgcgctgccgtacgagccggtcgtgtgctgcacgaggaggacgatgccgatggtgagcatcgcgaagggctgccgtgcggcgaagcccgggaggaggaaggtccacgcaccgggggtgcgcagcagttgcccgtatccggggcggtcggagaccgtggttgccacggtccttgcctttctgccgcctggtagccctgcttcccggcgcccttgtggggcgggccggacggaagcggccgagagctgtcctcttcgcgcggaactgcggtagatgccgggcgactcgctgcaagcggcgaagaaacgccgggcgaagagacaccacgaccgccatacggtcgcgccagctctgcttcagacagagttggtcgatcaggtttaccttcatgctacaggcaggaagccctgtgcgcctgtgattgcgcacaggggcttccggttcggcctgtgatctgcgacgcgtccggtgccggtcgcctgagtcgtcgcctcagggagcctcaaggtccggtcttcgtgccgcttccgcttccgttcgcgcttccgcttccgttgacacgggtactggcaccgccgagcttcttggccagcttcatcgcctgggggatggcggaaccaccgtggggtcccgccgtaccgggtgcgccggaagcggggaatctgcccgtgcccagccagccggccagtttgccgccctcgccgaccgcccgcagccgttcctccgccctgtcgcgcaccggatcggtggccaccaccagcagttcgtccccgcgccgcagcaccgtcgccggggacggcacgaagctcttgccctcccggaccaccagagtgaccgcggcgccggccgggagccggagctccccgacctcgacaccgtgcatcttggacttcgtggggatggcgaccgacagcaggtgtccgcgcagccgttccagcggggccgactcgatgcccaggtcggcggcctcggccggatcgtcggcgatgttcagcttgttcgcgacccagggcagcgtcgggccctggatcagggtgtagacgatgaccagaacgaagacgatgttgaagattctcgtactgccctccaccccggacaccatcggaatggtcgccaggacgatgggtaccgccccgcgcagcccggcccaggacatcaggatcttctcgcgggccggcagccggaacggcgcgagactcaggaagaccgacagcggccgcgccaccacggtcagcaccaggcccacgacgatggcgggccagaagtcgtcgaccaggtcgtgcggggtgaccagcaggccgagcagcacgaacatgccgatctgggccagccagccgagcccgtcggcgaagccccgggtggcgggccagtgcggcagcttggagttgccgaggatcatcgcggccaggtagacggcgaggaacccgctgccgtgggccatggcgcccgcggcgtacgcggagacggcgatggccatcacggcgatcgggtagaggccggaggcgggcagcgccacgtgccgcagtcccagggaccccagccagcccaccgcgatgccgatcgcggcgccgatggccagctccatggcgatctccgcgaccaggatgtaccagtgctcgaccgggccgaccgcggagaacgcgacgaccatgatgacgacgggagcgtcgttgaagcctgattcggcctccaggaccccggtgatccggggtggcaggggaaccctgcgcagcacggagaagacggccgccgcgtcggtcgaggagacgaccgcgccgatgatgagggcctggcgccagtccaggccgaccaggtagtgcgcggcggcggcggtgatgcccacgctgatcccgacgccgacggtcgagatcacggcggccgcgggcagaacgggtttgacttctttccacttcgccccgagtccgccctcggccaggatgacgaccagtgcggcgtagccgaacacctgcgtcagttcggcgttgtcgaacttgacgtcgaagatgccgtcctgccccagggcgatcccgatgccgagatacaggagcaggctggggagcccgctgcgcgaggagatccgaaccgccgccacggcgacgagcaggacgagcgagcagacgagcaggagttcgttgagcgcgtggacagtcagggtccgttccttccctgcgtgcgcctgccggatcgtcctccggcagccagttacttcgttaccttacctaatctttaacgattccttgacgggttcgagtgttcgtacgaggaagacgcaaatggatgcatccccataccgcgtccgagtggcttctccgctgcgcctatggttgctcctgcactcccaggaccaccctgcccctcgaaggacagcgatgcccgccaacacaaccgcctcttccggcccttccgacgcgaagaagcccggcaggaagaaggggcgacgcgcccgcctgatcgtgctcgtcctggtgctggcgctcgtcgcgggtgtcggatacggggcgtactggtccgtttccaccgtgcgggcctcgtacccgcagaccaccgggtcgatgactctcgacggcctttccggcgacgtcgaggtcaaacgcgactcctacggaattccgcagatctacgcggactccgacgccgacctcttccgtgcccagggcttcgtccaggcccaggaccgcttctgggagatggacgtccggcggcacatgacgtccggccggctctccgagatgttcggttccggacaggtggagaccgattccttcctgcgcacgctcgggtggcgacaggtggcgcagaaggagtacgacgaggttctggacgagagcaccaagaagaacctccagtcgtacgcggagggcgtcaacgcgtatctgaagggcaaggaaggccgggacatctcggtcgagtacgcggccctggggctgaccaacgactacaagcccggcgagtggaccccggtcgactcggtggcctggctgaaggcgatggcctgggatctgcgcggcaacatgcaggacgagatcgaccgttcgctgctgaccagccgcctcgacaaggaccagatcgaggacctgtaccccggctacccgtacaagcagcacaagccgatcgtcgagcagggtgcggtctccccggtcaccgggaagttcgactccgaggcgaccccgtcggactccatcggatcgtcgacccccgagggcgccaccgatggcctgaacacccagatgtccgccctctcggacaccctcgacgagatcccggcgctgctcggcccgaacggcaacggcatcggctcgaactcctgggtcgtctccggcgagcacacgacgtccggcaaggcgctgctcgcgaacgacccgcacctcgcgccgatgctgccctccctctggtaccagatgggcctgcactgccgggagctctccaagacctgccagtacgacacggccggctacacgttctccggcatgcccggtgtgatcatcggtcacaaccaggacatcgcctggggcctcaccaacctgggcgccgacgtcaccgatctcttcctggagaaggtctccggcgacggctacctgtacgacggcaggaccaaggccttcaagacccgcgaggagaccatcaaggtcgccggcggcagggaccggacgatcaccgtccgcgagacgaacaacggccccctggtctccgaccgcagcaaggaactcgacaaggtcggccagaaggcccccgtcagcaacgccgcgcccgaccgggccgacggctacgcggtggcgctgaagtggaccgcgctggagcccggcaagtcgatggacgccgtcttcgcgctcaaccgggccaaggacttcaccaccttccggaaggccgccgagaacttcgaggtcccctcgcagaacctcatctacgccgacaccgacggcaacatcggctaccaggcccccggcaagatcccggtccgctccgagggctacgacggaacggcgccggccccgggctgggaccccaagtacgcgtggaaggggtacatccccttcgacgagctgccgtacgagtacaacccggaccgcggcttcatcgtcaccgccaaccaggccgtcatcgacgagaagaagtacccccacctcctgaccaaggactggggctacggcgcccgcagtcagcggatcaacgacctcctgacccagaagatcaagggcggcgagaaggtctcgaccgatgacatgcagaagacgcagatggacaacttcagcgagatcgccgcgctgctggtgcccgaactgaagaagatcaacatctccgacccgagcgtccgcgaggcccagaagctgctggagggctgggactacacccaggagcccgactcggccgccgccgcgtacttcaacggcgtctggcgcaacatcctgaagctcgccttcgggaacaagcttcccaaggagatgcgggtcgagggtgactgcctcaatgtgccgccggccaagaacagcggcccggccgaccagcagaagaagctcgtccgcgagtgcggccagcgcgacggcgacacagcgcagccggacggcggcgaccgctggttccaggtggtccgcgacatcgtggacgaccaggacaacgagtggtggaaggcgcccgcccggggccgcgaggatgccctggagagccgggacgacctgttcgcccgggcgatggaggacgcccgctgggagctgaccgccaagctcggcaagaacatctccacctggagctggggccgcctgcaccggctgacgctgaagaaccagacgctcggcaccgaaggacccggcctgctccagcgggcgctcaaccgcggcccctggaacctcggcggcggcgaagcggccgtcaacgccaccggctggaacgcggccggcggctacgacgtcgtctgggtgccgtcgatgaggatggtcgtcaacgtgggggactgggacaagtcccgctggatcaacctcagcggagcctccgggcacgccttcaacgcgcactacaccgaccagaccgccaagtgggtcgacggtgaattgctcgactggtccttcgggaaggaagcggtcgacgcgtccaccgtcgacacgctgacgctgaagccgtagggctcgtcagacggtcgttcagagggcctttatggctcacgcgggcctcaccggatcacgtgtgagccatacggccctcgtgagccatgaaggactcgtgaaggactcatgaagcgaagcgccgtgctccggccggcgtgaccaccgcgtccacggggtggtcgtgcggttccgaggggacccgcgcgaccacctcgtcgtcgtacagcagcacgaccagcggggggtgcgccccggcggccgtcagccgggccagcacccggtcg

SEQ ID NO: 3283 - DNA, 4986 bp, Unknown
  Kingdom: Bacteria, Phylum: Actinobacteria, Class: Actinobacteria, Order: Streptomycetales, Family: Streptomycetaceae, Genus: Streptomyces
acgggccggctcggccgccgtgctgacatgggcaggactgctgaccgtgctggcccttctgaccggctgcaccgaggcccgggacgccgtgttcaacggcaaggcgcgatcctccggcgacgcgatcagcgtcttccccgaggacggcgccgaggacgtcgacgaggagacccgcatcgcggtgaaggttcccgacgggcggctggagagcgtgaaggtcatgcggatcgaggacgcgcggcagcagacggtggccgggcgcatcgccggtgacgggaggtcctggaagccggagcccgccgcgggacggctggcgctcgccgcgaagtacagcatcgacgcggtggccgtggacggagcgggccgccgctccgcccggcactccacgttcaccacgctcgtccccgagcaccgcttcatcgggtacttcaaaccggagaaccggtccaccgtgggcaccggcatgatcgtctccttctccttcaaccgcccgatcgccgaccgggccgcggtggagagggccatccgggtgacgtccgatccggtggtggaggtctccggccactggttcggcaaggaccggctcgacttccgcccgaaggcgtactggaagcccggcaccgaggtcaccgtcgacatcgggctccgcgacgtcgagggcgccccgggggtctacggcagccaggacaagagagtcgtcttcacggtcggccgctcccaggtctccctggtcgacgcggaggcgaagaccatggaggtgcgccgggacggagaactcgtggatacggtcccgatcaccgcgggggccccgaagacgaccacgtacaacgggaagatggtggtcaccgagatgcacgaggtgacccggatgaacggggccacggtcggcttcacggacaagaagggcaagggcgagtacgacatcaaggacgtgccgcacgcgatccggctcaccgagtccggcaccttcctgcacggcaactactgggccgacgagtccgtcttcggcgaggagaacgtcagccacggctgcgtaggcctgcgcgacgccaagggcggcagcggctccacccccggcggctggttcttcgaccggaccctgatcggcgacgtggtcgaggtggtcaactcccgggacaagaaggtcgcaccggacaacgggctcagcggctggaacctcggctggaagaagtggaaggccggttccgccctgcgctgacgccccgggtcccggccacgtttcacccgcaccccgccgctccactccggcacccggcgccacctgcacagctccccggaccactggtacggaacggtgacattccggagggagttcaccccgctcgcgatgtgattatcttgcggcgggcgcgcatgttcggcgcgcgggggtgcgggccatggcgggagccgggccctgcgaggggagacgaccacagtgaacgggcagccgatatcgggggcatcggccggggcgagcgggaagcggcgcggcggaacggggcttctggccctggttctgggcgcactgctgttgctggtgacggcgtgcggcggcggcggcgccggcgcgggggacgagaaggggccggcgggcagcgcgaagaaggaggacacgaccgcctcgcaggcggtggtgaccatcgcgcccaaggacggcgcggagtccgtggcgaccagcggtgcgctgaagatcggcgccacgcagggcaagctgaccacggtgaaggtctccgaccccaagggcaacgaggtcgagggcgagatcgcggccgacggcgcgagctggacgcccgagcggcatctcgccgcctccacgaagtacgcggtgcacgcggtggcgaaggacgccgaagggcgtgagtcggcgaaggacaccaccttcaccacgctcgtcccggcgaacaccttcatcgggcagtacacaccggaggacggctccaccgtcggggtcggcatgccggtctccatcaacttcacccggggcatcaccgacccggacgcggtggagcgggcgatcaaggtgacggccgaaccggccgtcgagatcgagggccactggttcggcaacgaccgtctcgacttccgcccggagaagtactgggcggcgggtaccaaggtgaccgtcgacctcaacctcgacggcgtcgagggccggccgggcgtctacggcaagcaggccaagaaggtgacgttcaccatcggccgcagccaggtctccaccgtcgacgcgagcgcgaagcggatgaaggtggtccgcgacggcaagcagatcaaggacatcccgatctccgcgggcgccccggcgacgaccacgtacaacggtcagatggtcatcagcgagaagctcaaggtgacccggatgaacggcgacaccgtcggcttcggcggcgagtacgacatcaaggacgtgccgcacgccatgcggctgtccacgtcgggcaccttcctgcacggcaactactggggtgcgtcctccatcttcggcaacaccaacaccagccacggctgcgtcggtctgcgggatgtgcgcggcggctacgacaaccagacgccggcggcctggttctacgacaagtcgctgatcggcgacgtggtcatcgtgaagaactcgcacgacaagacgatccagccggacaacggcctcaacggctggaacatggactgggaggagtggaagaagtaggacttccttccgctccccgatcgacccggcgggcccggtgctgtgaccaacggcaccgggcccgccggcgttagcgttggttaacctgcctccatgactgtgaccctcgaagtacgcgacggcgtcggcacgatcctcctggaccggccgcccatgaacgccctggacgtggcgatccaggaccgcctgcgggagctggccgaggaggcgacccggcgcgaggacgtgcggtcggtgatcctctacggcggcgagaaggtgttcgcggcgggcgcggacatcaaggagatgcaggcgatggaccacacggcgatggtcctcaggtccaagggcctccaggacgccttcaccgccgtcgcccgcatccccaagccggtcgtcgccgccgtcaccggctacgcgctcggcggcggctgtgagctggcgctctgcgccgacttccggatcgccgcggacaacgccaagctcggccagccggagatcctcctcggactgatcccgggcgcgggcggcacccagcggctcgcccggctgatcggcccctcccgggccaaggacctcatcttcaccggccgcatggtcaaggcggaggaggcgctgacgctgggactggtcgaccgggtggtcccggccgccgaggtctacgagcaggcgcacgcctgggccgccaagctggccaagggtcccgcgctggcgctgcgcgcggccaaggagtcggtggacgccgggctggagacggacctcgacaccgggctcaccatcgaacggaactggttctccggcctgttcgccaccgaggaccgcgagcggggcatgcgcagcttcgtggaggaggggccgggcaaggccacgttcctctgagccgtagtcagaacgggtggcccggtagtcgggtcggacggtcccgcgcggggagttcatccgtcagagcggattatccgggccttaaggcaaccttaaggcccggagcggccctcggtcgggcattcctcgtcgggctgggcatcgtcgcagctcagcgcgggcgttcggggagctgtcctgccagaggcatatgccaaaagccttccgtgggaggggtcgttccggggtgccgattcccccggaacggccccggcgggcgatccgtgcggccatgatggtgggcatggcgggcctggagggtgtggatcagccgcgaccgcgcagcagcgcgaccgcggcacgctggacgtcgaccatggatgacgaacaggcgttcaaggcgctggagttgttcggaaatccgaccgagggggaggttcggctgccgtcccgcccggagtcggcggcgacggcccggcgcatcacttcctgcgtcgtgctccgtcagtggggtctctcgccccagaccgccgagtacgcggtgctcctcgtatccgagctcgtggggaacgcggtccgccacaccggtgcccgggtcttcgggttacggatggtccgccgccggggctggatccgcatcgaggtgcgcgacccctcgcgcgggctgccgtgtctgatgccggtgcgcgagatggacgtcagcggccggggcctcttcctcgtcgacaagctctccgaccgctggggtgtggatctgctgccgcgcggcaagaccacctggttcgagatgcgtatctccgaccgctgaccgtacgaccgctgaccgcccggccgtccttgccgctccggatgcgcagaagcccccggtcggccgtggtgcggcgctgcgggggcttctggcgggggccgtggcatggggggtgtgtccacggccgctcatgacgacctgtgcccgggtcgatgggggtcgtggctccgactatggcagacgggcgaccccggtgccaaagcgacttgtcgggatatttagggaacaagcgggcattcgctggttgaatcgtaggtgtgctcggtcactcgcctggcattccgtgcatccttatggtgatgcttgaatgattcattgatcatctggcgaattgctcaatcgtcttatttcggccatcacgcctctactgtgtcccgggaagccggtggaacccgtggaacgcgaggtggtcgggcatggacggacacagggccccgatgggccgccgggaccttctgggcgccacggccggggcgctggccgccgccctcgccgcaggatgcgtccggagcgacgggccgggcggagccgccggacccgccgccgtcacccgccctcccggcacggcccccgccgcctccggcacccccgcccccacagcctcccgcgccccccccccgcaccccctccccgggctgcccttccggat

SEQ ID NO: 3284 - DNA, 1253 bp, Unknown
  Kingdom: Bacteria, Phylum: Actinobacteria, Class: Actinobacteria, Order: Streptomycetales, Family: Streptomycetaceae, Genus: Streptomyces
ggtgggccggcccggcgacgggaagagcaggtcggcgtcgggctcgaacggcggcgggtcgtccggggcgcggtcgcggccgccgctgtcacccatggcccgctcgatccagctgttgtcgtccacgttcacgatgatcagactggtggccgccttgacgccgggctcgacagccacgatgcgcgcggggtcgtagccgggccagcgctcccctcggtgagcgaccttcccgtcggcgaccacgggcgggcccagcgggttgccgcaggcgcagcggacgcggggcatcccccggctgtccaccagcacggcggtgcccgcctggagcacggcctggaaggcggtggccgagccggcgctgtagccgtggttggtgacctgtgcgtcggcacgcaggacgaccggggtgagggacttcaggtagcccgggatctgtacggcctcgatgccggacgcgtcggcgaaggcgcgcgccttgtcctcgtcgtcggccaggagggcggcctgctgttcgacgtcgcaggcggcgacggaccgggtgccgccgtagagcccggggacggcgccggagaccggatggaccgtccgggtggcggaggtcggttcggcgtccggtgcgccggtgggggacggggaggccgccgcccgcgccgtggacgcggtgaacgggccgggcccgggggacgcgagcgactggaggaggacgtccttggcctccgcggttcccgtggttcccttcgccgtccggtcgccgccgtcgccgcagccggcggcggcgagcagcaccccggcggacagcgcggcgagcgccgtacgccggatacgtctgggtgagcgcacagagctctcctgcctgtccctggggaacggatgggtgtcaccatctgtgccgcaccgagcacgatcccgcaagcggacagccgcccgcacccccgtcttgaacgcgttcaagaaaccctctagtctcactcccagaacttgaacacgttcaaagcagggtgctcggagcagggttctcgaagcaggggggaagtcatgtccacattggtcaacgccatcgtgatgctgggcatgctcgtcgtcgtgcctgcggggctgcggctgaccggacagcaggagctggaccgcgtccggcggctctggcccctgttcgccgtgccgggcgccatcgccctctggctgccgcgcggccccgcggccacggcgctcgcctgctgctacgcgctgggaaccgtcctgctcgctctgcgcgc

SEQ ID NO: 3285 - DNA, 3333 bp, Unknown
  Kingdom: Bacteria, Phylum: Actinobacteria, Class: Actinobacteria, Order: Streptomycetales, Family: Streptomycetaceae, Genus: Streptomyces
gcagaggcagaggcagaggcagaggcggcgcgggggtggcgtccggcccgccgccgcccagcacatggcgcagatacggctccgccgccgccgcggaccgggccagcaccccggcggaggccagccccgaccggtcgggggaggggagcagcccgttcgtcgtcttcagcccgaacaccccgcaccaggcggccggaatgcggaccgacccggccccgtcgctgcccgtcgccagctccgccatccccgtcgccaccgcgaccgccgacccggccgaggagccgcccggagtacggtccgcccgccacgggttgaccgtacggccgtgcgctcccaggccccaggtctgccagtgggtgccgggtcccggcaccgaggccgcaccgaccggggacccgcccgccgcgatcagccgacgggccgcgaaggaccggatcccggacgggcccttcaccgcgaacggcagtccgcccagggggagtcgccgcgccacggcctcccgttcgcgggcgagcgcctcgtccggccagacctcgatgaacgcgtgcagcgcagggtccagccggccgatccgctccagggcccgcgccaccgcggaggtcgtccgtgtcatgggcccagtctgccggtgcgcccctccacgcgccccggctactcctccaacgccgcctccatcacggcccgggcgatcggggccgcgctgccgccgccgctgatgtcgtcccggtcggcggcggcgtcctccacgaccaccgccaccgcgacggccgggcggccggagccggggtcctgggcccaggagatgaaccaggcgtacggcagcccggagttgtcgacgccgtgctgggcggtgccggtctttccgccgaccgtcaccccgtcgatcgccgcgttcgacccggtgccgtcctccaccacgtcgaccatcatccgctggagctgcacggccgtcgacgggctcatcgcccgctcgtacggacgggatccctcctgccggaccgtgtccccgtcgttcgtggtgacccgttccaccagatgcgggcggcgcagatccccgccgttggccaccgccgacgcgaccatcgccatctggagcggggtcgccgtcgtgtcgaactgcccgatcgaggacagcgccagctggtcgtcgctcatctccgtgtcgaagttgctcttcgccaccccggacgggatgcgcagcccggtgtcgttgaagccgaacctctccgccgtctccaccatcccctccaggccgacctccacccccagatgggccatcaccgtgttgcaggagacccggatcgcgtccgccagggacgcctgctcgcagcctctcgcctcgttcggcagggtcgttctcgtgccgggcaggacgtacggcgacggggtgtccgtgggagcgtcggcgtccgtcacggcccgggcgtccagggccgccgccgccgtcacgatcttgaaggtggagcccggcggataggtctgcctgatggcccggttgagcatcggcatgctcttggccgcgttcagccgggcccatgcgtcggtcaccgcggaaccggtcccggacagccgctcggggtcgtacgacggggtcgagaccagtgccaggatctcgccggtcgacggatccagcgccgcgaccgccccccgccgcccgctcagcccgtcgtacgcggcctgctgcatcgacgccctgatcgtggtgacgacatcgccgcccggctgccggccccgggtgaactcgttccagaagggcagcggcgccagcagcgagtccgtaccggacaggacggcgtcctcggcgttctcgatcagcgtggtgccgtacgtctgcgaggcgtatccggtcaccggggcgtacagcgggccgtgcagataggtgcgctcgaagctgagctgctcgccggtctccttgctgccggtcacgggccggtggccgaccaggatgttgccgcgcggctggtcgtaacggacgatggtgttgcggcggttggccggattgtcgtccagttcgtcggcctcgaagagctggacgcgggccgcgttgacgagcagcgccaccagcagcagcagacagaaggcggcggcccgccggatgtagcggatcaccggtcctcctccacggccgccgcgatgaccccggtatcggcctgttccgggtggggtctgcgcgagacgtcgctgacccggatcagcagcgccacgatgatccagttggtgacgaccgacgagccgccctgcgcgaggaacggcatcgccatcccggtcagcgggatcagccccatcaccccgcccgcgatcacgaacacctggagcgccaggatcgacgccaggccgatggcgagcagccgcccgaacgggtcgcgcagggcgagccccgcccggtagccgcgcgccacgagcagcgcgtagagcaggaagatcgcggtcagcccgctcaggcccagctcctcgcccgcggtcgccaggatgaagtcggacttggcggcgaagccgatcaggatggagtggcccgcgccgagtccggtcccgagcatcccgcccgcggcgaaggcgaacagcgactgggcgagctgacccggtccctggcccgcgtcgatcgaggcgaacgggtccagccagtcctgcacccggctgtggacgtgcggttcgaaggagccgacgacgaaggccccgacggcggccaggagcaggccgaccgcgatccagccggtccggccggtcgccacgtacagcatgatgacgaagagcccgaagaacagcagcgaggtgcccagatcgcgctccagcaccagcaccccgacgctcagcagccagatcgccacgatcggcccgagcacccggccggcgggcagttgcagcttccacaccgtgcggccggtgtacgcgagcgcgttgcggttggcggccagataggcggcgaagaacaccgcgagcaggatcttggcgaactcgccgggctggaaggagagtccgccgatccggatccagatcttcgccccgttcaccgccgggaagaagatcggcacgatcagcagcgcgagcgccgaggccaccgagagatacgcgtaccgctggagcacccggtggtcgcgcagcagcaccaccacggcggcgaacagcgcgacgccgagcgtggaccagacgagctgggtgggtgcggcctggtcccgcggggtctccaggtcgagccggtagatcagcaccaggccgagcccgttgagcaggacggcgatcggcagcagcagcggatcggcgtacggggcccggaagcggaccgcgacatgggcgagcagggcgagcgtgccgagcccggcgccgtacccggcgacg

SEQ ID NO: 3286 - DNA, 2279 bp, Unknown
  Kingdom: Bacteria, Phylum: Actinobacteria, Class: Actinobacteria, Order: Streptomycetales, Family: Streptomycetaceae, Genus: Streptomyces
cgtcttcgccgccctcgccgcgacactgccggtcttcctgccgatggccgtcggcgtcgtcgcgggcgacgcggtcgcgggcgaggcgagcagcggcaccctgcgctatctgctggtcgctccggcgggccggacccggctgctgctcgtgaagtacgcctccgtcctcgccttctgcctggtcgcgaccctggtcgtggcggcgtcggcgctggcggtgggtgcgctgctgttcccggtgggcgaggtcaccacgatctcggggacccggatcagcttcggcgagggactggtgcgtgcggcactgacggcgctggtcgtcgcggtctcgctgaccgggttcgccgcgctggggctgttcgtctcgacgctgaccggcagcgggatcggggcgatggcggccaccgtcgggctgctgatcacggtgcagatcctggacagcattccgcaactgggcggtgtgcacccgtacttgttctcgcactactggatatccttcgcggacgtcctgcgcgaacccgtccactgggacgacctgatcaagaacttccagctccagggcctgtacgtcacggtcttcggctcggcggcctgggcgcgcttcacggccaaggacatcacggcctgagaggcgggtccgggagagaccgcacgggcggcgtccggggaggcacgacccggcgagagggcatctgctggctggatcggatcggcagggagcccgtccgcgccgtcggccgggcgagccgtcccccgatcggctcgtcgcggcacgaacggcacgaacggtgcggatggggaacgacacgacacggtacgttccgtttccgcctcggtattgttcggcctttggcgacgagctgtcaacaagagattggctgaaacccccctatgctcaccgaatgatcacatcgccgagcagtgtgcgccgtagcgaacggtcacgccgcgcgatcctgcggtccgctctcgacctctgtacggagcgggggtacgggcacgtcacgatagaggccatcgcggccggcgccggtgtcagcaagaagacgatctaccgctggtggccgtcgaagggcgccgtgctgctggaggcgttcacggacgccctgatcgacgccaccccgttcgtggacaccggcgatatcggcgccgacctgcgtgcccacgtcgccggcgcggtgaaactgctctcggtcccgccgttcggccccgcctacgcgggcatcctctccgagctgcaccacgacgacctcctggcccagcaactgcgggaggaactggtcgacccacgcgtcgaggaggcgatcggccgcctgcgcggcgcccaggagcagggccagatcccgcccggcgcggacctcccgctggccgtggagatgctgtacgggccggtctactaccgccatgtgctgcgcaagcccgtccaggacgaggagacgatcgccggcctggtggaccacgtactgcgctcgctgcgcgcgccgggctactgaggcccgccgtccggatcctgccgggtggcgccgctcaccccacgcgtcgtgtggatgtccccgtgctggacggcgaagactgtgccggaatcacgggcggtgttgttctgctccaggacgacggcggcacggccgctcgcgaacgctccgtcgacctcggccgtcagccgggccagcggcacacggcaggccgggtcccggcccagcagctcgcgcagttcccgggtccagactccggccagggcccgccggacgtcgtcgggggcctccgacgaccgcaccagggccgcaccctcgtccagccggacgccgaccggggccgcgctgtccgcggcgtcccggcggaagaggccgaggacggcatccctggtgtcctgccacaggtccgtggccatcgccgcgaccacggccgcggcacccgcctcggcgagcagcatcagttcgtcgctcacgtgggtcccttcacttcttcccgccgatgttcatcgtgccgttccccagcgcgtagacgacgccgtgcccggaggccttgctgatcatcttcgtgttcccggccggcgcgtccgcgtcggaggccgtacggtccgcggtggaaacggtggactgcggtgcgccgccgtacgcgggtacgtgcagccaggcggatccggcgaactccttctcccgcacgtcgacctgacggaacgaggccggctcgacgcccggccgcccctggcacaccgccgtctcgtggaagtgctccgacaccaggagcgcggtcgtcgcctccggggcctgcgccagggc

SEQ ID NO: 3287 - DNA, 4346 bp, Unknown
  Kingdom: Bacteria, Phylum: Actinobacteria, Class: Actinobacteria, Order: Streptomycetales, Family: Streptomycetaceae, Genus: Streptomyces
ctcggcccgcgccgcggtcgccgccggggcccgggtggggcgtgcgctggagatcctcggtgaggaggtccccgagcacctggccgccgcgggacggctgcgcatggagcacaagcaggcctccctggaggagctcggcgcgctcgccgacccgccgctgaccaaggacgcggtcgccggccggatccgccggctgctggcgatggccgacaagcgggcccaggatctgggcatcccggggaccgagtcgaccctcagcgaggagctcgccgacggcctggtcggctgactcggcggcgagcaggggacgttggtcccgcacccgccgggaccgaggtcccgcacccaccgggaccccggtcccggcgggcgaaacggaggtccgtactcctactgacgagtacggacctccggtcgtatccggtggcgcgcagtggccctctcgatgtcacccccgggccctcggagaggtagggtcggaagcggtcggggacatccctatacaactcgccggcgtcgaaaaccggcgtacctaacgaggagatcggttcgtgacgatccgcgtaggcatcaacggcttcggccgcatcggtcgcaactacttccgcgcgctgctcgagcagggtgcggacatcgagatcgtggctgtcaacgacctgggtgacactgcgaccacggcccacctgctgaagtacgacaccattctgggtcgtctcaaggcagaggtcagccacaccgccgacaccatcaccgtcgatggtcacaccatcaaggtgctctccgagcgcaacccggccgacatcccctggggtgagctgggcgtcgacatcgtcatcgagtcgaccggcatcttcaccaagaaggccgacgccgagaagcacatcgcgggtggcgccaagaaggtcctcatctcggctccggccaaggacgaggacatcaccatcgtgatgggcgtcaaccaggaccagtacgacgcggccaaccacaacatcatctccaacgcctcctgcaccaccaactgtgtggcgccgatggccaaggttctcgacgagaacttcggcatcgtcaagggcctgatgacgacggtccacgcgtacaccaacgaccagcggatcctggacttcccgcactcggacctgcgtcgcgcccgcgccgccgccgagaacatcatcccgaccaccaccggcgccgccaaggccaccgccctggtcctgccgcagctcaagggcaagctcgacggcatcgcgatgcgcgtcccggttccgaccggctccgccaccgacctcgtcgtgacgctggcgcgcgaggtcaccaaggacgaggtcaacgccgcgttcaagaaggcctccgacgacggtgcactcaagggcttcctgacgtacaccgaggacccgatcgtctcctcggacatcgtcggcgacccgtcgtcctgcaccttcgactcctccctgaccatggtccaggaggggaactcggtgaagatcctcggctggtacgacaacgagtggggctactccaaccgcctcgtcgacctcacggtcttcgtcggcgagcagctctgatcctcgggtcggcaggcacatcgatgtaagcgaaggggctcgaccggcgcaacggagcgcgggtcgagccccttagcatgctcatcggtccttccaaggagtaaacggaacagatgaagacgatcgacgaacttctcgccgaaggggtcgcgggcaagcgggtattcgtccgtgccgacctcaacgtgccgctggacggcaccacgatcaccgacgacggccgtatccgcgccgtggtcccgacgatcgccaagctcgccgaggccggcgcgcgcgtcgtcgtcgcctcgcacctcggccgccccaagggcgccccggaccaggccttctcgctggcgcccgccgccgtacgcctgggtgaactcctcgatgccgaggtcgccttcgccgccgacacggtcggcgagtccgcccgcgccgcggtcgccggcctcgccgacggccaggtcgcggtcgtcgagaacctccgcttcaacgccggcgagacgtccaaggacgacgccgagcgcggcgccttcgccgatcagctggccgagctcgcggacgtctacgtcggcgacggcttcggcgcggtgcaccgcaagcacgcctcggtcttcgacctcccggcccggctcccgcactacgcgggctacctcatcgccaccgaggtcggcgtcctgaagaagctcaccaccgacgtcaagcggccgtacgcggtcgtcctcggcggcgccaaggtctccgacaagctcggcgtgatcgaccacctcctggagcgggccgaccgcatcctcatcggcggcggcatggcgtacaccttcctcaaggcccagggccacgaggtcggcagctcgctgctccaggaggaccagatcccggccgtgcgggagtacctgcgtcgtgccgaggagaagggcgtggagttcgtcctccccgtcgacgtcgtggtcgccccgtccttcccggacctcaagaccaaggccccggcccaccccaccaccgtcgccgccgacgccatgccggccggccagatggggctggacaacggaccggagaccaacaagctctacgcatcgaagctcgccgacgcggccaccgttttctggaacgggccgatgggcgtcttcgagcaccccgacttcgctgacggcacccgcgcggtcgcccaggcgctcgtcgactcgtcggccttcagcgtcgtcggcggtggcgactccgccgcggccgttcgcatcctgggcttcgacgagaatgcattcggacatatttcgaccggtggcggcgcgagtctcgaatacctcgagggcaagacgcttcccggcctcgccgcactggaggactgacctttcatgaccacccgcaccccgctgatggcgggcaactggaagatgaacctcaaccacctcgaggccatcgcccacgtccagaagctctccttcgccctggccgacaaggactacgaggacgtcgaggtcgccgtcctgccgcccttcaccgacctgcgctccgtgcagaccctggtggacggcgacaagctgaagatcaagtacggcgcccaggacatctcggcgcacgactccggcgcgtacaccggtgagatctccggccccatgctcgccaagctgcgctgcacgtacgtggccgtcggccacagcgagcgccgccagtaccacggcgagaacgacgagatctgcaacgccaaggtgaaggccgcctatctgcacggtctgaccccgatcctctgcgtcggcgagggcctggacatccgcaaggccggtgaccaggtctcctacacgctcgcgcagctcgacggcgctctgaaggacatcccggccgagcaggccgagaccatcgtgatcgcctacgagccggtctgggccatcgggaccggcgaggtcgccacccccgaggacgcccaggaggtctgcggcgcgatccgtggccggctggccgagctgtactcccaggagctggccgacgccgtccgtatccagtacggcggctcggtgaagtccggcaacgtcgcggccatcatggcgcagcccgacgtggacggcgccctcatcggcggtgccgcgctggacgccgacgagttcgtcaagatcgtccgcttccgcgaccagtgagtatgcggtagcgcggatccgtcgtacccttgcgggggccggaggggctagcgcccttcggcccccggtgcacgtacacgcagtagtcaagaattccggaaagtagggaccagccgtggttttggcgttccagatcgctctgatcgtcttcagcctgctgctgatgctgctggtgctcatgcacaagggcaagggcggcggcctctccgacatgttcggtggcggcatgcagtcctccgtcggtggctcctcggtcgccgagcgcaacctcgaccggatcaccgtcgtggtcggtctggcctggttcgcgtgcgtcgtggtgctcggtctgctcgtcaagctggacagctgacccgtcgtccgcgcataccggtgacggtgtaactccttccactggacgcgcgttgggccttacgtagactggggcatcgctcgactcacgcagggagttacgaccgtggcaagtggcaacgcgatccggggaagccgggtcggagcggggccgatgggggaggccgagcggggcgagtccgcgccgcgcgcccgcatctccttctggtgctcgaacgggcacgagacgcagccgagcttcgcccatgacgcgcaggtgccggacacctgggactgcccgcgctgcggcttcccggccggccaggacaaggacagcccgcccgac

SEQ ID NO: 3288 - DNA, 10297 bp, Unknown
  Kingdom: Bacteria, Phylum: Actinobacteria, Class: Actinobacteria, Order: Streptomycetales, Family: Streptomycetaceae, Genus: Streptomyces
atgcgggactacgacgcgcgacgggcggagcactggcaccggaacgcgcacgacctgctggccgcgctgtccgaactccacgtggcgcgaggctgggactccgagagcttccggctcaaccccggccatcggctgcgtcgccggacgcccgctccgtccaccgcgtgggacatcgtctgggcccgggtggcgaatcggctgctcgccctcaccctgacgctgtgggagaccgcctccgagcggcgaggtctgccgctgccgccgcagagcgccatggccgatgtcggccggatcctgtcggccgcggcggaggtctgctcggccgacgagtccatcgtggcgcacggtgaggacgaggaacggtgcggccgaaggaacgacgccctggcagctgcccaccgagccctcgccgacgtgaaggaacacctgcacggtcagcgtcccgacgtcggggccgcgctcggcagcctgaccgccgactgccaggcgctgctcgacgacctcacccccgacgcagcggaagcgggggttccgcccgcccgtgcacgacagagagagggacccctttgatgccgtcgcccctggacacgcggttggacaacctgctccggccccgcggcgcgacggggcgcgtcctcgtcaccggctggttcagcttcctggacggcgaggtcaccgccggtgacgctctcgcccaacgggccgtctcggcctcgctcgaccggctggggatcgtgcacgacacggcctggagcccagtattcgtcccagccgggctgagcctggaggaggcgctcccgtcgcgttatgagcagctcctgttcgtgtgcggcccggttcacggcgcaccgttcacacggcttcatgagcgtttcgcctcctgtcgtcgcgttgccgtcggcgtgagcgtgttggaccccgagagcccggcggtgcgaggttttcaccacgtcctggcccgcgacggcccgaaagccgccgcgctgccggacctcgcgacggacgcgccggccaccgctgccgctcccgtcgtgggggtggctctcacgtacggccagggtgagtacggcgaccgccgcgcccacgatcgtgtggccgaggtcctcctcccctggctcgcccgtcaggactgcgcgcggatcgacgccgacacccgtctggcccacgacgactggcgccattgccgcacgccggatcagtacctctccctgatcggacgtctcgacctcgtggtcaccgaccggctgcacggcctggtgctcgctctgcgggccggggtcccggtcctggcggtggacccggttctgggcggtgccaaggtcacggcacagagcgggatcctgcgctggccggcgatggtgggcagtgagaatctgtccaccgtgctgctggaccactggtggaactggtgtctgtccccggcgggcagcgcagccgcacgtcgacggagtacacgcctttcccgggtgtccggccggccgatggagacccggggaacctcacgtttggctgcgggcgacggtggtacccgcccgacgcccggaggggaagagagctccggcccctcaccgacaccgcccatggaggagacatgaccgacgacagcgcccaggtcgccccggtcgccctggtgaccggggcggactcgggcatcggcagagcggtcgccgtccggctcgctcggcaggggatggacgtgggcatcacctaccaccgtgatcgtcagggcggcgaggacaccgccgccgaagtccgcgccgccggccggcgtgccgcgatcgcccggctggacctcaccgacccgccggtcgccgccgacgtggtggatgccgtggcggacgagctgggccggatcgacgtactggtcaactgcgcgggcaccggcacatccacccggttcgtcgacctggaccacgccacggtgcagcaggtcatcgacgtggacctgatcggccccttcctgtgctcgcagcgtgcggcgcgccgcatgatcgcccagggggacggtgggcgcatcgtgaacatcacctcggtgcacgagcaccagcctcgggtcggtgccgctccctactgcgccgcgaagggcgggctcggccttttgacgcaggtgatggccctggagctcgccgagtacggcatcacggtgaacgcggtggcccccggggagatcgcgacgccgatgacaggtcaggaggacaccgacgtggagagcgtcgcccggccgggcatcccgctcgggcggcccggcgacgcccgggaggtcgccgcggtggtcgccttcctcgctggaccggagtcgtcctacaccaccggagcctcctgggcggtggacggcggaatgctgcgcatgggcccccaggcgggctcccacctgcgttccgacgactggcgccgtccctgacacgtccgctcccgcccgcaccacggaggaaccatggtcgacagcactctcccgctccttctccagggttacgcctggcttcccgaccgcaggcgccgcagcggcggtgcgcctgtgcgtacacgtctcctgggcaagaaggccatcgccctccacggcccggccgcggtgcggttcttctacgacgaaaggcacatccggcgccacgacgcgctgccgcaaccggtgatcgacacgctgttcggccggggtgcggtccacacgctggacggcgagcgccaccgggtgcgcaaggctctgttcaccggtctgctcaaggacccgccgacggtgcgcgacctctcgcggcaggtgggcggagaactggaacgggcgcggccggcttggtcgcgcaaggaccgcgtcgtgctcttcgacgagttggcgaaggtcctcacccgcgccgtgcacacctgggccggtgtgcccctggacgaggacaccctgacgcgcacgtcgcgcgacctgatcgccatggtcgacggcttcgccgccgtcggcccccgccatctcgcggcacgacgggcccgcggccgccaggaggaacggctggcgtcgctggtggaggccgctcgtgctgacgccggtccagacggcggcggccccggccccacggtgttccggacgatcgcggcacaccggaacgcggacgggtcccccctcacgccgcgcaccgccgcggtcgaattgctcaatgtgctgcggccgacggtggccatcacctggttcgccgtgttcgccgcgcatgcgctgcaccgtcaccccgaacaccgggagcccctggcaggcgacgacggcacggggttcgcgtgggcgttcgcccaggaggtgcgccggttctacccgttcgcccccttcgtgggaggcctggccgccgagcggctggagtgggccggacagacgatcgcccccggcacgatggtgctgctggacctgtacgggctcgatcacgacgcggatctgtggcccgagccctatcgcttcgacccgtcgcgcttcctggcgggccctgccccggcagacgcgctggtcccccagggcggcggcccggtggacggccaccgttgccccggggaagacgtgaccgtcgccgtcctcgcgacggtggcccgtttcctggcgcggctgccgtacgtcgtcaccgagcaggacctgcggattccgctggggaggatcccgacggctccccgcagcggattcgtcatcagcgaggtcgcggcaccgtctgccgcaggttccacggacatggcgaaccgcgcctgacccgcacgagcgtgcccccttcgtacggctgtaacagctctgcacgagcaggccgccgatctgtgtgccggtggcggatggatcggggtacggcgactccgtgccgcgcgggatgcacggagtcgccgtacggcgctcgtcagaccgcggtggggaagcgctcccagacccggtgtgcggccagcagttcggcgatccggcccatgacggtgtcgggactgtcgccgatcaccacgccgggccgggtggcgggtgccccggccgcctccagcacgccggcgacctcgccccagccgccgacggccttcccgtgccggaacgcctcggacagaagcagcagaacgcgaggatcggtcgtcacaccgttcacggcctccggcccggcggccttcgcgtcacgggcgccgtacgcgtcgtccccccgtccgggggcgcccgccaggagcaccgcgtcgaactccacggagcgggcgttggcgaacgtccgctgcacggtgaccgggtcaccgtcggcatcgagcactccgccctgcggagcgatgaccaggggaaccatgccggcacgcagcaccgcctcgcgcaccgagcggacacctgcgagatcgccttcccggtccgtgacgatgccgacgatgcgcccgtccgtgggccaggtctcgcccacctgcgacagtgccgggctgggttccggcgagcccaacggttccgtggcctgcggaacgggcagaccgagcccggtcgccacctgttcgcagagcacggggtcaatgttggccagtaccttcagggcccgctccttgacggcctgctcgtaacacttgctcagctcgaaggtgtaggcggcgatgatgtgctcctgctccaccggtgtcatgctcagccagaacagccggggctgggtgaagtggtcggcgaacgaggccggggccgcgcgccttctgctcgccccggacaccgtgaccggagtctcgatgaaggctcccgtgtccgccccggcgagaaacgggcagccaccgtcgagtgagttggggcggtacggtgcgacgccccggtgaaccgcgctctggtgcatcccgtcccgcagcatgtcgttgaccggcgtgtgcgggcggttgaccggcaactgggcgaagttcgggccgcccagccgggagatctgcgtgtccaggtacgagaagagccgcccggcgagaagcgggtcgtcagtgacgtcgatgccgggcacgaggtggccgacgtggaaggcgacctgctcggtctcggcgaagaagttcgacgggttggcgttcagcgtgagcagaccgatcggctgcacaggagcaagctcctcggggacgatcttcgtcgggtccaggaggtcgatgccctcgaacgtctgctcgggggtgtcggggaaggcctggatgcccaactcccactggggaaaggctcccgcttcgatggcgtcggccaggtcccggcggtggaagtcggggtccacaccgttgatgatctgtgcctcctcccagaccagggagtgcacgccgagcttgggcttccagtggaacttcaccagggtcgtggagccttccgcgttcaccaggcggaaagtgtggacgccgaagccctccatggtccggtacgaccgggggatgccccggtcggacatgttccacagagtgtgatgagctgcctcggtgtgcagggtgacgaagtcccagaaagtgtcgtgtgcgctctgcgcctgcgggatctcgcgatccgggtgcggctttccggcatggatgatgtcggggaacttgatcgcgtcctggatgaagaagacggggatgttgttgccgacgagatcgaacacgccttccgcggtgtagaacttcgtggcgaaaccgcgcgtgtcccggacggtgtcggccgatccacgcgaaccgagtacggtcgagaaccgcgtgaagacgggtgtctcgacgccgtcggcgaggaacgcggccttcgagacgccggtggcggtgccgtagcccacgaacacgccatgtgcggccgcgccccgggcatggaccacgcgctcgggaatgcgctcgtggtcgaagtgtgtgatcttctcccgcaggtggtggtcctgaagaagcaccgggccccgctcccccgccttgagcgagtgatcggtgtcgtacagacgagcgccctgggcggtggtcaggtaggcgcccgactgggccatgccggcctggtcggcggcgaggtcctggccggtcgggctcatcgtcgccgggccccgctggtcgtgcttgggcggcagaggctcccgcggccgggtgggctcgtcgaccggaggcgactgccgggccggtttgccggggaccccgccctcgggtgatgaggagacgcccaggacgcctgcggccttctctgcggcggctttcagagggttcttgtcgctcatgacaactccggatgtgaaggggaagtcgcaggcgggtgaggtgacatccgccgtaccacggaatggctggagacagacgggccgccgagtacccgagccgcccctcttcacacgggtgaacttcctcgtacgctcgaccgggtcatccagagcgcgggcgtccggtactcgcgggcttctcccctgccgacggttcgggtgccgtgtgctcgcggatacggcggcaggactccgagatgaggcgggacacatgcatctgggacacgcccagttccgcggcgatggcgctctgcgtcaggtcggcgaagaagcgcagatagagaacgcgtttctcgcgctccgccaggcagaggatgcccggcctcgccgcttcgcggtcgagcaccaggtcaaaggcctcatcgacggcgcccaggctgtcgccgagcagcgcgtcgccgtctccggcggcgatctcggcgtcgatggacagggcactgaagccgtgcagtgcctcgtttccctggcgcacctcgtcctcgctcaggccggtgtgctcggcgacctgggagagcgacgtcgggaggccggcggctgccagttcggctctcgccaggcggacggtgttgcgcaggttctggatcctgcgagggacgtgcacggtccacatgcggtcgcggaagtgccgcttgatctcgccggtgatggtggggatggcgaagggcgcgaaggcgggggtgacagcggggtcgtaacggtcgacggcgttgacgagcccgacggccgcgacctgccgcagatcctccagggtctccccacgatcgcggtagcgggccgccagacggtgtgccatcgggagccaggcacagatgatcctgccccgcagatgttccttgaccggcccgtcggacagtccggcgagccgccggaagtccgccgccgtgtcggggtcgtcggcataccggctgtcgacggccatgggccttctcactcctcgccgttcagggatcgatgacaccgggaggagcgtgcgggaagtggcggacatacccgtgcacgtccccatgacatccgtcgccgggacgtgcctcacctccaaagcacatggtggccctgcccctcggcgggacccccgaatcgcatcggccgactcgaccacccggccggtcgacaccgatcaggctgtcggcccaggcggaggcacccgccttccgttccggagcagagaggtgcgctgatggccggctcagcgggcacgcgtgtggctgatcgcggtgtgcagggcgcggcgtgtcgccggcggcaaggggctgccgtgaaagctctcgacgagttggtgcgcgatgtcccgcaacttgatgttgctgttctgggacgcggctacgagtacgtcccaggcctgtcggctcgtacagggtgtcgaagcgatgaggatgccccgggcgatgtcgatgacgggccggctgctgagcgcggcccgcagcccttccagctcgctccgcagggcggcgcagtccacccccggcgggcctacggtctgcgcgtgtcctccgcggcccggcggcgctacccgtgtgccgtggtcctgttcgagtggttccggcacctctggttctccttcctgcgcatcccgccccctgtccacagtgcgccccggcgagcagccgggggccctaacggagttcgtcacggcgggcgctccggaggtgggtcgggccccctgcggggggcgacgcaggggccccggggcaggtgcggctcgtggggcgagcacacccgccggtgaaccccggacacggcagcggccatggtggggttctacccgcggctggctgacttcttcgcccggccgactgttcggtggaaggacggaacggtgtgcccggtatgtccttccaccgcacggagcataggcagggcccgggagcacgtcgaatccaacacgcggccggaatcggctcctgccttgaaggatcgttccgcctgacggctgttgccaggaccgccctgtctggttggagtcgcagcctcgtcttctggctcggcggcctctggtgccggtgtgccgcgttgtcgccggacgacacgcctcggggcatggccctgaaagtcctggtccgcaggtcccgcagcaaccagtccggcacgacgtcgtgcggtgccgcgggcggcgggacgaactgatcggcgcggttccccacgaacgtgggccatgtcgagcatcacggcgcgcagtccggggcccggctccgacggcgcgctgagggctgtcagcccacgtagcgccgggcgaccgacgtgcgccgagcgcgctccagcgcccgcagtcgctcttcgagatcggggggcaccaccgcacgctgacggaggacccagggcagtcccgccgccgctcgggcgaatgcccgcagggaagccccgtcccgggggacggtcttcagcaggtcggcggtacggcgcaaggcggagggccaaggacggcggagccaggtgaaccacagggtgttccgcactcccaggatccgccgtgcggtgctgtcccggaccggagaggccgcatggtggatcaacagctcgggcacatagctgagccaccatccctgccggagcagatcggtggccagcagctcctcctcgccgcccagccacaggccggggtggaagccgccggcggaccggaaggcgtcggtgcgcatcacggtggcggcggcgaggaacgatccgagagcgggccccggaagccacgcgggcccctccagcggtgaatcccgcagctcggtcacgatggggtcctcctcccccgacggttcgacgacgatgcgtgcggtgaccgcagccagcagcggcaaccggtcgaggaggtccgccgcgtgccgcagcgagcccggctcccaccaggtgtcgtcgtcgcagaaggccacgtagggagtgcgtacgtgctcgaccgccaggttgcggccgactgcgccgaggttgcggcccggggtcaacaggaccatgtccgggaacaggcgtgccaccgcctcagcggtgccgtcccgggagtcgttgtccgtgacgacgacctccggagcctccggcagcgcacgcagggcccgcagcgtacgcaggagctcggggcgacggccgtgggtgatcaccacgaccgtgatccggtcgtcgctcatgcggccgttcccctctccccagcgctgctgaaacccttcctcgtcgcgcgggcgtgtctttccagcacccgcacgcgctgttcggtccgcggcggcagcggacgccgctgccgtacggcgcgaggagcgcggatcagcgcccctcgcagcgccttggcggccccgtcctcgcgcaggaacgtggcgacgcccagctccagggtgtgtcgcagggccacgtgggccggtcggcgcagccaggcggtgagcagtgcgttcctgcggaggagagcgattcggccaggtcgtgcgcccgggtcggggtgatggtgggcggtcaccgaggcgtcgtaggagacgccccagccggcggctgccaggtcgtaggcgaggagggtctcctccgcgccgaagaagagcagcgggtgataaccgccgacttccaggtatgcctgcctgcgtacgacgcaggcacagccgaggaagcccagaacggggcggcccggcaggccgggttcgggtgggagcggcgaatgcgccagcaggtcgttcagcgggtcctcccgctcgtcggggcccaccaggctgcgggccgccagcaggcccaggtgcggataggtgtcgaggaggtcggcggcgcgccgcagggagccggacccccaccaggagtcgtcgtcgctgaaggcgacgtacggagtggtggcgtggcgtacggccaggttgcggcccagcgctccggtgttgcggccgggctccagcaccctggcgccgacgcggtgggctcggagagcggcggtcaccgcgggatcgtctccgttgtcgacgaccacgaccggcggccgttcgggcagctcggccagtcggtcgagggtgcgcagggcgcctgccgcccggtttctggtgatcatggcgacggtcgtccgggcgtcggcctgtgccgcgagcccgcgggagcgctcacccacggcggttcacctccgcgaacccggtcggcgcgtgccggttctccgcctgcccgcggcggacctggcgcaggacggatgcgagcac

SEQ ID NO: 3289 - DNA, 15247 bp, Unknown
  Kingdom: Bacteria, Phylum: Actinobacteria, Class: Actinobacteria, Order: Streptomycetales, Family: Streptomycetaceae, Genus: Streptomyces
acatcgccctgcgcggcggcgtcgcaccggtacgcgcgtacataccggagctgctccccgacgtgctggacggcacgatcgatccgtcgcccgtcttcgaccggtccatcggcctggacgaggtgcccgtcggctaccaggagatggacgagcggaccgcgctgaaggtcctgatcacgccgtagtgccccgacacggggcgagggcccgggtagaacgttctccccgggccctcgcctcttgctcggtcactgcctaccagcgcaccgcgtccagcgcgtcgaccactccggccccgtagaagccgttgtagctcttgccgccctcgcagaccgcgtcgatgacgccgtcaccgttgatgtcgtacggctcaccgcacgccttcgcgtccgcctggatcgtcagcagcgccttcaccgcggccggcgaggcgtaggggtgcttcgacttgatcagtgccacgacgcccgcgacgtgcggggacgccatcgacgtgccggccttgtagccgaacttgccgcccggcagcgtcgacaggatcagcccgttgacggccggcggctcgggggtctggtagaccgtcgagtcaccgcccggggccgccacgtcgatgacgcccttgccgtagttcgagtacgaggacttcaggcccttcgcgcccgtcgctgagaccgtcacgacacccggcagcatggtcgggatgtccgggcacgcgctcgggtcgaccgtccgcgtgaccgtctcggtgtcgttcgggctggtcgtgtcctcgatcgcgtcgagcgccaggtcgtggcgggagttcccggccgccgcgacgttgaccgtgcccttgcgctccgcgtacttcacggcgcgggtgagggcgtcgaccagggcgccctggtccgggtcgttcttgcagttgaacagccacgggtcggtgtagtagctgttgttggtcacctcgacgccgtgctcggcggcccagaggaacccgcagacgacggcctcggtgtagaagaacccgtccgggttcgacaccttgatgcccgacaccttcacacccggggcgacgccggtgacgccggcgccgttcttcgcggcggcgatggtgcccgccacatgcgtgccgtggtcgctctcgcccgccgccggacgccaggagccggcggtggtgtccggagcgcccgacacgcagttggccgaggcgccactgtcgaagttcggggccaggtccgggtgggtgtcgtcgacgcccgtgtcgatgacggcgaccgtcaccttcttcgagcccagcgtcttctcgtgtgccttgtccgccttgatcgcgggcagcgaccactggaggggctccagcgggtcctcgccggccttcgcgtccgcggcggcggccgccgcctgctcggcggtgagcggctgggctatcgagccgacgtccttggtggcctgcgggacgatcgggttcgtacgggtggcgcccgccgactccacgccatgtacccggcggatcgtttcgccgaaggccgggttctgcgagtggacgacgatgacgccgatctgctcataggcgatgacgacggtgccgccggccttggcgatcgctttcttgacgttcttgacggtgccgtggccgccgcgggtgttgaccacgtaggacagcttcggcccgtcggttcgcacactcgcggaggtctgctcgccggtgggcgccgccgtggccgtcgccgtcggcaggaagccgagcgaggcggtcagcgcgagtccgacggggaccgcgagtgcgcgggtccgtctcgatgccagatgagccatgggttctccacatcatccgtgccgaacgaccggacacctggcgtgttcggtcgcgtacatgacgagtgaagctatcgctgatcatcccggcgcatcaacgcttacgggcaagtgagttcgaagagtgacctgtgcggccgaatgtggacgggtggcttccgggcaaccggacgcaccgcgacacctccgagaaggcgaaagacacggtgaaccgcttcgtcgcgccctccgtgccgttgtccaggaggcacaacaccgtccccccggtaacgaggcttcccatgacacccaccgtcccccagaccaccgcacccgcgtcgcgaggagattccgtggctaccgatgcaccgccgcccgagggcggttcgcccaccggccccgtccagcccaccaccgaggcgttcgtcgcgatgcaggcgagcccggagttcgccgacctgcgccgctcccaccgctccttcgccttccccctgaccatcgccttcgtgacctggtacctgctctacgtcctgctctgcaactacgcgggcggattcatggccaccgaggtcgtcggcaacatcaacatggcgctcgtcctcggcctcgcccagttcgccaccaccttcctcatcgcctggctctactcccggcacgccgccaccaagctcgaccccaaggccgaagcgatcaagtcccgtatggaggccgacgtatgagcgccgcccacgccctctatcccgccgtccagctcgccgccaccgagggcgcgagcgagcaccggccgctgatcatcacgctgttcgccgccttcgtcgtggcgaccctcttcatcaccgtgtgggcgggccgacagaccaagagcgcctccgacttctacgcgggcggccgccagttcaccggattccagaacggactcgcggtctccggcgactacatgtccgccgcgtccttcctcggcatcgccggagccatcgcgctcttcgggtacgacggcttcctgtactccatcggcttcctcgtcgcctggctggtcgccctgctcctggtcgccgaaccgctgcgcaactccggccgctacaccatgggcgacgtcctcgcctaccggatgcgccagcgccccgtccgtaccgccgccggcacgtccacgatcgtcgtctcgatcttctacctgctggcccagatggccggtgcgggcgtcctcgtctcgctgctgctcggcatcaccagcgacgccgggaagatcctcatcgtcgccctggtcggcgtactcatgatcctctacgtcaccatcggcggcatgaagggcaccacctgggtgcagatggtcaaggccgtcctgctcatcgcgggcaccctgctcatcaccttcctgatcctgctgaagttcaacttcaacatctccgacctgctcggcaccgccgccagcaacagcggaaagggcgcggccttcctggagcccggtctgaagtacggcgccgacggcgtctcgaagctggacttcatctcgctcggcatcgccctggtcctcggcaccgcgggtctgccgcacatcctgatccgcttctacaccgtgcccaccgccaaggccgcccgtaagtccgtgaactgggcgatcggcatcatcggcgccttctacctgatgacgatcgtgctcggcttcggcgccgcggcgatcctcaagccgggcgacatcatcgcctccaacaaggcgggcaacaccgcggcgccactcgccgcactggagatcggcggcggctccggatccaccggcggagccatcctcctcgcggtgatctccgccgtcgccttcgccaccatcctcgccgtcgtcgccggactcaccctcgcctcctcctcgtccttcgcgcacgacatctacgccaacgtcatccgcagggggcaggccaccgagaaggaggaggtccgtgccgcacggtgggccaccgtcgcgatcggcatcgtctccatcggcctcggcgcactcgcccgcgacctgaacgtcgccgggctcgtcgccctggccttcgcggtcgccgcctccgccaacctgccgacgatcctctacagcctcttctggaagcgcttcaccacgcagggcgctctctggtccatctacggaggtctcgcctcctccgtcctgctggtgctgttctcgccggtcgtctcctccaagccgagctcgatgttcccggacgtcgacttcgcctggttcccgctggagaaccccggcctgatctcgatcccgctcggcttcctgctcggctgggtcggctccctgctctccaaggagaagcccgacacggacaagtacgccgaactggaggtcaagtccctgaccggcgtcggagcccactgagcacaccggaacgggtccgttcggatcgtcaccgacgggtccttcggctcatcacccaccgtcggcggccgggccgcgtcgtagagtcctacgacgcggcccggccgcgcctcgtggcaaacgggccaccccgatgtcagcggtctcacgtaggctcggtagtaccggaaccccgaagggccgacgtctcggacgaggcgaccgacccggccaggggcgaaggcccgaagaagagcgaccgcaccaccgcggacacaccgggggaggggcccaccgtgctcatcgacacctacgaccgggtcgccaccgacctgcgcgtgtcactcaccgacaagtgcaacctgcgctgcacctactgcatgcccgaagagggccttcagtggctcggcaagagcgaactgctctccgacgacgagatcgtccgcctgatccgtatcgccgtcacctcgctcggcatcaccgaggtccgtttcaccggcggcgagcccctgctgcgtcccggcctcgtctccatcgtcgagcagtgcgccgcgctcaccccgcgcccccgtatgtcgctcacgaccaacggcatcggactcaagcggaccgccaccgccctcaaggccgcggggctcgaccgggtcaacgtctcgctggacaccctgcgccccgacgtcttcaagaccctcacccgccgcgaccgccacagggacgtgctggacggcctggaggccgcccgcgaggccgggctcaccccggtgaaggtcaactccgtgctgatgccgggactcaacgacgacgaggctcccgagctgctcgcctgggccgtcgcccacgattacgaactccgcttcatcgagcagatgccgctcgacgcccagcacggctggaagcgcgacggcatgatcaccgccggggacatcctcgcctcgctgcgcacccgcttcaccctcaccgccgagagcgacgagtcccgcggctccgcccccgccgagcgctggaccgtcgacggcggcccgcaccgcgtcggcgtgatcgcctccgtcacccgcccgttctgccgcgcctgcgaccgcacccggctcaccgccgacggccaggtccgcacctgcctcttcgcccgtgaggagacggacctgcgcggggcgctgcgcggggacgcgccggacgaggagatcgcccagctctggaagacggccatgtggggcaagaaggcgggctccggactggacgacccgtccttcctgcagcccgaccgcccgatgtcggcgatcggcggctgaggccccggcggccgaggctcaaggtcccaggaccccgaggctcaggccccggtctctttcccgtccccggatccccactcctccagcgccacgacgtccttgaggaaaccccgtacaccgaggaacgaggacagatgctcccggtgttcgccgcaggccagccaggttttgcgccgctcgggcgtgtgcagtttggggttgttccaggcgagcacccacacagcggcggcccggcagcccttggcggaacagagcggggcgccggtgggactctcggcggacgtctcgggaaaaatcacgtgacccagcctaagtcaggtgctcaacgagctttctgacgcatccccggtcggagaaagggcgacgccgagcagccacggggggagctgcccggcgtcggtccgtcgctccgacgggggatgcggagcgccttcgaagtatgtcacggggaccggggtgcggtgcaccggaacgtcatgattgatctgagcttttcttgagcttcgcgggacgtgcgggtttaggtgtgctcgtgcggcggccgggccctgccggacgcgccgtcggagtccccggactccgtgggaccgggcaccggggaggcctccagagcaggccgcaacggcatctgcacgaacgtcgtcggcagcgaagtcacgttctcccggcccgcgttggcgatgaccaccgcaatgtacggcagcagcacccccagcacgagcgccacgatcgccacatgccgctccacgttccacagcaccgcggccagcaccaccgacaccgtgcgcaccgacatcgagatcacatagcgtcgctgccggccgcgaacgtcgtccgtcagtccctgacgggcgcccgtgatccggatgacctccgtacccgcgctcttccgtgccatgctccaccaccagatctcgtcgccgggcgctcccggaccggccgcatccacggtacgcccggcaccggccgggcaggcgaccggggcggccggacgaggaggagcggggagagccgggggtcccccggacggcgcaaccgggcatgcgccgcccggacggtgggccgagactgggtggacgcgcactccgcgccgtacgaggaggcgaaatgagctggttgtgggcaatcatcgtggggttggtgctcggtgtcatcgccagagcgatcctgccgggtaagcaggacatcccgctctggctgacggccgtgttcggcatcctcggcagcatcctcggcaacgccgtggccggctggatcggtgtggaggacaccaagggcatcgactggatccgtcacctgctgcaactggcgggcgccgtggcggtcgtcgccgtcggcgacatggcctggcagtccttccgcggcagccgcaaacagcgaacctgacccaccgggccaccacagggccgaggtcagcacacgccgcggccggacacgcgagcaaagcgtgtccggccgcggcgctgtgctgcgggcggtcggtgaagcggcgtaccgggctcgcggtgtgcagttcccggactcagactggaagggaggacgtttcttgctgttccttcgacagatgagcgaggaggaaccatgacagcgacgacgcggaaggacactcctgtcgtcatcgaagacggcggagtggagctgcgtgttcaggacttcggcggagacatgtccgtcgcgttcgtgaagtttcccgagggcaccgacatgggtccggctctcaagggtctggccgacgacctctgcccgtgcccgcactggggctatctcttcaagggccggctgaagatgcggacgcctcacggcgacgagatctacgaagcgggtgaggcgttctactggccgcccggacacgctccggtggcgcttgaggactgcgagtacatcgacttctcgccggccaaggagttcgacgaggtcgtcggccacatcaaggcgcaggcaggatgacggacgtcacgtgaggaccggccggcgcgccacgtgacggacacggatcgcaccaggccgaacccggccctgccgcggcagggcacccgagaaaaggtgtccggccgcggcacggtgacgcggtggagggtcagcccgccgggctgacttccacggccgccaggttcttcttgccccggcgcagcaccagccagcgcccgtgcagcagctctccggcggacggtgcgacctcgccgtcgacgaccttcacgttgttcacgtaggcgccgccctccttgaccgtgcggcgcgcacccgacttgctgggcgccaggccgacttccaccagcaggtccaccagcggacccagctcggagacggaggcgtgcggcacctcggacagggccgcgctcagcgtcgcctcgtccagctcggccaggtcaccctgcccgaacagcgccttcgacgccgcgatgacggcggcgcactgcgcaccgccgtgcaccagcgtggtcagctcctcggccagcgcgcgctgcgcggagcgggcctgcggccgctcctcggtcagctgctccagttcctccagctccgcacggctcttgaagctgaggatgcgcaggtagcgcgagacgtcccggtcgtccacgttcagccagaactggtagaacgcgtacggcgtcgtcatctccgggtcgagccagacggcgccgctctcggacttgccgaacttcgtcccgtccgccttcgtcatcagcggcgtcgccagcgcgtgcacggcggcgcccggttcgagccggtggatcaggtcgatgcctgcggtgaggttgccccactggtcgctgccgccctgctgaagggtgcagccgtgccggcggtacagctccaggaagtccatgccctggagcagttggtagctgaactcggtgtagctgatgccctcctgcgactccagccgccgggcgaccgagtccttggtgagcatcttgttgacccggaagtgcttgccgatgtcccggaggaactcgatcgcggacatgcccgcggtccagtccaggttgttgaccatcgtcgccgcgttctcgccctcgaaggacaggaacggttcgatctgcgagcgcagccgggccacccaggcggcgatcgtctccggatcgttcagcgtgcgctcggcggtgggccgcgggtcaccgatctggcccgtcgcgccccccaccagggcgagcggcttcagcccggcctgctggagccgccgcatggtgagcacctgcaccaggtgccccacatgcaggctggccgcggtcgggtcgaaaccgcaatagaaggtgacgggaccgtccgcgagagccttgcgcaatgcgtcctcgtcagtggactgggcgaacagcccgcgccacttcagctcgtcgacgatgtccgtcacggtccggtgctccttatgactggcagagatgctggtagagatgtacgggtcagtctaggcgggtcacactcccaggctgaccgagctcatgttgaagtccgggatgcgcagcgcgggcatcgcggcccgggtgaaccagtcgccccactcgcgtggcagcgtcttctccgtacgccccgcctccgaggcccgggacagcaggtccaccggcgactcgttgaaccggaagttgttcacctcgccgaccacctcgccgtcctcgaccagatagacgccgtcccgggtcagcccggtcagcagcagcgtcgcggggtccacctcgcggatgtaccagaggcaggtaagcagcagcgccggccccgacgtcgcggcgaccatctcctccagggaccgctcgccgccgccgtccagcagcaggttgtcgatgcccggggccaccggaagcccggtcaggcccgccgtgtgccgggtcgtcgtcagccgctccagcttcccttccctgacccagtccgtcggggccagcggcagtccgttgtcgaagacggaaccgccgtcaccggaggagtgggcgatcacgaacggcgccgactccagacccggcgcgtgcggatcgctgcgcagggtgagcggaagcggggagagcgtctcgcccagccgcgtaccgccgcccggcgtggagaacaccgtccggccctccgcggcgtcccgcgcggtcgacgaccagagctggtagatcagcaggtccgccaccgctgccggcggcagcagcgtctcgtaccggccggcgggcagctcgacgcgccgctcagcccagcgcagccgctgcgccagctccgcgtccagcgccgccgggtcgacgtccttgaagtcccgggtcgcccggcccgcccatgtggagcgcgtccggtccggcgacttcgcgttcagctccagggtcccgttcggctggtcgtggcgcagccgcaggcccgtcgacgtccccaggtaggtggaggtcagctcgtggttcgcgaacccgtacagctcgcggcccccggcccgggcgcgcgcgaaggcgtcgcccagcgccggggcgaagccggcgaagacctccgagccggtctcggcgggcgcgtccgtgaagtcgggggaggcgggtaccccgctcaccagcggctgcgcgtcctccgccggacccgcgccccgggcggcggcctcggcggcccgcaccagcggctccaggtcgtccgtggtcaccgcggaccgggagacgacgccggacgccgtccccttcgcgccgtccacggtcgcgatgacggtcagggtccgcccccgggtcaccccgttcgtggtgagcgtgttgcccgcccagcgcaggttcgcggacgactgctcgtcggcgatgaccaccaggccgtccgtggtggacagctccagagcccgctcgacgatctcgtacggcttgctgacgcggctcatcgtccggcctcctgcgtcgtgtcgagactgtgcctgcccgggggacgacccccggacccccagccggttccgtggtcgcggctcatcgtccggcctcctgcgtcgtgttgaggatgttgacgccccggaagagggcggaggggcagccgtgcgagaccgccgcgacctggcccggctgggccttgccgcagttgaaggcgccgccgagcacatacgtctgggggccgccgaccttctccatcgagccccagaagtccgtggtcgtcgcctggtacgccacatcgcgcaactgcccggccagccggccgttctcgatgcggaagaaccgctgcccggtgaactggaagttgtagcgctgcatgtcgatcgaccaggaccggtcgccgaccacgtagatcccgcgctccaccccgccgatcaggtcctccgtcgacagccctcccgggtccggcttcagggacacgttcgccatgcgctgtacggggacgtggcccggcgagtccgcgtacgcgcagccgttggagcggccgaggccggtcagcttcgcgatccggcggtccagttggtagccgacgagcgtgccgtccttcaccaggtcccacgactgcgcctcgacgccctcgtcgtcgtacccgatcgtcgcgagcccgtgctcggccgtgcggtctccggtcacgttcatcacgggggagccgtacgccagcttgcccagctggtcgaaggtggcgaacgaggttccggcgtacgccgcctcgtaccccagcgcccggtccagctcggtggcgtggccgatcgactcgtggatggtcagccacaggttcgacgggtcgacgaccaggtcgtacgcccccgcctcgacgctcggcgcgcgcatcttctcggcgagcagcccggggatccggtccaactcgtcgtcccagtcccaaccggtcccggtcaggtattcccagccccggcccgccggcggcgcgatggtccgcatcgagtcgaactcaccgctcgtgccgtccaccgccacggcggtgaactgcgggtggatccgcacccgctgctgcgtggtgacggtgcccgcggtgtccgcgtagaacttgttctcgtgcacggtcatcagggacgcgtccacatgcgcgacgccctccgcgcccagcagccgcccgctccactcggcgagcagggccgccttctcctcgtccggtacggagaaggggtcgacgtcgtacgccgatacccaggtccgctcaccgtgcaccggctcgtccgcaagctccacgcgctcgtcggaacccgccgccgcgatcaccttcgccgacagcttcgccatcgcgacggcctgcgaggccaccttcgcggcggcgtccatcgtcaggtcgacgcccgaggcgaacccccacgcaccgccgtgcaccacgcgcaccgcgtacccgaggtccgtgctgtccgacgccccggccggccgggcgtcccgcagccgccaggaggcgctgcgcacccgctccagccggaagtcggcgtgggtggcgccgagcgcccgcgctctggcgagcgccgcgtcggccagcgcgcgcgacggcagggccaggaatgactgatctacctcgtggggcacagggagttcccttctcgatacaccccggcagtgaaccacgcctgagggtgaccgcaccgggggatatcggagacgcgtgggccgaccacgtacccgcgcggactgtaggaacccgacagcaccccggacaagccactgtcagggcccgattcctcgatcggcgcacggtaccgataggttttcgacgtaccagaccgccaaggaaagggtgatccgttgagccgctcggttctcgtcaccggaggaaaccggggcatcggcctcgccatcgcccgcgccttcgccgacaacggcgaccaggtcgcgatcacctaccgttccggagagccgccccaggtcctcaccgaagccggtgtcctcgcggtccgctgcgatatcacggacgtcgagcaggtggagcaggcctacaaggagatcgaggagaagcacggtcccgtggaggtgctggtcgccaacgccggcatcaccaaggaccagttgctgatgcggatgtcggaggaggacttcacctccgtcctcgacaccaacctcacggggaccttccgggtcgtcaagcgcgccaatcgcggcatgctgcgcgccaagaagggccgtgtcgtcctgatctcctccgtcgtcggcctcctcggctcggccggacaggccaactacgccgcctccaaggccgggctcgtcggcttcgcccggtcgctggcccgtgaactcggttcgcggaacatcaccttcaacgtcgtcgcccccggttttgtcgacaccgacatgacccaggcgctcaccgaggagcagcgcaagggcatcgtgtcccaggtgccgctcggccgctacgcgcagcccgaggagatcgccgccgcggtgcgcttcctcgcctccgacgacgcgtcgtacatcactggagccgtcattcccgttgacggcggattgggcatgggtcactgatcaccatgagcggaattctcgacggcaagcgcatcctgatcaccggggtgctgatggagtcgtccatcgcgttccacgccgcgaaggtggcccaggagcagggggccgaggtcatcctgacggccttcccccgccccaccctgaccgagcgcatcgccaggaagctgccgaagccggccaaggtcatcgagctggacgtgaccaaccaggagcacctggaccggctggccggcctggtgcgcgaggagctcggctccctggacggcgtcgtccactccatcggcttcgcgccgcaggacgcgctcggcggcaacttcctcaacacgccgttcgagtccgtcgccacggcgatgcatgtctcggcgttctccctgaagtcgctggccatggcctgcaagccgctgatgagcgagggcggctcgatcgtcggcctcaccttcgacgcccagtacgcctggcctcagtacgactggatgggcccggccaaggccgcactggaggccacctcccgctacctcgcccgtgacctgggcaaggacgggctgcgctgcaacctgatctccgccggaccgctccgctccatggccgccaagtccatcccgggcttcgaggaactggccgacgtctggaacaaccgcgccccgctggcctgggacatgaacgacccggagccggccggccgcagcatcgtcgccctgctctccgacttcttcccgcgcaccacgggcgagatcatccacgtcgacagcggcgtgcacatgatgggtgcctgaccgcgcaccacccctgagacggcccccggccgcgtaccccctcccggttctccggaggcggtacgcggccgggggccgttcacggtccgtggcctcccggtgccgctccggtcgaaaagtcggccgatccaccgcagaatgaggaggaaccggacttcttgtcaggctgcgggagggagatcgccgtgcgtcccacgcgccgccgaacccgtctcctcctggccgccccggtcgtcgtcgccgccctcgccgtacccctgggagtccacgccgccagaggagccgactccggtacggaagcggagcccccgaagcccgaaccggcgggctcggagtgccgtacgtccgtcgagggatcccgggtcgtcgcctactgccacaacccctacccctccaccgacctggtccggctgcacaccgagtgcgaccgctggtgggacgtcgacgcggacggcgcggcggtcgcggtggaacccggccggaccgtacgtcttgaggaccgctgctggaaagaggtcgccacggcctgggtcagccaccgtcccgcccccgtctgagcgggtgctcccgccgtacgtggcccggggtgccgctacacccggtcggtcaggcaggtcagcgcatggctcgccgcctcggccgccgccgtctccgcgtccccggcccggatcgcctcgaccagccggccgtggtccatatggttctccggccgcagctcgggacccacatcgccgcgcaggtagtcgcgcagcaggtccccgaggtcggcgtagagctcggtcaggacgtcgttgtgcgaggccgcgaccaccgccaggtgcaacgtcgcgtccgccgccacgaacgcctccgcgttccccgacgcccaggcctcctcgcggtgcgccatcagcgtgtccagctgccgcagatcccgctcggtgcgccgggcggccgccagccgggccgccgacgactccagtgtcgagcgcagctccgcgatatgacgcggatcggccgccgcgaacctgcggtgcatcaccccggccagctcactcgtggcgatcacataggtgccggagccctgccggatgtccagcagcccgttgtgcgcgagggcccgcacggcctcgcggacggtgttacgggccacacccagctgctcgaccagctccggctcggtcggaatccgcgagccgaccggccactcgcccgaggtgatctgattcctcagctgggcgatcacctggtcggcgagtgccgaacgccgcggagacgtcaacgccatggtgctccttgctcgtgggccgggccgggggagtgccggaccgaagagggtgtcggggccggattctcccaggaaacccgggggatcagcggacgagacggattggacaatcaatcatcccatgattctatgatgaccccatgccggacgacgagacgcaggccccgaccctgaaccgcggcgccgccgcgcgcacctcccacgagctccacgcccagcggctccccggagcgggcgacacccccgcaccgtggctgctgcgcctcatcgccgtgggactcgtcctggccgccctgaacctccgccccgccatcaccagcctcggcgccctcctcgaagaggtccgcgaggggctgcacatgagcgggagcgtggccggcgtcctcacctccgtaccgccgctctgcttcgcggtgttcggggtcatggcgccgcgcctggcccgccgcttcggcgcgggc

SEQ ID NO: 3290 - DNA, 24445 bp, Unknown
  Kingdom: Bacteria, Phylum: Actinobacteria, Class: Actinobacteria, Order: Streptomycetales, Family: Streptomycetaceae, Genus: Streptomyces
ccgagcgcggccgggcggtgcacgcctaccttgccgaccgtcacggccgcggcgtccccagcccgtgcacggcgcggattccggagcggtgggtcccggacggcttcgacctgcccgaccacgaacgcgctctgggggaagtgctgttgcgcaggcatgcggcggtctgcccgctccggtgcgtccgggacgggtcggatgtacggaccgagccacgtgtcgtccggcacgacagcgccgccgacgtcgtggtgctggccgaacccgatctgctctaccgcgacgcggactcgtgggtgtggcgcgagaccaagacttcggcgagcgaacgccgtccgaaccgttcgctcctggagcactacccccaactggcgctggccgtcctgctggtggcacggggcgacctggggggtagccccgaccgggcgcgggtcgagttggaggtgctgcgccccggcggggccgacctcgagatcatcgaccctttcgcccccacccaccgggacacggcggagcaggtggtgcggacgatggtgaccgcgtggcaccaggacgacgactacgctcccgccccgggacgttcctgcggccggtgcgaagtggcacgatggtgcgatcagtcgcccgccgccggggtcgccgcgtgaacgcgccgacggccgcgtaccgcggcgacccacccgaggcccgtgaggcggcagacgcggggaccgagcttttctgcgaactcgcccggacggtagcggcgttggccgatattcagggcctacgatcgttcaccctcccctacccgggcttcgcgcaacgcgcgcttgaccgcacggtggcgcgctgcctcgacatcgggcacacgccgccgagaagcttgccggagatgtgggagtggtgcaggagccgtacggcagccgatcccctcttcggggtcccggcctccttcgtcgcttccgacgccacgctggtgcatcccgtcggcctgatgcccacgcggacctgcctggaagtggcttctcaccgccacgccgcgggagcggacgccgaggtacgcactctcctcgacgagcttgtggcccggtgtggttcggacgagcggttccagcgatgtcgccggttcctggcgcgcaaccccgtcgtccaccaggaggaccgcttcgccgtccgcaggaacaaggcgggctggaacaacgacgcgtggaccagagtcagggagctctaccggcccgtgcccgagtatctgtacgtcgacgacgtcggcctgcgctgtccgacgtgcgggctcccggccctcacgcacgatcgcaccgttccgctccccggccaccccatggccgccgaggaggcgtggtgcgagggagaggaatgcccgcgcgacggtggcctcgaactgatcaggaagccgaagctcgccctggtgcagccgcgctcgctgcgggtgttcctcgccctgccgcaggccgtcgaggaagcggccctgagcgggttggaagcggccgggatcggctggtccgccgtatcgggaaagctgggtgcctaccggttgcgggagaccggcggcgcaaccgtggaagtacggattcgcgatcgtctggagcccggcctgctcgccgccggcatcgcccactcggcaccgtccgcggaccggacgttcgtcgtcgtgcctcagcggctcgccgaccgcgcgggataccgggcccgcttcatctccgccctgccggcttcgctccgcgagcggatggtgctgaccacccccaccggcctcgtaccgggcatccgaggagaggaccaggccgatgcgtagcatcaccccgcccttgaacgacgtgctcagcggtctccagacgtttctggggccgtccttccgcaagcccgcgctggaagcgttctgccaggtggaactcggcctgtatctccagcaggaactgatgccggactccccggcgggcagcgcgtgggtgctcttcagcggatacgggttcgcgcaggcgtacggagcaccgctgccaccggacgcggaacagacgctgcgggtcgcccgatactcgctgtggaccctgcgcagaggccggacttggcgcgacgcgctcgaccgctatcagcagttcgacgcgcgggcgcgtggctatgacgtgcccgacaccgaggctccggccgctcgccgcgagatctccgtcgcgagcgaccgctttcaggtgtacgacgggctgctgcggacggcacccccgctcgcgggcaagcgacggccggtcgcgggtcctgggccgcacgtcttcaccgtgagccgctccctggcggaggtgcatctgccgatagtgcccagcacccccgtcgtcgcccacgacctcgacatgactccggccggcggcggtgagccgttggtctttaccaggaaggacctggagcgcaccgcggcggagatggacgccgtacacgcccgagccctccgcgccggcaggacgtcggggaggccgccgcggtggctgggacggctcggagacttcgagatgtccgtcaaagagccggtcgacgccaccggcgaggcgcagagcgctttccgcaaggaccacgacttcaccttcaccatcgacagcatccagcacctcctcggcatcgtgggcgcgggcaagagcacgctgcgcgacatcatcgccgtccacctcgcgaagctcggcaagcgcaccaccgtcgtggtctccgacgtcgcggaggtgctcaagctcgtcgagacatacaacctctacaccgaaggcgcggccgcccctgttctgggatcctccggccgggagcggcacgcccagcgactgcatcgccgactggccgggcgggccgaacaccgactgctcgcccacgacgaccccgccttcgcctacctcggaacctcctgcaccctgaacgtccaccgacaggacgccaccccgtccgccgagccgctcgccttcggcgaggccccttgctcccggctgaggccgccgtccgacccgagacgcgggagcgggaaatctccctggcagaaacggctgaccacctgcccgtactggtctgtctgcccccgccaccacggggcacgcgctctggtcgacgcgtacatctgggtcgccacaccggccggtctgatcgacgcctcgccaccccgcccgcagaacggcgagcgcatccgctacctcgaactcgcctgtcgccgcagcgacctgctgatcgtggacgaggccgaccgcgtgcagatgcagctcgaccaggtcttcgcgcccgcggcggtgctcgccagtgacgaggacaagggcctcatcgacgaactgacccggcacaagatccgggaactcgcggcgagcgggcgcacacagctgtccgagggggacgtacagatcttctccgccgcgctcaacaccgccaccgccgcgacggaccggctgtacgcgatgctcgtcaccgactacgacctgcgctgctgggtccggacgggatacttcagcgcctggaccctgcagatgggcctgctcgacgaacgctatcggctgccggacggcagtggccgggagcacgagaaccatgagccccgggaggccctgggcaaacgcctcgacgcgttccgcgacaaccccttcggtgaccgggcccgcaggacggacgaggacttcggcgacctgacgggcctgctcaacgagctcctgcacacgggcaatccggagaacacccgacgcgctctggtcagggtgatggacgaggtcttccagctggacgcggcgtacatgtccgcccgccggctggactacgagcaggagcgcgccgagtgggaacggaaggaagagttacggagggaggccgcgcgcaagggccgcgcaccgaggaggaccgagccgccgaagagcccggaggactggcgcaaggaacttgctgtccggttcgagttcaccttgctgctgagcgccctcgaaccccgactcgccatgatcaacgctatgtggccgcgggtcgagtcagctctcgacctgcgctacaaccagatgtatcgtcggccgctcgactacgggccgatggtgcccgaggcgcccatgggcaatgtgctggggttccagttcagggtccccggcaaggacgagggcggagtccgcagcggggagctgaccttcttcaggtgcagtggggtcggtcgtgaactgctgcgcgcgttgccccatctggcttccgtggacggtcgccccggtgcgcatctgctcctgatgtccggcagcagttgggccggcgagtccagtcgctaccacatctgcgtcccggtcggtgtcatcatcgagccgcctcgtgaggtgaccgaacgcatcgccgccgagagcgacatgcggttcgagttcatcgatgacggtgacgagaagctgcggatgtccggcagcgcccccgaggaccgccccgaaaagctgcgccgtatcgcacggtacctgggagagggagaacacgaccttctcgaaggaggaccgttggagcgtgagctgttgtccctgcctgcgaagagggggcgcatcctgctgctggtcggcagctacgtcgaagcacgcctggtcgcggacaccttgcacaacctcaacaagcgctggcgcgacaaggtcctctgtctggtctcggacgacgaggagatcgcccccgaggacgaggcgccctcggtgaaccgcgcccgctccctgcgccggggcgacgtcgagcacctgaacgagatcgaggcggagatcctcgtggcgcccctgctggcggtcgagcggggccataacatcctcaacgacgacgcggaggccgccatcggcaccgtctacttcctggcccggcccaacccgcaccccgacgacctgtccctggccgtccacgccgtcaacgactggatggtccgcgccaccaccacgagcaccttcggctcctgggtgcgaggggcccacagcatcgaggagggcgccgacgaggtccgccgcctggcccgctcgcgctggtaccaggtactcgcacggtcgatggcctggagccgcctcgacgacgatgaacgggcaccggtcacctgggacatgctggtcctgatgtggcaggtcatcgggcggctggtacgcggcggcgtaccggcccgggtggtcttcgtcgacgcggccttcgcccccaaccgcgcggcgacgccggagcggcccgacactcccgaatccagcctcctgcacagcatcgtcgacgtgctggacccgtacttcgagggtgacgcgaagtcggcggaggagcagttcatcgcccgcgcgctgtacgagccgctgcggcgcatgctcacccgtctactcaccggccctccgcggcccgcgggctcgcaagcgccgcaccttacctctcactaggaggcagccgtgtaccgaaccattcgttccaccgcctacgaacccgacccgctgaacggcccgtggcaggaggaatcgcacgtactacggctgggcgaggacctgcacaccgagctgtcccggatgcacgccgaagccggcggggacagggcccgccccgaccggcttccggtgcgacagctcaacttcctgctccaggcgctggctcccggggtcatcgccaccggacgccacgcgggcacggacggcagcttgccctggctctacgggagggaaacggtgccgccggatgtgctggccccgctgatcagcacttgggcggcgcgcctgtcccagcatcaggacgacgacggtcccgatcttgaggaacggctgctggcggcggaggcggacccgaccgttccgatgaggctccccgagtggcagaccgagcggatcgatctcaccgagacggtcacatcggcgggcggcaccgccgaacccgctccgcggctctacggcctgctgccggagtgggtcgctttccgattggccgcccgaccgtttcgcaccaatggcgccactcttcacttccgggtggagagctcggggagtggggcccgtctcgtctcctggccgccccagcggtacgagcggaacaagcggacctggtactactccgcctgcctgaacatcacggtccagacggtgccgttcgctccccgattccgtgtccacgtctccagccaggtgcgccgctgggccacggagctggaggtgcgcccccacgcgctcggcggggcgacggtcctgttggacgtgccactgccgtggccggggggaccggaccggggacaccggctggcggtgaacacactcggatacgaccggcgtctgaaggaactggtctggcgccgccgtagtcccgctctgctgctgcccgacctggacatcgtgcgccattacccggaacccgaggagctcttcgcccacccggaacgctggatcaacggatgcggggacgtggcggcgggcatcgtctaccacccgacggtcgggccgcacaaggtcggcgccgggttgatgccccgggagcgggcggaactggacgcctgggtggaggaagggctgagcccggtgctgcgtcgtgtccccgacctcacgcgggtgacgcgcagcaacactccctcgctgctgcctcgttcgggccccagggcggcaccgggcgtccgggaggcgcgactcgccctgatgcgcggggcggccctggcgcgagccctgaaaggccgggctctggacgtcgagatcctctggcagtccccggagatccgcaccgcgctcctcgctgaactgcccaagctgatcggtgctgcccccgcggagaaggtgggcgaggacgctgacgccacctggcgggttcggtgtgagggtgtcgacatccgggtgagcacccggcccgccggcccgatggtcgacgctctgcccgtctcccgcgaccgcagccgcccgaagtccgtccggttcgccgaggcagtggaggagcgcagtgcgttgctggcgaagcggatgaccccaccgcggggcgaggtcggcgtcgtgatcgcggagatcgcgagcaaggaccgcttcgccgcccacccggactccgaccccaagcacgcgctccgcctcgcctgggcgaggcagggatggctcagccagttcctcaatgtgtccgacgaccccgccggtgccctggaacaccgtgcccggtggatctggttggacgcgttgcgtcagctcggggcgatcagcccacccgcgcaccgggtgggggccggaatccctggcgaccttcagtacgcggcgctctggctcgtccgccatacgaggaagggccccacgcgccgtcccgtccgacgcctggtcgccgtgcgggtccgtcccgacgccgcgcccggcgtcatcgaggggtgggactccgagcgtgccgagtgggtgccctatccgaagctgctgctgcttctctcccgggccgccgggccggccgtggaaatcgagcgagagatccgtacgctgctcttccagctccgcgaccgcccgacgctgctcatggcggacgcgggcaaccttcgccagtgctggccgaaactgcgcaacggctcgctggcccgagacaccgtcggattcgaggccgaccccgggcagcggctcgcggcctacggcaacgaactgcggatggtgctcgtgcgggacgcgaacgggagggaagaagtcccggagtggtacgcgcacgaccaccggggcaaggtcggcttcgccgagggcgtgtgggggacgatggacgacgagagccgggtcttcgccagcacggccgccacgccgcacacggcggcgaggcccaagggcctcatgaagctggtgcccacggcggaaggccgctcggcgcctgccaagacagcctggaaccccggccagctggagatcacggtcctcggctgcctctcggagaaggcgctggcggacaccgggcgcgagggcgaggagcccgaccgcccggcggagtgggcgacgctgacccaccagctgcggtaccacgacgactacccgccactggcccgcccgctcccgctgcacctggcgcgtctcgcgggccagtacgtcctcccggtggcagacggaacggagaacggcagggcgacagaaggcaccgagtccgggccctccgagcggtgacgccgtgcgaccggtatgcctgatcaggggcatggcggttgccgtcgacggtcgagcgagcccggatgcggacaccgtcggcgcttccgagccgacgaaaatcggaggctcgccggacggacacgccctagggtgacccgatggcttcgatcaggcaggtccagatcaccttcgactgcgcgtcgccctcgcgcgtcgcgcatttctggtgcgaggtgttggggtacgtcgtaccgccgccgcccgaggggttcgccacgtggggggattacgacctctcgttgccgcccgagaagcgggacgcggggttcgtctgccaggacccctcgggtgtgggtccgcggatgtacttccagcgcgttcccgaagacaaggtcgtcaagaaccgtgtgcatctgtgcgtgcgggtcggcaccggactcgtgggggaggagcgcctcgccgcgctggaggccgaatgcgcacggctgattccgctcggcgcggtgcggcagcgcttgctgctcgccgatgaggagaacgagtcctgcctcgtgatgcaggacatcgagggcaacgagttctgtctcgactgacacccccggctcctgaccccgggtcctgacccgcggggcagggcccggaggccggccgttctgcgaagcccgttccgcgtgcggacgcggtgtgggagcggcgctcagaggtcagcggtgagctgccgtgcgaagcggcgtacggcatcggtgaaggcgtccggcgcgtcgaagttcgcgagatgtcctgcccgcgggatcagttcgacgcgagcgtgcgggtgcgcgcgggcgaagtccgcctcgccggaccggaagaggctgtccttctcgccgttgaggatcagtgccggagccgccacgtgccgcatcgcacccgcgtcgaagcgccccagtacctcgccccaggcggcgggcagggtgtggaaggcgtagccgccgcggatggtcgcctccaccacgtccggcggatagagccgcagcagcaaccggtcgttccaccgggtcagccggtccgccggtatgcggggcaccagcccggcggcccaccggtacggcgctgtccacgggccccgggtggaggcgctggcggcggcgaggaccagtccgcggagctgctccgggcggcgccgcgcgaactccagcgcggcgtatccgccgagtgagtgcccgacgaccagggccgggccgcggccgagcgagtccaccgcggaggcgatgatctcggtcgcggagctcaggctccagggctggtccgagcgctccccgtggcccggcaggtcgacggcggccaccgggaattcgtcccggagcgcggcgagctgggtgctccactgtcccgcgctgaagcgtgtcccgtgcacgaagaccacgggcagcgcatgcgcggccatggctggcacatccgctgtcgtcatcggccccccggggacgtcgtcctcacccggactccacccgcgcggtcccccgggtgatcggggcgggccgacgcgtccggtggcgtggtggggcacctgggcatgaccgagcggcggcgatgtactagagttatctcgacatcgagatatctgccgaggcgcaccgcggccgccgcccggtaagggttacctaactaacccttaccttagcggatggtcggggcagtagacggcaaaacgcggcgccgactgccaatgaggcgcggcgcggagatacgcgcacattgaagaaggagactgtcgtgtcggcgaacagcttcgacgcccgcagcacgctgcgcgtgggcgacgagtcgtacgagatcttcaagctggacaaggtagagggctccgcgcgcctcccgtacagcctgaaggtcctgctggagaacctgctccgtaccgaggacggcgcgaacatcaccgccgaccacatccgggccatcggcggctgggactcccaggcgcagcccagccaggagatccagttcacgccggcccgcgtgatcatgcaggacttcaccggcgtgccgtgcgtcgtggacctcgccaccatgcgtgaggccgtcaaggagctcggcggagacccggcgaagatcaacccgctggccccggccgagctggtcatcgaccactccgtcatcgccgacaagttcggcaccaaggaagccttcggccagaacgtcgagctggagtacggccgcaacaaggagcgctaccagttcctgcgctggggccagaccgccttcgacgagttcaaggtcgtccccccgggcaccggcatcgtccaccaggtgaacatcgagcacctggcgcgtacggtcatggtccgcaacggccaggcgtaccccgacaccctcgtcggcaccgactcgcacaccaccatggtcaacggcctcggcgtgctgggctggggcgtcggcggcatcgaggccgaggccgcgatgctcggccagccggtctccatgctcatcccgcgcgtcgtcggcttcaagctgaccggcgagctcccggccggcaccaccgccaccgacctcgtgctgaccatcaccgagatgctccgcaagcacggtgtcgtcggcaagttcgtcgagttctacggtgagggcgtcgccgccacctcgctcgccaaccgcgccaccatcggcaacatgtcgccggagttcggctccaccgccgcgatcttcccgatcgacgacgagacgctgaagtacctgcgcctgaccggccgcgacgagcagcaggtcgccctcgtcgaggcgtacgccaaggagcagggtctctggctggacccggccgccgagccggacttctccgagaagctggagctcgacctctccacggtcgtcccctccatcgccggcccgaagcgcccgcaggaccgcatcgtcctcgcgaacgccaaggagcagttcgcccgcgacgtccgcaactacgtctccgacgacgaggaggcgggcaaggagtccttcccggcctccgactccccggcgtcctccaacggcgtcccgtcgaagccgaccacggtcacggcccccgacggctcgacgtacgagatcgaccacggcgccgtcaccgtcgccgcgatcacctcctgcaccaacacctcgaacccctacgtcatggtcgccgccgcgctcgtggcgaagaaggcggtcgagaagggcctgacccgcaagccgtgggtcaagaccaccctcgccccgggctcgaaggtcgtcaccgactacttcgacaaggcgggcctcaccccttacctcgacaaggtcggcttcaacctcgtcggctacggctgcaccacctgcatcggcaactccggcccgctgccggaggaggtctccaaggcggtcaacgagaacgacctcgcggtcacctcggtgctctccggcaaccgcaacttcgagggccggatcaaccccgacgtcaagatgaactacctggcgtccccgccgctggtcgtcgcgtacgccatcgccggttcgatgaaggtcgacatcaccaaggacgccctcggcgtcgaccaggacggcaagccggtctacctgaccgacatctggccctccgaggccgaggtcaacgacgtcgtggcgaacgccatcggcgaggacatgttcaacaagtcctaccaggacgtcttcgcgggcgacgcccagtggcaggcgctgccgatcccgaccggcaacaccttcgagtgggactccgagtccacctacgtgcgcaagcccccgtacttcgagggcatgacgatggagacgaccccggtcgaggacatcaccggcgcccgggtgctcgccaagctcggcgactcggtcaccaccgaccacatctccccggccggcgccatcaaggccgacaccccggccggcaagtacctcacggagcacggcatcgagcgccgtgacttcaactcctacggctcgcgccgtggcaaccacgaggtcatgatccgcggcacgttcgccaacatccgcctgcgcaaccagatcgcgccgggcaccgagggcggctacacccgcgacttcacccaggccgacggcccggtgtcgttcatctacgacgcctcgcagaactaccaggccgccggtacccccctcgcgatcctcgcgggcaaggagtacggctccggctcgtcccgcgactgggccgccaagggcaccgcgctcctcggcgtcaaggccgtcatcgccgagtcctacgagcgcatccaccgctcgaacctcatcggcatgggcgtcctcccgctccagttccccgagggccagaccgccgagaccctcggcctcaccggcgaggagaccttctccttcaccggcgtcaccgagctgaacaacggcaccaccccgcgcacggtcaaggtcaccaccgacaccggcgtggagttcgacggcgtcgtccgcatcgacacccccggcgaggcggactactaccgcaacggcggcatcctgcagtacgtgctccgcagcctgatccgcaagtaggcgggccggaccgagcggtgagggccgcatcccgggttcccccggggtgcggccctcacgcgtaccgtcgggctaacgggccgtcacagcgcgtgccggtcgacctcggcgatccggcacttcgttcccgcggccacctcgccggacccctgggccctcaccttgaccgacgcgccgggggcgacctcctcggtggtcgcgatgccgtcggacaccacagcgccgtccgcgttcacgaaggtgatggacacgatgtacgccgccggactcccggacctgttcacgatcttcaggtccgcgtgcggccagccgatcagggagtcgcgcgcgcacttcgtgaccgtgacgtccccctcggcggccggcccgggcgcgtcgggctccacaggctcctccccgtagggctcctcctcggacggctcctcggcgtacggttcggagtagggcgcgtccgaccgcgcgggcggcagcgcgatggagtccgcgaccgagtccatcaacgaatggacgagcgccaccatcgcccccgccacgaccagccccccgcccacggcgagcgtcacgatcagccccgtacgctgtctgccgggcggtgccgcgggggccgcccacggcgaaggcggcgacgcacccaccggagcccggtgctccggctgcggctgttcgggcggcggaggcgggaagtagtcggacatgcggtccccccacgggaaatggatcagatgagggacttacggtacggggccccacccgcaccaccggtaccacctgtacagaaagcgaacggacccatgggcgagctgatcctcatccggcacggcgagaccgagtggtgccgttccggacagcacaccagctacaccgacctccccctcaccgacgtcggggagcgccaggcccgcgcgctcgtcccgctgctggccgaccggaacatcgggctcaccctcgtcagcccgatgatccgggcgcgccgcaccgccgaactggccggactccccgacccccgggtcacccccgagctgcgggagtgggactacggcggctacgagggcatcaccaccccggcgatccgccgcacccggcccttctggaacctgtggaccgacggcgtcgaccccggctccgaggagcaccccggcgagagccccgaacagatcgggcagcgggccgaccaggtcctcgcgggcgtccggtccgccgccgacggaatcgggagcgcggacatcgcactcgtcgcgcactcgcacttcctgcgtgtcctcaccgcccgctacctcggcctgacacccgccgaggggcggctcttccagctcgccaccggcgccctctcccggctcggcaccgaacacggccggccggtcgtcgccgccctgaacgtcgccctgcccgagagcctccagccggagtgaaccccgcctgtccgaaagcctccagccagggagtgaaccccgccccctccggaagccgtcagcaggcgtgaacgccgacggccggcaccccgccctcggggtaccggccgcccgcgctcatcgcgtaagggtcaggagagcagctccacctccgcgagcgtcgccgaacccgtcagcaccagccggtacttctcgtacgagccgggcctgtccaccgagaacacccgggtctgcttgtcccaggcgaacgactggccggagcggcggtcgatgtccgtccacttctcgccgtcggccgagccctggagcgtccagcccttcggggccttgtcggcagccgccgacgtcagcgtgtactgggtccccttcgtcgccgagggcaccggcagctccaccgagtcgaccgtcgccgaggtggccgaggtgtcgtcgaacagcgcgccgtcgcccttgagcgcgtcgcccttgggcgtcgggaccttgtcgtccttctgcacggaggccggggccgcgtccttgcccgtgccccaggccgacggcttcggacccatgtcgaactccagcgtgccgcccttggccagcacgtcgtgggggagcgccgtggaggtccacttcttgccgttgaccttcacgccctggacgtagatgttcgtgtcgctgttcttcggggccttcacgaccagcttgcggccgttgtccatgcggacggtcgccttcttgaagagcggcgagccgatcgtgtactccccgctgcccatgaccagcgggtagaagccgagcgaggagaagaggaaccaggccgactgctcgccgttgtcctcgtcgccgtggatgccctgtccgatctcgctgccgacgtacagccggcccagcacctcgcggaccttctcctgcgtcctgtacggctgcgaggccgcgttgtacatgtacgtggcgtggtgcgcgacctggttgctgtgcccgtactggcccatccgcacgtcacgcgcctcggtcatctcgtggatgacgccgccgtagctgccgacgaactccgggcccgccgtctccggcgtcgagaagtacgtgtccagcttcttgccgagcccggcgcggccgccgtaaaggttggccaggccccggctgtcctgcggggcggtgaaggcgtagccccagccgttggtctcggtgtagtcgtagccccagacgcgggggtcgtactcgccggagggcagacgccagtcgccgttcggcttcttgccctggaagaacccggccttgtcgtcgaagagcttgacgtacttctgcgcccggttcatgaagtactcggactcttccttgtaccgcgccttcttcgtcttcttgtacagctcctggcccatccgggcgatgccgtagtcgttgacgtaaccctccagcgaccaggacaggccctcatgggtggcggtgtccgcgtagccggtgaagaccgaggtctgaaggcccttgcggccgacgcccgaggacggcggggccacggtggcgttcttgagcgccgcgtcgtacgccgcctcggcgtcgaacttcacgcccttgacgtacgcgtcggcgaacgccacgtccgagctggtgccggtcatcaggtccgcgtaaccgggggaggaccagcgcgaggtccagccgccgtccttgtagtgctggacgaaaccgtccaccagctcgccggccttcttcggggagaagaaggagtaggcgggccacgtcgtgcggtaggtgtcccagaagccgttgttgacgaacacctcgccgtcgacgatcttcgcgccggtccgcgtcggggtgttctccccgaccgccttggagaaggggctggcgtacctgttcttgccattcaccttctcgtggccggagttcgggtagaggtagagccggtacaggctggagtagagcgtcgtcagctggtcggcgttcgcgccctcgacctcgatcgtccccaggatgtcgtcccaggcactctgcgccctgcgctgcacccggtcgaaggaggtggactccgggatctccatggccaggttctgcttcgcctggtcgacgccgatcagcgaggtggccagccgcaggttgaccgtgcggtccttgcccgcgtcgaagcggaagaacccggtgacgtcgtcgccaccgccgcccttcagcttgccgctgtcggtgaccggcgcgtcgaagacgccgtacacgaacatccgggtcgccccggtggacaggccgctcctgacgtccgagtagccggagaaggatccggtcttcgggtcgagggtgatgccgccgtcgttcgagacgttgtcgaagaccaggctcgcgtccttgccggggtacgtgaaccgcatccgggccgcgtggtcggccggcgccatctcggccttgaggccgttctcgaacgtgacgccgtagtagtgcggcttggccgtctcgttctcgtgccggaacggcagcgcgcgggccgtccgggaggcgtccggggtgccgctcgcggccgacggcatcagctggaaggtctgccggtcgcccatccaggggctcggctcgtggctggcggcgaaggcctggagcgtggggaggttgtccgcgttgttgccccggtggtagtcgtacagccagctcgtggtgccggcgttggtgaccggcgtccagaagttgaagccgtgcgggacggccgtggccggaatgttgttgccgcgcgagaagccgccgctggagttggtgccgcgggtcgtcagcgcgtagtccgacagatgcgccttgcgcttctcggccgccttcggggcgatcgtgatgtcgtcgatccagccctggaacttcgccgggcccttgggggagtcgtacgccaccaggatccggtcgaccgtcttgcccgcggcgaccgtgccgaggcgggcggcgaccctgttccactggttgacgtagagacgcttggcatccgcctgaccctgcggcgtcagcagcccgccgtggctgtcggtggccttcagctcgctcagatacgtgccgtcggtgaaggccaggtccaccgcgacgtgcgtggcgggatagttcaggtccgtctcgcccatctgcgggtagacgaggtaggacagctcggtgtcctgggtgacggccgtgttcacgtcgaagatcttgttgtacgagtaggcacgtccgtcgggcgtgtgagtgcccgcgtaacgcagtgccttctttccggtgaatccggccccggacttcgcggtgggggatccggagggaccgcggtcgggctggctgcgcatctcgtcgggcaccggcgcggaggtgtcaccgttcgagaactgaacgtcggcgagctggagcgcgtccgacgcgccgttgttcctcgtgatctccagccggaagtgccggtaggcggtgtcgcccgagaagtcgtacttcttcgtctcgtgccgcttggcgaaggtctcgccgctgcgggtgtcgaggtcggtccactccttgccgtccgccgagcccttgagcgtccagtccttcgggtcgcgctcggcgtggtcattggccgaagtgagggcgtacgtcatgaccttgacgggttcgtccagatcgaactcgacccagccggtgggcttgaacgtcagccatttggagcccggctcgacgtcgacgaggttctccttgacctccccgccggcggtgttctcggcgctcgcgcgcacgtccgtcacccggtcggtgacattgcccggtatgccggaggagaagcccccgtcgacgccggaggaccgcttcttgccgtcgggcccctcctcgacggtgctgcgccagtccggctgtacctcgtccgcctcgaacgaggtgctgaacgtccggtcgccggaaggcttcctgtccggcgaggagggctgggcggtggcgaccgcgggggcgatcaccaccagggcgagggaagccgccagagcggctgcggtgggggtccgtctccggcgggaggccgggcggggggccgcttgaggggcctggtcggatctgtgattgaggccgcgtggtggctgcatgccgagccgttcctccccgggaaaatgcatggacaacgttgtcatagcgggatgcaaggtccagtagggatccaagtggcgcgacgtgtcaagggtgttgccgaggggctcgtcggcgaatcggccggaatggggaaatagtcgccgcgggaggagggcgcggggtgccgaggtgtccgtgaggtctcaactcgggaaagactgccgcccaaacctgcattcgatcttgctcagttggcgacaagtggactatacctgtcggcacctgcacggccgcttcacgcggacgtgcgcgcgggggaaacggggacggttgcgaggacgccaggggtgtcctcgctgtacggtctcccggcatccccactgcaccggcccgtccggtacatctgcatatccgcatgacccaagcgcaactgaccgcggtggcggggcccttcgcctgaggcgaattttcgacgggtgaccggtacaccgcctgagtcctggagaaggcgaggacttgagcatgggatccacctccgcccacaacaatgagggccttggccgtcgcgatctgatcaagcgttctgccgcactcggcctgatcgctgttccgacgatgagcttcctgtccgcctgcgcgagcggcgacagcggcagcgacgacaaggtcgaaaagggcgaaaagaccgagaagaacccgctggccgtcaacggcagcgcaccgctggacatcgtcatcttcgacggtggcttcggcaccaagtacgccgaggacgccaaggccgtctacgagaagacctatcccgacgcgaaggtcaagttctccgcgacgcagaagatccagtcggttcttcagccgcggttcaacggtggtaccccgccggacctgatcgacaactccggcgcccagcagatggacatgggcgtcctggtcggcaagaagcagctcaccgacctgaccccgctgctcgacgccccctccatcgacgaccccgccaagaaggtccgcgacactctgcggccgggcatcatcgagatgggccagttcgacggcgacccggtctggatcatgtactacgcgtacacggtctacggcgtctggtactcgcagaccgcgctggagaagctcgactcggcgtacccggagacgtgggacgacatgctcgcgctctgcgcgaaggcgaagaaggagggcatcgccggctggacctaccccggcaagcacccttactacctccccttctcgctgtaccccttcatcgccaagatcggcggcgtcgaggtcctcgacgcgatcgacaacctggagccgaaggcctgggagcacccggcggtcaaggcggccttcgaggcgtactacgagctcgtcgcgaaggactacatcctcaagggcaccccgggcctggaccaccgcggttcccagggcgcgtgggcccgcggcaaggcgctgttcatcccgaacggctcctgggtcgagaacgaggaagcggcgatcatccccaaggacttcaagctgtccgtgggcgctccctccagcctcgactcctcggacaagctgcccttcggcacgctctgggcgtccggcggcgagccgttcatcgtcccgagcaaggcgaagaaccccgagggcggcatggagcagctgcgcatcatgctcagcgaggcctcctccaagtccttcaccaccagcaccaagtcgctctccgccttcaacggcggcacggacggcatcgagctgtccgacggcctgaagtccggtgtcgccgcgctggagaaggccggcaccaacgtggtcaacccgcgcctgcaggactggtacgtgaagctccagaaggagcagatcggcgtcgccgcgctcggcgagatgatggccggccgcgccaagccggccgagaccatcaagaagatccaggccttcgccgacgcgaccgccaaggaccagtccatcaagcacttcaagcaccagtgaccacgcgtcaccagcggcgggcagcaggggaaggtcggagtcggtaacgatgcaacacggtaaataccggttcatagtcgggttcttggtggtcccgatggcgctgtacgtcatcttcgtcatctggcccttcatccagtccatctactactcgttcacggactggacggggctgagtcccgacttcaagatggtcgggttcgacaactacaccaagatgctcgatgacgacatcttctggaaatcgctgcagcacagcgtgctgctggccgtgctgctgccgctggtgacgctgggcctcgcgctcttcttcgccttcatgctcaacgtgggcgggcggcgccgtaagggcgccgccgtcaccggcgtccggggctcgggcttctacaagatcgcgtacttcttcccgcaggtgctctcgatcgcgatcgtggccatcctgttccagttcgccttcgacccggcccagggcatgatcaacggcacgctcaaggccgtggggatcagcgacgtaccggactggctgggcgatccgcagctggccctgtggtgcatcatggcggtcctcgtctggtgcacgaccggcttcttcgtggtgctgttctccgcgggcatggcctccatccccaaggacttctacgaagccgccctgctggacggggcgagccgcttcacgaccttcttccggatcacgctgcccctgctgtgggacacggtccagtccgggtgggtctacatgggcatcctggcgctcggcgccgagggcttcgcgatcgtccacatcatgagcgtcggtcccggcgggcccgactactcgaccaccgtcctgccgctgtacgtgtaccagtcggcgttccgtgacggacaggcgggctacgcgaccacgatcggtgtcgccctgctcatcgtgacgctggcgttcgccgccgtcgtcatgcgggtgggccggcgcgagcggctggagttctgatgaagaccactgacacccctccctccgggccctccgggtccccctccgacgccgacgcggcgaaggtcccggcccagcgcaccgcaacggtctccaagggctcaccgccccccgcgaagaagggcgagggccaggtcctcaacgtcttctcgcacgggatgctgatcctgtgggcgatcatggtcgtcctgccgctgttctgggcggtgatgtcctcgttcaagaccgacgcggacatcttcaacacgccgtggtcgttgcccagttcgctgaacttcgacagctggggccgggcctggagccaggcccacatgagcgagtacttcctgaacacgatcctggtggtcggcgggtcgctcaccggcaccctggtcctcgggtccatggccgcctatgtgctcgcccgcttcgagttcccgggcaaccggttcatctacttcttgttcgtcggcggcatgagcttcccgatcatgctggcgctggtcccgctgttctacgtcatggacaacatggggctgctgaacacgatccacgggctgatcctcgtgtacatcgcgtactcgctgccgttcaccgtgttcttcctgacctcgttcttccgtaccctgccgacctcggtggcggaggcgtcgatcatcgacggcgcctcgcacacccgcacgttcttccaggtcatgctgccgatggccaagcccggcctgatcagcgtcggcatcttcaacttcctggggcagtggaaccagtacatgctgccgacggtgctgaacaccgacccggagaagcgtgtgctggcccagggcctggtggagctggcctccagccagggctacaagggcgactactccggcctcttcgccggcctggtgatcgcgatgctccccgtgctggcggcgtacatcatcttccagcgccaggtcgtctccggtctgacggcgggcgccctgaagtaggtcacgtatccacaacaacccggtgccccggcggactcctccgccggggcaccgcgccgtcgcggggtgcgcgggtgctcaggtcttgacgggaggcacccccgaacggtcagcttagagttcacatgttggaggaagccggggtctcatcgctgcggccccggccggggcggtcttcaggaccgtccgccaagggcaggagtggatgagtcgatggagactcccgggtcgcagacatcgctgcacagggccaatctggagcgggtcgtacgcgccgtacggatggcaggatcgctcacccaggcggagatcgcccggagcaccgggctctccgcggccaccgtctccaatatcgtccgggaactgaaggacggcggaacggtcgaggtcacccccacctcggcgggcggccggcgggcccgcagcgtctccctcagcggcgacgccggcatcgtcatcggcgtcgacttcggccatacgcatctgcgcgtcgccgtcggcaacctcgcccaccaggtgctcgccgaggagtccgagccgctggacgtcgacgcctcgtccgccgaaggcttcgaccgggcggaagtgctggtcaagcggctgatcgcggccacggggatcggcccggacaaggtgatcggcatcggtctcggcgtaccgggccccatcgatgtcgagtccggcaccctgggctccacctccatcctgccgggctggacgggcatcaaccccagcgaggagctctccggccgtctcggcgtgcccgtgtacgtcgacaacgacgccaatctcggagcgctgggcgagctggtctgggggagcgggcgaggcgtcaaggacctcgcgtacatcaaggtggccagcggcgtcggcgcaggtctggtgatcgacgggaccatctaccggggccccggcggcacggcgggggagatcgggcacatcacgctcgacgagtcgggcccggtgtgccgttgcggcaaccgcggctgcctggagacgttcaccgccgcccgctatgtcctgccgctgctccagcccagccacggccccggactcaccatggagcgggtggtgcagctggcgcgggagggcgacccgggctgccgccgggtgatcggcgacgtgggccgccacataggcagcggcgtggccaacctgtgcaatctgctcaatcccagccgcgtcgtgctcggcggctcactggcggaggccggggagctggtcctggggcccatacgggactccgtgtcgcgttacgcgattcccagcgccgcgcgacagctctcggtgctgcccggcgcgctcggcgggcgcgccgaagtcctgggcgcactcgccctggtgctcagcgagatgggggattcaacccttttggagggcaccctccccgcggcgactcctgccttcacttagataacgaatggcaccgttgtcatctcgttaaggatttactccttgacgctggcgctggggccgagttgacttccagccacctcggccgcaacgtcgcggcctcgtcagggaggttcgagaatgaacacgcgtatgcgtcgtgccgccgttgccgttgccgccaccacgatggcgatttcgctggccgcttgcgggagcgccaaggagtccggcgacaaggccgagcagagctcggagaagaagggcgacgacctgaagataggtctgctccttcccgagaaccagacggcccgttacgagaagttcgaccggccgatcatcgagaagaagatcagcgagctcaccggcggcaaggcggaggtcgtctacgccaacgccaagcaggacgcgaacactcagtcgcagcagatcgacacgatgatcaccaacaaggtcgacgcgctcatcgtgggcgcagtggactccaaggcgatcgcgaacggcatcaagaaggccaaggccgagggcatcccggtcgtcgccttcgaccgtctcgccgagggtcccatcgacgcctacacctccttcgacaacgaagaggtcggccgcgcgcagggcaccgccctgctggaggccctgggcgacaaggccgacggcggcacgatcgtgatgatgaacggcgcgatcaccgacccgaacgccgccctcttcaagaagggcgccaagtccgtcctcgacggcaaggtgaagtacggcaaggagtacgacaccaaggagtggaagccggagaacgccaacgccaacatggaagcggcgatcaccgcgctcggcaaggacaagatcgacggcgtctactccgccaacgacggcatggcgggcggcatcatcaccgccctcaagggcgccggcctgtcgccgctcccgccggtcaccggccaggacgccgaactggcgggcgtgcagcgcatcgtctccggtgagcagttcatgagcgtctacaagtcctaccccgccgagggcatcgtcgccgcggagatggccgtcgccctcgccaagggcgagaagctcgactccatcgccacctcgaaggtcgacagcgccaccaccaagggcatcccgacggtcctcgtcccggtcgtctcgctgaccaaggacaacatcaaggacaccgtcatcaaggacggcatctggacgctggacgagatctgctcggccaagtacaaggccgcctgcgacaagatcggcctgaagtagtcccccgggacc

SEQ ID NO: 3291 - DNA, 1055 bp, Unknown
  Kingdom: Bacteria, Phylum: Actinobacteria, Class: Actinobacteria, Order: Streptomycetales, Family: Streptomycetaceae, Genus: Streptomyces
gctggggctcgcacgtcttcaccggcaccacgctgagcgccggctccgcaccccgcaccggcgaggtcgtgctcgacgcgggtacggcccgtacggcgaaggcggccgccggtgacaccgtcgcactcgacaccgccgccgggccgcgcgacttccgggtcgcgggcgtcgcggaggcaggacccgcggagagggcccggagcaccggtgccgcacgggcactggtctggttctccgacgccgatgccgccgcactggccgggcatccgggcagggcggacgccatcgccgtcctgccgaagtccggcgtcggagccgacgccctcgcagcctccgtcgaggaggccctggccggctccggggcggaggtgcgcaccggcgacgaccggggcgcggtcgaggacccgggcctcggctacgccaaggagacgctcttcgggctcggcggctccttcggtggcatcgcgaccatcgtcgcggtcttcaccgcggccgggaccgtggccctgtccgtgtcccagcgggcccgcgaattcgccctgttgcgcgccgtcggagcgaccccgcggcagatccgccgcgcggtggcatccgaggcgctgctcgtcgcaccgctcgccgggatcatcggctgcctgcccggcgtcgggctcgcgtactggtggttcggacagttgcaggaccggggcgcgatcccggaggcggtgcgggtgcacgtctccgggattcccctcctcgtcgccgtcgccgtcggactgctcaccgcgctcggcgcgggctgggcggccgggcgcaggccggccaggatcaggcccggacaggcgctgagcgcggtgagcagtccgacggcgacggcgacgaggaggggaatcccggagacgtgcacccgcaccgcctccgggatcgcgccccggtcctgcaactgtccgaaccaccagtacgcgagcccgacgccgggcaggcagccgatgatcccggcgagcggtgcgacgagcagcgcctcggatgccaccgcgcggcggatctgccgcggggtcgctccgacggcgcgcaac

SEQ ID NO: 3292 - DNA, 4022 bp, Unknown
  Kingdom: Bacteria, Phylum: Actinobacteria, Class: Actinobacteria, Order: Streptomycetales, Family: Streptomycetaceae, Genus: Streptomyces
gccgcgggccgcgccggcgtgccaggtgtgcagccggcggcccaccgtctcggctatcccgtcgaccagggcgtccagccgggcctcgggcagcgcctcggtgtgggggcgcagatggagcacggctccgtcggcgagcccggcccgcgccagcgtggtctcctcgtcgagcggggcgtcgccgagccgctggagcacccagccggcgtggtcgagtccggcctcctcggcctcctcaccgacgtaccgcaggagagtggggagcagatcggcgaccggtacgtcggcgggcacggccagatcgatggtgacgctcggcgcacgtacggtcaggcggcacgattcggccaccgcactgtcggtcatcagcagaactctcgtcttccgtgcgggctttgacagagacttccccgggagtgggaatgtgcgaacagtacggaaagtccgcgcggccgtgaaccggggggcctggcagggaaattgtgcccgcatacccggcgaccgcccctcccgcgtggacaggtcgcgttccgtgaatgcagactactgcctgcggccaccggccgtgctgcgggccggggtgaggaatccggcaaacaggcggccatcccggaagttgaccgctcccgctgtccatgcgaaacattcacccggcgttcatcgaggcatccgagcccgagcaatccgctgggtgggacctttcctcctcccgggtgcgccggtattcggcgcggtccggaaagtcagtgaaccggaggttctcttccttgagtgtcgtgctgtttcgccgcccggcccgcaggcgcgggccggagatgcccgaggggcagttgaccctccaggagccgccggtcctcgccgagacggtgcccgacacctcggcggtgtggacctatctgccgatggccctgatgtcggtctcgatgatgctgatgttcttgcgccccggcggcgggaacagcgtgttcatgtatctggcgatgggcgtcatggcgctctccgccggtgccatgctgctgggacagctgatgcgccgctccagtgagcgcaagcagcggctgaagggtgaacgacgcgactacctgcgctatctggcgcagacccgcaagcgggtgcggaccaccatcgcggagcagcagcgcgcgctggcctggcgccaccccgagcccgcgtcgctccgctcgctggcccgcacctcccgcctgtgggaacggcgcccggccgacgaggacttcggcgaggtccgtctcgcggtcggcgaacagcagctcgcgctcaccctgaaccccgtctccacccgcccggtggaggatctcgaacccctctgcgcgcacgccctgcgccgtttcatccgcgcctactccaccatccccgagcagccgttgggactctacctgcgctcctcggcccggatcctgctgcgctcggaggaggcgcccgacggcgagacacccgatgcgcatgcgccggaacacgacgccgtacgggccctggtgcgggcgatgctcgggcagctcgcggtgttccacgcgcccgaggagctgtgggtcgctctctgcgtcagcgacgagcgacggcccggctgggagtgggtcaagtggctgccgcacgtgctggatccgcacgaggaggacggggcgggacaggcccgccggatcaccgccgacctgaccgagctggacgatctgctcggcgccgagttcgccgagcgccccggcttcgacccggatgcccggcccggtcgtgacgagccgtacacggtcgtcgtattggacggcgtcaacgtccccgaaggccaccgctgggagggccacggctatcgcaacgctctgatcctcgacgtctccggggcgctgcgctggcggcccggccgcaacacgctgcggctgaccgtcggtcccgaccgggtgagcctggtccgcaccgaccgcagccgcaaggagcgctcggtgccgctcggccgccccgaccggctcggcccgctcggcgcggagtcgctggccaggctcctcacgccgcgccggatgagcctcggcaccgacatcgcgcagccgctggacaccgacgtcgagctgaccaccctgctcggcatccccgacctgcaccggcacgacccgcagaccctgttcgaccggcactccggctccggccggctgcgggtgccgatcgcggtcggtgtggacggccgcccggtcgagctggacatcaaggagtccgcgcagggcggcatgggaccgcacggcatgctcatcggcgccaccggctccggcaagagcgagctgctgcgcaccctcgttctcggtctcgccctgaccaactcctccgagacgctcaacttcgtgctggtcgacttcaagggcggcgcgaccttcctcggactggaggaactcccgcacacctccgccgtgatcaccaacctggccgacgaagtcgccctggtggagcgcatgcaggacgccctgcacggtgaactcatccgccgccaggagcttcttcgctcggcgggcaactacacctcggccctggagtacgagcgggcccgcgccgccggggcgggcctcgccccgctgcccagcctgttcgtggtggtcgacgagttcagcgaactgctctccacgcaccgggagttcatggagctctttgtgatgatcggccgtctcggccgctcgctcggcgtacatctgctgctcgcctcgcagcgcctggacgagggacgcatgcaccagctggagagccacctctcgtaccgcataggactgcgcaccttctccgcgatggagagccgcggcgtgctcggcgttcccgatgcctacgagctgcccgccgcgcccggcagcggctatctgaagtccggggtggaggccctgacccgattccgggccgcgtactcctcggggacctaccggcgtcggaccggtgcggtggtgcaggcccgggtggcgagccaggtggtgccgtggaccagcggctgggtggtgccgcgcaccttggagaccccgcccgacccggagccggagacggaggaggcggaggaggccgaggcactgctggatgtggcactggaccggctgcgcggctccggacccgaggcccaccaggtatggctgccgccgctgggcgagccgtccccgctggacgcgctgctgcccggcgtcgagccggacagggcacgcggcctcatcgccacccgatggcccggcaccgggaagctgcgggttccggtcggcctggtggacaagccgttcgaccagcgccgcgacccgctgatcgtggacctgtccggggcgggcggccatgtcgccgtcgcgggcggttcccagagcggcaagtccacactcgcccggacgctcatcgccgccctggcactgacccacaccccggccgaaatccagttctactgcctggacttcggcggcggtggcctctcccagctcgccgccctgccgcatgtcggcggagtcgcggcgcggctcaacccggagcgggtgcaccggacggtcgccgaggtgatggcgctcctcgcccgccgtgagcagttcttcgtggaccacacgctggactccatgcagtcctaccggcgccgccgggccgccggggagttcccggacgaaccgttcggcgatgtgttcatggtggtcgacggctggtccacggtccgccaggactacgacgacctgataccgaagttcaatgaactcgccgcccggggactcaactacggcatccacctgctcatcaccaccacccgctgggtggagctgtccgcgcaggtccgcgaccaggccgccacccggctggagctgcggatgggtgatccgatggactccgagatcgacacccgcaaggcccgctcggtgccgcgcaccggtggccggggcatcaccgccgacagcaagatgcacttcctcgcgggcctgccccgcctggacggcagcggctccctggaggacctcggcgagggcgtcgcccacctggtcgcggagatcggccggcactggtccggcccctccgccccccaggtg

SEQ ID NO: 3293 - DNA, 1564 bp, Unknown
  Kingdom: Bacteria, Phylum: Actinobacteria, Class: Actinobacteria, Order: Streptomycetales, Family: Streptomycetaceae, Genus: Streptomyces
acgtcgagggcggtggtcggctcgtccatgatgacgatctcgggttccagggcgagcgccatggcgatcatcacgcgctggcgcatcccgccggagagctggtgcgggtaggcggcgagccggtcggccgagatgccgaccaggctgagcaactcctcggcctgtgccgtgcgttggcgcttcttcagttcgggccggtgggcggcgaggacgtcggtgagctgactgtggacggtgtgcaccgggttgagggagttcatcgccccctggaagacgatggacagctcctgccagcggaaggcgcgcagctggtgcggcgcgagggagaggatgtcgacccggtcgccgccgggccggtggtagtggacctctcccccggtgatgacgccgggcggggacagcagccgggtcaccgcgtaggcgagggtggacttgcccgatcccgactccccggccaggccgagcacttcaccccggtggagggtcaggtcgatgtcgcgcagggcgtggacggcgtgcgcgtcggtgccgtagtcgacgttgagtccgctgatggtcaggaccggctcggcgctcatgggcgcggctccttgctgctgtgctcgctgctgtggtcgcggtgtccgtcgccggtggacctgcgggcgaccggggtgaagccgacgcgcatcctgaccttccgggaggatccggtggcggtgcgcaggcgggggttgacgaactcgtcgatgccgaagttgatgagggcgagcgcggtgcccagcagggcgatgcagaggccggccgggacgaaccaccaccaggctccctgggcgagtgcctggttggactgggcccagaagagcacggtgccccagttccagtgggagatgtcggcgacgccgatgaaggcgagggtgatctcggtgaggaccgcgaagatgaccgtgccgacgaatccggaggcgatgacggcggtgaggttcggcaggatctcgaagaggatgatccgcggtgtcgactcgcccgtggcacgggcggcctccacgtagtcgcggcggcgcagggacagggtctgggcgcgcaggatcctcgccccccaggcccaggaggtcagggcgatggcgacggcgatgacgatgtccccggtgtcggggacgaagctcgcgacgatgatgatcagcgggagtcccggcagcaccaggaagatgttggagagcgcggagaggatctcgtcgacggccccgccgaggaatccggcgctgaccccgacgaggacggacagggcggtcgcgatgacggcggccagcagcccgacgacgaggacgccccgggtgccgacgaggatctgcgagaagacgtcctgcccggtgtgcgtggtaccgaaccagtggtcgccggagggcggtcggagcagctggtcgctcatcgcgtcggggtcgtacggggcgagccacggcccggcgacggccagcaggacgaagaacgccagcaggatcaggcccgtacgggtcttcccgccgcgcaggaaccggagccgggcccggcgggcgggcgccgcgggtgggggtgcgccgtcgaggac

SEQ ID NO: 3294 - DNA, 3383 bp, Unknown
  Kingdom: Bacteria, Phylum: Actinobacteria, Class: Actinobacteria, Order: Streptomycetales, Family: Streptomycetaceae, Genus: Streptomyces
cgccagcgccgcgccgcccggccgtgtgccgcggcagaccccgtggaccaccgggacgggggcgtcgggggcgagccggtcggcggtgccggacaggtcgtggtcgaggagggcgtccccgacgacaagcagcggggccggtgcggtcacagcgcgcctccttcgacggacaccgcggggggagaaggccgccgcgaggccgcggcgttctcctcgcagacctggtcgaacgcctcgcagagcatgtggaccgctaccaggtgcagttcctgaacggttgccgagacaggggcgtccacgcacaccgcctcgtcgcaggccgcttcgagcgggttgggcgccgggccggtcagggcccagacggtcatgccgatgcggcgggcctcggcggcggccgagaggaggttggcgctggcgccgctggtcgacaggagcatcaggacgtcgccggggcggccgtgcgcacaggtctgccgggcgaagacctcttggacaccgtagtcgttggcgatggcggtcgtggaggaggtgtcggcgtggagggcgagtgccgagaacggcggccggtcctcgcggtagcggcccacgagttcggcggtcagatgctgggcctgcgcggcgctgcccccgttaccggcgacgagcagtctggccccgccgccgaggcggcccgccagttcgccgccccagcggtggacgacggagcaggaactccggaacgcggtgagggctttcatgaggtcgtcgcagtgctgagcgttgcgggtgaggttcatcggactgctcccgagagtgaggcggaggcgcgcacggcgctgtagacgcgcacgactccgtcggcgacacggtcccagctgtagtgcgcgagaacgcgttcacggcctgcctcgccgtagcgggccagccgttccggatcgtcgagcaacgcgccgatgacctgggcgaggtgcgacgcgtctccgccgggcggcaccagggcgccggtgacgccgtccacgacggtgtcgaggtggccgccgacggcggtggcgaccaccggcgtccggcaggccatggcctcgatcggcacgatgccgaagggctcgtaatcgggcagcgacaggaccaggtccgcgctcgacatcagccggggcatccggtcgtgagccaccgcgccgagcagggtgacgcggtcggcgacgccgtgttcctcggcgaccttcctgaggcgctccgcctccggctcggcgaacagcagatcggcctccggcccgccggcgatgagaagttcggcgtcgggaacggccgcgagcgcgccgatcgcgcgatcgaatcccttgcgccgtacgagtctgccgaccgccagcagccgacggggcccagcagccgcacggccggtgtcgccgaccggtgcgaagtgccgcgggtccacaccgcagggcacgacggagactcgggcgcggtccacccccatcgcgacgagctcggcgacctcgtccgcacaggtcgccagcacgcgacggcacgctctgccgatcgccgcctcgatcgccagacgccgcggcgggctggtgtcctcgcctccctgatgccgcttcttcaccgtgccgagcgcgtggtacgtctgcaccacggggatccccagcccccgggctccggccagtgccgccgtgccggacatccagaagtgggcatgcacgacatccggcggggcggccctccagcggctcgcgaggaacgacccgaactccggcatgcacgggagtagttcgtccttggggacgcgtcgcgctggtcccgcaggcacgtggacgaccttcacgccgcccgccgtggtcagttcggggagcaggccgggggcgtcccggcgggtgtacacggtgacgtcgtggccgcgcagggcgaggtggtcggcgagctgggcgacgtacacgttctggccgccggcgtccggtccaccgaggtcggccagcggactggcgtgctccgatacgagagcgacacgcagcggggccggtcggatggtgctcatcgcgtgacctccttcatcaggtgttcccagtcgtccaggaagcgccgcaccccgtaccgtgcctgtacggccgcccgggcccgctcgcccgcgtaggccgcctgggccgggtccgcgaggaaggcgcgtaccgcttcgtcgaggacctccgggcggttcgacacgatcccggcgtcgtcgggcacggcttcgcgcacctcggtggtgtccagggcgaccacgggcatcccgaggaacatcgcctccagcagcgacaggccgagcgacgtccaccgcaccgggtggaggtagagacggcagcgggccatggcggggtgcagttcaccctgcggcaggtcgcgtgtgcggacgcggtcgggcggcagcccgaggtggacgccgagcccttcggtgcgcatcccgaagacgtccaacgcggcgaccccggcgaagtgcggcagcagatcggtcccggtcgtgcggcctcggcgcaccgggtcgttgaccaccaccgctgccctcgtctccacgccggtccacagcggccccgggtcgatgacaccgtgctcgatcacggtggcgggggcccggccgctgtcccacatcagccggttgaagtgggtgacgtggatcaggggaatgtcgttgcggtcggcgagcggatgccgggtgccgacgggtgtgccgtccgggctgttgtgctcgacgtagaccgccggcacgtcgataccgggccggcgcccggtccaggcgtgggccagggtgatctcgtggggacgctggagcaccatgaggtcgatgtcctgctcgcccaactcctgcggggtcacctcgcgcacgttcggcggccacttccacgtcgccgcccggcccaggccgtccggcccacggtccggggtgacgggaacgaggtaggtgtgaggtccctggacgaaagaagtggcccaggagccgtggacatgccagatgaggatgttcatgcgtgctcctcgatgagttcccggacggctcgtacgacgtcctcgggggtgatgtcgtcgagacacgggtggccggggacgggacagtggcgggctcggctgtcggcacacttcgcggactggtcgccgagcaggacggtcggcactccgaacggggcccagcgttcggccgggaccacgggggcgaagagggagaccaccggagtggagacggcggcggccaggtgggccggtccggtgttgccgctgaccagcacgtcggcgttgcgcaggatgcctgccagtgtccgggggtcggtgcggccgcccaggtccagggccgcctcgccgctgacgtgccgggtgagggccgtctcgcccgatccgccggtgacgaccacgcggtggcccgcgtccgcgaggctccgtaccgc

SEQ ID NO: 3295 - DNA, 5020 bp, Unknown
  Kingdom: Bacteria, Phylum: Actinobacteria, Class: Actinobacteria, Order: Streptomycetales, Family: Streptomycetaceae, Genus: Streptomyces
ccgcctccggatccggcgacgggcgggcgttcagccgtcggccgagggcatccgcggcgatcacgaaccgctcgtcccacgacccggccacccgcagcctgtcctcgacccgcccggcgtcgcgtccccagacgtcctccagggggacgaccgtccggctgaggtcggccgacgcgccgaacaccgcgaccgccatgggcggcgacaaccggatctgcaagcactcgatcctgccggccgcccggcctccgagccgcaggtcgcccgtcgccagtcccacgaccgtgctgccgcgtgcgcgccggccgttcgagtcgtggaccatgccgtccccctcgctcaggtccacgaacagcgtgaccgaggggtgcgcgaccatcgcgatgtccacgtggacgggggcgagttggcggaatccagccatgctgagccccgggagccgacccgcgtgccggggcaccgcgacttccaccgacgaccagtcgggggacgattcggtgagtctcacagcaccaggctagagggtcagcggcccgtcaccgcgaagcgcagcagcaactcgccggtctcctgcggcgcttcgagcatcgggaagtgtccgacgtcgggcagccgctcgactcgcgccttcgctgtcgcctcgtaccagtgcgccgcgtccggatcccagcggggatcagcggtgccgaagaccaccagaaccgggacgtcgagtgcgccgagccgcgcgggtacgctccgctcggcgatgtacgcgctgttgcggcgcagcaccgtcctgaaggtgcggtagccgatgcctcgtacgtcggcgaccagatcgtccgggacgctcaccgggaggttgcacaccgcggtcaccccccggcggagcatcgcgtcggaacggattctccacaggagcgggccgagcggcggggcgatgagggcccgaaggaaggcgggctgcggaaggagcgcgtcgggactcgggccgctgctgatcagtgcgagggaccccaccaggtccgggcgctgttcggcgagggcggtggcgatgtatccgccactggagtgcccggccacggtcacgggacgcagaccgagttcatcgagcgccgcggccaggcccgccgcctgctcgggcacgtcgtacgacgccgcgggcggggactgtccatggcccggcaggtcgacccggacgacgtggtgccggcgcgccagcgcgggcaccaccgggccccaggaactgcccgaggcacccgaaccgtggatgagcacgagcggcggcgcatcacgcgggccgtcgtggaccacgtgtattcctcgcacgtacatgctgtcgtggatacccatgcacgcgaggatgaccgaggtgtcggccccaggtcttgtacgaatgtcgtcgcggggccggcaccccgtcggcctcggagctcggtgctcggtgctcggtgcgcggtgcgcggtgcgcggtgcgagctcgtcttcggatctcccgggaaaaggagacagaagctgtcgggtatcccgcctagcgtcgcgctcatggatcgcttccccgagcgctgcgcggagctggacacccccggccccgcgcaccgcgacatcgtcatcaccggcgcgcgcgagaacaatctgcgcgacgtctccctccggatccccaagggccgcatcaccgtcttcaccggtgtgtccggttcgggaaagtcgtcggtcgtcttcgacacgatcgccgtggagtcgcagcggcagctgaacgagaccttcacctcgttcctccgcaaccggctgccgaagtacgagcggccgcacgtcgagtccgtcgaggacctgtcggtggccatcgtgatcgaccagaggccgctgggcggcaatgtccgctcgacggtcggcacggcgaccgacatctggtcggtgatccgggtgctgttctcccggtgcgggaacccgagcgcgggcggggcgagcgcgtactccttcaacgaccccgccgggatgtgcccggagtgcgacggggtggggcgcacggtccagctggatctcgaccgggcgatcgactggtcgaagtcgctgaacgagggggcgctgctgctgcccggcctgacggtgggcagctgggagtggaatctgtacggggggtcgggccgcttcgacaacgatctccccctgtccgagttcggcgaggaggagcgccggaccctgctgcacggttcggggttcaccgtccgcatcgacatgcggaccgcctcggccgacatgcgtttcgagggggtcgtgacgcgcttcgagcgcctgtacctcaagcgcgacaccgcctcgctgtccgagaaacggcgcgaggcggccgcccggttcaccgtggagcgggagtgcggggcctgcggcggggcacggctgaacgcggcggcgctcgcgacccggatcgacgggctctcccccgccgactacgggcggatggaggtctccgaactcgtcggcgtccttgagcggatcgacgatccggtgggcgggcccatcgccgccgccgcccgggaacggctggagcggctggccggcatcgggctcgggtatctgagcctggaccgggagaccacgaccctgtcggggggcgagggccagcggctcaagatggtgcggcacctgggcagttcgctcaccgggctgacgttcgtcttcgacgagcccagcgtcgggctgcatccgcgcgacgtcgggcggctgggcgatctgctggtgcggctgcgcgacaagggcaacacggtgctggtcgtcgagcacgacccggatgtgatggccgtcgccgaccatgtcgtcgacatggggccgggggccggttccgacggcggtcacgtcgtcttcgaggggaccttcgagcgactgcgcgaggccgacaccctcaccggccggtcgttgcgcggccgcaccccgctcaaggagacggtccgctcccccacgggccggctcccggtgtacggggccgatctgcacaatctcaaggagctggacgtgtcgttccccgccggggtgctgaccgcggtgacgggggtggcgggatccgggaagtcgaccctggtgtcgcgggtgttcaccgcggcgtacccggaggcggtggtgatcgaccagagcgcgatcacggcctcgtcccgctccacccccgcctcgtacatcggcgcgctggacgccatccgcaaggtgttcgcccgggagaacggcgtggacgcgggactgttcagcttcaactcggccggggcctgcgcgggttgctcgggccgcggagagatctcgaccgatctggcgttcatggatccggtcaccacgacctgtccggagtgcgagggccgccggttccacgacgatgtgctgaagcaccgggtcggcggccggtcgatcgtggacgtcctggacatgacggcggagcgggcggccggactgttcgaggatccggtgctgctgcggaagctgcgcaccctcgacgcggtcggcctcacctacctcaccctgggccagccgctctcctccctgtcgggcggtgagcgtcagcggatcaagctcgccacccagttgcaccgcacctccagcgtgtacgtgctggacgagccgacgaccggactgcacctggcggacacgggcacgctggtggatctgctggaccggctggtggacgcggggaacacggtgatctgtgtggagcacaacctggatgtggtcaagcgggcggactgggtgatcgacctcggtcctgacggcggcaagggcggcggggagctgatcttcgaggggacgcccgccgatctgctcgcgcatcccacgtccgtcaccggccggtatctgcgccgggacccgggggtggaaccgctcccgggtcccggggtggaacaaccccgtaccgccgggtcggagcaacccattccggaacggtgaaacgggggcaggaagggcccccgagaaggctctcgcacaccgcgccacctgggtgtatgactccgtgtatccactcacttccccggacgggcttggctttggccttacggtcgccttaacctacggtcacgtaacctacgaagccgtaggtaattctcccgtccccaggagctccccgtgacagtcacctctccccacctcggcagctcgaaggcgtggaccgacgcccagctgctgtacgcgctggaagaggtggtggagaaggaactcaaccgccatctcaaggtcgccaaggactggatgccccacgagtacgtccccttctccgacggccggaacttccccggtatcttcgaggacggcgaggcgtgggcggccgaccagtccaaggtcaccgacatcggcaagatcgccctcgtggtgaacctcctcaccgaggacaacctccccagctaccaccacgagatcgcctccctcttcggccgcgacggcgcgtggggcacctgggtgcaccgctggaccgccgaggagggccgccacggcatcgtgatgcgcgactatctgctcacctcgcgcgccgtggacccggacaagctggagcagttccgcatggcgcacatggcggagggcttcgagtcggacaaccggcactcgatgctccactccgtcgcgtacgtcgccttccaggagctggccacccgcgtctcgcaccgcaacaccggccaccagtccggcgacccggtctgcgaccggatgctggcgcggatcgcgaccgacgagaacctccacatggtcttctaccgcaatctcctgggcgccgccttcgagctggccccggacctgaccatgcaggccgtgcgcgacgtcgtcgtcgacttccggatgcccggacacggcatgccgggcttcgagcgggccgccgcgcagatggcgatcggcgagatctacaacatgcgcatccaccacgacgacgtgatccagcccgtgctgcgcttcctgaaggtcatggagatcgacgggctcggcccggagggtgcgaaggcccaggaggagctcggtctgtacatggacggactggacagcgaggcgtcgaagttcgacgagaagctcgccgccc

SEQ ID NO: 3296 - DNA, 9491 bp, Unknown
  Kingdom: Bacteria, Phylum: Actinobacteria, Class: Actinobacteria, Order: Streptomycetales, Family: Streptomycetaceae, Genus: Streptomyces
acagccgtccgagccggtcgcgcagcaggatcgcggccccgctctgcgtcgccgccagcgctaccaccagcagcgacggcggatgcgagttcgtccgcgcctcgcccggcaccccgaccatcgacgccgggtagtggaaggcgagcagcagcgcggcgaacagcaccccgccgccgatcagcagcatcctggccccgcgcttcccgatccgcccctcgccccaggacacgccgagctgatacgcgaagagccagccgggcaggatgttgagcatgctcagccaggacggcatcacctccgcgaagggcccgtagcgcaggaagtccaccaccgcgaccgaggccagcagcggcagcgccgcccagccgccgagcttccgcgccagcgtgacgcagaccggggtgagggccgtgaccacggtgtacaccccgacgaaccagagtggctggatcaccagcgtcgaccccgtacgcagggtgtcgccgggcacgcccagcgcggacagcaccgagagcagcaccgcccacacggcggtcaccccgagcaccggccggccgaggcgggccagccggccgcccagccaggccgtcgtcgtcgaggcccggcggcggtaggagagcaccgaggcgtatccgccgacgaggaagaagatccccagcatctggagcacccagctcgcgggcgcgagcccggcgaacgtcgagagcgggctcgcgttgtgcaggccgtcggcgtccagccggaacccgccgagcatccagtgaccgagcggcacggcgagcaggagcaggtcgagcctcccggcggcgaggccttccagcagtgaggaggtctgctcctcgtggacctggaggtcgaggtccacgtaccgctcgtggacgaggcggagcacggtgggcagcagatacggggcgacagtggggatcacgccgagccggagcactccggtgaacggagcccggaccgcctccgcctcctccatcagcgcggcgacggcctccagcaccgccccggcgcgcaccgcgagccgctcccccgcgggcgagagcagcaccttgcgcgtcgtacgctcgatgagctggacacccagtgcctcctccagggtggacaccgcgccggagagtgcgggctgactcatcccgattgctgccgccgcgtcccggaagtgcagatgctccgccacggccgtgaaggcgcgcaactgcgacaggctgggctgcttggcggccgacctaccggactgcttgggacgtatgccctgattaccctggcccactgataggcacctccgatcatctcgaccgagtgtagctatttccgtgatcaatgcactctgtgccaaggtggaactcgtccaaccctcaggaacgcccccaaaaggggaattccagacgttgcaaggagagcgcgtgctcactgtcggtgacaagttccccgagttcgacctgactgcttgtgtttcgctggagagcggcaaggagttcgagcagatcaaccacaagacctacgagggcaagtggaagatcgtcttcgcgtggccgaaggacttcaccttcgtgtgccccaccgagatcgccgccttcggcaagctgaacgaggagttcgcggaccgcgacgcccaggtcctcggcttctccggtgactccgagttcgtgcaccacgcctggcgcaaggaccacccggacctgaccgacctgcccttcccgatgctcgccgactcgaagcacgagctcatgcgtgacctcggcatcgagggcgaggacggcttcgcccagcgcgctgtcttcatcgtcgaccagaacaacgagatccagttcacgatggtgaccgccggttccgtgggccgtaaccccaaggaggtcctgcgggtcctcgacgccctgcagaccgacgagctgtgcccgtgcaactggaccaagggcgagaacaccctcgacccggtcgcgctcctctcgggcgagtgagctgataccgacatggctctcgacgaactgaagtccgccataccggacttcgccaaggacctgaagctgaacctcggctcggtcatcggcaacagcgacctcccgcagcagcagctgtggggcaccgtgctcgcctgcgcgatcgcctcgcgttcgccgaaggtgctgcgcgagctggagcccgaggcgaaggccaacctctccgccgaggcgtacaccgcggcgaagtcggcagccgcgatcatggcgatgaacaacgtcttctaccggacccggcacctgctgtcggacccggagtacggcacgctccgcgcgggcctgcggatgaacgtcatcggcaacccgggcgtggagaaggtcgacttcgagctgtggtcgctcgccgtctccgcgatcaacggctgcggccagtgcctggactcccacgagcaggtgctgcgcaaggccggcgtggaccgtgagaccattcaggaagccgtcaaggtcgcttcggtgatccaggcggtcggtgtgaccctcgacgccgaggccgtactcgccgagtagtgacaccgcaccacccctgatacgagaagagccccgaggacgaccgaccgtccccggggctcttcttttcgttccgcgccgtctcccgtgccgcctgccgtgcccttccgctactcctggtgcggccgtttctcctgcgcgggttcgcccggggagccctgcggacccggcggcgcaggcgccgcgtgcgccggactcatcgacagggcggtggccccgtggtggccgccccgctcgcccggctccccgtacgagcgcagatagccgaccaccgtgttgatcacggcgaccagcggtacggcgaccaccgcgccgccgatgcccgcgaccaggccgccggtcgccaccgcgaggaccaccgcgagcggatgcacccggacggcgcggccgaggatgaacggctgcaggatgtggccctcgatctgctgcaccgccaggaccaccaccagcgcccacagcgcggtccacactccctcggtgaccagcgcgacgaccaccgcgagcgccccggagacgacggcgccgacgagcgggatgaaggcgaacaggaagatgaagacggccagcggcaccgcgagcggcacattgaggacgtagaggccgaatccgatgaagatggcgtcgatcagggcgacgagcaccgtgccgcgcacatacgcggtcagggtgcgccaggcgcgcggtccggcgccggcgaccccgggacgggccgcggcgggcaccagcttgagcgaccactcccagatgcgcttgccgtcgtagaggaggaagagcgtggagaacatcgccagcagcagcccggtgaggaactccaccatcacggtgacgccctggagcccggcggaggtgatctcctcggtgttggtgccgatggtgtcgttgaggttcttggcgatgtcgttgatctgcgactcggtgacgtggaagggactgtcgagcagccagcgcttcaactcgtcgatgccgtcgcggacccggtcggagagcgtgtcgaggttgtccatcacctgccacaccacgaaccagccgaccaggccgatgacgacgaagccgaggacggcggtcacggcggtggcgaacccgtggggcagcccgaaccgcttgagccggaccacggtcggctggagcatcgcggtgacgagcaacgcggcggcgaaggccagcaccacgagctggaccgcgctgatcacccgcatcagcacccagagcgtccccgcgaggacgaggaggcgccagccggcctcggcggcgacccgcatcccccacgggatcgccgccaccggatccggcttggcggcgaccgagggggcgtacgagggtggcgcgggcacctgtccggcgtcgtcggcctccgggacggccggtaccccgcgcggcgcgagagggtcctcgtcatcggcggcggcgcgcgcccgccgctcgtccagtcgcgcacccagttccgtcagttcggacccgaagcggcccagccagcccggtagtttcgacatgcttgctttccttcccccatcttcgccacccagcgcttctcagcgttttccccccgctccccgggaccgccagggtgcgaccgtacacgcgcgaggccccccaccgtctggacggtgaggggcctcgcgaggttgagagggcggtccgtggacttcgcccgctcgctctaataccagttgttggcctgccagaaggaccaggcgccgcacgggctgccgtaacggccgtccatgtagctgaggccccacttgatctgggtggccgggttggtctgccagtcggcgccggcggacgacatcttgtgacccgggagcgcctgcatgagcccgtacgccccggaggacgggttggtcgcgcggtagttccaggtcgactcgtggttcacgatgttgctgaagcactggaactggtccgcggggaccatctgacgggccatcgcctggacgtcggccacgctgtaggagccctgcgcggagaacgatgcggcgtcgcggacggaagaacggctggcgcgctcggcctcttccttcttctccttctccgccttgcgctcggcctcgagccggtcctcggccgcctgcttcttggtcttggcgtccttggcggcctggaggcgggccgattcctcggccgacttcttcgcggcggcgtcggcggcggatgcctgggcatcggcctgctgcgtcagcgaagcggtctggacctgggcctgctggcccgcggggatgtctgcgagcagcgtggtgtcggctgcggccgcctcgaagttgttgtcgtcgggggcaggtgtgccgcccgcagcaacgcctacgacggcgccaacggtggtgaccgcggtggcggatgccacggcgaacccccggaccgagatccggctcacatggtgtccttccagcatcgcccgcttaggtgacctcgcgggcgcgttcgtgcccctgacactggcctccctactgcgtgggtcacgggaggcacgggcccgatgggcaaccccggcgagggggttgccgcgtggtgctcgcgggcggcatacggacgtctcgtgttgagttgtgtgatgcgtggcgcctctgaaggtgcccaagtgccgtatgcggggcctgacggaagcaagactctgccggacgggagcgccaggaggcaattctgtgttgcgtgggaaaggtcacacctcgtttggccccctggtttttcggaaatgacggcgcagcacaatgccgcccggctaagctccttggctcgccgggcggcatcaaagggacatgcgtgtcagatgtggccttcctccagcatttcggtcaccagcgcggcgatctgcgaccgctccgaccgcgtgagcgtgacgtgggcgaacagcggatggcccttcagtttctcgacgacggcgacgactccgtcgtaccggccgacccggaggttgtcccgctgggccacgtcgtgggtgagcacgacacgcgaattcgccccgatccgggacaacacggtcagcaggacgttccgttcgagcgactgcgcctcgtcgacgatcacgaacgcgtcgtgcagggaccggccgcggatgtgggtgagcggcaggacctccagcatcccgcgcccgagcacctcctcgatgacctcgcgcccggcgaccgccgagagcgtgtcgaagaccgcctgcgcccagggactcatcttctcggcctcgctgccggggagatagccgagctcctgcccgcccaccgcgtacagcgggcggaagaccatcaccttcttgtgctgccggcgctccagcaccgcctccaggcccgcgcagagagccagcgccgacttgccggtgccggcccggccgcccagcgacacgatgccgacgtcggcatcgagaaggaggtcgagcgcgatccgctgctcggcgctgcgcccgtggatgccgaaggcctcccggtcacccctcacgagccgtacgttgccctcggccgtcacccgtcccagcgccttaccgcgctcggactggaggaccagaccggtgtgcacgggcagttcggcggcctcggggacgtacagcgtctcctcgccgaacagcaggtcgatctgttccccggcgagggacagttcgctcataccggtccagccggagtccgtgatggcgagctccgcgcggtactcctcggcgaggaggccgacggaggacgccttgatacggagcgggaggtccttggagacgaccgtgacgtcgtacccctcggcctggaggttgcgtgcgaccgcgagaatccgtgagtcgttgtcccccaaccggtagccggcgggcagaacaccgggatcggagtggttgagttcgacgcggagcgtcccgcccaggtccccgagcgggatcggggcgtccagccggccgtaccggacccggaagtcgtccagcaggcgcagggcctgccgggcgaagtatccgagctcggggtgatgccgtttggcctccagctccgtgaccaccacgatcggcagcacgacttcgtgctcgtcgaagcgggccatggcaccgggatcggccagcaggacgctggtgtcgagaacgtatgtgcgccggtcgggcatgcggcgcttgctgctggtcaccacggaaggacgtaccccctcggacgaggtcggggagtgcgacggacggtcgcggagcttcccgaagggagaggacggaccgggatcgggcccctgtgcgcgggccggaccacggccaccgcgtcggccgcagactgtctacggtccttcgtgtgcaaagggcctcccgggcgagcggtcttggcaccgctcacttggatgcgacatccgcctggttgatgaccggacgtcgacctgacaggggtattcccttttccgcgcgaagccatgccgccgcatatgacacggtgtggagaagtcccggtggacgcgcggtgacccccttacatacgcgatggctcccctatataggggagccatcgacggacgtgcgggcgggaggggtgtttcaggacacctcaggccccgtagcggcggtggcgggcggcgtagtcgcgtagcgcccggaggaagtcgaccttgcggaaggccggccagaagacctcgcagaagtagtactccgagtgggcgctctgccagagcatgaagcccgagagccgctgctcgccgctcgtccggatcaccaggtcggggtcgggctggccccgggtgtagaggtgctcggagatcaggtcggtggagacgacctcggccagctcctcgaaggtcgtgcctttctccgagtgctccaggagcagggagcgcaccgcgtccgcgatctcctggcggccgccgtaaccgaccgcgacattgacgattattccgtcgatgtcggacgtcgcctcctgggcctccttgagcaccgactgcgtctccggcggaagcaggtcgagcgtgccgacgtgatggacgcgccagcgcccgtccgcggcgaggttgcgcacggtgttctcgatgatgccgagcagcggcttcagctcgtgctcgggccggtcgaagttgtccgtggacagcatccagagggtgacgacctcgacatcggtctcgctgcaccagccgagcagctcggagatcttgtccgcaccggcctggtggccctgcacggccgatccgccggacgccttggcccagcgccggttgccgtcgaggatgaccccgatgtgcttcggcacctggtcgtggtccaggcggcctcccacccggcgcgcgtagagcctgtacaccaggtcgcggaagttcactgcgttcaccctctcggttccgtacgggcccggagcccgccctccccgtcgccgggggtccgggggccgtccccccgcaggggatcgccgcacggtctgcgccgcccgcacgatccctcggcggtccgcgcctttaccactggcacggccacgcgggccttcgccgcgccgcacatcggcgttccccgaagccgccacattactgcgaccgggccatgggggcccaacccggtctgtcacaactccgtgataaggaatgaaacgtgactgattacctctcccccggcctgcgccaccgcgccgccgactcccgttacgactccatggagtaccgccggaccgggcgcagcggtctcaagctccccgctctctcgctgggtctgtggcacaacttcggcgacgaccgggccctggactcccagcgggcgattctgcgccgtgccttcgatctcggggtcacccatttcgatctggccaacaactacggtccgccgcccggctcggccgagctgaacttcggcaagctcttcgcccaggacttcaccccgtaccgggacgagctggtcatttccaccaaggccggttatctgatgcaccccggcccgtacggcgagtggggctcccggaagtatctgctgtcctcgctcgacgcctccctgaagcggatgggcctcgattacgtcgacgtcttctactcgcaccgcttcgacccgcacaccccgctggaggagacgatgggcgccctggcgtccgccgtccagcagggcaaggcgctgtacgtgggcgtctcctcgtacactgcggagcagaccgccgaggcggccgggctgctgaaggagatgggcgtgccggcgctgatccaccagccgtcctactccatgatcaaccgctggatcgaggacgacggactgctcgacaccctggaggcggccgggatgggatgcatctccttcgtgccgctcgcccagggcctgctcacgaacaagtacctgaagggcattccggagggttcgcgcgccacccagggcaagtccctcgacccgggtctgctctccgacgaggtggtccgccggctcaacgggctcaacgacatcgcgcagggccgcggccagtcgctcgcccagctcgccatcgcgtgggtgctgcgcgacagccggatgacctcggcgctgatcggcgcgtcgagcgtgaagcagctggaggagaacgtggcggccctcgcgggcccggcgctgaccgccgacgagctcaaggagatcgacgccttcgccgtggacacggcgggcacgaacatctgggccggtcgcagctgacgtcggctcaccggggctcgcgcacaggggagaacggaagctccccggggccgctcggcagcgccgacgccgacccgtaaaaacgggccggtccgtggggggggatacggaccggcccgagggggggtttccaccataacccttcgtaagtactggcgcgtgccgcgccactccacaattactctccggattcgccggactgcattccgggcagggcggacgcccgccgggcttccgttaccggcccggtatcggccccggtagcgaagggtcgcggtacggcgtcggcttgacgccgccggggtccagaggacggaacccgaccccttatggccctaggttcgacgcatgacgacacgatcccctgcgacagcggccgtgacctggaccggggcgaacgcccggaggctggcccgccagcacctcca

SEQ ID NO: 3297 - DNA, 771 bp, Unknown
  Kingdom: Bacteria, Phylum: Actinobacteria, Class: Actinobacteria, Order: Streptomycetales, Family: Streptomycetaceae, Genus: Streptomyces
gctggccgccgcgctggagcggctctgcgccggcacgaccgcaccggacctgaccgtacggttcgcggtgagcggcaccccggtggagctgccgacgccgtacgaggtggcgctgctgcggaccgcgcagtcggcgctggccaacacggtgcgccatgcgcgggccgggcgggcggagatcaccctgagcttcatggacacctcggtggcgctggacgtcgtggacgacgggcagggcttcgacccgtcgggagcgccggtccacgagcgcggcgacggcggcttcgggctgccggcgatgcgggcgcgcgcagggtcgctcggcggtgcgctgagcgtggagtcggcgccgggacagggaacggctgtggcggtcaccctgccgctgcccgtcacggaagcggagcgtgcggcatgagcgggagcggggacgcgatccggctgctgctcgcggacgaccatccggtcgtccgggcggggctgcgcgcggtcctggacaccgaaccggacttccgggtcgccggtgaggccgccaccgccgaggaagccgtcgccctggctgcggcgggcggcttcgacgtggtcctgatggacctccagttcggtgcgggcatgcacggttcggaggccacggcgacgatcaccgccgcaccggacggtccccgggtcctgatcctcaccacctacgactccgacgcggacatcctcgcggcggtcgaggcgggcgcgagcggctatctgctcaaggacgcgccgccgccgtgcgcaccg

SEQ ID NO: 3298 - DNA, 4512 bp, Unknown
  Kingdom: Bacteria, Phylum: Actinobacteria, Class: Actinobacteria, Order: Streptomycetales, Family: Streptomycetaceae, Genus: Streptomyces
aggacgacgcgggggatccggcgaaggccctccgggcggccggtcggctggcggcggaccccgaggtcatcgcggtcgtcggccccaccggaaggcttctgcgcgaggacctcgtcgagcggtacgggacggagcggctcgccaccgtcgtcgtcgcggccggttccaccaccgccgagtcgggcaccggcctccacctctgcgtgacccgccccttcgaccgggtgctctcgcccggcctcatcagctacgtgacccgtacgcgccccgcgacccgcatcctgctcgtcgaggacgccgccgacccggtgctcgcggcggagatcggggtcgcgttccgcgaggccgccctcaccggcgccacccttgtcgaacatcgcctcgtccgggggaacgcgggcttcgccgccgtcgcccgcaaggccatgaccagccgggccgacgccgtggtgctcggcggtggcaacgcgtcccgggccgcccgcctggccaccgcactggcgggcgagggcttcaccggcaccagggtcgccgtcggacccgccctcgcacccgccttcctcgcgggcgcgggcgccgccgccaacggctgggtcttcgccgaggcgtacgccgatcccacggccctcccgtcggcccggacgttcaccgccgcgcaccgcaagcgcttcggcgcacccccggccacctgggccgccgaggcgtacgacgcggtcggcctgatcgcccgtgccgccgggaccaccagcgcctcgggggaggtgcgcagcggcatcgcccggcggctcgtgcggaccgagcaccgggggatcgtgcgcaccctcgccttcgacgcctcgacccgccaggtgcgcatcccggacgggatcttcctctaccggatcgagaagggccgaccccgcttcctgggcccgttcggcgacgtgcagccgtcacggcaggggcccggcgacggcagcggtcggtgaagccacggccaggcgtgaagatctcctgcgaccgcgcttaagaaatcctcgatggacccgggccccgtcgtacggcagatttctccgtgacggccgaggatggcgcgtggagccgtacgacgtgcggccgtacgtcgtgcagccgtacgacgcggaagtcgtgcgacgagctccgtccgtcccgccgcgctcccgccatgggggcgatcatccgaaaaccaccccgggccgcagggttcttccgacatgccccgaggcccggggtatccactcgcgtaccgacgtcagggagcagcggccgtgaaggcactcgtcaagcagaaggccgaacccggactgtggctgatggacgtgccggagccggagtacggccccaccgacgtcctgatcaaggtcctgcggaccggcatctgcggcaccgacctgcacatccgcgcctatgacggctgggcccagcaggcggtcaccaccccgctgatcctcggccacgagttcgtcggcgaggtcgccgcgaccggctccgacgtcgcggacatcgcggtcggcgacctggtcagcggcgagggccacctcgtctgcggcaagtgccgcaactgtctcgccggccgccgccacctctgccgctccaccgtcggtctcggcgtcggccgggacggggcgttcgccgagtacgtggtgctgcccgcctccaacgtctgggtgcaccgggtccccgtcgacctcgacatcgcggcgatcttcgacccgttcggcaacgccgtccacaccgcgctgtccttcccgctcgtcggcgaggacgtcctgatcaccggtgccggaccgatcggcatcatggccgccgccgtcgccaagcacgccggggcccgcaacgtcgtcatcaccgacgtcagcgaggcccgcctcgccctcgcccggaaggtcggcgtcagcctcgccctcaacgtcgcggaccggaccatcgcggacggccagcgggaactcggcctgcgcgagggcttcgacatcggcctggagatgtccggccgccccgaggcgatgcgcgacatggtcgccaacatgacgcacggcggccggatcgcgatgctcggcctgcccgccgaggagttcgccgtcgactggtcccgcatcgtcacctcgatgatcaccatcaaggggatctacggccgcgagatgtacgagacctggtacgccatgtccgtcctgctggagggcggcctcgacctcgcccccgtgatcaccggccggtacggcttccgcgacttcgaagcggccttcgacgacgccgcgagcggcctcggcggcaaggtcatcctcgactggaccgtctgacctcccgaccgcccttcgcccttgatcccctaaggaatcccgcatgttcgactccgtacgcgacgatctgcgcaccaccctcgacgagatccgcgccgccgggctgcacaagcccgagcgcgtgatcggcaccccgcagtccgcgaccgtggccgtcacctccggcgggcgcgccggcgaggtcctcaacttctgcgccaacaactacctgggcctcgccgaccaccccgaggtcatcgccgccgcccacgaggcgctggaccgctggggctacgggatggcctcggtccgcttcatctgcggcacccaggaggtccacaaggagctggagcagcggctctcggccttcctcggccaggaggacacgatcctctactcctcctgcttcgacgccaacggcggcgtcttcgagacgctgctcggccccgaggacgcggtcatctccgacgccctcaaccacgcctccatcatcgacggcatccggctctccaaggccaagcgccaccgctacgccaaccgcgacatggccgacctggagacccagctcaaggaggcgtccggggcccgccgccgcctgatcgtcaccgacggcgtcttctccatggacggctacgtcgccccgctccaggagatctgcgacctggccgaccgctacgacgccatggtcatggtcgacgactcgcacgccgtcggcttcgtcggccccggtggacgcggcacgcccgaactgcacggcgtcatggaccgggtcgacatcatcaccggcaccctcggcaaggcgctgggcggagcctccggcggctacgtcgcggcccgcgcggagatcgtcgccctgctgcgccagcgctcgcgcccgtacctcttctccaactccctcgccccggtcatcgccgccgcctccctcaaggtcatcgacctgctggagtccgccggggacctgcgcgagcagctcaacgccaacaccgcgctcttccgcacccggatgaccgaggagggcttcgacatcctgcccggcgaccacgccatcgcccccgtcatgatcggcgacgcgggcaaggcgggccggatggcggaactgctcctggagcgcggggtgtacgtgatcgggttctcctacccggtcgtcccgcaggacgcggcccgtatccgggtccagctctccgccgcgcactccacggccgacgtgaaccgcgccgtggacgcgttcgtcgacgcgcgggccgccctggacacggaggcgtaaccgctcaccgggtcgggcactcgccgcgacctgggacaatgggcacatgatcgatgcgcggcggctgcgaatcctccgtgcggtggccgaccaccgcacggtgaccgcggccgccgccgcgttgtacctgacgccctccgccgtctcccagcagctcgccgccctggagcaggagaccggccaccgcctcgtcgaacggggtgcgcgcggcgcccggctcaccgccgccggggagatcctgctgagccacaccaacgtggtcctggcccagctggagcgggccgaggcggagctcgccgactacagcgcgggcgtcgccggtacggtcacggtcgccgcgttcgccaccggcatcggcctcgtcctcgcccccgccctcaccgagctggcccgcaccgcgcccggcatccgggtcaaggtccaggacgcggagggcgacgcgagcgtgccgatggtgctggaccggcaggtcgacgtggcggtggccgtcgaataccggggcgcgcccgccgaggacgaccgccgcctgacccgcgtccccctgtactcggagccgttcgacgcggtgctcccggtggaccaccgcctcgcggaccaggaccaggtggcggtcgccgacctcgcgaaggacccgtggatcggtccctacccgggcaacccctgccatgacgtggtggtcctggcctgcgagttcgccgggttcgccccccgcctcgaacactcgtcggacgacttccgcgccgtggtcgccctggcgggggccgacgccggagtggccctggtgccccggtccgcgctgcgcgggatggaactgaccggagtggtcgtccgccccgtcgagggcagcgcccccacccgccgcgtcttcgcggccgtacggcagggggccgagggccatccgctgatccggccggtgctggacgcgatggaagcggtggccgtacgggaagcgggcctggcgcggacctgagc

SEQ ID NO: 3299 - DNA, 3380 bp, Unknown
  Kingdom: Bacteria, Phylum: Actinobacteria, Class: Actinobacteria, Order: Streptomycetales, Family: Streptomycetaceae, Genus: Streptomyces
gggggcatagggggcgaagtgtggagcgggtgacacaggtcggggcaccgcgctcacatggttcagtgtgcgcggtgccccgcccgaacgtgcagaaccgcaggccaggtgttacttcaggccggggtacagcgggaacttctcggccagcgcgaccacgcgggccttgaggtcgtccgcgtcgtaggacggcttgagggcggcggcgatgatctccgcgacctcggtgaagtcctcggcgccgaagccgcgggtggccagctcgtggagccggtcctcggcctgctggccgtccagctccgagttgcgcaggtcgaccaggaccaggtgcacgtcggttccgccggagaggacggatacgcccacctcggtgacgtccggctggatcaggcgctcggccaggatccgcgcgccgtccagggtgcgctgctggcgctccttgaactcctcgcccgccgcgatcttgaacgagaccgccttggccgcgatcacgtgctccagcgggccgccctgctgacccgggaagaccgcggagttgatcttcttggcgagctcctgggtggagaggatcacgccgccgcgcggaccgccgagggtcttgtgcgtggtggtggtgacgacgtgggcgtgcggcaccgggttggggtgcagaccggccgcgaccaggcccgcgaagtgcgccatgtcgaccatcaggtacgcgccgacctcgtccgcgatgcggcggaaggcggcgaagtccagctggcgcgggtaggcggaccagccggccacgatcagcttcggctgggactccttggcgaggcgctcgacctcctccatgtccacgatgccgctctcgtcgacgtggtacgggaccacgttgtagagcttgccggagaagttgatcttcatgccgtgggtcaggtgaccgccgtgggccaggttcaggcccatgatcgtgtcgcccggcttcagcagcgcgaacatcgcggcggcgttcgcctgcgcgccggagtgcggctgcacgttcgcggcctcggcgccgaacagggccttgatccggtcgatcgcgatctgctcgacgacgtcgacgtgctcacagccgccgtagtagcggcggcccgggtagccctcggcgtacttgttggtgaggacggagccctgcgcctccatgacggcgaccggagcgaagttctccgaggcgatcatttcgagggtggactgctgacggtggagctcggcgtcgacggcggcggcgacgtccgggtccagctcgtggagggaggagttcagaagcgacatcagggggtcccttaaggtctcagttgccggagaacgcggtgtactcatcggcggagagcaggtcggccggctcctccgcgacgcgcaccttgaacagccagccgccctcgaagggagcggagttcaccagcgaggggtcgtccacgacgtcctggttggccgccgtcacctcaccggtcaccggcgagtacagatcgctgacggacttggtcgactccagttcgccgcaggtctcgcccgcggtcaccgtgtcgccgacctccgggagctgggcgtagacgacgtcaccgagcgcgttggccgcgtactccgtgatgccgatggtggccacgccgtcctcgagggccgacagccactcgtgctccttgctgtaccgcagctgctgggggttgctcatgacctgaattctcctgtacgcgggggagtgctgatgaacggtggtcttacggtgtgagacggaggtacgtcacttccgtgacgcctgcgtgcgtgagaaggcccgggttctcccgggatatcacttctggcgcttgtagaacggcagcgcgacgacctcgtacggctcgtgcgtgccgcggatgtccacgccgacgccctcggtgcccggcgcggcgaaggccgcgtccacataggccatggcgatcggcttgcccagggtcggggacggggcgccggaggtgacctcgccgatcaccttgccgtcggcgacgacggggaatcccgcgcgcgggacccggcggccctcggcgatcaggcccaccagcttgcgcggcggggcgctctcggcacgctcggcggcggcggtcagggcctcgcgcccgacgaagtcgccctccttctcgaacttcaccacccggcccaggcccgcgtcgaacggggtgagcgcggtcgtcagctcgtgcccgtacagcggcatgcccgcctccaggcgcagcgtgtcccggcaggagagcccgcaggggatcaggccgtgcggggagccggcctcggtcagcgcccgccacagctgctcggcgtgctcgggcgcgacgaacagctcgaagccgtcctcgccggtgtagccggtacgggcgatgagcgccggaaccccggcgaccgtgcccggcaggcccgcgtagtacttcagtccgtccaggtcggcgtcggtgacggccttcatgacggcgggcgactcggggccctggaccgcgagcagcgcgtaggcgtcccggtcgtcgcggacctcggcgtcgaagccgccgacgcgtgcggtcagcgcgtccagcacgatctgggcgttgcccgcgttggcgacgaccatgtactcggcctcgccgaggcggtagacgatcaggtcgtccacgatcccgccgtcctcctggacgatcatcgtgtagcgggcccggccgttgccgacggtggcgatgttgcccaccagcgcgtagctcaggaaggcggcggcctcgggtccggtgacggtgatctcgcccatgtgcgacaggtcgaagaggccggcccgggtgcgtacggcgtggtgctcgtcgcgctcactggcgtaccgcaggggcatgtcccagcccgcgaagtcggtcatggtggcgccgagcgagcggtgcagcgcgtcgagggcggtaagacggggggcagtgctcatggatacggctccagggcatgacgacgtcaggacgaatcctccccatctgtcatcggaacctgagaggttcgccgatagcccctgacggggtatgccctggagggcgccccggttcagggggctcggcttgcaccttgggtggagccgcggaacggctcgcttttcagatctgcctcatccacgcggtacggggcctgagagattcaagggaggatcttgctccttcggcgcccggctcacactgtggccggaactctcccgcgcggattcgaacggccggtatgcagttggcggggtcatcatcgcatgcattgggggagagtggggggcccggtccccgcgcaggtgaagacggcgaggccggttgtgcctcattgccttttctttacacttcaggggcaggcgtgggggacacgacggcagggggatgggcgatgacgttgcagcggtcggtaccgaccgc

SEQ ID NO: 3300 - DNA, 2794 bp, Unknown
  Kingdom: Bacteria, Phylum: Actinobacteria, Class: Actinobacteria, Order: Streptomycetales, Family: Streptomycetaceae, Genus: Streptomyces
gccgaccccgacgcccacgccaaggacgtcgcccagcgcggcgacaagacgtccccgggctggctccaggagtcctacgaccagctccagtccatggtctccacctccagcgagcagcaccgcgcctacctcgtcgcctgcatgcactacggccgcgaactggccgccgaggccaacgccatggcccgtgccgcccgcccccacggcggccgtaagctcgaccgcgacgccggcctcgccgtcgtcatggcccgcgagctcaccgacatctgcgcccgcctcgccgaggccgacatccgggtacgccagcccctcggccagagccgcctggcctccctcgtgcactccatgtacgaccccgaccaccccatcgaccacatccaggccatgaccaagcgcaacgcctggcccgccgaactggacgcggtcgagccgacgttcctccaggccaagacacgcgagtccaccacccgcgccccctggtgccacgccacggcctgggtgaaggaatggccgatgactcctgtcggcgtcaacttcctcgccccgcttctcgtccacacgcccgacgtcatccgcaccgtcgccgtctgcatggacctcgaacccaccgaggtcgccatcgaacgcatgctgaccgagaagaccaacgacgacgccgaggccagccgccaggccaagatgaaccgcaccgtcgacccacgcgacatcgccgcccacggccgactcgaccagcggggtgaagatctcgccagcggcgcggccggagtgaacctggtggggtacatcacggtgtcgtcccgctcccccgaggccctcgcccgcgacaagcgcacgattcgcgcctccgccggcaagtcgtatctcaagctggagtggtgcgaccgcgagcaccaccgggccttcgtgaacacgctccccttcgccaccggcatccgccgctgacgacctgacgccgtatcgatagccgctccacccctcgatcggtagcagctccaccacccgatcggtagccgctccaccacccgatcgagagccgctccaccccctgatcaccgcaccaccacccgcaggaagaaccgcaacaagagagggcacccccaccatgcgagaccccctgtccgcattgtcggatgccttcacctccttcctgttcggcaaggtggagacgacccgcctccccgtccgtacgtcgacgggccaggcgcaggccgtctacctccccaccgccgcccccggcctcggcgactccggcgtgatcatcggccgcgaggtctacagcggcaagggctacatctacgaccccttccagctgtacgggcaacagctccccgccccccactggctcgtcctcggcgaatccggcaacggcaagtccgcactggagaagacctacgtcctgcgccagctccgcttccgcgaccgccaggtcgtcgtcctcgacgcccagggcgaggacggcgtcggcgaatggaacctcatcgcccaggaactgggcataacccccatccgcctggaccccaccgcagcgctcaacggcggcatccggctcaatcccctcgacccctccatcaccaccaccggccagctcgccctgctccgtacgatcatcgaagtcgcgatgggccacgggctcgacgagcgttccggcttcgccctgaaggtggcccacgcctacgtcaccgcgaccatcaccgaccgccagccggtcctgatggacatcgtggagcagctgcgccaccccgagcccgagtccgccgaggcgatgaacgtcgacatagacgatgtacgggcctggggcctggacgtcgccctcgtcctggaccggctggtcgacggtgacctgcgtggcatgttcgacggacccacgaccgtcggcatcgacctcgacgctcccctcatcgtcttcgacctctcgcacatcgaccgcaactcgatcgcgatgccgatcctgatggcgatcgtcggcgtctggctggagcacacctggatcaggcccgaccgcaagaagcgcatctttctggtcgaggaggcgtggcacatcatcaactcccctttcgtcgcccagctcttccagcgcctcctgaagttcggacgccggctcggcctctccttcgtcgccgtcgtccaccacctcagcgacgtggtggacggagccgcggcgaaggaagcggcggccatcctcaagatggcctccacccgcacgatctacgcccagaagtcggacgaggccagagcgaccggccgggtcatcggcctgccccgctgggccgtcgagatcatcccgacgctcacgcccggcatcgccgtctgggacgtcaacggcaacgtccaggtcgtcaaacacctgatcaccgaggccgaacgccccctggtcttcaccgaccgcgccatgaccgagggatcgacggacgacctgctccccgaggacatccgcgccgccgaactggaggcggagcaacgggcggcccggatcgagcaccagcaacggatgaacgagtcgtcagagtcaacggtggcatgacatggcacgccaggcggcgcggggccggggcccggcccatcacgacggacacgaccggccccagggcggcggcatcccggacggcctgctgatcggactcctgggcctcctcttcgcggccaccctggtcgcctggacggccacaggcctcgccgggctcttcgcccacggggcctggccggacggcgtgacgttcacccggtccccgctcgctctgcgcgagctggccaccgccccccaggacctcgccgccgcctggccggggacgcc

SEQ ID NO: 3301 - DNA, 10410 bp, Unknown
  Kingdom: Bacteria, Phylum: Actinobacteria, Class: Actinobacteria, Order: Streptomycetales, Family: Streptomycetaceae, Genus: Streptomyces
tcacacggttcatccgccgcttcttcgcggcggatgaaccgtgtgagcctgcacggctgttgcctgtccagcgccgggtaccggtgcactctccatcgtcatcgctcggtgcgcttcctcgtcgtggggccggacatgccggccagttcctggtagagaccggcaaccgcctccgcggtccgtcggacgtcgaaggacgcgcgggtgtggcgcagggcccggcgggacagcgcctcgcgcagttccgggtcggtgagcaggacggtcagcgccgcggccagggcggccggatcctccggcggcaccaggcagtgggcctcgtggccgggcggcaggctctcccgcgccccgttcacgtccgtcatcacgacggcgcggccgcaggccatcgcctccagcggggccagcgccatgccttcccatcgcgagggcagcacgaggacgtccgccgcgcggatccacggccgcacgtcctcgcaggatccggtgaacagcacgcccggcggggccgattcctccagtccgtcccggtcgggcccgtcgcccaccaggaccagacgggccccggcgtccggcatccggcgccaggcccgcagcagtacgtcctgtcccttctgccgggtcagccggccgacgcagacgaccagcggagcgtcccggccgactccctccagtaagggcagcgaggcgcgggcctccgcccggtccccgctcccgccggggcggaaacggtcgaggtcgatgccgttgtggatgaccgaccagcgggcggcgatgcccgcctcctgtccggtgcggcgttcggactcgctgacgcacaggatgtgatcggcccagcgcgcgccgaaccgttcccagccgagcgcgagttccgcggtgcgtccgccgacggcctcgaacgaccaggcgtggggctggaacacggtggggacccggccgcgcaccgcgatccggccggcgagtcccgccttggcactgtgggcgtgcaccacgtgcgggcggctcgcgcggacgatccggcgcgcggcggccacctcacaggccagccggggcccgggggcccgggtgacggaccagtcgtggacctcggcgccggcggccgccgccccgagggccagcgggctgccgggcgggcaggccaccaccgggcgcagcccggacccggcctgggccctgacgagatcggtgacgacccgggccactccgccgtccacgggctgaaccaaatgaaggaccgtcaattggctttcttcagtacgacgcatgagcacgcacggctctcttcgctcaatccggtgaggaagacccaccggcaatggaggggtggcgtcgcggggccgggtgcgcgcatctacggcgttgtcgtcaatcaccaacgctccgcattgcctcaatcctccgccttgcagctgcacgcaccgagccccgctccttcttccacccccccattgccggtaggtctaagccgaagtgcactttggcagagttgtggcgaaatcgtgcgcgtgactcgctcatacgaccacaggggaatgacgcgtgcaggagggccgttcgagtggcggcgcagcagatcggcgcacgaacgtcggcccttcacgggcaccgggcgaaagggcttgccgcgcgcccctgtacggaaaggaggaggcgttccgtgcctgtcccgccgcttatatcgccagccgttttccggcatgccgtactccgccgatcgccgcaccggatggcggcaccatctatcggccgactaggccgttctcgctgtggcggacggagtggcgaaagagacgttcccggcgcgcgccacgatttccacctcgtcacccagagcccattccgcgacccgtgacgccatcgccgccggaaccacgtcactgatgtccggcgcggccggaatgtcgtacgtggcgtgggcgtcatggggcaggacgacccggtagcccagctccagggcccggcgtgcggtggcgagcacgcacatctccgacatcaccccgcacacggcgagcgcccggacgcccgccgccgacagcccggcctccagcgacgtcccctcgaaaccgtcgtccgcgctcttgcggatcaccctctcggccggcccggtgcgcacgggcaggtgcagctcccacccgggcgtccccggctcgtcgggctctccgtccgcgccgtcgttctgcagatggacgacgagcgccccggcctcccgggcccgcccgatcagatccgtcacccggtccagcagccggatcgcgtcgggcacggcggcgtcacccgcgacgaacgccgactggacgtcgatgacgagcaacgccgtgaccggtgcggggagggcggtcatgccgggggattcctcacgtcgtcgcggcgggtgcgcgggcgacgaccgatgcgcgggcggcgccgaagcgcgctccggcgcacgcggagcggattcgcttcgagggggcgctgctcatcgccgccgagcagctcggcagcgccgcccggaccaccgagacggccgttcaacacgccggggaccgcgagcagttcggatcgcccatcggatcgttccaggcggtcaaacatctctgcgccgacatgctcgcccgcaccgaaccggcccgcgccgccgtgtacgcggccgccgtgaccggcgagccggtggagatcgcggcggccaaactgctcgccgacgaggcggccgtacgcaatgcgcgcgactgcctccagatcctcggcgggatgggcttcacctgggaggcagatgttcacctccatctgaaacgggcctggctccggtccgcggcccggctcaccggggccggggcggaggagcttctggccgccggtctggggaccgcacggccgcatcccggcagctcgggggcgcaccgccggggagcccgggaagcagggggtggagggtgacgcagagcagccggccgatgccgataccggcttgtgtcctttgcgtgattcgtcaccgggtggagtcggtgtccggctcgggtacgctccgtgggatgcgagtggttctggaaccgggcgatccgggggcggcctgtgcggcggctccggtccggggtgagggctctcgccggagatgtgccgggcctgcccgaagagcgtttctcgcggtctctgcgcgcttctgttcgactccccgcagcgtgcgtcgcacagtatgcaccacgcgtactccttcgcgctggaatatgcccgaagcgcttgttgcggtgactgtacgtcaaccatgctgtcgcgtaagggaatcacgttccgtgaccctgaggaggcgcgaggcgatgtgtccgccggttcggatggtgtgagcggtgcaggtgcttcaggttcagttggaggtcggtccggatcccgcggaggtggggcgggcccgtaggtgggcgcggtcgcgtctggtcggttccgggataggggatgacgagccgctcgccgagacgctcatcctgctgatctcggagctggtcaccaacgccgtcgtccacacgggctgtcccgccgttctgcggatgctcttcggcgggaccggggcgtccggcgcggccgggaccgtccgggtcgaggtcgcggacgccagcgactgtccgccgctccagcggcatgcggagggcgacgacacgggcggccggggcctggagctggtggacggcctcgcggaccgctggggctggctgccggagggcgccgggaagcagatctggtgcgaggtcgaccggggcggccccgtgcggccgccggagacgccctcggtcgtcggccagggcggcgaggcgtgcgaatcgccctcctgcctcttcaccaacctcgcctgagcccggcctctccccttctcggggaggctgttcacaggaccgctaccggggccaccggcgagccggtggccccggcgaacggctccggcgacgcggtgagcaggaaggcgtgtcggccctcctccgcgcaggcctcggacagcgcctccagattccagttctggccctggagcatgcccatctcgaccaggtgcagcgcgtgcaccggcatccacaggtcctcgatctccggcgggaagatctcgaaggtcagggtgtcgttggcgaccgccgcgacatcccgggcgtggaaccactccggtgtgtgcaccgaaagtcccggcgacggatagccgtacgcctgccggtccccggccagcgccacccgcagctgcccggtccgtacgagcacgaggtccccggcccgtacgcgtacgcccccgaagtcctccgccgcggccaggtcctccggcgtcactgcgtgatcgccgggcagccggtccaccccccgggcgcgggccacgtccaggagcaccccgcgtgagaggaggtgctccacggtggcgatcgaggagaaccgggccccgccgtgggcggtgatcgtgtccgccggtcggccgttgtagatcttcccgctgtgcgatacatgggtcagggcgtcccagtgggtcgaggcctggagtcccatggtgacggtgtcgtcgctggtggcgaccgtgtcggggccgaagatctcctggttgatctggaccatcgtgtgcagcggattgatccggcccggaatgagcccgctctgcaccccgtcctgctggagcggcagcgcgagcggtatccggcggccggtgcggacggtggcgacggcctcgcgcacgacggcgtcggtgatcaggttgagcgtcccgatctcgtcggcctcgccccagcggccccagttgttcacgcgcttcgcgatctcgtggaactcggccggcagggacatggggacctcctgggtcttgtgccggagcgtctgactgcccataaaatctaacggtccgtcagaaaccgcgggaaggggccgggcatggggaacttcttggcaggcagggtggtcgccgtgacaggggccggccggggcatcggccgggcggtcgcgctcgccgcggcggcggagggggcgcgggtcgtcgtcaacgactacggcgtctccgtcgagggctccgaaccgaccagcgagatcgcccggtccgtcgtcaaggagatcggggcggcgggcggcgaggcggtcgcggtcgccgacgacatctccacgatggcgggcggccggcggatcgtggacaccgcgctggcggagtacggccggctcgacggggtggtctgcgtggccgggatcctccgggagcggatgctgttcaacatgtcggaggaggagtgggaccccgtcctcgccacccatctcaagggcacgttcacggtcttccgggccgcgtcggcggtcatgcggaagcaggagggcgggggcacgctgatcggcttcaccagcggcaaccaccagggcagcgtctcccaggccaactacagcgcggcgaagggcgggatcatctcgctggtgcgcagcgcggcgctgggcctgcacaggtacggcgtcacggcgaacgccgtcgcgccggtcgcccggacccggatgtcggccggggtgccgatggagctgaaggagatcggtgaacccgaggacgtggcggccctggtggtctacctgctcagcgagcgggcgcgggaggagcggatcaccggccaggtgtacacgatcgcgggcccgaagatcgcggtctgggcgcagccgagggagttgcgggcggcgtacggggagggcccctggaccccggaacggatcgcggacttcctgccggggacggtggggtcggacccgatgccgatgctggcgcggctggaggagatggcggcggcggcgaggtcgggcgaccggccgaaccagtgaccgccctcgggggcccgcccccgctccccggctcctcaatcgccggaggggcttgagccctcaggaactggaggcacgcatggacttccgtatgctcgcccgcacctggctgcgaagccacctcacagacgcccccgagccccgcacctgggaacgccagttgggcaaggccgggtggatcggcatcggctggcccggcgcggacggcgagaggtacggcaaccgccgcgccaccctcacccagcaggtcgtctgggccgaggagtacgcccgctccggagcccccgcccggatgggccacatcggggagaacctcctcgccccgaccctgatcacgtacggcaccgaggagcagaagcagcgccatctgccccccgtggcccggggcgagacgctgtggtgccaggggtacagcgaaccgggcgcgggctccgacctcgccggggtgcggaccgccgccgtgccggacggggccggcgggtacgccgtgaccgggcagaagatctggacctcgctcgccctggacgccgactggtgcttcgtcctcgcccgcaccgaccccggctccacccgccaccgcggactgtcgttcctgctggtggagatggaccagccgggccggatcgaggtgcggccgatccggcagctgaccgggaccagcgagttcaacgaggtcttcctcgacggggcgcgggccgccgaggtcgtcgggggcgagggcaacggctggcaggtcgccatgggcctcctcgccctggagcgcggggtgtccaccctggcccagcagatcgggttcgcgcgggagttggacaaggtggtcgccgccgccgtggcgagcggggccgccgaggacccggtcgtcagggcccggctcgtccggcagtgggcggagctggacaccatgcgccggcacgccctgcgcaccctcggctccgccggcgacccgggcgcgcccagtgtggcgaagctgctgtggggcggctggcaccagcggctcggcgaactggccgtgcaggtcgccggcgaggcgggggccgtcggacccgagccgtggtcgcagccgcgaccgtacgaactcgacgacgcacagcgcctgttcctcttcagccgggccgacaccatctacggcggctccgacgagatccagcggaacatcatcgccgagcgggtgctcggcctaccgagggagccgagatgagaggcgtcgtcttcgacggcacacggaccgaggtcgtggacgacctggagatacgggaaccgggtcccggggaggtgctggtggcggtcgccgccgccggactctgccacagcgacctgtcggtggtcgacggcacgatccccttcccggtccccgtcgtgctcggccatgagggcgcgggcgtcgtcgaggccgtcgggcccggcgtcggccacgtacggcccggtgatcacgtcgcgctctccaccctcgccaactgcggggcctgcgcccagtgcgaccgggggaggccgaccatgtgccggaaggcgatcgggcggccggggcggccgttctcgcggggtgggaagccgctgttccagttcgcctccaactccgctttcgcggaacgcacggtggtgcgggccgtccaggcggtgaagatcccggccgacctgcccctcacctcggcggccctgatcggctgcggggtcctgaccggtgtcggggccgtcctcaaccgggcgaaggtcgaccggggggacaccgtcgtggtcatcggcaccggcggcatcggcctcaacgtgctccagggggcccggctggccggggcgctcaccgtcgtcgccgtcgacagcaacccggcgaaggaggcggtggcccggcagttcggcgccacgcacttcctgacgagcgcggagggtgtgcgcgacatcctgcccgacggggccgaccacgccttcgagtgcgtcggccgcaccgagctgatccggcaggcgatcgacctgctcgaccggcacggacaggccgtgctgctgggcgtaccggcggcgagcgccgaggcgtcgttcctcgtctcctcgatgtacctggacaagtcgatcctcggctgccgctacggctcctcgcggccgcagcgcgacatcgccctgtacgcggacctctaccgggagggacgtctgctgctggacgaactggtcaccgagacgtacccggtggaggacttcgccaaggcggccgacgacgcacaccacgggcgggtggcgcggggggtcctggtcttctgatccaccggttcggacgaccgggccccgtcggcggtcttcagctcgccgagccacgcttcgaggccctgccggaggatctcggtcgcgtagggaacgttcttctcgacctgctccccggtgcgggtctcctcggtgcggacgaggacgccgcccgcgacctcgtccatgctcgtgacgtggctctgtcagctacgggacatggcgggacttcctgtaacgcacggcgggccgaggggtcaaccgctttcgtgataccttctaacgaaactttgagcaagtagcttcagggtcgggaaggtggtggcgaaacatggcggatgtggcggatgtggcgggtgcggcggatgcggacgcgaatgccggtgccgatgccggcggtggagccggtgcgaagtccggtgcgaagggcggcgggaaagccggtgcggcgaccccgcgcgagcgctatcgcgcccaggtgcgcgcggagatcaaggagcacgcctggaagcagatcgccgaggccggcgcctccgcgctctccctcaacgcgatcgccaagcagatgggtgtgagcggtcccgcgctctaccgctacttcgccggccgtgacgagctgatcaccgagctgatccgggacgcctaccggagcctcgccgacgccgtccacgcggcggccgtcaccggcgccgacccggccggactcgcgcacgtcctgcgcgactgggccctggcggacccccaccggtacttcctcatctacggcacccccgtccccggctaccacgcgcccgaggagatcaccggcatctcgtcggagatcatggccgacctgctgaccgcctgtgcggccctcgaaccggacgcgcccgccaccccgttcgccgcccacctggccgaccaccgcgactgggcccgcggccacccggctccgcccgccgcactccaccgggccctcatgttctggacccggctgcacggcgtgctgtccctggagctggccggtcacttcaccggcatggccttcgatccggccctgctctacgaggccgagatcgacggcctgcggacaccccggggctgaggcgcgggacccggccgaggtgcgagggtctcaggacgtggtgtccgccgaggagcggaacgtacgccggtaggccgtcggcggcacgcccagggcggcctggaggtgctggcgcagcgaggtcgccgtgccgaagcccgcgtcccgggccacctggtcgatggacaggtccgtcgactccagcagatgccgcgcccgctccacccgctgctgggtgagccactggccggggctgatcccgacctcctcgcggaagcgacgcgtgaacgtccgtacgctcatcgcctcgtgctccgccatgtcccgcagcaggatgggccggtcgaggcgggtcagcgcccaggcccgggcgccggtggtggtcgcgaactgcggctcggggacgggccggtggatgtactgggcctgcccgccgtcccggtgcggtggtacgacggtgcggcgggcgatctcgttcgcgaccgccgtcccgtggtcgcgccgcaccaggtgcaggcagaggtcgatcccggcggcgaccccggcggaggtgaggacgtcgccgtcgtcgatgaacaggacgcccgggtcgacgcggacctgcgggaaggtccgctggaagtggtcggcggaggaccagtgcgtggtggcggggcggccgtcgagatacccggccgccgccaggacgtaactgccggtgcagatggagaccatccgggtgccggtccggaccagggcgagcgcggcggccagctcctcggtgagccggccctcctcgaagaccgggcccagctcgtaggaggcggggacgaccaccgtgtcggcggtggcgagcgcctccgggccgtgctccaccaggatggagaagtccgcgtcggtccggaccgggcccggcgggcggatggagcaggtaaccacgtcgtacagcttcctgctcttcccgcccggctccgtgccgatactgcggccgaagatccgctgggggatgcccagttcgaagggaagcagcccgtcgagggccagaacgacgacgcggtgcggcacgacggcctcctcgaagatcacaggaaattctgtagtggtatagaccacgagctgatacaggttagcgacgtgatggagaagccgacagagcgcgcgtccattcccgacgccgcgtgcgacacccgaacgaccccgaacccggaccagcgcccggatcagcacccgaaccagcacccggccctttccccgctcgatcccggcggaccgggcggccccgccggatcgggcctgggctccgggtcctccttcggttccgcgcccggtccctcggggctctggaaccgcaacttccgctacttcttcgt

SEQ ID NO: 3302 - DNA, 1353 bp, Unknown
  Kingdom: Bacteria, Phylum: Actinobacteria, Class: Actinobacteria, Order: Streptomycetales, Family: Streptomycetaceae, Genus: Streptomyces
ggcggtgccgtcgggcgcgggggcctcctcggcctgctccgcctccgccttctcctcggtcccggacaggggcagcaagggggcgctggagttcccgccgaggacggcgaggaccagcgtcacggcgtaggcgacgcagaccgaggccaggacccagccgagacgtcggaaggtcttgccgcggcggccgctctcgtcgacgaagacgggaccgtcggagccgtccggcggggcgggttcgccgggcagttcggcgagctgacggcccagcccgtcgagctggatcgtcgcgtcgttgggctcatgcgtgtgcccggttctctgaccttcgcgccaattgtccacaagtgcagcccatcccccactcaagaatcaggcgcatggaactgactggttctttactgtcggactgggcccccacccgtccacgaacccggccttcctgcgcccggacgatgaatgtagcgcacgacattgacgcccaagtgcccctgaacggagttgatcaggaacggttgcgcatcagtgaccgatcgccctcgggaagccacgatccggccggcgggaccatccacccctcggcaagggccaactggtcagtagcagtgcgcaacgcgtctgtgccggggtggttcagacccttgcgccagaccagcgccagcggcgaaagcggaatcgggtcgacgagcgggcgcagcaccgttccgggcagcgccgggaagtcgacgacggcgagcacggggtgtccacccttcgacatgacccgctggaattcggccacccccacggcgagcggaacgggcggggccatcgtgatgtcccactcgccgaacagcagcgcggcgaggtccgtccactcccgcgtccgctcgttgccggcccccgcgtagacggtctctccggacagctcggccagagcgacgacctcccgcgcggcgagaggatgggagacgggcagcatcagggccatcggctcgtaccgcacggggtgcacggaaagtcccgcgcgcaccgcgggggccagtccggcgacccggccgaaagaggcgtcgagccggccggccaggatctcgccggcggcccaggtgagaccggactcgaagcgggccatcagctcgcactccggcagcagctcgcgggcgcgcgccagcacgcgggcggcggtcgccccgtcgctgttcaggtcgacgagcagcggccgtgcgggcgcaccgctgaaggccccggccagttcggcgtgcgcgtcgagcacccggcgggcatacgtcaccaggcgttcgccgtccggggtgagcgccacctgccgggtcgtacggacgaacagctcggcgcccagctcgcgctccagccgcc

SEQ ID NO: 3303 - DNA, 2048 bp, Unknown
  Kingdom: Bacteria, Phylum: Actinobacteria, Class: Actinobacteria, Order: Streptomycetales, Family: Streptomycetaceae, Genus: Streptomyces
cggcggaactgagcgccgcgcccgctccccagatcgggttcaactacctcggcaggttctccgccgacccggtcggcggccactggacgcccgcaccggagaccgcctccctgcccgcgcacgcggatccgggagcacccctcccgcacgtgctggagatcaatgccgccgctcacgacggcgcggacggcccccggctgtcggcgaccttgtcctggccggacggactgctgtccgaggccgaggtacgtgagctggccgagagctggctggtggccctggaggccctggtcacgcacgcgcagggccccgacgcaggcgggtggaccccgtcggacgtcgcactgacatcactgacccagagtcagatcgaccacgtgctcgccggagacgacgagggcgacgaagaggatgaagaggacgacatggactcattctggagggatgcacggtgaacgcccggatcgaggacattctcccgctctcaccgctccaggaggggctgctcttccacgccctctacgaccaccaggcacccgatgtctacacggtgcagatcgtcctggacctggagggtgacgtcgacgccgccgcactgcgcggggccgccgacagcctgctgcgccgccacgccaacctgcgggccgcgttccgctacgagggtctcgaccggcccgtccaggtcatccggcgcaaggcccggatgccctggtacgagatcgacctcggcaccgagccggaggacggccgcgaggccgcgttcgcccgcatcctggagaccgaccggggccgcaggttcgacctcgccaaggctccgctgatccgtttcctgctggtcaggttcggcccggaccgctgccggctggtggtgaccaaccaccacatcctgctggacggctggtccacccccctcttcttcagcgagctgttcgccctctacctgagccgcggcgacgacagcgcgctgccccgcgtcaccccctaccgcgactatctcggctggctcgccgggcaggaccggacagccgccgaggacgcctggcgcctggcgctcgccggggtggacgagccgaccctcgtcgccccggtggacgcgacggcgctgccggtccgccccgaccggctgcccttcgagctcgacgaggagctgaccgcacggctgaacgccgtcgcccggagccacggcgtcacgctcaacaccgtcgtccagaccgtgtgggggctgctgctctcctcgctcaccggccgccccgacgtcatcaccggtacgaccgtctcggtccgtccgcccgacctcgacggcgtacgcagcatggtcggcctgttgctcaacaccctgccgctgcgcatcaggaccgacccgtccgagtcgatctccgcgctgctggccagggtgcaggacgagcaggccgggctcatgccgcaccagcacctcgggctggccgagatccaggccctggcaggggccggaacactcttcgacacctccgtcgtgttcgagaactaccccgtcgaccccgaagcggtgaacgccccgatcggcgggctgcgcatccggggtgtcgagggccgcgacgccaaccactacccgctcggtctgaccgtggccccgggcgaccgcattctgctcaagctggactaccggcccgacgtgttcgacagcgcgctggtggagcgcctcgccgagcggctgcggcagctcttcggatccgtggcggacgacccggagcgcccggtgggccgtctggagctgctgaccgaggccgagcgcggcacggcgctcacccgcagctcgggcccgcgccgcagggttccctcggccaccctgcccgagctcttcgcccagcaggtggcccgcaccccggacgcccccgccgtggcgttcgaggacacccggctgaccttcgccgaactcgacgagagggtcacccggctcgcccggctgctgctcgcacgcggcgcgggccccgagcagctggtggccgtggccgtggagcggtcgaccgagctgatggtcgccctcctcgccgtcgccgtgaccggtgccg

SEQ ID NO: 3304 - DNA, 2399 bp, Unknown
  Kingdom: Bacteria, Phylum: Actinobacteria, Class: Actinobacteria, Order: Streptomycetales, Family: Streptomycetaceae, Genus: Streptomyces
cccgcccctccccgaagccgacgccgccgtccgccgccacgcggcccggccacaacgtcagggtgccgtcctgcgtacggccgtgcagatcggcgaccccgtcgccgacctgcacggccgtacgcaggacggcaccctgacgttgtggccgggccgcgtggcggcggacggcggcttcggcttcggggaggggcgggtgatcgggtgactcccccggatcggccgggtgttcccccgaggatcgcctgactcccccggggccgacggcgcgccggcggccctcaggtcgccaccgacgacagtcgttgcaccccccgcgccgtctccgtgaccccgctcaggaagccctgggcgcggggcgaggccgtggcgcgaagccattccggggcgatgtcgcagaccgcgacgttcacgcccgtgccggccagggccagcgggagggtgtggacgaccgtggaggggaagctgacgatcgtgcggccgatgggtccccggcgggcgatgagttccagggggaggtcggggcggacgatctccaggccggtggcggcttccagggcgtggagtttctcggcggactcgcggcggtgggcgaagtagcgggtggctccgtgcgtgcgggccagggccgcgaccgcctcctggtacgggacggggtcgacgacgcccgtctcgaccagggaggtgccgaccaggtccgcgcccttgccgatgctgggcgggccgaagcgggcgcgggtccaggcgaaggtgttcggggtgaccacgatgccgggcggagcctcgaccggcatcgcggtgaacacctcgaccgtgtggttcgccgtcggggtgaagcggcggcgggccgtcgccgtgaccggggccaggaccagttcgcgcggtcccgtgcggccccggcggtgccagcgtgtcaggcgctcgccccgggccagctgggcgacgaactccatggtggccgtgccgtcgtcgaccaccgtgaggcgatcggcgcggaccagggtcagcaggagctgcacatagcgggagaacgggtcgccgatcactatgtggtccgcgcgccggaccagaccggccagggcgcgcagggccttcaggggcgcgccggagtccccgcgcgcctcctgccagcggacggcgatgccctcgtcgcgggccagctccgccatccggcgcagctgaccgcgcgacatcgggtcgaccggggggaggacgacgaccgtggtgtcggccggatcgtctcccccctgggtgtgaacccactccaggacgttcaggagctggaccgggctctcgacgaaggcgaggttcaccggtcggcgctcagaccgcgaccggctcgggggccggcgcgttctcggtctcggcgacgacgcccgcgacccggcggagcttcttcatcgggccgagctcggactcgtacaccttcttgacgccgtcgccgagcgactgctcgatggtgcggatgtcgcggaccaggcgggtcaggccctgcggctcgacggaggcggcctggtcggaaccccacatggcgcggtccagggtgatgtggcgctcgacgaacgtggcgccgagcgcgacggccgcgagggtggtctgcaggccggtctcgtggccggagtagccgatcgggacgttcgggaactcctgctggagggtgttgatgacccgcaggttcagctcctcggccttcgccgggtacgtggaagtggcgtggcagagaaggatgttgtccgaaccgaggacctcgaccgcgtggcggatctgcttcggggtcgacatgccggtggagaggatgaccgtgcggccggtggcgcgcagggcgcgcagcagctcgtcgtcggtgagggaggcggaggccaccttgtgggcggggacgtcgaacttctccaggaaggcgacggcctcggtgtcccacggggaggcgaaccagtcgatgccgcgcttggcgcagtgctcggcgatggcggtgtactcggcctcaccgaactcgacgcggtggcggtagtcgatgtacgtcatccggccccagggggtgtcgcgctcgatgtcccactggtcgcggggggtgcagatctccggggtgcgcttctggaacttgacggcgtcgcagccggcttcggcggccgcgtcgatcagcgcgatggcgttgtcgagctcaccgttgtggttgatgccgatctcgcccgtgatgtagacggggttgccggggccggcggtacgggtgccgaaggtgcgcaggcgggaggtgctcatggtggtgcttccttacttggtggggacagcgggggtgggagtggtcgtgagggtggggcccagcagccaggccgcgatctcgcggatggcgccgtagccgccgggggtggtcgtgacggcgcgcgccgcggcgcgtaccgagt

SEQ ID NO: 3305 - DNA, 1554 bp, Unknown
  Kingdom: Bacteria, Phylum: Actinobacteria, Class: Actinobacteria, Order: Streptomycetales, Family: Streptomycetaceae, Genus: Streptomyces
acgccgaggaccgtacggatacggctcaccaaccgcgtcgccagcagcgagtgaccacccagctcgaagaaactgtcctccggcccgacctcctcaacacccagaatctcggcgaacagaccacacaaccgctcctccgccaccgacaccggaccacggcccccaccgctctccggctccggcaacgccgaacggtccaacttcccgttcggcgtcaacggaaaacggtccagcaccacgaacaccgacggcaccatgtgctccggcaacacacccgcgaccaccggccgcagcacatcaccactcagcaccgcaccctccaccggcaccacatacgccaccaaccgcgcacccgcagcaccagcaccctcaccacgcaccaccaccacagcaccagccacaccggagtgaccggccagaaccgcctccacctcccccaactcgatccggaaaccacgcaccttcacctgaaagtccgcacgccccacatactccagctcacccgaaaccgaccaccgcaccagatccccggtccgatacatccggccacccgaacccccgaacggatccgccacaaaacgcgaagccgacagacccggacgacccagatacccacgagccacaccagcacccgccacatacaactcacccaccacacccgcaggcaccggacgcaacccaccatccagcacatacacccgcgtattcagcaccggacgcccgatcgaagccgaggcgggccagtggccggtgtcctcgggcagggcggtggcggtgacgacatgggtctcggtgggcccgtagtggttgtgcagacgccagccgccgcgccggtgcgcgtcccggagccgtccggtgagcgcgagggcctcgccggcctgcgcgacatgggtcagctcggggagttcgccgtccggtcccagggcgtcgaacagcgcgttgacgaccaggctgggcgcgtacagctcctgcacccgatggtgccgcagccagtcggcgaaggccgccgggtcccggcgcagcgcgtcgtccgggaccaccaggcacttgccgtgcagcagcgtggacaggatctcctgcgccgacacgtcgaagctgagggcggtgaactgggcggtcctcgtgccgggctcgcccggtacggccccggcgtgccaggccatcaggttgaccagggccgcgccgggcatgaccacgcccttggggcggccggtggagccggaggtgtagatgacatacaccggatgggccggtgtcagcgggctcagccggtcggcgtcggtcaggtcgcggtcggacccgtcaccgtccgccggtgccccggagccggtcgcgaccggctcgccggacaggtccagcaggagcggcggggccagccgggtgcaggcggcggggagccgggccgcggtgtcctcggtactcaggaccagctggggggccgcgtcggcggccatgtggaccagccggtcggccgggtagtccgggtcgagcggcagataggccgcaccggacttcaggacggcgagcagcccgacgatctggccggtcgaccgg

SEQ ID NO: 3306 - DNA, 11265 bp, Unknown
  Kingdom: Bacteria, Phylum: Actinobacteria, Class: Actinobacteria, Order: Streptomycetales, Family: Streptomycetaceae, Genus: Streptomyces
gcgcagcccccgggcggcgaggtgtccggccaccgagtcggacagctcgtcggtctcgcggtagctcaggcggccgtcgaagtaggccagggccgggtgctcgggcgcgcgccggacggcgtcccggaaggagtgcagcacggtcgcgggcggggtgacgggggcgcgctgggcatcgctgagcagggcgagccacggctgggcggcgtagatcgagccgccgggagccggtgcggcggaggtcggaccgctcatgcctcactcgcctcccacttctgctggaggcggttcataccgcgcatccaccggtcggggtcggcggcgcgggcctggtagtagcgggacacctcggggtgcggcaggaccaggaagcggtcggcgtccatcgcctcgaacagcgcgtcggccacggcgtccggctcgacggccccggggccgaggaccagctcgccggccgaacccgccgcggtgagcatgtcggtgcgtacgccctgcgggcagatcgcgtggaccttgatcccgcggtggcggtaggtgagcgagagccactcggcgaaggcgaccgctccgtgcttggtgacgctgtacggggccgcgccgatcatcgtcagcagcccggcggcggaggcggtcgtgacgaaccggccgctgccgcgctccagccactccggcaggagggccctggccgcgcggacgtgggccatcacattgacgtcccaggcggctgcccagatctcctcgtcggcgaacacgtcaccgggcgaggccaggcccgcgttggcgcagtagacgtccaccgtgccgtccagcgcctcccgggcggcgtccacgatgcccgaggcgtccccggcgacggcgaagccgccgatctccttcgccagcggctcgatccgcgcgaggtcgaggtcgttgacgacgacccgcgcacctccggcggcgaacctgcgggccagagcggctccgatgccgcctccggcccctgtgaccactaccgcggcgccctgcaccgtacccatcgtcatcccgcccttcccatccggctgcaccggcagactaaccggtcggtatgtgatccgggaagggtcgggagcgggccgggcggggcccgtacggacctccgggaccggccgggggaatcggcgcggtccaggtcgttccgtgcggccccgggccgcgctagcgtgcgtggccatgacagtcggcgcgatcatggaggttacggaatgagcctgtcccgacgtggtgtgctggcagcgggaggcgccgtgggagcgctcgcggcgacggcgggcgccggtcccgccgcggcgtcggccgcccccggacgcggctccgggcacgggcggggccgggtgctcaccggtttcgaccggctggcggccgacggctaccggctgctgcggggccagaaggtcgggatcgtcaccaacccgaccggcgtcacggccgacgtccggcacatcgtcgacgtgatgcacccggacgcgcgggtgaacctgaccgccgtcttcggccccgagcacgggttccggggcaccgcgcaggcgggcggctccgagggccgctacgacgacccggcgaccgggctgccggtctacgacacgtacctcaagagcgggcagccgctcgcggacgtcttcaccgcctcgggcgtggacaccgtcgtcttcgacatccaggacgcgggtgcgcgcttctacacgtacatctggacgctgtacgactgcatggaggctgcggcgctcgcgggcaagcgcctcgtcgtgctggaccggccgaacccggtgaccgggcgggcggcgctcggcccggtgctggacccggcgttcggcacgttcgtcggccgccgggagatcgcccaggcgcacgggatgacggtggcggaactggcgttgttcttcaacgcggagttcctgcacgagagtccggcgcggctggacgtggtgacgatgtcggggtggcggcgctcggacttcttcgacgagaccgggctgccgtgggtgccgccgagcccgaacatgccgacgcccgagacggctctcgtctactccggcacctgcctcttcgagggcacgaacctctccgagggccgaggcaccacgcgccccttcgagctgctgggcgcggagggcgtcgaccaccgctgggcggccgccgcgaacgccctggagctgccgggggtggccttccgcgaggcgtacttcgcaccgaccttctccaagttcgcggggaagacggtgggcggggtgcaggtgcacgtccaggaccgggaggtcttcgacccggtccgcaccgggatcgccctgctggtgacggcgaagcagagctggagcggcttcgcctggcggccggacaactggatcgacaagctcaccgggaacacccgggtccgcaccatgatcgacgcgggtgcggacaccgacacggtggtacgggcgtggcagcgggacctgtcggcgttccgggcgaagcggcggaggtatctgcggtacggcggatagcgcgggcgtcccggacccggccggccgggtccgggacggcggttcagccggtcaggtccaggtcaccgaggcactcgtcgtcctcggtgataccccgcttgcggtagccgagccgcaggtagaactcctccggtccgccctcgccgggcttccaggtcacggtcgagaccgtcccgccacgccgccggatctcctcgttcaccgcccccacggcgaaccgcccgtacccccggccctgctccccggccgcgacggagagccgccagagcccggagcgcggcggggcgtccggcacgtcggcgtcgaaggtgaacggcacgtcgaagaaggccatcacgaagccgacgacgcgctcgccgtcacagatcagccggggccaggcgatgtcgggatgcacataggcctcggccagggactgggccaccggggagacgaacacgcgctgctcgggtgcgacttccagccgacaggcggcgagcacggtgtcgggggtgaccttttccaggcgtggctgagctgctgtcatgagcgaacccaaccgtacgggaccgtgccgccgccatcggatttcgggcgcgcacgcgagtccgcacgccctcgcaccacccgcccgcacgccgctccgcttcgacccgtggcaccccttcccacatggggagtctcggccaatggacggatttcatctttcgatggagccgaaacgggcaggcgtacgtccattccttgacgtccaaggacgagcgacggaggtggcggtgtcatggccggtttccggagtcttgcgagacaggtccgcgatccgatgggagatctggccctgcggcggtattcgctgcgcaagtgtttggagaggttcgccccgtacgggcaccgggcgacctgggaccatctgtgcgcccggcacgggatcgatcccgaggaccgggcgcccgatccggcgagcctgctgggcgcgctggacgagctggaggaggcgcgggcggtctggctcgcgtacgaggcgggtttcgccgagcggcggaggcgcgagaagcacgcggggctgcggcggcccggcgcgttcgacgactggcaccgccgcacctggggcggtcacggggtggcccgctgctccgacccgggcgtccaccccaccgagccgctcgccgaggtcctgcgccgcctgatcacggctctgggcgccggccccggatccgcctgcccggtctgcgcgggcaccggcatcgagtggcggcaggagcggggcgacgaaccgtgggcgggcccggtgtgcacgggctgcgggatcgcggtgccgcggcccgccctgaccgaccgcaccctggccagggcccgactgccacgacaccggaggccggccgtcgcggcggcgtgaggtcacgcggtcccgccccggcggctacgaacgcctgggcgacttccggctctcgggcatcagccgggaaccggtgatccgctcgccggcgatgtcgtcgggattggacagcacacaggtctccagcgacagacagccgcacccgatgcagtcggtcagatggtcgcgcaagcggtgcagctgcccgatgcgctcgtccagttccttgcgccagacctcggagaggcgggcccagtcctcgcggttcggcgtgcgctcctcgggcagttcggtgagcgcctcccggatcgtgacgaggggaatgccgacgcgctgggccgcccggacgaaggcgacccggcgcagtgcgtcccgcgagtagcggcgctggttgccgctggtgcggcggctgctgatcaggcctttggactcgtagaagtgcagggccgagacggcggcgccgctgcgcgccgagagctggccgaccgagagttcgtggagtgtctgtgggatctggggcacccctcgaatctactgccatgtcgttgacaggaacgcgccgcacaacgatgctgagcaagcgcttagacatcgcgcctgatggtgcgccgagccggaaggcaggaaccgggaacatggcagagccgaggatcttcacgtccgcgcaggagctgcgggacggagtgggcgagcagctgggacacagcgactggctggagatcgagcaggagagggtcgaccggttcgccgaggcgaccggcgaccaccagtggatccacgtggacccggagcgggcgaaggacgggccgttcggcacgaccatcgcccacggctatctgacgctctccctgctgcccgcgctggtgccgcaggtgatgcgggtcgagggcatgaagatgggcatcaactacgggaccaacaaggtccgtttcccctcgaccgtcccggtcggctcgcggctgcgggcgacggcggtgctccgcgatgtcgaggagaccggcggcggcgtacaggtcacggcggtcgtcacggtcgagcgcgagggcagcgagaagccggcctgcgtcgccgagtcggtgtcccgctactacttctgaacctgtcgggcgccgaccatccgcaggacgaggccggcgtacagttcgccgacctcgtcgggggtacgactgccctgggcgttgaaccagcgggccacgtcgatgcagagggacagcaccgcgagcgcggttccggggacgtcggggacgtcgaactcgccgtcccgcaccccttcgccgatgatccggcgcaccaccgcgtcgctcctgcgccgcagcgcgacgatctcggtgcggtgctcctcgccgagagcgtcgagttcgtactgcacgacccgggcggtggtgtgccgctccgcgtgccagcggacgaaggagcggacggccccggcaagccgttcggcggccgtgccgtcccggtccgcctcggtgtcgaggacgcacagggcccgctcgtggccgatcttgctgatccggtggagcagctcttccttggtcttgtagtggatgtagagcgcggccgggctcatcccggcccggccggcgatgtcacgggtggtggtcgcgtggtacccgcgctcggcgaaggcgtccacggcggcgacgaggagccgcctggccgcctcgggagtgacctcgccccacggcgcgtcctcgccgctcgtctcctgcgccgcacacatcgcccaagacccctctccgtcaacaggacgaacaccataccccgaacctgagcaagcgcttagggattgacctgtcgatcttgccgggtcagagcttctggaaggggtcgtgctcggcgaggatcttctccagcctggcctggtccacccggctgacgatctgcccggcctcctggcggtccctgatcaccttggcgagcgtgaagcaggacgtgaccaggtagagcacgccgatggcgaggaagccgcgcacccaggcgtcggcgtcgaggaagaagataccgaaggcgaccgcgctgatcgccaccatgaaggaggcgacggcctgcatgtagaaggcggcggtgctctgctgcttgaccgatgtcgtgtcactcatgggttcagcatccgccgacgtggcgcacgccacatccgtgcccgtactcaggccggtactcagacacccgtacgaacccgcgtgccggtcagaaggcggagacaccggtcagcgcgcggccgatgatcagcttctggatctgactggtgccctcgtagagcgtcatcacgcgggcgtcccgcagcagcttgccgaccgggtactcgtcgatgtagccgtagccgccgaagacctggagggcgttgttggcgcagcggacggcggcctcggaggcgtacagcttggccttggacgcggcggtggcgaattcctggccccggtcgaccaggtcggcgacccgccaggtcagcagccgggcggcgtccacgtccacggcgatgtcgctgagcagctcctggacgagctggtggcgggcgatggccttgccgaactgttcgcgctcaccggcgtagcgcacggccgcgtccagggccgcctgcgcgatgcccacgcagcccgccgcgacggacatccgtcccttggccagggcggacatggcgatggagaagcccttgccctcgggcccgaggagagccccggccggtatccggacgtcctggaggaccagttcggcggtggcctggccgcgcaggccgagcttgccgtgaatggtgcggcgggtgaggccgggggtgtcggcggggacgaggaaggcggagacaccccggtggccgggggcgtcgttcgtccgcgcgaagagcaggacgacatcggcccaggtgccgttggtgatgaacatcttggtcccgttgacgacgtagtcgccgccgtcgcgcacggccctggtggcgaggttcccggcgtccgagccggtgcccggctcggtgaggccgaagcagccgatcgcctcgcccgccgtcagccggggcagccactgccgcttctgctcctcactcccccaggtcgcgacggtcttggccacgaggccgagcgatacggagacgatgccgcgcaccgaggagtcgccgcgccccagctcctcggtgaccaggcagtaggacaggtgatcgccgccggagccgccgtactcctcggggacggtcagaccgaggaagccgaggtccccgagcttcttcacgatcgacttgtcgacgttctcggcgcggtcccacgcgacggcatggggggtgacctcacgggcgacgaagtcctcggccagctttcggacggcttcctgctcctcgctgagcctcaggtccatcgtgcccacccactgtctctcatgagcgccgcccgggcgcgcttaattagcactgctagtttctggttcgcaggccctactatgagccgcatggcccgaccgcgcaagcccctcctcagcagagaccgcatcgtcggggcggcgagcgcgctcgtggactccgaagggctcgacgccgtctccacgcgccggctggcggccgtcctgggggtcagcgggccctcgctctacaaccacttccgcaacaaggaggagatcctcgacgccgtcgccgacgcggtctccgtacaggtcgatctgtcgatgttcgaggagtccgacccgcgtgactggcgcgaggccctgcacgactgggcgctgtcctaccgggccgccctcgccgcgcacccgcacatcgtcccggtcctcgcccggggccccggacgccgcccggcggggctgcgggtcgccgacgcggtgttcggggccatgaccggtgcgggctggccgcccgcccaggccacccggatcggggccctgatgcgctacttcatcaccggttccgcgctgggctccttcgccgggggattcgtcgacgacgagaccgcctacgaccccgccgactacccgcacctcggccaggcccatctgctggccgatcaccgccgccaggtcgacgaaggagccttcgagaccgggctgcgggccttgctggacggcctggcgatccagtacgagcagtacgcacggcccacggacgagcgcctgtccagcccgtccgacgcgtgaggacgggggcgagcgccgggggtgggcggctcccctgcttcccggacacgaggggtcgcccggtaccaacgccacggctccgtcctcgaacgccggacgggccgggacgtccggccggccggccgtcgattgacggtcctcgacaattcggtgggggccgcagcgttccgactctacggtcgtggccatgacgacgaccccgacacctcttccggtctccccgccggcccaccgccggcgggccaccgccgccgcctgcaccaccgtcgtgctctgggcctccgccttcgtctcgatccgcagtgcgggcgaggcctactcccccggcgccctggccctcgggcggctggcgacgggcgctctggtgctcggggcgatcctgttcgtccgccgggagggactgccggggcggggcgcctggcgggggatcatcacctccggcgtgctgtggttcgggctctacatggtggcgctcaactggggcgagcaggaggtcgacgccgggacggcggcgatgctggtgaacatcgggccgatcctgatggcgctgctgggcgcccgcatgctcggcgaggggctgccgcgccgcctgctgctggggatgggcatctccttctcgggcgcggtcgtcgtcggcctggccatgtccggacacggcggctcgtccgtgctgggcgtggcactgtgcctgctggccgcggtcgtctacgcgctgggcgtggtgagccagaagccggctctcgcgcacggttcctcgctccagatcaacaccttcggctgcctgatcggagccgtggcctgcctgccgttcaccggggtgctggtctccgaggccgccgacgcgccgctgtccgccaccctgaacatggtctacctgggcgtcttcccgaccgcgctggcgttcaccacctggggctacgcgctggcccggaccaccgcgggccggatgggcgcgaccacgtacgcggttccggcgctcgtcgtgggcatggcgtgggtggtcctggacgaggtgccgacccccctcggcgtcgtcgggggcgccctgtgcctggccggcgtggcggtctcccggagccgtcagcagacggggcgcacacggggaaatccggcccggccggtggagggatcccggcatgacgaggagcgccaagcggaacggacgtagcgggaccggggggcgaggcacccagcgggaccgggggccgagcgggacgggacgagccctccgccccccggggcgagcgagcgggcggcccgtctcggcggcccgtatctggacgggacgcgccctggacggtggtgaagagcgacgacaagaagcgggcccggctggaggcgatgcggcatgtgctggaccgcttcgaccaccccggcaaggacccggagacggtcgggaagccggacccgctgatcgtgggcccggcctcccggctgttcgaggagggcgagatggacgccaggctgccgggcccggtgacgtggacgtcccggaccacggacttctgagtggatctctagaagacgaccagggctcggccgcccttgcccgcgatcatgttgtcgaaggcggcggggataccgtccagggcgatgtgctcggtgaccatcatcgacaggtcgaagcggcccgcgcggatgtggccggcgaggacgggcaggtcgcgggccgggtcgctgttgccgtagacgcagcccgtgagcgaccggccccagtggaagatctccagggcgttgaaggtgacttcctggtccttgccgccgatccccacgaccgtggtgcgcccgccgcgccgggtggattcccaggcggcccggatggtcgccggccggccgacgcactcgacggcgacgtccgtgccctggccgtcggtcagcttgcggatctcgcgcggggtggtggcggaggcgaccaggtagtcggtcgccccggcccgccgggccagctcctccttggccggggagacgtcgaccgcgacgatccgggaagcgcccgcgatccgggcggcctggagcacggcgagtccgacgccgccgatcccgaacaccacgacgctctcgccctcgcggacccgggcgctgtggtggatcgccccgtagccggtcaggaccgcgcagccgaggagggcggcgtcggtgagcgggatgccgtcgggggcgggaagcacgcagttcgcggcgacgacggtctcctccgcgaaggccgcgacgttgaggccggggtggaggtcggtgccgtccgccgtacgggcgtggaggttggcggtccccttcagggcgtcggcgcagagccatacctcgccgatcccgcagtggaagcaggccccgcaggagggggcccagttgaggacgacgccgtcgccgggggccacgtgcgtgacgccatcgccgacggacagcaccgtgccggcgccctcgtggccgaggacggcgggcaccgggacgcgcatggtgccgttcgacagggacaggtcggagtggcagaccccggcggcggcgagcgcgatacgcacctggccgggtccgggctccggcaggacgatgtcggtgatctccagcggagctccgacggcgggcagtacggcggcgcggaccacgaaaaggctcctttgtcggcaggattgagggggtcagaactggagcgacttggtctggaggtactccgccagaccgtgcggccccagctcgcggcccacccccgactgcttgtaaccgccgaacggggccagcgggttgaaccggccgccgttgatgtcgacctgtccggtgtccatccggcgggcgaaggccaccgcctcctcgtcgtccgcggcccacacggcgccggcgaggccgtacacggtgtcgttggcgatccgcagggcgtcctccacgtcctcgtaccgcaggatcgcgaccaccgggccgaagatctcctcgcgggcgatcgtcatgtccggggtgacgtcggcgaagacggtcgggctgacgtagtagccggtctccaggggcgcgtccgggccgccggcgatcagccgggcgccctcctcgacgccctgggcgatgtaaccgcgcacccgggcctgctgcttggcgttgacgagcgggccgacccgctcccccggtacgtacttggtgacggcgttcgccgcgagctccacggcctcctcgtaccgctcggcgtccaccagcatccgggtccaggcgctgcacgtctggccggagttggtcatcacgttggcgatgccgacgttgaccgccctggtgaggtccgcgccgggcaggatcacgttggcggacttgccgcccagctccagggcgacc

SEQ ID NO: 3307 - DNA, 5417 bp, Unknown
  Kingdom: Bacteria, Phylum: Actinobacteria, Class: Actinobacteria, Order: Streptomycetales, Family: Streptomycetaceae, Genus: Streptomyces
ggcggcgagggacgtgccccgggggtcgtgagggacgggcggagcggcttcggcggcaagccgcccgaagggaccgcgagagttctaccggtgggtacgccatgtgtcgttcacgtaatccgcgtgatcaattcttccggccgtgtcgtggcctcttcgccattcccggcttcgcggcggaaaggcgaagggcgtcatgtggcttgatcaatttcattgcggtcggacagttacgtccgtacgggtgagcgatcaccgaacggagtacggaatgatggctatctcgaagccgacaaaacgggactttcgccctcttctgtagggcttccgggccgtgtggcgtggatgtttcgctccgggcgcacagtggctccgacctgcgaataccgtcttccggaagccttccgcagcacgttcgtgttgctgttgtcaagccccgagatatgccctgacctgcgaaaacgccattcaggagatgcggttctcgtgttactctggatagccacggaaggggtacctgtcacatgacgttcaaggttggcgacaccgtggtctatccccatcacggggccgcgctgatcgaggctatcgaaactcgccagatcaaaggcgtggacaagacctacttggtgctcaaggtcgcccagggcgacttgacggttcgtgtgccggcggacaatgcggagttcgtgggcgtgcgcgacgtggtcgggcaggacgggctggaccgggtcttcgaggtgctgcgcgcgccgtatgccgaagagccgacgaactggtcccggcgctacaaggcaaatctcgaaaagctcgcctccggcgatgtcatcaaggtcgccgaagtggtgcgtgacctgtggcgtcgggagcgtgagcgcggtctctccgccggagagaagcgcatgctcgccaaggcccgccagatcctggtgagcgagctcgctctcgcggagaacacgaacgaggacaaggccgaggctctgctcgacgaggtcctcgcgtcctgaaagctggattgatccggctcgaatgccggatcgcaccggttgtatgaatgtgccgcggtgcccgctgaccagtcgttttcacactgtgtcgtcgggcgctgcggcatgttcggacccacatccgcatccggtgcccgactgccggtaggacccgtgcccgcggtgtgatccgcgtgtgcggcggccgcccggtgaagggtggccccgtgctgcgtgagccgccggtgcgacctgtgctcgaccgggtgtcacggaaggggcccggtgcgagtccagggcgtcacgcccggctcgctgggcccctacccatgtcggtcgtggaaacaaacctgccgaaccttcggaccttctcggaccttcggagtgcaaccgatgtcatcgacgccacccccgaccgaccggccgcgccctccccgtaccgccgcggtgatccccgcggccggacggggcgtgcggctcgggccgggcgcgcccaaggcccttcgggctctcggcgggacgcccatgctgatccacgccattcgcgccatggccgcgtcccgggccgtctccctcgtcgtggtcgtcgcgccgccggacggcgcgcccgaggtgaagcacctcctcgacgagcacgcgctgcccgagcgcaccgactatctggtggtgccgggcggtgagacccgccaggagtccgtgcgtctgggcctcgacgcgctgcccgaggacgtcgccgtcgtcctggtccacgacgccgcccggcccctcgtgccggtcgacacggtcgacgcggtcgcctcggccgtacgggacggagcgcccgccgtcgttcccgcgctccccctcgcggacaccgtcaaggaggtcgagcccgccgggacccccggggagccggagccggtgctcgccacccccgtccgggccaggctgcgcgcggtgcagacgccgcagggcttcgaccgggacacgctggtgcgggcacacgccgaggtcgccgtcgacggcgagggcgccacggacgacgcgggcatggtggagcggctcggcgcgccggtggtcgtcgtccccggccacgaggaggcgttcaaggtgacccggccgctcgacctggtgctggccgaggcggtactcgcccgcaggagggccaacgatggcttctgagcagcacgccgcgggactccccgccgcacccgtcatcccgctcgtcgggatcggcaccgacatccacgccttcgaggagggtcgtgagctgtggtgcgcgggtctgaagtggaagggcgagggtcccgggctggccggccactcggacgccgacgtcgtcgcgcacgccgcctgcaacgcgctcttctccgccgccggcctcggcgacctcgggcagcacttcggcaccggccgccccgagtggtccggagccgcgggcatcacgctgctcaccgaagccgcccggatcgtccgcgccgggggtttcgagatcgggaacgtcgccgtccaggtcgtcggtctccgcccgaagatcggcaagcggcgcgaggaggcgcagaaggtgctgtccgccgccgtgggcgcgccggtctcgctctccgcagccacctccgacggactcggcttcaccggacgcggcgagggcatcgccggtatcgcgaccgccctggtctaccgaaccgtctgacgcccgggaagcgcccggcccgggatcctgttgcacatcgcttgcacgtacgctgaaggtgcaaacggtgggcggcaggaggcgggagtggtaccggtgaccagcgcgaccacggtgatggcgggggcgatggccggccgcgccgacgccgacaggggtcatggggacgccgaatacgtcctgcgcaccgccaccgccgacgatctcggcggagcgcgggccgtgatgctcgacaccgtctaccgcgacctgaaatccggctacgtaccccgctggcacgccgacatcatcgatcccgggaccgcctatctgcgcccggagcgctgcaccctgctcgtcgtcgagcaccgcggcgagatcgtcgccaccggggccgtgcgcgaccggggtccgcagtcgccgcccaatcctccgtgggtcgccgagcgcttcccttccgggaccaccgcccagctctgccggatctatgtgcgccccgagcaccgcaggcacggactggcccggcagctggtgcgcgagctgggggagttcgccgtacgggccgggggttacgaggcgctgtacctgcacaccgacccctccgtgccgggcgccgagcccttctggcgttcgctggcccgggaggtgtgcgacgagcggacgctgcccggcggcgggcaggggatcgtccacttcgagctgccgatgcccggggcggtgccggtttccggtggtgccgacagggtcaccccgtcggttagatgacaatcgttttcatataaggtcgtcgccatgtccacctcccgtccccgccgcgtcgcactgcccctggccgccgccgcgctcctcgtgcccgtcgccaccgcctgcacctcgtccggaagctccggcggctccggcggggaccagcggctgaaggtggccatggccttcccgccggcccaggccatgtccccgtacggcgacgacgccgtcaccctgagccggctcgccgtcgtcgagggactgacccggctcgaccgcgacggtgaggcgaagcccgcgctcgccacctcctggaagcgcgacggcgaccgggcctgggagttcacggtccgcgaggacgccgtcttccaggacgggacgaagctcgacgcggccgccgtggtccgttcgcttaccgcagcgcagaaggcgtccccgaagccccgggtgctgtccgacaccaccctcaccgccacggccgcgggtgcggacaccgtacggatcacgacgaaggacgccgacccgctgctgccccagcggctggccaatccgtcgctgagcgtgctgtccgccgccgcgtacaaggacggctccaaggtcgaccccgccgggcacgccaccggccccttcaccctcgccgaggtcaacggcgcggtcagcgccaccctggagcgcaacgacgcctactggggcggccgggccaaggcccccggcgtcgacgtgaggttcgtcgccgacggcaccgcccgcgccaacgcgctgcggacgaaggacgtcgacgtcgccgagtacgtaccgatctcgcaggcctcgctgctcggtgacggcctggtccacgagttcccctccgcccgcaccaacggcctctccctcaacacccggcacggggtcttcgccgacccggccatgcgcgccgccgcccgcgaggccatcgactcccaggcactggtcgacggcgtctacgagggtcgcgccgacaccgcgcaggggctgctcggccccggcgtcccgtgggccgccgagctgcgcaccacccccaccggccgcgccggggccgccgtcccggccgaggtgaggaagacggagcggatcgtcctggccacctacaccaaccggcccgagctgcccgaggccgccaccgtcgtccagcagcaactggagaagcgcggcttcaccgtcaagcaggtcgtccgcgactacgcgcagatggaggccgacgcgctggccgggaagtacgacgcgttcatccaggcccgcaacaccctcctggacaccgccgacccggtctcctacctcgcctccgacttcacctgcgacggcagcttcaacatcacccagctctgcgcgaagcccgtcgacaccgctgtcgacaaggccgccgccctcgccggcaccgacgcccgccaccgggccgagatgaccgccgaggccgcgatcctcggctccgacgccctcgtcccgctcgtccacgagcgcttcgcgcagggctacgacgacacccgcgtccggggagtcgccctcgacccgatggagcgcaccctcatcaccgccgacacccgcctcgggtgaccgcgtgaagtacctcgccggacggctcggcacgctgctggccgtcgtcgcggtgatcgggctgctgccccggctgacccggaccgacccggcccgcacgatcctgcacgcccggtacgccgaccgggccccgacacccgagaccctcgccgcgatccgcgccgagaccgggctcgacggcgggccgtggcaggtcctgggcggctggctcggcgggctgttccggggggacctgggggagtcctgggtctccgggcagcccgtcgggccggacgtcacggccgccctcggcaactccctcaccctgatggccgtctcgctcgcggtcgccgtgctcctcgccctcgcgctgagcgccgccaccctgcgacgcggggccgcgcgccggatcgtccgggtgcgcgccggagcggtcgcggcggtgctcgccgcgctgccggagttcctgctcgccgccgtgctggccacgg

SEQ ID NO: 3308 - DNA, 4673 bp, Unknown
  Kingdom: Bacteria, Phylum: Actinobacteria, Class: Actinobacteria, Order: Streptomycetales, Family: Streptomycetaceae, Genus: Streptomyces
ggtgaagccccggggcgccacgggggccggcggaggcgcggtccgtacgggggccgtcgtggcgccccggggcttcaccgccgggaccgggcggccggtggacctgcaccggcacccggcggccgacgggccgacggagagcaggatgctgctgctccacgggctgggcaacagcgccaccgtctgggacgacttcctcgcgcaccgcccgacggggtacgacctgtggaccgccgacctgccctggcgcggcaccggggacggcgggtggcaccgggacccggacgccacccgctggcttgccgaggcgctggaaggcgtgccgggcggtgcggggaccgtcgtcgcgcactcgttctccgctctccagaccctggccctcctcgaccgcgaactggaggcgggccgggacccgttcggccggtacggcatcgacgcgctggtgctcgtcgccccgttctaccggcggcgggccgaggagttcgactgggacgccatgacccgctacccggcggagttcgagcggatcatggaggagggcatccgggtccactccggaggccggctcgatcccgagatccagctctccatggcccgccgggtctgcgaccggatcggtccgtacggctggctgcggttcgtggacagctatctgcgcaccccctggctccgcgccgggcggatcgacatccccaccgtggtcgtctgcggtgcgctggacatcgcggtggaccccgccgagggccggaatctcgccgccgacctgcccgacgcgcacgtccgcgtcctcacggactgcgggcacttcctgatgaccgagagggcggaggagttctccgccgtcgtcggcgacttcatcacgtcactgtcctcgcgggcgcgttcgcagcggcccggagaccgagcgcctggagaccctgccccatgacccctgtgaccgaggcccggatcaaggccctgctgcataccccgacccgggtgctgctgcgcccgcgcttcgagggctccaacatctgtacctggatcggcttcaagcacgacaactacctggtcgaggaggcggtcctggaacacttcaggtccgccggcctgtccagccgggtgctctacgaggagctgggcctcggtctggacttcaccgagctggacgtccgcatcctcagctcgctgcacctggacgacctggtgaccgccgacgtcgagcaggtgtccaggaacgacggcgagctggtcttccgggtgacgctgaccgtcgaccgggacggcgcgcccgtgaaggccgtcaccggacgggcccgggtcgtgctgcggatcgacaccaccttcccgcccgagccggtccccgaggcgctgcggcccttcgcggtcgagcggctcggcacgtccgagcccggcgccgaggtgacacccgccgcttcggccccgctgtccgccggccacggcaccaccggcccggacccggtgctgagtctgctcaccgagggcaggaacgccttcggctggaagtggcgtattccctacccgtactgccacttcaccgagcggctccagatgtccggctacctgcggcagatggaggaggtcgtggacctgttcctggccgaccggggcctctccatcaagacgctcctggacgaccgcaagtggatcccggcctgctcccactcgaagatccgcatcctcgacgaggccctcatggaggaggagctgtacgtcgtctacacggtcgacgagatcttcaaggacttcctctaccgctcccggttcgacacctatgtggtgcgcgagggcagcctcgtgcagaccgccaccgggcacgtcacccacggctacgccgtcatcgacagccgcaccgactggcacctggtcaacttcgacgagcccgtcctgcgggccctgcgcggcgaagcggccaccggcgcatgaacagccacctcctcatcgagacccgtggtccgtggagcggcggccgggagtgcgcgtccttcgtccgggacgccgccgccctcgcgggcggcggccaccccacgaggctcttcctcatccaggagggcgttctcggggctctgcccggcgtgctcccggagctgacggacttcctggacaccggcggacagctcctcgtcgaccgttactcctaccgccaacgcggactgaaggaggaacagctggtggagggcgggcggctggtggacatggacgagatcgccgggaacgtgctcgacgccacggtgaaggtggtgtggcactgagatgggcaagggcatcccgcacaccgacgtgctgattacgctcatgggctccccgcacggctccgacctggtcaccagcgtgcttcggctcgtcgagtcgctgttgcggcgggaggccaccgtccaggtgtgggcctgcggctacgcgacgctgctcacccaggagaacctgggcgagtcgaagccgcgcaacctcgccgcctggtccgtcgactacccgtcgaccgtcaccgtcatccgcgggatgctggcggcgaacccgggccggctccactggtacggctgccggttctgcagtgacgaccggggtgccaccgcccatgtgccggaggtcaggctccgggctccgggtgccttcgccgagaacgtcgcggcggccgaccggacgctgttcgtgggggtgctctagccatgccggatcaggacatcaccggcggcgcccaggtgctcggcatcgtggagcgggcctaccggggcgcggtggagaagcagttcttcgacgtgctctacatgtcggtggagctccaccgacagctcggcgggatggacctcctgctgcgcggacccgccgtgacctgcgccctcaagggggcggagaccggcccgctgctgctgggcggacgcctcctggacaccctcggcgaccagggtcgcgatctgcgggcgctgatcgactccggggtgcgggtcttcgtacaggaggaggacctgaaggacctcgggctcggtcccgccgacctggtcgacgcggccgtccgcccggtcacctcggcccagctctccgactggtggccgcgctaccggatggtcggcttcctgtgaccgcacgcacctgatcccgcccgatccccgcctgatcaggcatcctcccgcctcctcccgcctgatccctcgtcgctccagccaaggaatggatccgtatgaccaagaccgtgatctccgcctggtcggccgtttcgccgttcggcatcggccgggaagccttcgtgcgcggattccacgcgggacggtccgccgtcacggcggtggaccgcgagcagtggcgcaccccggacgacgaggtctgcctcgtccccgggttcagccccgcggccgtgctcggccgcaagggcacccgcgccatggaccgggtcaccggcctcgcggtgtcggcggtgggccggctgatcgacgagtcgcccgacccgcacgccgcggccgacggcgaggacgtggccctggtcctgggcaccacgtcgggcagcgtgcagagcatgatggacttcacccgcagcggactcgtctcggagaagccctacttcgtggaccccgcccgcttcccgaacgcggtcatgaactgcgccgccgggcagtgcgccatccgccaccggctcaagggtcccaacaccaccatcgcgggcggccgcgtctccgggctgcacgcgctgaagtacgcacagcggctgctcaacgccgaccgggcccgcaccgtgctgtgcggcgcggtcgaggagtacgcggacgcccgcgcctggctggacctgcacagcagggccgaggacgagacgggcgtcgtgcacggcgagggatgcgtgatgctgcgggtcgagccccaggcggaggggacgggcgacgcgcccgccaccgtggaggccgtggaggtcggggtgttcgacggcagcggtgacgccgccgccgtgctcgggcgctgcgtgagccgggccctggaacgctccgggaccgatccggccgacgtgtggaccgtcgcgcccagcggggcggccggcgtgctcggggcggccgaacagtccgtgctggaggagcacttcgacccggcggtggtgaaccgggtgtcacggctgatcggcgacacggccggggccgccgcgatgttccagctcgccgccgtgctcgccctggccgaacaggaagacgtccgcggccggatcgccgtgatcaccgcggtggaccgggacggcgaggccggctgcgcggttctgcggctcggctgaaccccggcgacgggccgcacgaggccacgaagcaacgaagcggcgagacagccgaggcaacgacgcaatgagagagggaaccccatgacatccgctgtgcagacactggacctggagcagctgcgcgagatcatcgcggaggtgctcgacgtcgagaccggggaggtcggtgacgacacgagcttcaccgacgacctggagatcgactcgctgatggccctggaggtcgtcgtggtgctggagaagaggtaccgggtcaaactccgcgaggaggagctgaagcaggtcacctgcctgcgtgccgcgtacgggctgatagccgagaagctggcggacccccggtgaccgtcgccggggcggcccgcacgggcgcaccggactccggcacgtcgcggaccggcgcctcgccggtcaccgccccggtccggat

SEQ ID NO: 3309 - DNA, 8417 bp, Unknown
  Kingdom: Bacteria, Phylum: Actinobacteria, Class: Actinobacteria, Order: Streptomycetales, Family: Streptomycetaceae, Genus: Streptomyces
cacccggaccgcgcggcgggcggcgaccagaccgatgtcggagctgactccggtgccgggcgcggtcccctcctgcactgccgcgcccggctccgggacgtccccccgggccctctgcgtccaggacgccagggctcgtactcgggcggccgcgtcggcgagccgctcctcggtcagttccccgccgcgcacggccgcgacgagggcgtcgcgcagccgcagcaccgtctcctcgtcggccagaccgccgcccacacagatggcgtcggcacccgccgcgagggcgaggacggacccgcgctcgatgccgtacgtaccggcgatggcgtccatctccacggcgtcggtgacgatcaggccgtcgtagcccagctcctggcgcagcagaccggtgaggatctgcgggctcagggtcgccggacggtccggatcgagtgcgggaagcaggatatgcgcgctcatcaccgatttggaacccgcggcgatggccgcccggaagggcaccagttcacgggcgtgcagggtgtcgaggtccacatcgatgcggggcagcgccaggtgggagtcgaccgcggtgtcgccgtgcccggggaagtgcttggtacaggcggcgacgccggcggcctggagaccctcgatgtacgcggcggtgtgccgggcggccaggcgggtgtcggcgccgaaggagcgcacgccgatgaccgggttgcccgggttgctgttgacgtcggcggacggcgcccagttgaggttgacgccgcactcggcgaggcggcggccgagctcctgggcgacggcccgggtgaggtggacgtcgtccaccgagccgagggcgaagttgccggggaaggaagagccgtgcgtgacctccaggcgggtcacgtcgccgccctcctcgtcgatggcgacgaggacgtcctcccgctcggagcgcagtcgctcggtgagggcggagagctgttccggcgaggtgatgttgcggccgaacagcccgacggaggcgaggccctcgccgacgcggcgcagcagccagtccggcgcggtggtgccggtgaacccgggctggagcaccgcgagcgcgtcacgcgtcagggtgtccgtggtggaaacgagcgtggtcatgggcccgcactatcccttcacagcgccggaagtgaggcctgcggccatcttcttctgaatgatcatgaagaacacgacgacgggaatggcgatcatggtggaagccgccatgagggcgccgtagtccgttcctcgctcggtcgtgaacgtcatcagccatacgttcagcgtgtacttggagttgtcgttgatcaggatgtacgcgaagaggtactcgttccacgcgttcaccagcgcgaagatcgacgcggcggcgagcccgggggcgagcagcgggaagatcacccggcggaaggcctggaagcgggtgcacccgtccaccatcgcggactcctccagctccaccggaatgttcacgacgaagccgcggatcatgatggtggcgaagggcagcgtggagaccaggtagacgacgatcaggccccagtactcgtcgatcccgcccatcgcgttgagctgggcgtagatcgggatgagcatcgccgtcggcggcagcatctggaccaggatcatgatcaggaccagggccttgcggccgaagaaccggaaccggccgatcgccagggccgccagggtcgcgatgatcatgccgccgaccaccgcggtgaccgcgacgatcaggctggactggatggcggtggcgaagttcggctgctcggtggcccggacgaagttgtcgaaggtgatcgacgtgggccacagggtctggtcgtagctgcggatctcccggttgggccgcagggcgctgatgaccagccagtagaccgggaagaccatgaccagggcgatgccgaggccgatgaggtcgaagtgcagccggctcttcttgcggtcggggcgcagcacctgtgtgtgggtcgagctgctcattcgacctctcccgtcttcatgagctggcgcaggtagtacacggccacgccggacagcagcagcaccgtgatcagggcgatcgcggtgccctggctgaaggaggtggactcgaacgccttggagtaggagtagaggccgagggtctcgtactccggctcgggcttgttgccgcgcagcagccagatctggccgaagacgttgaagtcccagatcaccgagagagtggcgaccatggtgaagaccggcttgatgaccggccaggtgacgaacttgtagatgccgtaggcgctggcgccgtcgagggcggcggcctcctccagttcctgggggacctgggtgagggcggcgtacagggtgacgacgacgaacgggatggcaccccagacgaccagcagggtgatgatgccgaagccctggaccgggtcgaggtaccagttgtgtccgagccagtcctcgccgacgaccttggcgatcagggtgttgatcaggccgtagtcggagtcggccatgaaccggaagatcgaggcggcgaccatcagcggcatcgaccaggcggcgatgaggcaggcggtgagcaccagccggacccaggtggagagcttgcgcatcaggagggcgaccagcaacccgaggcccatggtcagcgtcacgcagatgaccatgaagacgacggtgcggaaggtgacccaccagaactcggagtcgccgaggatgttggtgaactgctcgaggccgacccagggagccggttctccggaccacagctcacggcggcccatgtcctggaaggacatgatgaccgtcttgccgagcgggtagaggtagacggcggcgatcgccacgatcgccgggaggatcaggagataggggagcagttcccccttcttccgcttcctcttctgcacccggggcgcatcgtcgtgggaggacgacttcccggtcgcctgcgggtcgggtggtacggggaccggcggcccggcggccttggtatcagcggcagacacgtggctgaccttccatcgcgggtccggggcgggccccggaattcacggcgttcacttgcgggaaaggagcgggggcccggcgctggcgccgggcccccgcctggcgatcggaaggtcaggattccttgttgatcagggcgttgatcttgtcgtcggccttcttcgaggcgtcggcgacggaggcgcccttgacgatctccaggagcatgttctggaggatctcctccttctccacggaggcccagcccggcgcgatcggcgtgaaccaggcgtccggcaccgcgttggcgatggcggcggtctccggcttcgccttcagcggctcaagctgcttctcgttgttggggaggatgttcttcgacgcgaggacctccatggacttcgcgctggtgaagagggagatccactcctcgccgaggtcctggaccttggacttggagatcgtggcgaggtccgagccgccgatgaaggacgggagggccttgccctcggggccgggcataccggccgtggcgatcttgccctcgagcttcgggttgccgttctcgcccgtggtgacgctgccggcctcccaggcctggccgtagatgaccgcggccttctcgttggccatgacgttggcgtggtcctgctcgtccttcgtcacgtcggccttgttgtacttcttgaccaggtcgacgaagtgctggatgcccttctgggcctccggggtggacagggcggccttccactccttgctgccctcgtcgtacttcgctatctggccaccgtaggcggcgacgtaggacatcgcggcgtaccagtagcggccggggaggtagagggaggaggcgcgcttgtccttcttgcccagctcggcggagaccttgtccatcgcggcgaggaactcgtcctcggtctgcgggagggcgtcactgccggtgccggccttcagcatgtccttgttgtacacggccaggcgggcgctggcgtagtaaggaacgcagtacgtcttgccctcgaaggagcacgtgtctttcagacccttgatccaggtgtccgagttctcgtacttcttggggtcgatttctccgagcgcaccattgaggatgtactgcatggtctcggtattgccgagttccacgacgtccgggaatttgtcgccaccgagggaggtgtccagcttcttgaccttgtcggcccactgctggtactgaaccttgacggtgacgcccgggtacttcttgttgaactcggcgttgacgtccttgaccagctccggccaggtggactgggcctcgcccatgagccagacggtcaggttttccttgcggtccttcgggtccgcggacgacttggcgtcgtccgaaccacacgccgcgaccgaaaccaacatgcccgcgacaccgatagccgcgatgagcttgcgcttcacgtcaaaccctcctcagggatgctgcaaccccacccaccgcgaagtcattcgacgagttctgctggggctggacctggtctttaatggtttagaccagtaccgggagcttggcctagacctttaggggtgtcaagggtgtataagaagtgcactcgcgtccgttataggaccgacacctaagggagggcgacgacccgtgaccggaccgtgccaccatgtgagccgcgacagacggaggagccggtgacggcagcaacgcagcagtcgggaaggcgggccatgggcgccgacgggggcagtacggggagcgagaccggtgccggtacgcgcacagcgcgcgtaccgaagtactaccggctcaagcggcatctcctcgacatgacggacaccctgccgcccggtaccccggtgccgcccgaacgcaccctggcggccgaattcgacacctcgcgcaccaccgtgcgccaggcgctccaggaactggtcgtcgagggccggctggaacgcatccagggcaagggcaccttcgtagccaagccgaaggtctcccaggccctccagctcacctcgtacaccgaggacatgcgcgcccagggactggagccgacgtcccaactgctggacatcggctatgtgacggcggacgacacgctcgccggtctgctggacatctcgacgggcggccgggtgctgcgcatcgagcggctgcggctcgccagcggggagccgatggcgatcgagaccacgcatctttcggccaaacgcttcccggcgctgcgccgttcgctggtgaagtacacctcgctctacaccgcgctcgccgaggtgtacgacgtccgcctcgccgaggccgaggagaccatcgagacctcgctcgccaccccgcgcgaggcggggctgctgggcaccgacgtgggactgccgatgctcatgctgtcccgccattcggtggacggccagggcgaaccggtggagtgggtgcgctcggtgtaccggggcgaccgctacaagttcgtggcccgcctgaagcggcccacggactgagcacccccacggacggcgcggtacgcacagggcggtggcccggggacgagatccccgggccaccgcccgttttcggtcacgcggggtgcgtcagcgcagttcggggtcggtctcgatgacgctgtacgggtacgggagcacctggtcgctcgcggcggtcagcagggcggcgtcggccgggtcgaggtccaggtccgccgcgcccaggttggtctccagctgctcaagggtgcgggcgcccacgatgggggcggtgaccccgggccggccgagcagccaggcgagggccagcaccggaaccgcgaggcccgtgcgtccggcgacctcgtgcagggcgtccagcacccgccaggtgcgctcgtccccctcgtacgcgctccacgactcgccccagccgagcttctcggcggtctccacccgggtacccgtgggcggcctccggacaccgcgccggatcgcgccgctcagccagccgccgcgcagcgggctccacgggatgacacccaggccctcgttgcggctgacctccagcagctcccactcggcggaccggtccagcaggttgtagagcggctggagggcggtgaagggctcccagccgtgttcccggctcaggtcgatcgccttctggagctgccagccggagaagttgctggccccgatgtagcgcaccttgccggaggtgaccagcgtgtccagggtggcgagggtctcctccagcggggtgccggggtcccaggcgtgcacctggtagaggtcgatgtggtcggtgccgagccggcgcaggctcgactcgaccccggagatcaggtgattgcggcccaggccgcggtcgttggggccctcccccgtgccgtagcgcaccttggtggcgatcaccacgtcgtcgcggcgctgtctcttcagccagcggccgaggatctcctcggaggctccggcggagtagatgtcggcggtgtccacgaaggtgccgcccgcctcggtgaagcggtccagcagggcgtggccggtggtctcgtcggcctcgcggccgaacgtcatggcgccgaggcagagttcactgacccgcaggccggtctttcccaggtagcggtaacgcatggtgagttccttcgtcgtgatggccgatacggaggtcggtggtcgtcgggtggtccggttcggcgagcgacacggacacctcctggacgctgtggtcggacaggccgcgcggatcgcggaagcggtagcggtggacccgggcgcccggtgtggtgagcacccagtccagccgccaccagcgcatgccggggcgggcctgccaggtggtggggcagagctttccggcgacggcgaccgcgtcggcgcccaggcgggcgatgcggcgggcgtccccgatcgcggcggtggtgttgaagtcccccgcgatcagggccggatggggacagccggcgacgtccccgaggagtccccggtactcccgtgcccggtcggcggcccgggagcggaccgcgcggtagaagtctgcgcgcaacgggctgatgagccgcagctgtaccgggatgtggacgttgaaggtggcgagaatccgaccgtcgccgggcatctccaggtccacccgcagggtccggcgggcggccgtctcgacggtcgccgcgaccggcagccgggacagggtgatcaggccccgggcgatgacggcccggtggccggggaaggtctcgcgcagccgccgctcgtcgtcgatgaggcggtaggtgccgttgaactggtcgtggtggtactcctggaggaggtagacgtcggcgtcgagcccgcgcagaaaggcgtagaagggttcggggtcggtggactggcaccagtgctgggtgttccaggacacgatgcgcaccgccccgtccggcggcggccggcgcgctccccgtacgagcgcgccgggtacgaggccggactgacggaccccggacagcagggacgcgcccgccacgactgcggccgtgaggtcccccgtcgcccaggagagcgccaggagcagggcgggcacgacgacgaacacgggcggcggcagcagcgagggcagcagccagaaccaccagcggccgttgaggacgaggtgtgcggccaggaacaccgcccaggccccggccgcccacagcacccatccgccgcccgtcgaggcctcgttcacccggaccgccgccaggaggccggtcgtcgtcacgcgggggctccctgtacggccccggcctcctggaacagcgcgtcgtaggcgtccaggcagttgtccgtcccgtaccgggcgcgggcgtcacggcctccctcggcgcggcgctccggggcgtagccggccacctccaggagggccccggccagcgcgcggacgtcgccgggcgggaagaggcggccgaagccggtctcggacaccggcacgcgcatgcccggggcgtcgctcgcgacggaggggacgccgagcatcatcgcctcggcctgggagatgccgaaggactcctcggcgacggacggcagggcgaaggcgtccagcgaggcgtagaagcccgccacccggtcgtcggcgaggaagccggtgaaccggatacgggtgtcgtcgccggcccgtgtgcgcagggccccgacgacgctgccgcccgcgaccttggagtagtcgccggcgatcagcagccgggcctcggggtccgggatcgtccggaaggcgtcgaccaggtggtggagccctttctccggggcgatccggccgaggaagccgaagtgcgggccggcagtctcgcggaaggcggcgggggcgggttcgcgttcgcggcagggcggggcgatggccagcagccggcgctcgcgcatcaggggccagtggcgcgaatgctccgcgtggtccacgttgttgacgaccacggcggccgagcggcgcagcgccccggccaccgaggcgtcgacgatcttcacctggagcggggcgagtgcgcccccgg

SEQ ID NO: 3310 - DNA, 3438 bp, Unknown
  Kingdom: Bacteria, Phylum: Actinobacteria, Class: Actinobacteria, Order: Streptomycetales, Family: Streptomycetaceae, Genus: Streptomyces
gggcgtgggtggccacgcgggtgcgggagaagtagcggtaccgctctggccccacgagtggtacctcgggaccgacatggtcgaggtcgatcaggacgaggcgtacaagctcgtcatcgaagtggccatgggcagccttgaggatgtggaccggatcgcagagcggctgagagcgctgcacgaggcgatgtgagcacggtctcgtcgggcctcggcgcggctcgtccgtaccgggtttccaccgggcccccggtagggtggcccggttgtcgtatcgcgggccgggccgatcaagggccgggtccggtgcggacagcggcccacgtacccgagagccccgaaccggagaccgtgactactaccaccgcctcccaccacctctcacccgcctttcccggccgcgccccctggggcaccgccggcaagctgcgagcctggcagcagggcgcgatggagaggtacatccaggagcagccgcgcgacttcctcgccgtcgcgacgcccggcgccggcaagaccacgttcgcgctgaccctcgcgtcgtggctgttgcaccaccatgtcgtgcaacagatcaccgtcgtcgcaccgaccgagcacctcaagaagcagtgggcggaggcggccgcgcggatagggatcaggctcgaccccgagtacagcgccggcccgctgagcaaggactaccacggggtcgccgtgacgtacgccggtgtcggcgtccgtccgatgctgcaccgcaaccggtgcgagcagcgcaagacgctcgtgatcctcgacgagatccaccacgccggtgactcgaagtcctggggcgaggcctgccaggaggcgttcgacccggcgacccggcggctcgcgctgaccggtacgccgttccggtcggacaccaacccgatcccgttcgtcgcgtacgaggagggcaacgacggcatccgccgctcctccgccgactacacctacggctacggcaacgcgctcgccgacggcgtcgtccgcccggtcatcttcctcagctacagcggcaacatgcgctggcgcaccaaggccggcgacgagatcgcggcccggctcggcgagccgatgaccaaggacgccatcgggcaggcctggcgcaccgcgctggcgcccaccggtgagtggatccccaacgtgctctccgccgccgacaagcggctcaccgaggtccgcaagggcatccccgacgcgggtggcctcgtcatcgcgaccgaccaggagtcggcacgcgcgtacgccaagatcctcaagaaggtcaccggtgagacgccgaccgtggtcctctccgacgagaaggccgcctcgaagaagatcgacaagttcagcgcggacgagtcgcgctggatggtcgcggtccgcatggtgtccgagggcgtcgacgtaccccgcctcgccgtcggcgtctacgcgaccacgatctccacacccctcttcttcgcccaggccgtcggccgcttcgtgcggtcccgcaggcgcggcgagaccgcgtccgtcttcgtaccgacgatcccgatgctcctcgacttcgccaacgagatggaggtcgagcgcgatcacgtgctcgacaagccgaagaagggcagcgacgaggagaacccgttctcggaggaggacaagctcctcgccgacgcggagaagctggaggacgaggagaccgaggagcagctgccgttcgaggcgctggagtccgacgccgtcttcgaccgggtgctgtacgacggcgccgagttcggcatgcaggcccaccccggctccgaggaggagcaggactacctcggcatccccggcctcctcgaaccggaccaggtccagctcctcctccagaagcggcagagccggcagatcgcgcacagccgccagaagccggccgaggaggccgacctcctggagaagcccgccgacgcccggcccgtggtcacccacaagcaactgctgagtctgcgcaagcagctcaacaccacggtctccgcctacacgcaccagagcggcaagccccacggggtgatccacaacgagctgcgccgcgtctgcggcggccccccgagcgcggaggccacggcgcaccagatccagcagcgcatcgcgaaggtccaggagtgggcgacccggatgacgtgacccggcgccgcccgttttcgtcggcccgtacggaggttccctctccgtacgggccgacggcgttcccgggcatcggggcgacgctcccgggatcggcggagatgtttccggtcgtcgtcgccgggaaatttctcggtggccgttcacacactgttaacgttggttcacatctgtggacgcgccgcccggcggtgtcgtgacacgtgaacgcgcgtagatgttcgctttccggacgtcgtcccgctgaccggcccttatgcgtgcaccgttttggggctccgggtccggagaccggattctggacgaggacttccgctgagcggactggatcgctactgtccccgccatatgaacgccccgtggcaacgccgccgcggagcgcagccggtgccttgccaggccggcggcctctccgtgcgtcgccgctgggaccggcgtcgcaaccccgccggagcaggaccgtcgtcgctcaccccgaagaggagagggcgtcgtgacagcggagacctcccagacgctcgaccgaggactgcgcgtcctcaaactgctcgccgacaccgatcacggcctgaccgtcaccgagttgtccaacaagctcggtgtcaaccggaccgtcgtctaccgtttgctcgccaccctggagcagcacgccctggtccgccgcgatctgggcggccgcgcccgggtcggcctcggtgtgctgcggctcggccgacaggtgcacccgctcgtccgggaagccgcgctgcccgcgctgcgctccctggccgaggacataggggccaccgcccatctcaccctcgtcgacggcagcgacgccctcgcggtcgccgtcgtcgagcccacctggaccgactaccacgtcgcctaccgggccggtttccggcatccgctggaccggggcgcggcgggccgggccatcctgtccgcccggcagacgacggagcccggacatcccggctacaccctcacccacggcgaactcgaggccggcgccagcggggcggccgcgcccctggtcggggtctcgggcgtggagggcagcgtcggtgtcgtcatgctcgccgacgccgtaccggaacgggtcgggccccgcgtgctcgacgccgcccgggaagtggccgacgcgctgcggtagggggttaccggccggggagctcccaggtccaccctcgcggaggcagcgggggcggcgtacgcctggcgcgttccggccggagggcggcggttagattgggtccgtgctcactcgtctcacgcgcccccgcgtcctcgccctctgcgcgctgcccgtcctcgccc

SEQ ID NO: 3311 - DNA, 5642 bp, Unknown
  Kingdom: Bacteria, Phylum: Actinobacteria, Class: Actinobacteria, Order: Streptomycetales, Family: Streptomycetaceae, Genus: Streptomyces
ccggctcggccagcgtccacgcgccgacgaccagcacgccgatcagctccgcggcgcagcacaccagcgccgcccggcgggccttctccccgccgcgcaccagcgagtacgtgatgaagccgtacaccagggccgcgacggccgagagcgtgtacgccagcggcgcccggtcgaagcccctgatcatctcgacgatcgtccgcgaggcggccgcgaccgtgaacaccccgtagaaccagaccaggacccggccggggccggtgcccagttcgaaggacggcttcggtgccgcggccacctcggtgcggtcggtgtcgctcacgtcagtttccccagatgtcatagagccggacctccagaaccgccagcacgaccgcgcccgccgccaccgtgaccgaaccccagcgggtccgctcggtcaacgacaggaagccggccgcgggcacggcggcgaacgaaccgatcagataggcgatgaacaccgccatcccctgctccggccgctccccgcgcgccagctgcacgacgcccacgaccaactgggccagcgccagcacggagacgaccgccataccgatgaaatgccagtccttcgtcggctggtcccggtaggcggcgtgaccgcaccaggcggcgagggcgagcgcggccacggcgaccgcgaccgtcagggcgtcaagcatgagtcgagggtattacggacggaacgcccgcccgcgtgcggccccggccgccacggaggcggccaccgccccggggcgcgcatcgtggccttggccacaaccggtggacgtggttccgctctccggacccccgctcacctctgagtccggccgtgcgaccgccctgtcgtcgcaggtcacagccgtgtgccgaggatcggccggcataaccggaagacaggcttccggccatccagcactgtccgctatgcggacggccgggatcgcggagatctcacgtctgttttacttggcccatgaccacgacgagcagccgcacccttgcgaccgaggcgatcagcacgcccggtgctcgttgtatgtgtcgaatgcgcgccttctgagggcccccgcctgagcctcgcgccccgaagcgagaccgagcctgcgccgtccgcaccccgcggaacgagcgcgcccgcgcatgcgctgtcccccggccgaacgccgtgtgtcagccatgccgagacccccggccgaccagcccgaacagtctcttcagacgaacgccccgtgcccggcggacaccgcgccgcgcactcgacagtgacggaaacccctgtgatcaccacgacgggcctcacgaaggtctaccagtcgcgcgaccgcgaggtcacggcactcgacgacgtcgacctgcacgtccgcgaaggcgaggtgtacggcgtcatcggccagagcggcgccggaaaatcctccctgatccgctgcgtcaacctcctggaacgccccacctccggcaccgtgacggtggcaggccaggacctcaccgccctcgccggccgaggccggcgggccggtgcggagctgcgccgggcccgcacccgtatcggcatggtcttccagcacttcaacctgctggactcccgcaccgtcctggacaacgtggagctgccgctggagatcctcaacttctccggccaggagcgcacccgcaaggccaaggagctcctcgacctggtcggcctctccgacaaggcgaaggcctaccccgggcagctctccggcggtcagaaacagcgcgtgggcatagcccgcgccctggcgggcgacccccaggtgctgctctcggacgaggcgacctccgcgctcgaccccgagaccacccgctccatcctccagctgctgcgcgacctcaaccagcaactcggcctgaccgttctgctcatcacccacgagatggacgtcgtcaagaccatctgcgactccgcggcgctcatgcggcgcggccggatcgtcgagtccgggaccgtcggcgagctcctcgccacccccggctccgaactggcccacgagctgttcccggtcggcgggaccgcctccggcccggaccgcacggtcgtcgacgtcaccttccagggggagtcggcctcccagccggtcatctcccagctctcacgcacgtacaacatcgacatctcgatcctcggcgccgcgatggacaccgtcggcggcaagcagatcggccggatgcgcatcgagctgcccggccgcttcgaggagaacgtcgtacccatcggcttcctgcgcgaacaggggctccaggccgaggtcgtcgaggacgagaccggcccgaaggccgccgccgtgaccggcgtacccgccgctgccgtcgccgtgccggagcagacgtccgccgcgctcaccaaggaggtcgccaagtgacctggtccgaaatgcagcctctgctgacccagggcaccgtcgacaccctctacatggtgctgtggtccgcgctggtcaccgtcgccggcggactgccgctcggtgtgctgctggtcctcaccgacaagggcggactgctgcggaacaccgtggtgaacaaggtcatcggcgtgatcgtgaacatcggccgctccctgccgttcatcatcctgctgatcgccctgatccccttcaccacctgggtcgtcggcaccttcatcggtcccaccgcgatgatcgtgccgctcgccgtcggagccatcccgttcttcgcccggctcgtcgagacggcgatccgcgaggtcgaccacggactcgtcgaagcggtgcagtcgatgggcggctccatccccacgatcgtccgcaaggtgctcctcccgcaggccctgccctcgctcgtctcgggtgtcaccaccaccctcatcgtgctcatcggctactccgcgatggccggcgcggtaggcggcgaagggctcggctccaaggccgtcacctacggattccagcgcttcgacaaccagttcatgctgatcaccgtcgcgctgctgatcgtcatcgtcaccgtgatccagctgatcggcgacctcaccgtccggctgctggcccgccgcggccgcaccgcctcctgaggcccggcccccgaactttctgtcaccaccgagcccgaactccttgtccgggcgcaccaccacaagaaagaggcactcttcgtgcgcaagaacatcaagatcaccgcaaccgccgcttccgccgccgccctcgccctgggcctgagcgcctgcggtacgtcctccgacccggccgccaagagcgagaccggcgcgaacgccgacacctccaaggccctggtcgtcgccgcgtccccgacgccgcacgccgacatcctgaacttcgtcaagaagaacctggcgaagaaggagggcctcaacctggaggtcaaggagttcacggactacgtcctgccgaacaccgccacccagagcggccaggtcgacgccaacttcttccagcacaagccctacctggacgacttcaacgcgaagcagaagaccaccatcgtgccggtggtcaacgtccacctggagccgctgggcctctactccaagacggtcaaggacctcaaggacatcaaggccggtcagaccatcgccgtccccaacgacaccaccaacggcggccgcgccctccagctgctcgccgagaacgacctgatcaccctcaaggacggcgtcggcaccagcgccaagctgagcgacatcaccgacaagaagggcctggagttcaaggagctggaggccgccaccgtgccccgcgccctggacgacgtggacgccgccgtcatcaacggcaactacgccatcgaggccaagctgaagcccggcaaggactccctcgccctggagaaggccgacggcaacccgtacgccaacttcctggcggtcaaggacggcaacgagaaggacccgcgcgtcgcgaagctcgcgaagctcctcaactccgacgaggtcaagaagtacatcgaggacacctaccagggcgcgatcgtcccggccttcggctcccccgccaagtcctgacgcccgcccggcacttgccgacccggccatgcacaaggcggacccgatgctgcatgctgtgcttttacccggtcttcggcatggagctgcgcatgactaccacctttccgtccatctccatcagcacggacaggttggtgatgcgccccttcgagatggccgacatacccgcgtacatcgagatgatgaacgacgagacggtcaccgcgtggatcgacgggccgaacccttacacccaggtcgacgccgaacgctgggtccgcaggatcgctcctgcggagcgcaccgcgggccacggcatcgccctcgccgtcaccgagttcctcacccagcggctcgtcggcagcgtccgcctcctcaacaccgactggcgcaccctggccaccgaggtccgctacatcaccgcaccctgggcccgcggcgaggggtacgccaccgaatccgtgctcgccatagccgaatggctcttccgcgaccagggcttcgaacgcatcgagctgcgcacccccgccgacaacaccgcctcccagcaggtcgcccagaagctcggctgcatcagcgagggtgtcctgcgcaacgctcgcatcgcccggacccggaccgagaacggcaccgacggcggctggaccgacatccgcaccgacctgatcgtctggggactcctccccgaggacctcgaaggggtcgccgaacagctcgccgacgccggcgactacggcacgtacaacaactggaagtagagcccggggccacccggaagcccaaggtccggacccggtactctcacccctgcccggcaccgcacgggtaacgccgcacgggaaacgcccgcaccgcacgggcgtacgcgccccacccctccgaacctcaggagacagacgacgatggccgaccgggtcacggtgatcggctgggacggctcgccactgaccagagcggccacggccgcgctctcggccgccacgctcgtcgccggcgccgcccaccatctcgccctgccggaagtgcccccgcacgccgaacgcatccgcctcggcagcgtcgacctcgccgcccgcaggatcgccggacaccgcggcagcgccgtggtcctcgccgacggcgaccccggcttcttcggcgtcgtccgcaccctgcgcgcccgcgaacacggcctggaagtcgaagtcgtccccgccgtctcctccgtggccaccgccttcgcccgcgccggcatgccctgggacgacgcccaggtcgtcgtcgcccacccccgcaccctgcgccgcgcggtcaacgtctgccgggcccaccacaaggtcgccgtcctcacctcaccgggcgccggacccgccgaactggcccttctcctcgacggagtccaccgcaccttcgtgatctgcgaggaactcggcaccgcccgcgagcgcgtcaccgtcctcacctccgacaaggcggccgaccacgcctggcgcgaccccaacgtcgtcatcgtcatcggcggcggccccgagaccaccgccgccggcgcctggatcgccggccgcccgcccgcctacccccaggggatacggggctgggccctgccggccgcggcctaccgggccgccggggccgagcggatgcaggagtccggcgagggcgagctccccggcctgcg

SEQ ID NO: 3312 - DNA, 1248 bp, Unknown
  Kingdom: Bacteria, Phylum: Actinobacteria, Class: Actinobacteria, Order: Streptomycetales, Family: Streptomycetaceae, Genus: Streptomyces
ggtggggggacggatggaggggcgctggggcgagccgatccgcgagggcgcgatgcgggacgtcctggtggacacctggccggtggtcgtccgcgtcgccgccgtcgcctccgcgctctacctggtgtggcgggcgcggaggcggaccggctgagccgggcccgggccagggcttgccgcgtcggcccggctccgggctgccggccgggcgcgcgaggccgctgatccggccccggcccgccccggcgaagcaccggacgagggactacttcgtcatgagggtttcgaactcgtccaggatcttgccggcggcggtgtagccgatgcccgagatccacagacggtcgtcgaccttgaagaccttgtcgttcttggccgccttcagccccttccacaggccgctgctcatcgtcttcgtcgtcccggccttgcccgggtcgccgtacgtcgacgtgaagatgacgtccgcgtccgcgaggtcgatcttctcgggcgacacgtcgtacgagaacccgtccttcgccttgtccgtgatcggggggcggccggtgccgatgtcggcgaggatcgagccgatgtagttctgcttgccgtagatgcggatctcggcgccctcgacgaagcggacgaagttgacgtccgtcgcggcggccttctccttgccgccgagcgcctccgtcaccttcgccacctgggtgtcgtacgtggcgaggaccttcttggcctcggcctgcttgccgagcgcctccgcgtgtacctggaagttctccttccaggcgctgccggtcgcctccgtcatcacggtcggggcgatctcgctgagctgctcgtagcggtccccgtcacggaccttgctggtgaggatcaggtccggcttgagagcggcgacggactccaggttcgcgttggcgatctcgccgaccggcgtgatgtccttcgtctcgctcgcggggaggtaggaggggaaggcgtcctcggacgccgagtgcgtcgcgccgaccggccggacgccgagggtgatcgcggagtccagctcgccggagtccaggacgacgacccgcttcggcgacgcggggacgtcgacgtcgccgttcgcggtggagacggtgcgcgtcttcgccggggagtcggaggagtccgcagccgggtccgaggagccgcacccggcgagggtgagcgcggcggtcacggcgagggagccggcgacgagggcgcggcggtcgcggaggaggggagtcatgtcagaga

SEQ ID NO: 3313 - DNA, 2382 bp, Unknown
  Kingdom: Bacteria, Phylum: Actinobacteria, Class: Actinobacteria, Order: Streptomycetales, Family: Streptomycetaceae, Genus: Streptomyces
ccgaaggccgggttgagcaggcccaccacgttgaccgtgttgccgaccccgttcaccgggacggcgacgggaacctgcgcgaggtcgccgctggcgacgcccggggagtgggtggccaggccgtggacgtcggcgccgctgtggccggtggcggaggcggctccggcgccggcggcgatgagcccgcccgcgatcatggtgacggcggcggccttcttcaggttcttcacttcaggatcctcctgtagaggctgcgacaggccgtcgcagcacgacctggagaacgccgtgcggccaggaacgatgcgccgttcgggtgacatacgcccgacagtatgaatctcggtccggacgggaacccgcgacggtggcggcgtcagcccgccgctccgttgcgtaccgcccacagcgccgcctgggtccggtcggccaggtcgagcttcatcaggatgttcgacacatgcgtcttgaccgtcttctccgagaggacgaacgcacgggcgatctcgcggttcgaccgcccgtccgcgatgagggcgaggacttcgcgttcccgctcggtgagcgtgctcccccggcccgtgccggtgcccgcgtcgtcctgggcgagcagcgctcccgcgacttccggctggagcaggacgtgaccggcgtggaccgagcggatcgccccggccagggcgtccgggtcgacgtccttgtagacgtaaccggaggctccggcgcgcagggcggggaccaccgtgcgctgttcggtgaagctggtgacgatgaggaccttggcggggttgtcgagctcccggaggcggcgcagggcctcgataccgtcggtgccgggcatcttgatgtccatcagcacgatgtcggggcggagctcctcggtccgggccacgccctccgcgccgtcggacgcctcgccgacgacctctatgtcctcctggatctccaggaacgtacgcagtccgcggcgtaccacctgatggtcgtcgaccagcagcaccctgatgttcttgtcaaccaccggggacctccatctcgatcgtggcgcccttgccgggctccgaggcaacggtgagtcggccgccgacgctgttcgcccggtggcgcatggagacgaggccgaggtggcggcccgcccgccggacggcggtgggatcaaagccgcccccgtcgtcggtgacgcgcaggacggtgtcggtgccgcgccgggccagggtgacgctcacgcgttccgcaccggagtggcgcagggcgttgtggagggcctcctgcgcgacccggagcagcgcttcctcctgggcggccggcagcgcgcgcacgccgcggctctcgaaggcgacctcggcggcgtgcgcccggtccaggacctggatctgggtacggagcgtggcgatgagcccgtcctcgtcgagggcggccggtcgcagttccacgacggcggcccgcagctcgtccaccgcctcggcggcgagggcggcgacctgctggagttcgcccttggcgcgggccgggtcgcggtcgacgagggcggtggcggcctgggcggtgaggcggagcgagaacagcttctggctgaccgcgtcgtgcagttcgtgggccaggcgggagcgttcctcggcgatggtcagctcccggctgcgttcgtagagccgggcattggtcagggcgatcgccgcgtgctgggcgaggatcgagagcagctcttcgtcctcggcggtgaagccgcagccgccctcgggcttggggcacagcttgttggcgaggaacagcgctccgatgatctcgtcgccgtccgtgatgggcaggccgaggaagtcggacatgtcggggtgggcgtcgggccagcccccgaagcgggggtccttgcggacgtcggcgaggcgttcgggcttcgcctggtggagcatcgcggcgaggatgccgtgctggcggggaagcgggccgatggccttccactgttcgtcgctgacgccgtcgaccacgaactgggcgaagccgccgtggtcgtccgggacaccgagggccgcgtactgggcgtcgagcagctcacgggcggaggcgacgatcgtcttgaggacgtcgcccacttcgaggtgccggctcatggcgaggagcgcggcactcaccgcggcgaggcccgacggtgggcgatgactcatgggatcaccgtaccggcggggaccgggcggtcgtatcgggccgggggcggtggtggacgcgcgggtggcctaggtccgggcagcggcaccctcggccgaaggtcgtaggactgcccgggaccgtatgccgacgtaccggggtacggctggcgctcccgggcgaggcgcggtgcgaccggggggctggggcgcgcgccgacggggacgcccggccgggcagggg

SEQ ID NO: 3314 - DNA, 9771 bp, Unknown
  Kingdom: Bacteria, Phylum: Actinobacteria, Class: Actinobacteria, Order: Streptomycetales, Family: Streptomycetaceae, Genus: Streptomyces
gccagggagagtcccagctcctcgccggccgacccgcccgcctcgtggtagggcagcgcgtccacggcgacggcccgcagacccggatactccgcgtcgcagacccgtgcccagcgcacggcggcggcgaggtccgcctcgacgcccgtccgggcctcgtggccgagcgggtcggcgcccagtgtgccgcgcgcctcgcccttggcgacgccgcgttcctcgtacagccgcagcagctccgtcgcggctgcgtccaggtcggccggagcgtcgagcgcgatgggcgcgaggtcgagatacacgccttccagcgcccgggcgagcccgtcgacggggaccccggccgggccgcccacggtgagccagagggacgtgacaccgttctccaggtcgccgagcaccgcctcgttgagccgggcggggtcggtcagggtgtggcgttggcgcacgtcccagccgcctgccgcgttcccctcggccctgctgccccgggtgaagggggtgaagccgggaaagccggtgtccggcgactcgtcttgtgcggtgtagagggggtgggtggtgagcccgtcctccagtgtggtggacagcgcttcctcggcggccgatcccgagacttccttgcccgacttgcgcagtacgccttcgacgagggtctgccactggtcatgggaggggtcggggaactcggcggccggagagagcccgtcagcaggctggaccgtcatgctcagatgctaggccagtgcgtcgaaccagcagcaggggcacctgctgtgaccttgccctctcggacatgtacttgatcctttacatacggtcgcgtaaccgccgtggcgggcggacagcggcaacacgacggttctcgacatcgggattaatcaggacagagatgcatattatgtgcgaagttacctgattttttatgtcatccctggaatgccgtatccaccccggcgcccctgcggccgccgggatacggagaggacgcgaccgtggccgtcggacctgtggagtacctcgtcatcgccttccccggcagtcgcttcgccgggtcggtcgcacccgtgctcgccgacgccgtgtcgtccggagccgtacgggccggcgacctgtccttcgtccgaagggtcgagggtgacgcgctgaccccggtggagcttcgggagctggaccccgagggggtggtacccgccggaacggccgaggacgggaccgccgcggcgctgggcgcggaggacgtcgaaaggctcgaccggggtgtgccggcgggcgatgtcgtggcgatcgtcgtccgggaggacctgtggaccacacagctcgcccgtgcggcccgcgaggtcggcggcacgttcgtcgcgcacgagcgcctcggggcccgtgattccggtgaccaggaggtcgcgggggacgacatcatcacccggctggagcggctcgccgagctgtggaagcgggacgtcctcaccgacgccgagttcgtggagcagaagacgaagctcctgtcggactgatgcccggccggcgtcccggggtgccgcccggcgttctccggtgatgctttccttaccgcatgcgatgttgatcctgatatgtggaattcctggaattcatcagggaaagaggcagttcatcgtgcagaccgcccggaccgttccggccgccaccgttgtcaatctgcgcgacctgggcggcatcgccctgggccgtgaccgccgggtgcggcagggcgtcctgttccgctcgggtcagctgagcgagctggacccggagagcgaccgggcggtgtccgcgctcggtatccgcacggtcgtggacctgcgcaccgccgacgagcgccagtgggccccggaccggctgccggaccgggccaggctcttcgtagccgacgtactgggcggccacccgggcgtggcgcccgcccgactgcggtccctgctcgccgacccggtcgaggcggaacgggcgctggggggcggccgtgccgaggaactgttcgccgagacctaccggaagatggtcctctcgccgggtgccgcggccgcctaccgggcctttctggagacggccgccgaccccggtgcgcgcccggtgctcttccactgcacggcgggcaaggaccgcaccggctgggcggcagccgtcctgctgatgctcctgggagcgccccgcgcgacggtgcggtcggacttcctcgcggtcaatccctccgtacgggccgccttcgccccgtacgtggcgaagttcctggacggtggcggcgaccccgccgtcgccgcggcgatcatcgaggtccgaccccgctacctggacgtggcgctcgacgccatggacgagcgctggggcggcctcgacggctacgtgcgtgacgggctgcgcgtgcccgacgccgcactggagcgactgcgcgacggcctggtgatccgcggctgacggaagtgagcgaagcgtcgtgaacgcggaaagaggccggtccggccgggacgatcccggccggaccggctcctgtgcgtcctgggcgaggccccggctacagacgtacgaggcgttccgtcaggtcgcggtagtgctggagggcgatccgcagatcctcggtctccgccccggtggccgggccgctcccgcccttccccgcgcgcagtcgccgtccgcgctcctccaggatcttcccgaggctcgcgacgacctcgtcgaaggcggcgtcggcctcccgcaccgcccggtgcgggtcttccacgaacccggtcaccgcctgctggatccgggcggtgaacgcctcctgctccgcgggggcgaacagcggactgccgggatgcgggccgtcgtcgatgccgctgcccggggccctcacgggcgtgcccgtgtcgatgggaccggcgccttcgggcaggtccgtgccgatgggaccggtgggaccggcgccttcgggcaggtccgtgccgccgggcagcggcgcgtttccgttcgatgtccgcgtcatgatgtcccgcgtcccttcaccagatgcctgttgccgtgctcacgccccgacggaccgcccgcgagcaggctgtcgaagagcccgcgggcctcgatcagggcctcacgcatctcctcggtgctcgcgtccccgcgacgagcggcgtgcacccggcggtagccgtcgacgtgcgcggcgtggtggacggagagcgcgtccgtacggtcctcgaagtcctcgccgtccgggaagccgcgctcgcgcgacagatcggccagcagcgcgtcggcttcggtgagcgcccgctccggcgactccacgaacagttcctgggcgctcgcccagcgggcggcgtaccgtgcgcgcgcctcctcggtcagcgggcgttcgtcgaggtgcccgtgccgcttcacccgatcgccgagctcctgctcggccgccgcggtgtcgccgccgtgccgggcgaccacgcggtcgtactccggtccgaagcggccgcgcaaccccctgccgccggccggacggccacgaagaaggaagaacgccgcgatggccgccacggcgaccacggcgatgatgatgatcgctgtcgtcatgactacctcccccgacgttcatcggccggtacgtagctctgctgtcgcacagtggtcaacccctttcggtccgagcccggcggcaaccgccggacgatgtacaggagttcgtgtaccccgggatctccgttcgaggcagcggccctccggcgcgaaggctccgcgcgacgctctgtgtagggtgaaagcgtcggatcggcggcaggtcggagggacacgcgatgacggagcgcaaaccaccgggagtcagtttcgagtcctgggtcgaccggcagatccacgaggcggaacagcgcggcgacttctccgcgctcccgggcttcggcaagccgatcgccggcctggaacgcccgtacgacgagacctggtggatcaagcagaagatgcagcgggaaggcgtgtcgatgctgccgcccgcgctggccctgcgcaaagaggcggaagacgtcccccacgcggtggccgcggcccgcaccgaggccgaggtgcggcgcatcctgaccgaggtgaacgagaagatcgagcaggcggtccggcggcctcccgagggcccgccgctgcggctgacccccttcgacgtggacggggccgtccgccgctggcgcgaggaacgccgcccggtctgaaggcgccaccagggtgccgcatactcgccgtatgggatcgggcagggaaggacgacgcgggcgcgtcccgcggcgtaccgacgtgacggtccgccgggccgctgcgggcgacgccggccgcctgacccggctggtccgcacatcaggcgcctacgaggacccgtacgcctcgatggtcgagggctaccgggtcgggccggactacatcgagacgcaccgggtcttcgtcgccgaggacatcgcgacgggccgggtcctcggcttctacgcgctgctcctcgacccgccggaactggacctgatgttcgtcgccgactccgcccaggggctcggcatcggcagactgctcgccacccatctgcgcgaggaggcccggagcgccgggctcaccggcgtccggatcgtttcccacccgcccgccgagggcttctaccggagcatcggcgccgaacccgtcggcacggtgcgcgccgatccgccggcggtgatgtgggaccgccccgaactcctgctccgcatcggctgaggtgcgccctgccggggacgaccggagcccggccgcagtgcgcggccgggctccgggacggggtgcttcaggcggtggtcaaccgccgtacgggcgggtgatcagctccatgccatgaccgctcggatcggggaagtacacaccccgcccgccgtcgttgtggttgatctcgccgggaatcttctggtggggatcggcgaaataatcgatccccagagcctggatcctcgcgaacgcggtgtcgaactccgcttccgaaatcaggaaggcgtagtgctgcggggtgatcgaagcggcggggatcgtcgcgaaatccagtgtgacgctgttcgcgagaacgaccggaatgaacggcccccactcttccccgaccgtcaggcccagcagatccgccaggaatgcggcggactcgcggttgtcccggcaatggacgatggtgtggttcaactcgactgacacggtggaatgcctccaacgggcatctcacgggctacctccacgcctcacccggccggtgaccgacgcgcgatgccctgccgtgatcataggcgggccccgcgcaccggtccacggggttacgtccgtggccggggggaacctgtgagatccggccatcggcacgccaccgtcgccgccggggccctcaaggagcaaagggaggacacgtgacaccgagcagaggccgtcgggagacccaggaggagcgggcggaccggcagtggtccgagctgctccaggaactgcgcgtcgcacagaccggggtgcagatccttttcggtttcctgctcgcggtggtcttccagtcgaggttcgcggacctgggggacaccgaccggaacatctacgtcgtcacggtgatgctgggctcggcgacggcggcggcgctcatcggccccgtggcgtaccaccggctgctcaccggccgtcggatgaagcccgagacggtcgtctgggcctcccggttgaccgtgctcggcctggtgctgctcttctgcacgatgtgctccgcgctcctgctgatcctgcgcgtcgccctgcacaaccaactggccctctggctggtcggcgcgatggccctgtggttcctggcctgctggttcgtcttcccggtgtgggccctggcccgagggcgctccggccggcgcgcgggagagcgcgaggacgaggacagtgacggggacgcgtcgcccgagcgggggagcgacgcctcctaggtcgtgtcaggccgggctgtgcacatcggtcaccgcgaacagcgcgccgtccgggtcccgcagggtgacctcggtgcccccgaagccggtgcgctcctcgacgagggcgccgccgtgtccctcggccgcggagactgtcgccgcgaggtccgccaccgggaactggacctgccagtgcgggcgtaccaccggatcgacagccgactccacggctccggagctgatccgggccagcggatgctccccgcaccgcacgatgacctcgtcgccctcgtacgcgacatcgcagcaccccggccgcccgctcgcccagtcgagcacctcgccgtagaagatcgccgcgtcgaaggcgttacgggtccgcagccgcagccaggcgtgcgcatggtcggccggggccgacggcgaggcggaggcttcggtgcgctcccagagcccgaaggacgccccgtcccggtccgacgccagcaccccgcgccccttgccgagcgtcagcggccccaccgccacggtcccgctgcgctcgcggacccgggcggcggccacgtcggcgtcctccaccgcgaaatacggcgtccaggccaccgcgacccggtacgccgaggagacggcgaagacaccggccaccggcacctcgccgcggtaggccacggagtagtccgccccgagccgcccggggcggaacgaccagcccaggacctgtgcgtagaaccgctcggcggtctccaggtcccgggtcatgagagtgacccagcagggtgcggccggccccgtgagcggtgctgccgaggccgtacggggatcgcttccggtcatggtccactgccttcgtcggggagcggcgtcctgccctgccgctgcggtccagcaaccagcctcgaccggcccgcccggtcccgcaacgcgggcccggctcaccgccccgcgcgcggcggggcattcgtgatgtcgaggaagacctggtcggcctgcggccaccggtcggccatcgcctccctgatccgcatcgacacctcctcgacccgctcgctgtcgatgccgggagcgaggtcgatacgggctgccacgaggaccgagtccatgcccagccgcatcgtgaggagttccgccacgttgtcgatctctccctggcgcatcaggaagcccgccaggtcgtcccgcagttccggatcgacggcctcgccgatcagctggtcgcgggcgtcccgtccgagccggaaggccacgtagaccagcagcagtccgatgcccagcgaggccgccgcctcccagaccacgctcccggtggtcaggtgcagcaccatgcccgccatcgccagggccacgccgaggaccgccgtgctgtcctccgcgatgacggtgcgcagtgccgggtccagagctccgggcctctcccggcgcgcctgatgcagggcccgagccagtgacgtgccctcggagacgagggcgacgccgaggacgatcagccccgccgtgtagccctcgggggactcgtggtcaccccggcggagtgcggagagcgcctggtagaacgagaagcaaccgcccatcacgaagatcccgacagcggccagcagcgcccagaagaagcgttccttgccgtatccgaacggatgacgggcatcggcgggacggcggctgcgccggagcgcggcgaggaggaagacctcgttgagactgtcggcgaccgagtgcgcggcctccgacaacagggcgggggagccggaggccagcccgcccacggtcttggccgcagcgatcaccaggttggccgcgagcgccaccaggaccgtgaggcgcgtacgccggtcggacgccgagccggccatcaccacctcctgagcagagggggcggcctggaacccccgagggacgccgtcagccgcgcggccgctcctcgtcgggcggcagcgggccgttgccgtggtccttcagctcgtacggggacagggcatgaccgtccgcggggaactggtcggaggagtgagggtcgtgctgctcgacgtgggtgcgccctgccggtttccgaggctgctcatcgggctggggcggcggaggctcggcgtcgtgcttgcgcttgctgaggatgaagccgccgatcagcagggcgacgacggccagcgccacgatggccataacgaccccgagggcccccgcgctcgccgcgagcgggacctcggccgacacctcgaccgcattgactgcattcagaacatccatgtagtgcgcataccccgggaggagggcatcagtcagctattcacagcaattcatgttttatgggtatctcatgggaaacgcgtttcaagaccgcccgccaggaccgccctcctgcccgctctccgggagttccagtcctctctcggacgcttcccgtgtcgccgtcgaccggatgcggggtcagcctggagtggtcccgaaggccggcatccccagcggaaggaatcacggtgaacagcacccccgagcagagcggcgaggatcacccggcgggccgggaggtggtggtctcgctcagccgctgcgacacacaggacgcgcggaccgtgttcgacgtgctcgccaccgccttcgcgtccgaccacccgatgggcgagacccccacgtcggactcgagcccccgcccgaccgtctgggtcaccaccgtcgacgtgtccgaaccgagggcggacgccaccccggcccgcctcaccgcaccggtcacggtggacgcccagggcggctactgggccgtcgaccggctgcgttcccacctcaccggggccttcgtggtgagcgtcgtcggcacggccgccggggaccaggaggaggaggtcaggctgcggctggagaaccgctgacggcccgaacgagaacacgaccggggtgaccccgccccgcggcgaagcgaaaggcgcgcgcatggattccctcgctctgggagccgacctcgaaccggaaccggtcgtcgacgaacactccaccgtgaccctgcacgtcaacggtgacccgacgacgctgaccgtcgaccaccgcaccacggtcctggagacgctgcgggagagcttcggcctcaccggggccaagaaaggctgcgaccacggccagtgcggggcctgcacggtcctcgtcgacggacggcgggtcaacagctgtctgctgctcgccgtggcccaggacggcgccacgatcaccaccgtggaggggctcgccgacggcgagagcctgcacccggtgcagcgggcgttcatcgagcgggacgccctccagtgcggcttctgcactccgggccagatctgctcggcggtgggcatgctccgcgaggccgccgacggccacccctcgcacgccaccggaccggagaccaccgccaccgggccggtcgcactcgacgccgacgagatccgggaacggatgagcggcaacctgtgccggtgcggggcctacccccggatcgtcgaagccatcgaggacgtgatcgagtgaaaccgttcggctatgtgcgccccgcctccaccgacgaggccgtccggctctgcgcggccggtcccggcgcccgtttcctgggcggcggcaccaatctggtggacctgatgaagctcggtgtggaggcgccccgggtcctcatcgacgtcgccgggctgccgctggaccgggtgacccggacggccgacggcggcctgagcatcggcgccaccgtgcgcaacagcgacctcgccgcccaccccgacgtgacgcggaactaccccgtgctgtcccaggcgctgctggccggggcctccggccagctccgcaacgccgccaccaccggcggcaatctgctccagcgcacccggtgccgctacttccaggacgtctccaagccctgcaa

SEQ ID NO: 3315 - DNA, 4988 bp, Unknown
  Kingdom: Bacteria, Phylum: Actinobacteria, Class: Actinobacteria, Order: Streptomycetales, Family: Streptomycetaceae, Genus: Streptomyces
gcgtgtccggagtggtgccgggggccgcgtccggcgtcggccgggtcgtcgtctgctggtcagggcgtcgcacgcctgcgcctccgggcttcgatgagcatttcctggacgtgccgcagcggctggccgtccgcgtccgtggcgtgccgggtccagttcccgtcggggcccaggtgccaggaggcggtggtgtcggccataccggtctccaggagtcggctgagtgcggcgcggtgggcggggtcggtgacccggaccagggcttcgatccggcggtcgaggttgcggtgcatcatgtcggcgctgccgaaccacacctcgggctcgccgccgttgccgaaggagaagacccgggagtgttcgaggaagcggccgagtatggagcggacccggatgttctcggagagtccggcgacgccggggcggatcgcgcagatcccgcgcacccagatgtcgacggggacgcccgcctgggcggcccggtagcaggcgtcgatgatcgcttcgtcgaccatcgagttgaccttgaaccggacgtaggcggggcggcccgcccggtggtgggcgatctccttgttgatccgggcgatcagcccgtcgcgcagggacttcggggcgaccaggagacggcggtaggtctcgcggcgggagtagccggagagccggttgaacaggtcggagaggtccgcaccgacctgcgggtcggccgtgagcaggccgaggtcctcgtacagccgggccgtcttggggtggtagttgccggtgccgacgtgggagtagcggcgcagcgtgtcgccctcctggcggacgacgagggagagcttgcagtgggtcttcagcccgacgaggccgtagacgacgtggcagccggcctcctccagcttgcgggcccacttgatgttggcctgctcgtcgaagcgggccttgatctcgacgaggacgaggacctgcttgccggactcggcggcgtcgatgagggcgtccactatcggggagtcgccggaggtgcggtacagcgtctgcttgatggccaggacgtccgggtcgcccgccgcctgctccaggaacgcctggacggaggtggagaacgagtcgtacgggtggtggagcaggacgtcgcgttcgcgcagggcggcgaagatgtcgggtgcggaggcggactccacctcggccaggtcccggtgggtgcccgcgatgaacttggggaacttcagctccggccggtccagcgaggcgatggcgaacagtccggtcaggtcgagcggtccgggcagcgggtagacctccgcgtcggacaccttcagctcgcggaccagcaggtccaggacgtacgggtcgatggactcctcgacctccagccggaccggcgggccgaaccggcggcgcatgagctccttctccagcgcctggaggaggttctccgtgtcgtcctcctcgacctccaggtcctcgttcctggtgacgcggaacatgtggtgcgccagcacctccatgcccgggaacagctcctccaggtgcgccgcgatgatgtcctcgatgggcacgtaccgctggggcgaggcctccaggaagcgggtcagcagcggcgggaccttgacccgggcgaagtggcggtggccgctgaccgggttgcggacgacgacggcgaggttgagggagagcccggagatgtacgggaaggggtgcgcggggtcgacggccagcggggtcaggaccgggaagacgcgctgccggaagaaggtgaacaggcgggcctgctccttctcggtcaggtccggccagcggatcagctggatgccctcgtcggacaggtccggggcgatgtcctgctggtagcaggcggcgtgccgggccatgagttcgcgcgagcgggtccagatgaggtccaggacctcgcggggctggaggccggaggcggagcgggtggcgacgccggtggcgatgcggcgcttgaggccggccacccggaccatgaagaactcgtccaggttcgacgcgaagatggcgaggaagttggcccgctccaggatgggcgtggtggggtcctcggccagttccagaacccgttcgttgaacgcgagccagctgcgttcgcggtccaggaagcggccctggggcagctcctcgccgtcccggtcgggctcgtaggcgtccgcgtcggcgtccagatcgggatccagatcggcggcggtggagaagccgaccccgttggacgccggggtggcgtgcggccggtgcgcggcgagtgaaccgacggacggctgggcggcgggctggaccgggacctcggagctgggctgctggctcatggacctattgttccgcgcggagcgctcctcaggcgcgtcggagcccggaaagatcgcggaaggaccgggaaaccccgggtcacggccgggggtgccttgagtggcgtttccccgggctctcccgttgcggcggggggcgggcacagctggctgcatcccgtgagggtcgcaaggacgtctgaatggccggtaacggcgacatgacgtacaggaagcggtgtgcctgcgggtgggtctcgtcgtcactgtacgtgttcgccgtgccggttcgccgctcgggggcgggcgaacgcgctcgccgtccgggcccacccctcgcggggcccggacggcgggtctccgccgggtgggcggtcagccgtgcaggcggcgcaggacccggaaggccgcgaacacggcgagggcggcgagagccagcaggatgccggtctcgacgagctggaggggccagtagtgggaggcggggtgcgcctcggcgaacggggtcacgccgccccggtcgcgcatacaggcgtcgtagccctccaccgagccggcgtcgtagcagtcccgccagtacaccttgctgccggacgtcgtgagcatgccgccttccaggtgccagtcgctgtcacgcagcagctcggggccctccccctgacggaggacggcgggccacagcaggtaccgccgtgtgctgaggccgatgcccacggccgcgagcacgagtgcggtcagggacatggacagcacggtgcggcggacgagcaccgcgcacaaggccccgaccgcgacggccagcagcgcgtagccgaggatcgcgggcccggtgccggggaacacgccactggcgtaccacttgagccccgggctgctcgggcccgcccgcagggcccacagcccccagcggaggacgacgaccaggaccgtcaggccggtgaccgtcagcgcggcgggcacggccagccgggcggccagccagtgggcgggggagaccgattgcgcccaggccagccggaacgtgccgctctccagttcgcgggcgatcagcgggcccgccacgaagacgccgacgagcgcggccaggaggaccagcaccgtgccgccgttgaccaggaagctctcggcggacgtgtgggcgtagctggagacgtagacgtcgtcgccgcacggagtcgtgtcgccgtccgcgcacagcaccttcgaggaggaggccatccagacgcggagcgcgacgacgatgccgatgccgaggaccatcagggcggctcccgcccagagggccttgcggtgcacccgcagcagcacgcgtacggcaccgcgaagagcggcgggagcggccgtgaccctgtcgggcttcgggggtgtcagggtgctcatgcggacgccacctccgtacgggccccgccggacgaggcgctcgcgctcggggtgagcagcggcggtgcgtccggggagcggaggtgggcgagcagcagctcctccagggacggttccgtgacggcccaggcggtggtgtccacggggccctccttcctgacgagcgcggtgagctgacgtcccgtcgtgcgggattcgacgacggtgtgcggggccaggtcgcgggccagtccggtgagcagggcgtgcgcgccgacgatgtcgtcgctctcgccgccgagccggacgcgcccgccgtcgacgaacaggaggtagtcgcaggcgccctccagctcggtgaggatgtgcgaggacatcacgatgccggtgccgtgctcggcggtctccgccatcaggacgcccatcagctcgtgccgggcgagcgggtcgaggtcggccatcggctcgtccagcagcatcagttcgggccgcttgccgagcgcgagggccagtgcgagccgggtgcgctgcccgccggagagggtgcggacgcgggcgttccgcggcagcggtccggcgatccggtcggcggtggcgcggtcccagcgcccggggttcagctcggctccggcccacagcgtgtcggcgacggagagctgcgggtacaggggcttgtcctgggagacgaaggcgatgcggtcgcgtacgtcgccggggacggtggagccgaggacggtgagggacccggcgctggggcggtccagcccggccgccaggttcagcagggtcgacttgcccgcgccgttgggcccgacgagggcgcagacgcggccggcgggcagccggaacgagcagtcgtgcagggcgcggtggccgccgctcccgcgcccgtaggtctttccgaggccgtgtgcctcgatcgcgacgccggtcatcgttcgtcgtcccccttgtacgtgctgtccagtacggcggtgaagagcgcgccgacgtcgtccttctccaggccggcctcccgggcccggcccaccacgtcggaggacggccccagccagatgccgacccgccacgccagcagcgaggcgagcagcgcgcccagcgccagccccacgaccacgaacacgcccccgcggcgcagccgccagaagacggcggcggccgagagcgcgccgaagccgacggccagcaggacgaacgttccgtccgccccgatcgcctcctcgccctcgctgttctcgaggaagaccgccgtgtcgtcggagatcagcggaacgcgcggcgcgagccacagccacaacagcccgagcgcgatgcccgcgagcgcgaccaggacgacgacga

SEQ ID NO: 3316 - DNA, 9105 bp, Unknown
  Kingdom: Bacteria, Phylum: Actinobacteria, Class: Actinobacteria, Order: Streptomycetales, Family: Streptomycetaceae, Genus: Streptomyces
gagctggacccgtacgcggcgtccgtgagggtctccgcgacccgccgcgcccgacgacggcggcgcagcaccacgaaggcggcgacgaggaccaggacagccaggagcacggcgacgacagggtggcggtcggcgctccgccaggccgcccgcagggccagccccccgcccgcgaggaccagggcgagcagggcgaagccgaacgtggtgcgccggaggtcgaagggagcacccccctgccggtcgctccgtccgcgtatcggtatccccatcggcgccccaccctgctctctgtccacttcaagatcacttgatcgcgtacacctgccccgagctgggctttcgacgcgtccgggaacatcggcccgtgcgaacggggccgaaatccgttggttccccgatcgccgccgtgctgaggtgcccggatgcgaaccgacgaagtacgcgacctgtacgaccgcgcgatgcgcgagcacgcccgcccggacgggcccggcgtacgcgtggagcgcgccggacccctggtacgccaggtcggcggctccgacgactggaacgggatcgtctggtcggatccggagctggacgccgaaggggccgacgcggcgatcagggcccagatcgggcactacaccgcgctcggccacggggaattcgagtggaagctctattcccatgaccggccggccgacctgggcgaccggctgcgggcggccggattcgtaccggatccgccggagaccctgctggtcgccccggtcgaggcgccggcctccctgcccggggccgggctgcccgagggcgtcgtcctgcgcccggtgaccgacgcggccggggccgagctgatggcgctggctcacgagcgggcgttcggcaccgacgcgggccggctgcgccaccaggtgctgacgcggctggagcgggctccggacgacttcgtggcactggtggtgatggccgacggggagccggtcagctcggcccgcatggagctgtaccccggcaccggcttcgccgggctctggggtggcggcacggtcgccgagtggcgcggcaggggcctgtaccgggccctggtcgctcaccgggcggccgtggccgccgagcgcggctaccgctacctccaggtcgacgcgacggacatgtcggccccgatcctggtccggctcggcttcacggcgctcggcacgacgacgccgtatgtgtaccgcacggccgggtaaccgcctgccagcaggacagaacgtcccgtaacacccatcgtgttgctcatgcgtgcccacgggatgacaagtgagagaaattgttggcactgggtgccttgtcaggtgtcacggagtgccatacgttgaaggtgtccgggcggccggcgtgctgagacctcacacgtacgccggctgtccccgcaaccaccgtgctgcgcgcccggacgcctgcgtcacaggcacccttctgctccaccgagcaaagccgagctccacccgccgaaccgacggcaacacctccacaccgcactcccctgccagcagggcccctcaagcgttccctcgacgccgcatcaccggaggcaacaccgtgaaggaaatcctggacgcgatccaatcccaggacagcaccgccgcggacttcgcggccctgtccctccccgagtcctaccgcgcgatcaccgtgcacaaggacgaggcggagatgttcgcggggctcgaaacccgcgacaaggacccgcgcaagtcgatccacctggacgacgtcccggtccccgaactcggccccggcgaggccctcgtcgccgtgatggccagttcggtgaactacaactccgtctggacctcgatcttcgagccggtgtcgacgttcagcttcctggagcgctacgggcgactcagcgagctgaccaagcgccacgacctgccgtaccacgtcatcggctccgacctggcgggcgtcgtcctgcgcaccgggcccggcgtgaacgcctggaacccgggcgacgaggtcgtcgcgcactgcctgtcggtcgagctggagtcctccgacggccacaacgacacgatgctcgaccccgagcagcggatctggggattcgagacgaacttcggcggcctcgccgagatcgccctcgtcaagtccaaccagctgatgcccaagccccagcacctcagctgggaggaggccgccgcgccgggcctggtcaactccaccgcgtaccgccagctcgtctcgcgcaacggcgcgggcatgaagcagggcgacaacgtgctgatctggggcgccagcggcggactcggctcctacgccacccagttcgcactggccggcggcgccaacccgatctgtgtcgtctccagcccggagaaggccgacatctgccgcgccatgggcgcggacgcggtcatcgaccgcaacgccgagggctacaagttctggaaggacgagcacacccaggaccccaaggagtggaagcggctcggcaagcgcatccgcgaactgaccggcggcgaggacgtcgacatcgtcttcgagcaccccggccgcgagaccttcggcgcgagcgtctacgtcacccgcaagggcggcacgatcgtcacctgcgcctccacctcgggctacaaccacgagtacgacaaccgctacctgtggatgtcgctcaagaggatcgtcggctcccacttcgccaactaccgcgaggcgtgggaggccaaccggctcatcgccaagggcaagatccacccgacgctctccaaggtctactccctccaggacaccggccaggccgcgtacgacgtccaccgcaacctgcaccagggcaaggtcggcgtcctcgccctggccccccgcgagggcctgggcgtgcgcgacgaggacatgcgcgagcagcacatcgacgccatcaaccgcttccgcaacgtctgaggttctccgatgaacgaacgtcagaaggaccggccctggctcatgcggacgtacgccggtcactcgaccgccgaggcgtccaacgagctgtaccgccgcaacctcgccaagggccagacgggtctctcggtcgccttcgatctgcccacgcagaccggatacgacccggaccacattctcgcccgcggggaggtgggccgtgtcggtgttcccgtctcgcacctcggtgacatgcggcggctgttccaggacatccccctggagcagatgaacacctcgatgacgatcaacgcgaccgccatgtggctgctggcgctctaccaggtggtcgcggaggagcagggggccgaccccgacaagctccaggggacgacgcagaacgacatcgtgaaggagtacctctcgcgcgggacgcacgtcttcccgccggtgccctcgctgcggctgaccacggacatgatcacgtacacggtcaaccgcatccccaggtggaacccgatcaacatctgcagctaccacctccaggaggcgggggccaccccggtccaggagatcgcgtacgccatgtcgaccgccatcgcggtgctcgacgcggtccgcgactcgggccaggtgcccgaggagaagttcggtgacgtggtcgcccgcatctcgttcttcgtgaacgcgggcgtccgcttcatcgaggagatgtgcaagatgcgcgccttcggccgcatctgggaccgcgtcacccgcgagcggtacggcatcgcgaacgcgaagcagcgccgtttccgctacggcgtccaggtcaactccctcggcctgaccgaggctcagccggagaacaacgtccagcgcatcgtcctggagatgctggccgtcaccctctccaaggacgcccgcgcccgcgccgtacaactgccggcctggaacgaggcgctcgggctgccccggccctgggaccagcagtggtcgctgcggatccagcaggtgctggcgcacgagagcgatctgctggagtacgaggacatcttcgccggctcgcacgtcatcgaggccaaggtggactcgctggtcgaggagtcgctggcggagatcgaccggatccagcagatgggcggcgcgatggcggccgtcgagtccgggtacctcaagtcggagctggtctcctcgcacgcggcgcggcgggccaggatcgagggcggcgaggagaagatcgtcggcgtcaacatctacgagacgaccgaacccaacccgctcaccgccgacctcgacggcgcgatcatgacggtcgaccccgagaacgaggcccgggtcgtcgccgccctccacgagtggcgggacaaccgcgacgagacgcgcgcctccgaggcgctcgccgcgctgaagaaggccgccgcgggcaccgagaacatgatggaggccaccgtcgagtgcgcccgcgcgggcgtcaccaccggcgagtggtcctgggcgctgcgggacgtcttcggcgagttccgcgcgcccaccggggtctcctcggccccggtggcggtcaccgccgagccgggcagcaccctcgccctggtccgcgagaaggtcacccgcaccgccgccgacctgggcgtgggacggctgcgcctgctggtcggcaagccgggcctggacgggcactccaacggggccgagcagatcgccgtacgggccagggacgccgggttcgaggtggtctaccagggcatccggctgacccccgagcagatcaccgacgcggcgatcgccgaggacgtccactgcgtgggcctgtcgatcctgtccggctcgcacgccgagctggtgcccgacgtcctgcaccggctgcgcgcggccggggccccggacatcccggtgatcgcgggcggcatcatcccgccggccgacgccgccgcactcgtcgaagccggtgtggccgccgtcttcaccccgaaggacttcggcatcaccgagatcatcggtcgtatcgtcgacgagatccggaaagcgaacaagctcgaccctctggaggtccccgcatgaccacgcccaccacccccgtgaaccggctgcgtccccgccgctcgtgcctggccgtgccggggtcgaacccgcgcttcctggagaaggcccagggcctcccggccgaccaggtcttcctggacctggaggacgcctgcgcgccgctcgccaaggaaggcgcgcgccacaccatcgtggacgcgctgaacaacggtgactggagcggcaagacccgggtcgtgcgggtcaacgactggacgacgcactggacgtaccgggacgtcatcacggtcgtcgagggcgcgggtccgaacctcgactgcatcatgctgccgaaggtccaggacgcccagcaggtcgtcgcgctggacctgctgctgacccagatcgagaagacgatgggcttcgaggtcgggaggatcggcatcgaggcgcagatcgagaacgccaagggcctggtgaacatcgacgacatcgccgccgcctcgccccgcctggagacgctgatcttcggtccggccgacttcatggcctcgatcaacatgaagaccctggtcgtcggccagcagccgcccggctacccggcggacgcctaccactacatcctgatgcgcatcctgatggcggcccggacgcacgacctccaggcgatcgacggcccgttcctccagatccgtgacgtggacgcctaccgcgaggtggccggccgcgccgccgcgctcggcttcgacggcaagtgggtgctgcacccgggtcaggtcgacgcggccaacgaggtgttctcgccctcgcaggaggactacgaccacgccgagctgatcctcgacgcctacgactggtgcacctccgaggagggcggcaagaagggctccgcgatgctcggcgacgagatgatcgacgaggccagccgcaagatggccctggtgatcgcgggcaagggccgggccgccggcatgcggcgcacctccaagttcgaagccccggaggcctgatcatgcagttcggacgcacctttgaggagttcgaggtcggtgccgtctacaagcactggcccggaaagacggtcacggagtacgacgaccacctcttctgcctgctgaccatgaatcaccacccgctgcacatggacagcaattacgcggagaagacgaccgacttcgggaagaacgtcgtcgtcggcaactacatctactcgctgctgctcggcatgtcggtgccggacgtctccggaaaggccatcgccaacctggaggtcgaatcgctgaagcacatcgcgccgaccttccacggcgacacgatctacggcgagacgaccgtgctggacaagaccccgtcgaagtccaagaacgaccgcggaatcgtgtacgtggagaccaagggctacaagcaggacggcaccgtggtctgcgtgttccgtcgcaaggtgatggtccccaccgagacgtacatcaaggagcgcggcggcgagcagcccggccgcccgacgcccgccaagtaactgtgtgaagccttaaggccatccgcgtgaagccacaggagaagcagccatgacgcgactcgcccagaccgccggtctgaacgacatccagcgggaaatcctttccacggtccgggatttcgtcgacaaggagatcattccggtcgcgacccggctggagcaccgtgacgagtaccccacggaaatcgtcgagggactcaaggaactcggcctgttcgggctgatgatccccgaggagtacgggggtctgggtgagtcgctgctcacctacgcactgtgcgtggaggagatcgcgcgcggctggatgagtgtgtcgggcatcatcaacacgcatttcatcgtggcctacatgctcaagcagcacggcacccaggagcagaaggacaccttcctgccgcggatggcgctcggcgaggtccgtggggccttctcgatgtcggagccggcgctcggctcggatgtgtcggcgatctcgtcgaagggggtgaaggacggcgacgagtacgttctcaacggccagaagatgtggctgacgaacggcggaacatcgaatctggtggccgtactctgccgaagtgacgaaggccaccccgatggcaccgcgccgcacaagtcgatgaccaccttcctcatcgagaaggagcccggcttcggagaggtccggcccggcctgaccatccccggaaagatcgacaagatgggctacaagggcgtcgacacgaccgagctcatcatggacgacctgcgcattccggccaatcgcgtcctcggtggcacgaccggccgagggttttaccaaatgatggacggtgtcgaggtcggccgggtgaatgtcgccgcacgtggttgcggtgtcgcgcaacgtgcattcgaactgggcgtttcgtacgcacagcagcgccacaccttcggcaaaccgatcgcccagcaccaggcgatccagttcaaactggccgaaatggccaccaaggtcgaagccgctcatgcgatgatggtcaatgcggcacgcaaaaaggactccggggaacgaaacgacctggaggcagggatggcgaagtacctcgcctccgagtactgcaaggaagtcgtcgaggacgccttccgtatccacggcggttacggcttctccaaggagtacgagatcgagcgcctctaccgtgaggcgccgatgctgctgatcggtgaaggtaccgccgagatccagaaaatgatcattggccggcgcctcttggaggagtaccgattccagggctgattgtccctttcgaggtgatttggtggcgaagaacatcacaccgggtcaccctcggcgggtgcctttccgccgtccgactcggctgctggcttgcccagttgcgcccggcaaccgatagcatcgccggaaagccgccgtcccccgttgccagcgcggcatcatccgctacgaaggtcattcatgcccgacagcacttcctccgcatcccgcggcggggtccgcatcgcccgcggagcatcgccgtggctcctgccgaccgtcgccaccgcagccctcagcctggcccgcgcccgcaagtcggggcgctgggcagcagtggctgtgcccaccaccgcgctcgcggcgggcatgctgtggttcttccgtgaccccgagcgcgagatcactgacggccgggtcatctccccggccgacggtgtggtgcagagcatcatgccgtggaaggacgggcgcacccgcgtcgcgatcttcatgagcccgctcaacgtccacgtgaaccgcgctccgctggcgggcaccgtgacgtcggtcgagcacatcccgggcggcttcgttccggcgttcaacaaggagagcgagaacaacgagcgcgttgtctggcacttcgacaccgagctcggcgacatcgagatggtgcagatcgcgggagcggtcgcccgtcggatcgtgccgtacctcccccagggcacgaaggtggagcagggcgagcgcatcggcctgatccgcttcggctcgcgcgtggacatctacctcccggagggtatcgatgtcgcggtcgaggtcggtcaggccaccaccgcgggggtgactcgaattgaccgtgattgatcctgataccaaggccggctgggtgccggaggccgacgacgagagcgaggtcgacggcgcggaggagatgccgctctcgatgcggctgtcgatagcggacacgctcacgctcggtaacgcgacgtgcggattcatggcggtgtacttcaccaccacgggcattctgatcccgcacctgacgggcagcgacgagacgggcatggcccggcactcggccgccaccgccgtgatcctcatgctgatggccgcgatcttcgacctgttcgacggtctcgtggcgcgcaagctgcgctcctcgccgatgggtgccgagctggacaacctctcggacctgatcagcttcgggctcgcaccggcctacttcgtgctcgtgtacggcatggtcgccgacgacgcccatcagcgggtgtcggcgctggcggcgatcgtcgtgttgctggcggtggtgctcaggcttgccagattctcctgcgtgacgctgaaggacggcatgttccagggcatgccgagccccttcggagcgctgacggtcgtctcgatcgtgctcctggagctgcccttcccgcccaccctgctggcgatcgtcggtgtggcgtggctcatggtgagc

SEQ ID NO: 3317 - DNA, 10080 bp, Unknown
  Kingdom: Bacteria, Phylum: Actinobacteria, Class: Actinobacteria, Order: Streptomycetales, Family: Streptomycetaceae, Genus: Streptomyces
ccgaaggggtgccgggacggctggaaaaccgtcccggcaccccttcggcatggatcgccgcgtccttccatggtccgcccggccggtgccgcccgccacccgggcggcgccggcccgcaccggacagccggtgtcaggtggccgcgaccgtggtcacctggagctgcttgatcccgttgagccaggccgaacgcagccgccgcgggtcctccaggagccgcaggtccggcagcacgtcggcgatggcgttgaagatcaggtcgatctccatcacggccagcgacttgcccagacagaagtgcgggccgccgcccccgaacccgaggtgcgggttggggtcgcgggtgatgtcgaaggcctcgggggcgtcgaacacctcggggtcgttgttggccgaggagtagaacagccccacccgctcgcccttcctgatccgctgaccgcccagctccaggtcctgggtggcggtccgctggaaggagacgaccggggtcgcccagcgcacgatctcctcggccgtggtcctcgggcgctcccgcttgtagagctcccactgttcggggtgggtgaggaaggcgtgcatgccgtgactgatcgcgttacgggtcgtctcgttcccggccaccgcgagcaggatcacgaagaacccgaactcgtccgaggacaggttcccctggccctccgccgcgacgagccggctcacgatgtcctgggccgggcactccttgcgggccgccgccaggttcatcgagtacgccacgatctccatcgccgcctcggcgccgacctcctcggtgatcgcgtactccggatcgtcgtacgcggccatcttgttggaccagtcgaagatcttcgagcggtcctcctgcggtatgccgatgagttcggcgatggcctggagcggcagttccaccgcgatgtcggtcacgaagtcgaaggagccgtcggcgtcggcggacgccagggcggtctcgacgatggagcgggccctggagcgcagagccgcctccagcgagcgcaccgcgcgcggcgtgaagccgcgctggacgatctggcggacccgggtgtgctccggcggatccatgttcagcatgatcagcttctggacgtcgatctggtcgcggctgatcgtctcgttgaagcggatgacggcggtgttggtgttcgaggagaacaactcggggtgcgtggagacgtacttgacgtccgcgtgacgagtgacggcccagtagccctcgtcgccgaacccggagatgttgcggggctgggagcaccaccagaccggcgcggtctcccgcatcagcgcgaactccgggtgcggcacgcgggcttggaggaggtcggggtcggtgaagtcgaacccgtcgggcagatgggggcagcgcatgggcacctctccactccggaactgtcggcgaaccgtccgacggccgcgactgtctgacgctccatcagaagttgcccgcaaggtagtaacgagttctacaagtggcaagagccgtggccggatctgttgcctccggacccggcgagggtccgccgcctcgccggaggggtgtacgcacagtgcgtgcacgccccttgcgcagccgggtcaccgtcacgagactgctagcagaactagaacgcgtactagttccttccgcgggcgccgggacgccccctgcggaagcgcgaggagaggacgagctcatggccgcggaacccgtcatcgtcgaagccgtacgcactcccatcggcaggcgcggaggcgcgctcgccaatctgcaccccgcctatctgctgggcgagacctaccgtgaacttctcggccgcaccggcatccaggccgactgcgtcgaacagatcgtcggcggcaccgtcacccacgccggtgagcagtccatgaacccggcccgcaacgcctggctgacggtggggctgccgtacgagaccgccgccaccaccgtcgactgccagtgcggctcctcgcagcaggcctcccacatggtcgccaacatggtggccgccggggtcatcgacgtgggcatcagctgcggcgtcgaggcgatgtcccgggtgccgctcggcagcggctccaagcacggcccgggaaagccctggcccgacgagtggaacgtcgacctgcccaaccagttcgaggcggccgagcggatcgcccgcaagcgcggcctgacccgggagcgggtcgacgcgctcggcctgctctcccagcagcgcgccgccgccgcctgggcggaggagcgcttcaaacgcgagacgtacgccgtccaggtcccgaccaccgaggaggagcaggcggccggccaggggatgtggcggctcgtcgaccgggacgagggactgcgcgacacttcgatggaggcgctcgcggggctcaaggccgtcatgccgagcgcgatccacaccgccgggaactcctcgcagatatcggacggggcctgcgcgatcatgtggtcctccaagcgcatggcccgggccctgaagctcaggccccgggcccggatcgtggcccaggcactggtcggctccgacccgcacttccacctggacggcccgatcgacgcgacccgggcggtcctcggcaaggcgggcatgacgttgcgggacatcgacctcgtcgagatcaacgaggcgttcgcgtcggtggtgctgagctgggcgcaggagttcgaggcggacctcgacggcctggagaaggtcaacgtcaacggcggcgcgatcgcgctgggccacccggtcggcgcgaccggagcccgcatcctcgccaccctcacccgcgaactccaccgccgcgaggcccgctacggcctggagacgatgtgcatcggcggcggccagggcctcgccgcggtcttcgaacgcgtcgcgcactgacggcggttcgcgcggaaccacctaccgggcggccggctcccccgtgcccgcgtccatgtccggacggcgcggggccgacgacgccgagccggcctgctcggcggtctcccgaccctcctcgtagaggtagtgccgcgttcccgccagcaccccgcggaaccagacgtccacctcgccctgccccatcgtcggccagtcgggggtctcctcgaccagggcgttccccagccggcggcccagctccaccaagtgcgcgcccgccgccgtgcgttcgtccgcgtaccgctccagcgccgcgcagacgtccggcccctggcggaggacccgctccaggcacagggcgtcctgaagcgccttgaccgcgccggtggcggtgtgcggcctggtcaccccggccgcgtccccggccagcagcagcggcggacgggcgacccggggggcctgtgcgtcggcgaccgggtggcagaccgccgcacgccgcccaccccgggcgacgatgtccgcccaggccgccggaaagtgctccttcgccagctcgtgcacgtacagtccgggctcggccccctcgggcggacggccgtagatggcgtacgccagcagccggttgcccgggccggtgctgccgtcgccgtcctgcgggccgcccgggatcagatagaagacgccgtgcccgccggggaagcccagggtcacccacgcgtcgcgcaacagctccagctcccggggacgccctgccggtgggccgagcgggatcgcaccacgccagaccgcgtacggagcgggctccgggcgcagccccggggcgagcagctgccgggtggccgacgcgtgcccgtcggcgcccacgaccacgtcgtacggttcctcgctgcgcgcggtggtgatcacggcccgtccggccccgtcccggccgaccgaggtcaccggccgcccgcgcagataccgcacggccccggcactcgcgcgcaacgaccgccacagcagaccccagttgcacggggccacgggggagggctgccgggccagttcccgcacggaccggccacccggctgccgcgtcagccagacccgcgtccccaccggagccgtcggcatcgccgcgtccagatacccggacccgagcagctccgtgtgcagctgcggcggaatcacgatgccgaacccccggtcctggagctcggcgccgctccgctcgtacacggtgacgtccgccccggcccgcgagcccgcgacggctgccgcgcaccccgcgatgctgccgccgatcactccgatgcgcaaagctgctgccacgtccctgctccttccgtcatcccgtcgttccctgacaacggcatcccgcgcacgcggaaggtccggccggacagtccccgctgtccggccggacctcgttctcccgcaggaggtctgtcagtcccgcgcgttgcgggtacggcgcatcagcaccgcaccgccgagcagcagcgcggcgctcgcgccggcggccagaccgagatcggcggcaccggtgtcggcgagatgcgcgtccggcgtgttggacccgggagtgccggacccgggagtgtccgagccgggggtgtcggtcggcggctggtcgaccggcggctggtccaccggaggttcgtccaggggcggctggtcgaccggaggttcgtccaccggaggctcgtccaccgggggttcgtcgaccggcggctcgtccacgggcggctcgtcgaccggaggctcgtccactgggggttcgtcgaccggcggttcgtccacgggcggctcgtccaccggcggcttcaccggcgggtggttgtgcttcgggccgtcggcgttcacgcacttgttgccgaaggccgggttgagcagagcgatcacattgacggtgttgccgcacacattgaccgggatgtgcaccggtgcctgcaccgcgttgcccgaaccgacccccggtgaaccgacggccgcgccctcggccgacgcgtcggcgtgcgcggtgccgccgaccgccgccaggaggcccgatgcggccgccatgacgatcatgcttttgttcaagacctgtcgcattacttgcccttccttaggacattcgcgaggacttcgcgtgggtgttttcgcgcgcggaggacgggcagccatcgggcggagccgctgcacagccggatcctgcggcgaagccatggtgaaagtggtgaaaacgtgcgcgctggacgactgccataacgactcaggcccttacgggaaacttggagttgcgtggaaattgtgtaatcacccgaacgggtggtgtcgccggattccgcgcatcccggatcgcaggcaaagaaaaacgattcgccttcaactgtgttccgtcgtcacggggttgacggaagaagtgcgcccttctcggatgcgacgcgcgctcggagccatccggcctcgaccacccgttcgggtgaggctcgtcgggggagtgtgcgcaattccttcacgaacgggcggtcgtgcgaacgggagagggggtcggcggctgtgtccggcattcgggtgaatgggcggaacctaacgccgcgcggtgagttgaccagggagctccgcttacggggcgaccagtacgagaagggttaatcgtgatcaagaaggttctggctacgggcgctgtcgccgcctccatcctcggtctcggcgcgacgcaggccatggccatcgccaacgacggcggcaccacctcggtcaacggcaacggtgcttcgcagtcgtacggcaactccgagacccacggtgactggagcccgcagttcgcgctcatccagggctcgctgaacaagccctgcatcgccctcccggccaaggcgaacgtcggctccctcatcggtctcgtgccgatcgcggtccaggacatcaacgtcctgtcctccccgcagaaccagcagtgcaccgagaactccacccaggccaagggtgacgaggcgctgtcgcacatcctggaggacatcccgatcctctccggcaacggcgccggcaacaactgatccgcagccgccctactcgggcccgtgccgtcggcgttcctccaccgaacggctcgggcccgttgccgtcccggaacgcgggtgcggcttccttgcccgtgttctccgccccggcccgacgggcagtgcggcattcgggcggacatccgggaattcgcccgtcgaacacctgcgtcaacaagtgaccctctgaccggccgggccgtctgcccgtaagcggtgggccccggacggcgggtgacgtccggggccttttcgcggcccgtcttcacaggccggaaccgtgaagggtgcggagaaaatcgccgacccacagtttcccgaaagcggcctgatcgttgatcagggagaaagcggcagaagtcacaggtaaagaaagcttgtgtgcggcacgggaacgtgaccgaaacagatgccgcgcagaagggaaccagaaaagtgaagtacgcgaagaccgccgcccttgttgccggttccgtggctgccctcggagcggccgctcccgccttcgccgctactacgcccacggcccccaacttcagcctcgacagcggcctcaaccaggtgatggccagtgccccgcaggtcgtggacccggtggtgggcacggtcgccgagaccgccgagacggtctcgaaggacggcacggtcggcaagctggcgggccaggcaaccggggtggccgagggcgccgctccgctgctcggtggagttcccctcggcggctgaccgtcgtagcgcgcccgttccacctgattctttcaccgatccgcatcactccccagaagggccccttacatgttcaagaagatcatggccacggcagccgtcgccgcctcggtcgtcggtgtctccgccgctgccgccgcacccgccatggccatcgccaacgacggcggcaccaccacggtcaacggcaacggcgcctcgcaggcctacggcaactccgagacccacggtgactggagcccgcagttcgcgctcatccagggctcgctgaacaagccctgcatcgccctcccggccaaggcgaacctcggctccctcatcggcctcgtgccgatctcggtccaggacatcaacgtcctgtcctccccgcagaaccagcagtgcaccgagaactccacccaggccaagggtgacgaggcgctgtcgcacctcctgaacgacatcccgatcctctccggcaacggcgccggcaacagctgagaccgggtagttccggcccgctgggtcggacccgcgtggggccagtccatccgtacggcgatcgttcttcgccggtccggacggactggcccttcgtcgtgtgccgacgcctccggccggggtatccggttgggccggatgccgtagcccgggctgacgatccgtgccgggccgggtagggcctccgtatggatccgtacgacagtcagaccccacagggcgcagagccgtggcccgcgtcgggcggcacaccgatctacgaccggctcgtcgccgagtggcgggcggccggaggaagccaccccttctcggagccgcaccaggaccaggcaccccggcgcggcggtttcgtgccgtcggcgcgtacctcggacgagggttccgggcccgaggcctccggagggtgaggccctgagggaggaggagtggcgtcgaccttgcgccggaacgaacccatttgagtggtgctgcgcaaccgatcaggggtggtggcagttgatcagtacgttccacaacgggacgctccgaaaggtgaagttgatgaagaagatgatggccggcgctgcagtggccgtgtccctgctcggtctgtccgcagtcgcggctcccacggccatggcgatcggcaacgacggtggcaccaccaccgtcaacggcaacggtgccgagtcggagatcggcaacgccgagacggagggcaactggagcccgcagaaccagctcgtccagggcaccctgaacaagctctgcgtcggcctgcccctcaaggccaacgtcggttcgctcatcggtctcgtgccgatcgcggtccaggacgtcaacgtcctgtccaacccgcagaaccagcagtgcgccgacaactccacccaggccaagggtgacgagccgctgtcgcacatcctggacgacatcccggtcctctcgggcaacggcgtcggcaacaactgacgcagcacagcctgaggtgttgagtgcggacggtccggagatcacactccgggccgtccgtcctcattttcccggcgcggcgcggcaaagtacggcttcgtcgcccgcccgaacagccgcgcgccgcacgggcgaggcccaccactccacggggggtggtgggcctcgtcgtgcgtccggggaggctggagcgcttctcagcccagggagcggaccgggagcaggcagtgggcggctgtgcggacgacttccacgtccgtggcgaaggcccgcagctggtcctcgctgaccggctgcccgggaacggcgtccggccacgggctggtggcgaacatcccgtacacctgaccctgtgcctgcgcggcggccagccactccgcgggggcggggtactgcgccgacaggtgaggcagcgtcaggacggcccgccccgcctggacgaggagcttcgcctggacgcccgggctctcggccgcgttctggatcgggccgccgacgtggaggcccgcgcgctccagtgcggcgcgcatggcctcgcggccgaccaccggaccgtcctgcccgtcgcccagcgagtaggcgaggaggaaggcggtgtcctggtccgcgtcgggctgccggccgctccagccgatcaggatctgcgtgcccaactgggcttgggtgaacgtgccggtggaggcctggggtgtggtcatgctcggcaccctaacggccccggaccaggctctatgcatgcgtatcacccgatcgggggagatctgcggcgaactccggcgaacaccccggtccggtcgcctccatcggaggtgcgcggaaaagctgttgacgtcgctcccgggtgccgggctactgtggccactgttccggacgccgcgatgacgcgtgcggcacggaaacggaagaggaaccaggaggtgaggacattgatgactgtcgttgcgatgggcactgcccacaaccggaagagcatcgtcctcatccccgtggccaccggctgaccgacttcttcaaccttcccgcgcccgagcgcgcgtgccggggccaccctgtgaagggtttcccttgtctttctcgtcttctcccgctccttcctcctcgcacccgctgactccgtacggctgggacgaggactgggcggctgctttctccccgtacgccgagcagggtctcgtaccgggtcgcgtcgtgcgggtcgaccgcggtcagtgcgacgtgatcaccgccgacggcaccgtccgcgccgacaccgcgttcgtggtgccccgcgacccgatgcggatcgtctgcaccggcgactgggtggcgctcgacgcggacggcgatccgcgcttcgtccgtacgctgctgccccgccgcaccgctttcgtccgctccacctcctcccagcggtccgaggggcaggtgctcgccaccaacatcgaccacatcgccatctgcgtctcgctcgccgtcgagctggacctcggccgcctggagcgcttcctcgcgctcgccctgtccagctcgagcggcgccgccctgctcggtgacggccaggacgcgggccacacccccgaaccgatcgtgctgctcaccaaggcggacctggtgcccgacgcggtcacgctgtcccacctcgtccaggatgtcgaggcgatcgcccccggcgtccaggtgctgccggtcagctccaccacgggggaggggctcgacgtcttcggcgcagtcgtctccggtggtacgagcgtgctgctcggaatctccggcgcgggcaagtcgaccctggccaacaccctgctcggcagggacgtcatggaggtgcaggcggcccgggacgtcgacggcaagggccggcacaccaccacgacccgcaacctgctcgtcctgccgcacgggggcgtcctcatcgacacccccggcctccgcggagtgggcctgtacgacgccgggaccggggtcggcgaggtgttctccgagatcgaggagctggcaacccgatgccggttccacgactgcgcccacgaggccgaaccggggtgcgccgtcctcggcgcgctgg

SEQ ID NO: 3318 - DNA, 4126 bp, Unknown
  Kingdom: Bacteria, Phylum: Actinobacteria, Class: Actinobacteria, Order: Streptomycetales, Family: Streptomycetaceae, Genus: Streptomyces
gcccggatccgggcgctcagcagatgactcagcaccaggagctggtagagcggctgcggggtgtcacgcagccggatccccgcctccgccgcatacgtccgcccgtacccctccagcagcgcgtcggtgatgcggcgcgccgacgcggacacctcgcggctcatccgtaaccgaagattcgggcgaggaagaatccggcgaccaccagcgcgccgatcatgatgagagcggcccagaggccggggtgctcccacagccctccgtccgcgcgttcctcatgggcctccccgatggaaccctcggccggcggtgtctctcctgggggattcactagaacagccatgcctccagcgtctctcggtccgagcgcccgcgcacgccgtccgggtcccgtgcccggctacggggccgtacggcggagccctgacgggggaagcactgcgacgagggaattcggggcaccgtcatggaatgccccgagtcgccgcccccgtcgtcaagctcgtgcagcgcaccaccgaacccgccggggtgcagacgctgcgctcgacggctgccgccgtcatcgcctactccgtggcggtctgggcgctgcccgaaccggcgccgctgaccgcgcccctcaccgcgctcctggtcgtccaggtgaccctctacgcgaccctcaccaccggcgtccgccgggtgaactcggtcgtcgtcggtgttctcatcgccatcgccttcagctctctggtggggttgagctggtggagcctaggcctcacgatcttcacctcgctgctgatcgggcggctggtccgggtcaacgagttcgtgcccgaggtggcgatcagcgcgatgctggtcctcggcgtctcccaggtcgccgacaccgcgtgggaccgggtgtgggagaccctgatcggcgcagtcgtgggactcctgttcaacctgctcctcgccccgcccgtctgggtcggctcggccggctcctccatcgagtcgctggccgtccggatgggcacgatgctgcgcagcatgggcgaggacgtcgtggggaacaaccccgtgtcccgggccgccgcccggctccacgaggcccgcaggctcgaccacgacatcgtggaggtcgacgcctccctgcgacaggcggaggaaagtctcaccctcaaccccagggtgagacagggactgctccaccgggtcgtcctgcgcaccgggctcgacacactggagatctgcgccgtcgtcctgcgcgtcctgtcccgcaccctcaccgacctggcgaaggcccgcaccgaggagtcgctcttcccggccgatgtgacggaactgctccaggaactcttcggccacctcgccgacgcgatcgagagcttcgccgtactggtcacgacccagctcgccgccgacgcggaggcggcggaggacagactcgccgacgcgctcgtccgtagccgggccactcgcgaccgggtggccgacctgctgctggaggacgtccaggagcacccgcgccagtggcagctgcacggcgctctgctcgccgagatcgaccgggtgctggccgagctcgacatcgaggaacgcaccgaacgcctcggcgaggagctgaaccgtcgctcggcggaggcgcacgcgcgtcaccccaggctgcgcgcactcctgaggaggctgggccggcaccccggctgacggcccgcgccggaacggcaccccgattccggtacggagccccggccgcgcgggatgcggaggcggccggtcgctggttcgctgggggcagaggtccccagcgtccaaggagtggtgatgagcggttcggacggacccgccgacctggctcggcagatgcgtgacaaggcccagcagctcgcggacgccgcggagcgcgcgagcgatccgcacgagcgcgagcggctggagaagaagtcccggacgatccgggaccggagcgagcagcagagcgccatggaggccggggacatctaccccgagaagtagcccggtcgactgccgcccgcctccggaggacctacggatcctccggaggcggcagccgcgtgcgggcgcgtcggtgggtcagccggcccactccaggagccggtccgtgctccaggtcgtcaccacccggtcggccggcaccccgcactcctcggcgcgggtgcaccccgaccgctgccagtcgagctgccccggcgcgtgcgcgtccgtgtcgatcgcgaacaggccccccgccgcgacggccgcgcgcagcagccgccggggcggatcccgccgctccggacggcagttgatctccaccgccgtacccgcctcggcgcaggccgcgaagacccggtccgcgtcgaaccgcgactccggccggccacgcccggccagcaggcgtcccgtgcagtgtccgagcacattcgctcgcgggtggcgtaccgcagcctccagacgccgcgtcatcggctccgggtccatccgcagcttggagtggaccgagaccacgaccacgtcgagccgctccagcaactcgggctcctggtcgagcgagccgtccgggaggatgtcgcactcgatccccgtcagcagccggaacggggcccactcctcgttgagccgcgccaccacggcgagctgctcccgcagccgctccggcgacaggccgcgcgccaccgtcagccggggtgagtggtcggtgaggacggcccacgcgtgccccagctccgctgcggtccggcccatctcctcgatcgggctgcccccgtccgaccagtccgagtgcagatgacagtcgcccgtcagccgggcgaagagctcctcgcccccctcgacgggcggctcggcggcggcctccttctccaaccggtccagatacccgggcgtctccccggacagggcctcacggatcacctcggcggtgcggggcccgatcccggcgacccgctccagggagttcgcggccacccgctcggccgcctccccggcggccatcgcgtccacggcggccgcggccgtacggaaggccttcacccggtaggtggcggcctgcgagcgttccagcaggaaggcgatccgccgcagagcggtgacggggtccatcggcacctccaccaggagcgcggtccgccgggcaggccgcccgtcccaccaggatgggcgcatccggccacgggcgcctccgcgagccgccgccgcttcaggacgcggcctccccggcgtccgccacggacacccaatggccggatcccgtgtcgtagtcgagcacggggcgcccccgcaccccgctcgtacggaacggccgcccgtcgtcgtcgatgcgcaccgtgccggaccggccgccgctgctccaggtcagctccgcgaaccagtcgcagtcgcacccggccgtgcgaccggtgatcaggaggacctcgggatcggtgacggagacgctgtacgggaaggcgaccgcctcgatgggctcgcccgagtcgttgcccgccaccgagcgggcgacgggccggggcacgtcgagatccacgtcgaacatcctcggcgtgagggatccgccgcagccggaactcatccggtagacccggccctgcgccggcgaacggcgctcgacgatccggatccgcagggcttcgagcaccacggcccgctcgtcccggccctgcaacgtgatccggacgccggtctcgcccgcgtgcgccgcgccgagcgctccggcccaggactccgcgtccgcctccatcgggggcggcggaacggcggcgggtgcccggtcgacgacgtaggcgtggtcgcagccgttcttccagacatggtcgtcagcggtccaggtgaacggcgcccgcccggccgccggacccggtgagcccccggacggccgggggagcgtctccgtgcgcggctcgacaccgggagcgtgggggagcgggaaggcgagggagccgggcggcagcccggatccctcgccttcccgctcccccacgccgggaaagccgcagggcacgccgagcgggaccccacgcggaacgccgtccgacggaccccggccgaccgtgcctcccggtgtcgagccgcgcacggagacgctcccccggccgtccgggggctcaccgggtccggcggccgggcgggcgccgttcacctggaccgctgacgaccatgt

SEQ ID NO: 3319 - DNA, 3616 bp, Unknown
  Kingdom: Bacteria, Phylum: Actinobacteria, Class: Actinobacteria, Order: Streptomycetales, Family: Streptomycetaceae, Genus: Streptomyces
gctgggcatcggctgccgcgtcttcgaacgtgccgagcagcctgccgaggccggcgccggggtccagttggcgccgaacgcggtccggcttcttcgccgtctggggctctccgattccctgcggcagcacggcgtccgcccgctctcccgcgatctgctgcgctgggacgacgggcggctgctggccaggaccgagctcggcgaggagtgcgagaagctgttcggcgcgccgtatgtcaccgtgcaccgcgcggacctgcaccgggcgctgcgtgacctggtcggcccggtggtgcggaccggtcaccggctgaccgggctggcggaggagcccggcgccgtcgtgctgcgcttcgccgacggctcggagcaccgttcggagctggtggtcggtgcggacggcatccgctcggtggtacgggaacatctcgccgcggacgccccggtcttctccggccggcggatctaccggggtctggtgccggtggagcgggtgccggaactggccgacgagcctcgcgtccaggtgtggctgggacccggccggcactgcgtctgctatccggtctccggcggccggctgatcagcttcgcggccaccacgggcggtaccgccctcccgggcgagtcctggaccaccctcggcgacgggggtgaggcggccgaggcctaccgggggtggcaccccacggtcacccggctgctcggggcgggcggcggtatcggctgctgggcgctgcacgatcgcgagccgctggcacgctggtcgtccgacgccctcacgctgctcggcgacgcggcgcatccgatgctgccgttcgccgcacagggcgccaaccaggcgatcgaggacgccttcgcgctggcggcgacgctggcgctgtcgcgcggcgacataccggaggcgctgcgccgctacgaggagctgcggatcccgcgtaccgagcgcctgcagcagtcggcccggtccgtggcggtcagttcgcatctgccggacggaccgctccagcgggcgcgcgacacggagctggcccggggatcggcgctggaggagctgcgctgggtgtacggccatgacgccctggccgccgcggcacgctggacgacggagcggcagaaggcgtgagcgggcaggacccggaccgcgtgcgacggtcgggcagccatccgcatccgtgtccacccggcccgtcccgctcgcggatcgggacgggccgaacggttccggccggggtcggaaagggtacatagctgaataagtcgccctggggaggctgattcgatgccgtggttcgcttggctgctcgccgccgcggctctcggtgccgcggagttcttcactctcacgctggtcttcgggctgctggccggtgcggcgttggtcgccgccgtcgtggccggtgtgggaatcggcctgctcggccagctcgtggcgctcggactggcggcggcagcgggtctcgtcctcgtccgccccgtcgcgctgcggcacctggcgcaggagccgctgacccacgagggcagtgatgcgctgatcggcaagcgggccgaggtgctccaggaggtgaccgcgacccacggcctgatcaaggtctccggtgaggaatggtccgctcgcgctctcgacgagagcctggtgatcccggtgggcgccctggtggacgtcatggagatcgaaggcgccacagccgtcgtgtatccccgtgagctccttccgtgaacggctgaacacgcagcgcaggaggaagcatggatccggtcgtcatcccgattctcgtggcggcgatcgtcgtcgtcttcctggtggccgccaccgtacgtgtcgttccgcaggcgcgccgctacaacatcgagcggttcggccggtaccgccggacgttgcagcccggcctgaacttcgtcctgccggtggcggaccgggtcaacaccaagctcgacgtgcgtgagcaggtgtactcgtccgaccccaagccggtgatcaccgaggacaacctcgtggtcaacatcgacaccgtgctgtactaccagatcaccgatccgagggcggcggcctacgaggtcgccgactatctgcacgccatcgaccagctcaccgtgaccaccctgcggaacgtcatcggcagcatggatctggaggggacgctcacctcgcgcgaggagatcaacgcccggctccgtgccgttctcgacgacgcgaccgggaagtggggcatccgggtcaaccgcgtcgagatcaaggccatcgatccgccgaacaccatcaaggaggcgatggagaagcagatgcgggccgagcgtgacaagcgcgcggccatcctgcacgccgaaggggagcggcaggccaagatcctcaccgcggaaggcacgaagcagaaggacatcctggaggcgcagggcacgcagcaggccatgatcctgcgggcggacggcgagtcgaaggcggtggagctcgtcttccaggcggtccaccgcaacaacgccgacgcgaaggtcctggcctacaagtacctggagacgctcccgcatctggcgcagagcgacaacaacaccttctgggtgatcccgggcgagctgaccgaggccatccgtaccgtcaccagcgcgttcggcgaccagccgacgggcaccggaccgccgccgggggcgcggcgcgaggacgcgaccgacgccgacgcctcggacaaggaccacgtcggtgctccggaggtggaggcgaactccacgctcgcgctggacgccgtggcggccgccgacgaggccgcgaagcaggccgccgtcgccgtgagcgacgcgaaggccgaggcggaggccgcaggagagacgcggctgccgggtcggccttcggggtccgacgcctgagcgagcggggcgtcggcgtccgccgccccgctcgggggcttacctggtcacactgcgctcggaggccgacgcggtcacaccgccagcggcaccgcgtggatctcgtccgccgtgtggcccgcgcgctcgtggatgcgctggacggcttccgccgagggagccgtggacaggcagtagaccgtgccggactgcgggtccgcccaggcgtgttcgaagtggacgccctcctccttctcgatcgccgtgtcggccgcgtgggcttccttcaactgtgcggacgtgatgcccttcatgccccggtggacatccatgtacatgcccatgactcgtacacctccggatgttcggttgtgacccctcttccatgctgcacctgatgccgagcgcgggcgcgcgggcgctccccggtgcggcgccccgcgcctaccgctcctccgcctccacccgcagttccgccagccccgcaggcttctccgggtcctccgagcggaccgtcacacggaccttgcgagccgtgtcgcccgccaggtagggacgccagaagcggccgtcgagggaggtctccacggtgtgcgaggcgggggcggtgtcgctccacgccggggtcacggagctgagccggagcggccttgcgcccaggtccaccgtcagggacccctccgcgccgtcgggggaccaggacgtcgccggggccccgtccaccgccgcctccgcgtacaggcccggcgcctcggacgtcgccgtcaccggtcggcag

SEQ ID NO: 3320 - DNA, 3859 bp, Unknown
  Kingdom: Bacteria, Phylum: Actinobacteria, Class: Actinobacteria, Order: Streptomycetales, Family: Streptomycetaceae, Genus: Streptomyces
tcccgcgcccgtgccgaagcccgcccgccgcccccgtacggcgaagaagaaggtcacgcttccccgcacggcaaagaagtcgctcgccgacaacgacacgtggcggaccgcccggctgttcccggtgtcggcgctcaagagcgaccgcgagcgcgagacgcgggccacctccgtcgtgctgtccgtgatggcccaggtgccggagttcggccgccgtctcaccgcggggttcggcgcaccggccggccggatggagacgttcaccgaggtgaccctgccgcacggggaatcgccgcgccgcccggacggtgtggtccgggtggagcgggcgggcaagctgtggaccgcactcgtcgagaccaagaccaacgggaacgcgctcaagcccgaccaggtgcaggcctacatggacatcgccgcccggcgcgggtacgaggcggtgatcaccctgtccaacgacgtcgcgctcgaaggcagcccgctcgtcgacgtacgggtcgaccgacggcgcaagcacaaggtggcgctctggcacctgtcctgggccgaagtcgtgcaccaggcgcagatgctgatccgccacgagggggtcggcaacgccgcgcacgcctggctgctccaggagctcctccagtacctccagcacgagaactccggctgtcacggcttccagaacatgggcgcggcctgggtcccggtgcgccggggcatcgacgaggaaaccctgtgccggggcgatgcgcgggctctggaggtcatcgagaactgggagcggctggtccggcaggtctgtctgcggctgggcggtgagctggggcagaaggtcctgccggtccagcgcgcgaggcgcggctccgatccgggtgcacgccgcgccgagctggccgaccacctctgcgagcaggggaggttgggcgccgagatccgcatcgaaggcacaccgggcgtccttgccatcaccgccgatctgcgcaccggcaagctccgtacgtccatcgaggtccccgcctcggaaccgggctatcccctcagccgggccaagcggctgatccggcgactctccgaggcccccgcggatctgcacatcgagacgctcgtcggcggcgagggcgccggcccccggggcacgctggagcgactgcgtccggagcccgccgacatccttccgaaggacggggcgcagatcaccggcttccggctctccctgttcaagggcatgggcaacggcaggggcagcgccgagaccggcttcatccgcagtgtcgacgaggcggtggaccgcttccatgcccaggtggtcgcccacctggaggccccggtgccctgacggcgggcccggaacgagcaggtcgcccccggtcctcggatcggggcttcagtggtatggacatgaccaaaggacaggactagcctccgtcttggtctagaccaagagcggcgagtcgtcgcccggtccatctgtccgcacgctccacccctcaccccaggagcaccacatgcgcagaaagatcacctccttactcctcggcctcggcgtcgccggggtctccctgctggccacctccggcagcgcacagagccacgggtacaccgactcgccggtcagcaggcagcagctctgcggcaacggcaccgtccgtgactgcgggcagatccagtgggagccgccgagcgtcgaaggccccaagggcttcccggcgcgcggcccccgcgacggtctgatctgcgccgggggcaaccagcggttcgccgagctggacgacccgcgcggcggagcctggcccgcgtccgacgtgaccgccggggcgagccacaccttccgctggcggatcaccgcccggcacgccacgaccgacttccggtactacgtcaccaaggacggctacgacccggcgaagcccctgacccgggccgacctggacccgcagccgttcctcaccgtgccgttcggcgggcggcagcccggggcgacggtcacgcacgcgggcaacctgccgcagaagtccggcaagcacctgatcctcggcgtctggaccgtcgcggacaccggcaacgccttctacgcctgctccgacgtcaccttctgagcggcacatcgccccgcggcacgaagaagggccccggtccgaagaccggggcccttccttcagggtgagtaacgggacttgaacccgcgacatcctggaccacaaccaggtgctctgccagctgagctatacccaccatgtcgcccggtcgtttccgaccggccgagaaaaagtgtacagggtccgggagggtgctcgcgcccccgtttcccggggccggtccacgggcgcttgcgcgcccgtgaccagcgggttcctacggtgcggccggggccgacaaacgcgccgcgatctccttggcgcgctcggagtccgggccgggctgcggcacgaagaccgcctcccggtagtagcggagctccgtgatggagtcacggatgtccgccagcgcccggtggttgccgttcttggccggactgttgaagtacgcccggggataccagcgccgggccagctccttgaccgaggacacgtccacgatccggtagtggaggtaaccctccagatcccgcatgtcccgcgccaggaacccgcggtcggtaccgaccgagtttccgcagagcggagccttgccgggctccttcacatgctcacggacgtacgccaggacctgctcctcggcgtccgccagggtggtgcccccggccagctcgtcgaggaggcccgaggcggtgtgcatctgccgcaccacctcgggcatggtctccagggccgcgtccggcgggcggatcacgatgtccaccccttcaccgagcacgttcaactccgagtcggtgaccagggcggccacctcgatgagtgcgtcgtccgtcaacgagagcccggtcatctcgcagtcgatccacaccatgcggtcgttcatgcgccccaccctacggggcactccgctgtcccggcagggccgggcgtccgggaacgtacgcgtcagggcccggcagggagtgctccccgggtcccatcgaagccgccacggcgacggccgcggaggacaggggcgaaccccggcgtccggacggcggcccctggctgggcaccatcgtctcgaccaccgtcgcggcgctctccgccaccccctgcggacgacgggcccgataggcggcccggtacgcggcgggggacgagccgagctggcggcggaagtgcccgcgcagcgcgaccggggagcggaagccgcagcggcccgcgacctcgtcgaccgaatagtcggaggtctccagcagccgctgggcctgcagcacccgctgggtgatcagccactgcagcggtgcgctgccggtgagcgaacggaacctgcggtcgaaggtccgcctgctcatgtaggcgcgcgcggcgagcgtctccacgtcgaactgctcgtgcagatgctccagggcccaggcgacgacctcggcgagcgggtcggagccgatctcctccggtaaagacctgtccaggtagcgctcctgcccaccactgcgccgcggcggcacgacgagccggcgggcgagtgcccccgcggcttccgtgccgtggtcggtgcggactatatggaggcagagatcgatcccggcggccgtgccggcggaggtgagcacatcgccgtcgtccacgaacagctcgcgcggatcgacgtgcaccgacggatagcgcttggccagcgtcggtgcgtacatccagtgtgtggtggccggacggccgtccagcaggccggcggccgcgagcacgaaggctcccgtgcacagaccgacgatgcgggcgccctcctcgtgggcgcgccgcagcgcgtccagtgc

SEQ ID NO: 3321 - DNA, 8418 bp, Unknown
  Kingdom: Bacteria, Phylum: Actinobacteria, Class: Actinobacteria, Order: Streptomycetales, Family: Streptomycetaceae, Genus: Streptomyces
gcgaggtcggcgtcctcgcgaccgcgaccggcgcgctccggcaccccggacaggctctgttcgtcccggcggggccgggccgatgcggtaccgcgtcagctcacgttcacgcggtaccgcctcagctcacgttcacgtccacgcaggcgtagaaggcgttggcggtgtcggcgatgttccacacggccagcaccttctgcttgccggacaggccgccgaagctgacctggtgggtcacggtctcgccgggccgggcgccgccgtcgttgaactcggcgatcttccggcctcccgcgtagtactgccaggtgctggtggcgtgccgtgcggtcagccgccagttgaagctggtcgtcctgccgaccggagtgaccttccagcccttgttgtcattgttgagctcggcgaaggcggcgttccctccgctgcagctcgtcagtcccttggggccctcgacgctctgcggctcgtacttgatggcaccgcaggagaccacgccggaggcgcactgggcctgtcggctggggggtgatgagatgtagccgtgcgcgctcgcgctgccggccggcaggctgacggccaggagcggggcgattcccgcgccgatggcgacggctaagagcctcttgcttttcatgacaactcctctgtgggggtccgtgcctgcccgcgcgaagacgaggcaggcatgcgcatgtcaagcagccacgccgtggcggtggggctgccacgggtagcgacggaagcgtaccgctcttggtctagaccaagctagtgcgcgggggtgacctctgggcccggctgtcgagccccggcagggccgaacaggcgctccaggaccaccgcgaccccgtcctccgcgttcgacagggtcacctcgtcggccgccgcgcgcagctccggatgcgcgttgcccatggccacccggtggcccgaaccggcgaacatcggcaggtcgttgggcatgtccccgaacgcgacgatccgctccgtcccgacccccagcagctcggcggccaccgcgagacccgtgcccttgtccaccccgcggggggccagctccaccgtgccgggtcccgccatggtcactgtcgccagatcgcccacggccccgcgcgcgacagcggccagcgcgtcgtcgcccagctcggggtggcgcaccagcaccttgatcacgggtcgctcccacaacgcggcacgcgcgtcgacgcgttgggcgggaagcgtcgggttcggcatccggtacccggcctcgatcagggtcgccccgtccacgccgtcctggtccacggcggcgaacacggccccgacctccgcctcgatcttcccgagtgcggcgtcggccgcctcgcggtccagggcgacggaccgcaacagccgcccgccgcccgctccggcctcgtagagctgggtgccctgtccgcagacgacgagcccggtgtacgccaggtcggcgagcagcgcccgtatgcctggcacgggccgcccggtgacgaccagatgccgggcgcccgcggagacggcgagggcgagcgcggcgcgggaccgggcgctcacggtgtcgtccggacgcagcagggtgccgtccaggtccgtggcgacgagggcgtatgcgggggtgatgccgggggcgtatgcgggtggcgtgggcatggccccagcctagaagggcccgaacggccgcttgcgcgccagggccggatcggctaggcgtccccgggcccggcggggagccgcgggggtgtcagtggaagatgccgctgtacgcgttgagcgcgggctggccgccgaggtgcgcgtacagaacgttggacccctcggggatatcgccgccccgcaccagatcgatcagcccggccatggacttgccctcgtagaccgggtcgatgatcatgccttcgagccggccggtgagtttgatggcgtccaccgtggacgccacgggtacgccgtagaggtctccggcccagccttccaggacggtgatctcgtcgtccttcaactcccgtccgagaccgatgagttctgccgtgtcacgggcgatcctcgccacctgggcgcgggtctcggtgagcttcgccgacgcgtcgatgcccagaacccgccgcggcctgtcctggcccgcgaacccggcgatcatgccggcctgggtgctgccggtgacgctgcacaccacgatcgtgtcgaagaagatgcccaactcctgctcctgccgctgcacttcgcgcgcccagttcgcgaagccgaggccgccgagcggatggtccgagccgcccgccggaatcgcgtacggtgtgccgcccgcggcccgtacgtcgtccagcgcctggcgccagctgtccttgacgccgatgccgaaccccgcctgcaccagccgcacgtcggcgcccatgatgcgggacagcaggatgttgccgaccttgtcgttgaccgcgtcgggccagtccacccagctctcctggatcaggaccgccttcagaccggcgcgggcggcgacggccgccacctgccgcgtgtggttggactgcacgccgccgatgctgacgagggtgtccgcgccctgccggagcgcgtcggggagcaggtactccagcttgcgggtcttgttgccgccgtaggcgagaccggcgttgcagtcctcgcgcttggcccagatgcgcgcaccgccgaggtggtcgctgagccggtccagcgggtgcaccgggctggggccgaacagcagggggtaacgctcgaagtcgtcaagggacatcgcgggctcctcgtgggtgtggacgggtccggcacggtggcactgcggtgggtcgcgcggtgagggacgttcagggggacacgtcgagcagcggcagcagcgtctgccagttcgcccgggtggcggccaccgcaccctcgacgtccccggccgcgcacagcgcgatgatccggtcgtgctgcgcgaccgacccgcgcccgctcagcgaggagaagcgcagccgctccaggcgtcgcagcacgggcgtgaactgatcgaggacggcggcgacggcggtgttggcacaggcggtcacggcaacgcggtggaaggcgtcgtccgcctccagcgccgcctcggcgtcgctgcgccgcaaggcctcggcgaaacgggtgttcgcctcgcgcatggcgtcgagctcgaccgcgcccagctgcggaaccgcttcccgtacggcgagttcgtgcatggcggaggtgaccgactgcgcggcccgcacggcacggacgtcgagcgggctcacgatggtgtaccgacccggcttcgtctgtaccagacccgcctgctccagccgcgccagcgcctcgcgcaccggcgtccggctgaccccgagccaggcgaccaggtcaccgtcgttgaggcgttcaccgggcgcgagggtgccgtcgacgatggcgtcacggatggcccggtaggcgctctcgcgcaggagcgaccgggagacgagacctcggttctgcggaactggcatgcaatatattgcatgctgcgcggggtgtggctgtcaagggtgaggtgagcagcggctgttggcccgtcggcgtcggactgaacgacgcgaggccccaccgcgtgtgtgcggtggggcctcgcggtacggctccgagtgctcagaccgtgccgaaatccccggcccgcacgccggccacgaaggcgctgaacgcggcggcggggacggtcaggctcgggccgctgacgttcttggagtcgcggacggggacgatgccgtgcgcggtggcgaggttggtggcgacctggacgcactggccgccgttgccgctgtacgaggaggtgtaccagcggggggtctcggtcgtcacaggatgccctttcgtaacgtcttgatcatggctacggaagctgcttgcgacagcgcctctgcctgcaactgatggtaggccgtcagcagaggcaggacgagggcgttgttacgttccaggtgcccgtgctgggtggactcggcgtacgacacgagtgagcggtccggcagggtcagcacggtcacgggcaggctgaatgggcggcgttcccccatctggaacggggcgatctgaagtacggtgctcggctgctcggcgaattccagcagtcggtcgaattgagctgccatgaccgcggggccgcccatgggtctcaggacgcagccctcgtccagaaccgcgaacaacaagggggtgggggagcgaagaagtgcggcctgccgctgcgccaccaacgcaacacgctcatccgcctgttcctgagtgatcgcctccctgcgtacggcatcggcctccagcgtggccgcgtactccggtgtctgaagcagtcccgggatgactccaacctcgtacagccggatctccgccgcgcgctcctcgtgcgtgacgtactccggaaacccctccagcagtgccgtgtgccgtacggcccggctctggcgctgcagccggtcacccgtgcccagtgccctgtcagctcttgccgcgaaggggccagttggagatcgtcgtccagtttccacggccgagatatgcgccccggagcaccccatgcgtgcggccagttcgtcctgcgtccagccgcgctcgtcccgcaagctgcggagaagcgctccgaacgcggcactcgccgaccgctcgggatccagttccttgcggttcaccatgcgacacctaacttgcctgccagtttgcgtaagttgaagacatcccgaccgtaggtcacgctgaatcgccccggtagtcgtacgactacagagaggagcgatcggtgtacggcgagaacgtctgctcgaatgcgcaagacccccccgacctcccggcccccggcacgctcatggtggacaccggtcacggtgaccgcgtgggcgagttccgtggggtcgccggcccctactggtcgctgcggcccgtgggcggcggggccgagtgggaggccgagccgcaccgggtccggcccgcgctcctcatggagcagcttcgggccaggaccgcacggctcaacgcccgcagccggggtgaggtgctgtgaacgcgacgcagacgcaagtgcgttggtacgtcgccgagagccacggcggcgacgcggcgcggtccgtgcggctcggcgggatcctcgcgccgacgcgacggctggccctccgctggctgcgccggcaggcccagcgcttcgcggacgcgctcgacccggacccgtacaccccctgggttccggcccgtgcgctgtacccggcccccgtggggggccgacgcgacgcaccggccgaactccgctcctgggcaagcagtttccgcgagcacgactacgcgctgatgcggctcgcggaagggttgccgtacgagttcgtcgcccgggacgccgcgtcctggtacgggctcgtcatgcgtcccctggccgccgccgcccgtatttctcccccttctcaccggcaaggatgagcgtcatgttgcagtgcaccgccttcagcgaactccccgagatgggtgcgcgcgtcgcgctcatgggcctggcgggcgggcccggccaggcgtcggaagcgcccgacctggacgacttcctgctctgtgaactcggcgagcacgacgaggggaccgagcacgcggcccagctctggtcggcctcggctccggccgggcgggacctgtggatgttctggaccgacgccgatggccgccggaagttccgcttcacggagctgctgccgtgcccggccgtcattcaccgactgtccgtcaaggagggggatgcctgtgtgctgtacgaccggcaccccgccgcgcactcctgggacgtgacggatccgctcgccgatctgatggcggagcggatcagggaagaggtgcggcgtgaccgcgacgggggaggcggcctgggggcccaggccgacaggccctagcggcgcttgcggccgacggcgttccgcaggccgccggtcagcgtgccgacgccggtgcgcagggcgatgtaatcaagggcgctgcccacaccgcgagcggcccacctgaacgctctcaccagctgttcgtccatcgcgtctttctctccctcggccgtacgtcgtcttcctgtatgacgcatctaccgtacgggaggttgccccggtcccgttcgtcgcagacctctgccgatcggcagatgtgcggggacgtcccgcgcggaagccttggttcccgacagcagacgccgctccgcgtgcgagcgggagaccagggggccaccatgccgaacaccgtcaccgaaacgccacccagcggggagacctccccgcgggtcgccgtggaccgccgccgacgctggtggtccggctggccgcagtggtccggatacctggcgatcgtgtggtcggcgctctacggagcggcggcgctctactgggtgctcggcggggacggttaccccttcgagcgggtccacgaggaccggtcctccggatcgatcctggagccgagccgggccgaggcggtcgccccggtgctggcggtgttctgcgccctcggcgtggtcgccggtcttctgatgctgaagaacctcgggaccggccgggtccgcaaggccctgctcgcctacgggtgggcggccggcgtcaccctgacgctcctgatacccgactactcgctgctcggcctgctggcgttctcgccggcgctgctcgtgttcgtcttcaccggggtgccgggcccgcaggacctgggcgacatcctgtactggcaccgcgggaacctgatgatcgtcttcatcggcgggctgctgtgggtcgccgcgaccctcgcgtaccagcggcgcaccaacgggcagtgcgtgtactgcggccgggccccgcacggcccggatgcctgggccgaccccgccaggctgcgtacgtggggccgccgggcggtctggctggccgtgctctcgaccctcccgtacgacatcacccgcatcgcctggtacttcggcctgccgctcggcatcaccgacgatttcctgaaggagatgcaggacacgccccacatactggagataggactcgcgctgggagtggtgtcgaccctcggcagcctgctgacgcacgggctggtcgccagatggggcgaggtctggccgcgctgggtgtggtggaagacgggccggacgatccacccggcgaccgccgtcgtcccggccgggttcgtcgcggtcgtgctcattccgggcggcctgatggcggtgcgcggcttcgagctcacctcgtggggaatcaccggccccgcgatcctgtgggtggtctggggtgcggcgctgggtgttgccacctacctgtaccaactgcgccgccgcggtgtctgccgcaggtgcgggcagggctgacgggcagtcggtacccaggcccccgcgtcagttcaggcagaactcgttgtcctcggggtccaccatgaggacccagctcccgccctgctcgtcgaacgtgcgcagcacccgcgcacccagcccgaccagccgttcctcctccgcgtcacgctgtcccggcgcggagtggacatcgatgtggaggcggttcttcaccgtcttcggctccggtacccgctggaacagcagccgcctcccctgccctgtaccgctgacctcgtcgtacgggtcgtccggatgccgggccgccgcgaggtcgagccaggcgcggcggccgtgggcgtgggtcgtgatggcctccggtacggcgccggccgcgagcagccgctcgaccagcgggctgttgtcctcgacgagatagcccagggccgccgcccagaatccggcttgcgcgtgcgggtcggcgctgtcgatcacgagcttccaggacagtgtctgtgtcatgaaaccgtttatagtggttacatgagtgagaaggcaacggacacgccggagcgatcccagcgggcggaacgatccggacgggcggggggacaggagccctccgggctgttgctgcggcacccggacggcagttcgttccgtttcgatccgggtgcgctgtgtctggagctgctgccgaccggggggccgggcccgttggcgtacttcgaggtgctgcacgagccggccgacctggtgcgctgggcggaggagagccggctgccggacgggctcggtccgggcgacgggcccgggccgagttcgcgcggcggagccggatcaagtccggcgcccgcgcttgtcgtgagcgcgggggaggtggcggacgcgcgtgttctgcgagatgcgttgtggcggctggcggagggccaggtggagggggtgccaccccgcccggacgacctcgccaccctcaacgacgcggcggcgcacccgcccctggtggcccggttgaccgcgggtggtgaccgggagtgggcccccgggggtaccggagccgggctgctgtccaccgtcgcgcgcgatgcggtcgagctgttcaccggggtgttcgccgaccggatccgcacgtgcgg

SEQ ID NO: 3322 - DNA, 658 bp, Unknown
  Kingdom: Bacteria, Phylum: Actinobacteria, Class: Actinobacteria, Order: Streptomycetales, Family: Streptomycetaceae, Genus: Streptomyces
gcccccgggcccgcccgcgctctgcccaccttcggtggggtccttcttcttgccctcgtcgccgttctccggctcctccggcggaaggccgaatccgaatggggtgtcactcacgggtttcctcggctcgtagggccgccggctcgaaccgacggcgactgcccgacatcaccatccagcgtagacaccacgcccgcttcgggcctcagtgctccgccgactcccggcctgcggcaggatggacgccacctggtacgtacgcgtcattcgggtacgtactgaagacaaccgctggagacgcccggtgagttccccagatccgcaggttcgcgcagcgcgaaacctgaccgacccctcgcccgagagcacacccgaaacgaaacgccccaggacccccagaaaccggggccccgtcgtcgcggtcaccggcgccgccaccggcatcggcgaactgctgaccgcccaccttgccgcatccgacgcgatcaggcaggtcatcgcgatcgacgagcgccggggagaggtctccgaggcgacctggcacatcctggacgtacgggacccggcgatcgccgagaagctgcgcggcgcggacgtcgtcgtccacctggccctcgatctcgacctggagaccgaccccgccgcacgcaccgcgtac

SEQ ID NO: 3323 - DNA, 15033 bp, Unknown
  Kingdom: Bacteria, Phylum: Actinobacteria, Class: Actinobacteria, Order: Streptomycetales, Family: Streptomycetaceae, Genus: Streptomyces
gacgccggactcgacgtgaccctcctggaagggcggccccgcctcggcggcctcgccttctccttccagcgcggcgacctcaccgtcgacaacggccagcacgtctacctgcgttgctgcaccggataccgctggttcctcgaccggatcgacgccgcccgcctggccccgatccaggaccggctggacgtgcccgtgctcgacgtcggccgggccgcgggaccgcgcctgggacggctgcggcgcaccggcctgcccgtaccgctgcacctcgccggcgggctcgccgcctatccccacctctcgctcgccgagaaggcgagcgtgggccgcgccgccctcgcgctcggccgcctggaccccgccgaccccgagctcgaccgtatcgacttcgccacctggctgcggcggcacggccagtcggagcgcacgatcgaggccctctgggacctcgtcggcgtcgccacgctgaacgccaccgccccgaacgcctccatggcgctcgcggcgaaggtcttcaagaccggcctgctctccgaacccggcgccgccgacatcggctgggccaccgtgccgctcggcgagctgcacgacaccctcacccgcaaggccctggacaccgcgggcgtccgcaccgaactgcgcgccaaggccggctccctcacccgcaccgaggacggccgctggatcgtcgagacggcgggggagcggatcaccgccgacaccgtcgtgctggccgtgccgcagaccgagacgcacgacctgctgcccgagggcgcgctggacgaaccggacctgctgctcgacatcgagaacgcacccattctgaacgtgcacgtcgtctacgaccgcaaggtgctgcgcaggccgttcttcgcggccatcggctcaccggtccagtgggtcttcgaccgcacccactcctcgggcctcaccggccccggacagtatctggccgtctcgcagtcggccgcccaggacgagatcgacctccccgtcgccgaactgcgctcccgctacctgcccgagctggaacggctgctccccgccgcccgcggcgcgggcatccgggacttcttcgtcacccgggagcgcaccgccaccttcgcgcccgccccgggcgtcgggcggctgcgccccggcaacaacacccggatgcccggcctccaactggcgggggcctggaccgacaccggctggcccgcgacgatggagggcgccgtgcgcagcggcgccggcgccgccgacgcggcgctccacgccctcggccgccccccaggacatccgctgcaggaggcggcatgagcagtaccaccggaacaagaggagagtctgtgaccccggcgaatccggctttcgacaccgtggcggacaccgcggacgtcaccgcgcttctggagcgcggacgagccctgtcagcgccggtcctgcgggctgccgtgggccggctcgcgccgcccatggacaccgtcgccgcctaccacttcggctggatcgacgccgacgggcggccttcggacggtgacggcggcaaggctgtgcgccccgcgctggccctgctgtccgccgaagcggcgggcgcggccgccgaggcaggcatccccggcgcggtggccgtcgaactcgtgcacaacttctcgctgttgcacgacgacctgatggacggcgacgagcagcgccgccaccgggacaccgtgtggaaggtgcacgggcccgcccaggcgatcctggtcggcgacgcgctcttcgcgctcgcctacgacctgctgctggagctcggcacggtcgaggcgggccgcgcggcccgtcggctgaccaccgccacccgcaagctcatcgacgggcaggcccaggacatctcctacgagcaccgggagcgggtcaccgtcgaggagtgcctggagatggagggcaacaagaccggcgccctgctggcctgcgccgtctccatcggcgcggtgctcggcggcgcggacgaccgtaccgccgacaccctggaggcgtacggctaccacctcggcctcgccttccaggccgtcgacgacctcctcggcatctggggcgacccggaggccaccggcaagcagacctggagcgacctgcgccagcgcaagaagtccctgcccgtcgtcgcggcgctcgccgcgggcggcgaggcctccgagcggctgggcgaactgctcgccgccgacgccaagagcaatgacttcgacagcttctccgaagaggagttcgccgcccgtgcggcactcatcgaggaggcgggcggccgcgagtggaccgcccaggaagcccgtcgtcagcacgcggtcgccatcgaggcgttgcacgccgtcgacatgccccaccgggtgagggagcagctcaccgagctcgccgacttcgtggtggtacgaaagagatgatcactcttcgcatatgactcgcagtcgccggccggcgtcccctgaccgggtgccggccgacggagaccccagcacagcagagaaccgactgcacgaaggggaagctcatgacagcgacgaccgacggatcgaccggggccgcgaacctctccggggccccggcagatccgaccgacacgacaacctccgcggacgacgtgaccgtcgccgcgcgacgggccgcggaacgctcggtggagcacctcctcggcagacaggacgagcagggctggtggaagggcgacctcgccaccaacgtcacgatggacgccgaggacctgctcctgcgtcagttcctctccatccaggaccccgagaccacccgggcggccgccctcttcatccgcggcgaacagctcggcgacggcacctggaacaccttctacggcgggccgggcgacctctccgccacgatcgaggcgtacgtcgccctgcggctggccggggaccgccccgacgagccgcacatggcacgcgcctccggctgggtcagggagcagggcggcatcgcggccgcccgcgtcttcacccgtatctggctggccctgttcggctggtggaagtgggacgacctccccgaactgccgcccgagctgatgttcctccccaagtgggtcccgctcaacatctacgacttcggctgctgggcccggcagaccatcgtgccgctcaccgtcgtctccgcgaagcgcccggtccgccccgcgcccttcgccctggatgagctgcacaccgaccccgagcaccccaacccggccaggaagcttgccccgcccgccagttgggacggtctcttccagcgtctcgacaaagggctgcacctctaccacaaggtcgccccgcgcccgctgcgccgtatcgcgatgaacctggccgcccggtggatcatcgagcgccaggagaacgacggctgctggggcgggatccagccgcccgccgtctactccatcatcgcgctgcacctgctcggctacgacctcgaccacccggtgatgaaggcgggcctggcctcgctcgaccggttcgccgtccggcgcgaggacggcgcccgcatggtggaggcctgccagtcgcccgtctgggacacctgtctggccaccatcgcactggccgacgccggactcagacccgaccaccccgccctggtgaaggccgccgactggatgctcgccgaggagatcaccagacccggtgactggtcggtgcgaaagcctgaactcgccccagggggatgggcgttcgagttccacaacgacaactacccggacatcgacgacaccgccgaagtcgtcctggcgctgcgccgggtgcgccaccccgaccccgcgcgcatgcaggcggccatcgaccgcggggtccgctggaacctcgggatgcagtcccgcaacggagcctggggcgcgttcgacgccgacaacaccagccccttccccaaccgcctgcccttctgcgacttcggcgaggtcatcgacccgccgtcggccgacgtcaccggccacgtcgtggagatgctcgccgtcgaagggctcgcccaccacccccgtacccgcgagggcatcgagtggctgctcgccgaacaggaggcgtgcggggcctggttcggccgctggggcgtcaactacgtctacggcaccgggtccgtggtgcccgccctgatcgcggccgggctgcccgccggacaccccgcgatccgccgggccgtcggatggctggagtccgtccagaacgacgacggcggctggggcgaggacctgcgctcctaccaggaggagaagtggatcgggcacggtgagtccacggcctcccagaccgcctgggcgctgctggccctcctggccgccggccgccgggacacccgcccggtcgctcgcggcgtcacctggctgaccgagacgcagcaggccgacggctcctgggacgagccgtatttcaccggcaccggtttcccctgggacttctccatcaactaccacctctaccgccaggtcttccctctcaccgcgctcgggcgttatgtgtacggcgacccgttcgccgaccgcgcggacgccgccgagggggcctgatgggcgatccgagagggtccggaagtcccgtgactcctctgctggtcgcctgtgctctgggcatcgagcagctggccctgcgcagcggcagaggcgctccgggcccggtccgggtgctgcgcaccggaatgggcccccgggcggcggaggcggccgtggcgcgcctcctgggacccgacggggtccccgacgccgctgtcatcgcctccggcttctgcgccggcctcaccccggggatgcacccgggggacctggtcgtcgccgaggagacccgggacgcggacggcaccacaccctgcacgggcaccggcgtcctggtcgccgcgctctccagggccgttccgggccgtacggtccacaccggcccgctgaccggctccgaccacgtcgtacggggctccgaacgggccgcgctgcgggccggcggggccgtcgcggtggacatggagtccgccgcgacgctgcgtaccgccctgtgtcacgggccgcgcccggttgcggccgtccgggtggtcgtggacgctccagagcatgagctcgtccgtatcggcaccgtacgcggtggaatatcggcgttccgcgttcttcgttccgtccttccggctttctacgaatggcaccgatctttactgctccccaggaggtgagctagatggccatgccgctccgtcagtccatcaaggttgcgacgtatcttctcgaacagaagctccgcaagcgtgagaagttcccgctgatcgtcgagctggagccgttgttcgcctgcaacctcgcctgcgagggctgcgggaagatccagcacccggccggtgtcctgaaacagcgcatgccggtcgcccaggcggtgggcgcggtgctcgaatccggtgccccgatggtgtccatcgccggtggcgaaccactgatgcacccccagatcgacgagatcgtgcgtcagctcgtcgcgaggaagaagtacgtcttcctctgcaccaacgcgatgctgatgcggaagaagctcgacaagttcaccccgtccccgtacttcgccttcgccgtgcacatcgacggactgcgcgagcggcacgacgagtcggtcgccaaggaaggcgtcttcgacgaggccgtcgccgcgatgaaggaggccaagcggcgcggcttccgcgtcaccaccaactccaccttcttcaacaccgacaccccgcagaccatcatcgaggtcctcaactacctcaacgacgacctgcacgtcgacgagatgatgatctcgcccgcctacgcctacgagaaggcccccgaccaggagcacttcctcggcgtcgagcagacccgcgagctgttcaagaaggccttcgcgggcggcaaccgggcccgctggcggctcaaccactcaccgctcttcctggacttcctggagggcaaggcggacttcccgtgcaccgcgtgggcgatccccaactactccctcttcggctggcagcgcccctgctacctgatgagcgacgggtacgtaccgacgtaccgccagctcatcgaggagaccgactgggagaagtacggccgcggcaaggacccgcgctgtgccaactgcatggcgcactgcggttacgagcccacggcggtgctcgccaccatggggtccctgaaggagtccctgcgcgcggcacgggagaccatcagcagcaaccggtgaggcggtgaccgacgaggtacggccggccgccacggtctccgcggcggccggcctccgcagcagcacacctggaaggagaagaacgggcgatgacggacggcggatcccagggcttcgacctggctcggctcctcgccgagcgcggggccgagcgatacgacctgcacgcgcgccacctcaaccaccaactgccgcgcatgctgcacaccatcggcttcgacaaggtctacgagcgggccgagggcgcgtacttctgggacgcggagggcaacgactacctcgacatgctcgccgggttcggcgtcatgggcctcggccgccaccaccccgtcgtccgccgggccctgcacgacgtcctggacgcccagctcgccgacctcacccgcttcgactgccagccgctgcccggactgctcgccgagaagctcctcgcccacagcccgcacctggaccgcgtcttcttcgggaacagcggcacggaggcggtcgagacggcgctgaaattcgcccgctacgccaccgggaagccccgggtcctctactgcgagcacgccttccacggtctcaccacgggatccctgtcggtcaacggggagagcggattccgcgacggcttcgcgccgctgctgccggacacgtcggtcccgctgggcgacctggacgcgctgcgccgcgagctgaagcggggagacgtcgcggccctggtcgtggagcccgtccaggggaaaggcgtgcacgccgcgccgcccggctatctgcgcgcggcgcaggagctgctgcaccggcacaaggcgctcctgatcgtcgacgaggtgcagacgggtctcggccggaccggggacttctacgcctaccagcacgaggagggtgtggagccggacctggtgtgcgtcgccaaggcgctctccggcggctacgttcccgtcggcgcgaccctcggcaaggactggatcttccgcaaggtctactcctcgatggaccgggtcctcgtccactccgcgagcttcggctccaacgcccaggcgatggcggcgggcctcgccgtcctgacggtgatggaggacgaggagaccgtcgcgaacgcccggcgcaccggcgacctgctgcgcgagcggctggcggccctggtggaccgctacgagctgctgcacgaggtccgcgggcgcgggctgatgatcggcatcgagttcggccggcccgcctcgctcaagctccggagccgctggaccatgctccaggcggcccgcaagggcctcttcgcccagatggtcgtggtgccgctgctccagaagcaccggatcctcacccaggtctccggcgaccacctggaagtgatcaaactgattccgccgctggtcatcggggacgcggaggtggaccgcttcgtggcggccttcacgtccgtcatggacgacgcgcacagcggcggcggactgatgtgggacttcggccggacgctggtcaagcaggccgtggccaaccgctgaccggagcgggagacagaaattgcctctgaggtaagttatttgcctcagaggaaagatcctggcccaatggaagcatgaacactccggacgaaggggtgccggacgagctccccggcgtcgcaccccgactgcgtgacctgcgacgcgaccgcggtctcaccctggaggccgccgccggccgggccggactctccccggcccatctctcccggctggagaccggccgcaggcagccctcgctgccgatgcttctggggctcgcccgtatctacggtacgacggtctccgagctgctcggcgagcagccgcccgaacgggacgcgatcgtccgcggcggcggcttcgagggagcggaggccgacggctggatgtaccggcaggccggcggatccggccgcgcgatgcaggcgttgcgggtgcgcgttccgtacggggcccagggggacctggtccgggtccatcccggcgaggagtggctgtacgtcctggaggggcggctgcgggtcgggctcggcgacaccgtccacgacctcgaacccggcgacagcgcccacttcgactcgctcaccccgcaccggatcgcggccgtcgaccgctgcggtgcggagctgctcttcgtccactccttgctgcagagtcccgccgccgagctgtgcctcggcaacgccctccacgcgcgctgaccggccgtccccgccggccccatccttcgctccaccggccgcgaggccgacagagaggaccgtcatgtccgattccgaacactatgacccgctgggccccggccgtcgcgcgaacgaggacccgcaggagaagcggatgccgcgcggcgtggtgatccggctcttcgcctatctggtggcgggccacatcatcgcgggcttcctctacctgctcttcgtggtggccgggagcaagtgacggcggccggatcgcgtcccgtccgggtcagctctggtcgagcaggcgctcgcgcagccgctcccgggtctcggaggagaccttcagtccctccgccaggtagcggtccgtcgtcccccagttctcctcgatggtggtgaaggccgccgcgaggtaggcgggccgcgctccgaagagcgggtccagcagctccatcacctcgggcgacatgccggtcccggacgcctcggagcgcttcacctcgtagcggcggtgaaggtcgttggacttgaggtagtcctcctcgatggcctccggctcgacgccgaccgccagcagggtgatcgcgatcgagagaccggcccggtccttgcccgccgcgcagtgcatcagggcggggacgctgtcctcggccagggagtgcagtacccggctgtgctcggcggtgcggtcctcgatcgtcgcgcggtacatccggatcatgcggtcgacgcccttgccgttcgcgaggaccgagcgcagctgctcgatgttcccgtcgctcaccagccgccagaactccgcgccgtcggccgggtccgagagcggaatactgacattgcggacaccggccagctcgatgtcgtatccgtcgagccggtggtcggcggagtggcggaagtcgaagatcgtgtgcagtccgagcccgccgaggaagatcgcgtcctcggcggtcgcgtgcgccaggtggccgctccggtagagccgcccgaaggcggtgcgccgcccatccgtggtggggagcccgcccacgtcgcggaagttgcggactccggtcagcgcggtctctgtcggcgggacctgcggcacctgttgcgtcacggtggctcctgggatctctggcgtcggcgcggctcgccggcgagggcgctcccgtgacgatacgacatcgattcgacggaaaatcatcacggtcgcgcgcctcggtgaggggtgccggagcggccgggctgacccggcgtcaggggtgtcgcccacgccgtgtccgtattggtgtatttcgcagaacatgccccgctaatgggggagatgggattccagaggtgagcgggatcatatccgtgacggtccgtggcgagcgcgccccgggctattcccgttgcccgtacggaaacccaagatccgtaatccacggagtgtgacgggaattccggagcgatattgaatcgatgattcccgtgcgcaaccgatggcttgttctgctcgtcctgactcgtttacggtcgccgcaatccggacggaccgcctaatcctgccgccgcccggaattcgcacccacccactcacgcgtggcaggagcgggggaaccaggtaagccgccgatccggagcgatccggaccggctcggggtgaagtcgccgcaaggcgaccgggcatctccagcccgaacccgacagctcacctcgcaggcgccggagaggaacttccccatgcccgcaaagggtaagcaccgtcgtccgaagtccggcccgatctcccgcggcgtgctcgccgcagggaccggcggcgccgcactcgccctcccgctcatcggcgccaccgtcgcgaacgccgcggatcaggccgctccggccgtgaagcccgcggccgcctcggtcgccgccgcgcacaccgctccggccaccgcccccgccgcgtcgaaggccgccccgaagacgtactccgtcgtctccggcgactacctggcgaagatcgcggccgagcaccagctcaagggcgggtgggagaagctgtaccaggacaaccgctccaccgtcggcgagaaccccggcctgatccacccgggcatgaagctgaccctcggtgccaagggttccgccccggccgagaagtccgctgctcccgaggccgccccgaagaaggccgaaccggcgccgaaggccgcgccgaaggcggacaccgtctccgccgacgactccgagggctccggcagctcggcgcggaccggctcctccgaggccaccggctccggctggtccgcccccctggccagcgccaacgtcaccacccagtaccgggcttccggcgccagctggtccagcggctaccacaccggctcggacttccaggccgcctccggcacccccgtactcgccatcggcccgggcaccgtggtctcggccggcaacagcggctcgtacggcaacgaggtcgtcatcaagcacgaggacggcatgtactcccagtacgcccaccagtcctcgctcaacgtctccgtcggccagaccgtcaccggcggccagcagatcggcctctccggctccaccggcaactccaccggtccgcacctgcacttcgaggtccgcaccggcccgagctacggctcggacgtcgacccgatcgcgtacctgcgtcagcacggagtctccgtctgaccgggcgcggcgagaagtgatcgaggggcggtgcgcggcggcgcaccgcccctccgcttattccggctttaccaaaaactgaccgggtggtctatctcaccacccgtcaaccccgtattacggtcgcgtaggtcacatcacacgatgcaggataagtgcttgtggcagacgattcgagaaacaaccagcagcacaccatcgggtcgtacgcggcgattggcgacagtttcaccgagggcgtcggcgaccccggccccgacgggacgtatctcggctgggcggaccgcttcgcggtgctcctcgccgaccggctcccggcccccgacgcggtggccggctccgaggactccccgcacggggacttccgctacgccaatctcgccgtacgaggacgtctcctcgaccagatcgtcgaggagcagatcccgcgcgccaaggaactggcccccgacctggtcagcttctgcgcgggcggcaacgacatcatccggcccggcaccgaccccgacgacctcgccgagcgcttcgagcgggcggtcgccgacctgagcaacgccgtcggcacggtcatggtcaccaccggcttcgacacccggggcgttcctgtgctgcgccacatgcgcggcaagatcgccacgtacaacgtccatctgcgggccatcgccgaccgctaccactgccccgtactggacctgtggtcgctgcgttccgtgcaggaccggcgcgcgtgggacaacgaccggctgcatctgtcgccggagggccacacccgcgtcgcgctgcgcgcagcacaggtactcggccacgacgtgcccgccgaccccgaccagccctggccgccgcaggcccagcgcacccccttcgacgagcggcgcgacaacatccagtgggcccgcgaatacctcgtgccctggatcggccgtcggctgcgcggagagtcctccggcgaccacgtcgaggcgaagcgcccggacctcctgccgctgtagccgtcgagccggtcagggctccagcaggggaagcgcacgccgggacgggcccggcaccacgagcccgtccggcggcgtgcccgcgcccggaggatgtcctgccggtatccgctccaggacaccccccgcgaacacgtcgtacagcggcagcgactccagatgcacataaccgatgtggcagtcgcacacggcgagcggacaggcccgcgggccgagcgcccggcggtagctgccgtcgtagagattccccagctccgccttgacgaagtgacagcgtcgcaccgtgccgtcgccgtccaccgagatcaccgactcgccagtccggcagggcagccctgccgagcggtggggatcacggctgtaggggaacagcggatccagctccgtccaccgcgccgcctcctcgtcggtgtaggtgtgcccctcggcggcgttcacccagagatagacctcctccggcagcgccgcccgcagccgccgtgcctcgtcgaggtgctcgtcgaaccccaccacgcccacgctgtagcggatcccgagcccggacagctcccggcaccggccgaggaaccgctcgtacggtgtctgccccgggtgatacgtgcaccagagcgcgatccgctccggatcggcgtcagccagccagccggtgcggcagctcaggttcgtctggatcgcgacgcgcttgatgtgcggcagccgcgacagctcggtcagcgcccgccggtaccaggaacgcaccaggccctcgccccacggggtgaacagcacggacagccggtcgccggtacgctccgcggcccagccggtgaaccgctccagtgcctcccggtccgccgtgagctgcgcgcgactgtcccgccgcttggcgaacgggcagtacgggcagtcgtagtcgcaggaggcgagggggccccggtagagaatcgtcaggtccatcgccccgtcacttccgctcgtacgcggccatcgcggcccgcaccccgggggagaacagcgcgggacccagcgcgtcggagtgggcgaggcccgacggggacagtctgagcagaccgtccggcgccgacgcgtccagccagccccgggccgcgaaccccgccagctcggccgggaagtccgcgcccggatccgtgccgaaccgtgcccggtagtccgccaccggcagccccgccgcctggagcagcgactgcaacagatgccgtcggcgcgcctcgtcggcgtcgacgtaccggccgacctcggcccgggagaagtcctcgacagcggtgaagcggtcgatgatcgaccggatctcccgcatgaccaccgcgtagtcgaaggagtagtgcagggccgccgtgtacgaacgcgccccgcagcccaggccgatcatgccgtcggtctggcaggcgtagtcctcaggactctcctgctcccgcggggcatccgtccgccggaacatccgcatcgacacctgctcatagccgtgcgccagcagatggtcccgccccaccgcgtacagccgcagccgctgctcgtcccaggcggcctgctccaggtcctccgcctcggcgccggccgccgcgccaaggcggtgcagaccggtgagcggccggacgtacaacggatacagatacagctcctccggccgccaggccagcgcggcgtccagcgagacgagccagctgcgctcggtctgcccgtcgatgccgtagatcaggtcgatgttcagcaccgggatccgggcctcgcggatccggccgagcgccgcctccacctcggctcggcgctgcgggcggaccgccgcccgcgcctcctcgtccacgaaactctgcacaccgatgctgatcctcgtcgtgccccggtcggccagcaccgccagccggtccgccgtcgccgtggacggggaggtctccaccgacagtggcaccgagcacaggtcggcgcccatccgcttctccgctatgtcgcagagccgctccagctcacctgcggtcaggaacgtcggagtgccgccgccgaacgccgccgcggcgaaccgcaccggcccctcgtcgcccagcgcgtcccgcacggccccggcctgcctctccaacgcgtccagatagcgcgtcgtcagctcctcgggcgcgccgatccgggtgaagaggttgcagaagccgcagcggacctcgcagaacggtatgtggagatagagggagagcgcgtccttgggctccgccgcccacagcgaccgcagcgacgggcggtcctccagcggccggtaggccgtcttgtgcggataggcgtagacataactctcgtacggccgtacggagggaagcccggcggtggccgcttccgtggcgacggtggtggtcatcgggcggcccccggttcgagtggtgcgggtggttcgaggaagaaatgcgcgtacggcacggtccagacggccgggtggccgagccggtgaccggtgtagccgtcgtcgccgtaggcggtgccgtggtcggagcagacgatggcgaagcagcggcgccgactgctcgccgcggcgaagagccggccgatgtgccggtccacgtactccagggccgccgcgtgcgtgtcccgggagtcgcccgcctcacgggtcgccccgggcagatggaaccagttcggctgatgcagggcggacacgttgacgaagaggaacagccgctgctcccgggggagcgccgcgacgacctgctccgcccgggcgacctgctcctcgaacgaggtgggcgaggcgacgccgaaaccgggctcccagtggctctcctggaacatccccggcagcaccgaaccgagcggcccctgacggttgaagaagccgaccccgccgacgcacaccgtgcggtagccctcggcggccagccccgacaccagatccggcgtgtcgaacacgaacgtgccgtccgccgtcgtctcactccccgcgaaccgcgccgcgaacaaccgggggtgcggccccggggaggcgggcgtcggcaggaacccggcgaacatcgcctggtgcgaggcgtaggtgaagctgcccggagcatgccgctcctcccagccgcccccgggcagataccgggcg

SEQ ID NO: 3324 - DNA, 6950 bp, Unknown
  Kingdom: Bacteria, Phylum: Actinobacteria, Class: Actinobacteria, Order: Streptomycetales, Family: Streptomycetaceae, Genus: Streptomyces
ccgccagatcgccggtgcgggcgcaccgctgcccggaccgctgggcgcggcgctggccgggcaccatctggccgcgacccgtaccggccgccggggtccgcaccggcgatctggcggccggtgggggagaggacccaggcgcgcaggtccaggtcggaggtgaggaggtccaggaccacctcggggccgccgcccgccggacccgaggtcatcagccgccggtgccggtccaccaccgccgccagatcgcccgcccgctcgccggagacctggcgtacgacgtgctcggtgatcgttgcgaaagccacggtctcgttcacggcgaagagggggaggcggtggtgcaggcacgcctcgaccagatcggcggggatgtcgccgagctccgcctcaccggccgcgagaccggccaccccggcgcccgccaggatgcggacgaacggttcggagtccgccgcgtcccggcgccaggcgagtcccgtgagcaccagctctccgccggagagatagcggctgggatcgcgcaggtcggtcgtcatgacgccccggaccgtgcggtccagctcgtcctcgccgccgagcagccgcaggcccagcgcgtcggtctccagcagtgcgcgcagccgcatctcgtcgccgccgatctttccgtagggagcaggtgaagttcgtggaggtgcaggtgaaggtggaagtgggtgaaggaggtcgtggggtgggggagccatgagggatacgggtatctgtcgattgcggcgaggttactgattcccgccattcgttcgaatctacaagacgaggacggacaccagccaactccttcagtgtttcggtgactgcaccggtaggagcagggcttgtgtactgggccacacaccacgtgaacaccatatgaacgagccagtcgagggccggccgtcccccagccccggcgaacgacccgattgagaagaagagagccactcatggacttccttcgccccgccagctgggaggaggcgctcgccgccaaggccgagcaccccaccgctgtgcccatcgcgggcggcaccgatgtgatggtcgagatcaacttcgaccaccggcggcccgagtacctcctggacctgaaccgcatcggtgagctgtccgagtgggaggtgggccaggagagcgtgcggctcggcgcctccgtgccgtacagcagcatcatggagcacctgcgcgtcgaactgccgggcctggcactcgcctcgcacaccgtcgcctccccgcagatccgcaaccgcggtggtgtcggcggcaacctcggcaccgcctcgccggccggtgacgcccacccggccctgctcgcggccgactgcgaggtcgaggccgaatccgtacgcggaacgcggctgattcccatcgacgccttctacacgggggtcaagcgcaacgccctggagccggacgagctgatccgcgccgtgcacatcaggaaggccgacggaccccagcagtactccaaggtcggcacccgcaacgccatggtcatcgccgtctgcgcgttcggcatcgcgctgcaccccgagacccgcaccgtgcgcaccggcatcggctccgcggccccgacgcccgtccgggccgaggcggccgaggagttcctgaacgccgcgctcgaagaaggcgggttctgggagaacggcaagatcatcacccccgcgatcgccaagcagttcgccgccctcgcgtccggcgcctgcaacccgatcgacgacgtccgcggcacggcgaagtaccgcaggcacgcggtcggcatcatggcccgccgcacgctcggctggacctgggagcagtaccgcggcgcgggccgcacgctggaaggagctgcgtaaccatgcgagtcaatttcacggtcaacggccgtcagcaggaagccgacgacgtgtgggagggcgagtccctcctgtacgtcctgcgtgagcgtatgggcctgcccggctccaagaacgcctgcgagcagggcgagtgcggttcctgcacggtccgtctggacggcgtcccggtctgtgcgtgcctggtcgccgccggtcaggtcgagggccgcgaggtcgtcaccgtcgaagggctggccgactacgccaagcaccgcgaggacgcccaccccggcggcggctgcgccgccggatcttgtggcaccactttggacgaagccaagcgctggcagcccaggcccaccgacggacagaccggcgaggccaccccgctctccccgatccagcaggcgttcatcgacgccggagccgtccagtgcggcttctgcacccccggcctgctggtcgccgccgacgaactgctggagaacaccccctcgccgtccgaccaggacatccgtgaggcgctctccggcaacctctgccgctgcaccggctacgagaagatcctcgacgcggtccgcctcgcggccgcccgtcaggaagaggcggtccagtcatgacgacgacccccgaggtccggaccgtaccggccggcacccccaccaagatcacccagggttcgcccaccaagggcggtatcggcgagtccacgctccgccccgacggcaccctcaaggtcaccggcgagttcgcgtactcctccgacatgtggcacgaggacatgctgtggggccagacgctgcgctccaccgtcgcgcacgccgagatcgtctccatcgacacctccgaggcgctcgcgacgtccggcgtctacgccgtgatgacctacgacgacctgcccgccgagatgaagaactacggcctggagatccaggacaccccggttctcgcccacggcaaggtccgtcaccacggcgagccggtcgcgatcgtggccgccgaccacccggagaccgcgcgccgcgccgccgccaagatcaggatcgagtaccgcgagctgcccgtcatcaccgacgaggcctcggcgaccgctcccgacgccgtgctcgtgcacgagggccgcgacgaccaccacatcggccacgtcccgcaccccaacatcgtgcaccgccagccgatcatccgcggcgacgccgacgaggccgccaagcgggccgacgtcatcgtcaccggcgactacaccttcggcatgcaggaccaggccttcctcggccccgagtccggcctcgcggtgccctccgaggacggcggcgtcgaactgtacgtcgccacccagtggctgcactcggacctcggccagatcgcccccgtcctcggcctgcccgaggagaaggtccgcatgacgctctccggcgtcggcggggccttcggcggccgcgaggacatctcgatgcagatccacgcctgcctgctggcgctccgcaccggcaagccggtcaagatcgtctacaaccggttcgagtccttcttcggacacgtccaccggcacccggcgaagctccactacgagcacggcgccaccaaggacggcaagctcacgcacatgaagtgccgcatcgtcctggacggcggggcctacgcctccgcctccccggcggtcgtcggcaacgcctcctcgctctcggtcggcccgtatgccgtcgaggacgtcgacatcgaggcgatcgcgctctacaccaacaacccgccctgcggcgcgatgcgcggcttcggcgcggtccaggcgtgcttcgcctacgaggcgcagatggacaagctcgccgcgaagctggacatggacccggtggagttccggcagctcaacgccatggaacagggcaccctgctgcccaccggacagccctgcgactcgccggccccggtcgccgaactgctgcgccgggtcaagtcccggccgctgccgcccgagcagcagtggctggcggcgggcagcgagggcacctccgtcgacgtccgcgcgctgcccggcgggctctccaacaccacgcacggcgaaggcgtcgtgcggggtgtcggttacgcggtcggcctgaagaacgtcggcttctccgaaggcttcgacgactactccaccgcccgggtccggatggaggtcatcaacggcgaaccggtcgcgaccgtgcacaccgcgatggccgaggtcggccagggcggcgtcaccgtccacgcccagatcgcccgtaccgaactcggcgtcaaccaggtcaccatccaccccgccgacacccgggtcggctccgccggatccacctccgcctcccgccagacgtacgtcaccggcggcgcggtcaagaactcctgcgaagccgtacgggagaaggtcctggagctgggccgcaccaagttcggcacctaccacccggcctgggccaccgccgagctcctcctggagggcggcaaggtcgtcaccgacggcggcgaggtgctggccgacctcgccgacgtcctggaggacgaggcgattgacatcgagctggagtggcgccaccggcccaccgaggcgttcgacctgcgcaccggacagggcaacggccacgtccagtactccttcgccgcgcaccgcgcggtcgtcgaggtcgacacggaactgggcctggtcaaggtcatcgaactggcctgcgcccaggacgtcggcaaggcgctcaacccgctctccgtcctcggccagatccagggcggcaccctccagggcatgggggtcgccgtgatggaggagatcatcgtcgacccgaagaccgcgaaggtgcgcaacccgtccttcacggactacctcctgcccaccatcctcgacacgccgaccatccccgtcgacgtgctcgaactcgccgacgagcacgccccgtacggtctgcgcggcgtcggcgaggcccccaccctgtcgtccaccccggccgtcctcgcggcgatccggaacgcgacaggtcttgagctcaacaggacaccggtgcggcccgaacacctcaccggcgcctgagatcgtgccgggcggtctcccaccggtggccgcccggcagtctccgagcggtccccccgaactctccgggcggtgcgcagcgccgagaacgtcacacttttccgctcccgcgccgcccggaggcaccaagtaccgcaccgctcgcggttcttcgccgtgccgagcgcacggcatcgcctcacggaccgtccgtgccgccggcacaaccgttctgcttcaccgtccgtcccggccgtccccgggtcgtgcagccgacgcagtcatcccaaatcccgcattcaggaatctccaagcgggtgcccctgtgaaccttgggagtcaggcatcatgacccagcagtcagtggaaccgaagaccggcgcggaggccgcgggccccggctcgcgcgtccccgccggaagatcatggctcgaccggtacttccacatatccgaacgaggatccacggtcgcgcgcgagctgcgcggcggcgtcacgaccttcatggccatggcgtacatcctgcttctcaacccgctgatcctgggcggggaggacgtcaacggcaacctcctcagccagcccggcctgatcaccgctaccgccttcgcggcggccgcgacgaccctgctcatgggcttcgtcggcaaggtgcccctggcgctcgccgccggactcagcgtctccggcgtcctcgcctcgcaggtcgcgcccagcatgacctggccgcaggccatgggcatgtgcgtcatctacggtgtggtgatctgcctcctggtggtcaccggcctccgcgagatgatcatgaacgcgatcccgctcgcgctcaagcacggcatcaccatgggcatcgggctgttcatcgccctcatcggcctctacaaggccggattcgtccatcagggcaaggcgacccccgtctccctcggcccggccggtgaactcgccggctggcccgtcctcatcttctgcgtgaccctgctgctcatcttcatgctccaggcgcgcgacatccccggcgcgatcctcatcggcatcgccgttggcaccgtggtcgcgatcgtcatcaacgcgatcgtcgacgtcgaccccaggacgtggagcagcggcccgccggagctggagggcagcgcggtctccacccccgacttctcgctcttcgggaacgtcgagttcggcggctggggagacgtcggggtgatgacggtcggcatgatcgtcttcactctggtgctggccggcttcttcgacgcgatggccaccatcatcggcgtcggcaccgaggccgagctcgccgacgacaagggccgtatgccgggcctgtccaaggcgctgttcatcgacggcgccggcggcgtcatcggcggggtcgcctcgggctccggccagacggtcttcgtggagtcggccaccggcgtcggcgaaggggcccggaccgggctcgcctccgccgtcaccggactcttcttcgccgcctgcctcttcttcaccccgctcaccgcgatcgtgccgaccgaggtggcctccgccgccctcgtcgtcatcggcgcgatgatgatgcagaacgcccggcacgtggactggagcgaccgctcggtcgccatcccggtcttcctgaccgtggtcctgatgcccttcacgtacaccatcaccaccggtgtcgccgcgggtgtcatcgcgtacagcgccatcaagctcgcccagggccgggcccgcgaggtgggggccttcatgtgggggctgacggtgatcttcatcgtcttcttcgccctcaacccgatcgagagctggctgggcgtccactgacgccggagcccccttcacgcccaaaggagacacgccatgctggacatcgccgaggagctgcaccggtgggtctcgcagggacgcgagttcgccgtcgccaccgtggtggcggtcggcggcagcgcgccccggcagcccggtgccgccctcgccgtcgaccgcgacggcacggccatcgggtcggtgtccggcggatgcgtggagggggccgtctacgaactgtgccaacaggccctggacgacgggaaatccgtccgcgagcgcttcggctacagcgacgaggacgccttcgc

SEQ ID NO: 3325 - DNA, 7279 bp, Unknown
  Kingdom: Bacteria, Phylum: Actinobacteria, Class: Actinobacteria, Order: Streptomycetales, Family: Streptomycetaceae, Genus: Streptomyces
cgggtcgctgctcggcgtggtcggcgaggccgacgagggagagcagcagggcgacccgctcgtcgcgctcggccgggtcggccttgcgcagccgcaggggtacgccgacgttctcggcggcggtcaggatcgggatgagaccgaaggactggaagatgaagccgacccggtcgcggcgcagctccaggaggcccttctcgccgagtcccgacagctcggtgccgtcgacggtgatccggccgccgtccggggtgtccaggccgcccaccaggttgagcagggtggtcttgccggagccggagcggcccttgagcgcgaccagctcaccgcgggggatctcgaacgagaccccgcgcagggcgtgcacggccgccgctccgctcccgtacgagcggtgcaggtcctcgaccgtgaccatgaccgtacgggccgggccctcggcaagggccgtaccggactgcccgctggtgctctcggtcatgctgctcccccgtcatcacgtggcctgcgtcgtcgcccgccagtatgtgcgtgcggcacacggccgggcaatggccggtgggccgcacccgcggaaagggtgcggcccaccggcctgtgctgcgaagtgctggcgtactgccggcggaccccggtaccgctagcggacctcggtgatctcggggccgcgctggagctggcccatgccgccggagaacttcgagctctcctggtcctcctgctgcacaccctcgggcaccatctgggcgtcgttggggagcttgaggacgatcgggtcgcggggcgccatcgggccctcgccgcggacgaccacggtgtcccggaagatcgtctccagcagcccggcggcctccggctggacggcgccctgaccggagatcactccacgcaggaaccagcgcggcccgtcgacgccgacgaagcgcacgagctgcacaccgcccgtgccgtccggaagctgtacggggacctgcgcgcgcagctcccagcccagcgggccctcgacctcgtcgatgatgccgccctgctgggtgatgcccgaggcgatctcgtcgcggacctcgccccagatgccctctttcttgggggcggcgaaggcctgcagctggatcgcgctgtcgcgcagcaccacggtggcggcgacgatcgcgtccccggccacctcgacgcgcagctccatgccctcgacgccggggacgaaaatgccgcccaggtcgacccggccctcgccgggctgggtgacctcggcgctgtcccagggtccgtccggcctgggggccggcggaaggttcatccgacgggcgcccttggcggcgccgtcactgcccccgggctcgtcggcgacctgctcggcctcgcgcacctcgtccgccgcgtcctcggcggaaccactcttcttgcgacgtccgaacacgtcactgtccttcccggtcggatacgaccgaagcgtagctgttcccaccgtgggtgatcccgccctcggcgccgtccaccgacgcgtggccgccggtggacccgaagcccccttcggcccgcgccgagccgggaagttccgccacctcgtggaagcgcaccttctcgacctgctggacaaccaattgggcaatccggtcgaaccgttcgaatcgcacgctctcgcgtggatcgaggttgaccacgatcaccttgatctccccacggtacccggcatcaaccgtccctggggcattcacgagggccactccgcagcgggccgcgaggccggagcgcgggtgaacgaacgcggcgtacccgtcgggcagggcgatcgacaccccggtggggagcaccgcgcgctcgccgggggcgagctcggcggcctcggtggtcaccaggtcggccccggcgtcgcccgggtgtccgtacgccgggatcggcacctccgggtcgaggaggcggatcagtacgtcgacggggttgcgcgtcacgggttcacctcgaaggcgcgggcgcgcctgacctggtccgggtcggacatggccgcccggatctcggcgggccttccgttgtcgatgaagtggtcgaccttgacctcgatgaagagggcgtcggcccggaccgcgacgggcccgtcggggccgccgatccggccggtggcggtggagtagatcttccggccgtgcacggcggtgatccgggcgtcgaggtgcaggacggtgtccacgggcacggggcggacgaagtcggtctccagccgtccggtcaccgcgatcgtgcgcagcagccagttcagcgagccgagggtctcgtccagcgccgtggcgagcacgccaccgtgagcgaggccgggggcgccctggtgggcgggctgcacggtgaactcggcagtcacgctcacgccttcaccggcccgcgccatcaggtgcagtccgtgcggctgtcccccgccgcagccgaaacagtgttcgtagtgcgctccgaggagctcgccgggggcgggcgcgtcggggtgccggaccggcgcgacggcgtcggccgggggtgtcagagctgctgatgttccactcacaggcgcagaccttacccgcgcggcagtccgccggtcgcgccgtgccaagcttggtcccatgcagccttccgcaccgcccttcgacgaacgtctcaccgcgccccgctcctggtggttcatcgccttcggggtcggtgtcgcctgtgctctgatgcttctgccgctgggcaccctgccgctgctcgccggtctggcgggcggcacggtcgcggccgcggtcctggtgagcagttacggctccgcccggatccgggtggtggcgggggccctcgtcgccggtgacgcccggatcccgctgtcggcgctcggtgagcccgaggtgctggacgccgaggaggcgcgggcctggcgcacgtacaaggccgacgcccgtgcgttcatgctgctgcgcggctatgtggagacggcggtgcgggtggaggtcacggacccggacgacccgactccgtacgtctacctctccacccggaacccgcgaggtctggcggcggcgctgagcagcgtcccgaccgcctgagcggacgccggcgggcgggggctccggacccggtgcgggttcaggggcccttcgtcgctcaggggccctcgatctccttgggcagctcggccgggttcagtggctgctccagcggaggcagcgcgggcagccggtcccagcggatctgatccttgcgcaggtcgttcctgacccggtcggcgagcttgcgggtgtcgcgacggttcatcgtggcgccgacggcggcgccgatcatgaacgggatcaggttgggcagattgcgcgccatgcgcttcatgatctgctggcgcagctcgcgcttcatctggccgcccagcgcggcgttgagcgtggtgggacgggtgacgtcgatgccgcgctcctccgtccacgacgtcagatacgcggtgctgcgctggccgagattgccaggggggcggcggccgtagacctcgtggagctcggcgacgagcttcatctcgatcgcggcgacgccggtcacctccgccgccagctcggcgatcatggcgggcggtacgggcatcatggcggcggccccgatgcctgcaccgacggtcgcggtggcccggcaggctcccgtgaccagcttgtcggccagttcctcgggccccagcccggggaactgcttccgcagggtggcgaggtcgcgcaccggcacgcgcggggccgtatcgatgatgcggtcggccagctgcgcggccagtgccttcgcactctcccggcccttgcgtacaccccgtctcactgcgtgcaggcggcccccggtcgtgggttccgtccggccctgctctccgggccggtccggcgacgctgccgccccggccacctcgagcgaggccgaacggcctcgctcgtcgtcgaaactgccggagtgctccggcagggcggcggaccgctcggcagacgcgttaccgccttctgccgggcctgtgccgcctgtaccgtcctggttcgcctccgggccgtgccggcgccaggggcgccgcttccggaacggtgtctcgcctcccacggccgactcgacctcagtcgcagtcgcggcagatgggctgaccgttcttctcgcgggccagctggctgcggtggtgcaccaggaagcagctcatgcaggtgaactcatcggcctgcttgggcagcacccggacggccagctcctcgttggagaggtccgcgccgggcagctcaagtccttcggccgcgtcgaattcgtcgacgtcgacggcagatgccgtcttgtcgctccgacgcgccttgagctcttcgaggctgtcctggtccacgtcgtcgtcggtcttgcgtggggtgtcgtaatccgttgccatgtcgctctccccctcttgggtgtctacgggtgtctcagcgcacgtaacgcgtgagaggccggacttgtgcccgacctgaggcggagattttgcctcacatcaaggtctgttactcaatcgacacccaaccgggcgcctcggcgaggctcggcttgggtggcgatggggaccgtacacggtcccgactgcgcagttcacgggtgccaccccgtgtacttcccgtgataacgatccccgaaaacccggacgattaccggctttccgacagagtcgcgatcacggagagtagatggccggaaaatcgaccctgtgatcgatcacacacgactcacccgggagcgggtcctgaaaattccgcccaaagcgaacatgaagattcggtgcagagtcacatcgtgcagcctctcagaccggcagggtgacgcgcatcacgagaccaccgccctcgcggggctccgcgatgatacggcctccgtgggcccgcgcgacggaccgggcgatcgacaggccgagccctacccccttgtcgctgcccgtacgctccgtacgcagccgcctgaagggctcgaagaggttgtcgatctcgtaggccgggaccaccggtcctgtgttcgagacgacgagcagggcctgcccgtcccgcgcctcggtggtgacctccacccagccggcctcgggcacgttgtagcgcacggcgttctgcacgaggttcagcgcgatccgctccagcaggacgccgttgccctggaccaccgccgtggcccgctcgccgcggatctcgaccttcctcgccaccgcctccgcccgggtctggtcgatggcgcgctcggcgacctccgcgaggtcgaccggcttgcgctcgacgatctggttgtcgctgcgggccagcagcagcaggccctcgacgagctgctcgctgcgctcgttggtggccaggagggtcttgccgagctgttgcagctccggcggggcctccgggtcggagaggtggacctccagcagcgtgcggttgatcgccagcggggtgcgcagctcgtgcgaggcgttgccgacgaaccgctgctgcgcggtgaaggcccgctccagccggtccagcatgtcgtcgaaggtgtccgccagctccttcagctcgtcgtcggggccgtccagctcgatccgccgggtgaggtccgtcccggccacccggcgcgcggtcctggtgatccggccgagcggggacagcacgcgtccggccatggcgtagccgaaggcgaaggcgatcacgctcaggccgaccagggccagcagcgaacggttgagcagggtgtccagagcgtgtttgcgctgtgactcgttgcacgccttcagtgcggcgttcgcctcgtccgccgagaggcccggcgtgagtgcggggcaggcgttgttggtgagctggatcttgctgtcgggcagcagcttgaacggcaggtccgtgcccacgtgcagcgcctgcgccgccagcatgtagatgatcgacaacagcacgatgcccgcgatgaggaacatcccgccgtacagcagcgtgagccgtatgcggatggtcgggcgcagccaggggtaagggggctcctgctgcttgggctcccaggtgggcttcggaggtgccgcgggaggctcggaggtggtggccatggtcctcagatccggtatccggagcccggcacggtgacgatgacgggcggttcgccgagcttgcggcgcagcgtcatgaccgtgacgcgcaccacgttggtgaaggggtcggtgttctcgtcccaggccttctccagcagctgttccgccgagacgaccgcaccctcgctgcgcatgaggacctccagcacggcgaactccttcggggcgagctggatctccacctcgtcgcggaagacctcgcgccggttcgggtcgagcttgatgccggcgcgctccaggacgggcggcagcgccactgtcgtacggcggcccagcgcgcgcacccgggcggtcagctcgctgaaggcgaagggcttgggcagatagtcgtccgcgcccagctccaggccctcgacccggtcgctgacgtcgccggacgcggtgagcatgagcacccgggtgggcatgccgagttcgacgatcctgcggcagacgtcgtccccgtgcaccaccgggaggtcccggtccagcacgacgacgtcgtagtcgttgaccccgatgcgctccagggccgcggcaccgtcgtagacgacgtcgacggccatggcctcccggcgcagtccggtggccaccgcatcggcgagcagctgctcgtcctcgacgacgagtacgcgcacggcgcagtccttccttcggtccttcgatgggttcacagagcggccacgcgggcccgctcgaacgcgggcagcaatgccgactgtgcgcctccatcctgcccgcaacgcgcataaaccggcggtaaggcggcggcggcgccggacctctgggcggctgtccgccgggaaaccggcggatttccgggccagttgaggtttctccgagtcatggcgcggggaagaggggttcacacccgcgatcacgcctgtcacgtggcatgccacggcccactccttcttccccggagcggcggcgcgatcacccgctcctccggccccccggccggggggatcccgggcacacccccgtgccaccgacccacgatgagggggcgcatcatggacgctttcaccgcaggtctgctgcaacgcatcaagacgaccgagaccgtcctcacgcgggcgcgcgaggacggcgacgacttcctcgcggacgtcgagcagggcgagctggacgatctgcgccgcctcgccgccgagcacggcgtggaaatcggcgccaccagcgtctgagccgtacgccacggggccccggacaccgtcatggtgtccggggccccgtggc

SEQ ID NO: 3326 - DNA, 3162 bp, Unknown
  Kingdom: Bacteria, Phylum: Actinobacteria, Class: Actinobacteria, Order: Streptomycetales, Family: Streptomycetaceae, Genus: Streptomyces
  misc_feature (659)..(660): n is a, c, g, or t
cgaacgtccgcgtgcggccgacgaggaactgcgccttactggtatgccgccagggctgaagtacgccatgcagagccggacgtaaccgctggtcctggccgaaggtacgtacaattcgcagcgctgcgggttcagtccgtaagcggtgacgtgggagatgtccgacgggggcggccgccgacgcaaagtcaccgcgaaggcaacccgcgcctgcgggggtgggcattctggcccaccacggccgctgtttggttgccgcaccgccttggagacccgacatgcaaaacgtcgctttcagtcgggggcgacgcctttctggggaccgcaagcgggtgccttacgttcccgcagtgactgccaggcgctgacgaatcgttcctgcggtgaacgtgtgcgtccgtgcgggtgagaggcggtccttggggatgagccggtgacgtcggaccggtagaacacggatggatgccgcagcggtcgtcgcgccaccgcgttccaggaccggggccgtgggaattctccagaatttctgaccgctgttccaatacgtgggtgaaggggactcgtcaatgagccgaggcttgatcgtcgtggacgtgcagaacgacttctgtgaaggaggcagcgttcccgtcgcaggcggtgcgcagatcgcgacgaanngagcgcgggccgggactaccagtacgtcgtggccacccgggatcaccacatcgacccgggaagtcacttctcggagcacccggacttcaaggacagcttccctgtccactgcgtggccggggaggagggcggggagttccacccgaacttcactcccgccgtcaccggcggcaaggtcgacgccgttttcttcaaaggcgcccacagctcctccaagagcggcttcgaaggcgccgacgagcagggcacgcccctggcggactggctgcgcgctcgcggggtggaggacgtcgacgtggtgggcatcgccacggaccactgcgtgcgcgccacagcgctggacgccgtgaaggccggcttccgcgcacacgtacgcctggactactccgtcggcgtcgcccccgacaccatcatctcgacgctggacgacttccgtgaggcgggcatcgtcgtatccggcgaggctcccgtgccgcagtagcgcttcccagcagaccggaaccgcagcgggccgcatggccggacgggggtgcgtcgtatcgccggaaccggcggctcgacgcgctcttggcggccctgcccgtgtgggcggggccgctggtgtccggagggccggcgggatcaggcggagcaggtcatccttcttcccagtcgacgctccccatgcccgtgtggaacacgccgttgcacttgtagcccgacgagctcccgtacccggggttcagggtgacccagtgccccttgccgtccgtgcccccgccgcagaccacaacggcgcggaaggcgatggcacggttggtgtggttctcgcagtgggcgactcccgtgatcccgttgtcgatgacctcggtccggcacgtcagcaccttgttcgccgggaggggtacggcgtcggcggtgccggcgagcggcagaaccagcgcggcagccgcgacggcgacagcagttctccgcagcacttcaccgcccaagagaggaatatcgcccacacaggtgatcacgccgcagtgccccggagctgcgtggcggcgtaccccgaggccatcgcgaccgcgcacgccgtcttctgcctgccgcactcgttcgtcgccgccctcgcatcgggccgcacgtcgtgctgccgaccacgggaggccgtccgcctcggccgcgaagaggacgtcgccggggtcaccgccgcccgggtccgccgcgtggtcgatgacctgatcgttggcggtcagtggcggtggggaaaccgtgaggcagcgaaccgggccgtgctgccgtgcaggtcgccgggcacggtctcttcctccaggaagccccggtacggccgggagagctgaaccagtaccgggcgtcaggcggcgatgagttcctgctcgcggtccggagttttcaccctgggcttcttgttcggcagagcgagtcggaagaccttgtgccacgcggagaacacctgcttgggcagcggaccggtgacgtactccaactcgtacttttcgaacagcgcgcgcaccttcaccgcgacctcggcgtaccggttgctcggcaggtccgggaacaggtggtgctcgatctggtgcgacaggttgcccgtcatgaagtgcatggccttgctgccgctgatgttcgccgagcccatcatctggcgcaggtaccactggccgcgcgtctcgccctggatcgactcgcgctcgaagacctgtacgccctcggggaagtgcccgcacatgatcaccgagtgcgaccagatgttgcggaccaggttcgcggtgaacgtggcgccgagcgtggtgaggaacgacgggcccgacagcagcgggtggatcacgtagtccttgagcacctgcttgcggatcttccggcccacggccttggcccgcgcgcggaactccgggttcttgcgcctctgcttgcccaggttcttgccgagctccaggtcgtaagcggcgatgccgtactcgaagaagcaggcgttgaggaagttccacagcggctggccgaggtggaaggggtgccacttctggtcctcgtcgacgcgcatgatgccgtagccgaggtcgttgtccttgccgatcacgttggtgtacgtgtggtgcagatcgttgtgcgagtgcttccactgatcggacggcgagacgtgatcccactcccaggtggtggagtggatcttcgggtcccgcatccagtcccactggccgtgcaggacgttgtggccgatctccatgttgtccatgatcttcgccacggacagcccggcggtgcccagcagccacgcgggagggaagatcgagaacaacaggacgcccctgctgaccagttcgagcgtgcgctgcgccgagatgaccttacggatgtaggcggcgtcctcctcgccgcggccggcgatcacctcgtcgcggatcgcgtccagctcgcggcccagctcctcgatctgctgtgcggtcaggtgggcggtggggtcgatggcggtcaaagtgctcctaccgttcgatgtcgcaggggcccgccgcggcg

SEQ ID NO: 3327 - DNA, 1386 bp, Unknown
  Kingdom: Bacteria, Phylum: Actinobacteria, Class: Actinobacteria, Order: Streptomycetales, Family: Streptomycetaceae, Genus: Streptomyces
  misc_feature (1177)..(1178): n is a, c, g, or t
ccccccgggcccgcaccaccgacccgaaggtccaggcagcgcgcttcagcaccttcagcaaggcggtacgggccaactccacgcacccggaaggcaacacccgatgaccgcgaccaccgacgagaagctcaactggctgctggaggggctgctcgaccgcacccccggtacccgccacgccctcgtcctgtcccgcgacggcctcaagctgtgccgcacccccgagctctccgtcgaccaggccgatcagctggccgcgatctccgccgggatccagagcctgtcgcacggcgcgtccatcgaattcggcgacggcaccggtggcgtacggtccgcgatggccgagttctacggcggcgtgctgttcatcgtcgaggcgggagccggagcccacctggccgtcgtcgccgacgaggactccgacgtgggcctcgtcggccacaacatgagcgagctcgtcgagcagctcggcgaacacctcgtcgcgccgccgcgcgagcccgccgagaccccggccgtatgacgacggcaccccgcccccgaccgggccgcgacgacgatccggaccggctgtacaccctcaccgggggccgcagccgctccgattccgccgcgttcgacctggtgacgctcgtcgtcgccgagtgcgacccggccccggggatgcagtccgagcacgtcgcgatcctgcggatgtgccagggccccaccgccgtcgtcgagatagccgcgagcctgaacctgccggtcagcatcgtccgcatcatgctgtgcgacctgctcgacaccggccggatcagcgcccgccacccccgtacagctcgtgtcgcggaccggctccccgaccccgacatcctggaacaggtgctcgttggactccgcaacctctgaccgcgccgccctgagcgcgacggccgacaacggactgaagatcgttgtcgtcggcggcttcggggtcggcaagaccaccatggtccgatccgtgagcgagatccgtccgctcaacacggaggagacgatgacccgcgcgggcgaggccgtcgaccacctcgacggcatccaggccaagtcgtccaccaccgtggcgttcgacttcggccggatcacgctcgacgcacgctccgtgctgtacctcttcggcgcgcccggccaggagcgcttctggttcctgtggganncgccatcgaccgcctggagcaccacggcacaccgttcatcgtggcgtgcaacgacttcggcgggccgctccacagcgagcagcagatccgcgaggccctggacctctcggaggacgtgccgctggtggagtgcgacgcccgcgaccgttcgtccagcaagtacgtgctcatcacgctcgtcgaacacctcgccgcgctctccgccgcc

SEQ ID NO: 3328 - DNA, 2891 bp, Unknown
  Kingdom: Bacteria, Phylum: Actinobacteria, Class: Actinobacteria, Order: Streptomycetales, Family: Streptomycetaceae, Genus: Streptomyces
ggtatgtggcgggagcgacgttcgcccgggcgctcgggtggcagggggcgcgggtggcgtccgtgtacgcggcgtgcgcgtccggggcgcaggccatcgacacggcgcgggcgcagatcctggcgggcctggcggacgtggtgctggtggtgggggccgacgcggcgcccaaggggttcttcgccccggcgggcggggagcggccggacgacccggactggctgcgcttccgggtgctcggggcgacgaatccggcgtacttcgggctgtacgcccgccgccgcatggcgctgtacggggacacacccgaggacttcgcgctggtcaaggtgaagaacgcggcggcgggggcgctgaacgagtacgcccgctaccgggagccggtgacggccgaggaggtcgccgcctccgcgacggtcgccgatccgctgcggctgctggacatctgcgccacgtccgacggagccgccgccctggtgctgtccagcatggagttcgcccggctccgcggggcgcgtgatccggtgcggatccgggccgtctccaccgtgacgccgacctacccgaggaccgtgctggacctgccggacatcggcacggactcggcggtggccgtggacccctcccccgagagcttccgcgcctcgatcgcgcgggccgcgtacgaggaggcggggatcggaccggaggatctctcgctggccgaggtctacgacctgtccaccgccctggagctggagtggtacgaggacatcggactgtgcggtgccggcgagggagcgaagctgctgcggacgggggcgaccgcgctgggcggccggattccggtgaacgcgagcggcggtctggcctcgttcggcgaggcggtccccgcccaggccgtcgcgcaggtctgcgagctcacccggcagttgcgaggccaggccggggagcggcagattccgggcgcacgggtcggcatcacggcgaaccaggggctgttcgggcacggctcggccgtggtggcggtccgctgaacccgaccggccccaacaggtttttcctgccctttacttgactgggcgtcaccgccgcagaacactcggggcccggtccgccggacgatgcacggcccgtacccctgtcggcgggggtacgggccgtacgcgtgccggtacgctccccggctcaggtggcgacgggttcgcgggcccgcgccgcgcgctccagagcgtgctccacgaccgcgaccaggacgtcgcgcacggaggaccggtcccgcgcgtcgcagacgagcaccggaacctcggggtcgaggtcgagggcggcctgcacggtctccgtcgggaaccgctcggcgccctcgaaggagttgaccgcgaccgtgaacgggatccgcctgcgctcgaagtagtcgaccgccgcgaagcagtcctcgagacgccgggtgtcggcgaggacgaccgcgcccagggagccctgggccagttcgtcccacaggaaccagaagcggtcctggcccggtgtgccgaacagatagaggaccaggtcctcccgcagcgtgatccggccgaagtccatcgcgaccgtggtggtggtcttggactcgaccccctccagatcgtccaccgggcggcccgcctcgctgaggcgttcctcggtgcgcagcggcctgatctcgctgaccgagccgaccgcggtcgtcttgccgacgccgaaccctcccgccaccaggatcttcagggtgacgggctcgacgtgccgctgcttgccgcggctagagcgcccgaaggccattgataacctcgcgaagaatgttcacgtccggcagctcggccggcggaacgggacgggtgacatgcaccagctcgtcctcgacgaggtcaccgaccaggacccgtaccacccctacgggaaggtcgagttcggcggcgagctcggcgatcgactggggcatgtcgctgcagagttcgacgatcgccacatgttcgggggcgagcgtctggtcccggccgggatcgtcggcggccggttccggcacgacgagcgcgatcaggtcgaggcggtgacgggaggcgctgctggtgcgcccgcgggtcatcgcgtacgggcggaccaccggtcccgcctccgcgtcgtaccaccgcgagacctggggatcgagggacccgtccggggatccggggccggtgccccggggggagtcggcgctcatgcccgccacgctcaccctccggcgggcagaccggtcgtccgtggggcgttggccagatgggcccccacgcgcttgaccatcagtgtcatctcgtacgcgacctggccgacgtcggagtcggcttccgccaggacggcgagacagcttccgtcgccggcggccgtgacgaagaggaaggcctcgtccagttcgacgacggtctggcgcacccggcccgcgttgaagtggtggcccacgcccttggcgaggctgtggaagccggaggcgacggcggcgagatgctcgctgtcctcacgggtcaggtcccccgaggcgccggtggcgagtccgtcgctggagagcaccagcgccttgcggatgctggcgacgcgctggacgagttcgtcgagcagccagttcagttcgcccgagccgtggcgtgcggggttgtgtgctgcggcgttcggtgcggtcatcgaccgtcccctcccggagtgtttcctggtgctgtgccaccggggccgccggtgtcctcggtgtgctctgtgctctcggtgttgtgggtggtttcggctttcgccgtgtgctcggtgttgtgggtggtttcggcgttcgtcgtgtgctcggagtgctcggcttcgttctgccgacggccgcgctgccagccccgctggagcgaggccatgcggtcgcgtacctcgtccgcgtcgcgctcggc

SEQ ID NO: 3329 - DNA, 12481 bp, Unknown
  Kingdom: Bacteria, Phylum: Actinobacteria, Class: Actinobacteria, Order: Streptomycetales, Family: Streptomycetaceae, Genus: Streptomyces
ctgcgccgcaagctcggcgcggagtaccgccgttcgatccagacggtccggcgtgtggggtacaagtacacgccctgacccgcccggtccaccgcgtacgtccggcggccccggaccacggttcctcctcgccgtggtccggggccgtccgggcgtctcagacctgctgggccgccggaaccggcgtgtccaccgtcccggccggctcgccgtacccgtcgtgacgctcgtcctccaggctcggcaagcgcgaaagtccgcgcggggtatgccagttgcgctcacccaggagcagcatcacggagggcagcagcaccatccgtacgacggtggcgtccagcagcaccgcgacggcgaggccgacgcccatctgctgcatgtcctgcatggacagggtgccgaacaccgcgaacaccgccaccatgatggccgccgctccggtgaccgccccggccgtgcggcggatgccggtctcgatcgccgcccggttgtccaggccgccgccgcgcgcctcccggatccgggagacgacgaacacgtggtagtccatcgacagcccgaacaggacgacgaggacgaacagcggcatccacgcctcgatcgcgccgaccccttccgagccgatgagcgacgctccccagccgtgctggaagacggcggtcatcaccccgtaggaggcggccaccgagagcaggttgagggcgatggacgtcacggcgatgacgtagctgcggaagcagaacagcatcagcaggaaggtgaccgccgtgatgaaggcgaagaccgggacgatgccgcgtcggagctggtcgttgaagtcgaccgatccggcggtctcccccgtgacgtgggtcttcgccccggtgccgtcgaacgcggcgggcaggcgcttctcccggagttcggtgaggtcggccgtgccgcccgggagggggatctcgatctcggcgacgtccttgtcccggtggacggtgacgtcctcgaatccgtcgagggccttgccgacctccggagcggtgatgtcgggtgcggtgacgacgacgagggcgggggcggggccgccggggaagctctcggtgatcctgctgtgggcgatggagagctgcgagtcggagccgaactgcttctccaggccgagggattcggtcttcatgccgagggcgggcgcggcgagcgcgagcagcaggacgacggcggcgacggcgaaggtgcggggccgggcgaggacggggccgagcacccggccgacgatgcggccgctgccggggtggccgtgccgggcgcggcggttcagcagcgggatgcggccggcgtcgatccggtcgccgagccaggagaggagcgcgggcaggacggtgaccgagccgagcatggcgatgaacacgacgatgatcgtggcgagcgcgaaccccttgaacagcaggagcccggagaggaacatgccgcccatcgcgaccatcacggtgaggccggagacgagtaccgcacggccgctggtggctgccgcgatgcgcagggcggtctcggcgtcccgtccggcggcgcgttcgtcgcgttcgcggcgcaggtagaagaggcagtagtcgacgccgacggcgaagcccatcaggaacatcaccgagtaggtggtctggaacaggtgcagttggtggctggcgatcgacaggaggccgaaggcggccatgcacgcggtgagagcgagtccgaccgggagcagggcggcgaccaccgcgccgaaagcgacgaggaggatgccgagggccagcggtacggcggtgaactcggccttcttgaagtcctcggccagcaggtcgccgagccacttgcccgcgctggcctcgccgaactggtggatctcggcgtccgggtggtcctcgcccacggcggcgaccgcgtccaggacgggttggatccggtcggaggaggtggcggcctcgcccttcatctcgaaggcgatcagggcgtccttgccgtccgcggaggcgacgggcggggcgatgttctgtgcttcgccggtctgccgtacggcgtcggcgagggcttcggcggccggcttccagtcccccgcggcgggggcggagaccatgacgagttcgcccgcgggcttgtcgagtccggcgtcgaggaggatctgctcggcgcgggcggactcgcccgcgccgttctccgcgttggtcatctcgaccatgccggtggccccgccgatgcccgtggcgagcacgacgaagagcagccagccgagaacggccgtcttgcgatggtgtgtgctccacacgccgatgcgtgcggcgagattgcgcctcatgcggtttctcccccggaggtaagcgtcaggtaagtgatcgggacgcttcgaatctaggaatcggacgcggtccgccccagccgtcggagcccccggtcgcggaggcgtagggggcgggtccgggggtggtgccaggtacaccccctccgggtggcggaccggctgacgcggcggggcggtgccgggtgagactggcatccggaacgggaacggcccggctccggtgaggggggagagacccgcgatgaagctgttctctggacggctgcggccggctgcactggcggcggggcgcggactgttcctgtcggtggccggactggcggcgtccatcactctgttcgtgctcgcggtgctctcgatcgccttcatcccgctcggcatcggggtgttcaccaccccggtggtgctggaggcggtgcgcaagcacgccaaccagcggcggctgtgggcggtgacctggtcggacgtacggattccggtcccgtaccggcgcttccccaagaatctgcggacgggtgtcatcggccaggtcgagcgcaccacgctgatgctgaaggacccggcgacctggcgggacctccagtggctgctggtcgacatgacggcgggcacggtggtggcggtcctggcggcggccctgatgatctaccccgtcgaggggctggtcctggcggcgggcctgtggcgggtgttccgcgacgatccgtactggtacgggttcgtgccggtggacagccaggcgacggggttcgcggccctggcgctggggatcgtgctcttccacgccggactgtgggtgagccggccgctgttgcggctgcacttcgtgctcgctcgtagggtgctggcgcccactcaggaccaggagttggagcagcgcatcgagcggctgaccgagacccggcacgaggccgtggacaccgccgcctccgagctgcgccgcatcgagcgggatctgcacgacggggcgcaggcccggctggtcgcgatgggtatgaacctgggcacggtcgaggcgctgatcgagaaggatccggcgcaggcgaagaagatgctggcgatggcccgggagtcgtcggcggaggcgctgaccgaactgcgggacctggtccggggcatccacccgcccgtcctcgcggagcggggcctcggcgacgcggtccgggcgctggccctgcggctgccggtcgcctccgaggtgacggtggagctgccggggcgggcggaggccccggtggagtcggcggcgtacttcgcggtcagcgaggccctgacgaacacggtgaagcacgcggaggcggagcggatctacgtggacctgcaccacgccgaggggatgctccggatctccgtgacggacgacggcaagggcggtgcggtcgtcggatcgggctcgggtctgagcggaatagaacggcgactgggtacattcgacggcgtactggccgtcagcagtcccgcgggcggtcccaccatggtgaccatggagattccttgcgagttgtcctagccgaagatctcttcctgttgcgcgacggcctggtgcgcatgctggaggcgtacgacttcgagatcgccgcggctgtggagacagggcccgaactgacgaaggcactcgccgagttgcagccggacgtcgccgtcgtcgacgtccggctcccgccgtcccacacggacgagggcctccagtgcgccctggtcgcccgccgggcgcgaccggggcttccggtgctggtgctctcgcagcacgtggagcagctgtacgcgcgggagttgctggcggacggcaacggcggcatcggctacctgctgaaggaccgggtcttcgacgcggaccagttcatcgacgcggtgcggcgggtggcgtcgggcggcacggcgatggacccgcaggtcatctcccagctcctgtcgcgccgttcgcaggacaaaccgatgggcggcctcaccccacgcgaacgggaggtgatggagctggtggcccagggccgctccaacgccgccatcgcctcgcagctggtgatcacggagcgggcggtggccaagcacacgtcgaacatcttcggcaagctcgatctgcccccgtcggacgacgacaaccgccgggtgctggcggtgctggcgtatctggaccacggctgatccctgcttcctgcggccggcgagcggcccggcgggtcccggggctccgctcagccggtgaaccacccgctcaacccgtgaaccatcctgccgcgtccagccggaaggcacccgcgggggccatcgtgcgcaggtcccgctccaggccggccagccgctcctcgccgagcgtccgggcccactccgcccgcagtcggtcgaagccctcggccgaccgggccagcaggtcgtcgccgtgcggggtgaggcggatcagggtgcgccggccgtcggcggggtccggggcgcgctccacgtaaccgagcgcctccagcttctcggccgtctttccggcggcctgcttggagaccccgagccgccgcccgatctcgctgatggcagcgccgtcgcgtcccaccgcctggagggcgaagccgtacgcgggccgggtctcggggtggccgtgctcggccaggtcccggtgcagggcgtcaatgatcgagcggaagccggcgaagaggagcagcggcagctcaaagccgttgccagattcgacaacctggtttacctttttttcgtcaaccatgttgtcgaccctaaccgctcccgcgccgagaggtccgtcatgcgcttccccgaccacacccccgagaccgccccgccgggttcacgacgcgccatggaggcggtgaccgagcggctgggctaccggcccgccgccatctcccggctcgccgcctcaccccacgccctggacggcttcctgaagatcagcgcgatcttcgaggcctgcaccctggacccgctctcccgcgaggtcctgatcatgacgatggccacccgcaacgactgtcacctctgcgtcgcgatgcacaccgcgaagctgaccgccctggacgccgatccggcgctcgtcgccgccctgcgcgaccgttccggaaccccgcttccggacgaacgcctggaagccgtacggcggttcactctggctgtgctcgcctcggcgggcgcggtggacgacgcgaccctgcgggacttcctggcgtacggctacaccgagcagaacgccctcgaagtggtcctggggatcggcgcgtacaccctgtcgaccctggccaaccggctcaccggggctccggtggacgcccccctggccgccttcgcctgagagtggggggtcgggccgcctgccggccggagcttcccacgaatcggccgggtggctgaacgggccgcgccgcactcccgtatgggacgtcacgcttctccctcgaagcagaggagtcccatgcgacgcacatcgcgcaagaaacgttccacgctcgccaaccgggccatcgccgcctccgcggccgtgatcctgggaggaggcgggctggtcgcggtcaacgtctacgcctccgcgggagaaggaccatccggttctccgcccacccggacgcagaacgccggccgccagttgtccaccatcgactgccccgaagcggccaacggactgcccgaggtgccggatcgcgcacgcggggaggtcgatcgcgaactcgcggcgatggacacccagatcaccgacgcctaccggcggttcgcggaccggaaggagcagatggcccgggaacccgggctggcggagaacgccgtcctgggcccgttgcgcgacaggcgggccgcgagcctcgaccgcatcggcaccgcgatcgggcgcgtggcggaacggccggaaggactggagagcctcgccgggtgcagcctgcgcgccgacgacagccagagtcagggccagagccagggccagaacgaaggacagggccaggacccgggcgatcaggaaccgggcgaccaggaccccggccagggcgaggaccccggccagggccagggcggcaacgggcccgaggccgccgacttcgtcgatatccggtccgtccggcccgacgccgaccgtccccgcaagcgccgcggcgcgtcccggggcagcttcaccaccgactgcggccgcaacgagaacgggaagttcaacccggacaacgtcatcgtcgcgcccggcgtgagcaacggcgcgcaccatatgcacgattacgtcggcaaccaggccaacgacgccttcgcgagcgacgacgatctggcggacggcgcgaccacctgccgcaaccagggcgaccggtcgacctattactggcccgtcctgcgcctgcagaacgggcaggacgaggacgacgcggacgccgacggcggcggccgggaccagaacaccggggagatccggaccccgtcccgggtgacgctgaagttcgtcggctcgcccgtcggcagggtcaccgcgatgccgcgtttcctgcggatcatcaccggggacgcgaaggcgttcaccaacggcgacgccaacgccaacgcgtcgtggagctgcacgggcttcgaggaccggcaggtgaaggacaagtacccgatctgtcccgagggcagtcaggtggtgcgtacgttcgccttccagaactgctgggacgggcagaacaccgacagtgccaaccaccgcacccatgtggcgttcgcccaggacgacggacggtgcccgaacgggttccgggcggtgccgcagctggtgcagcgcatcgtctacgacgttccgccggggccgggcttcgccgtcgactccttccccgagcagctgcacaagccgatcaccgaccacggtgacttcatcaacgtcttcgacgaacggctgatgaagaacatggtgcggtgcatcaacgacggccgccgctgccgctgacgcggcgcgcgcggcccccgtgaacctgcgcggtcagctcccgcggtgaccggagtgtccgtcctcgctcccccctccgccactgtcccccgagtggtgcggcgaggcggtctccaccgtccccccgagccggccgcgcagcgccgcgaccacgtccggatcgccgacggccacccactgccgtccgacgaggtacgagccgccgtactccttggcctcgttgatccactcgcgccggccccggtcggtggcgaaggtggtcagtacgtaacgtccctcctccgtggcgcagttggcctgccgcagctcggccgcgtcggtctgcacgttcgggtcgcagcccgccttcctcgcgagctgttccaacgtgcccgtcgcggccggctccggcgtgggccgctccccgtcgccgccgtcgtcggccggttccgcggtgcacccggccaggagcagaaggcccgccaggagtagcgcggtggccccgccgtgccgcgcgcctcggcattccggttgtgtcgccatcggcccatcctgcacccgaatccgggctcagggatgagctacggcaagactcacgaggtaggcctcctcgacctcgccgtccgggaacagggcggtcagcagagcccgttcgcggtcgaagtagtcgcggaccgccgccgggtcgccgaccaggaagtcggagtgggtggccaggttggcgacatgggcgtcgatcggtacgcggcggctccaggcgacctgccgggtgcggaagtcgagcccgtcgggcagttcggcccggaaacgggcccggtgggacgggacggcggggatctcccccccgaagaagacccgcatacggttctcctggtcgacgagccactccacggacgggtcgccgtcgttccaccacaacgccagcgccccgcccggccgcagtacccggcggacctcggggaccgagcgtgccgggtcggtccagtgccatgactgggcgtacgtgatcaggtccatggagccggtccgcagcggcaggtggttcccgtcgccccggaccagggggacgtccggcaggctccggcggaactgctcggccatcccgtcgcccggttccaccgccgtgacccgggccccgcgctcgcacagccgtgccgtaccgagtccggtgcccgccccgacgtccgctacccgggctccggcgagcggtattccggccagctcctcgacggcgtcgaacagggcgggcgggtaggaggggcggtgcgcgtcgtagtcggcggcgatggcgtcgaaggagcgggcctgcacaggtttcgtcatacaggcaatcatcacgtgggggcgccgggccgggcgggaaatctccgcacgcctctggtccccccgcatacccgtcagtacattgacgccatgtctaacacgcagccagcggcggtcgcgtcggagcggacgcccctcaaggcccgcaaggtgtccttcgcctgggagaagacgcccctgcactgggtgccgggcgacccgttcaccacgcacaccatcaatgtgctccacctgctgctcccggccggggaacgctggttcatccacgtctaccggcagatactcccgtacatccacgacgaccaactgcgcgaggacgtcatcgggttcatcggacaggaggccgtgcactcgcaggcgcacgacgacgtgctgccgcatctgcgggagttgggcctcgacccgaccccgtacaccgcgcaggtcgactggttcttcgagaagctgctcggggaccggacgctgccgccggggcgggcctcgaagtggtggctgatggagcgggtggcgatgatcgcggcgatcgagcactacaccgcgttcctcggcgactggatcctcaacgccgacgcactggaccaccggggcgcggatccgacgatgctcgatctgctgcgctggcacggggcggaggaggtcgagcaccggtcggtggccttcgacgtcttcatgcatgtggacggcggctaccggcggcgggtgcgtacctgggcggcggcgttctccgcgctggtgttcctctggcagcgcggcatccgcttcttcatggagaacgaccccacgctgctgggcggcaaggcctccttcaaggcgttccacgcgagcgggaagcagggcacgctgcccagcaccggcgcgatcctgcggtccgtgccgggctatctcagccggtcgtaccacccgtcgcaggagggcagtacggcccaggccgtggactacctcgcccgctcccccgccgcgctcgccgccgagaccgctacgacgggaaggtcctgaaccatggccctgccccgtctgcgtaccgtcgtgctcgtctccggcaccgttctgctcacccggcgcgccctcagacgccggatcgcccggtcaccgctgtggccgctgcccgctctgcccgaaccggtatcgggccactcgaagcggcgcgcgacctcggcacgccggctgctggtcaccgggcggagcgaggtcgccgacggtgtcgtccagctccggctggagggcgccggcctgccgcgctgggagccgggggcccatctggacctggtgctgccgtccggcctggtgcggcagtactcactgtgcggcgacccggaggacaccggtgcgtacaccgtggcgacccggctggtggaggacggccggggtggttcgcgggaggtgcacgaacagctccaggagggcctggaggtggaggtgcgcgggccccgcaaccgcttccctctcaccggggccccggggtacgtcttcgtcgtcggcggcatcgggatcaccccggtcctgccgatgctgcggtccctggccgcctcgggggccgactggcggctgctgtacgggggccggtcgcggggatcgatgccgttcctggaggagatcgggaagctcggcgcggacggtgaccgggtcacggtcgtcgcccaggacgaggcgggccacccggacgtcgcggcggcgctgaccggtctcgccccgggcacggcggtctactgctgcggccccgagccgctgatggacgccgtcgccgccgcgctcccggagggacaccccctgcacctggagcggttctcggccgcgaagggggacgcggcggggcccggttcggggacgttcgaggtggagttgcggcgcagcgggcgcacggtgccggtcgcggccgggcagtcggtgctcgacgctgtccgtgcggcggcgccccaggtcgcgtactcctgcgagcaggggttctgcgggacctgccaacagcgggtcctggagggcgagatcgatcaccgggacgatctgctgaccgacgacgagcgggacgactcgatgctgatctgtgtctcgcgctgccgcggcggacgtctcgttctggatctgtagggcggggtgtgggccgtatgcgcggcgccttcgccgcaagaggccctccggccccggataggctgtccgtatgacgaccggggtgcggcgcaggatgggcgtcgacgagcgcagacagcaactgatcggcgtcgcgctggacttgttcagccgtcgctcgcccgaggaggtgtcgatcgatgagatcgccgcggccgcgggcatctcccgtccgctggtgtaccactacttccccgggaagcagagtctgtacgaggcggcgctgcggcgggccgcggacgagctggcggcccgcttcctggaacccctcgaaggacccctgggagcgcggctgctccgggtgatgggacggttcttcgacttcgtcgacgagcacggcccaggcttctcggcgctgatgcggggcggacccgcggtcggttcctccacggcgaacgccatgatcgacggggtgcggcaggccgcgtacgaacagatcatcacgcacctcggggtggccgaaccgtcggcccggctggagctggtggtccgttcctgggtctcgctcgccgagtcgacggcgctgatctggctggacgggcggcgcatcccgcgcgccgagctggagatgcagctggtgcacgacttcgccgcgctcgccgcggtcagtgccgcgtacgaccaggagatggcgggcatcgtgctgcgggtgctcacccaggagcccgcggacggaccgttcggggaactgctcgcccggctctccgccttcgccccggacgtgccggccgtgcccgcgcagcgactgccgccgcactgaccccccgatgacgactaggccggcagtccgttgcggtgggagacgcggcgggcggcggccagcagggcgtggatctgcgggcccgcctggtcgatctcggtgaccggccgggggaacggcagcctgacgtcctcgtgggtgccggggtattcgagccgcagggtcactccgaagcggtccatcgccagcggcacggcccgggtcatgccgcgctccgggcgggggtggacgaggcgcaggagcagcgggacgagttcggcgtggtcgtccaccaggtgggtgagcatgcccgcctcgcacgcggcgatcgggtcggtctccacctcctccaactcctccagcgtgacgaaggtgcgcccctcggcgtcctccaggacgacctgtccgaactccatgcaggtgctctgctcgatctcggtgctgtacggcgcggccagcaggccggtgaccgtgacgcgggcacgcagccggtcgcgtacgggggtgggggcgatgtccgtgaactccaggcgggccgggacgcgttcggcgctcggcgcatggccgccgtcgttcggggcgtgcaggtggatgtggcccatcgcgcccgtgccgtcgaggcggcggacttcggtgtgcaggccgtcgctgaccaccgtcatggagtgggcgacggtcaggatcgaccggacgcgctcggcgcgggtcggctgcgtggcgcgggggcgggaaagacgcatccgagttctccaggaagggtcgacggaacccaagcagctacttaggtatgcctaaccttactcacatggtcccggatgtgggtagtccggggactccgcctgtgcacggatccccgatcgtgcccgggtcagagctgtagttcggtacgcagcgcggcggcgaggccgacctccgcgttgtccgactggccgcgctcgaaggcgcgctggtaggcctcgtcgccgatggccgcgcgcgcctggagctcgcacctctcgcggaccggccccagctcgggcgtgccgcgctggggatggcccaccatgcgccagtacgcgtgtccggtgccgtagacccgggcggcctgcgcgcccgcgccctgggcggcgatggcggcggccag

SEQ ID NO: 3330 - DNA, 11991 bp, Unknown
  Kingdom: Bacteria, Phylum: Actinobacteria, Class: Actinobacteria, Order: Streptomycetales, Family: Streptomycetaceae, Genus: Streptomyces
ctccagcagcgcgagcagcaggtgttcctcggtgaccgagtcggccccggcgcgctcggcctgcgccaccgcgcccttcaccgtggctcgggcccctcgggtgaatcgctcgaacatcaacgcctcccgtacttcttgtgcacggcctgccggctgacgcccagctcggcggcgatctcctgccacgaccagccctggacgcgggcacttctcacctgtacggcttcgagctgctccagcagccgccgcagggccgccaccgaccgcaagccgacgcgcgggtcacggtcaccggcacgtgcggccagatccgttgcttcggtcatgatgtcaacttacattgacaccatcctcccgtcaatcaaagttgacatcatcgtcggccagacgggcatgccgctcgacgtcgtaccggaggtcgccgtagcggagcctggcccgctcgatgccctcgggtgcgaatccggaccggatcgcgacccggcaggaggccgggttgtcggtgcggtggcccagctccagccggtacagcccgagctcgtcgaaggcccagcgcgccagcgcccgcacgccggccggggcgacgccccggccgcgcgcctcctccgtggtccagtaggagacccagccggtgtcgtggacccggttgacggcgccgacggcgacacagccgagggcctctcccgactcccccacgacagcccaggagtagccggtacgcgctccccgttcgcgcgtacggtccgcgatccaggtcagcgccccgggccggtcgaacacgggccggtcggtctggcggtccatctcggccggggcgaaggcgcggagcaccgccgaggcgtcggcgggctcccagggccgcagcagaaacccttcaggggtggtcagttcgtccatacgggccagcctcccgcacggtcaccaccacctcggccccgggccacgccagtacggccggccaccccccgcgcgacggcttgccggggccgccgacgaccactcccgggccggtgacggagaggcgccacccccggggcgagggcgggagggacagctccgtcaccccggggcgggcggcggcacggtaggcgaggcggtaggagcgggtgtccgcgtcgtacccctccgagcggacggtccccgcgacggccggggcgtacggcgtggccgtccgctccttgttcgcacggaagcggccctgctcgtcgaccgcgcagtagccgccgccgtagcaccagacgtaccccgcccagccggagctgtagcggttcagggagtcgacggcctcgcggtagaagcggcccatgttcggcagggtgttgttcagcggcccccactcgccgacgacgaccggcatccggtggcgggccgggtaggcggtgacggcggcctcgtacgcctcgatccagccggccgagggatcgtagtccgcgcccgcctccatggcggtgttgtagaagtgcggggcgtacacggtccggcggtcctcgatccggccgagcccggtgggaacgccctcgccgacgatgggcgtcggctcgacgaagagccaggtgtcgcggtccttcgcccggacggcgcgggcgagccggttgtacatcggggtgaggtgctgggcctcgatccggcgggcggcggtcggcaggtcctcgccctcgcgcagttcccccatcggttcgttgatcaggtcgtagccgatcacggccgggtggtcgcggaaccgtgccgcgaggacctgccacatcgcggcctgggcgcgctggaggtcggggtcctcgtagaggtgggtgaaggcccgctggacggcgggctggaagtactcggagaaccagtcgtcggggttggcgatgaacgggagcccgtcggtcctggtggcccaggcggggatcccccggtgcccgaacgcgggcccgaagacgtcctggtgggcgtcgacgaggacatggatacggtgcttgctcgcccagtccaggatgcgttcgacgcgacggaggtagcgctcgctgtaccggccgcgcgtgggctccagatcgtcccagaagaccagcaggcgggcgaagttgaacccgttcgcacgcaggtcgcggaagtgccgttcggtgatcgcggcgagggcggcctcgccgcggttcgccttgtcctcgacgttccagccgcgcagggtgagggtgcggcctcggtcgtcggtcagtggcgggacggcacgtgcacgggactcggacgccggtacgggtgcggatacgggacgcgccgaggcggcgggagcgagggcccccgccgcgagcacggacgcgacgacaactgccatgagtgctctgcccattcgcatgggcggcatcccatcagcaaagctgacacttgttcaagtacgcgttaccgacgcgtacttggctgagctaggaggtcggcgtgagcacgatcttcccgaagaggtcgcccgactccagccgccggaaaccctcccgggcccggtccagcggcagcacctcgtcgatgaccggccgtacgccggtggtcgcgcagaacgcgagcaggtcctccagctcgtccttggaccccatggtggagccgacgaccttcagctccaggaagaagatccgggtcagctcggcgtgcgccggccggtcgccgctggtggccccggagatgacgagggtgccgccggggcgcagcgacttcacggagtgggaccaggtggcggcccccacggtctcgatgacggcgtccacccgctgcggcagccgcgcgccgggctcgtacgcctccagcgcaccgagttcgaccgcccgctcgcgcttggccttgtcccggctggtggcgaagacccgcagcccggcggccttcccgagcacgatcgcggcggtggcgaccccgccgccggcaccctggacgagcacggaatccccgggccgcaccccggcgttggtgaacagcatccggtacgcggtgagccaggcggtcggcaggcaggcggcctccttgaagctgagctccttcggcttgggcaggacgttccaggtggggacggtgacctgctcggcgaaggtgccctggtagcgctcggtgaggatggagcgcggctccttcggcccgacgccgtgccccgactgcccgatgacggagtgcaggacgacctcgttgccgtcctggtcgacaccggccgcgtcgcagccgaggatcatcggcagccggtcctgcgagaggcccacgccccgcagggaccagaggtcgtggtggttgagggaggcggcccgaacggtgacggtggtccacccgggacgcgcctcgggtgccgggcggtcacccagctccaggccgtcgagaggctggtcgggatcgatgcgggctgcgtaggcggcgaacatggctcgacgataggcggggcggggcggccttcgtaaccgcctgcgcgtgtgacgcacgccaaccagccctgccgagccggccgagccgctccggcacacccagcctctccggcgtctgaggagcgggggtctgggggcggagctccccgggcgcgacgggcggggcccgatccacaggccccgcccaccgcaccaccgctcaggacctcagcgccgagccacaccctccgcacgagccgccgcggccaccgccgaggtgaccgccggggcgacccgctcgtcgaacggcgaggggatcacgtagtccgccgccagctcgtcgccgaccacgtcggccagcgcgttcgccgcggcgatcttcatgccctcggtgatccgggaggcccggacctggagcgctcccgcgaagatgcccgggaacgccagcacgttgttgatctggttcgggaagtcggaccgcccggtcgccacgaccgccgcgtacttgtgcgcgacatccgggtggacctccgggttcgggttggccatcgcgaagacgtacgcgccgggagccatggaggccaccgccgcctccgcgaccgtgccgccggacacgccgatgaagacgtccgcaccggcgagcgcctgctccagcgaaccggtcaggcctgcccggttggtcagctcggccagctcgcgcttgacctcggtgaggtcgtcgcggtcgcggctgacgatgcccttgcggtcggccaccgcgatgtcgccgatccccgcctccagcaggaacttggcgatggccacccccgccgcgccggcgccggagatgacaccgcgcagatcgccgagcgtccgtccggagagcttcgcggcgttgcgcagggcggcgagggtgacgaccgcggtgccgtgctggtcgtcgtggaagaccgggatgtccaggcgctcctggagcttgcgctcgatctcgaagcagcggggagccgagatgtcctccaggttcaccccgccgaacgagggggcgagccggacgacggtctcgacgatctcgtcggcgtcggtggtcgcgagcgcgatcggcaccgcgtcgacgccgccgaactgcttgaagaggatggccttgccctccatgacggggagggacgcctcgggcccgatgtcgccgaggccgagcacggcggtgccgtccgtcacgacggccacgacctgggacttccaggtgtagtcgtggacgagctcggggttgtcggcgatggcgctgcacactttcgccacaccgggcgtgtacgccagggaaaggtcgtccttgtcccggatcggaacggtggcctgcacggccatcttcccgccccggtggagggcgaaggccggatcgaagggctcgtcggccccggtgtccgctgcgctcgtgcgctggatgccgctgtcggtggtgctgtcgctgcgaggattgacgatctccgctgccatggtgttgaccccttaagtcttcatcgtttgagggtggccactcctggttgaggaggggtgggcgggcaccgcgtacgcgccccgcaccgggcggttggcccgccccggcagggattgaggtacatacgcgcgggcgcgccgcacacgcgccctgagccccggatgaggggtgtaaacgtctttcttaccggacggacggggttacggacgagtccatatcgacgcggtgacgtgactcatagtcgaatatctggacaagtcggcaaaccggcataaatgccgcccactagtcgagacatgccgaagattctccggcagggggaatgaatccccacagatggtccggtcttcgtgtaccggccgttgatgttcgggggtcgcccgttatccgattttgacatggcaagacccctgaatgggtcagtccgaatggcaggatgccgtcatcacacaaggtggcgacactcgaaggtgcgtgccaagccgcccaccagcacctcaccctcacctgccggaggatcccgacatgaccgcaagcaccacgcgtcgtacgaccgcgaagtcccggattgcggcgatcggcgccatcgcggtcgccggctccctgctgctcaccgcctgtggtgaccagacagacagctcctcccaggagggaggcagcggcaaggagaccaagagcggcgcgccgctcttctcgaagctgccggagaagtaccagaagtccggtgtgatcaaggtcggcacgaatgccgaatacgccccgatggagtccgtcgagaacggaaagatcgtgggcgtcgaccccgatctggccgaggctctcggcaagcagctcggcgtgaagttcgagttcacctcgggttccttcgacggtctgatcaccgccctgaacagcgggcgtcacgacatcgcgatgtcgtcgatcacggacaacaagcagcgccaggagggcctggacgagtcgggcaagaagctgggcgaaggcgtcgacttcgtcgactacttcctcgccggtaccgccgtgtacacgaagaagggcaacccgcagaacatcaagtccatcgaggacctctgcgggaaggccgcggccgtgcagcgcggcaccacgtacgagaaggccctcaagacgcagtcgaaggcctgtacggacggtggcgagaaggccgtcaagatcgagtcgttcgagaacgacaccgaggcgcagacccgcgtcaagtccggcggtgcggtcgccggcgtcaacgactacccggtcgcggtcgacctggcccgcaaggccgacggcggcaaggcgttcgaggtcgtgggcgagcaggtcgacgccggccccttcggcatcgccgtcaagaaggacaacacggggctgcgcgacgccctgaaggaggccgtcgacgcgatcatcgccgacggttcgtaccagaaggtgctcgacaagtggggcgccggtacgggagcgatcgacaaggccgccatcaacggcggcaagtgaccggacgcttcactgaagggcagtcaccatgactgacaagttcgacaagacacccgccggttcaccggccggccaggtgtccgtctccaaggccgccaccccggccccggagaacatcaaggccatcccggtccgccatgtcggccgctggatcagcggcgtcgtggtcatcggcctcctcgtcgccctcgggtacgccttctcgcagggcaacatccagtggcacgccgtgggcgacaagctgttcgacagcacggtcgtcgccggtgcgggccgcaccctgctgatcagcgtcctcgcgatggtgctcggcgtcatcctcggcgtcgtgctggccgtgatgcggctgtcgaagaacccggtcaccagctgggttgcctggctgtacatctggttcttccggggcaccccggtctacgtacagctgctgctctggttcaacctggcgctgatcttcccggtcctgaacatcccgttcatctacaaggacgagatgacggacgtcatgaccccgttcatgtgcgccctgctggggctcgcgctgaacgaggccgcctacatggcggagatctgccgcgccggcatccagtcggtcgacgagggccagaccgaggcctcgcacgcgctgggcatgacccagggcaaaaccatgcgccgcgtggtcctcccccaggcgctgcgggtgatcatcccgccgaccggcaacgagttcatcaacatgctgaagacctcctcgctggtgtacgcggtcacgtacaacgaactgctccgctccacctcgcagatcggctccacgtcgtacgcggtgatggagatgctgttcgtggcgtccatctggtacatcgtgatgaccagcgtgttcagcgtcggccagtactacctggagcgccgctacgcccgcggctcgctgcgctcgctgccgctcaccccgtggcagcgcgtcaaggtcaacctcgccgcgttcggcaaccggccctccggaggtgtctccgcatgaccatccccatggtgaaggccgaaggcgtccacaagtccttcggcgcggcccacatcctcaagggcatcgacctggaggtcgccccgcgtgaggtgttctgcctgatcggcccgtccggctccggcaagtcgaccctgatgcactgcctggccggtctcgacacggtgacgtcgggcgagatcttcctcgacgagaccgagatcaccaagctcaaggacaagaagctcacccagctccggcgcgaccggatcgggttcgtcttccaggcgttcaacctgctcccgacgctcaacgcgatcgagaacatcacgcttccgatggacatcgcgggccgcaagcccgacgccgactggctccagcaggtcgtggagaccgtcgggctcgccgagcgcctcaagcaccgccccacccagctctcgggcggtcagcagcagcgcgtcgcggtcgccagggcgctcgccgcccggccggagatcatcttcggtgacgagcccaccgggaacctggactcccgcgccggggccgaagtcctgtccttcctccgcaagtcggtcgacgagctgggccagaccatcgtcatggtcacccacgaccccgtcgccgcctcctacgcggaccgggtgctgtatctcgccgacggctccatcgtcgacgagatgtacaacccgaccgcggaccaggtcctcgaccgcatgaagcacttcgacgcacgcgggcggacgtcatgactgtctggaagacctcggtgcgcaacttcctcgcgcacaagggccggatggccctctccgccgtggcggtgctgctgtccgtggcgttcgtctgcggcacgctcgtcttcaccgacacgatgaacaccaccttcgacaagctcttcgcggtgacctcacccgacgtcaccgtcagcccgaagacggccggcgggaacgaggagcagcccgacaacggcaagcccgcctcgcttcccgcctccgtcgtccaggaggtcgcgaaggccgacggggtgaagaaggcggagggcgccgtcttctccatggcggtcaccgtcgtcaacagcgagaacaagaacatgggctccgagaccggagccccgaccatcgcgggcaactggaccgagaacgacctgcggtcgatggagatcacctccggacacgcaccccgcggccccaccgaggtgatggtcgacgccgacaccgcgaagaagcacaagctgaagatcggtgacgagctgcgcaccatcgccgccaccggcgacatcacggcgaagatcagcggcatcgcgtccttcaccgtcaccaacccgggcgcggccgtcgtctacctcgacaccgccaccgcccagaagcagctgctcggtgcccccgacatcttcacccagatcctggtgagcgccgagagcggcgtcagcgacacccagctgaagaagaacgtggccaccgtcctcgacggctcggccgcgtacaagctccagacccagcaggaggccacggaagccaacaaggactccatgggctccttcctggacgtcatgaagtacgcgatgctcggcttcgccggaatcgccttcctcgtcggcatcttcctcatcgtcaacaccttctcgatgctggtcgcccagcggacccgtgagatcggcctgatgcgggccatcggatccagccgcaagcaggtcaaccgctccgtgctggtggaggcggtcctcctcggcatcgtcggctccgtgctcggcgtcgcggccggcgtcggcctcgccgtcgggctgatgaaggccatgggcgccgtgggcatggagctgtccaccggcgacctcaccgtcgcctggacgaccccgacgatcggcctcgtgctcggtgtcgtcgtcaccgtcctcgccgcgtacatcccggcccgccgggcaggcaaggtctccccgatggccgcgctgcgcgacgccgggacccccgccgacggcaagtccggctggatcagggccggtatcggcctgttcctgacggcggccggaggcgcggccctgtgggcgaccacccaggcggacaaggccaccgaaggctcgatgttcctcgccgtcggcgtgctgctgaccttgatcgggttcatcgtgatcggcccgctcctggccggtgtggtggtgcgggccctgagcgtcgtcgtcctgcggctcttcggcccggtcggccggctggccgagcgcaacgccctgcgcaacccgcggcgtacgggagcgaccggagccgctctgatgatcgggctcgccctggtggcctgcctgtccgtcgtcggttcctccatggtggcctcggccaccgaggagctcgacaagtcggtcggagcggacttcatcgtccaggacagcagcaccggccgcccgatcgtgccccaggccgccgacgccgtgcgcgacgtccccggcctggagcacatgaccgactacaccttcgtcgaggcgaagatcaccgccccgaacggaaagaccgaggacgaggggatcaccgccgccgacccgacgtaccagcaggacgtccggcgcacggtcctctccggcgacctcgcgaaggcgtacgacaagaacgccatgtccgtcggcgacacctacgccgagcggcacggcatcaggatcggggacacgctcaccgtcgccttcaaggcgggggagaccgcgaagctcaaggtcgcggccatcacctccgacgacaccaacatcgaccgcggcgcgatgtacaccaacctcacgacggcggcgtcctacgtcccggccgaccggatgccgcagaacgtggtgatgttcgccaaggccgaggagggcaaggagaaggaggcgtacgcggccctgaagagcgccatcgccgagtacccggtctacaaggtgcagaaccaggccgacttcaaggagcagttgaaggaccaggtcgggcagctgctcaacatcgtgtacggcctgctcgcgctggcgatcatcgtcgcggtgctcggtgtggtgaacaccctcgccctgtccgtggtcgaacggacccgcgagatcggcctgatgcgcgccatcgggctctcccgccggcagctgcgccgcatgatccggctggagtccgtggtcatcgccctcttcggggcgctgctcggactcggactcgggatgggctggggaaccgcggcccagaagctgctggcgctggagggtctggaggtcctggagatcccgtggccgacgatcctcacggtcttcgcctgctccgccctcgtcggactgttcgccgctctcgtcccggccttccgggcgggccggatgaacgtcctgaacgccatcgccgcggacgggtgagccagtgccctcccggcaagggtgaccctcagggcgtcaccgtaggatgaccggcaggccccgggacgttcctccaaacgtcccggggccgagcccgttccccgccgcccgccccgggtctcggatcccctggtctcagatccagccgcgttcgcgggccagcagcgcggcctgcgcccggctggccgcgccgagcgtctgcatcaggtcggcgacgtgccgccggtaggtccgcaccgacacccccaggttccgcgcgcccgcctcgtccttgcccaccgtgcacatcgacaccagcacccgccgttcgataccggagggacgggcggcggcgtcctcgccgctctccgtgccgtcgcccgccggagacagctcgtccgcctggtcccagatccgttcgaacagcgagatgacgttggagaccaggccgctgcggtgggcgaggagcgcgccccgcgaggtgtcgcgcgggtccagcggtacgagcgccgcttggcggtcgtagacgaggagccgctccgtggtgtccgccgtcacccggatcgccgccccgtgctcggccagctcccgcagataggcggcggtcggcgggtcctggagcgccacgctggagacgacgttgcggatccgcaccccgcgccgcagacagcgcaggtccagcgggcgggagcgggcgatgttctcctccgacagccgggtgtacggctcgacggacaggatctcgtcccgggcgaagaacgcgaggtcgtcgatccggtcacggatctgggcgagtccctccaactgctcgaccccctgcggagggggcgtacggatcccatgctccgcgcgtagaccatcaatgacgtgccacgaccgggtgacgcgctgcagctcctgatggagcgtgtgcagccggacgtccaccagccgggtgagagccacctcgggatccgccgggaagatccgcttctcggcgtcctcggcgaggagcagccccagctcctggagccgggcgatcctcgcgcgcgcctcccccggccgggagcgcagcaggacgtcgaggtcgtcggcgcgggtgccggggttgcgcaggaagtgccggtagacctcttcctcggtctccggcaccccgaagacagacatctcgttctcgcccacgtacgcccccgatgcctgatgccgtggggagcgtgcaccgagggggtcgccccgcgccgcccgcccaggccgctgctcgctccgcccgtgccattgaccgtgcccccacccgcaggggtgacgcgccggccgatgctcgtccgcgtgtccgggccatggtcgggcaaagactagacgctggggtcactcctgtgaggagtcccggcacaactgtgtgcgggactcctcacaggagtgaccc

SEQ ID NO: 3331 - DNA, 1894 bp, Unknown
  Kingdom: Bacteria, Phylum: Actinobacteria, Class: Actinobacteria, Order: Streptomycetales, Family: Streptomycetaceae, Genus: Streptomyces
  misc_feature (1558)..(1559): n is a, c, g, or t
ggccgtccccgccgggcgggcggacggcctcaatacaagggtccacatctatcagacagccgcccgcccccgggccggtccacccgtttgggaccactttcgggaccgcacgaagtttttttgagaagtcgcgtaataggtggcggggagggcgctctctccttgtgcgggacggtcacgggaccggcccacgagcaccggaaggttgtgcattctcatgatgagcatcgtggaacgtgagctggagctgaagctggtcctgtcccccgagcggtccatcccggtacccgcccggctgacgtatcgcacgaacgacccgtacgccgtgcacatcgccttccacatcggctccgagtcgcccgtgcactggacgttcgcccgggagctgctggtggagggggtgttccggccgtgcgggcacggggacgtacggatctggccgacgaaggtcgcgggccgcagcgtcatctgtgtggccctcacatcgcccgacggcaacgccctgctcgaagtgccctcggccgccgtggccgcctgggtggagcggaccctgcgggtggtgccgccgggcaccgagagcgaccggctcggcatcgacgaggcgctggcggagctgctggctccgctgccggccgacgacctctggctgagcgacccgtggtcgtcggacgacgcgccgtcccaggacggcgaggcgtgagggcggccggacaggagggctgctgtcagaagagcttgccggggttgaggaggccgagcgggtcgaaggccgccttgatgccgcgctgcagttcgatgccggtctcacccagttcgcgggccagccactccttcttgaggatgccgacgccgtgttcgccggtgatggttccgcccagttcgaggccgagcgccatgatcgcgtcgaaggactcgcgggcccggcgggactcgtcggggtcgtggtggtcgaagcagacgacggggtgggtgtttccgtcgcccgcgtgggcgcagacgccgatggtgaggtcgtactcctcggcgatcgccgccgtgcccgcgagcatcgcgccgagctgcgagcgcggtacgcagacgtcgtcgatcatcgtggccggcttgacggtctccagtgcggtgagcgacatccggcgggcctggaggaggagttcggactcggcggggttatccgcggggaccacctcggtggccccggcggcggtgcacagcgctccgacggcggcgaggtcggccgacgggtcgggggtgtcgaaggcgcagagcagcagggcctcggtgctctcgggcaggcccatggaggcgagcgcgttgacggcacgcacggtcgtacggtccatcagttcgaggagtgacggggtgtgaccacgctccatgatccggcacacagcgtcacaggcggcggctgccgaggggaactcggcggcgaggacgagctgccggggcggctgcggtttgagcgcgaggacggccttgacgacgatcccgaggctgccctcggagccgacgaagagccgggtcaggtcgtatccggcgacgcccttggcggtgcggcggnncggacgcggtgccgatgttgccgccgatggtgcacgtctcccagctggagggatccggcgggtagtacagaccgtgttcgttgaccgcgcgtgacagcaccgcgttgacgacgcccggttcgacgacggcgatccggtcgaccgggctgatctccaggatccggtccatcttcaccagggacagcacgatgcagccgtccgaggcgttggccgcgccggacaggccggtacgggcgccctgcgggacgaccggcacacgcagcgcggtggcggtgcgcatgacgtgctggacctgctcgaccgtgcgagggagcacgacgacggccggggtgccg

SEQ ID NO: 3332 - DNA, 1744 bp, Unknown
  Kingdom: Bacteria, Phylum: Actinobacteria, Class: Actinobacteria, Order: Streptomycetales, Family: Streptomycetaceae, Genus: Streptomyces
gcgcaggagcgcaggagcgcgccgggcggatcctggtgatggacggcccgcgcacccagtgcggcacgcccgacgcgctcctgcgctcctgcgccctctaccgggacctggccggcctctgggaaccggaggaagcgggggagccggaggcgtcgggcggagccgtcggttccgggcgggggaaggggagcggcatcagatccaccccgcctccttcgcccgtctgatcgcgtccagccgattgcgcgccccggacttccgtatggcggcggccagataattgcgtaccgtccccggcgtcaggtgcagccgaccggcgatcccggccacggtgtcacccccttcggccatcgagagcacactcaattcccgcggcgataacggcatgtcggccacctggaggaggctgaaggccagcgactcgtcgatatgccgtcccccgtccgccagtttgtgcatcacctcggaaaggtcgtccaccggacggtacttgtcgatgtagccgagcgctcccgcctcgaacgcccttcgcagaccgcgtggtcggtcgctgcgggtgagcacggcgagcggaaacggctcgccgtgcggcgcggtcatcgtcttcacctcgtcgaggacgtccagcgcgcccggacagtcgaggtcggtgaggagcacatcgggacccggcccgctcaacgcggcgcgtatcgcaccgtgttcggcggtgcggacctctatcccccggcccgtgccgaggagcgaggccagcgatgcgcgccacaacggcacggtgtggaccagcagcacggttgtcatcagtctgtcctcagcttttctcttccggcccgcccaacgcggaatgcgacggactgtacgcatccggtgacgggtgtccagttgagcgcatgggcattcgcgtacgccgacaaacgggctgaataccgcgcccgttgggcgcggaagggggcgttcggatgtaaaacgggagcgcacatcgcccacggacccatccgtctcgtcaccgcaggggcggccggagagccggtggtagggccggattccggggattccccgccggacggccggatcagttcagcagggcgcgcgcggcgtgggccttgcgccggatgttctcggccgtagtcggctcgattccgtcgaggatctccgcatattcctccatctccgccgccccgcgcaggaactcaccgcgctggaccaggagctgggcgcgctcgaagcggagcctggccggatgcgagggcagcagcagcgacagctccaccgcccacagggccacgtccgtgcgctcgggacgggccgccgcccacgcccggacgttgttcaggatccgcagcacgatctccagcggccgtgcgggcgtcatcatcgacggttccagggccgtcccggtcacccccgtgaccagcagctccgcgtcctgaccggtcagcggcgcgcccccggcgaacggatcggccagcaccgggcgctcccgatcgccgaaaccgaccacgaagtggccgggcagcgccaccccgtaaaccggtgcgcccgccctcctggcgacctcgatccagacgaccgacaacaggatcggcagaccccggcggcgccgcagcacctgctggaggagcgaggagtccagccgctggtagtcgacggatgagccgccgaacccgcagcatccgcccagcagttcggccagcgccgaggcccaggcggcgggtgagcgggagccgtacggcagcagtcccgc

SEQ ID NO: 3333 - DNA, 4945 bp, Unknown
  Kingdom: Bacteria, Phylum: Actinobacteria, Class: Actinobacteria, Order: Streptomycetales, Family: Streptomycetaceae, Genus: Streptomyces
acacccgcccgggcgtcgtcggacagccgacagcggctcagcggctcagcggccaggcgatcgagtcgtggtccagctcgctctgctcggcactgcccgcgtaccgcgcacaggcgtcggtgagcgtctccagcagggtcagcggatcgggcagctcgtgctcggggccacgtacccagtggacgtcgagctcaccggggagccgggcgggcggcaggaggacgtagctgccccggcagtgccagcgcaggcccggatgggcgtccatggtctcggggtggcagtccagctcgcagggccaccactcgtcctcgtcctcgggggtgccgcgggtggcggtgaagaagagcatccggtcctcgccggactgggcgaccgggccgacgtcgatacccgcgtcgaggagacgctccagggcgctgcggcccgcggtgagcgggacgtccagcacgtcgtggatcatgccggtcgcggtgatgaagttggccagcggctggctgccggcccagcgctcgatctgggcgcggtccgtggtcgactgcgtctgccaggcgaaggagatgggatgccgggcgggggtgggacagccgatgcgttcgcacgaacatcggtatccgagggggtgggcggcgggggcgatgggcattcccgcgtcggcgaccgccaggagcagcgcgactctggccgactcgtcggcctcggcccccggtgctttgggacgtcgccgcagccactgggagatcctgctctctgtgccgcggaaacggccggaatcggcgcccatctatcccctcacctcagcagttcacctcagcgttgcctgtccatcgtcgcaccatcctgcggttcgggtggccagagttcaccagcggggccgtgtaccactgcaccgagtgagcaccatcacgcccgatgtcaccccatactggacgtctccgcccattgctggtggggcctgaggtccgtcgcccggcgctcgggtcagggtcgcggggtgagcccgtcgagggcgtagtcgacgatcgcgtcggcgtacgcgtgggtaagcggcagggtccgcagcagccagcggtgcatcagcgggccgatgagcagctccagggcgatccgggggtcggcgtcggcacgcacgtgtcccgcctcctgggcggcccgcaggcgcgtgacgtacagcgcgagctgcggttcgagcagcttcgctacgaattcggcgcccagctgggcatcgacgatgccctcggcggtcagcgcgcgggtgggaacctccagcgccgggtcgttcagctcgtcgacggtggcccgcaggacgagcttgaggtcggcggccagatcgccggtgtcggggatgccctgcgcggtgtcgccggaccgcggtgcggcgtcctcggcggcgcggcccgcgaggtcgaggaaggcttccatcagcacggcggccttggagggccaccagcggtagatggtctgcttgccgaccccggcgcgggcggcgataccctcgatcgtcgtgcgccggtagcccacctctccgacgagggcgagggcggcgtcgtggatcgcgcggcgggagcggtcgctgcggcggctggagtcgggtgccttggtgggtgccatacgcccaatctacgccggacaagccgatacgtatcgtcttgcagcggccgtcgagggcggcggagcatccggactgtggccgcgacggggcggtccggtgaaccacccgatcggatcactgcggatccggcgcgcacggcgcaccatgggctcacgcacagaccgtgcgcatcccaccgttccgcggccccggccgccgttcgcgaggagcccgatgtgaaccgtgacgccacccctcgtcgctacctgatgtgcgccccggcgcacttccgggtcacctactccatcaacccgtggatggacccgtccaaacccgtcgacctgccgctggcccagacccagtgggaggacctgcgcgaccgctaccgcaccctcggccacaccgtcgagctgctcaccccccgtcccgacctgcccgacatggtcttcgccgccaacggcgccacggtgatcggcggccgggtgctcggcgcgctgttcgcgtaccgggagcggtacgaggaggccggggcccaccgggactggttccgggagcacggcttcaccgaggtccacgagccggagcacgtcaacgagggcgagggggacttcgccgtcaccgcctcgtacctgctggccgggcgcggcttccgttccagtccgctctcgcacatggaggcccaggagttcttcgggctgccggtcatcgggctcgatctggtggatccgcgctattaccacctggacaccgcgctgtgcgtgctggacgcggcggccgacgagatcatgtactacccggacgccttctcccccggcagccgggcggtgctgcgccggctgttcccggacgcgctgctcgcccgggaggcggacgcggcggcgttcggcctcaactcggtcagcgacgggcgtcacgtcctgctgccgcagggcgcgacggggctcctggacccgctgcgggaccggggattcgagccggtcccgatggacctgggcgagctgctcaagggcggcggcagcgtgaagtgctgcacccaggagctgcgcgtctagagacggtcgtcagtccgtgctctccggcggccagggggcgccccaggcgacgtccctggccgcccggtacagctcgccgtggcgcttggtgaccgtggtgcgggccaggccgtcgtcgcgggtgcacagctccagcagcacctggcccttgcggatctgcggcctgcgggtgatccgggcggtcgccggggcggtggggaagcgggtggcgacgacgtaaccgaacttctcgtcctcgtggctcagcgagccgcccttgacctgccggtgcagcgaggagcggctgacccgggccgagaagtggcaccagtcggacccgggggtgatcgggcaggcgtcgctgtgcgggcagggggccgcgacactcagcccggcggcgatcagccggtcgcgggcctcgatgatccgggcgtatccgtcgggggtgccgggctccacgatcaccaccgcctgcccggccgccgcggccgcgtcgaccagttcggtcctggccccggcggtcagctccttgagcacatagctgacggtgaccaggtccaccggggccagctccagcgccgctccgatccgggccttctcccagcgcgcgtcgcggagcaccgggaccccggacgcctcggccagttcgcggccgagcgcgagggccggttcggaccagtccaggacggtggtggccgggccctcccagaccccggccaccgcccaggtcgccgcgcccgtgccgcccccgacgtcggtgtgggtggcgggcgtccagtcgggcgcggccccggccagggcgtcgagggcggaccgtacggcttcgaaggtggcgggcatccggtacgcggcgtacgcggcgacgtcggagcggtcccgcaggatcggggcgttcgtcggggtctccccccggtagctggcgatcagccgctcgacggcctgcgcggcctgcttgggcggcagtccgtcgagcagcccggccagcgccgcgcgcagggactgtgcggtggggagggtgacgttcaccgccgaattgtaggcggaggagacccggcggacgcattccgcttcgccccggccggaaggggtacgggggtactgcccgggcgggcgggctccacacaggggctccacgtaatcggtacggaacaggaatcctgcgaactccacgccgcgggaagcctgttgctacgctggcccgcgcgtgagcggcaccagatcaccaaggtccaacgagggatccatgagacagaagatcgtgcggctggtcctggtcggcggggtggtcttcctcgccctgctcctgctgctggccacctgcggcggcagctccggcgacaaggacgagaaggacggcgcggctgccgcgacggcgaagccggtgctgccgagcgcgggcccggtgacccggctgaccgttccgccgcagtacacgacggaccggggctgggagatcatcggctcctcccccgacgtcaccgtgtcccacgcgacggggttgctggcctatctggagcggtcgaaggacaaccgctaccggctgcgcaccgtcgacacggccaccggcgagctgggctggcgcggcaaggcctggcggcagccggacccgctgcactaccccaagctcgccacggtggccaagggggaccggcagttcttcgtgacctggtcctacgggaaggtcggcgacgggctgtcaccggcgaacacgttcctcgcgctcgatctgtacgacgtcacgaacgggaaccggcagcgcgtcgaggtgccctggtccggggccccgaacgtcagcacgaccggaccggacatcgtggtcagcgacgggaaggcgaacagcaccctggtcgacccggtcaccggtgaggtgtccgagctgagcgcggacgagctgaagtaccccaagggctgcacggcctgcaagcagctcaccgaggtgcacggtcagaccgccgggggcctgctgctgggcggagcacgggagttctgggtgcgcggcggctggttcagccggaaggtcgcacccaagggcaccgacaagggcagcggtgtggtgacgtcgatgaccccggaccaggtgctggcgaagtgggctcccgcgaagaagaccaagcgggcgtcgacccacgagctgtgggcggtgcacgacgcggcgaccggcgaggtcctcacctcggtggagtgccacaagcccgccataaagccggggcgcttcccgcaggcggtcctctccccctcgggcgactacctgatcgccgggaacctggccttcgatctggaggcgaagcagggccgctgcttcgaggacgagggcggcgccgcc

SEQ ID NO: 3334 - DNA, 4894 bp, Unknown
  Kingdom: Bacteria, Phylum: Actinobacteria, Class: Actinobacteria, Order: Streptomycetales, Family: Streptomycetaceae, Genus: Streptomyces
catcaacacgcgcgccctcgtcctgctgagggcgacggtcgggatcgtcttcctcggcttcggcgtcctgaaactgttcccctcggccagtcccgcggagcaactggccgtcgacgcggccacgaagatgaccctgggcctcgtaccggagacggtgctgctgctctccctggcagcgctggagacggccatcgggatcggcctcatcgccggcggccgcctgctccgtcccaccctcgtcgcgttcttcctgcacatgggtggcgtgttctcgacccttctcctcctccccgacgcgatgtggcaaccccactccccggcgccgaccatggaagggcagtacgtcgtcaagaacgtggtcctggtggccgtgtgcctggtcgtggccgccgacgcctggggaagcgggaccaggtcgtcgcgacggccggacggggccgaccgcacgacgtcgggctgaaggcagaagggccgcccttggaatgctccggccccggcagcggcggccgcggtgaggtgacatcggcggcgatcagccgacgtggaccggcacctcggcgagctgctgaggggtggccgcgggacgtgggccacggagcatggccgcggcgacgaccgccgcgaccaccagagtgacggcggtggcgaggaacaccgcggagtagccctcggtgagggcggctccccggccggagccggccgcggcggaccgttcgacggcgccgagatagatcgtggtgaacaccgacaggcccacgcatccgccgatctgcatggcggagttgaccagggccgacgccgcgccggcgtcgtggtggccgacgccggcgagagcgacgttctgcaccgggatgatcacgaacgcgatcccgatgcccacgaccacgaggccgccgaagacctccgcccagtagcttccgccggccgtgatgaaggtcagccacagcatcccggccgcagcgatcaacggcccaccggtcatcaggacacgcggcccccgggtcggcagcagcctggcggccacgggtgcggtgatcatggtcgcgacggtcatcgcgaggctcgcgagaccggccgacagcggggagagcccgagcacgatctggaggtggaacatcaggtaaagcgtcatcccgatgtagacggcgccgatggccgcctggatgaggaacgctccggcgcgggcgcggtcccgcacgatccgcagcggcagcaacggctgcgcggcgcgggactcgatccacacgaacaccgccagcagcaccaggccgccggcgaggaagccgatggtgtccggctcggtccatccggactcggccagggtgaacccgtagaccagggcggccaggccgagcgtgacggtcagggtacccaagacgtcgtagcggttgtcgccctcgacccggctctcggagacgaacagcagcgcgccgatcaggccgacgacggcgaagacgatgttgaccagcaggcaccaccgccagtcggcgaactcggtcaggacgccaccgagcgccaggcccaccgcggcaccggtgccggcgacggtaccgaagaccgcgaacgccgttccgcgctcgcgtccggccgggaacgtgaccgtcaggagcgcgagtgccgcaggcgccagcagtgccgcgaagacgccctggaggccgcgcgccgcgatcagctcggtcccgctctgcgcgaggccgccccacacggaggcggcgccgaacccgagcatcccgaccatgtagctgcgcttgcgtccccagtagtcggcgacacgtccgccgagcagcagcagcgcgccgaacgccaggacgtaggcggtgatgacccactgccgctcggtgtcgctcagctccagttcgagctgggcctggggcagggccacgttgacgatggtcgcgtcgagcacgaccaccagctgggtcagggcgatcaccgcgagcgcccaccatcggcggggatcgggagaagtgggcggggacgacaagacagacatgaagaaacctccggggttctgtccaaatgagcgccggaggtttcaagcctcggaccagacaccggcacggcggggtctgaccacctcggccacggggccgagcccgaccatcctaaccaccggccgcagcccgcaccgcaccacagaggtccgtgatccggctcacggagcgacggcgctcgacggtcgatcccgtgcgcaggcgccgcccgggacggcgatcacgtcgcgccgcccccgtccctgtactcgggaaacagacgaggatgctgcgcggcgagagcccgggtgatcgcctcgccgatggggtccgtgacgcgccgactgtgctcggaccgatgtccggcgaacggctcgcacgcctccttccgcgcatcgcgcgcagggcaccactgattcgttcgaaggcgcacggcccgaggtcatcggagccgtcggccccatcgggggtctcatgcggcatcagccgggcgactcgcagcgttcgagccgatggtcagccctgcccggaccctctgtccgtggtcgttcacggtccggcaccggccgggactctcggatcaaccgtgtcgaaatagacccggtcggtgcggacgtcgacagagaaccggccggtgtacctcccgccggtcacttcctggtcgaaggcttcgctccgtacccatgcggcacccttgggcaggaaggcggcgagcttctccggcacccggtccggctgcccgggccggaagtcccgctgcggcaccgcgacgatggcagctccggtgcccgcttccagttgcgccacccccaccacgcggacatcgatgggacccggcgcggacgtcctcgaatcctcgcccaacgagataccgagccagtgcacgtcggacagcgggccgagcagagtgaaacgacgctccaacggcgcaggatcggtgcgcaccttgtccttctcaccgccctgaccgctgtcctcctccttcttacggtccttctcgctgtccgcctcccgcgaagccggtgcacacgccgcgaccgctaccatcgcgccgagcgcgagtaccccgcggcgtccgatacccaccgtgccggccatgttccgccccctccggatccgcgcacgcagcctgtccagccgtacccggaccggtgaacctacctcatgtcccgccgataccgaccgggttgtgggggtggaccgcgtacgacgtcgagccggtatgcggcgcgatcaaaatcctttccatggaaccgaattgctgagacagaacctggacgctcgcaggatcattccgagaacgggccggccctgacgtcgtggttgtcagcaggaagcaccgcaaccgaccacccgctggagatcacgatgcgctcgcgtctcgccgcccgttccacccgtctcgtcctggccgcagcagccgtgacagccctcgctgccaccaccgcctgcggccccgaggaccccgcggaggagaacggagcggccgcccccaccgccgcttccacctccgccgccgacggcgggaagggcgaatccagcaccggggacaagagcggctacggccagtcctgcggcaccaacgattccgacttcacggtgacgtgggaagcgcagccgatcagccactacccgatcaccgccaaggcaaagtccggcatcacctgctacctggacgtcaacacccccagcgtctccttcggatccggcgccgacggcgtcgcctcacccgtcggccagggcggcgaggacctgagcaagctctccggctcctccgtcgcgtacgccggcatcaacgtcaagaccacggagggcgagggcggcaagcagttcgagcacgtcatcatcgccaccacggaggaggaccctgaccccgcccaggtcgagctccccgacacggccaccgtggacgagccgatcgtcaccaactggtccaccaagcgcgacgagacgaccccgcgcgtcatctgacggccttcgcccgggggatctcaccgcgcggccgggtccgcgaactacgccccggatcacgtcagtcgaatcacgtgcttgccccgcaccccgcccgcctccagggcgcggtgggcggcggcgatctccgccagcgggtggaccgtgtcgacgacgggtcgcaggtccccgcgttccacatacgcggtcacctcggcgagcaggtcgtgtttcgggtttccactgaagaagcggacacgccgacggccgtgcacggccgagcccagcaggtagccgacgctccggaccggacggtcgatgtcgaaggcgatggagacgagacggccgcccggagccaaccgttcgcgcagcaaccggtgttcggtacccaccgtgtccaggatgacgtcgtaacggtccaggccggccagggacgtcgcccggtggtccagggcctcgtccgcgcccaggtcacggacgaagtcgaggttcttcgcgctcgcgagaccggtgacatgtgcgccgagggccttgccgagctggacggcgacgctgccgacgccgccggaggccccgcgtacgaggaggcgttcgcccgcccgcagaccggccttgtcacggagggcggtgagggaggtggtaccgccggcgagcagcgagacggcctcggtgggagtgacgttcccgggggcgtacgcgatccggcgcgggcggaccgagacgtacccggccgcgctgccgaaggtacgtcccaggaggccccagacccggtcgcccgcccgcagcccggtgaccgccgcgtccacctcggcgacctcccccacgaagtcgaggccggtccgctgcgggaagcggcggccggtgaccaggcggaccttgccggcgcggccgtgcagctcgcccccgttgacgctcgccgcgtggacgcgcacgagcacctcgcccggcttgcgggccggcacggggacccg

SEQ ID NO: 3335 - DNA, 2391 bp, Unknown
  Kingdom: Bacteria, Phylum: Actinobacteria, Class: Actinobacteria, Order: Streptomycetales, Family: Streptomycetaceae, Genus: Streptomyces
gggacgcgcgggcgaactcgccggaccgagcggagtcgccgcggcgtcgacgctcggctacggcgggatgctgctcggcccgcccgcgatcggcttcctcgccgactggttctccctgccgctggccctgacgacggtcgccctgctggccgcggcggcggccgccctgggctacggggcccgcaacgccacatcggacgcgcacacctgatcgcccgcacacctggtcgattgagtagccgtactcaggcggtctccgctcccccggcgcacgatggaagcctcgaccgagcacgaagcaggggagcacaccatgaagcgcctgaccggccacccgcacctgaacaccctggtccggctgaccttccgcaaccccgcttccctgatctacctcgggctggtgctcgcggcgacgctcttcgtcgccgtggacaccctgttcgtcgcccacgaggacgcctcgttctccggcgtctggctgttcctgctcgcggccccgaccgtcttcctgttcttcctcggcggttccctggcgggcgccgaggcgggcgggcccgcctggttcctggtgctcggtctggtggtctcggtcctcgtccagtcgctggccctgggctggttcgtccgcctggtgcgccgggccggatcggccggatccgcgcatccgcagggcgtctgacgcccagggcgtgtcgcacgagctcctggcacaatcgccgccatgcagatcgccgatcacatcgcgtcgttgtccgaggaagggcggctgctcgcggccgccgccgagcgggccggaacgggggcatcggtcccgacctgccccggctggcagatacgccatctgctgcggcacaccggcatggtgcaccgatgggcggcggcgttcatcaccgaggggcatacggcccaccggcccgacggcggtgaacccgcgctcgacggcaccgaactcctggactggttccgcgagggccatcgtcatctggtccggtccctggaggaagcgcccgtcggcctgaactgctggaccttcctgccggccccctcccccctggcgttctggtcacgccgccagctgaacgagacgaccgtgcaccgcgtggacgcggaatcggcgctcggcggaccactgacccgggtgcccgcggaccgggcggtcgacggcatcgacgaactcctcaccggcttccactcccggcccaggagccgggtccgctccaggacaccccgcacgctgcgggtgcgggccgtcgacacggcggcgacctggacggtacggatctcgcaggaccccccggaggccgtacggtcggcggacccgggcagcacggacccccgggacggcggcggcgcggaacgcgtcgactgcgagctgagcggtacggcggaggggctctacctcaccctctggaaccggctgccgctcaccgccgtcaccctgcgcggcgaccgctcggtggcccggatctgggcggacaactccgcggtcacctggtgagcgccgccgggccggaaggcccttggctcagccgagccagccagggcgcaccagccccgattcataggcgaggacgacgagttgggcccggtcgcgagctccgagcttgaccatcgtgcggctgacgtgggtcttcgcggtgagcgggctgacgaccagtctgcgggcgatctcctcgttcgacaggccgatgccgaccagcgccatcacctcccgctcccgctcagtgagccgggcgagcgaggcggcggccgtcggttccttggagcgggccgcgaactccgcgatcagccggcgcgtcacacccggtgagagcagcgcgtccccgccgaccaccgcccgcaccgcgcgcagcagttcctccggttcggtgtccttgaccaggaagcccgaggctccgttgcggatggcctcgaagacgtactcgtcgagttcgaacgtggtgagcatgaccaccttcacgtcgtccaggtccgggtcaccggtgatccgccgagtggcggccagtccgtccaggcggggcatgcggatgtccatcagcacgatgtcggggcgcagttcgcgcaccaggcggaccgcctcctcgccgtcggcggcctccccggagacctcgatgtccggctgcgcgtccagcagggcgcggaagcctgctcgtaccagcagttggtcgtcggcgagcgtcacgcggatcacggtgtctcctcggggggctccggcggggtccggcggggtcggtcgcggtccggtgcggtgaacggcagttccgccaggacccggaagccgccgtccgggcggggtcccgcctagatcgtgccaccgagggcggcggcccgctcccgcatgccgaccagtccgttgccgccgccgcccgcgtcgccgccggtggcgggtcc

SEQ ID NO: 3336 - DNA, 2618 bp, Unknown
  Kingdom: Bacteria, Phylum: Actinobacteria, Class: Actinobacteria, Order: Streptomycetales, Family: Streptomycetaceae, Genus: Streptomyces
gtcccggtcggccgccgcccgtcccacggactccaccagcggcagcacccggtgcgccacccgctcgcgcagcgccacatcggtccgcgtcctgacgacccccggcagctggatcagccgttggatcacgtcctccagatgcccggcgtcccgggcgaccacccgggtcagcagatcgcccccgcccgtcgtcgagaacgcctcgatgatctcgggaacggccgccagggcgtcgcccacctcgaccagatgcccctgcgtgacctccaggtggacgaaggcgagcacgggatggccgagcgcggccggggagagggtcggcccggtaccggtgatcaccccgtcgcgctccagccggtcgagccgggcctgcagggtgccgcgggccacgccgaggatgcgcgcgtactcccggacgctggtacgcggctgctcgatcagcaggcgcaggatccgggtgtcgagagcgtccaccgccatgatccgcaggtccccttccgagccgtccggtgcggccccgactgtacccaggacgaggggccccgcgccgccggggcgttacgacagcgcgtcagccgtagggtgacagcagccaggccatcagtgcggccgtcaggacgaactgggccacggcggcgccccggtaccgtccccagcacagggccagtcccacagcagccagcacgccgccgctccccagcagctccatcaccggaacggcggcttccgcgccattgtgcgcggcggcccagccgccgatgccgaccacgagccaggcccagccgccgacgagcgcgtcgagcggcaggagggccaggaacaccaggaggttcgctcctccgctccgtggctcacgcccctcccggatcccgtccgcgcgcatgtccacgtccatgtcggcatcgtgcgcctcccgcacggccctggggatgagtacgcgtactcatcccgctcgccgccgaaccggagcccgaccggccggtgcgtacgtcgtcgcggagtggcgaccctcccgggtggtccgttggcacgctgttggccgaaacaatgagcgatgtgctgggccattggtacatggttctcctcccggtttgatccaagagcccggtagatgctgcaatagatccatcgatggcgctgcggacttccgcagcgcctttttcatgcgagttctacggagacgcggaaggggcggaagcgtgctgaagaaggtgttcgtggcgccggacccgggcctgttgcgtttgcggagtgccgcgcgttccgtcgtgggggtgggcggtgcggtggccgcgtgcggcgtgacggggcattctctggtggccgcgatcacgggtggcctgactgctcttctggctctgttcactgtcgcggattcgaccgttcgtgctcaggccctgaccaccgcgctgctgccggcggtcggtttccccgtgctcgcgctcgcgagcgcgttgcacgaaatgccgctggtccgggacgtggccttcctggcggtgatcggtgcgggggtctatgcgcgacgttgggggccgcgcgggaacgcgctgggaattttcgcgttcatgatgttcttcgtcgcccagttcctgcatgccacgcccatccagctgcccggcttcttcactgctgtcgtcctcgctctgctggtttcctcggcggtccgttttggtctgtggtgcttcgagcgccgctatccgcctgcggctgtgccagctccggcgggtggtcgaggtctggggcgtgcgacgacgcgccaggcgatacaggcgaccgcggcgtgcgggttcgctctcggggtggggcaggtgctgtcgcacgaccgctggtactgggcggtgggcacggcctggtggattttcgtgaacaccgcctcgcgtggtgagacactggtccgcggttttcgccgggtggtgggcacggtcctgggtattcccgccggattgctgatcgctgttccgctccacggaaatctcgtgggtacggcgatcctggtggcggtatgcgtcttcgggatcttctatacagccgcggtgtcgtattcctggatgatcttcgccgtcacgttgatgatctcgcttctctacggtctgctgggagtcctgaaccctgaattgctcgtgctgcggctggcggagaccggggtcggggcgctcggggccgccctcgcggtgctgctggtgcttcccgtgaccacgcacgcgacgacccatgcgtggatccagcgcgccctgagccgcgtccacgagtgcaccgccggggctgctgcgcggctcgccggtaccccgggtgccgacccggagccccacatcgccgagctcgaacttctgctggggcgcgtacggtactccctcgcgcccctggtgcacccgctcaacccgtttcgagcccgcaaggcgcgcgcccgcaaggtcctggctctgctcgacgactgcgctcgtgaggtccgcggcctggctctggtcgccgccgacccggacgcctcgcacgacgaccgcctcacggccgcctgctggcgggtccagtcagcggtcgagatcctcacctccccccaacccggcgcgaccccggcagcgcccgcccctgcgcagcgttcgaccgccccctaccccgccctg

SEQ ID NO: 3337 - DNA, 4508 bp, Unknown
  Kingdom: Bacteria, Phylum: Actinobacteria, Class: Actinobacteria, Order: Streptomycetales, Family: Streptomycetaceae, Genus: Streptomyces
tcggcgcgggcctcgggcgaacggtgcttgagcgccttgcgcaggtgcgagcgaccgcggtggatacggctgcggacggtgccgagcttcaccccgagggtcgcggcgatctcctcgtagctgaggccctcgatgtcgcagaggaccacggccgcacggaattcgggcgcgagggtgtccagcgcctgctgcacgtcggcgtcgaagtgggtgtcgttgaagacctgctgcggggacggctcacggctcggcaggcgctcggccgcgtcgtcgccgagcgagtcgaagcggatgcgctgcttgcgccggaccatgtccaggaagagattggtcgtgatgcggtgcagccagccctcgaaggtgccgggcgtgtacgtcgacagcgagcggaacacccggacgaagacctcctgggtcaggtcctcggcgtcgtgctggtttcccgtcagccggtaggcgaggcggtacacacggccgctgtgcgtgctgacgatctcttcccatgagggcggggtccacgcctgagaatccgcgtcggaggcgaaggtcgcggtcggtgcggagtcttcggaagaacggtcagcaatgttggtcacggatttcggctcaccggccgacctgaggagacgccgcagcatccctccccggtccacaggcgcagccgcacctcccctatcggctctggtggtgtccagtggagcccctaccatagccacctcgcccgttagctccggataagcctttttccctgatggggccgggcgtcgcccgggactttcccgcagctcgccggtccgatccgcggacctgctcactgcgctttccccactgcttgcacaacgcccggtcccatctgcgggttcccgggtccagcggatacagtcaccgttgcgccaactacggggacaggagagggtcattaccgccaaccggcagacgagctgggcgttcgccgacgcctttgtcgccgaggacgaagcactgcacggggcccgggaacgggctcgtgagctggggcttcgctcggtgtcaccgggcaccggcgccgcgctgcgcctgctggcagccgccgcggacgccaaagctgtggcggagatcggcacgggcaccggcgtgtccggcatctatctcctgcacggaatgcggccggacggggtcctgaccacggtggaccccgagcccgagcgtcagcagttcgcgcgggcggcgttccgcgaggcgggcttcgccaccaaccgggcccgcttcatccccggccgcgcgctggacgtcctgccccggctcgcggacggcggttacgacctcgtcttctgcgacggcgaccggctggagagcctcgatgtgctcgctgaatcgttgcgcctgctgcggcccggcgggctggtctgcttcgagggcgtcttcgcggacggccgcacggtcgactccgcggcccagccggccgaggtgctgcggctgcgggagctgctgcgggcggtgcgcgagagccaggagctgatgtcgaccctgctgccggtcggcgacggcctgctctgctcggtccggcgcggctgagcagacagacctcatcgtgagcgcgtaggacctcatcagaacgcaccactgcccggtacggaatccgtaccgggcagtggtgaaggtgatgggcgttccgcgtcagccgacgaccttcttcagcgcgtcgccgagggcatcggcctcgtccggagtcagctcgacaacaagccgaccgccgccttcgagcggaacgcgcatgacgatgccccgcccctcctttgtcacctcgagcgggccgtcgcccgtccgcggcttcatggccgccatgctcgttccccttcctgaaaccagctcatcgcaaccggcggccccatgacaggcgctgcctcaccggcatcgaacacattgcttcttcgccattatcccgcatcaatgaccccgatgaccaacatcggtctgcatcgcttgcgcaacgcgctctcgcaaaaccacccaattcggcgatccggctgcgatactgcgccgccccggggccccaggtgagagccaattgttagacgcaggtcacatctctgcccagccccgcatcggccatgcttgcctccagtggcaacgatgcccgagcagcgaggggataccggaatggccgacgagccggcgaacagcgtcctgtacgacgtgagcgagggtctcgcgacgatcacgatcaaccgacccggcgcgatgaacgcgatgaacaccgcggcgaaggtcgcgctgcgggacgcgctgctggcggcgtccgcggacgcgggcgtccgggcggtcctgctcacggccaccgggcgcgccttctgcgtcggccaggacctcaaggagcacgtcgccacgctcacggccacccgcgaggcgggcggcgggaacgcgctgagcaccgtgcgggagcactacaacccgatcgtccgggcgatcacggagatggcgaagccggtcgtcgccggggtgaacggcgtcgcggcgggggccggattcggattcgcgctcgcggccgactaccgggtggtcgccgacaccgcctccttcaacacctcgttcgccggcgtcgcactcaccgccgactcgggcgtgtcctggacgctcccccggctgatcgggcagagccgcgccgccgatctgctgtacttcccgcggtcgatctccgcgcaggacgcgtgggaactgggcctcgtcaaccgggtcgtccccgcggccgagctgcccgaggaggcggcggcggtggcccgtgccctggcggacggcccgacggtggcgtacgcggcgctgaaggagtcgatggcgtacggcgcaggccacacgctcgccgaggcgctggagaaggaggacgaactccagacccgggcgggcgcgtcgcaggaccacaccatcgcggtggaggcgttccttgccaaggagaagccggtctacctcgggaagtagccgctgctcagcgcggtactccctcgccgccgcgcgccacgcagtccgcgaggtggtcgtcgaccagtccgcaggcctgcatcagcgcgtaggcggtggtggggccgacgaagcggatcgagcgcttcttcagcgccttggcgagcgcggtggactccggcgtgacggccggaacgtccgacaggctgcgcggggcgggccggccggccgggtccggggcgtaggaccagatcagcttgtccagctctccttccgaccagtcggcgagcaccttcgcgttggcgagggtcgcgtcgaccttggccttgttgcggatgatccccgggtcggccaggagccgctcccggtcggcgtcggtgaacttcgccaccgcctcgatccggaatccctcgaacgcggtacggaaggtctcgcggcggcgcaggatcgtgatccaggacaggccggactggaaggcctccaggcagagccgttcgaacagcgcgtcgtccccgtggaccgcccggccccactcggtgtcgtggtacgcgaggtagtcctcggcggacaggccccacgggcagcggagcaggccgtcgggggcggccacggccgcgccggtcatcgcccgtcctcctcggcacggtcctggacgctttcctggccgacccgcccggtggggcggtcgtcctgccggtcgccgggctgcttgaacaggtcggtgcccgtcgtcaccgcggccgcctgcactccggccagcgcggattccagctcggcgatccgggcgtcgcgctcggccagttcggcgccgagccgggacagcgcctcgtcgacgtccgccatccggtaaccgcggggggccatcggcaggcgcagcgcctcgacgtccgcccggccgaccgggcgggtcgtgggcagcggatcggtgaaccggtcgggcgggacgtcctggagcaccgcgctcccaccgcccccgaccaccgcgagggtgaccgcggtgacgaccacgaccatcgtgagcagcaagaaccagaacacgcgcatctccccgggggcggaaacctcgtccggatccgatcgtgccatgcgtcacggacaagtcagggccgaccccgacaaggccttagggtcgcaagcgggctatctgaggaggaaacacgggatgcgaagcggtgcactcaggctggggcggcgggaattcggtccgcacgagccggtgatcatggcgatcgtgaaccggaccccggactccttctacgaccagggcgccaccttcggggacgagccggcgctggcccgggtcgagcaggcggtggccgagggcgccgcgatcatcgacatcggcggggtgaaggcaggtcccggcgaggaggtgagcgccgaggaggaggctcgccgcacggtcgggttcgtcgccgaggtccgccgccgtcacccggacgtggtgatcagcgtggacacctggcggcacgacgtgggcgaggcggtctgcgaggccggcgccgacctgctgaacgacgcgtggggcggggtggacccgaagctcgcggaggtcgccgcgcggtacggggcgggtc

SEQ ID NO: 3338 - DNA, 1360 bp, Unknown
  Kingdom: Bacteria, Phylum: Actinobacteria, Class: Actinobacteria, Order: Streptomycetales, Family: Streptomycetaceae, Genus: Streptomyces
gcgccgctgtgcttgctgatgttctggagcagctccgagacggtgaaatacgcgatgccctcaatggcctccgccgggcggtcccgaagccccaccgacaccttgaccgggactgtgcagcgggaggcgatggcggagagtgcggcgtccaggccccggtcggtgaggacggcggggtggatcccgcgggccaggtcgcggagctcctggagggccaccttcacttcgccgtgggcctcgtcgaccatgcgggcggcggcctcggggtcgtcggtgagcttctccttcgccaggcccagatccatggcgagggcgacgaggcgggcctgggcgccgtcgtgcaggtcgcgctcgatccggcgcaggtcggcggcggcggtgtccacgaccaccccccggtccgactccagctcggacacccgggtggccagccgggacggacccagcagaccggtgaccatcagccggtccaccgtgagcagaccccgcacgatccacggcgcggccagcacgagtgccaggcccaccgctccggtcaccgccagttcgccgggcgagtccagatactcctggtggttccggtccccgtacagctggaggccgccctgccccccgaacaccgggaagagccagaaccacagcgggtacgtcagtgccgccaggccgtacgtccagaacgtgatcgccacgacgaacgtgaacacggaccacgggaagtgcagcagcgtgtacagcaggtgccgccaggacaccccgctcttgaggaccgcgcccatccaggacaacggaccgccggtcttcccccgcacccgctccggatccgccacctccacccgcagcaggccgcgcgcccggtgccgctccagcgcaccgaagccacggcagacggcgagaccggcggcgaggaccggtatcccgatgaaggtgacgaggagacccgcgctcaccgacgtcatggcgaccgcgaagacgaacatcgccgtgctgagcgggaagctcagcagcgcgtagagcagctcgcgccaggtgcgggcttccagcggcgcacgcagcggcgcggggaggaagtgcttcgtcggggtcttctccccgaagccggggccggaaccctgatgctcccggtcccgcctgtccagtccgtatgccgtggccatgagtcccgtccgttccgtctctgtctcagtctctcagtggggctgtgcgtgggcgtgcgccgcgaaggcgccggaggcggcccgtcaccccggaccgttctccctcaagagtgctggccggcggccttccgcaccatgaggtccctctccgtatccgcccgggggttttccccaccccccgggcggccgggcggtcaggcggcagg

SEQ ID NO: 3339 - DNA, 8522 bp, Unknown
  Kingdom: Bacteria, Phylum: Actinobacteria, Class: Actinobacteria, Order: Streptomycetales, Family: Streptomycetaceae, Genus: Streptomyces
gccgggaccatgtagtccggcagctcccgcgccagctcggcgcgcagccgcgcgggatccagcggtacgcccggccgggcgacggcgtaggcggccaactgctgtactcccggccggtcctcccgtacgacggcggccgcctggaggactccggtccgtccggcgaggaccgactcgacctcgcccagctcgacccggaagccgcggagcttgacctggtcgtcggcccgtccgacgtattccagcgcgccgtcgcgccagcgcacgaggtcgccggtgcggtacatccggctgccgggcggaccgtagggacaggccacgaaccggccgccggtcagcgccggttcaccgacatagccgcgggccagggcgggtcccgacagatacagctcgccggtgacgccgggcagcgccgggcgcagccggccgtccagcacgagggccgccgtgtccgggaccgggctgccgatcaccgggcgtccggcgccgatgcgggccaccaccgagtcgacggtgcactcggtgggcccgtacaggttgaacgcggccagacccggcgtcgcggcgagcctccgccacagcggctcgggcaccgcctcggcgccgagggcgagggcccgcagtccgtgcggcagctccagcaggccccggtccaccagccgcgccgcgtacgacggggtggtggacagagcgccgatccgccggtcggccagacagcgcaccagccggtccgggtcggtgcgggtctcctcgtccaggacgtgcagttcatgtccgtcgaacagccacagcagctggtccaccgaagcgtcgaacgagaacggggcgaaatgcgcggcgcgcagcggcgtaccgcccgaggagggcccgtacacccgctcgcgcatgccgcggaacagcccgctcagggaacggtggctgaccagcacgcccttgggcgtgccggtggatccggaggtgtggatgacgtaggcgggagcgtcggggcgtacgacggccggcggcaggtcgcccgtgccgtgtcgcgtcccggccagttcgtcgagggtcagcacctcacccgcggtccgcaccccttccggcagcccctcgggaccggtgaccaccagccgggggcgggtccggccgaggatgcggccgatccgctcggccggatggtccgggtccagcggtacgtaaccgcccccggccttcagcaccgcgaggatcagggtgacgagggcggcggagcggggcagggcggtcgccacgagggactccgccgtcaccccccgggcggtcagggaccgggccagcaggctcgcccgtgcgtccagttcggcgaaggtcagcgtggcgtccggggcgacgacggccgtggcgtgcggcgtccgcgccacctgctcctcgaacagtgcggcgggggtggcgtcggacagcgggtgctgtcccctgccacggccccattcctcgacgacgcgttccagctcgccggggccggcgacgtccagcgcaccgaccggcacggcgggatccgccgcgacggcggacagcagccggaccagccgggcggcgaacagctcgaccgtctccgggtcgaagagctcggcggcgaactcgatccggccaccgatgccgtcgggctcgccggcggcggtcagccgctcctccaggttgaaggacaggtcgaacttggcggcgtccaggccgacccggagcggctccacgctcagtccgggcaggccgagttcggcgtcctccgcgttctggaaggacagcatgacctggaagagcgggtggcgggcgagggagcgtgccgggttgaggacctcgacgagccgttcgaagggcacgtcctggtgggcgtaggccgcgaggtccgtctcgcgcacccggtccagcagttccaggaacgtcgggtcgcccgacacgtcggtacgcagcacgagcgtgttgacgaagaacccgatcagatcgtcgagcgcctcgtccgtgcggccggcgatcagggagccgagcgggatgtcgtcgcccgcgccgagccggttcaacagtgcggccaggccggcctggagcaccatgaagaggctgacgttcgcctccctcgcgagcgcggcgaggtcgcggtggacggccggcgggagtgccacttcggcacttccggcgatccggctgggcgtctgcggccggggccggtcggcaggcaggtcgatctcgtcggggaggccggacagcgcctcgtaccagtagctcaactgccgggcgatcggggactccggatccgtctcgtcccccagcacctcacgctgccacaccgtgtagtcggcgtactgcaccggcaacggccgccactccggcacaccgccggccagccgcgccgcgtacgccgccgacaggtcacgcgccagcggagccaatgaccaaccgtccgccgcgatgtggtgcagcaccagcagcagcacgtgctcctgctcaccgttcctgaacacccgtatccgcagagggagttcatggtccagggcgaagccggtgttggccgcggccgccagggtcgcggtgaggtcgtcctcggccggggtctcggcctcgaagtccgggagccgcggcggaaggacaagctgactcggccgtccccggtcctcggggaagacggtgcgcagcgcctcgtgtcgggccagcacatcgccgagggcgaggcgcagcgcgtcgacgtccagctcgccggtgagccggaccgccatcggcacgttgtacgccgaggagttctcctcgaagcggttgaggaaccagagcctgcgctgggcgaaggagagcggcacggtgtcgccccggtcgaccggggcgagtgcccggcgggcggtgcccgcgtcgtcgagggtgcggtccagcgcggcgacagtcggattctcgaacaacgcccgcaccggaagctccacccccagcaccgaacgcacccggctcaccaaccgcgtcgccagcagcgaatgaccaccgagatcgaagaaaccgtcctccgccccgacaccctccatacccagcacctcaccgaacagaccgcacagaatctcctcccgcgccgtcctcggcccacgaccacccaccaccaactccggcgcgggcaaagccctccgatccaccttcccgtgaaccgtcaacggcagcacatccagcaccacgaacgccgacggcaccatgtaatccggcaacacccccgccacagccgaccgcagaacacccacgtccaccgcaccgccgaagccttccgccggcacgacataggcgacgaggtgcgcgccgcgcgccgggtcctcccggaccacgacggcggcctggccgacgcccggcaccgcggcgaccacggcttcgacctctccgggctcgatccggtggccgcggatcttggcctggtcgtcggtccggccgacgaactccagctggccgtcgtgcaggtgccgcaccacgtcaccggtgcggtacatccgcgaaccgtcggcggcgaacggatcggccacgaaccgcgaagccgtcagagccgaacggcccagatacccgcgggccaggcccgccccggacacgtacagctcaccggcgaccccgggggtgaccaggcccagcgcaccgtccagcacgtagacccgggtgttccacaccgcccgcccgatcggcggcgtgctctccccggtgagcgggtcgctcatggtcgtcgcgaccgtcatctcggtcgggccgtaggcgttgacgacgcggcgtccgccccgggcccagcgggcgacgagctcggcggagcacgcctcaccgccggtgacgatgcagcgcagggtgtccagcccggcgtccgggacggtcgccaggaccggcgcggccagctggaggtgggtcaccccgtaacgggagacagcctcggccagctggtcgccgacgatgtgccggcgggggtccgccagcacgagggcggcgccggacagcagggccatcacggtgtcggccacggacgggtcgaaggtggtggacaccgcctggagcacccggctcgcggcgtcgacgccgagccggtcgatgtgcaccgccgcgaggttgccgatgctggcatgggtgacgaggacgcccttgggccttccggtcgagcccgaggtgtagatgacgtacgcggggtgttcgggcagcagcggcgacgtacggtcggcgtcggagaggtcggtcccgtcgaggccggccgcgagccgctcggcctcctcgatacggagcgcggcgacggacgcggcgagcggcgcggcggagaagacggagtcctcaccgctgtccgtgctcccggtgcctccggtgttctcggtgttctcggtgagcaccagcaccgggcgggcgtcggcgatgacaccctcgatgcgcgcggcgggctgggcggggtcgaccggcagatagccggctccggccttggccaccgccagcagggcgacgagccagcggacggagcgcggcacggccaccgccaccaggctctccggtcccgcgccccggcacgccagcagccgggccagccggttggcccgcgcgttcagctccgcgtaggtcaactcctgatccgccgcgaggaccgcgacggcgtcgggcgtccgggccgcctgctcctcgaagagaacgggcagtgtgccgtcgggcagctcgtgaccggtggcgttccaccggtgcagcacggtgtcccgctcggaggcggacaggacgtcgaacgcgccgacccgggtgccgggcgaagccgcgacggccgccagccagcggccgaaccgctccgtcaggagccgtacggtgccctcgtcgaagcggtcggcgctgtagtgcgccagccccaggaggccaccgggcgcaccgtcggagtcccggcgttccacgagttcgacacccaggtcgaacttggcgtcacccaggacgggaggcagcggcgtggcgtcgagaccgggcagccgcagggtcccttccggcgcgttctggagggcgagcatgacctggaagagcgggtggcgggcgagggagcgtgccgggttgaggacctcgacgagccgttcgaagggcacgtcctggtgggcgtaggccgcgaggtccgtctcgcgcacccggtccagcagttccaggaacgtcgggtcgcccgacacgtccgtgcgcagcacgagcgtgttgacgaagaacccgatcagatcgtcgagcgcctcgtccgtgcggccggccacgggggtgccgagggggatgtcgtcgcccgcgccgagccggtgcagcagcgtggccaggccggcctggagcaccatgaagaggctgacgttcgcctccctcgcgagcaccgtgagccgctggtgcagatcggcgtcgaacgcgaactccaccgtgcccccgcggtacccgggcacggggggccggggccggtcggcaggcaggtcgatctcgtcggggaggccggacagcgcctcgtaccagtagctcaactgccgggcgatcggggactccggatccgtctcgtcccccagcacctcacgctgccacaccgtgtagtcggcgtactgcaccggcaacggccgccactccggcacaccgccggccagccgcgccgcgtacgccgccgacaggtcacgcgccagcggagccaacgaccagccgtccgccgcgatgtggtgcaccaccagcagcagcacgtgctcccgctcgcccaggcgcagcaggtgggaccgcagcggcgggtcgaccgcgagatcgaccggtacggagaccgcgtcccgcacctccgagtcgagctcggcctccgtcacgtcgaccagaccgagctccggcacccagaagtcgaggacctgctgacgcggtacaccgtcgtcgtcggggaagaccgtgcgcagcgcctcgtggcgggcgaccaggtcgcccagggcgaggcgcagcgcgtcggcgtccagctcgccggtgagccggacggccatcgagacgctgccgcccgccgactcgaaccgttcgaggaaccagagcctgcgctgcccgaaggagagcggcacctgtgccggacgcgggaggggagcgagggacttcctggcccgggccgcgtcgtcgagggtgcggtccagcgcggcgaccgtcggattctcgaacaacgcccgcaccggaagctccacccccagcaccgaacgcacccggctcaccaaccgcgtcgccagcagcgaatgaccaccgagatcgaagaaaccgtcctccgccccgacaccctccacacccagcacctcaccgaacagaccgcacagaatctcctcccgcgccgtcctcggcccacgaccacccaccaccaactccggcgcgggcaaagccctccgatccaccttcccgtgaaccgtcaacggcagcacatccagcaccacgaacgccgacggcaccatgtaatccggcaacacccccgccacagccgaccgcagaacacccacgtccacaccgactgccgcgttccgctcgggaacgacgtacgcgacgacggccggcgatcccggtcggtcctcccgtacgacgacggcggcctgctccacctcggggtggtccaggaccgcggcctcgatctcacccagctcgatgcggaagccccgcagcttcacctggtcgtcgacccggccgacgaactccagctgaccgtcgtccagtcggcgcaccacgtcaccggtgcggtacatccgcgaaccgtcggcggcgaacggatcggccacgaaccgcgaagccgtcagagccgaacggcccagatacccgcgggccaggccgggccccgccacgtacagctcaccggggactcccggcgggaccgcgcccagtccgccgtccagcacatggacccgggtgttccacaccgcgcgcccgatcggcggcggggtgcggcggcccgagggggccaggggctcgctcatggtggcgcagacggtcgtctcggtcggaccgtacgcattgatcattcggcggtcgcgcgaccactggtcgacaagggcgggggagcacgcctcacccgccacggtcagcaccatgccgggcggcagcccgtcgccgtccagcgcggcgagcgcggccggcgggatcgtcgcgtgggtgatccgctgccgggcgatcaggcccgtcagtccggcgccgggaagcagccggtccgccggggccagcaccagggtggatccggacagcagcgcgaggcacagctcggagaaggccgcgtcgaagctgggcgaggcgacctggaggacacggctgccctcctcgaccgcgaaccgctcgatctggctgcccgcgaggttggcgacgccccggtgggtgaccacgacccccttgggacggccggtggagcccgaggtgtagatgacgtacgcgggactgtccagggtcagcggcccgcgccgctcggccgccgcgggacggtggccgggcaggtccggagcgatgtcgccgcccaggaccagggccggggtgctcgtggcgatctccggcagccggcgtccggtcaccgagtccaccaggatcagggcgggccgcgcgtcgccgacgacgtacgcgatgcggtccgccgggtactcggggtcgatcggcagataggcggcccccgccttggagacggcgagcacggccaccacctggtccaccgagcggggcagcagcagcccgacgacgtcctcggagccgataccgcgcccgatgagaagccgcgccaggcggttggcgcgggcgtccagctcggcgtaggtcagctcgacgcagtggcccggcgtctcctcgtgcaccacggccaccgtgtccgggttccgggcgacccggccctcgaacagatcggggaagggcaggagggcgacgtcccgatcggactcccgacggtcccggcccagccgttccgcctcgtcggcggtgaggacgccgacgcgtccgaccggccgttccgggtccgtcacgatgagttcgagcacggccctcagacggtcgccgagggcggccacccggtcggcggtgaagctctccggccggtagtcgaagcggagttcgaggccctcgcccgggacgacggccagggagagcgggtagtgcgccgcatcacgcacgcgggctccggcagccctcagaccggtgccgggcagatcgagcgtcgccggatccagcgggtagttctcgaagacgagcagcgtgtcgaacagctcaccgagcccggtccgcgcgccgatctccgcgagaccgacgtggtggtggtccagcagctccgcctgctcctcctggacccgctccagcagcccggccagcgatacggcccggtcgagcacgacccgcaccggcagggtgttgctgaacagtcccgtcatgtcctcgacccccggcagatcggccgggcggccggagacggtggcgccgaagacgacgtcctcgcggccggtgagccgggacagcagcagcgcccaggcgccctggaggacggtgttcacggtgagcccgcgcgagcgggcccaggcgtgcagctgggcggtgaagggctccggcagccggacggagagccgctccggaaggcccgc

SEQ ID NO: 3340 - DNA, 7847 bp, Unknown
  Kingdom: Bacteria, Phylum: Actinobacteria, Class: Actinobacteria, Order: Streptomycetales, Family: Streptomycetaceae, Genus: Streptomyces
ggcaccgagcacatcctgctggccctgctggagttcgagggcggctccggcgtgctgagcggcctcggcgtggagaaggacgccgcctcggcggccgtcgaggcggcggtgaccgaagcggccgccgccctgtggcagcagaagtcctgaccggacggaccccggtgcgcggacggcgggttctcagtgcaccgagaacccgccgtccacgaacaccgactgaccggtgacgtacgccgaggaacgccccgccaggaacaccgcggcccccgcgaagtcctccccgagcccgttgcggccgaccagggtccgggcggcgagcgacgccaccttctccgggtccgaggcgaggctctggttcagcggcgtcagcacgaaaccgggcaccagcgtgttcacggtgaccccgtgcggagaccacgcctcggcctgggagcgggccagggactccaggccgcccttggacaccccgtacgcgccgctgtccacgaaggcccggtgcgcctgctgcgaggtgatgtggatgatccgcccgtagccgcgctcggccatgccgggaccgaagcgctgccccagcaggaacggggccttcaggttcacggccatcgtggtgtcccagacgtcctcgccgagctcggtcatcggcgggcgcagattgatcccggcgcagttcaccagaatgtccggctccccgaacgcctgcgcggcctcatccgctcccgcgcgcacgccctcggcggtgctcaggtccgcgctcacccaggcggcccggcagccctcggcggtcagctcgtccacggtcgccctcagctcggcctcccggcgggccaccacgacgacgcccgcgccggcccgggccagggcgccggtgatcacccggccgatgccagagctgccgccggtgaccaccgccacccggccttccagcgagaacagttccgaaacgtaagcgtgtgcactcatgtgcgtactttagatatctgctcggatcccccgcccgggtggggtgggggatcggtgaacgccgcgcgccctgtggtgcggaacctggccgggatgggaccctagtggtatgaacatccctttcttggacaactggcgtaagcgtcagggtggtacgcattcaggcgcactcgccgccgccgtcgaggcagaccccgacggcgtggccgaactgctcgccgaatgcgaactgctgcgcgtccgggcggggcagcacggactcgaactcgatgacacacccgcctcgttggccgcgctcgaccagctgccgccccgctggcgcgacgaccccgaggagcttccctggctcggcaacgacgccggtctctacctcggcaccgtgatcgtgcggaccgtcccgggtgcggcgtgggacgtctggccgagcggacagcccgtggtgcggctggagtccgggcgggagatcgacgtcgtcgcggccggtctcgactgggcgatggcgggcagccccgagctctcccaggtgtacgcggagtccgccgagaactgagccgtcggccggccgggaccactctcctctcctaatccagttaaaaagccttttgcgccatttacgcgtgtcgggtgcgaagtcccttttcgggatggatagtttgcgctgacctcgacacagcgacaagtgggtagggcagcgcatggccgtcgatccgttgatcgaactgcgggacgtcaacaaacacttcggggagttgcacgtacttcaggacatcaatctcaccgtcggccgcggggaggtggtggtggtcatcggcccctccggctcggggaaatccaccctgtgccgggcgatcaaccggctggagacgatcgagtccggcagcatcatgatcgacggcagaccccttcccgaggagggcaagggcctggcccagctccgtgccgaagtcggcatggtcttccagtcgttcaacctcttcgcccacaagaccgtgctggacaacgtctcgctggcacagctcaaggtccgcaagcgcaagaaggacgaggccgaccggcgctccggcgaactgctggagcgggtcggcctggccgcccacgccggcaagttcccggcccagctctccggcggtcagcagcagcgcgtggccatcgcccgcgctctggccatggaccccaaggcgctcctcttcgacgagcccacctccgcgctcgacccggagatgatcaacgaggtcctggaggtcatgcagcagctcgcccgggacggtatgaccatggtcgtggtcacccacgagatgggcttcgcccgctccgcggcgaaccgcgtggtgttcatgtccgacggctgcgtcgtcgaggaccgcaccccggaggacttcttcacgtccccgtcgagcgaccgcgccaaggacttcctttccaagatcctcaagcactgaggggaggcctccatgttgcgcacgacgaacacgcgtacgggcagggccgccgccctcgtggcgggtctcctgctcgccgcactcgccgcgggctgcggcaaggacggcagcccgccggtcaagggtcccaaggccgaggccctgccggtgtaccaggtcgacaccggcttcgaactgcccgattcccgcacctggaccagggcgaagaagcgcggccacctggtggtcggcgccaaggaggaccagccgtacctgggggagaaggacccggcgagcgggatctactccgggttcgacatcgagatcgcccggatgatgtcggcctcgctcggcttcgaaccgaagacgatccgcttccgcacgatcgcctcggccaaccgcgagacggccctgcagaacggccagatcgactactacgtcggcacctacaccatcaacgacatgcgcaagaagctcgtcggcttcgccggcccgtactacatggcgggccagggcctgctggtacgcaccgacgagaacgacatcaacgggccccaggacctggcgggcaggaccgtctgttcggcggccggctccacgccctaccagcgcatcgccgccgactacccgaaggcgacgctcgtcgcgtacgacacgtactcgatctgcgtcgacaacctcctcaccttccaggtcgacgccgtcaccaccgacgacgcgatcctgctgggcttcgcggccaaggcgcccgacgagatgaaggttgtcggcaaacccttctccgaggagccgtacggcatcggcgtaccgcgcagcgacaacgcgctgcgcaacgcgctcaacgacgcgctggaggccaacgagaagaacggcaactggaagaaggcgtacgaagcgacgctggggctctccggagcgcccgcgccgaccccgccgccgatcgaccgctacccggcgaactgaggggacggccccacccatggatgtactgacagagaacttctccctctacggcaagggcttcctcggcaccgtcgagctgaccgtctacgcctccgcgctggcgctcgtcctcggcttcctgatggcgtccttccgggtcgcgcccgtcggctccttccgggtactgggcacggtctgggtcaccgtgctccgcaacaccccgctgacactgctgttcttcgcggtcctgctcggcctcccccgcttcgggctcgtcctgccgttccagttcttcgcggtgctggcgctcggctgctacacctcggccttcatctgcgaggtgctgcgctccggcatcaacaccgtgcccaagggccagggcgaggccgcccgcagcctcggcatgaacttcggccagaccctgagcaccgtggtgctgccgcaggcgttccggtcggtgatcccgccggtcggctcgacactgatcgcgctggcgaagaactccgcgatcgccggggcgttcagcgtcaccgaactcctcggcacctacaagacgctcaacgagctgggctacagcatcatctggtccttcatctggatcgccgtcggctacctgatcatcaccctgaccatcagcgcggtgttcaacgtgatggagaagcgctggggagtggcacgatgaccaagaccctcacccgcaggcccacgctgccgacggccaccgcgctctacgacatccccggcccggtgacccgcaaacggcacctgatgtacgggatcgcctcgacggtcctgatcctggcgctgttcggctggatcgtctatctgctcttcgacaccgaccagttcaccgccgagaagtggacgcccttcgagtacaagggcatccaggaactgctgctgcgcggactcggcaacacgctcaaggcgttcgcgtacgccgcggtcctctcgctcgtcctgggcgcgatcctcgcggtcggccggctctccgaacaccgggtgctgcgctggatctccaccctgctggtcgagttcttccgggccatgccggtgctggtgatgatcttcttcatcttcgtggcgctgaaggtccagccgctgcccgcgctggtcgccgggctgacgctctacaacggctccgtcctcgcggaggtgttccgcaccgggatcaactccgtggaccggggccagcgcgaggcggcgtacgcgctgggtatgcgcaagacgcaggtcaccacgttcgtcctggctccccaggccgtacgcgcgatgctgccgaccatcatcagtcagctggtggtcgcgctcaaggacacctcactgggctatctgatcacctacgaggaattcctccacgcgggaaagctgatcgcgtcgaatctcgactacgatcttcccttcatccccgtcgtgatggtgatctctccgatctacatcgggatgtgcatgctgctctcgtggttcgccacctgggtggcccgtcgtcagcggcgcagtccgaagacggaggcggtgggggtggccccggccgaaccggggacgctgctgccgggaggacagtagccgggccctgcccgcccggcagcagtcggtgatcacttctcgcgcagcgggaccgagagatgactcgggtccgtgccgggtgaggagaaggtcagctgcgcgccggtcgggttgtgctcgatgtacagcggatcgacggtgtcgatcaccagggcgagccggtgaccggccggaacgtcgtaggccgtggagtacagctccaggtcgacggggaacggccggcccggcgtctgcccgtggaaggtgtacggagcattgctgaccagtttgccgatgccgagcggccccacgtcgtagagatacgcgacgagggtgccgctcggcttcgtggcggtgaccgtggtgtgcagcgcggacgtcccccggatccgctgcgcggtggcgtaccgctccgactgccatacgctcgcgaaggtacgcggcagcagcggcacggagaccgtcggaggcagcttcaggaactggtccagcgcgttggacaggatcgcgatcccgccgttggcgcccgagtcgacgttcgcccacacctgcttggtgccgtccagtggcatccggttcttcaccgcgcccacggacttccagtccgggtagccctcgtacccctggtcggtgcgggacttgagctggaccggcagctcggtgtcgatgccgttgcgctcgtcctggagatagcggtcgaaccagcggcgggtactcgtccaggtgtcgttagggagcccgagcaggccggtggcctcggcggtggcatggtcaccggggcggaactccagccgcttggggccggtgagcttgtcgtagaaagaggcgtactggttgggcgggaagatggtgtcgccccaggcgttgcccatcatgatcgccgcgccgttggcgttgatccggtccagatacgtcgcgggggagcgcttcttcccccaggcgatcatctccggctccttctccaggtcggagccgaggaagtccttgagcgtccgcgtcagttcgtcgcccgggcggccggtgaccaggccggcgccgccgagcagggcggccgcctggaggtgctgggtgcgcccgctgtagatcgagtcgatcaggtcggcccagccgctgagcgcggccaccgccttgatgcgcgggtcgtgcccggccgccagcaggctgatgcccgccccgtaggagacgccgcccatgccgatgcggtccgggtcggcggaggtgtgctccagcgcccagtcgatgacggcggaggcgtccgcgatgtccggggggcccgcgacctcgatcttcccgcccgagagccagaagccgcgcgaggtgtaactcaccacgacgtaaccggagtcggcgagcttctgagcctgggccagatactcgatctgcggcatggcccagctggtcgggaagacgatcagcggatgcttcttcccggccgccgctccggcgggcgtgaagacgttgcccttcagggtgattcccccggagccggggatgtcgtggaacgtcaggccctgtgcgatcgtgcccgcggttgcggtgccgggggccgccgtcgcggccggggccgcgacgagcgcggccccggcgagcaggacgacggcggtggtgatcgaagcggtggtgcgcagtgccggtttcggacgtgccacggggtcactcctcacgcgtgtcagtgcaaagtgacccgacggtaaccccgtttgtttaccgctggtaactaccgggtgcgttgcgtgagggtaacgattgttggacgtggcgtcagtagtgctccgggtccggaacgagcgttaccgggtcacttcagggcactcctggccgcccagtcctcccacgagaggttccacgcgccgtacccgttgccctcggcgaccgtgcccttggcctgcgcgccggtcatctcgaacgggtcacccacccgcacctgcccgtacagggccgcggcgtccgcgtcgctcatcccgacgcatcccgaactccggttggcccgaccgaaatagcccgcgttccacggggccgcgtgcacgtacatcccggaccaggtcagccgcatcgagtagtcgaccatcttgtcgtaggcatcgccgaggcccaccgtctcggaacgcatgttgatggtgccctccttggacatcaggaccgcggttccccgccaggaagccttctcgccgcccggggtgcccgccgacatcgggatgtccaggacctgctttccgtcccggtgcagcgcgaggcgggaccggtcgaggtcgaccttgacgacctgggccgcgccgaccgtgaacgtcgtcgtgtagtcgcggacgaaccagccgccgtccgcacccgtgtcgaccccgttcagctgcgcgtccagggtgaccttcgtgccgggcttccagtactccttgggccgccagtccacgcggtccttgcccgagtagtcctggagccagccccaggagccctcggtgtcgttcgacgtggacaccttcagggccttctcgacggccgccttgtccttcacggggtggtcgaagacgacggacagcggctgtgcgatgcccacggtcgtgttcttccccggtgccagcgacagcttgttgaccttctcggcctcggcggtggcgaacgtggcccggtcgctgccgccgtccgtgtccttcgcctcgaccgtgtacgcggtgcccggcgcggcgacccgatcggacgtccaggtccggccgtcggcggatatcctcccggccagcgcgccgtccttgcccgccgtcaccgacaccgccttcagttttccgtgagccagcgtcaccttcaccggcccgcccggggccgccgtcctgcccttgaggttcaccgagacgtcggcgccggtcgccttgccgtccccacccacctccgcggagcccggggagccgcccgagcacgcggtgagcgcggcggctagcagggccgcgggcccggtcagggcgagccgggtcctccggccggccggggtggaac

SEQ ID NO: 3341 - DNA, 3398 bp, Unknown
  Kingdom: Bacteria, Phylum: Actinobacteria, Class: Actinobacteria, Order: Streptomycetales, Family: Streptomycetaceae, Genus: Streptomyces
agcctgtcgactcttgagttgggcctggcggcccaactccggcctgacggccggaaggtgttggtgtgtcatgcctgacggcatgacagtgagtggtgttcggcctgacggccgatgagtggcggggtgtcaggcctggcggcctgacagcgggttggtgtggtgtttgcccctaccctgccggtcaggggtgggttgtgcgcttgtcggcgctggtgatgtcatcttggtttttgggcagtgatttgatttggtgtctctctcttatcggtcgttggaaatggctcgtctgtggtggcgcggtgcagggtttggcctgacggcctggctgtttcgggcgagggtgcaacagttcggattcctgattcgtcaaaatcgacccccggtatgtatcccggctgacgcggacatcggctgcccgagcgggccgagggcctggaggcgctggacgtcgtgtgggacccgacggacgcggcgtgggaggagaacctcggtgcggcgaaggcctacttcgccgcgtggggtaacacgccggctgggccggatcggtggagcaccggacaacgactgaaggcctgatgccgggggcggagccaccggcatcaggcggtgcggcgcggccgtactccaggaggccgggtactggcatgtgcgcccgtgtcggcacgggttgggatgagcgtagtgactgtgcatcaggtgcggggcgggttggatcacgaagggccgggccgtttctgcttccgaccctggggcggtctgccgtccgtgtccttgtcgtggtgggggggtgggttcgcggtgggggcggttccctcagtcgaggtcggcgctggcgagggtgacggcgagcgcgaggtggggtacggcggccagcacagctcggccgccgtgctcgggtcggtcgcggcggcggtgcggtctcggccagcgccaggcagtccggtcaccaccactgcgtcgacggccgcgtccaggacctcgtcgaccgccagctccccgcccggccgtcagctccagcaccagggcggcggcctcctggggatcgcgtctccagcacgcggcgacctcgtcgcccgcgcccgccaagtccatcatggcccctgccccgcaggcggcagcggcaccgggccccggtccgggccgagttggtgcaccgcgtccggccaccgggccgtgtccccggaccgggccaggtccagcagcagcgggccggaacatcgcgacccgcatgcaggagagcatctgcacgtccacggcctcctggtccggcggggcggccgcgatcggcctgtacacctcccccgctgcgtccacgcacgcgccgatcaggttcgtcagggcggcgatcagccgggcatggcgacggcaacgggcaggcagtaagggtgccgggggtgcggtttcgtggtcacctgcggattgtccccgccctcgccgcccgatgggtgctgttcggcccggcggtgggcgtccgcttcgacggaacgaggccgttacggctgcaggtgcgggttctcgcgggccgggcagccctccggcaggcagcgccccggggctcaccacctcaatcgccttcatacgccctctggacacccggtcggccggactgggttacgaggcggtggcttcctcgatcgtctggcggatctccaggacgctgtcgacgccggagatcccgaaaagacgttgcacctgtcgtgagggggcgacgatgcgcagcgatcccgtccggtgggcgaggatcagcaggttcaggaacgccgaatctgcgaaggtgacagcggaggcatcgaggacgactttcgggtacttcctcgccgcggcctgcagcgcctcccggagcggagtgatcgaggccaggtcgtactcgccggacgcggcgatcacccaggccccgcggtactcgtactgtcgaggtgcggaaccgtacgaagcgtccacggtgatcctctgcggggtcagcgtcccgctggtgctgctcgtgcgcgtcgacaaggcggtctcgttccagaacacctcaggctcctcccgtgcttcttccgtaccggtaacacgtcgtcggtgacaggaaaaatatgtcatgtaacgtgcttccggcaacccgcgtcccctaaaatggtgagcatggccgctgtacctgagtcccacaccggatggacgttcatcaccagccacgcgcgcgtgctggcagccatcgccgacgatccgaacatccgcatccgcgagatcgccgcccactgccggctcaccgagcgcgccgtgtcgcggatcatctccgacctggaacaggacggatacctctcacacacccgtgaaggacgcacgaacacctaccgcatcggcccggacaaagtgctgcgccaccccgccgaagccggcctgcccgtggcctcgctgctctctctgctcgtccaggacgaaaccgagcgcaccggcaccccggccacccccgagcagcatccggtggacatcaccgccgcggggtagcacaggaccgccccgggccagttccccgggccgtcggcacggcaccgctattgtccgagtccccgttgggagggacggtgtgctggtgggcgatgtgttcctggtctatggcgcgttgcaggtgccacacggtgaccgcggggagcgggccgccgagccggcgcggctgctcgcaggttgtgggcgggggcgacgtcgtcggcccactgtaggccttgtccgcggcgaggctgtcgggcttcttgcgaggtctgctgggcccggacggggaacgcggatcttctccagcacaggctggaactgcgtgcagtccgcccgctgtcccggcgtgacgatcaaggacagcgggtggcagtggccgtccgcgctcaggtggagttcggtggtgaacccgccgcgcgagcggcccaggccctcaccttcaccaggcggccgtgaagactctgcaactctcgtcctggtggtctcctaccgcggcccctttgaggcgggtgccggcggtggatcggtgcgggcgccggctgcgtgctggtgagcacggacgacggtggagtcgaccgagatgtcccagtcgatctcacccgccgcgtcggcctcggccgggacttgttggagcaggcgctcccaggtcccgtcggccgaccacagccggtggcgttcatagaccgtcttccacgggccgaaccgttcgggcaggtcacgccactggacgccggcccgcacccggtgcaggatctcgtcgatcacctgccacaacgcccgttgccgaccggcaggcacggccgcaaccgttcccactcggcatcgttcagatcaccccgccccagccgcctaggagctgtccggccgatcatgtgactaccgctcgtcagggtcgttgatgcgggcctggggcggggtgatctgaa

SEQ ID NO: 3342 - DNA, 2639 bp, Unknown
  Kingdom: Bacteria, Phylum: Actinobacteria, Class: Actinobacteria, Order: Streptomycetales, Family: Streptomycetaceae, Genus: Streptomyces
caacggattcaacggattcagcggatcgaggagacgcccatggcccagcagctgagcccgtcacccccggctcccggcgagggacagtcccaacggagcgtcctggtggcgatcggagcgctgctcctcggcatgctgctcgcggcactcgatcagaccatcgtctccacggcgctcccgacgatcgtcagtgaactcggcggcctcgaccacctgtcctgggtggtgaccgcctatctgctggcggccaccgcggcgaccccgctgtggggcaagctcggcgaccagtacggccgcaagaagctcttccagaccgcgatcgtgatcttcctgatcggctccgcgctctgcggagtcgcccagaacatgccccagctgatcggcttccgcgccctccagggactcggcggcggcgggctcatggtgctgtcgatggccatcgtcggcgacctggtcacaccgcgcgaacgcggcaagtaccaggggctcttcggcgcggtcttcggcgtgacgagcgtcctcgggccgctcctcggcggccttttcaccgaacacctcagctggcgctgggtcttctacatcaacctgccgatcggcgtcgtcgcgctggtcgtcatcgcggccgtcctgcacatcccggtccgccgcgagaagcacaccatcgactacctcggcaccttcctcatcgcgtccgtcgccaccgtcctggtgctcgtcgcctccctcggcggtacgacctgggcctggagctccccgcagatcatcgggctcgcggtgctcgccgtcgtgctgctcgtggccttcatcgccgtcgagcggcgcgcggtcgagcccgtgctgccgctgaaactgttccggatgaggaccttctctctcgtcgccgtgatcagcttcgtcatcggcttcgccatgttcggcgcgatgacctacctgccgacgttcctccaggtggtccacgacatcaccccgacgatgtccggcgtgcacatgctgccgatggtgttcggcctgctgatcacctcgaccggttccggccagatcgtcagccggaccggccgctggaaggtcttccccatcctgggcacggccatcaccgccgtcgggctgctgctgctgcaccagctcgacgagaacagctccacctggctgatgagcgcctacttcttcgtcttcggcgccggtctcggcctggtgatgcaggtcctcgtcctggtcgcccagaactccgtctcctaccaggacctcggtgtcgccacctccggtgtgacgttcttccggtccatcggctccgcgttcggcgtggccatcttcgggaccatcttcgccaaccggctgaccgggcagctcacggacgcgctcgccgggcagccactgccgacgggcgtcgacgcggggcggctggccgccgatccccgggccatcgggcaactcccggccgacctgcggccctccgtcctcggcgcgtactccacgtccatcacggacgtcttcctgtacgccgtcccggtggtcctcctggccttcgtcctcgcctggttcctccgcgaggacaagctccggggctcggtgaccgcccccgacaccagtcagacactcgcctccaaccccgtcgagcgctcctcgtacgacgagtgcgcccgcgcactgtcggtgctcgccacccgggagggccgccgcgagatctacgaggagatcaccgcgcgggcggggtacgacctgctgcccgccgccagctggctgctcctgcggatcaagcggcacggcaccgtcgaacccgcccggctcgccgagacggcacccgtaccgctgcacgtgatcaccgatgcggcccggcaggtcgaggaacgcggactggcccgccgggagggcctgcaaatgatcctcaccgacaccggggccgaggccgtcgtccggctctcgcaggcccgcgaggactccctcgccgaactcctcggcgactggtggggtcccgagcgccccaccgacctggtccaactcgtcagcgaactgaccgccgaggtcagtggctcgaccagggaacgtccccactccccgcagccaccccgcgaccacgaggcccacctgcgccacgacgagcgcgaggcccacgaccggcgctccgacgacagcgacgaccacggccgccaccacccgtccgcctgagcacctgcctgtctgagcacctgagcacctgacggtgtccgtgctcggggccgcccgacaggccgggcaccgccgtcacagctccttggcgaaccagtgctccgcgtacgggttgcgccggtggaacgccggcacctcccggtacccgtgtttcgtgtacagcccgcgcgcctcgaccaggtcgttgcgggtgtccagccgcagcagccgtacgccgtacgccctcgccgcctcctccaccgaggccagcagcagcccgccgccgcccgtgccccggaacgccgggcgtacgtacacccgggtcagctccgccgtgcccggcccggcggactccgtcagcaccagcccggcgcagctcgcggcgctgctcccgtaccggccgacgacgaactgtccggtcggcggtgcgagcaggtcggctccgtcgccgtcgagcccgtcatcgatctcctcggcggtcgcgggccgctgccagt

SEQ ID NO: 3343 - DNA, 10714 bp, Unknown
  Kingdom: Bacteria, Phylum: Actinobacteria, Class: Actinobacteria, Order: Streptomycetales, Family: Streptomycetaceae, Genus: Streptomyces
ccgcgaccctggccgtccgggattgtgagcatccccggatcccgtgtatggtttacctcgttgccacagcgcaacgaggccccaatagctcagtcggtagagcgtctccatggtaaggagaaggtctgcggttcgattccgcattggggctcagagaaaagcgaaaggcccccgccaatggcgggggcctttcgctttgaagggtcagacgaggggtggttccggcacacgcatggcgaggatcgccatgtcgtccgaggccggctcggcagcgaagcgttcaacggcccgcagaatgcgtgaggcgaccgctccggccgtcaggcccgtacaggtcgacaggacgtccgcgagaccgtcgtcgcccagcatgcggcttccctcgcggcgttcggtgacgccgtccgtgacacacaggaggacgtcacccgggttgaggacgacctcctgttcgtacagttcgaggtcctcgatcacgccgagcaggggctgcggttccgcggcggactcgaccgagccgtcctggcgcaggcgcagcggcagcgggtggccggcgcagacgaccttcagcagcgcgctgccgtcctcctggggccacagctcgccgtacaggagggtcaggaagcggctgcgggccccctcgtcgaggatcgccgcgttgaggcgctccaggaccgccggaccgccgaagccctcgcgtgccagcagacgcagcgcgtggcgggccaggcccgtgacggccgcggcctcgggccccgtaccgcacacgtcgccgatggcgaagccgtacgcgccgtcgctgatcgggaagacgtcgtagaagtcgccgccgacctcgttgccctcgcccgcggcgcggtagatgacctcgatctcgacgttcggcacgtccgggaggcccgggggcagcaggctgcgctggagggactggctgatcgccatgcgctccgagtacagccgggcgttgtccagggccagggcggccctgcgggagaggtcctcggccagttccaggatctcctggcggaagtggtcgtccgagggctttccgagcgtcagcatgccgatcacacggttgcgggcgaccagcgggagaaccaccgtctccccgccgacggcctgggccgtggccaggatggtgcgggtggccgtactcatgctcagcggcgcgtcgtgctgcaggctgcgggtcgaggtgctcagcgcggcacggtgaccggcctccgagggagcggcccagacacgcgcgcccggagtcggtacgggatccggcggggccatcttggagagcagggccttgagcccgtcgatgaggtcctcgtcctcgtggaggacgtaggagaggtacggctcggaggactggtccgcgatcgtgtagacggcgcaccaggtggccagggtcgggaccgtcatctgggccatgagcgccagggtctggtcccggtcgagcgtgccggccagcaggtcggaggcctcgacgaggaaggacagggagccgcggcgcagccgttccagctcgcccaggcgggcggactccacggccagcgcgatgcggtccgccgcgaactggaggcgcagggcctcctcgttggtgtagcggcccgcgccttccgccgcgacgccgagggagccggtgaggcggccctcgaccttcagcgggaccgtgacgaccgagcgcatccccgtgtcggtgagcaggggcacggcgccggggacggcggtgaggtcctcgtggacggccggcatccgggcggagccgtagcgtcccgtcccggcttcgacggggacccgggcgaagcgctgacgggccgaggggaggccggtcgtggcgcggacctccagctccgtctcgtcgtccgtggcgagcaggaggaacgccgcgtcggcgtcgagcatgtcgcgtgcccgctcgaccgtccgctggaggaggccgtccaggtcgtcgggggccggggagccgatgaacacctcgaacgggtccgccgtgcggttgtcggaggaggtgtcggagaccggagcgcggacgggggactggagcacggcgcgctcgtcgtcccgtacgaggagacagaccgtggagggttcgccgtcggtgtcgcggacccgcaggtgcgaggagtagacggcgatggtccggccgtcggcgccgcggattccgtagctgccctcccagcgggagagctggagggcgtcggcgatgccggtgttggtcccgggggtgtgcggccaggccacgaagtcggtgaactgcttgccggtgacctgttccgcggtgtgcccgaagacgtacgcggcgtcgtcgttccacgcgctgatcgcgccggcgctgtcgatctgcacgacggcgacccggacccgctggtcggtgacggggagcagcgaggtgggcaggacggggcccgcggagcggatgcccaccggccggtcgggcaggtccagctggaaccagacgtgcttgcgggtgggggagtactcgacgccccagcgggaggccagggcggcgcagagcagcagaccgcggccgttctcgcggtcggggctgccgaagtcgaggccgttgctctggagcgggacctcgcgttccggatagtggtcggcgacctcgacgcggacgccgtccccgctgcgcaggcacagcacgtcggccgccgtccccgcgtgcacgacggcgttggtcacgagctcactggtgaggacgacggcatcgtcgaccacatcgttgtagccccacccctggagcgtgtcccggacgaaggcgcgggcggtcgcgacggagcgcccgaccggttcgaaggtggcggccgcgcgcgcggtgatcacagcactccccatatggtgtctcgtcgcttccccgagtcctgtgcccgtttatcgccgcttcgattcgcttgccaggctagacgttcgtcaagggtgtcggttacacgagggccgagttcgggacaggacggtccggcagtggtgcgcgggcgcacaagtatggactcctggtgcaaggcatggggggcaaccgggacaggttgcccgccgaccggtcccggcctggtacgttgcaacgatttgacgttcgcccggtcgcccgttgacggtgtgctgtggcggtgagccaaagtggaactgggcaagcttccggataggcccgagtgaaacggtcaacccctgcgggagggacacggtggagtctggcgtggcggcgcagggttcgaaggcgcgtacaaaaggcggacagtccgtgaaaaagcagcgcaatggcaccgtcgaagtggacgcggcagctctgaacagactgctcgcgggcctcgtggcgatgcgcgacggcaacttccgtcggcggctcaccgtctccggcgacggcgtgatgacggagatctcggcggtcttcaacgaggtcgcggaccgcaatctccacctcaccggcgagctggcccgtgtgcggcgcgtggtcggccgggaggggaagctcacggagcggctggagacgggcgcctgcgagggttcctgggccgccgcgatcgacgcctccaacgagctcgtcgacgatctcgcgcgaccggtctccgaggtgggccgggtgctgtcggcggtcgccgacggtgatctggagcagcggatggagctgcggtcgcacacgacggacgagacggtccggccgctgcgcggcgagttcctgaaggtcgcccgtacggtcaacaacctggtcgaccagttgtcggtcttcacggagcaggtgacccgggtcgccgtcgaggtgggcaccgagggcaagctcggcgggcaggcgcaggtgcgcgggatgtccgggtcctggaaggacctcacggactccgtgaacaccatggcgtaccggctgacggcccaggtgcgggacatcgcgctggtgacgactgcggtcgccaagggcgatctgtcgcggaaggtcaccgtccatgtggccggcgagatgctccagctgaagaacaccgtcaacacgatggtcgaccagttgtcctcgttctcctccgaggtgacgcgtgtcgcccgtgaggtgggtacggagggcgagctgggcggtcaggcgaccgtgccgggtgtggcaggtgtgtggaaggacctcaccgactccgtcaacacgatggcgggcaacctcacctcccaggtgcgcgggatcgcggaggtgacgacggcggtcgccagcggtgacctgacgcagaaggtcacggtgagcgcacgcggcgaagtcgcgcagctcgccgagacgatcaaccagatgaccgagacgctgcgcaccttcgcggacgaagtgacgcgggtggcgagcgaggtcggtggcgagggactgctcggcggtcaggcacaggtgccgggcgcggccgggacctggaaggacctcaccgactcggtgaacacggtcttccggaacctgacgacccaggtgcgcgacatcgcgcaggtgacgacggcggtggccagcggcgacatgtcgcagaaggtcacggtcgacgtggccggggagatgctggagctgaagaacaccgtcaacacgatggtggaccagcttcagtccttcggttccgaggtgacccgcgtggcccgggaggtcggcgtcgagggccggctcgggggccaggccgaggtgccgggggccgccgggacctggaaggacctcaccgactcggtgaacaccgcgttccgcaacctgaccggtcaggtccgggacatcgcgcaggtcaccacggcggtcgcgaacggtgacctgtcgcagaaggtcaccgtggacgtggccggggagatgctggagctgaagaacaccgtcaacacgatggtggcgcagctgtccagcttcgccgaccaggtgacgcggatggcccgggacgtgggcaccgagggccgcctcggcggtcaggcgcgcgtggacggtgtgtcgggtacgtggaaggagctcacggactccgtcaacttcatggccgggaacctcacctcccaggtgaggcagatcgcgcaggtgacgacggcggtggcgcggggtgacctgtcgcagaagatcgacgtggacgcccggggcgagatcctggagctgaagaacaccatcaacaccatggtcgaccagctctccgccttcgccgaccaggtcacccgggtggcccgcgaggtgggcacggacgggcgtctcggtggtcaggcgcaggtgcccggcgtggccggagtatggcgcgatctcaccgattcggtgaacggcatggccggaaacctcaccgctcaggtccgtaacatcgcgcaggtcgccacggcggtcgcgcgaggtgatctgtcgcagaagatcgacgtggacgcccggggcgagatcctggagctgaagaacaccctcaacacgatggtggaccagctgtccaacttcgcggagcaggtgacgcgggtcgcccgtgaggtgggtacggagggcatcctcggcggtcaggccgaggtccagggcgtgtccggtacgtggaaggacctcacccagtccgtcaacggcatggcgaacaacctgaccctccaggtccgcaacatcgccgaggtcaccaccgcggtcgccaagggcgatctctccaagaagatcactgtcgacgccaagggcgagatcctcgaactggtcacgaccgtcaacacgatggtggaccagctgctgaacttcgcggacgaggtctcgcgcgtggcccgcgaggtgggtacggagggaattctcggtggtcaggcgcgggtgcgtggggcgaccggcatctggaaggacctcagcgagaacgtcaacctgatggccaacaacctgaccagccaggtgcgcaacatctcccgggtctcctcggcggtcgccaacggcgatctgacgaagaaggtcaccgtggaggcgcgcggcgaggtcgcggagctggccgacaccgtcaacacgatggtgacgacgctgtcctcgttcgccgacgaggtcacgcgcgtggcccgtgaggtgggtacggagggcgagctgggcggccaggcgcgggtgccgggagtcgccggtacgtggaaggacctcaccgagtccgtgaactcgatggcctccaacctgaccggccaggtgcggcagatcgccacggtcaccaccgccatcgccaagggcgacctgaccaagaagatcgacatcgacgcgcgcggtgagatccaggagctgaagaacaccatcaacacgatggtcgaccagctgtcctcgttcgcggagcaggtgacccgggtggcccgtgaggtgggcaccgaggggcagttgggcggtcaggcgcgggtgcgcgacgtcgacggcacctggcgcgacctcaccgagtcggtgaacgagatggccgggaacctgacccgtcaggtccgcgccatcgcggccgtcgccaccgcggtgacccgcggcgatctgaacctgaagatcgacgtcgacgcggccggcgagatccaggtcctccaggacaacatcaacacgatgatcgcgaacctgcgcgacaccaccctcgccaacaaggagcaggactggctgaagggcaacctggcccggatctccggtctgatgcagggccgccgcgatctggacgacgtggcctcgctgatcatgagcgagctgacgccggtggtctcggcgcagcacggcgcgttcttcctggccatgaccgcgggcgactcggacgaggtgggtccggacgacgatgcgggcagcgcgtacgagctgcggatgcgggggagttacggctactcggcgggttcgatgccgacctccttccggcccggtgagacgctcatcgggacggcggccgaggagaagcggacgatccaggtggacaacgtgccgccgggctatctgaagatctcctccgggctgggggaggcccctccggcgcatgtgatcgtgctgccggtgctcttcgagggcaaggtactcggcgtgatcgaactggcctccttccagccgttcacgcacatccagcgggacttcctcaaccagctcgccgagatgatcgcgacgagcgtcaacacgatcagcgtcaacaccaagaccgagaagcttctggaacagtcgcaggagctgaccgagcaactgcgtgaccgctcgcaggagttggagaaccggcagaaggccctccaggcgtccaacgccgagctggaggagaaggccgagctgttggcccagcagaaccgcgacatcgaggtgaagaacaccgagatcgaggaggcgcggcaggtgctggaggagcgggccgagcagctcgcggtctcgatgcgctacaagtccgagttcctggcgaacatgtcgcacgagctgcgtacgccgctcaactcgttgctgatcctggccaagctgctggcggacaacgccgagggcaacctctcgccgaagcaggtggagttcgccgagacaattcacggggccggttccgacctgctccagctgatcaacgacatcctcgacctgtcgaaggtcgaggcgggcaagatggacgtcagcccgaccaggatcgcgctggtccagctggtcgactacgtggaggcgaccttccgcccgctcaccgcggagaaggggctcgacttctccgtacgggtgtcgccggagcttccggcgacgctgcacaccgacgagcagcgcctgctgcaggtgttgcgcaacctgctctccaacgcggtgaagttcaccgacagcggtgcggtggagctggtgatccggccggccggcgcggatgtgcccaacgcgatccgggagcacctgctggaggccggttcgctgcgggacgcggacgccgatctgatcgccttctcggtcaccgacaccgggatcgggatcgcgtccagcaagatgctggtgatcttcgaggcgttcaagcaggcggacgggacgacgagccggaagtacggcggtaccggcctcggtctctccatcagccgggagatcgcccggctgctcggcggcgagatccacgcggcgagcgagccgggacgcggttccaccttcaccctgtacctgccgttgcaccgcgcggagctgccgccccagggctaccccccggcgggttccggttccgccgaggtgctgggcggcgcgggcgagatggggcacacgcagtccccgcagggccagtcggctccgttcggcgacccggccaactccgccggggtgttccggcgacgcaaggccctcggggacgcggcccgcagggccgcgctgccggccggccgcaccacgcccgaaagctccccgcagcaggaggagtgggtgcaggggagccagggcgagagccaggtccagggccaggcggcggcggaggaggagcgggaaccccggcggacgttccgcttccgcggtgagaaggtcctcatcgtcgacgacgacatccgtaacgtcttcgcgctcaccagcgtgctggagcagcacgggctggcggtgctgtacgcggagaacggccgcgagggcatcgaagtcctggagcagcacgacgatgtgacggtcgtgctgatggacatcatgatgccggagatggacggttacgcgacgacgaccgcgatccgtcggatgccgcagttcgccggactgccgatcgtcgcgctcaccgcgaaggcgatgaagggcgaccgggagaaggccatcgattgcggggcttccgactatgtgacgaagccggtcgaccctgatcacttgctcgcggtgatggagcagtggatgcacggagagtgatcgagaattgtacgaacgagcgtaatttgttgaccgactgtgctcgaacgggtgtgaacgcgctgtattcggggaaccttctggtctcccaccgcgtttgcggtatgtgcacagtgacatcgcggtgacagggtgtggtgacgggcggggtgcggctaccatgaccggcacaaggacggacggcgtaagggagtcgtcccctggggcggcacccggtgcatttccggggcgaggaggacgggccatggtgcagaaggccaagatcctcctggtcgatgaccggccggagaatctgctggcgctggaggccatcctctctgcgctcgatcagacactggttcgggcatcgtcaggggaggaggcgctcaaagcgctgctcacggacgacttcgcggtcatcctgctggacgtccagatgccgggcatggacggtttcgagacggccgcgcacatcaagcggcgggagcggacccgggacatcccgatcatcttcctcaccgcgatcaaccatggtccgcaccacaccttccgcggctacgcggccggtgccgtggactacatctcgaagccgttcgacccgtgggtgctgcgggccaaggtctcggtcttcgtcgagctgtacatgaagaactgcaagctccgcgagcaggccgcgctgctgcgactccagttggagggcgacggccacgcgggcggcgagcaggagaaggagccggccggtctgctggccgaactctccgcgcggctcgcggcggtagaggagcaggcggaagcgctctccaagcagctcgacgacgaatccgcggacgccgcggcggtagccaccgccgcccatctcgaacgcaagctgaccggcctgcgccgcgcgctcgacgcgctggagccgggcaccggcgggggtacgggcgtgctgcccgcacagagctgacgagattcccgtccctccggctcggcgcgtgccggccgccgccgtgaggcgacgtcagttcccggcccctcgaaggcgacacggtcgggtgaacccgtaggcgaacgtgttcacggacgacgacagcggtaacctcggcaccatggcctcacgtacgtccggcaagggttcccagggcacggcgggcaccgcgaagcgcgtcggccgtaccgcgggcccggcgaagaaagccgcgcccgccaagaagaccgcgcccaagaagtcggctgctcccgcgaagaaggctcccgcgaagaaggtggcggccaagaagcccgcgcccaaacccgcaccgtcacccaccggaggcatctaccggctggtccgggccgtctggctcggagcggcgcacggcgtcggcgcgctgttccgctcgatagggcgcggagccaagggacttgaccccgcccaccgcaaggacgggctcgcgctgctcctgctcggcctggcgctgatcgtcgccgcgggcacctggtccaatctccagggtccggtcggcgacctggtcgagatgctggtgaccggggccttcggccggctcgacctgctcgcgccgatactgctgggcgccatggcggtgcggctgatcctgtacccggagcggcccgaggccaacggccgtatcgtcatcgggctgtccgccctggtcatcggagtcctcggccaggtccacatcgcctgcggctcgccgggccgggacgaaggcaccgaggcgatgcaggacgcgggcgggctggtcggctgggccacctccaggccgctgatcttcatgatgggcgaggtgctcgccgtaccgctgctggtactgctgaccgtgttcgggctcctcgtcgtcaccgccaccccggtcaacgccattccgcagcggctgcgtcagctcggggtccgcctcggcatcgtggaaccggcgcccgaggccggcgaggggtacgaggacgacgacgagcgctacgacgaacagtggcgcgaggcgctgcccgagcggacccgtcggcgcggcgcgcgtcgcacggacgcggacccggtccacgaccacgaccaggccgaggcggaag

SEQ ID NO: 3344 - DNA, 15087 bp, Unknown
  Kingdom: Bacteria, Phylum: Actinobacteria, Class: Actinobacteria, Order: Streptomycetales, Family: Streptomycetaceae, Genus: Streptomyces
gccctggtctcccgccccgccaacgtccgctatctcgcgggcggagcgccgcccggcgccgtgctgctgctcggccccggagaggacgttctgctctgcccccgagccccgaccggtgaacccgcccacggacggcccgacgaggcgctccggatcgatctcctgcccgttccggacggggacccggtggtcgccgccgcgggcctcgcggcctcggcgggcgcggattcgctggccgtcgaggagcacgatctgaccgtggcccggcaccgcgccatggggaaggccgccccgcgcctccggctggccgatctgggcttcaccgtggagcagcagcggatcgtcaaggacgaggaggagatcggctgcctccggatcgccgccgagatcaccgaccaggcactcggcgaactcctcgaatcgatcctggtcggccgcaccgagcggcatctcgccctcgaactggagcgccgactggtcgaccacggggcggacggccccgccttcgccacctccgtggccaccggccccaactccggtcagggacggcaccggccctcggaccgcagagtggaggagggggatttcctctccgtccgcctcggggcgagctaccacggctaccgctgcgagatcggccggaccttcgtcatcggcactgcccccgccgcgtggcagatcgagctctacgacctcgttttcgccgctcagcgggccggccgggaagccctggcgccgggggccgcctaccgggacgtggaccgtgcggcccggcatccgctggagtcggcgggtcatggagagggtcttcagccgaggaccgggcacggtgtgggcctcgaaatcgaggaggacccgcaactggcaccgacagccatgggtaaactggacgcttgtgtgccggtcaccgtcgaaccgggggtccacctcccgggccggggcggtgtccggatcgatgacacgctcgtcgtgcgccccgaggcggacggcggacccgagctactcaccatgacgaccaaggagctgctcgcgctctagcgcgcatcctcggtcgttccaccagcttcagtccaggagattccgcaaccgtggcttccacgaacgacctcaagaacggcctggtgctcaagctcgacggaggccagctctggtccgtcgtcgagttccagcacgtcaagcccggcaagggccccgccttcgtgcgcaccaagctcaagaacgtgctctccggcaaggtcgtcgacaagacgttcaacgccggcgtgaaggtcgagacggccaccattgaccgccgcgacatgcagttctcgtacatggacggcgagtacttcgtcttcatggacatggacacctacgaccagctcatggtcgaccgcaaggccgtcggcgacgccgccaacttcctgatcgagggcttcaccgcctccgtcgcccagcacgagggcgaggtgctctacgtcgagctgcccgccgccgtcgagctcaccgtcaagcacaccgacccgggcgtgcagggcgaccgctccaccggcggcaccaagcccgccaccctggagacggactacgagatcggcgtgccgctcttcatcagcaccggcgagaagatcaaggtcgacacccgctcgggcgactacctcggccgggtgaacagctaaccgtggctgcccggaacaaggcccgcaagcgcgccttccagatcctcttcgaggccgaccagcgcggtgagtccgtgcagagcgtgctcgcggactgggttcggctctcgcggaccgacgaccgtcagccgccggtcggtgaattcacgatggagctcgtcgaggggtacgcgcagtacgcggcccggatcgacgacctcatcgtcacctacgccgtggactgggagatcgaccgtatgccggtcgtcgaccggagcatcctgcggctcggtgcgtacgagctgatctggatggacgagaccccggacgccgtggtgatcgacgaggccgtccagctcgccaaggagttctccaccgatgactccccgtccttcgtgaacggcatgctggcccgtttcaaggacctgaagccgaacctccgccgggaggagtagccccccggccgcgacggttcggtcgcacacaccacgaagggcccgcggtcggacgaccgcgggcccttcgtcgtacccgcgagccctgccggcccgacggacccggggcacgcgagcgcgggtacaggaacgccgggcgggcggggacccgaaggtccccgcccgcccggcggcacgtttctgctggggggtcccgccccgctcgctcagccctcgtcgtgggagaccgcgcggcgcgcgtccgcgtccagcacgccccagctgatgagctgttccgtgagcacggacggcgactggtcgtagatcacggcgagcgtgcgcaggtcgtcctggcggatcgagagcaccttgccgttgtagtcaccgcgctggctctggatggtcgccgcgtagcgctgcagcggaccggccttctccggcgggacgtgggcgaggcgctccaggtccaggacgagcttcggcggcggctcggcggccccgcccggcgtcgtaccgggcagcagctcctgcacggggaccccgtagaaatccgccagctcggcgaggcgctgcacggtcacggcgcggtcgccgcgctcgtacgaaccgaccacgacggccttccagcgaccctgcgacttctcctccacgccgtggagggaaaggccctgctgggtgcggatggcacggagtttggccccgagctgttttgcgtattcgctggacatatggctccccggacgctggaacagtgtgcggctccgccgcgtggctggtaactcactgtgaggttacgcagcgttacttggatgcgtcaagccgaatggtccggaccggcacctcctgggggtggggtcagggccgagcgcaagccctggtagcgtggatgacgcaatttcgacgtcctttaacgatccgtcccgtgaggcggagaaggaggtccgtttcttatggacgcacagcacgaccacacaggcaacgcggcacgccccgttctcgaggcccccgacatcgcccgtgtgctgacccgtatcgcccacgagatcgtcgaacgcgccaagggcgccgacgacgtggtgctgctcggcatcccgacccggggcgtcttcctcgcccgtcggctcgccgagaaactgcaggaaatcaccggccggaagacgccggtcggatcgctcgacatcaccatgtaccgcgacgacctgcggatgcgcccggcgcgcgccctggcccgtaccgacatccccggcgaggggatcgagggcagcctggtcgtcctggtcgacgacgtgctcttctccggccgcacgatccgcgccgccctcgacgcgctcggcgacatcggccgcccgcgcgcggtgcagctcgcggtcctcgtcgaccgcggccaccgggaacttccgatccgcgcggactacgtcggcaagaacctccccacgtcgctgcgggagacggtcaaggtccagctcgccgaggaggacggccgcgacgccgtgctgctgggcgtcaagcaggccgcccccgcggacgcgcagtagcccgaaccctcccgtacgccctttcggggacgtacggccgctcccgcgcgcccgcatgcctgaaactccctccagcaacccggagaacccccagatgaagcgtcacctcatctcggccgccgacctcacccgcgacgacgccgtcctgatcctcgacaccgccgaggagatggcccgggtcgcggaccggccgatcaagaagctccccaccctgcgcggccgtaccgtcgtcaacctcttcttcgaggactcgacccggacccgcatctccttcgaggcggccgccaagcggctgtccgccgacgtcatcaacttctccgccaaaggctcctccgtctccaagggcgagtccctgaaggacaccgcgctgaccctggaggcgatgggcgccgacgccgtcgtcatccggcacggagcctccggcgccccctaccggctcgccacctccggctggatcgacggagccgtggtcaacgccggggacggcacccacgagcaccccacccaggccctgctggacgccttcacgatgcgccgccggctcgtcggcgccgactcggggctcggccgcgacctggacggccgccgcatcacgatcgtcggcgacatcctgcacagccgcgtcgcccgctccaacgtccacctgctcaccacgctcggcgcgcacgtcaccctggtggccccgcccaccctggtccccgtgggtgtcgagaagtggccctgcgacgtcagctacagcctcgacgacgtgctggcgaagtccgacgcggtgatgatgctgcgtgtgcagcgtgaacggatgaacgccgcgtacttcccgaccgagcgcgagtactcccgccgctacggcctgaacggcgagcggatggcgaagatgcccgaacacgccatcgtcatgcaccccggcccgatggtccgcggcatggagatcaccgccgaggtcgccgactccgaccgctgcacggtcgtcgagcaggtcgccaacggcgtctccatccgcatggccgtgctctacctgctgctcggcggctccgacaccgcgctgtccgccgcccccgcccgtaccgaggagaacaagtaaccatgagcaagatccttatccgcggtgcgcggatcctcggcggcgagcccggggacgtcctgatcgacggcgagaccgtcaccgaggtcggcaccggcctcgacgccgccggcgccaccgtgatcgaggccgaggggcagatcctgctgcccggcctggtcgacctgcacacccatctgcgcgagcccggccgcgaggactccgagaccgtcctcaccggcaccagggccgcggccgtcggcggattcaccgccgtgcacgccatggccaacaccttccccgtcgccgacaccgccggcgtcgtcgagcaggtctggcgcctcggcaaggagtccggctactgcgacgtgcagcccgtgggcgccgtcaccgtcggcctggagggcaagcagctcgccgagctcggcgcgatgcacgactccgccgccggggtgaaggtcttctccgacgacggcaagtgcgtcgacgacgcggtgatcatgcgccgcgccctggagtacgtgaaggccttcgacggcgtcgtagcccagcacgcccaggagccccgcctcaccgagggcgcgcagatgaacgagggcatcgtctccgccgaactcgggctcggcggctggcccgccgtcgccgaggagtcgatcatcgcccgcgacgtcctcctcgccgcccacgtcggctcccgcgtccacatctgccacctctccaccgccggctccgtggagatcgtccgctgggccaagtccaagggctggaacgtcaccgccgaggtcaccccgcaccacctcctcctcaccgacgagctggtccgcacctacaacccggtctacaaggtgaacccgccgctgcgcaccgaggccgacgtgctggccctgcgcgaggcgctcgccgacggcacgatcgactgcgtcgccaccgaccacgccccgcacccgcacgaggacaaggactgcgagtgggccgcggccgccatgggaatggtgggcctggagaccgcgctctcggtcgtccagcagacgatggtggacaccggcctgatcgactgggcgggcgtcgccgaccgcatgtccttccgccccgcggccatcggccgcctcgaaggacacggccgccccgtctcggcgggtgagcccgccaacctcaccctggtcgatccggcataccgtggagccgtggaccccgcgggcttcgcgtcccgcagccgaaacaccccctacgagggccgtgagctgccgggccgcgtcacccacaccttcctgcggggccgtgccacggtcgtcgacgggaaactcgcgtgacaactctgacccccctgtaccacctggccgccgagcagaagtcggcggaagtgacggactgggccgcccgcatcgcctgggtggtcggcctgttcgtcttcatcgccctcgtctactggctgatgcgccagggctggaagtggcgcggcagcctccagtccggcctgcccgagctcccggcggcccccgagggcttcgccgacgacgagacgctgctgacgctggaggggcgctaccacgcctccaccaccgccggtcagtggctcgaccggatcgtcgcgcacggcctcggcacccgcagccgtaccgagctcacgctcaccgcccgcggcctgcgcgtcgaacgtcccggggcggccgacttcttcatcccggccgacgccctgcgcgaggcacgcctcgacaaggcgctcgcgggcaaggtcctccccgagggcggcctgctgatcatcacctgggcgctcggcgagacgctgatcgactccggcttccgctccgaccacgccgccgagcaccaggcctgggtcgacgccgtcaaccggctcgccggcgcaccggccgccacggaactcaccagcaccactacggaaggcaccgcacgatgacgagctccaagccggggaaggcctcgcagagggcaggagcggcccccgccgtactcgtcctggaggacggccgcgccttccgcggccgcgcctacggggccgtgggggagaccttcggtgaagcggtgttctccaccggcatgaccggctaccaggaaacgctgaccgacccctcgtaccaccgccaggtcgtcgtcatgacggctccgcacgtcggcaacaccggcgtgaacgacgaggaccccgagtccggccgcatctgggtctccggctacgtcgtccgcgaccccgcccgcaagccctccaactggcgctcgcagcgctcgctggacgacgagctggccgcccagggcgtcgtcggcatcagcggcgtcgacacccgcgccctcacccgccacctgcgcgagcgcggcgcgatgcgcgtcgggatcttctccggcaacgcgatccccgacgagggcacgctgctcgcccgggtccggcaggcccccgagatgaccggagccgacctctccgccgaggtcgccaccaaggaggcctacgtcgtccccgcgatcggcacgaagaagttcaccgtcgccgcgatcgacctcggcatcaagggcatgaccccgcaccggatggccgagcgcggcgtcgaggtgcacgtgctgcccgccaccgccaccctggaggaggtgtacgccgtgaacccggacggcgtcttcttctccaacggccccggagacccgtccaccgccgaccacccggtcgccctcatgagaggcgtcctggaacggtccacgccgctcttcggcatctgcttcggcaaccagatcctcggccgcgcgctcggcttcggcacctacaagctgaagtacggccaccgcggcatcaaccagccggtgcaggaccgcaccaccggcaaggtcgaggtcaccgcgcacaaccacggcttcgccgtggacgccccgctggacaaggtctccgacacggagttcggccgcgccgaggtctcccacgtctgcctgaacgaccaggtcgtcgagggtctccagctcctggaccggcccgcgttcagcgtccagtaccaccccgaggcggccgccggcccgcacgacgccgcgtatctcttcgaccgcttcaccaccctgatggagggccagcgtgcctaagcgctccgatatccagtccgtcctggtcatcggctccggtccgatcgtcatcggccaggccgccgagttcgactactccggcacccaggcctgccgcgtcctcaaggccgagggcctgcgcgtcatcctggtgaactccaacccggcgacgatcatgaccgacccggagatcgccgacgccacctacgtcgagccgatcacccccgagttcgtcgagaagatcatcgccaaggagcgccccgacgcgctcctgcccaccctcggcggccagaccgcgctgaacaccgcgatctccatgcacgagaacggcgtcctggagaagtacggcgtcgagctgatcggcgccaacgtcgaggcgatcaacaagggcgaggaccgcgacctcttcaagggcgtcgtcgaggcggtcaaggagaagatcgggtacggcgagtccgcccgctccgtcatctgccacaccatggacgacgtcatcgccggcgtcgacaccctcggcggctaccccgtcgtcgtccgcccctccttcaccatgggcggcgccggctccggcttcgcccacgacgaggaggagctgcgccgcatcgccggccagggcctcacgctctccccgaccaccgaggtgctcctggaggagtccatcctcggctggaaggagtacgagctggagctgatgcgcgacaagaacgacaacgtcgtggtcgtctgctccatcgagaacttcgacccgatgggcgtccacaccggcgactccatcaccgtcgcccccgcgatgacgctcaccgaccgcgagtaccagcggctgcgcgacgtcggcatcgcgatcatccgcgaggtcggcgtcgacaccggcggctgcaacatccagttcgccatcgaccccgccgacggccgggtcatcgtcatcgagatgaacccgcgcgtctcccgctcctcggcgctcgcctccaaggccaccggcttcccgatcgccaagatcgccgccaagctggccgtgggctacaccctggacgagattcccaacgacatcaccgagaagacgccggcctccttcgagccgaccctcgactacgtcgtcgtcaaggccccccgcttcgccttcgagaagttcccctccgccgactccaccctcaccaccaccatgaagtcggtgggcgaggccatggcgatcggccggaacttcaccgaggccctccagaaggccctgcgctcgctggagaagaagggttcgcagttcgccttcaccggcccggtcggcgacaaggccgagctgctggccgaggcggtccgccccaccgacggccggatcaacaccgtcatgcaggcgatccgggccggagccacccaggaggaggtcttcgactccacgaagatcgacccctggttcgtggaccagctcttcctgatcaaggagatcgccgacgagctggcctccgcggagcgcctggacgccgacctgatcgccgaggccaagcggcacggcttctccgacgcccagatcggcgagatccgcgggctgcgcgaggacgtcgtccgggaggtccggcacgcgctcggcatccgcccggtctacaagaccgttgacacgtgcgccgccgagttcgccgcgaacacgccgtacttctactcctcctacgacgaggagagcgaggtcgcgagccgcacgaagccggccgtgatcatcctcggctcgggccccaaccgcatcggccagggcatcgagttcgactactcctgtgtgcacgcctccttcgccctgagcgacgcgggctacgagaccgtcatggtcaactgcaacccggagaccgtctccaccgactacgacacctccgaccggctctacttcgagccgctcaccctggaggacgtcctggagatcgtgcacgccgagtcactggcgggcccgatcgccggtgtcatcgtgcagctcggcggccagaccccgctcggcctcgcgcaggcgctcaaggacaacggcgtgcccgtcgtcggcacctccccggaggccatccacgcagccgaggaccgcggcgccttcggccgggtcctggccgaggccggactgcccgcgcccaagcacggcaccgccaccaccttcggcgaggccaaggccatcgccgacgagatcggctacccggtcctggtccgcccgagctacgtgctcggcgggcgcggcatggagatcgtgtacgacgagacgcgcctcgcctcgtacatctccgagtccaccgagatcagccccacccggccggtcctggtcgaccgcttcctcgacgacgccatcgagatcgacgtggacgccctctacgacggcaccgagctgtacctcggcggcgtcatggagcacatcgaggaggccggcatccactccggagactcggcctgcgccctgcccccgatcacgctcggcggcttcgacatcaagcggctgcgcgcctccaccgagggcatcgccaagggcgtcggcgtactcggactgatcaacatccagttcgcgctctccggagacatcctctacgtcttggaggccaacccgcgcgcctcccgcacggtccccttcacctccaaggcgaccgccgtgccgctcgccaaggccgccgcccgcatctcgctcggcgcgaccatcgccgaactgcgcgcggagggcctgctgccgaagaccggcgacggcggcaccctgccgctggatgcgccgatctccgtcaaggaggccgtgatgccgtggtcgcgcttccgcgacatccacggccggggcgtcgacacggtcctcggcccggagatgcgctccaccggcgaggtcatgggcatcgactccgtcttcggcacggcgtacgccaagtcgcaggccggcgcctacggcccgctccccaccaagggccgcgcgttcatctcggtcgccaaccgggacaagcgctcgatgatcttcccggcccgcgagctggtcgcccacggcttcgagctgatggccacctccggcaccgccgaggtcctcaagcgcaacggcatcaacgccaccgtcgtgcgcaagcagtccgagggccccggtccgaacggcgagaagaccatcgtccagctcatccacgacggcgaggtcgacctcatcgtcaacacgccgtacggaaccggcggccggctcgacggctacgagatccgcaccgcggccgtcgcccgctccgtaccgtgcctgaccacggtccaggcgctcgccgcagccgtccagggcatcgacgccctcaaccacggtgacgtcggggtccgttccctccaggaacacgccgagcatctgacagcggcccgcgactgaggggggcacccggcagatcatggccgggtacccccggcagcccagcagggggacaccggaaacggtgtccccctctctgtgaggacatctcttcatgtacaagctcttcttccggctggtcttcaagcggatggaccccgagcaggcccactacgccgccttccggtggatccgcctcgccgcccgcatcccggtcctgcgcaccttcgtcgccgccgccctcgccccgcgcttcgaggaactgcgcaccgaggccctcggtctgcggatgcacggccccttcgggctcgccgccggcttcgacaagaacgccgtcgcgatcgacggcatggcgatgctcggcttcgaccacatcgagatcggcaccgtcaccggcgaaccgcagcccggcaaccccaagaagcgcctcttccggctcgtcgcggaccgcgcgctgatcaaccgcatgggcttcaacaacgaaggctccgccgccgtcgccgcccgcctggccgcacgcaaccccgtcttccgcaccacggtcggcgtcaacatcggcaagaccaaggtcgtcccggaggccgaagccgccgccgactacgtgaagtccactgaagccctcgccacccacgccgactacctggtcgtcaacgtctcctcgcccaacacccccggcctgcgcaacctccaggccaccgagtcgctgcgcccgctgctcaccgccgtacgcgaggccgccgaccgcaccgacaccacccggcgcgtccccctgctcgtcaagatcgccccggacctcgcggacgaggacgtcgacgcggtcgccgacctcgccgtggaactgggcctggacggcatcatcgccaccaacaccaccatcgcccgcgagggcctgggtctccagtcggcccccggcctggtgggggagaccggcggcctgtccggcgcacccctcaaggagcgctcgctggaggtcctgagccgcctgtacgcgcgcgtgggggaccggatcacgctggtgggcgtcggaggcgtcgagaacgccgaggacgcctggcagcgcatcctcgccggagccaccctcgtccagggctacagcgccttcatctacgaaggtcccttctacgcccgcgcgatccacaagggcctcgccgcccggctcgccacctctccgtacgccaccctcgccgaggccgtcggcgccgagacccggaagaaggccgccctgtgacgctcgaacccttcggcgcccgcctgcgccgcgccatggacacccgcggaccgctctgcgtgggcatcgacccgcacgcctccctgctcacctcctggggcctgaacgacgacatcgccggcctggagcgcttcacccggaccgccgtggaggcgctggccgaccgggtcgccgttctcaagccgcagtccgcgttcttcgagcgcttcggctcgcgcggcgtcgccgtcctggagaaggccgtcgaggaggcgcgggcggccggcgcgctcgtcctgatggacgccaagcgcggcgacatcggctccacgatgggcgcctacgcgtcgacctacctggacaaggactcgccgctcttctcggacgcggtgacgctctccccgtacctgggcttcggctcgctgcgcccggcgctcgacgccgccgcggtcgccggcgcgggcgtcttcgtcctcgccctcacctccaacccggagggcgccgaggtccagcggtccacggccgccgacggccgctcgctcgcccagctgatgctcgaccacatggccgccgagaacgccggggccactccactcggctcggtcggcgcggtggtcggcgcgacgctcggcgacgcgggggtgaacctggcgatcaacggaccgctcctcgcgcccggcatcggagcccagggggcgaccccggcggatctcccggcggtgttcggcgacgcggtgggcaacgtggtccccagcgtgagccggggcgtgctgcgccacggcccggacgtgtccgggctgcgcgaagccgccgagcggttcgcggacgaggtccgcagcgccgtatccggcagctgaccctgacacgtttacagcgcgttgacgaaatactgacgagaaacctggtcgatatgtcgggaaaatcctggtcggccacagctgaccaggacttttcgtctgttctcgctgactacagcggcccttgccgctagtctccgtcgagagcggccgagcacagtgtgttctccgctcacctggtgggtggcgtccagcttccccgccggtccgtatccgacagatcgacatccgaggtgacgtaggcgtggctcttccgccccttacccctgaacagcgcgcagccgcgctcgaaaaggccgccgcggctcgccgggagcgggccgaggtcaagaatcgactcaagcactccggcgcctccctccacgaggtcatcaagcagggccaggagaacgacgtcatcgggaagatgaaggtctccgcactgctggaatccctgccgggcgtcggcaaggtccgcgccaagcagatcatggagcgtctcggtatctccgagagccgccgggtcaggggtcttggctccaatcagatcgcatccttggagcgtgagttcggcggcagccccgcctgacgttctcaggcactcctgagagcggggataatcgccccatggctgcaacatcccgggggacgtcccccgtacccccggacgtacgtccgcggctgaccgtgctctccggcccctcaggggtcggcaagagcacggtcgtcgctcatatgcgtaccgtgcaccccgaggtctggctctccgtgtcggcgacgacacgcaagccgcgccccggggaacgcaacggtgtgcactacttcttcgtggacgacgaggagttcgacaagctcgtcgccaacggcgaactgctggagtgggccgagttcgcgggcaaccgctacggcacgccacggcgcgccgtgctggaccgtctggaggccggtgagccggtcctgctggagatcgacctccagggcgcccggctggtccgccagtcgatgtccgacgcgcgtctggtcttcctggccccgccgagctgggacgagctggtgcgccggctcaccggccgcggcaccgaggcccccgaggtcatcgagcgccggctcgccgccgcgaagatcgaactggccgccgaggccgagttcgatacgacgctcgtcaacacctccgtcgaggacgtggcgcgtgagctgctaacgttgatgcttcaggcctagatctctgcgatcgctcagatctctttgatctttgatctacacccccttcggaaggcagagagtgtcctcttccatcaccacgcccgagggcatcatcaacccgccgattgatgagctcctcgaagccaccgactcgaagtacagcctggtgatctacgcggccaagcgtgcccgccagatcaacgcgtactactcgcagctcggtgaaggcctccttgagtacgtcggtccgctcgtcgacacccacgtgcacgagaagccgctctcgatcgcactccgcgagatcaacgcgggactgctgacctccgaggccatcgagggccccgcgcagtaacgcaggagaaccacggcaccttcacctcaggcccggcggcccgtccgccgggcctgaggtgtgtccggggccggatgaaagcgcgatccgcgcggtgaggcagcatgggacgcatacgtatgggacgcatacgttgccttacgttgccgagtgcggggagacgcagtggacaagccgaaggtcgtcctgggggtcagcgggggcatcgccgcctacaaggcgtgcgagctgctgcgccggctgaccgagtccggccacgacgtacgggtcgtcccgaccgccgcgtcgctgcacttcgtgggagccgccacctggtcggcgctctccgggcaccccgtgtccgacgaggtctgggaagacgtccacgaggtcccgcacgtgcggatcgggcagggcgccgacctcgtggtggtcgccccggccaccgcggacatgctggccaaggccgcccacgggctcgccgacgacctgctcacc

SEQ ID NO: 3345 - DNA, 5240 bp, Unknown
  Kingdom: Bacteria, Phylum: Actinobacteria, Class: Actinobacteria, Order: Streptomycetales, Family: Streptomycetaceae, Genus: Streptomyces
cggccggactcctcgtgccggagaagctcggcggccagggcgcgtcccaccgcgaggccgccgtggtcctggaggagctcggccggtccgtggcccccgtcccgtacctgaccagctccgtcgcggccaccgagacgctgctcgcgctgggcgcggaggacggtccggccggcgcgctcctgagcgagctggcatccggtgcccgtacggccgtgctcgccgtgcccttcgcgaccccgcccgccggggcggaggcggtgctcgcctcacgggacgggacggtacgcggcgtcgccgacgcggcggtggccgatgtgctgctggtgccgaccgccgagggactgtacgccgtcgaggccgtggaccccggcgtcgccgtgcagccgctcgtcccgctcgacctgacccggcccctggccgccgtcaccctgaccggagcggccgggaccctgctggccgacgcggacgcgagcgccgccgccgtgcggcgcgggctgctcgccggagccggactgctcgcctccgaacagctcggcctcgcggagtggtgtctgaccgagaccgtccgccacacccgggagcgccaccagttcaaccggcccgtgggctcgttccagtcgctcaagcaccggatggcgcagctctggctggaggtcgtctcggcccgcgcggtcgcccgcaacgccgccgacgccctcgccacccggagtcccgacgccccactcgcggtcgcggtggcccaggcgtactgctccggagtcgccgtccacgccgccgaggagtgcgtacagctgcacggcgggatcggcatgacctgggagcacccggcgcacctgtatctgaagcgcgccaaggccgactcgatcgcgtacggcacggcgggccgtcatcgtcaggccgtcgcggagctggcggaactcccggccccgtagaggcgtcctcggacgcatcgaccctggtgcacccgtctcgtctgtcgaggcgggctgtaccagggtcttttacgtgctgtttaattgcacactgttcgcaataacagccgatcttgaacagggatgtgcagactatgacggcccgatcgatacgggtggcggtcgccgccacactggtgaccgccctgtccctgaccgccgcctgctcgaacccggacagtgccacgagcggatccgggtcggggtccacctcggccgtcgtcggcatcgcctacgagcccgacagcctgagtccgctgctcggctacggcaaggacggcaactccaagatcttcgacggactgctcgccctggacgcggacatgaagctccgccccgccctcgcggccggacttcccgagatcagcgccgacggtctgacgtacacgtacaagctgcgccagggcgtgaagttcagcgacgggaagccgttcggtgccaaggacgtcgtcttcacctaccgcaccattctcgacgagaagaccaacaacgcctcccgcaccgagctggacgccgtcaaggacgtcacggcgaagggtgaggacaccgtcgtcttcacgctcaagtacccctacgcgccgttcgcccagcgcaccgtcctgcccatcgccccccagcacatcgcgggtgagcaggacgtcaacaccggggccttcaccacccgtcccatcggcaccgggccctacgtcctcaccaagtggtccaagggcgagaagctcagcttcaccgccaacccccactactgggggggtgaacccgaggtgaagaagttcaccatggcgatcatcaaggacgacgacgtgcgcgccacccggctgcgctccggcgacctcgacggcgcgatcctgccgcccaacctcgccaagggcttcgcggacgacaagagcaagaagacggtcgccgccaccacctacgactaccgcaccgtgaccctcccgacccacaacaaggtcgcgggcgacaccgccgtgcgccgcgccctcgacatcgccgtcgaccgcgagaccatggtcgacgccatcctcaacggcgacggcaagcccgcctacgggcccgtccccaccgacagcgagtggttcacccagggcaccgagcgcccccacgacctcgccgccgcgaagaagatcctggacgaggcaggatggaagcccggaaaggacggcgtccgggtcaaggacggcgtccgcgccgccttcccgctctggtacctcaccggcgacaagctccgccaggagcacgctctcgcctacgcctccgacgccaagaaggccggcatcgccatcaccgccgaggccggaacctgggaggtcatcgaaccccggatgaagcacgacgccgtgctcgcgggcggcggctcgcccgccgaccccgacttcgaccagtacaccctgctgaagtcctccctcgcgggcgacggcttcaacaacatggcctggtacgacaacgaggccgtcgacgccgcgatcgaggcgggccgccggagcggtgacaaggccgagcgcaagaaggcgtacgacaccgtccagcgcgaactggtgaagaacccgggctacaccttcctcacccacatcgaccacctctacgtcgtcgacgaccgcttcggccccctcaccacccaggtcgagccgcacgaccacgggctggcctccggcccctggtggaacgtggagaagtggtccaccgagggttccggagggtcgaagaagtgagccgacgcctcccctgggggccgatggcgcggatggcgggacggcgggtcctgttcgccgtccccgtcctcggcgtcgtcaccttcggcgtcttcgccgtcgccgccgcgtcccccttcgacccggtcaaggcctacgcgggcaccgccggactcaccgcctcgcaggagaacctcgaccagctgcgggccaacctcggcgtcgaccagccgctcgtcgcccgctggtgggactggctgacctcggcgctccagggcgacctcggggactccagcgtgatgcggcagccggtcgccgacgtcatcgcggagcgcatgggctggtccgtcctgctcgccgccaccgccttcctcgtcgcgatcctgctgggcaccggcctcggggtcctcgccgcccgcgaacccggcggctggctcgaccggtgcgtcagctccgccgcgtacaccctggaggccgcccccgccttctggctcgggctgctcgccatctggttcttcgccctcaagctggacgtcctcccggccggcggactcaccgacgccgccagcgacgtcgtcaccttcggccaggtcgcctcccacctggtgctgcccgcggccgtcctcggcatctcccagctgccgtggttcttcctgtacgtacgccagggcgtcgccgacgccctggccgaggatccggtgcgcggcgcccgcgcccgcgggctgagtgagcgcaccgtgctcctcggccacgccctgcgctccggaatgctgccgatgctcaccctgatcggctcccgcgtccccgaactcatcaccggcgcactgctcgtcgagacggtgttcagctggcccggcatcgccgccgccacggtggaggccgccacctcggtggacttctccctgctcgccgcgctcacggtgctcgccaccgccgccgtgctgctcggcaacctgctctccgacctcctctacggactcgccgacccccgggtggccttcgatggctgagaccgtgctcgcgcttcccggccgcaccacccgccgcgtccggatcgtcacctcggccacgatcgtcgtcgccgtcctgctcgccgtgctcgtcgtcccgccgctggcccagctcgaccagcaggccgtcgacctggccaacaagctcgacccgccgtcctgggcccacccgttcggcacggacgacgtcggccgcgacctcctgctgcgctgcgtctacggcctgcgcgtatcgctgctcgtcggcctggtcgcggccctcaccgccaccgtcatcggcaccgcgatcggcgcgctcgccggagcgttcggcggctggacggaccgggtcgtcatgcgggtcgtcgacgccctgtcctccgttccgcacctgctgctcggcatcttcatcgtcgcgatgttccggcccggcgtctggccggtgatcatctcggtcgccctgacgcactggctgtccaccgcccggatcgtccgctcggaggtgctctcgctgcgctcgcgccccttcatcgacgcggccgtctccggcggcgcctcccgcacccgggtcatcgtgcggcacctgctgccgggcgtgctcccgcaggccggtctggcagcggtgctgatggtgccgcacgcgatgtggcacgagtccgcgctgtccttcctcgggctggggctcccggcccatcaggcgagcctcggcaatctcgtccagtccgcgcgcggttcgctgctcgcgggggactggtggcccaccctcttccccggcctcttcctgatcatcccgaccctcgcgctcgcgggactcgccggagcctggcgcgaccggatcaacccgcgccggaaatcggagctgatgctgtgaccagcgaccacgatcccgcccccgcgggagccgaggtgcccgtcctcgccgtcgagaacctctcggtccgcttccggatgcgcggtgggcgggacatcgcggccgtcaccgacgcccgcttctccgtcgcgccgggggagtgcctggccctggtcggcgagagcggctgcggcaagtcggtcctggcctcggccctgctcggactgctgcccgccaacgcggcgaccaccggcagcgcggtgctcggcggggacacggacctgctgaccgccgacgagcgcaccctcgcccgcaccgtacggggacggcgcatcggtctcgtaccgcagagtcccgccgcccacctcacgcccgtgcgcaccgtccgggcccagttggaggagagcctgcgcgagctgaccggggtgcgggggagcgctctggggaaggccgccctggtcgcggccgcccgtgcctcgttccccgagggccacctcgaccgctacccgcacgagctgtcgggcggtctcgcccagcgcgccgcgaccgccctcgccctgatcggtgacgccccgctgctgctcgccgacgaaccgaccaccgggctcgaccgggacctcgtcgagcggaccgtcgacgaactgcgccggcacaccgacgagggccgggcgctgctgatcatcacccacgacctggccgccgccgaacggatcgcggaccgggtcgccgtgatgtacgcggg

SEQ ID NO: 3346 - DNA, 3486 bp, Unknown
  Kingdom: Bacteria, Phylum: Actinobacteria, Class: Actinobacteria, Order: Streptomycetales, Family: Streptomycetaceae, Genus: Streptomyces
gcggtgggggtgagccctgtggcggccgtggctgttggggcagctgagatcgcaggcctttcagggtctgctggggtcgcgggttcctggggttcttcttccggtcctggaggtcctgccggcctggttggccctgttggccgtgttggctctgctggtgtttctggctcttcaggcttctctggttcttccgccgtacgcgcggcttcctcgcgttctgcatcgcgcccgcccggggttcgaggttcgatggtgtgacgatccacggtgaaacctgccggtcggtgacggttgcggccgtctcacggcaatttgtgacagaacgatcccacggtgagacggtgggtcgggtggtgcgcgaggggtgtggcgtgcgcgggtgcggtcctggggtggtcgaagagggcgggtgaaccccgggtgtgctctgtgtgagcacttaagttgagcgtaagagactcaggtctgttgactccgggaccggcgtcatgcattcttgagtcagatccactcaagtagtcagttggaggaattgaaatggcacgtgcggtcggcatcgacctgggcacgactaactccgtcgtcagcgttctcgaaggcggcgagcccaccgtcatcaccaacgccgaaggcgccaggaccacgccgtccgtcgtcgccttcgccaagaacggcgaggtgctcgtcggcgaggtcgcgaagcgccaggcggtcaccaacgtcgacaggaccatccgctccgtcaagcgccacatgggcactgactggaagatcgacctggacggcaagagcttcaacccgcagcagatgagcgccttcatcctgcagaagctgaagcgcgacgccgagtcctacctgggcgagaaggtgaccgacgcggtcatcaccgtcccggcgtacttcaacgactccgagcgtcaggcgacgaaggaggccggtgagatcgcgggcctgaacgtcctgcgcatcgtcaacgagccgaccgccgccgcgctggcgtacggcctcgacaaggacgaccagacgatcctcgtcttcgacctcggtggcggcaccttcgacgtgtccctcctggagatcggcgacggcgtcgtcgaggtgaaggccaccaacggtgacaaccacctcggtggtgacgactgggaccagcgcgtcgtcgactacctggtgaagcagttcgccaacgggcacggtgtggacctgtccaaggacaagatggctctccagcgtctccgcgaggccgcggagaaggcgaagatcgagctctcgtcctcgaccgagaccacgatcaacctgccctacatcacggcgtccgccgagggcccgctgcacctggacgagaagctcacgcgctcgcagttccagcagctgaccgcggacctcctggaccgctgcaagaccccgttccacaacgtcatcaaggacgccgggatccagctctccgagatcgaccacgtcgttctcgtcggcggctccacccgtatgccggccgtcgccgagctcgtcaaggagctgaccggtggccaggacgccaacaagggtgtgaacccggacgaggtcgtcgccatcggcgcctcgctccaggccggtgtcctcaagggcgaggtcaaggacgtcctgctcctcgacgtcaccccgctgtccctcggtatcgagaccaagggagggatcatgaccaagctcatcgagcgcaacaccacgatcccgaccaagcgctccgagatcttcacgacggccgaggacaaccagccgtccgtgcagatccaggtctaccagggtgagcgcgagatcgcggcgtacaacaagaagctcgggatgttcgagctgaccggtctgccgccggccccgcgcggtgtgccgcagatcgaggtcgccttcgacatcgacgccaacggcatcatgcacgtcgccgccaaggacctcggcaccggcaaggagcagaagatgaccgtcaccggcggctcctcgctgccgaaggacgaggtcaaccggatgcgcgaagaggccgagaagtacgcggaggaggaccacgcccgccgcgaggccgccgagtcgcgcaaccagggcgagcagctcgtctaccagacggagaagttcctcaaggacaacgaggacaaggttccggccgacgtgaagacggaggtggagaccgctgtcggcgagctgaaggagaagctcaagggcgaggactccgccgagatccgcacggccaccgagaaggtcgcggccgtctcccagaagctgggccaggcgatgtacgccaacgcccaggccgagggtgcgacccccggcgccgacgccccgggcgatgcccaggccaaggccgatgacgacgtcgttgacgccgagatcgtggacgacgagaaggacaccaagggcggtgcggcgtgaccgaggagactccgggcttcgaggagaagcccgacgtcccctccggcgccacccctgatgacgccgagccgaaggctgccgcctcctccgaggaggaggcggcagccccggccggggacctcgacccgaccgtcggtctgaccgcagagctggaccaggtacgcaccgcgctcggtgagcgcaccgcggacctccagcggctccaggccgagtaccagaactaccgccgccgcgtcgagcgggaccgggtcacggtcaaggagatcgccgtcgcgaacctcctgtccgagctccttcccgtcctcgacgacgtcggccgcgcacgggaacacggcgagttggtcggcggcttcaagtcggtcgccgaatcgctggagaccgtcgtcgcgaagctgggcctccagcagttcggcaaggagggcgagcccttcgacccgacgatccacgaggccttgatgcacagctacgcgccggacgtcaccgagacgacctgcgtggcgatcctgcagccggggtatcgcatcggcgagcgcaccatccgccccgcgcgggtggccgtcgccgagccgcagccgggcgccacgcccgccgcggccaaggaagagaagacagacgacgaggagagcggtggcaccgaggaggtctgacggcaacgcgtctgaccaccagggtgcacaccgaccggcccggcggccggcccacgggccggccgctcggccgatcgtccggaaggagggacgtcgatgagcacgaaggacttcgtcgagaaggactactacaaggtcctcggcgtccccaaggacgccaccgacgccgaggtcaagaaggcgtaccggaagctcgcccgcgagttccacccggacgccaacaagggcgacgccaaggcggaggagcgcttcaaggagatctccgaggcgaacgacgtcctcggtgaccccaagaagcgcaaggagtacgacgaggcgcgcgccctcttcggcaacggcggcttccgcccggggcccggtggtgccggcggcaacttcaacttcgacctgggcgacctcttcggaggcggcgccccgggtggcggcggacagggcggcgcctccgaag

SEQ ID NO: 3347 - DNA, 4999 bp, Unknown
  Kingdom: Bacteria, Phylum: Actinobacteria, Class: Actinobacteria, Order: Streptomycetales, Family: Streptomycetaceae, Genus: Streptomyces
  misc_feature (4210)..(4211): n is a, c, g, or t
gccgcctggcggccgagcccacgcaggccgcgccaggcggctcaggtgggaggaggcgctgacgcgggccgtgtgcgccaggttggcggggtcgtcgtcgacgaggccgatcaccgaggcgtcctggcgcagcagggtgcgacgtaccaacttctgctggtcggtggcgagttcgcgcggagtgagaccttcggcaacgcacagggcggcggcggttccggcggcctcaccgagggtggcgcaggtggccatgacgcgggtggcgccgaaagcgatgtgcgtggcggagatgttgcgtccggcgaagtggaggttcgtgacgttcacggagtacagggaacgcagcgggatgtggaagatgccgtccgcgtagcgctggcgggctccgggctcgtcggcgtacatgccctgcaccggatggaggtcgacggaccagccgccgaaggcgacacggtcggcgaactgccgctgttcgaggatgtcccgctgggtgaggacgtggtcgccgaggaaacggcggtactcgcgcttgccgggcagcgaaccgacccactccagcgtgaggttggcggcgtcgtggaactcgccggagttcttgatgtggtcccagatgcccatgatcacggcctggagttcgtcgcggatgcgctcgttgtcgtggacggtgtcgagttcgccaccccactcgatccaccagtagtcgcagccgttgtcgccggtgcgcaggacgcggttgcgcaggatgggtgtggtcgagagatccttggcatgggccggcgggacgaacttcaccggcctgccggtgtccttggtgtggaacaggatcgtcgagccgagcagcgcctcgtccgattcccggggtgcccagggttcgtcgaactccgtgcgtgcctcgcggccgatgcggtagcgggcgccggcgaggtgcccgagcaggccgtcgccggtgcagtcgaggaactggcgggcgtggaaggtgatgcggcgttctgatcccatcatccagccggtgcaggagtgcacttcgcgggtgtcgtcggggccgctcgcgtcgacctcgcgtatgtcggtgttgaggtagaggtcgatgttcggttcggcacggacggcgtcgaggacgacgtggtcccagtagtaggggttgccttcggggttgcggtactggttctcggtgtacagctcgcccatgatgccggtctcgcgggcccagcggtgcacgccgtgggcggtggctccgcagacccagacacggacctcgctgctggcgttgccgcccaggacgggcctgttgttgaccagggcgacgcggcgtccgagccgggccgcggcgatggccgcgcaggtccccgccaggcctccgccgatgacggcgatgtcgtaatggacctcttctacccgcacggtgcggcctcctcggtgtgacgctcggatcctccccgctcgcaacggggtggcattgaacgtacatcacatccatattgtgcaaccactgttcaatcaatgggctccgctgtaggttccggttgcggccaccgacccggccgccgtgagccgataagcgcgttcggggcaggtggggcgtgttcatcgacctgctcggaatcggcgattcaccgacgaaaagggttgacgctccgcaggatatggagaacgatcccgcatgctgcaacttgaattcatcgcagcggagatgacggccctcacccagggctcccgatctccctccacgatgtgaaaggacagacccatgagttcggccgcaccgccccagaaggcgcccccgccacgcgagcggagcggggggcggctctccagcggtgcgttcgccctgctgctgaccgctccgggactcgccctgttcgcggcgatcatcgtctacccgctgctgtcggcccttttcaccggcttcttccagcaggatctgcggctgccgggccgggagttcgtcggcctggaaaacttcgcccactggctgaacggcgacttcctcaccatcctcgagcagacactgaccttcaccatcggcgcgacgctcgcccccttcaccatcggcttcgcgctcgcgctcgccctcaacaccgggatccggggcagcgggttcctgcgcggcctgttcctgttcccctgggtgatccccggcgtggtggtctccttcctctggatgtggatcttcaacgcgaactacggggtgctcaacggcgtcctcgtgaaggccggcgtcctcgacgagtcggtggcctggctcggccagcccggcaccgcgatgctcgccgtcatcatcaccaagacctgggccagcttcccctggatgatggtgatgctcctggccggcctgcagaccgtgccgaaggaactgcacgaagcggccgcgatggacggggccggctcgatccggcgcttcttcgccgtcacctggccgcaggtccgaggggtcgcctccatcgtgctgctgctggagttcatctggaacttccagcacttcgacacgatctacgtgctcacgggcggcggcccggccggttccaccgagacgttcgcgaccgccgtctaccagaccgcgttcaagggcttcgacatcggccgcgccaccgcgttgggcggcctgtggatgctgctcctgctcctcctcgtcgtcgtctacctcaggatcaccgagcggaaggacgacgcctgatgacctccacgacctctcccccgctgcccgccgtcgaccggccgcagccgacctccgcaccggccgggcgcagcccccggcgccgtatgcgcaaggacctgctgcgctcgcggatcgccgcctggagtgcggtggtcgtcatcggcgccttcggcctgctgcccgtctactggctgctcgccaccgcgctgagcaccccggagtcgaccttccagttcccgcccaggctgattcccaccgatctcaccctcggcaacttcactgccctggccgagaacgaccagctgatcgactacatgatcaattcgctcgtcgtggcctcggtcaccgcggtgctgagcgtggtcgtcgccacgtacatgggctactcgttctccaagttccgctacacgggccgacggtcgctgatgcacctggtgctggcctcccagatgttcccgcaggcactgctcctggtgacgctgtacaccgtcttctccagcttcggcatgctcaacacgtacaccgcgctggtgctctccttcaccacgttcaccatgccgctgtgcgtctggatgctgaaggggatcttcgacaccatcccggacgcgctgctggaagcggcgtccatcgacggcgcgtcccggtggcggacgctgcactccatcgtggcgccgctggccgcgccggggatgatcgccgccggcctcttcgccttcgtacgcggctggaacgacttcatcttcgcgctgaccctggccgacaaggagaagcagaccctgccccccgggctcgtctccacctacctcggcgagttccagaccgcctggccccagctgatggccgcctcgctggtggtgtccgtcccggtgatcgtcgccttcatgttcctgcagcgctacctggtcggcggcatgaccgccggttcggtcaagagctgatccccggagcccgacggctcctctccacctaccctcccgcacactccccatggagagatcatgaccacctctggcatcagcaggcgcggcgcgctgcgcatgctcggcatcggcgcgctcggcgcggcgggcgtcggtgcgctcggcgcctgcgcgccgtccggcgccggcgtcgcctccaacggcggcgacccgaaggcgaagaacttcgacttcacctcctggtcgctcaacgaggaggccgccaagccctcgatcgagaagatcatcgcggcctgggagaaggcggagaactcaaggatccgcgcggtctcctacccgtacaacgagtatctgagccagctcaccctcaagctgggcggcggggagacgacgggcgcggtacacctcgacatcgcctggctcgccgcgatggcccagatggggaagctggtcgacctcggcccggtggccgacaaggccgggtacacggacgtggcgctcaagagcggcgtgtacgacggcaagcagtacgggctgccgtggaacaccggatcgatcggagtgatcgccaactccaagctcctggaggaggccgggatcaaggagcaccccgccaccgtcgaggagttcgagnngggctcggcgggggtgtcgtgccgtacgccgccgccaccaaggtcgcgcagctcaaggacatcttcccctggatgcagaccttcggctgtgagctgttcgacggcgggaaggtcacgataggcgacgacgcctcggtcgacgccgtcacctggtacaagaagctgcacgacgagaagctgatcgccgccgacgtggaccgcttcgacgcgcgcgccctgttcgggcagggcaaggccgtcttctacgacgacgcgatcatcggcaagggtgtgacctccgcccagtccaaggacaagacgctggccgacgccatgcagccgatggagcgtccggtgctcaaggccggtgacacgcctcaggcgatgctgtggggcggcgtgatcgcgatcgtgaagggcaagggccaggacgcggcgacccagttcgcgctgcacaccaccacggaccgggtgaccacttccgagtacttcgccgcacgcgcgctgccgccgtccaccaccgcggggctggccgcacccgaggtcgccaaggacaccttcaccacggagtggacccagaagatcacgaagacggcgaccggcagcccgttctggcagttcgcccagagcgcccagatcgacgaggccgtcgccaagcaggtgcaggccgtcctcgtcggcacgtcgaagccgcaggacgcgatgaagcgggccggggaggaggtcgccgcgctcatcaagcgctgagaccgagcgccgtgttccgggcccggtggacgccgcacgcttcgcctggccccgccctcccc

SEQ ID NO: 3348 - DNA, 1466 bp, Unknown
  Kingdom: Bacteria, Phylum: Actinobacteria, Class: Actinobacteria, Order: Streptomycetales, Family: Streptomycetaceae, Genus: Streptomyces
ccctcggcatcctcgccgccgtcgccggcgccttcgcgtacgtcggcagcgtcgaccccaacgagtccggtcactatccggtctgcccactgctcaagctgaccggcgtcctctgccccggctgcggcggactgcgcagcgcccacgccttcatccacggcgacctcggcgcggcgttctccgcgaacgcgatcgccaccgtcggctatttcctcttcgccgccgtctgggtcctctggctggtccgggcctggcgcggacagcccctgcgcatcggtctcgcgcccgtctcgtggtggggcgtgggcgccgtcctgctgaccttcaccgtggtccggaatctgccgttcggctcggctctggccccctgaacgaccgggtcggcccactgattgaccaggaagtgggacgcgacgtggccggatgcgagccccggggcatcctgcggataccatcggtatggctgatcctgttcattgtcaaccgttcggaagggggccgctcgcgtgagtgtgctcgacgagatcatcgacggcgttcgcgccgacctcgcggagcggcaggcgcgcgtcagcctcgacgagctgaaggagcgtgcggcccgcgctccccaggccaaggacggagtcgccgcgctgcgtggcgagggcgtgaccgtcatctgcgaggtcaagcgctcgtccccctccaagggggcccttgccgccatcgccgacccggccgcgctcgccgcggactacgaggcgggcggcgcgtccgtcatctcggtcctcacggaggagcgccgcttcggcggttcgctcgccgacctggaggccgtccgcgccaaggtcgacaccccgatcctgcgcaaggacttcatcgtcacctcgtaccagctgtgggaggcccgcgcctacggcgccgacctcgccctgctgatcgtcgccgccctcgaccaggaggccctggtctccctcatcgagcgcgccgagtcgatcgggctcaccccgctcgtcgaggcgcacgacgaggaggaggcggagcgcgccgtggacgccggagccaagatcatcggcgtcaacgcgcgcaacctgaaggacctcaaggtcgaccgctccaccttcgagcgcgtcgcccccgagatccccgaccacatcgtcaaggtcgccgagtccggcgtccggggcccgcatgacctgatcgcgtacgccaacgcgggtcgcggccggtgaccagcgactcgccgaccaggacggcgtcggcgcccgcgttggcgtacgcgatcaggtcatgcgggccccggacgccggactcggcgaccttgacgatgtggtcggggatctcgggggcgacgcgctcgaaggtggagcggtcgaccttgaggtccttcaggttgcgcgcgttgacgccgatgatcttggctccggcgtccacggcgcgctccgcctcctcctcgtcgtgcgcctcgacgagcggggtgagcc

SEQ ID NO: 3349 - DNA, 4475 bp, Unknown
  Kingdom: Bacteria, Phylum: Actinobacteria, Class: Actinobacteria, Order: Streptomycetales, Family: Streptomycetaceae, Genus: Streptomyces
cccgacgacccccgcccggcccaggtcctcgccttcgcccgcctgcacgcctacgtgacccgtccgtgcggcggcggggacggcggctcctgccagccccgggcgcacagcgtcgcggggacccgcgagtcggccgtgctgtacgcgggtctcgccgaggcgtacgacctggcgggcggggagctgcgccgtggtgcggagccctgtcccggtgaggcgctggacggattcgtgggcgcgtacgcgagcacgtacggcgcccacgacacgtcggcgttccgccgtgtgctggcgggccggctcgcggccgatccgcgcatcgaccggtactgggacctgacggccgaggtgatcagcgctcccggtggccgtcccgagccgaccccgggctccgcgcacgactggctcctggcggccctggacgcgcagttggggacgacggccggccgcggcggtgcgctgagcgcggccacggggcgggggcaggcgtccgccccctcacccgggccggacgtactggacggggcgcgggccgtttcaccccggtgagccgggccgctcctgctccgcgaccgcctcggtcaggaactcccgcagggccagggccgccgggagcggcgtgtcgggcagtgccacgtgcacggtccggcgcagggtggggtcggtgagggggcgcaggacaagttcgccgggtaccgccggcgccgccaacgaggggaccagggccacgccgagcccggcgaccgcgtagccgaacttgcccgcccacccggcgatccgcatcacttttcgcggggtgaagcccgctcgtgcgcaggcgtcggcgagcatcgtgggccggtcaccgtacgcgctctggatccaggtctcgtcgcggagctcgtacaggtcgacggattcggccgcggccagggggtgtcggcgcggaagggccacgagcaggtcgtccccgcacagcacggtggtcgtgatcccgtcggccgaaggcaggccgtaggggtagtcgctcacgacggcgaggtccagtgttccgtccgcgagctgtcgcatcagcgtgccggtcgggctctcggcggccactacgtcgatccccggccgggcgtccttgagggcgcgcagcgcggtcggcaggagtgtgatgctggcggtggcgaacgcgcccgtgcgcaatggcccgccgtctccggcgtgcagcacggtcagatcccgctcggcccgggccaggcggtcgagcacgtccacggcatgccggtgcagcacccgccccgcgggggtgagccgtacgccgcgcgggaggcgtacgagcagcggcccgcccgcccggtgttccagcgcggcgatccgccgggacaccgcggactgcgtgtaattgagccgggccgccgcccgcgtgaacgatccggtctcggccacggtgacgagcaaccggagcgattcgttctcccacatgtcttcccctttgccgccgcgctcgtcgcccggacaccggcatcctccccgatcacattccggtcgtgcatgggttccatgcgattcggtcgctggtgtcatgtctcgggcagccatagcgtcgaatgcgcggcggcgaggaacggttgcgtggccgtccgggcccgccactcgctcagccggggacatgcggacccggtggcttcgatcccgagaaggcggttcatcgtgcggcagacccggagcgggccggagttggggcagcggatcggcacgtatcatgcggtcgggctcgcgggcgtgctcgcccagttcgcggtgcggaccatcacgctgctggcggtcgtcatgatcgtcctgctggtgtggatcaggcccaactccgcgctgctcaagggcagcgtggccgcggccgtggtgctcgtcctgttcggtctgcggctggtgtggcgcttcatcaccgcgcgatgcggcggcaaccggtgcaggctgcaccaggggggtatcgccgtcaccggcccgctcggcggggtgcgggacgcggtggtgtggcgggaggtgaccggtctgcgcaggacgagcagcgcctccctcctcatggccttccaccgcgtcgagttcgagcggcgaggcgcgccgccgctcaccttcacggcactggggctcgaacccgccctgatcggggtcctgttgaggctcgccgcacgcaacggcctggagtaggcgaccggcccggtcgcggtgggtcagcccgcgacggacgggccgaagcgctcggggtcgagagtcgccagcagtgaggtgaccacgagatcggtcgaggcggccatgtccacggattccggcgacaggagccactggacctgcaggccgtccatgaccgcgatgatggcgttggccgcgttgtcggtcaggtccgcccggccggagggcggttcgcaggcctcgcgcagggcgtcggcgacgaaggcgcgcagaccgtggtagcggtcgcggaagtactcctgggcggggtggtcgtcggtgacggactccgccgagagcaccgcgtacagccggacgatgccctcgcgctccgcgttgcgcagtgcggtgttcaccagatggcgcaggaagtccagcccctgggggcggtcggtaccgaggtgctcgatgtcccgctggtcgcgcagttcgagcacgctggtgaggagaagggccttggagcggaagtagtgcagcactcccgcctgtgtgaggccgacccggtccgcgatctcggcgagcgaggcgttgttgtaaccacgggcggcgaaggtgtccatggcgatggccaggatgtcctgttgtcgctgccgggcttccgggctgcgcggcgtacggggtttggccggactgcgcgtcggtctgcccactgactggttgctcaccggttcagcttaagcctgccggaggtccggtgaagatcttccggaccgcggggaagaacaccgggccagaccacttactaaccacttagtgagtgtgctttcatgccgttgtcccgccctcttgtgaccggcacgcccggagcgaggcgtccgccgcgccctccgtcggccggggtgcaacctgtcagcaggtacgaacccaaggagagccgcaaccatgccaagctccactcccccgcgtcggagagcgcgggcggcagccgccgcactcgtcatggccgtcggcgcgctcggcgtcaacggcgccgtcggaaccgcccgggcggccgacccggccgcacaggtgtgggtcaccactcccgacggctccaagaagctcaccccggaagggagcatccccttcaccgggactccgcaggcggtcgacatccgcatcgacgccgccgacaagggccagaagttcaccggtgccggagcctcggtgacgggcgcgtccgcccatctcctccagagcctcccccaggctcagcgcaccgcggtgctgaagtccctcttctccacggagggcgacggcatcgggctcaactacctgcgccagcccctgggaagcaccgacttcgacgcgaacggcaacgcgtacacgtacgaggacacccggggcgccttctccatcgaccgggaccggagccagatcgtcccggtcctgaagcaggccaccgccatcaaccccgccatccgcttcatgggctccccctggtcgcccccggcctggatgaagaccaacaactcgctcaacggcggcagcctgcggaccgagcactaccaggcgtacgccgactacctcgtcaaggcgatcagggcgtacggtcaggaaggcatcgctctcaccgacctcacggcgcagaacgagccggagttcgcgaccagttacccgtccatgagcatgacctcggcccagcaggcggacttcctccgggtcctggacggggcgctcaccgcggcgaacctgccgaccaacatcctggcgtacgaccacaactgggaccacccgaactacccgctcgacgtcttcgcgcggacgggcggcatccagcggatcatcggcgccgcgttccactgttacggcggagtgccctcggcgcagaggcagatcgccgacgccgggaagcgggtcttcttcacggagtgctccggcaccgacagcgcgaacccggcgacgacgttcggcgacacgctcaagtggcacaccgagaacctcgtcgtgcagaacatgcgcaacgggggcgagacggtcatcaactggaacctcgccctcgaccggaacggcggtccccaccagggtcactgcaccaaccgctgcaacggcatcgtcgagatcgacggcggccaggtcacccgcaacgccgagttctacgtcctgggccacgtctccaagttcgtccgggtcggcgcggtccggatcggatccaccagccagggtgccggtggggtgcagaacgtcgccttccagaacggcgacgggagccgtgcggccgtggtcgtcaacaccgcttccggatcgcagcgcttctccctgaccgacaacgggaaatcgttcgcctacaccctgcccgccgg

SEQ ID NO: 3350 - DNA, 2980 bp, Unknown
  Kingdom: Bacteria, Phylum: Actinobacteria, Class: Actinobacteria, Order: Streptomycetales, Family: Streptomycetaceae, Genus: Streptomyces
cacctgggcggtctccatcgccgccgaggaccgcccggtaggtctcacggcgcatcggggcctcgacgacgcccacgacccgctcgccgtcgcgctcggcggcgatggagaccgcccaggtgggcaggccgtagaggtagttcaccgtgccgtcgagcgggtcgatgacccagcggatgccggtgctgccgggggagctggccccctcctctccgaggaaaccgtcgtcgggacggaagtcggagaggtaaccggtgatcagcttctcggcggcgatgtccatctcggtgaccacgtcgatggggctggacttggtcgcggccacccccaggtcggcggggcggccgtcgcgcagcagtgctccggcgcggcgggcggcctccagggcgaggtcgagcagttcggacagggcggggtcggtcacggtgctcccaggggactcggcggaacaggcgctctacggggcatccgtagcggcgtccacggatcgggcgtacgggctgtcggccccggcggcggcgggtttcggggtcctggcggggcagcagccgaccggacagaggtcgtgcgagggacccagggatcccagcgcgcagcgctccaccgcccggccgcgctcggtcgcggcacgctccaggaccaggtcccgtacggcggcggcgaagcgcgggtcgtcgcccaccgtggcggaccggcggaccggcaggccgatctcggcggccttcgcggtggcctcggtgtcgaggtcgtacaggacctccatgtggtccgagacgaagccgatgggcgccatcacgaccgcggggaccccctcggcgctcaaggtctccaggtggtcgcagatgtcgggttccagccagggaatgtgcggggcgccgctgcgggactggtagacgagctgccacgggtactcgatcccggtctcctcgcgcaccgcctcgatgatcagccgggccacgtcgaggtgttcggcgacatacgcgccgccctcgccgtgcgcgtcggccgggcccgaggcgtcggcggcggaggtcgggatggagtgggtggtgaacgcgatgtgcgcgcccgcgcggacgtcctcggggaggtcggcgagcgaggcgaggacgccgtccgccatgggcgtcacgaagccggggtggttgaagtagtgccgcagcttgtcgacccggggcacgggcagtccctcggcctccagggcggccagcgactcggcgaggttctcgcggtactggcggcagccggagtaggaggcgtaggcgctggtggcgaggacggcgatccggcggtgtccgtcggcggtcatctcgcgcaggacatcggtcagatacggggcccagttgcggttgccccagtagaccgggagatccaggccgtgctcggcgaagtccgtgcggagcgcgtcgagcagtgcgcggttctgcgcgttgatcgggctgaccccgccgaacaggaagtagtgcttgccgacctccttgaggcgttcctcggggatgccgcggccgcgggtcacgttcgccaggaacgggaccacgtcgtccgggccctcggggccgccgaaggagagcagcagcagggcgtcgtagggagcgggatcgcgcagatcggacatgacatcgatcctgccacccgcctccgacagggcggcaaccgacatccgacgccccgtcgggaagaccggaagggatgggagccacggccgcgggaaacctgcgccgctcccccgggccggcccggaatccggtgtccggaacgcccggcccggccgtaagctgtatcggccagctatacgcctgacaggcacgaccggagtaccccttgcccagcccctaccgcgccatcttctccgcccccggttccaaggaattctccgccgcaggcttcttcggccggatgccgttgtccatgatgggcatcggcgtcgtgacgatgatctcccagctcaccggccgctacgggctggccggggcgctctccgcgaccctggcgatgtcggcggcggtctgcggcccccaggtctcccggctggtcgaccgctacgggcagcgccgggtgctgcgcccggtcacgctggtcgcggtggcggcggtggcgggtctgctgatctgcgcccagcagggggcgccggagtggaccctgttcgtcttcgcggtgggcgcgggctgtgtgccgagcgtgggctcgatggtccggtcccgctgggcggagatctaccggggttccggccgtgatctgcacaccgcctacgcgtgggagtcgatcgtcgacgaggtgtgcttcatcttcggcccgatcacctccatcggtctctccaccgcctggttcccggaggcggggccgctgatcgccgccgccttcctgctggccggtgtcttctggctgaccgcgcagcgtgcgaccgagccggtgccgcacccgaagtcccagcacaccgggggctcggcgctgcgctcgcggggactccaggtcctggtggccaccttcgtggcgacgggcgcgatcttcgggggcgtggacgtggtgaccgtggccttcgccgaggagcgcggccacaaggccgccgcctccctggtgctggcggtctacgcgctcggttcgtgtctcgcgggggccgtgttcgggctgctgcacctcaaggggaaccccgggaccaggtggctggtgggtgtctgcgcgatggccgtgagtatgatccccctccaactggccgggaaccttccgttgctggccgtggcgctctttgtcgcgggcctcgccatcgcaccgacgatggtcaccaccatggccctcgtcgaagcgcacgtaccgcgcaccaagctgaccgagggcatgacctggaccagtaccgggctcgcggtcggggtggcgctcggctcctcggccgccggctgggtggtcgacgccgccggggcgaaggcggggtacgcggtgcccgtcgtggcgggagctctcgcggcggcggtggcgttcctggggt

SEQ ID NO: 3351 - DNA, 4332 bp, Unknown
  Kingdom: Bacteria, Phylum: Actinobacteria, Class: Actinobacteria, Order: Streptomycetales, Family: Streptomycetaceae, Genus: Streptomyces
ccgcatcagccgcatcagccccaccagccgcagcagccccagttcggccaggtcccgggccagggcgctccgcccgccgctcccttcggtcagcaggcgcccgctccctacggtcagcccgcgccggccccgtacggtcagcaaccccccgtcggcatgccgccgggtgtcccgcagggcatgcctcagggagtgccccagggagtgccggccacgggcgcgggtctccaggcggccctgcagccgtacaaggagaccgccaccgggcagcgctggaccccgcagaaccagcagctcatgcgggtcgacctgaccatgggcggatccggggtcctggcccgccagggcagcatggtgatgtatcagggcaaggtggacttcggctacaagagcgccgggttcgtcggccgggtcgtgggcaacgccaccggccaggagatgcagctgatgcgctgtaccggccgaggccaggtcttcctcgccgaggagggctcgcacctgcacccgatcgaacttcagggcgatgccatctgcgtctccgccgagagcgtcctcgccttcgacgagtccctccagtacgaggtccgcagggtcgaagggcacggcatccccggcggcgctctgttcaccatgcagttccagggcaccggcaccgtgatcgtgaagacccacggcaccccggtcgtcctgccggtcacgcccaccacgttcgccgactgcaacgccgtcgtcgcctggtcggccgcctcccaggtgatcgtctccagccaggtccggctgcgccgcaacgcgtaccccggacacagcggggagaccgtgaacctccagttccggggagcccccggcaacttcatcgtcgtccagccctacgaggtctgagggagcccgtcatgaaccagcaactcgcgggcttcgccccgacccctgtcacggcccgtatggagaaccacggcaagaccatgctcaaggtcgccatggcctccgggcaggacctcttcgcacgcaccggctcgatggtggcgtacgagggcttcatccagtacgaacccaacccgcccgccgtccggcagatcgcctcccagtggatcaccggcgagggcgcacccgtcatgaagtgctccggcgacggactgctctacctcgccgactacggcgccgacgtggtcgtcatcaacctcaacaacgactccatctccgtcaacggcaccaacctcctcgccttcgacgcccacctcacctggggcgtcgagaaggtcaaggggctcgccaagttcgccggacagggcctgtggaacgtcgtcgtccaaggcaccggatgggtcgccatcacctcgcggggcaccccggtcgtcgtcgactgcggacgcggcgaggacgagacgtacgtcgacccggacgcgctcgtcgcctggtccccgaacctcaaggtgaagggcaagcggagcttcaaggccggctcgctgatcggccgcggcagcggcgaggcgtaccagatgggcttctccggccagggcatcgtcgtcgtccagccgagcgaggacagcacggaccgcctgcggatccggaactgacggggagggagaacacatcatgcagagtccgcttttcagccacaccgagcagcagacccaggaccgctacgcgatccagaacccgcagctcctgcgggtctcgctgaccggccacgacgacgtcctcgcccgcaagggcgccatggtcgcctaccagggcctgatggacttcgacggggaataccagtcccagggccagcgtcgcgcccgcgcgaacacgggcgagggcctcgacctgatgcgcgtgtccggccagggcaccgtctacctcgccaacctcgcgcagtacatccacgtcgtggacgtcgaccgcgaggggatgaccgtggacagcgcctacgtcctcgcgctcgactcctcgctgcacaccgaggtcattgcggtggacagccagtacgggatctccggcagcggaaagtaccagctcaacatctccggcacgggcaaggtcgctctcatgacctcgggccagcccctgatgatgcaggtcacgcccgagaagtacgtcaacgccgacgccgacgcgatcgtcgcctggtccagctccctgcgtgtgcagatgcaggcccagacgcactcgtccggtgtcttcaggcgccgcggcaacaccggggagggctgggagctgagcttcctcggccagggcttcgcgctggtccagccgagcgaggtcatgcctccgcagaacgcccagatcggccagggtgcccgcgcccagttcggcgtggggcagcagggctcccagggccagaaccagaacaacgcctggaactgaccggcacccgcagggcacagcagtaaggggcggcctccatggaggccgccccttacgcatatccatgcagcctgtcgctacagccgggaccgcgtcgcgtccagcagccgaacgacggaagcgtcggccacaccgggcacgtcctcgtagccgaaccagcgcagctccagggactcctcgctgatccgctccgccgatccggccggggccagcgcggcgtactggacatcgaggtgccagttgcagggagacggaatcgggtgccggtccagccggaccggtccgccgggcagcagggtgagccccgtgatgccggactcctccgtcgcctcacggagcgccgccgcctccaggccgacgtcctgcggttcgcagtggccgcccatctggagccacatccggagcttccggtgcagggtcagcagaaccttcccccgctccggatcgatcaccagggcgctggccgtcagatgcccggccccgcacgccttccacatgccgtcgtcgtgctgagccaggtggtccagataggcctgacgcagctcagcctggtcaccggccgcgtccccgggggcgtaccccttcagtacgagaacggcgtcgtcgcgcagggtcactggtcgcggccgtccttgctgtcgccctcgtcctcgccgtcacccttgccgtcgtccttgccctcgacggccttcggcttcggctcaccctccgccgcgggcttcggcgagcccttcgccgcctcgccgagcatcttgtccagctcggagaagtcggcctgctcgtggtgcacaaagccgtccgggtcgtccaggtcgtgggccgtcggcagcatgtccgggtgggcccagagcgcgtcccggccctccagaccccgggcgtccgtgagcgaggcccacaggcgcgaggcgtcccggagccggcgcgggcgcaattggagaccgatgagcgtggcgaacgtctgctcggccggtccaccggaggcgcggcgcctgcgcatcgtctcgcgcagcgcgtcggacgaggtcagccgggacttcgcggcctcgtggaccaccgcgtccacccagccctccaccagcgcgagagccgtctccagacgggccagggacgccttctgctcgggcgtgtcctccggctggaacatgccctgctgaagggcgtcctgcaactgctccggctgtgagggatcgaactggccgacgacgtcctccagcttgctggtgtcgaccttgatgccgcgggcgtacgcctcgacagcgccgaacagatgcgaccgcagccacggcacatgggcgaagagccgctggtgagcggcctcgcgcagggccagatacagccggacctcgtcctgcgggacgctgaggtccttgccgaacctctccacgttcagcgggagcagcgcggccttgcccgccgggcccagcggcagcccgatgtcggtggaaccgaccacctcaccggccagcacgcccacggcctgcccgatctgctggccgaacatggcgccgcccatcgaccgcatcatgccgatcagcgggcccgccatggcctgcatctcctcgggcagcacatcgcccatcgccaggcccacccgctcggccaccgggtcgaccagctgctgccaggccggcagcgaggcctcgacccactccgcgcggctccacgccacggtggagaccgaaccggacggcatcgacgtcacaccgtccagccagaggtccgccagccgcagcgcctcgtcgaccgccgtgcgctcggacgggccgacgctggcgtccttggagccgtccggggcaccctgcgagaccgtctggcgggcgatctgcttggccatgtcccagttcacgggaccgccctcgtagctcagcatctgaccgagctgctggaaggccgcgccgagatcgttcggattcatcgtgccgaacattgcggcgaacgggttgtccccgcccgcccccggcccgaatccgaacgggcccccgggcc

SEQ ID NO: 3352 - DNA, 16193 bp, Unknown
  Kingdom: Bacteria, Phylum: Actinobacteria, Class: Actinobacteria, Order: Streptomycetales, Family: Streptomycetaceae, Genus: Streptomyces
cctcgacggcctccgcgacgacctccgcgaggtgccgggcccgccgtccggccagctggtcgagctgcgtacggcaggagaagccgtccgcgaggagttccgtaccgggttccgcgttccgtacggcggggagcagccgctcctccgcgcaggcgacggacacctcccagtggcccttctcgaaaccgaagttgccggcgagcccgcagcagcctccgctgagttcgccggtgagacccatccgttcgcgcagcctgcgctccgcggcgtcgccgaggaccgcgtgctggtggcagtgcgtctggccggcgaccgggcggcccgggcgcggcggcgtccagtcgggggcgtactcctccaggtactgggcgaacgtccgcaccgcagcggccagttcggcggcgcgcggatcgtcggggaggagttcgggcagatcggtgcggagcgtcgcggcgcagctcggttcgaggaccacgagcgggtggcccggcaggaggcggaggcggtccagggtgcggcgcatcacgcggcgggccgcgtcgagctggcccgtcgacacataggtgaggccgcagcacaccccgcgcgtgggcggcagcaccgtgcgtcccgtcgcctcctccaggacccggaccgccgcccggcccacctgcggggacaggtgctcggtgaaggtgtccgcccagagcgccaccacccggtccgacgcgaggatccgggtccccttcccctgacggcggagcagccaccggctgtacgtctccgtcgccagcaccgggatcgtgcgctcgggcgcgatcccggccagccgtttcgcgagcgcggcgaggggacgcagccgggccagcgcgttcctcagcatggctgctccgtgccgggcagctgctcggcgtcgtgcggcagctccgcccagacgatgcgcccggaggcgtatccggcatcgtgcgaaccccaggcgctgctcatcgcgtcgacgaggagcagaccgcggccgtgctcgtcgtcggacgagcggcgcagccgcgggccgccgggctggtgcccctggtcctgcacggctatccgcagtcgtctgcctatccggctcagctcgcacaccacccgggtgctcgcggtgtgcacgacggcgttggtcaccagctcggagacgatgaggacggcagcgtcacaggcgtcgtggcccagcttccaggcgtccagccgggctcgcgtcagctcgcgcgcaccggccaccgactcggggtgcgccggaagcgcgaagcagtaacggagcgtctccgtcccggggctgaggtccatgagccgggggatgagcgcactgccaggtgccacgaccgattcctcacagtgggggctgcgtcacgcttcgttccccgggtgaaccgggggcggacgtgactgagcgaactggttctggagtcaactctccccctgacgatgacacttggcaaggggcactctgaaatttccagagtgactgtgtcgttgggggcgcacgcatggcacactgctcgcaaacagcgcatggggaggtctgaagtgagcgaaccgcggtccgccccgaccgtgggccaggtcgttctcggcaagcgtctgcaggatctgcgcgagcgtgtcggcctgacccgtgaccaggcggcgaaggtgctcagggtcgccccggcgacgatacgcaggatggaaacggccgaggtcgggctgaagatcccctatgtccagctgctgctgaaggcgtacggcatcgccgaccaggaggccgacgccttcgtcgacctcgccgaagaagcgaacaaaccgggctggtggcagcgtttccacgacgtcctgcccgactggttcagcatgtacgtcagcctggagggtgctgcgagcctgctgcgcatgtacgagccgcacttcgtgcccggactcctccagaccgaggactacgcacggtccgtgatgcggaccggagcagtgggccagacccggcccgaggacatggagcgccatgtggcgctgcggatggagcgccagtccctgctggccaaggacgacgcccccaggctgtgggtgatcatggacgagaccgtgctgcggcggcccgtcggcagtgcgcaggtgatgcgcgggcagatcgacaagctgctcgaatccacggagcttccccacgtcacgcttcagatcgcggagttcgccaccggccaccacccgggaacctacggaccgttcgtcctcttccggttcgccgtccccgaactccccgacatggtctacagcgagtacctgaccggagccgtctacttcgacgcccgacccgaggtggcctcctatctcgaagtcatggaccgcatggcggctcaggccgcaactgcacaacgcacgaaggaaatcctccaggatttccgcaaggagctgtgatgaaccacatatacaacggcatgcctgccggtgacctcggctccgaaggctggtacaagccgtggagcggtgggaacggcggcaactgcatcgaggccatgaagctcgccgacgggcgggtcgccgtacgccagtccgccgacccggacggccccgctctcatctactccaacggcgagatcgccgcgttcatccagggcgccaaggccggccaggccgacttccttctcacctgagaacgcacccccatattctttcggctgttccccatcgtcgacgtacggacccctgaccacggagcgcgtcatgaccgggcaagaaccccactccatcgagatcgacaccagcaagccgcatccggcccggatgtacgactggttcctcggcggcaaggacaactacccggtcgacgaacagatggcgcgacagctgctcagcctggacgcgcggggccgtgacatggcgcgggtcaaccgggcgttcatgcaccgggccacccgctggctcgccgggagaggggtgcgccagttcctggacatcggcaccggcatacccaccgagcccaacctccaccagatcgcccagcgggccgcccccgacgcgcgcgtcgtctactgcgacaacgacccgatcgtgctcgcccacgcggcggcgctgctccgctccacgcccgagggcgccaccgagtacatccaggccgacgcccgcaagccggagaccatcctggcggaggcaggcaaggtcctggacttcggccggccgatcgccctgtcgctgctggccctgctgcacttcatcgacgacgaggacggcgcgggcgaactgctcggcaagctggtcgagcagcttccctccggcagctatctggtgctctcgcacaccaccggcgacttcaacccggagggcgccgcgcaggcacgggccatgtacaaggcgcgcgggatgacgctgcggccccgcagccgcgccgaactcaccgccttcttcgacggcctcgaactggtcgagccgggcgtctcgctctccgccgactggcatccggagctcggcgaggtcatcgacgtcccgggcgacgagccgatccccggctatgccggagtcgcccgcaaaccctgaaccttcggtccgccgccggtccgcccgctcgcacccgacgcgggcgggcggtggcctagtgtgctcaggcgccgagagcgtgtcccgtggtgacgtccacatgcccgggcacctcgtcgtgcgcatcgcccaccgtcgacgtccccgacggttcgaggagcatgatcgacgcgcccccgtcggaacgggggcggtgccagaccccgcgcgggacgacgaagacggcgccccgctccagggtcacgcagcgctcaccgccgccgtcgccctcaccgccgtcgcgcagagcgatgtccagcgtcccctccaccacgaggaagaactcgtccgtgtcctcgtgcacatgccatacatgctcgccggccaccttggccacgcgtacgtcgtagtcgttgacccgggtcacgatgcggggactccacaacgcctcgaaggagccaagggcggcgctcagcagaatcggctcggcgacgcacggcgtcgcgttctcgttgctcatgggttccatcctgggcgctggaccccaccgcccgtgagtgctacgaatcgcatatggcgaaagaatcctcgcatcgggtcgtgatgatcgtatcgaccggttccaacccgttcgaaatgggtgtggcgaccgaactcttcggcctgcgcaggcccgagctgcccgtcgactggtacgacttcaccctgtgctcgcccacccccacggtccgcatgcactccggcttcttccagctctccggtgtcgccgggctgacggccgtggaccgcgcggacaccgttatcgtgcccaaccggcccgaccctctggaggagccggacccggacgtcctggcggcgatccggcgtgccgacgcccgcggcgcacgcctcgtcagcttctgcacgggcgccttcacactcgccgccgcgggggtgctggacggcagacgggtcaccacgcactggcggtgggcggaggccttcaccgcccgctacccgcacgtcgatctcgacccggacgtcctgttcgtcgacgacggccgggtgatcacggcggcaggcagcgccgcggccctggacaccgcccttcatctcatccgcgccgaccacggtgcggagaccgcggcagccgtcagcagacggctcgtccacccggcccaccgggacggcggccagcgccagttcgtcgagcacccggtccccgagaccgccgacacctcgctcggcccgctcctggagtgggccaccgggcatctgtccgacggcctggacgtgaccgcgcttgccgcccgcgccgccgtcagccctgccacgctccaccgtcgcttccgcgcccagctcggcaccacgccgctggcctggctcaccgagcagcgcgtcacgctcgcccgccgcctcatggaacgcggcgaggaccgcctcgacgtgatcgcccgggccagcggactcggcacggcgaccagcctgcgcacccagctccgccgccgtaccggactgacgcccaccgaataccgccgtcgcttcgccccggaccgctgagcccgccgccacgcgtcacaatggacccatgtcacgacgcacctcccggccccgggggcccgccgccgcgcggatcacctccgcctccccgtgtccctgcggcctgcccgccgcctacgggcagtgctgcggccggttccattccggcagtgccgccgctccgacctgcgaggccctgatgcgctcccggtacgcggccttcgtcgtccgggacgcggcgtacctgctgcgcacctggcaccccgagacccggcctcccggcgtcgacttcgaccccgcgatgcgctgggtggggctggacatcctggacaccaccgaaggcagcgccttccactccaccgggacggtcaccttccgcgcccactacaccgacgacgggcgccccgactccctccacgagaagagccgcttcgtccggcacgacggcgcctgggtctacacgacggcggtcttcgtcgactgagccggccgcacagcctcccgaaggtgtcccgaacgcgtcccgagcggcggcccggacacatcggggacgtcggtcgcgaggcgcgaaatccgtttcccgacaggtcgtgtgcgaccgtacgatccgcgcatggacgaggacgaggcagcgacgccgtacgccgcgcgggaacgattctggcggggccgtgacgtcggcttcactcctgtcgagcccgacgacgccgaactgatccaccgctggcgcgccgacccggtggccgcccacgagatcggcgtctggcccggctccctccacgaactccgcgagcgcgtcgaggccaacgtggaggaccggcaccgggacgacttcctcgtcctcctcgcggacggcaccccggtcggccacatcgccctcatcgaggaggacttcgtcgacggcacggccgaggcctacctcctcctcgcccccgaacaccgccgcaagggcatcggagccgacgcgctggaagccctcaccgatctggccttcggcgaactgccgctgcaccgggtcgaggccgtcacccacaccgacaacgcggcggccctcgccaccctgagcggagcagggttcgtccgcgagggcgtacgccggtcctcctgcctgcaccgcggccgccggcacgacaacgcggtcctcggcctgctccgcgcggagtgggaggcgctggcccgcccccggtcctgggagcactgacccgcccgtacgggagtggcccgcccacacgggagtggtcggggccccggccgggaacaggcccgagccaccgcctcggaccaccgcctcagaccggggccccgacccgcctcgaaccgccggggccggccgccggtgacagctcctgggccaggtcctccgccagcagccgtttggcgatcacatccaccgtggcccggagctgacggtcgtcggggcgggcgccgtcctcggccaggcgctcgttgagccagcgcccccaggcgtcggagatcaccgaggcttcgcgccggcccgccgccgtgtgcgagaagatccggccgtcgcccgtcaggtagccctcctcgatcatccggtcgaagacgggaaccagcacctccggcgggatacggtgccgggccgcgatcagcccgagaccggcgtggccgaccatcctggtgaagaggtccacctgcatcaccgcccaggcccccgccatgtcgaggcgcgtgtcggactcggcggtgatccgccgggcggtgtccgggcccgcgccgtgcaggatcgtggccacggagtactccaggaccttcgccgagtccccgctgcccggctgggcgaagccctcgcccatgtccgtcgacccgagccgcgccgagtcccgcagcttcacctccttcaggaacagtgcgacgacgaagccgatcagagcgacgggcaccgtccacaggaacacggtgtgcagggtgtccgcgtaggcctgggccagcggttccgactgggcggcgggcagggcgtgcagcgcctgcgggctctgcgaggcgccggccagggccgccgggtcgccgcccgccgccaccgcccgcgcgacgccgtcggtgaggttcggcttcagcgcgttggcgtagatggtgccgaacaccgccgtgccgaacgcgctgcccagggtgcggaagaacgtcacgcccgacgtggccgtgcccaggtcctcgtagtcgacggtgttctgcacggcgatcgtcagcacctgcatcgccaggccgatgccgagtcccagcaccaccatgtagagcgactccagccagacgccggtccccggtcccatccgggacagcaggaacagcccggccgccatgatcagggtccccacgatggggaacacccggtagcggcccgtcttgctcaccacgttgccgctgaagatcgaggcgaccagcaggccgacgaccagcggcagcgtccgcacccccgaaagggtcgccgagtccccgtccacgtactggagataggtcggcaggaagatcatcgagccgagcatcgcgaagcccacgatgaaactgaggatcgagcagaccgtgaagaccggattccggaacagccgcatcggcagcatcggctccttcgcccgcgtctccaccacgcagaacagcgccagggcgatcagcccgccgacgaacagcccgatgatcatgggtgagccccatgcgtactcgttcccgccccagctcgtcgccaggatcagcgcgctcgccccgacggtgaccagcgcgatcccggagtagtcgatgaccggccggccggcggccttcaccgacggaatgttccgggcggcggcgatcaccaccacgatggcgatcggcacattgacgtagaacgcccagcgccaggtcagatggtcggtgaagagtccgccgagcagcggcccgatcacggtcgagatgccgaacaccgccccgatcgcgccctggtacttgccccgttcgcgcagcgggatcacgtccgcgatcagcgccatcgacgtgaccatgaggccgcccgcgccgatgccctgcataccgcgccagatgatcagcagcagcatgtccgacgcgaggccgcacaggaacgaacccgtgatgaagatgatcgccgagacctggaagaccagcttccgcccgaacaggtcgccgaacttgccgaccaggacggtggccaccgtctccgccagcagataggcggtgaccacccacgacatgtgcgcggccccgcccaggtccgagacgatcgtcggcagggccgtgcccacgatcgtctggtccagtgccgcgagcagcatgcccagcacgatcgtcgcgaagacgatgttccgtcgtcgccggtcgaggacgggcggcggtgcggcggcactctgcgcggcgggggcttgctcgctggcagtggtcacctctgcaccctcacaccggcgcggggcccccgcatgcggggacgggccggacgggggtggtcagcggggcagcgaggcgatcgaggtcttcagccgcgccacgaacgtctcgcggacgtccttgccgacccggtcgagcgacagatacggattcaggtcctccagctcgacgagcagcagggcgccgtccgccgtccggcaggcgtcgacccgctggatcccgtgcgtgagggagttccaggcgatgaagcgccgggcgaactccaggtccgccgcgctcgccgcgtacggctccagcacccagcgccgctccggatccggagcgtacagcgcgtactggaagtcgtggtcgacgaagtagaaggacacctcgtggcggaagtcgatccgcggctggacgaggagcgaaccctcggccgccccctccagcgcggcggccgcctcctccgccgtgacgaaccgcagcccgaccgagtccgctcccagcttcggcttgatgacgtaccgggggacatcgggcagctccggcagatccgccgcccggtccaccgtggggatgaccgggaagccggtccggctcatctcgaccagatactccttgcccgccatgtcgccacgcccgcccagcgggttgtagaccggcgtccgcagctcccggacccgggagagatacgcgtcgtacgcctcccggtagtgcagcacgggcccgctgttgcggatcagcacggtgtcgaagcccgccagcagcgcggccgagtcccggggatggcagagcgcgacgtcgaacgtctcgcgcagccgggagccgaggaagatgtcctcgtcgcagtagcggcggccgcgggcctcgtacgcgaggtcggtgacgagcaggagggacgggcggcgtgcgccggcggatgacgcggcggtcatggggttctcccgggatggggacgcggacggacgatcactatcgtcgatgcccggccggcctcgcggagcgggtggctcccgttacggcggggtcactcaccgcttccggcgggagtccggcggcccgcggtcagacggcttccgtggctccgccccgtacggccgccacccactcgacgagcagccgctcgtactcccggcggccctcgggcgacaccacaccgccgtcggccaccagagcgcggatctccgcgttcagtacaaccatcgggcgggcaggcgtcggctcggtcgaagtggaggtcatgtgaagaggctagtggcagggaggccggagaggcaccggtgcagcgtgtggggcccaccacgggcaccgttcgtccccgcctcgaagcggtccaccggcatggagtcgtcccgtgccgcgaccctccccacaccgtcgtcacggatcgccgcggaacgtcacgaccgggcggcccggaccctgttgtcgcacgtcggcggggtgcggcagggcctcggcgctgtcgtgtgcccgtcccgacgcgctcggtgacggtctccgcccggcccggcccgatgacgatctccacggctccgttccccgtgggcgtacgcgttcggggcgacgaggatcacacggattcggggccgagcgggcccggatcggggacggatccggcagccgactcctcctcagcggatgtgccgccccgagatcgcccgcgcgatgacgaggcgctggatctcgctggtgccctcgaagatcgtgtagatcttggcgtcgcggtacatccgttccaccggatgctcccggctgtaacccgcgccgccgaggatctgcaccgccttctccgttgccgcgaccgcgagttcgccggcccgcagcttcgccatggagccctgtccggcgtcgaaggtccggtcgttgcgggccatccaggcggcctgccagatcagcaggcgtacggcctcgatctccgtgcggatgtcggccagggcgaaggcgatcgactggttctcgatgatcggcctgccgaacgcctcgcgctcaccggcgtattccagggcgtactcgtaggcggcccgggcgatgccgagtgcctgcgccgcgacggtggggcggctgacctcgaacgtcgccatcgccgcctggcccttggcggcaccgccctcgcgcgccctggccaggcgcgcgtccagcttctcctttccgcccagcagacagtgccccggtacggtcacctcgtcgaggaagagatccgcggtgtgcgaggcgcgcagccccagcttcttgaccgttcggcccgccgtcaggcccttcgtgccgggcggcacgatgaacgcggcctgtccgcgggatccgagtgccgggtcgaccgaggcgacgacgacgtggacctcggcgatgccgccgttggtgatccacgccttctggccggagatcacccaggcgtcgctcgcctcgacgtagcgggccctcgtcgtcatcgcggagacgtcggatccggcgcccggttcggagacgcagaaggcggcgaccttcggttcgtcctcgtccccgtagcactgcggcacccactcggcgagctggtccggggtgccggaggcgaagattccggcgaccgcgagcgaggtgccgaacagggccatgccgatgcccgcgtcgccccagaacagttcctcgttggcgatctggagggagagcccggtggggtccccgtacaggtcggcgagcgactcgaatccgtacagaccgatccgggcggcctcctggatcacgggccagggggtttcctcccgggcgtcccactcggcggcggccggacggaccacctgggcggcgaagccgtgtacccagttgcgcaggtcctgctgctcctcggtcagggcgagggagaagaagctcatgcgctcacgccttcgggatgtcgaagtagcgggtcaggccggaggcgaggccgacgtctccggcgaccttgagcttgcgcgtcatgaacatcgtgaccggattgccgttgcccgagacgagtttgaggaactccgcgtcgctcatcaccagggtggtgcgcggttcggcgtcggagcggccgggggtgacccggcaggcgccgtcggctatcgcggtctcgtagacggcgtcgctctccccggtgaccttccagcggatcagcgcggtgaggccgccggccgcctcgggacggaactgttgcttcatccggccgaagatctcgccgagtatccgggtgcgcagttcgccccgcatgacttcggcgagttgtttggcggacaggctcttgacgatccgggcgaactcctcgggtcctaccgccgcgaagtcgagcccggacaggtcgtcggtgaggttgtcgctgctggttccgtccacgccagttccttactccaaagtaaacttacttttgagtaaggtaaggggagtggtggcgccccgcaaggccggttcgccgtgcgtcggggtgagatgcggcaggggagaggtgggagccggtcagaagggcgagccgggcagcacggcgagttgggggtggcgcgcggccagcaccttgttggcacgggccagttcggacagggcctgttcgcggtcggcctggtcctcgacgccgagccggggaccgcggaacctgcgtacctcgcgggccgcgcagtcggcgtcgaactccgcctggaggatgtgcggcggaatgcacgagccgatcagcgcggcgacccggtccgggatcggcacggggacgaggaggtgcgaggcggtcatgggacgttccctctcggatggttggccaggaggcggtgcacgggtcctgtcgcctgatgggcggcaggttccttcctgtgtacgggacgcggttccgggtttctcgtcggatacgtctccgtgtcgcaaccgtttgggactgaccgtctatttcgccttacgcgccggtaagttgacctgccgcgccgaacgtgatccggatcagggggatgtgcccgtggaacgggagcgcagccgcagcgcgcgcagcaccgcctcggtggcgaaacgactctcgggatcgacgagttggtcaccgaagatggtctccaggctccgcatgcggtaacgcacggtctgcgggtggacatccagcagtgcgcccatctgggccgccgtgccccgggtgtcgagccagattcgcagcgtctccaccagccggtcgcggcgggtggcgctgatccccgcgacggcggccagctcccgctgggccaactggtccagcagggcggggtcggacagcagccacagagtggtgaggtggtcctcgcagcggatcagcggtgcgtcgtcgatcacgccggagtcgacgagctccagtacccggcgggcccagcggatcgactcgcaggccagcgccgtgggaacggtcaggccgatcgccgcgcggccggccggcagagcctgttccagcatcgatcttcgtgcgtcgtccagcgctccggggatcaacaggtgcggctgcggggcactgagatcgacgaggagatcgcggtccgcgctgagccggtccagctccgccggagcgcggacggcgatcagcgtgacctcctccggcagcgcccacccgacctgctcgcacagatcggcgatggcgcttccgggggccgggcgaccggcgaggatgaggtggagcagacggcggcgcaacgcttcgctgtgctcgcccgactgggactgcacttccaggaaaccctcccgggaaagcgattccagttcgtcgacgtaggcgaagagcgcgtcggcgaagctcagcatcagggtgggggacaggtgatagctctgcccgaccttcttcgctcgccgcagggccacccgtgcgcccagccggtaggccccctggagggtgtccatgctccggccctcgtacgcctcgaaccgtccgaagcgccggcacatgtcgtcccggagcgtggtgggggaggtgggctcggccaccagatcgacgaaggaggcgaggctctgctccacgcccacccggatggcctgcccgttcgggccgtcgagcagtcgggcgtattccggataggcccgggtgacctcgacgccgatttccttgatgaggctgggcagttcgggccgcatgatcgccgcgaattcctgagggagcggccccagcgggtcttcggtatccaacggctgtatgagatgtggcatgacaagtccccttgctctcggcgcccggtggtggggtgaggcggtggggggaaagcgctcccacgaaccgacaggtgcgtaccaagttcgcgacgaagatagaccaacgaacaggcactgcacaccacttggacaagatcgaagtgcagggggcacacatcccggccgcactgtgcgacttccgtgcaggtcgggcggtgctacgcgctttcggacaatgaatttcggccgcatgctccggcgatgacaacaaagccgttccgccgtcccggggatgatcccggcgtggtgcgcgcggcatcggtcgacccttgcggcgaacgggcgcgcgtgcggctcaccacggcgaatgcgggtgggtggtcgcaccctgacggacactttcggccgagtggccgaattgcgcgccagccgtgcgggagcggaagcgagacttccgcggtccccggcgtcgcggtgccgcgtacgcacggcacgcggggttccggtcgccggtgcgcaattccgcgtccccgggtgcgcattccctgacaaggagacggtgctcggatgctcatttccggatcaaaaagagtgcggtgcaaagaatcttaggcggacggattgtgtcgccctgtttcccgcgagtaacatcacgcctcgatcaattcggtcacgaaatctgcccgaaatttgatgctccgatcctccgcccccgggcccacccgaggctccatcaccgtcgacagccgtcgcggtgcgggctcgcgttgcagaaccggtcaacttcgtgcacgaggccgcgccacggcggcccacagaggggacgacatgagatccgtttccaaccgaacccgcgtaggtctgctcgcggcgttcacggcattcagcgccctgctctccaccggctcggccaccgccgccacccagctcaacggcgactgggcgcccttcgaccgctgcccggtcgacgcgcccgccatgctggcggcggacggcctcaacaccatcgccacctgcatagcgtcgagctcggccaccggaaccatcacgctgggcaagaccaaggtctccaccggccacaccgatctgcagctcggagtcatccagcgccccaacggcgccgcctcactggtggccccgcccgagggggcgctgaccgcggacccggcggagatccccggcgggctgatcgggctcatgtgtcccagcggaattccgctcgtatcgggaatctgccgccagttgacggacaacaatctcaaccgtgtgacagccaccatcgaaccggccggagcgccgcgcgacttcaatatgagcgcggcattctccaccggtgagcccattctcaccattccggtccgcatccacctcaagaatccgttcctcggtgacaagtgctacatcgggaccacgtccaacccggtgctcctgaagccgcagaacacgaccgcgccgagcctctcgctgcagcggttctcggccgacgggacgccgaacgacgacgagggcgagatggggcgctacaccttcgacggcgccgaccagggtgactccacgttcgccgttcccggggccagcggctgcggtgccgggctcctggactgggcggtgaacctcaagaccggcctcccgtccgccgccggaaagaacagcgtgacgctcgacgccaccacgacctacttcggcagcccctacgaccccgccggtctcgcgccggacgagggcaggaagctgtccgaattctggcactccgcgaagcggtaggccctggtcacgatcagccggacacgctccgacccccggtacgaggaggtgatgcgacagcagccccccgtccttgtccacgcacctcgacacgagccggtgtcgtgggccccgccgagtgccgcaccgtccggcacggcgagcaactgagcaagcgcctctccagtcacgttcagtcgaatccccaacgggacgagaaaagggagtacccccatgttcaagcgaaccggtgtcctgaccgcgatcggtgccgccgcggcatccgtcgtcctggccgccccgtcggcagtcgccgcgccgaccagctggacgatcagcccgaccggcgccttcaacggcagcgccggagtgaccgtcctgaccgacaacaacggcaacaagatccagtgcgcgacctccgcagcctcgggctcggcgccgacctccccggtcgcggggagcccggccaagctcgcgtccatctcggccatctccttcaactcgccctgcaccgggccgttcagctcgacgtggacggtgaccaccacgccgccgtgggagatctggggcctggactacgcggcgggcgccggcaccaactccacgggccaggtgaccggtgagatcagagcgatcaaggcgaaggtgtccgggagcagcgtcctcggtccctgcaccttcgacgtgaccggcaaggtcgcggccaagtacaacaacccgaccgcgggcggcagcaacggcacactgaacaccgcgggcggcggcctcaccctcgccatcgccaacaaggtcggcggcggctgcggcatcgtcggcaccacggccagcttccaggggctgtacaccatcgtgaacggggccacgggcaagtctccggtcatcagcgggtgatccaccgccgatgacgtcccgtacctgagcgtcgtgcccggccgtgcgcaccagacggccgggcacgacgctca

SEQ ID NO: 3353 - DNA, 2823 bp, Unknown
  Kingdom: Bacteria, Phylum: Actinobacteria, Class: Actinobacteria, Order: Streptomycetales, Family: Streptomycetaceae, Genus: Streptomyces
ctcctggtccacgcccggcaggaagcccggcacgtccacgaaggtgatgacggggacgttgaacgcgtcgcaggtgcggacgaagcgcgccgccttctcgctggcgttgatgtccaggcagccggcgaactgcatgggctggttggcgacgatgccgaccgggtggccctccacccggccgaagccggtgatgatgttcggcgcgaacagggcctgggtctccaggaactcgccgtcgtccagcacgtgctcgatcgcggtgtgcatgtcgtacggctggttcgccgagtccgggatgagcgtgtccagctcgcggtcctcgtcggtggtggcgaggtccgcctcctccgggaaggccggggcctcggagaggttgttcgacgggaggtacgacagcagcgacttgacgtactcgatggcgtccttctcgtcgcccgccatgtggtgcgccaccccggaggtggtgttgtgcgtacgggcgccgcccagctcctcgaagccgacgtcctcgccggtgaccgtcttgatgacgtcgggaccggtgatgaacatgtgcgaggtctggtcgaccatcaccgtgaagtcggtgatcgcgggggagtagaccgcaccgcccgcgcacgggccgacgatcagggagatctgcgggatcaccccggaggcgtgcacgttgcggcggaagatctcggcgaacagaccgagcgcgacgaccccctcctggatccgcgcgccgccgccgtcgttgatgccgatgaccggacagccggtcttcagcgcgaagtccatgaccttgacgatcttctcgccgtagacctcgccgagcgaaccgccgaagatcgtgaagtcctgcgagtacacgcagaccgggcggccgtcgaccgtgccgtaaccggtgacgacaccgtccccgtacgggcggttcttctcgatgccgaagttggtggagcggtgccgggcgaactcgtcgagctccacgaaggagccctcgtccagcagcagctcgacccgctcacgggccgtcagcttgcccttggcgtgctgcttctcgaccgcgcgggccgaaccggcgtgcgtcgcttcgtcgatgcggcgcgtcaggtccgcgagcttgcccgcggtggtgtggatgtcgcttagcggctcggacatcggggggcggctccctgcctggtcacggggacgacgtctggcaccggtcacggggggacggccagccgtcagtccggctctggctactgactcgtagggtatcggcgcgcctccggaaaggcagtgcgtcctttgccacacctaggctgggttgcatgacaccaccggatgcgccacacaaccgctggtcggacctcgaccggccgcccctcaacgggaccgcactgcggcgcggactgctgcggccggacacgctgtggacgtcgctggaggtcgtggagtccaccggatccaccaacaccgacctcgccgggcgggcccgtggcggggcggcggacgagggcacggtgctggtcgccgaggagcagaccgcggggcgcggacggctggagcggacctggaccgcaccgccccgctccgggctgttcttctcggtgtacctggagcccggcgacatccccgtggagcggtggggatgggtcccgctgctggccggggtcgccgccctgccactcgtgatcgtcgcgacgatggcgctccgccgcggggacccggcggtcacactgcgccaccagggggaccactgacatgcggcacaacaaccgggcggccaccgccccgtggatccgtacccggctgcgtaccgcgcccggtgcggcgacggcactcgcggtgctggtgcttgtgacggcgttcctcgccgcggcgttcccgcgggccgtggacgcgtacgagacgaaggggctgcgccacgacatcctgacggcggacgcgggccgcagcaccctggaggtctcccgtccgcagcccggtctggaactgccgcaggcgcagcgggacgccgaggcgcggagccccgagctggcgcggatcggggccaggctcctgaaggcactgcccgcaccgctgcgcgccgacaccccgtcggtcgctttcggggtacgcacatcgaagccggccgtcgcgaacgagccctggctgccgaggcccgatgcggttccgccgcagctctcgtacgtggcgcagtcgggtctcaaggagcacgccaccctggcctcgggcgcctggccgacgacgccgcgggaggtgacttcggactcccgtgcggtgcagggcgcggtcaccgaggagactgcggccgagctgaaggtgaaggtcggcgcgaccatcacgctgctcaccgcggcgcaggaacccatcaccgtgacgatcaccggcatcgtggccccgcgtgaaccgctcgggagctactggtccgccgatccgctgctgcgcacgccgtccctgatcccggaccccacgagccccttcccgcagcactactggaccggcaccgtcctgctggccgaggacgccggtcccgtgctcctgagcacggccgccgagcccgtactcttctggcggatcccgcccgacccggccgggctgaccggccccgacagcgcccgactgacatccgtcatcgcctcgctggagagcggccccgggctgctgaaggtgcgggagatcgccggggacaccgcggtgttcgccaccggactcggccacatcgtggaggccaacgcgcggatgcgcgacgcgatcagtcccgtgatcgcggtcgccgccctcgggatcggctccgtggccgccgtcgtcctgctgatgacgggggccctgctcgcaggccgccgc

SEQ ID NO: 3354 - DNA, 4288 bp, Unknown
  Kingdom: Bacteria, Phylum: Actinobacteria, Class: Actinobacteria, Order: Streptomycetales, Family: Streptomycetaceae, Genus: Streptomyces
  misc_feature (726)..(748): n is a, c, g, or t
cgccccgtaccaccggggcgtccagcgcgtgggcgatgatctcggctccgtgccggtccgccagctcctgcgcggccccgtagtggtcgcggtggccgtgggtgaggacgatgcgccggatcccggcagggtcgaggccgagcgtgcggatcgcgtcctcgatcgcggcggccgaatcgacgtcacccgcgtcgatcagggtcagatccgtcccgtcgcgccagagataggcctgaccgatccggaagcggaacatgtgcagctgggggagtacttcgacgagatccatgcggcgaacgtacgcagcggcggacgcccgccgcacggatctacgcttcgggcgacttcgccgagggcgtagcggagcgcccccggcctccccgaaaggcggtcgcgtgaggtcagaccttcttcgactccgcgtagttccgcaggaacagcgcctcggcgaccgacatccgctccagctcctcgggcgacacgctctcgttcaccgcgtggatctgcgcctcgggctcgctcagcccgatcaggaggatctccgcctccgggtagaggcccgccagcgtgttgcacagcgggatggagccgcccattccggaggactgcatctcctggcccgggtaggcgtcccgcatcgcgtccgccatcgccgtgtacgccgggctggtcatgtccgcgcggaacggctggccctggcccacctgttccacccgcacccgcgcnnnnnnnnnnnnnnnnnnnnnnncgcaccccacggggcgcgggactccaggtgggcggtgagcagcttcgtcgcctcggctgcgtcctggcccggcggcacccgcaggctgatctgcgcccgcgcgctcgcctgcacggacggcgtcgcgccgacgaccggcgggcagtcgatgccgatgacggtgacggcggggcgggcccagatccggtccgcgaccgtgcccgtgccgatcagctccaccccgtccagcaccttggcgtcctgccggaactccgcctccgggtactggagcccgtcccagtcggcgtcgcccgtcagaccgtccaccgtggtcgtcccgtcctcggcgcgcaacgaggctagcagctggatcatcgcggccagcgcgtccggggccgcgccaccgaactgccccgagtgcaggttcccttcgagggtgtcgagctgtacccgcagcatcgtcatcccgcgcagcgtcgccgtgaccgtcggcagcccgacccggaagttcccggtgtcgccgatgacgatcgtgtcggccgtcagcagctccgggtgcgcctccgcgtaccgctccagaccgccggtgccctgctcctcggaaccttcggcgatcaccttcaccgagaccgggacgccgccgttcgccttgagggcgcgcagcgcgagcaggtgcatgatgaacccgcccttgcagtcggccgtgccccggccgaaccagcggccgtcgcgctccgtgagctcgaacggcggggagatccacgccgactcgtccagcggcggctgcacgtcgtagtgcgcgtagagcagcacggtcggcgcgccggccggaccgggcaggaacccgtagacggactgcgtcccgtcgggggtgtccagcagggcgacgtccgtgaaatcctcggcgcgcagcgcctcggcgacccagttcgccgcgccctcgcactcgctcctcgggaacaccgccgggtccgccaccgactggaacgccaccagctcggccagttcctcccgggcgcggggcatcagcgaggcgacggtctcgggaatcggacgggcggtcatgggcacgctcctcgtgggtgcgacgttatgggtagggcgcggtgtgtacgcgaccgtgtgcgacgccgtcggtgcggcgacgcatgtacgacgaaaacatggccgatcctcccacaggagggcttggccggaacgcgccgtaggatgccgtgagcagctggggccactggtcggatcaggagcagaagcacatcgtgagcagcgagaacgcagacgccggacgtgagccggaagagtcgtccgtgtgggacgtcgtcgtggtcggcgccggaccggccggcgcatcggcggcgtacgcggcagccgtggcgggccggagagtcctgctgctggagaaagcggaactgccgcgctacaagacctgcggcgggggaatcatcggattctcgcgggactccctgccgccggggttcgaactgcccctgaaggaccgcatccacgcggtcaccttctcgctcaacggcaagctgtcgcgcacccgtcgctcccggcgcatgctcttcgggctcatcaaccgcccggagttcgacgccggtctggtcgaggaggcgcagaaggccggagccgaactgcgcaccggcgcatcggtggtgcgggtcgagcagcacggtcccgccgtgcccgaccggcggacggtcgccgtggtgctgaccggtggcgagaccgtgctcgcgcgggcggtcgtcggcgcggacggcagcgcgggccggataggagcccacgtcggggtgaagctcgatcaggtcgacctcggcctggaggcggagatcccggttcctgccaccgtcgcggaggactgggcgggacgggtgctcatcgactggggcccgatgccgggcagttacggctgggtgttccccaagggggacaccctcaccgtgggcgtcatctcggcgcgcggcgacggcgcgggcaccaagcggtatctggaggacttcatcgctcgcctcggcctcgccgggttcgagccggccgtctcctcgggccacctcacccgctgccgcagcgacgactcgccgctctcccgcggccgggtggtggtctgcggggacgcggccggactgctggagccgtggacccgcgagggtatctccttcgcgctgcgctcgggccggctcgcgggggagtgggcggtcaggatcgccgagtcccacgacgcggtggacgcccgccgtcaggccctcaactacgccttcgccatcaaggccggtctcggtgtggagatgggtgtcggccgccgcatgctcaagctgttcgaacgccgcccgggagtgctgcacgcggtgctgaccggcttccgcccggcgtggaaggcgttcgcggggatcacccgggggacgacgtcgctggccgagctggtccgtacgcacccgctggcacagcgggcgctctccgcgatggaccgctgaggtccccctcacgaccgtgctcctcggggcgccgttccgtccggtcggggcggcggcgccccgacgtcgtacggggtggtcagccctcgaccgtgatgcggaagaccgggtggtccgggcagaccgccagcagctcggcgtccgtggacttcgccgtgatcccctggaagtactggttgacctcccagccccaccgctccagctaggcccggatgatccgggccttctgtgcgtcgtcggcgatctccacggcgctgaagcggctgacctcgcgccccagccgcagttctccgccacccgcgacgcgcatgttgcgcaccccctgcgagtggccccgggccgagacgatgtaccgctcgccctcgaaggcgtgggcgttgaccgggacgcgctgcggctgcccgctcgtgcgcccgcgcctggtcttcatcgacatcgtccgtgccgccttccgggccgaggacctcgccgtgccctccctcgccccggagctgcgttccgacgcggagcggatggccgccgagttcgtcccgaggtgcctccggccgccgtggcggccctggtcgccgcctgggtccagtttgttcggcctgatctcgttcgagctgttcggccggttcaaccgggtcgtcgaggcgcgcgagccgctgttccggcaggccgccggtgagctggcccgctcggtgggcctgcccggcgtccgtacgacctgacggcggagcaccgctttcccggtggcgtactccccacggagtacgggtgatcaccacgcacggcggacgcctccgcgcccgtccgccgtctagcgtggccgccatggacgaacaacaaccgccgcaccggggcggcggtcacccctgcggtttcccgggcccccggcctcccggacggccgggccggcgaggcggcccgccggcatggctgtccggcgcgggttcgcggaccgccgccgggctgccctgggtgtcgacggccgtcctcctggtgttcgtcatggtcggctcgggattcgccgagcacgggcaggaccgccggcccctggacctggccgcgcggctgctgctgttcgtcgcggtcgtcgtgctgc

SEQ ID NO: 3355 - DNA, 2856 bp, Unknown
  Kingdom: Bacteria, Phylum: Actinobacteria, Class: Actinobacteria, Order: Streptomycetales, Family: Streptomycetaceae, Genus: Streptomyces
  misc_feature (281)..(282): n is a, c, g, or t
tgcgcgacacgtaggttttgacggtctcaggcgtgatgtacatcgacgcggcgatttccgcattcgagagcccctcggcgatcagctggaggacctccagctcgcggggggtcagcgcacgcacgacatcctgtctggccggccgggaggtgtcggccggtcgcagatgctgggcgaagtggccgatgaggtcgcgggtgacggcgggtgccagcagggcctcgccacgggcgaccgtccggataccgttgaccagctccgccggaggcgcgtccttgagnngggcatccggatgtccatcacgaccacgtcgggacgcagcagccgcgcggcccggaccgcctcgtggccgttcccggcctcccccacgacctgaaggtcgcactgcgcggagaagatggtgacgtagccggtccgcaccagcgcctggtcgtcacagacgagcacacgggtcagtggcggcgtatcgctcacgaggtcactcctgaaggggcttggacggaatcgtggcacggacctcgaacccgcctccgggcccgggaccggccgccagttcaccatcgagcatccgcacccgtgcacgcagcccggccagcccccgcccgcccgcggggtccggcttccacgcgaccggcgcggcggcgggtccgtcggtggtcaccacgatctcgatgtgctcgtcgccgtgccggagcaaaacccgtgtcggcttcccggccgcgtgcttcaaggcgttggtgagcgcctcctgcaccacccggtaggcggccagctccacgtccacgcgctgcggccgccgctcgccctgctcgccgaactcgaccggctgacccgacctgcgggtctcctcgaccaggtcccccacccgccccagggcgggtgcccggctcacgcccgccggttcagcggaagccgcctcaccggtcgcctccaggacaccgagcagataccgcagttccgtcagcgcccgacggccggtgtcgctcacggccgtcagtccctcgccggcgcgctccggcgcggacgtgagcaggaactgcgccgcatcggcctggaccaccatggccgtcacgtggtgggtgaccacgtcgtgcagctcgcgggcgatccgcgcccgctcggcggccgtggccaccacgacggccagccgccgccgtttcccctcttccgtccgccgcatgcgcaccgcgctccccaccagccaggccgtggccggagccagagagaacgcgaggtagtcgggtagccaattcggggagccgagacggttcaggacgacggccagcagggcgtaacccgcactcgccacgacgaccaggccgtggcggaagcggacctggtgggccccggcggagtacagggccagatacagtcccatgctcgcgaacgttgtcgcgaagcccagcgcctggtgcgcggcgaacgcacccgcgatgacggccagacaggctgcgggccacctgcggcggaccgccagcggcacggtctgggccaggaccagcacgacgctcagcacgtccgcgggccgctggggcagatcgcctatctgcgcaccgatcggggacaggggcggcacgaaggccaacagggtgagcgtcagggcgatgacaccgtccttgacgagagcgtccccctcccgccaccggtcgagcggtgcccgaagcggcgggaggcgccagagctcctgacgggacatcacttctgtttcctccagccggtctgcctcaacgggacgcgttccggcgggacttgatgccaccaccgcgatgagcgcggacgagcatcggaacggcgacagccacgcccatgaggacgggcaggatcgatgcctccagaccgaagctgccaccggtcagaagggcggagccatggacatcgacggtgaacaggccctcgggtgggtgcccggagaccgggatgccgagcagttgctccgtggtgttccaggcgaagtgcagccccacgacgaaccagatgttacgccgccacagaaacgcggctccgagcaggacgcccgcctccagggcgatcgccagtccgctccacgcgctcgctcccggggcgcccaggtgggcgacaccgaagaacagcgaggtgatcacgatggcggcccggctaccccacagctgctcaagagcctgcagggcaagaccgcggaacagcaactcctcggtgaccgcggctccgatctgcaccacgacagcggtccagaggaccgacatgaagccgtcgccagcccaggtgaaggagtagcctccgaacgccgcgatcaggagggcggagacaaggatgaaacccaggccgatcccgccgcccagcagcacctcccgggcggccccggaccgggcgatctccggcgtggagcgtcgtgccacacggcgcatgacgtagcagtacacggccaccgcggcaaccgctcccagcatcggcacgggaccgggtccggtggccgtcagccccgacaccaggccgacgccgaccattcccgccgccatccagccgagcggagaccgcatgatccgaccgaagcgtccgccgtccccgtcgcggcccttgcccgggccggagcccgcgctgtgtcgtacggcggatgtcgtgcccatggtgcctccccggtagtgggtcaccccgcggcgacctgacgaccacagtaggaatccgcggacgtccgcaaatcacccgtgcatggacagctcccgtagctctcacgggggatgcgccacccgcccgcgccggctccgccacgggacgcggccggagcgcgaacgggactacaggctcagcgcctgtcgaggggtgggcgcttcgtcctgggcgcccgcgggccgcgactccccgggggcgacgggcttgtcg

SEQ ID NO: 3356 - DNA, 2281 bp, Unknown
  Kingdom: Bacteria, Phylum: Actinobacteria, Class: Actinobacteria, Order: Streptomycetales, Family: Streptomycetaceae, Genus: Streptomyces
gtggtgggcgtcgccgacgacgacgcccaccacctcgccgtcgccgacgctcccgcccgccccgccgtccaccgttccgcagccgccgatcgtctcccgggcgggctgggaggcggacgagtcgctcagcagcgaggcacccgactacctggaccaggtcaaggccgtcttcgtccaccacacggcgcagacgaacgcgtactcctgcgccgactcggccgccatcgtgcgcggtctgcacacgtaccacgtgaagtcgaacggctggaaggacctcggctacaacttcatcgtcgacaagtgcggcacggtcttcgagggccgcaagggcggtgtggaccggcccgtgatgggagcgcacacctacgggttcaaccgggacaccaccggcatcgccgtgatcggcatgtacaccgacaccaaggccgcgaccgccgcgaccacatcggtcgcccgcgtcgccgcgtggaagctcgggcagtacaaggcggacccggccggttcggtccagctcaccgccggggcgaacggcaccaacatggaccacaagcagttcgtcgccggcagccagtaccccttcccgcggatctccggacaccgggacgggttcgccacggagtgccccggcctctccctctacggccagctccccgccatccgctcactggccgccggacccgtcaccggtctcaccatcgcctcggtgaccggggcgaacgcctccggctccacgtactacacccggtcgaagatcaccgtcggctggaaggcgaccaccccctccgccttcgtcagcggttacgaactgctcgtcgacggaaagccggtggccgccgtcaagggcaacgtcacctcggccccggccaccctcgtcgccggcaggcactccgtgcaggtccgggccacccaccagtcggggaagacttccctgtccccggtcgcgaccgtggtcgccgacatcgcaccgccggtcttctccaccaagccggccctcaccctgcgcaccggcacggtgaactccaccgccgtcccgctcaccctgaagtggaaggccaccgacgccgcctccctcaaggaggtccggctcaccgcccccgtcgcgaagacctacggcccgaccacgctcagcgcctcgcacaccgccaagtccgccacggcgaccgcctggaagatgacggcgtacgaccgcgcgggcaacacggccgccgcctcggtctccggcacgccggtgatcctccaggagtccgccgccacgaagagcggtaagtggaccacgaagtcctccggcagctacctgggcggcaggtcgtactccagcagcaccaagggcgccagtctgacctggacgttcaccggccggtcagccgcctgggtggtgtcgcgggccgccacttcggggcaggcatacgtgtatgtcgacgggacgaaggccgcaacggtggacctgaagtcctcgaccacgaagtaccggcaggcgatctggacgaagtcctggtcctccagcgccaagcacacggtcaagatcgtggtcgtcggcacgacgggccgtccgaccctgaccacggacgggctggtctacctgaagtagccgccggaccaccgcaccgcgagaggggttggcacatgaccgacatcgtggcggggactcccccgcgggtgaggaccgtgcacggcaccgtgcgcggtgcggtggagcgggacgtcgcggtcttccgcggcatcccgtacgcggctccgccggtgggcgcgcgcaggttccgcgcgcccgggccccccgaaccgtggacgggggtgcgcgaggccgtggcgtacggcccgacggcccccaagcggccctaccccccgccgctggaccggctgctgccggatccggcggtgccgggcgacggctgcctgaacctcaatgtgtggacaccctcgcccgggccgggtgcggccgggctgccggtgctcgtctggatccacgggggttcgctggtgcacggctcctcggcggtgccggtgtacgacgggtccgcgttcgcccgggacggagtggtcctcgtctcggtcaactaccgcctgggcgtcgagggcttcggcgtcttcccggacgcgcccgccaaccgggggctcctggaccagctggccgccctggagtgggtgcgcgacaacatcgcggcgttcggcggcgacccggaccgggtgacggtggccggggagtcggcgggggcggtcagcatcgccgctctgctggccgcaccccggtccgcgggactgctgcggcgggcggtgctccaga

SEQ ID NO: 3357 - DNA, 5807 bp, Unknown
  Kingdom: Bacteria, Phylum: Actinobacteria, Class: Actinobacteria, Order: Streptomycetales, Family: Streptomycetaceae, Genus: Streptomyces
cttctgctccggcggcgacgtcgacgagatcatcggcgccaccctggccatggacaccgcacagctcctcgacttcaaccggatgaccggacaggtcgtccgggccctgcgggagtgccccttccccgtcgtcgccgccggagcagaagccgcgcccctcgccggcgaggacgagggcgcggacggaacgttcccgggagagctcggcgaggaggtcgcgcagatccgcgtaggcgccgaaggtgagcgcgttgagtttctcggggcgggcgaatgtgacggtggccacaccgtcgtcccgggtcagccgcagatgacgccattcctcggcgctcggggccgagctgggaaacgggctcatggaggggtccccttcagcgatcgggctggtgccggccgtgcgcgggtcgcgttccgcctccgaagttatcacccttgcgtgactgccgtcacgaggtcgcaatacagcatccatgagaccgttgtggcgaaagtcccctttgctccggccgaccgcctctatggctgaaccggagcggttcgtaaggttgaaactaggaagtcccgacacgagtaccgcgtgaaccccagaagtcgagacctcccgcttcgaggaagacccgctcccgaacggaaaccccgccgtgccgcccgacgtccccgtccccgcttcctggcgcatcgccctgccgcactccaccgcggcggtgccgatcgcccgcgctctcatccgtacggcgctgtcggacatcgacgccccggccgacagcgacaccgccgagctgctgaccgccgagctggtggccaacgcggtcgagcacaccctgggcggtgagcccatcgagctggtcgtggagctgctgcccaccggctgccaggtcgaggtgcacgaccgcgaccccgccccgccgggcgacctgtcccggccgcagccgggctacgaggtcgacccctggcaggagcacggccgcggcctgctgctgatccggaccctcagctccgcgtgcggtcaccgcaccacggagcacggcaaggccgtctggttcacgcttccggcgataccggcgcagccgggtccgtccccggggagctgaccagccgggagcgcccccgcccgtagccggcgtacagcagcgagccgacggcgaggaagaccgcgaactggacccaggtcgtccagccggtcccgtacatcagatacaggcagaacgcgacgcccagcacggggctgacagggtagagcggcacccggaaggcccgcttcaggtcgggcgcgctccgccggagcaccaccaccgcgacattgacggcgaccatcgtggcgagcgtgccgatggtcgtcaggttcacgacgacgtcgagcgggacgaacgcggcagggaccgcgaagacgcaggccacgatccaggtgttggcgaccggggtgtgggtcctgggagagacccgctcgaagacacgcgggatgagaccgtcgcgggacatggacatcagaatgcgggtctggccgtacatcacggcgagcaccaccgaggcgatggcgacgaccgcgccgaaggcgatgatgccgccgccgaccatggagtcggtgacctggttgacggcgatcgagagggccgcgctcttgttcgcgacggcgtccgagccgatcgcgccgatcgccgagagcgccaccgcgcagtagagcagggtgacgacgccgatgcagatcaggatggcgatcgggatgttgcggcgggggttcttgacctcttcgccggcggtggtgatggcgtcgaagccgatgtaggagaagaacgcgagcgacgcgcccgcggtgatcccgccgagcccgtgggtggcgaacggcatgaggttgtcgtcctggaacgcgctgaacgccaccgcgcagaacgcggccaggatgccgatcttgaggaccgccatggcggcggtggccgtggcgctctcccggacgccgcgcaccagcagggtggcggccatggcgatcacgacgaccgccggcaggttgaccacaccgccgtcaccgggcccggaggacagggccgcgggcagttcccagccgaacaggctgttcagcagctcgttgacgtactggctccagcccaccgcgacggcggagaccgacacgccgtactccagcaggaggcaccagccgacgaggaaggcggtgcgctcgccgagcgccgcgtacgcgaaggagtacgagctcccggacaccgggatggcgctgcccagctccgcgaaggagagagcggtgaagatgcaggtgatcgccgcgaggacgaacgagatcacgacggcgggtccggcctcggcgacgctgtcggacaacccgacgaagatgccggtgccgacgatcgcgccgaccccgaaacagacgagctggaagagacccatcgtgcgcttgaggccgtggccctccaggtcgccgccggactcggcgatgagcagatcgggactcttgcggcgcaggcccggcttcgaggggccggggcgctgcggggtgccggaatacggcagaccggggctcatgcgggacgttctcatctctggtggtgcagtggggggacgtttcccggtgcgtacggcggccgtggggaccgcgggcggcacacgggaaggggtccgggcatcgcgagcccgaaccccaccaagaggcgacatcgtagccaccatcgcgcatgttcacccaatcgggtgtatgagcatgcgaaacgcggctacttcgcggccagcgtcgccaccagcacggccttgatcgtgtgcatccggttctccgcctggtcgaagacgaccgagtgcgcggactcgaagacctcgtcgctgacctccagctcggtcagcccgtaccgggcgtggatgtcccggccgacctgggtgccgaggtcgtggaaggcgggcaggcagtgcaggaacttcacgtccgggttgccggtggcccgcaggacgtccatcgtcacggcgtagggaccgaggccggcgatgcgctcggcccacacctccttgggctcccccatggagacccagacgtcggtggcgacgaactcggcaccccgcacaccctcggcgacatcgccggtcagggtgatcgtcgcgccgctgacctcggcgagctcccgggcccgcgcgacgacggcctcgtccggccagtacgcctcgggggcgacgatcctgacgtccaggccgagcagggcgccggtgatcaggtaggagttgcccatgttgaagcgggcgtcgccgaggtaggcgaaggccgtccccgtgacaggcccctcgcggcactcggtcacggtgagcacgtcggcgagcatctgggtgggatgccagtcgtccgtgagcccgttgaagaccggcaccccggcgtacgccgccagctcctcgacggcctgctgactctcaccccggtactcgatcccgtcgaacatccggccgagcacccgggcggtgtccttcacggactccttgtggcccatctgggagcccgacgggtcgaggtaggtggtgaaggcgccctgatcggcggcggcgacctcgaacgcgcagcgcgtgcgggtcgaggtcttctcgaagatcagcgcgatgttcttcccgcgcagccgctggacctcgaccccggccttcttggccgccttgagctcggcggccagggagaccaggccgagaaactcctcggaggtgaagtccagctccttgaggaagtggcggccggtgaggtctatggccatgatgactgctcctgggtcggacggggatcggcgcactgcgcgcgggcagaactggaagtctatacgatccaccgcatctctatacaggcctccctgtgcgggacccgtgggtcgcggtccgcgcgcctctcatgccacggggtcccgctccaccggacagctcatacagcgcggcccgccgcgtccccggcccagctcgctgccacggatctcgatcacctcgatgccctgcttgcgcagataggtgttggtcgtggcgttgcgctcgtacgcgacgacgaccccgggctcgaccgcgagcacgttgcagccgtcgtcccactgctcgcgctcggccgcgtgcacgtcctgggtggcggtgagcacccggacggagtcgaggccgagggcggcggcgatggcgcggtgcatgtgttccggcggatggtcggtgaccttcagttcgcgggggccgctgccgggctcgatggtgtaggaccggagcatgccgagaccggcgtactgggtgaacgtgtcgccgtcgatcatcgtcatcaccgtgtccaggtgcatgaacgcccgggccttgggcatgtcgagcgccacgatcgtgcgcgccgaaccggcgtcgaagaggccccgcgccagcatctccacggcctggggtgtggtgcgctcgctcatcccgatgaggaccgctccctgcccgatgaccaggacgtcacccccctcgatggtggaggggtagtcgtcctggccctccgaccagtggtggaaggcgcccgcctccgggccggtgaagaggggatggtgccggtagatcgcctcgaagtggacggtctcgcgctgccgggcgggccagcgcatcgcgttgatggagaccccgtcgtagatccatgccgaggtgtcccgggtgaagaggtggttcggcagcgggccgagcaggaagtcgtccaggtccatcacgtggaagcggacggaggtcggctcgctgtgccgctccaggaactcccgcttggtcatgccgccgaccagcgcctccgccagctcctccgaggacaactcctcgaaggcggcccgcagatgctcggtggcgagcggaccgtactccttctcgtcgaagacccggtcgagcacgagccgccgggcgaccgggatgtcgagggactcgcgcaggagatcgccgaagaggtgcacggcgaccccccggtcgcgcaggacgtcggcgaacccgtcgtgctcctcccgggcgcggcgcacccacagaacgtcgtcgaacaggagcgcgtccttgttcctgggggtgagccgcttcagctccagatcggggcggtgcagtatgacgcggcgcagccgcccggcttcggagtcgacttggaatcccatgccttcatcctcaccgcgcggagcgccgttcaccccgcgaatcgcctacgggttggacggctctcagaggcgggggtccaccggctccgactccagggccagaaccgcgaacaccgcctcgtggacccgccacagcggctcgccctccgccagccggtccagggcctccagaccgagcgcgtactcccgcagcgccagcgagcgcttgtggccgaggaaccgggagcgcagacgctccagattctccggacgggtgtactcggggccgtagatgatgcggagatactcccggccgcgcaccttgacgccgggctggacgagccggcccttggggtcccggacgagggcgccgagcggcttgacgaccatgccttcgccgccccgcccggtcatttccagccaccagtccacgcccgcgcgcacggaggcctcgtccccggtgtcgacgacgagccggcgggtgacctggagcagcccggtcgggtcgtgctccacgagccggtccagccaggcgagctgctcgtcgtgcggcacggaggccagggagcggccctggacggcgaggatctggaacggcgcgagccgcaccccgtccagcccctcggtgggccagcagtaacgccggtaggcctcggtgaacgcggccgcgtcctgcgcgcgggcccgctggtgcccggcgagacccgccacctcgacgccccgggcgaccgcctgctc

SEQ ID NO: 3358 - DNA, 7553 bp, Unknown
  Kingdom: Bacteria, Phylum: Actinobacteria, Class: Actinobacteria, Order: Streptomycetales, Family: Streptomycetaceae, Genus: Streptomyces
gctctcgtctgtcgatgacacgggacaagtctggcctatgccgccggccaccggtcccccgccccgagtcgaccctcccggtcccgttaccgccctgaacgggatcagcggcgttcagccgttgtccaccggacgcgcacgggttcaacgctcatccaccggacgcgcgcgggcttcagcgcctgtcggccgggacgtccatggccgtgcagaccccgcgccagacgtccttggcgtcccagcccgcgtccagggcctggtgcaccgtgcggccgccgagttcggccatcacatggtcacgggcgaaggagtccgcgtacgccgcaccgaagtggtcggccatccgctcccagaaaatcgtcaaccgcatgccaccagtatcccgctcctgagagtgcagccggtccgccgggcacctgccgggctcctttcccctctacggtcggtccatggctggaaccggagcaaacaccctcgcccgcgccgagcagttcatctggctcacggcccgtgtcctcgaacagcggaggttcgcccacgccttcctgggcggagatcccgacaccgtcgagacggccctctccgcctatctgaacgaggacggcggctacggtcacgcgctggagcccgatctccggggtccggtcagccagccgttgcacaccgcccacgcgctgagcgttcttgattcgatcggccgctgcgacggacagcgcgtcgaacggatctgtcgctatctgacccatgtgtcaaccaaagaaggcgccttgcccgctctgcttccgacgcagcgcggttatcccgcggcaccgttcatcccgatcgtggacaacccgccggcggagctgctctcgaccggcccggtcgtcgggctgctgcacggcaatcaggtgtggcacgcctggctgttccgggcgacggacttctgctggagtgccgtcgaggctctggagcagtcccatccctacgaggtcgaggccgcggtcgccttcctggacggcgcccccgaccgggcccgcgccgaggcggcggccgaccggctcggccgtctggtgcgcgaacaacgcctcgcggtgctcgatccctccagacgggcggagtacccggtcgcgacgggctacgcaccgggcgagcaccacttcccgcacgactacgcccgtacgcccggatcgctggcccgccgctggttcacggacgaggagctggagcgctcgctcgaccacctggccgccgagcagcaggacgacggaggatggcccgtgacctggcgtcagtgggcgccgggaaccgcgctggaggggcgccccctggtgacgctcagggccttggggacgctccgctcgtacggtcgtccgctcggctgaccgcgtatccggcgggccacccgcggcctcgcccgccgggtacccgattctcaggccagcgcgcgtacgcccgccgtgaccagaacgcccgcgccgacgacgaccaggaaaggagcgcgaaggaccagggcgagtgccgccgctccgagaccggcggcgcgggcgtcgaggacgagctgctggccgtcgccgaaggtctgctgcgcggtgagagccgccagcagcgccacgggcagcagagcggccatccgctggacgagcggtcgctccagcacgcctgcgggcaccagcaggcccaggagtttggcgaggtagcagcccgccacggtcagtccgatggcaatccagacgttcatgagcgccgctcacccttctcccgctgtgccgccgagccgtccgcggcgttcccggcgtccggtccccgcttcgtccgtcccatgaggaagaggacgacgggcgccgcgagcgccgacagcaggacgggcacgcccgccggcagaacgggcagcagcgtcagggccagcaggacggccagccccgccgtgacgcgttcgatggtgctcttgagcatcggcgcgagcagcgcgaggaacaccgcgggactcgccgcgtccagtccccacacgtcggtgtcgcccagcgcctcggcgcccagggcgcccaccagggtggtgaggttccacagcacgtacagggtgagtccggtgaccgtgaagccgatgcgcgcggcccgccgggtgggctgcggcagggtgaccgcggtcgtctcgtcgatgacccagtgggcggcgaagggccgtaccgcacggggaagggcgagcagttgggagagccgcagaccgtagaacgcgttccggacgcccaggaagaacgccccggccgccgccgtgtaggggttgccgcccgcggccagcgcgccgaccagggcgaactgcgaggcgccggtgaagacgagaagactcaggacgcaggtctgcaacaggctgaggccggagccggcggaggtgacgccgaaggcgaagccggagaggccgacggcgataccgacgccgagcgcgtcccggacgacggccgcgtccggcttgtccggtcgggcctcggccgccgggcctggcggaccggcggacatggcaccggccgcgccggtgctctctgggggtgctgtctgttctgccacgcccggaacgctacggggatcgttcggtccgggtcttgtacgttcttgcacactcggcggtacggtcgcgcaccctcaccggtccggccgcggtactccgcgctcgcgctggtaggcgccgggcggcacacccacgatccgggtgaagtggcgattgaggtgcggctggtccgtgaagccgacggcggtcgcggcctcggcgggcgcgacacccgcgtcgagcattcggcgggccctgcgcacccgggcattggtgagccacgtgtggggcggcatcccgtactccttcttgaaggctctcagcagcgcgaacggaccggtgcccagctcggccgcgagcgtctccagtgtgggcggtgcggccatgcgctcctccagcgcggctcgggcgcgcaccgcgttccgcgcacccccggggtgcgcggccagtccgggcagcgggctgccgtgccggctgaggagccgggtgaccaggattcggagcagactgtcggccgccagcgcgttgccctcctccgccgcccggtgcacctcggtgatcaggcgggaggcgtgggggtcggtcacccgggtctcggcgaagccgaccgtgccgcgcagggacgtcacctcggccgcgatgtcgttgacgacctggaccgacgggtagagcgtggcgtacgcccagccctcgggcgcgccggaacgagcgttgtgcggcacctccgggttgatcatgacgacggttccggggaccgcgtggaccgtgccgcccggcagacccacgtcctccaccccacgggtgaccgcgccgaagacatagccctcgtgactgtgccgggagaaggtgtggcggacgtaccgggcgcgcagcagatcgaggtcgggcagcgcggcgtactgccagtgccgtgcccattccgccgtgccgtccactcccgtcatggggccattctcccaggtcccgttcgtgcgccaccggccgagcgggccaccgcgggcggtgtcaccggcccgttgtcagtgccggggtgcacgatggggagcatgaccggatccgcgctcgacgcgttctcgcccgcgacccgcagctggttcgccggggccttcagcgcgcccaccgcggcgcaggagggtgcctggcgggccatcggcgagggcagcgacgtcctggtcgtcgcgccgaccggttccggtaagacgctggccgcgttcctcgcctcgctggaccggctggcggccgggccgccgcccgcagatgcgaagaagcgctgccgcgtgctgtacgtgtccccgctcaaggccctcgcggtcgatgtcgagcgcaacctccgctcgccgctgaccggcatccgccaggagtcggtgcgcctgggcctgccggagccggaggtgcgggtcggcatccggtccggagacaccccgcccgccgagcggcgttcgatggtgaccaggccgccggacatcctgatcaccacgcccgagtcgctgttcctgatgctgacgtcctccgcacgggacgcgctggccggcgtcgagacggtgatcctcgacgaggtgcacgcggtcgccgggacgaagcgcggcgcccatctcgccctctccctggagcgtctcgacgagctgctgccgcgtcccgcccgacgcatcggcctgtccgcgacggtccggccggtcgacgaggtggcccgcttcctgtcgccgcagcgcaaggtggagatcgtccagccccggtccaccaaggagttcgacctctcggtcgtcgtcccggtcgaggacctgggcgagctgggcggctcgcccgccacggacggtgactccggccaggcggacaagccctcgatctggccgcatgtcgaggagcgcatcgccgatctcgtgcagtcgcaccgctccaccatcgtcttcgccaactcccggcggctggcggagcgcctgtgcaaccggctgaacgagatcgcgtacgagcgggcgaccggcaccgcgttcgaccccgacaacccggcccccgctctcccggaggcgcacgctcccgccgagatcatggcccagtccggcgcgggcaggggtgctcccgccgtgctggcccgcgcccaccacggctcggtctccaaggagcagcgcgcccaggtcgaggaggacctcaaggcgggccggctccccgccgtggtggccacctccagcctggagctgggcatcgacatgggcgcggtcgacctggtgatccaggtggagtccccgccctccgtcgcctccggcctccagcgggtgggacgggccgggcaccaggtgggcgcggtctccaccggggtggtcttcccgaagtaccgcggcgatctggtgcaggccgccgtggtcaccgagcggatgcgccaaggggccatcgaggcgctccgcgtcccgtccaatccgctggacgtcctggcacagcagctggtcgccatggtggccctggacagctggcaggccgacgacctgctctccctggtgcggcgggccgccccgttcgcctcgctccccgagtcggcgttcaccgcggtgctcgacatgctcgccggacgctatccctccgacgccttcgcggagctgcgcccccgggtggtgtgggaccgcgtcgggggtacggtcacgggccgccccggcgcacagcggctcgccgtcacctcgggcggcaccattcccgaccggggactcttcggggtcttcctcgccggggccgacccgaagaagggcggcggccgggtcggcgagctggacgaggagatggtctacgagtcccgcgtcggcgacgtcttcaccctgggcaccacgtcctggcggatcgaggacatcacccgggaccgggtcctcgtctcgcccgccccgggcgttccgggccgactgccgttctggaagggcgaccagctgggccgccccctggagctcgggcgggccctgggagcgttcctccgcgagatcggcgggctctccgacgaggacgcccggctgcgcctgctggccgccgggctcgacgcctgggcggcggacaacatcctggcctacctggacgagcagcgccgggcctgcggccacgtaccggacgaccggacgatcctggtcgagcggttccgggacgagctgggcgactggcgggtcgtcgtgcactcccccttcggcgcccaggtgcacgccccctgggcgctcgccctctccgcccgcctcggtgagcgctacgggatggacgcccaggtcatgcacgccgatgacgggatcgtgctgcggctgcccgacgcggacatgatgggcctggacctgctcgatttcgacgccccggacgccgggaacggcggacccgcgccgggagccgtggcgtacgacagcgaccagcccccggtggcggccgccgacgtcgtcttcgaccagggcgaggtccagcagatcgtcaccgaccaggtgggcggatcagcactgttcgccgcccggttccgggagtgcgccgcgcgcgccctgctgctgccccggcgctcccccggcaagcgcaccccgctctggcagcagcgccagcgggcctcccagctgctccaggtcgcctcggagttcggctcgttcccgatcgttctggaggccgtccgcgaatgcctgcaggacgtgttcgacgtccccgggctcacggaactgatgggtgacctggaggcgcgccgggtccggctggtcgaggtgaccacccaggagccctcgccgttcgcccgctcgctcctcttcggttacgtggcccagttcctgtacgagggcgactcgccgctcgccgaacggcgcgccgccgccctctccctggactcccatctcctcgcggagctgctgggccaggcggagctgcgcgaactgctcgaccccgaggtcctcaccgagctggagcgggagctgcagtggctcaccgaggaccggcggatcaaggacgtcgagggggtcgccgacctcctgcgcgtcctgggccctctcaccgacgccgagctggccgagcgcggtgccgagcccgcctgggcgccggagctggcctcggcccgccgggcgatccaggtccggatcgccggcgccgaccactgggcggcgatcgaggacgcgggccggctgcgcgacgccctgggcaccgcgcttccggtcggcgttcccgaggcgttcaccgagccggtgaaggacccgctcggcgatctcctcgcccgtttcgcgcggacccacggcccgttcaccgccgccagagccgccgagcgcttcggcctcggcaccgccgtcaccgacggggcgctgcaacggctatcggcctccggcaggaccgtccagggcgagttccacccggcgggcatcggccaggagtggtgcgacgccacggtgctgcgccggctccgccgccgttcgctggcagcgctccgccaggagctggagccggtgccgcccgcggccctcgcctccttcctcccccagtggcagcacttcggctccaacggcctgcggggcatcgacgggctggcccgcgccgtcgagcagcttcagggcgcgcccgttcccgcgtcggcactggagaagctgatcctgccgagccgcgtcatggggtacgccccggcgatgctcgacgagctgacgaccacgggcgaggtcgtctgggccggtgcgggcgcgctccccggcaaggacggctgggtctccctctacctcgccgacagcgcgccgctcctcctgcctcccccgcacccgctggagctgtcggcgctccacgagtccgcgctcaccacgctctccggcgggtacggcctcttcttccgccagatcgccgaccaggtccgggccaccacccacccggactgcacggaccagcagttggccgacgccctgtgggacctggcctggtccgggcggctcaccaacgacaccctggccccgctgcgttcgctcctgggctcggggcggacggcgggctccaccgcccaccgctcccggcgcagcgtccagcgcgggcgctatggctcactcaccgctgccgcccgccccgcgtcccggac

SEQ ID NO: 3359 - DNA, 507 bp, Unknown
  Kingdom: Bacteria, Phylum: Actinobacteria, Class: Actinobacteria, Order: Streptomycetales, Family: Streptomycetaceae, Genus: Streptomyces
cagcgcgtcggccagcagccgggcctgccgcagggtgcgtccgtcgcccgaggcgaccgggacggccgggttctcgtagaagtcccgcagcccgggcgggggagaggtggtgccggtcatacggactccgaggacgtcgaggccaggtgacgggtgaacagctcgcgcagacacacgccgtcctcgtcccccagcagggtgcgcgaccagcgcagcgccagatgcagccggccgcccgtggacgccgtggtgaacgtcagcccccggggcatccgggcgggcgcggagaaccacacggcggtggcccggcccgcctccccgaagtccaacgggtacggcacccggccgatgttgctcagcagcgtcgtcgaggtccacggccccgccagcacccgcagcccccgggtgaaggcggcgcgggcggacaccggcagcagcggcgcggtcagcagggaagcggaccggcccaacggggggcgggggcgcgccttgagcgcccgggtccgc

SEQ ID NO: 3360 - DNA, 8138 bp, Unknown
  Kingdom: Bacteria, Phylum: Actinobacteria, Class: Actinobacteria, Order: Streptomycetales, Family: Streptomycetaceae, Genus: Streptomyces
gctcagcgtcggccaccgcctccggtgccgcccgtgccgctcccgccggtcacgggggcggcgcagcccgtgcaggggccggtgccctggcggagataccggtgctggttcgccagttcgaccgcgggggccagcgaggagtcctctgcgggaacgccgatgccgaaccggccgtagaaggtgagcaggcccgcgtcggaccgttcgaccgccgccgcggtgcgctcgtaggccaccgccgtcagacgacggacgtcgatgcgcacgagccggccgccctcgggtggaggccgcccgatgccctcgccccagcggtggaagaccgtcttcaccgggccgtcctccaccagcccgccgagatactccttgaccagctgcacggcctggttgtcgcccaggtcgagggtgtccagggcgcgggtgaccgcgagcgaggcgagctcggcgaaccggtcggtccgctcctcccgctccgcgcgctgctgctgggtctcgtcgagctgtccgaggcgcgtgtcgaggtcgtccccttccggggtcggggccgtggtgggctcgggagccggagcgtcgacgtccagcgtcccggcctggaagcgtccggcctgccgggcgatgtcgagtgccgtccggttcacgggctcgccgtccggcgagggagcgatccggtacgcggcgatgatcacgtcgccgatccgcgcggcggaccgggggtgcagcacgacctgccggtggatctcctggtatgcggccgccgcgccctcggcgtactcccggcgctgcacctccagtgcgtaccgctcgtccaccggccgcttccacgcgccttcggacaccggagccacgacgacgaggaagatcagagcgaccatgatgccgatgttgatcccggagaaggagcgctggacgaagttggcggtgaggcccagcggcagccgggactcgccgaaccgcgccgggcgcagccgcctgacccgcgcgacgagaccgggccgggccaggaggacgtaactgccgacggccagcaccgtgtaggccgccatccagtacagccagtgcacctcggtcagcccttgtatcttctcgaccacctccagtaccacggtcacctggggcggggtgaacgacaggacgttggccagccagaccatgagcagcgtcagcaccagcccgagttccacggacaggacgacgtccgccgccgcctgcacggtccgtcgcggtgagtccttcatccaccgccagccgcgccaggagagccagagcgcgagcgggaagaagagcccggcggccggcgcgacggtcaggacgtcgccggagaccgcctgctgacaggcgagcgcgaccaggagaaccccggggaggtcgggaaggtggcggaccgccgggtgatccgaacgtacgcatcgcgccaccacgagcagcagggcccagccgccgaagaacagcagcgccgccagagggaccagccgggacggaaaggcacggaagaggaggaagagcagtgccgcgggagcgacgacgatgcacagcgccagaccggccgcggcgatgtaccggcggtgccggaaccaacggatcgcggattcgacgaggatctcgcccccgaccttcgacacgaccgtgatggctgtcacgacgagcaggccggccagcaccccaccgattccgccgaggaccgccctgacgacggcgaggagcgcggcccccaccccgtcgatctcctcccgggtgccgagccgccaggccgcccacagtccgatcccataggtgaggtactgggtcaggaggtccagcagctcgtcatcacggggagccggagctgggccggccggagtccgcgcgtccggggacggtgcgtccggaccgggtgcgtcgggtgtcgatgcgtccggtgcgtccggtgcgtccggtgtctccggtgtctccggtgtctccggtgtctccggtgtctccggtgtctccggtgtctccggtgtctccggtgtctccggtgtctccggtgtggccggtgtcgtcggtgtctccggagccggtgggcccggagcgggtggtgcgttcgtcgccggtggggccggagccggcgtgggccgcaccgcgtcttggtgcagccgatgggcgagggcgaggaagagctccaggttgggtatccggtaccggtacctcatgaagtgcgtcgggaagtcgttgccgcgggaggagaccatgaggagtccctcgggggagagttcgagcgaacggacgtcctcccaggtcgtgaagtcgtcctggccgtgcctgcgccgtacggtcagtccgtcccggctcaacacgagatccccgaaagcggcttcgccgccttcgacagccgtagtggtggccggggccagctgcgcgttccggacgccgtgcaggatcgccgggtcccactcctcgtcccgcgggacctgggcaccccggatcaccgtgcgggtgcgtcggcccttgatcctctccccgccgaacgcgggtctgcggtccgtcggccccagcgtgacgaccgtgccgtcgggggtggacagtttgaagcggtcccagccgtccgtgaagaccgtcgtcgactgccaggggtagagcacctcccggccgctggcagtgaccgcgacgaggcccttctcgtaaaggcggaactccaccctcgtatggcgtcggtaccagagcacccgtacggcgaagggccccagcaacgcgagtccgccgagcaccgcgggtgcaaggtcccagtcccggccgacgaccgcaccgatgaggagggccaggaggtaggtgagggcagcgaagggggtgaggaacagcaggagcaacgcgtacgcggaaggcttcctgcgtatcggtcggtaggtacggcgatggctgcccagctccgggtgctcaggttgctccggtggttcccgttgctccggtgcttccggatgttccgcgtcgttctccgcgcccatgagctcacccgtcctgcggcgtgacccgcgcaactcctcttccacggcgaccggttgaccaggccggtcggcacgttagcaccccgccgcgcgcgggtgagccgcagagggcgtgccaggcgtcgcgggccggacgagactgtgcggacacggcctaggccagtgaaccgcccgtcgcgtcgatccagtggcccgtgacccatcgcccggcgtcggaggccaggaaggccaccacgtcggcgatgtccgccggggtgccgaccttcccgagggcggacagggcggccgcctcggcccgggccgcgtcgctcgcgcgcagccagtccgcgttgacgtcggtgtccacgatgcccggcgccaccgcgttgacggtgatgccccggctgcccagcactttggacagatagcgggtgaacacgtccagcgcgcccttggacatggcgtaggcgatcaggtccggcatcatcgccgcgtggctgaggcccgtcgagatgttgatgacgcgtccgccgtcccgcagtcgggcgagtccctgctgcgtgaggaagaacggcgccctggcgttgacggcgaacagtcggtcgtactcctcctcctcgatctccgtgaacttccgcgacgtgccgatcccggcgttgttgacgaggatgtccaggccgtccgcgtgcgcgtcgaaggcggcccagagtgcggccgcggcatcgggggccgccagctccacgccgagcgcgaacgccttgccgccggccgcctcgatggcggccacggtctccgcggccgccgaggcattgcggccgtagtgcacgccgacgaccgctccgtctcgtcccaaccgttcggcgatccctcgaccgatgcccctgctgccgccggtgaccagtgccgtctttcccgtgagcgtgcccatggctccgccctccctttttgattagcggtcgctacagaaaggaccgtagcacgttctctagtggtcgctatagaattggcgtatggcgacgaaaccgcgcggcaggccacggtccttcgaccgggaggccgccctccagcaggcgacgctgaccttctgggagcagggatacgaggcgacatcgatcgcggacctgacgcgagtgatgggcatcgcggcaccgagcctgtacgcggcgttcggcgacaaacgcaccctcttcggagaggtcgtcgagacgtacgccgccctcttcgggggcttcggcgaccgtgcgatggccgaggagccgaccgcgcgacgcggcgtcgcgcggatgctgcgggaggcggcggcggagtacacgacggccggccggccgcacggctgcatggtgctcagcgccgccgagaactgctcgtcggacgaggtggtggcggcgctgcgcgaccaacgcgcgcggaacgtgacggagttccagcggcggatccaggcggacgtcgacgcgggggtgctccccgcgcaggccgacgcggcggcgctcgcccgctacacggcggctgtcgtccagggaatgtcgcagcaggcgcgcgatggcgcgagccgtgcggagctggagacgctcgtggaggtggccatgcgtgcctggcccgaggaatccggtgaaggctgaacgcttccaggagcgaagggagttcgcggcgtgcggcgaccgtcggcaacgcggcggatgcgcgtgccggaccccgcgagcccgacctgatccggacgaaatgccctgggccgggcgcggttccccggtcgggtcggtggggatcggaatccggccacggaccggccgggggcggccgagtatcacgttttgcttgtgatcagtcaccgtgccgacctacgttgccccttgcgagatgacccgaagccagtgggggagccacgtatggccgcgaacggacggcaccgcagataccagccgagccggatcaaccgtgcctcgctcacggtgacggcgggcggcgcgggtatcgcgcttccgctcatcaccgcggcgtcggcgggcgccgcaccggtcgaggtctgggagaaggtcgccgcctgcgagtccagcggcaattgggccgtcaacacgggcaacggctattacggcggcctgcagttcagcggctccacctgggcggccttcggcggcgcgcagtacgcgccgcgcgccgacctcgccacccgggaccagcagatcgccgtcgccgagaaggtgctggacggccagggccccggcgcgtggcccacctgttccgtacaggcggggctcacccggagcggggacgcgcccgggaccgccccggaggcggggaccgacacacagagcgcgggaagccggcccgtccgggccgcggcaccgcagagcgcaccgccccggcagccgcagacccttcccgccgcggcgacgcccacccatgtgccgggcaagcgcgactcgtacaccgtcgcgagcggcgactccctctccgggatcgcgtccgcccagcgggtgcgcggcggctggcagggcctctacgcggccaaccgcaccgtcgtcggggacgacccggacctgatcttccccgggcagcggctgagcctcgaccagagccggacgccgaaggcgggggaggggaagagctccggacagcccgcgcggaagatcgctccgaagcccccggcggcgacggccgaggcgaagaagacggatcagcgcacggccgaggcgaagaaggaagcgcccccgcagaccgcgcccaagaaggaaaccccgaaacagcgggtccccgagaagacggccccgaagcagcaagcgcccaagaacgaagcacccaagaaggaagcgccgaagaaggccgctcctcggaaggagcggcccgctccggagcgggccgtgaagcactccggtttcagcgccccggtgtcggcgggcaccggcactccctaccggcaggcgggcggctggtccagtggctatcacaccggggtggacttccccgtgcccaccgggacatcggtgaagtcggtggctccgggacgcgtcgtctcggccggctgggccggagcgtacggctacgaggtcgtcatccggcacagcgacggcaagtacagccagtacgcccacctctccgcgctccacgtgcgcgcgggtcagtcggtctccggcgggcagcgcatcgcccggtccggctccacgggcaacagcacaggcccacacctgcacttcgagatccgcaccggccccggttacggctcggacgtcgacccgctcgcctacctgcgggcgggcggcgtcagggtctgaaccgtccgctcggagcgtgagcgccgcagggtggctccgccgcgccgccgctgctccgtgagtgggcccggcgcgccgaactccacctgcggcaccgcctgtcccggcggcaggggtgacgacctgtgcgccacggacagccgccccgacgcgggttccggtacgaccggtgacggcgaagggcgtccgtcctcgcgctcctccgacccggggaccgcgttcatcgaaccggaaccggtggccgggtccgcgcgccgcgcgccggggttccccgctccggcgtccgcacgcggctccgtggcgtgctccgtgctgagccgttcccgcgtcagcatgatcaggccgccggcggccagcgccccacaggagagagccaggacagtgccggggacgccgtggcggaagtgctcgccgaacaacgtgaggccgatcgcggcggccaccaccgggttgaccaccgtcaccgtcgcgagcggagccgtgaggcccgcgccccggtaggcggcctgggacaggaacaggcccgccgccgcgagcccggcgatcgccagcagcggcagtgcgcccgagcgcagcgaaccggacgtccactccacggccacggtcttggtgaacaccgaggccatgccgaacgccacacccgcgcccgtggccaggacgatgctccgcaggaccggccgccgcagcgtacgggcgagcacgacgagtgcgccgacggccccgaacgtcaccgaggccaacagcacctgctcgggaccgttcagagtgtgcggctcggcgcttcccgtgagcgccagcagtccaccgagtccggccgtcgccatcagggcgccgcgccaggccgtcgcccccgccctccgcccgacgaacagggccgccatcggcagggcgaagacgatcgtcagcgcgccgagcggctggaccaggctgagcgggccgtaggcgagcgccaccacgtgcaggaccgcaccggtcccgttgagaaggacggcgacccaccacacgccgttgcgcaacagggcatgccaggcgttgtcaccggtcgcggccacgcgctcctggatgatcgccccggccgcgtaggcgaccgcggagatcagtgacagcagcacggacagcgcaagggaactcatgtacaccacgatgtcccgtccggggccccacgtcgtcgtccttgagactgcacttcggcctactgccccagtagtacgcccgacggaccgacgtcctcctcccgacggtagtcctctcgcccccagccgtcagaagttaccgcccggcggatacggtgagccgcgaggacggcaccgtcggtgtccgtacggccggtcacgggaacgggccgcgaggcgggcagggaacgaggggagcagggcatggacctggtgctactggcgtcggtcgggggattcttcgcgctgcggaccaccccggtgcccggcggtggacaccgtccgctggaacagttgtacgcgggggacgacggccctctcgccgcgcgtgtcgacacggtcgcggcacgcctcgcggcccccgaacgcagggtcgccgcctccatcgcccacctcggtctcgccgcccggctctggtccctcgcgctgggcccggccgcgctcttcggacggatccccgccctgacgcccgacgccctccactgggacccgtccgccgcctcgccggacgacctgtggctcgcggggacggccgagctgcccggcacggcggcccggatccgtgaggaggtccagtacgggcatctggacccgctgtccgaggcgttccggcgcgacggcaccatctccccgcaactgctgcggggcaacgcgggatccgcgctcgccggcgccgtacgcgaactcgtcgccttcgcgcgcgcccacgaccggccggacgtggcagcacgggcccgctcgctggcggccgagctcttcgacga

SEQ ID NO: 3361 - DNA, 4451 bp, Unknown
  Kingdom: Bacteria, Phylum: Actinobacteria, Class: Actinobacteria, Order: Streptomycetales, Family: Streptomycetaceae, Genus: Streptomyces
ccggcctgcactggaccgaccagtctacgacgtgtccggccgcggtgcgcgaaaggcgcgaggccgcggcggaaacacgggactaccgggcgttgaagtacttcgcttcggggtggtggatgacgatggcgtcggtggactgctccggatggagctggaactcctcggagaggtgcacgccgatccgctccggctggaggaggtcggcgatcttcgcccggtcctccaggtccgggcacgctccgtaaccgagcgagaaccgtgcgccgcggtacttcagcgcgaacatgtcctcgacgtccgccgggtcctcgcccgcgaagccgagctcgctgcggacccgggcgtgccagtactcggcgagcgcctcggcgagctggacggacaggccgtgcagctccaggtagtcgcggtaggagttggcggcgaacagctcggcggtggcctcaccgatccgggagccgacggtgacgatctggaggccgatgacgtcgacctctccggactcctcggggcggaagaagtcggcgaggcagaggcggcggccccggcgctggcgcgggaaggtgaagcgggtgcgctcggagccgtcctcgtggaggaggatcacgtcctcgcccttggagacgcaggggaagtagccgtagacgacggccgcttccaggaggttgttggactggaggtggtcgagccagccgcgcaggtgcgggcgtccctcggtctccaccagctcctcgtacgtcggtccgtcgccggtccgggcctgcttgagaccccactggcccttgaacagggcgccctcgtcgagccaggaggcgtagtccttgagcgggatgcccttgatgacgcgggtcccccggaacggcggctcgggaatggggttggtggtggagacgtccgagcgcaccgagccctcgggctcctcgacctccagcacggcggtgtcgggattcttcttggggaccctgcgctgcttgagctcgggcaggaccgcgccgggcacaccgcgcttgacgccgatgagcgcgtccatgaggcgcaggccctcgaaggcgtcccgggcgtagcggacctcgccctcgtagatctcgtgcaggtcctgttcgacgtaggcccgggtcagcgcggcgccaccgaggatcaccgggaagtcggcggccatcttgcgctggttgagctcctggaggttctccttcatgatcaccgtcgacttcaccaggaggccggacatgccgatcacgtcggcgcggtgctcctcggcggcttccaggatcgcggagacgggctgcttgatgccgaggttgacgacggtgtagccgttgttggagaggatgatgtcgacgaggttcttgccgatgtcgtggacatcgccacggacggtggcgagcacgatggtgcccttgccgtcgtcgtcggtcttctccatgtgcggctccaggtgggccaccgcgctcttcatgacctcggccgactggaggacgaacggcagctgcatctggccggagccgaacagctcgccgaccaccttcatgccttccagcagcgtgttgttgacgatgtcgagggccggggtgtcctggagggcctcgtcgaggtcggcctccaggccgttcttctcgccgtcgatgatgcggcgctggaggcgctcgtccagcggcagggccatcagctcctcggccttgcccgccttcatcgacttcatgttgacgccctcgaagagctccatgagcttctggagggggtcgtatccctcggcgcggcggtcgtagatcaggtcgagggcgaccttgacctgctcctcctccagccgggcgatcggcaggatcttggaggcgtgcacgatcgcggagtccaggcccgccttgacgcactcgtcgaggaagacggagttcagcacgacccgggcggccgggttgaggccgaaggagatgttggagaggcccagcgtggtctggacgtccgggtggcgcttcttcagctcgcggatcgccccgatggtggcgatgccgtcgccccgggactcctcctggccggtgcagatggtgaaggtcagggtgtcgatgaggatgtcggactcgtggatgccccagttggtggtgaggtcctcgatcagccgctcggcgatggcgaccttgtgctcgatcgtgcgggcctgaccctcctcgtcgatcgtcagggcgatcagcgcggcgccgtgctcggaggccagggcgctgacctgcgcgaagcgggactcggggccgtcgccgtcctcgtagttgaccgagttcagcacggcccggccgccgagcttctccaggccggcgcgcaggacgggcagctcggtggagtccagcacgatcgggagggtggaggcggtcgcgaagcggccggccagctccgccatgtcggcgacgccgtcacggcccacgtagtcgacgcagaggtcgagcatgtgcgcgccctcgcggatctggtcgcgcgccatctccacgcagtcgtcccagcgggcctccagcatggcctcgcggaacttcttggagccgttggcgttggtgcgctccccgatcgccaggtaggcggtgtcctgccggaaggggatggtctggtagagggaggccgcgccgggctcggggcgcgggtcccgctcggtcggcgtgagcccccgggtgcgctcgacgacggcccgcaggtgctccggcgtcgtgccgcagcagccgccgatgagggagaggccgtagtcccggacgaagttctcctgggagtcggcgagaccgtcggggccgagcgggaagtgcgcgccgtccttggtgaggacgggcaggccggcgttgggcatgcacatcaggggcgtacgggagtggcgggcgaggtagcgcaggtgctcgctcatctcgtccgggccggtcgagcagttcaggccgatcaggtcgatgcccagcggctccagggcggtcagggcggcgccgatctcggagcccagcagcatgacgccggtcgtctcgaaggcgagggagcagatcagcggcacgtggacaccgagggcgtccatcgcccggcgcgctccgatgatgctggacttggtctgcagcaggtcctgggtggtctcgacgatcagggcgtccgagccacccgcgaggaggccctcggcgttcttctggtagccgtcgcgcaggacgtcgtaggtgatgtggccgagcgagggcagcttggtgccggggccgatcgagccgaggacccagcgctggcgtccgtccttccccgcgaactcgtccgcgacctcgcgggcgatccgggcgccggactcggagagctcgaagatccggtcggcgatctcgtactcgttcgcggcggagtggttcgcgccgaaggtgttggtctcgacgcagtcgaccccgacagcgaaatactcctcgtggaccgagcgcacgatgtcgggccgggtgatgttcaggatctcgttgcagccttcgaggttctcgaagtcctccagcgtggggtcctgtgcctggagcatggtgcccatcgccccgtcggccaccaccacacgggtggcgagtgcctctcggagtgcgtctgcgcgggtccggctgtcggcggcggatgtcggcaacgaggccatggatgatctcccagggatgcgacggctgtcggctttgcgtccttcttggggaaggcgcacctcgccagcgtagccggacgccgccccggaccgtaggtgcgtccatggggcggactacatgctgtgcgggtgcggcacgcgcgacccggtggcggagacttttccccggagtccgacgaaggtcggcatcgaccgatagtgttcagcattgtcgaaccgaggtggaggagtacggcgcgatggccaagaacatccagtcgctggagcgggcggccgcgatgctgcgtctgctggcgggcggcgagcgccggctcgggctctccgacatcgcctcctcgctggggctggccaagggcaccgcgcacggcattctgcgcacgctccagctggagggcttcgtcgagcaggacgcggcgtcggggcgctaccagctgggcgcggagctgctgcggctgggcaacagctatctggacgtccacgagctgcgggcgcgcgccctcgtctggacggacgacctggcccgctccagcggcgagagcgtccacctcggagtgctgcaccagcacggtgtgctgatcgtccaccacgtcttccggcccgacgacagccgccaggtgctggaggtcggggccatgcagccgctgcactccacggcgctgggcaaggtgctgtccgcgtacgacccggtggcccacagcgaggtcatggaggcggagcgccgctccttcaccgggcgcaccgtcaccgccgccgacgccttcgagtcgatgctcgacctgatccgggcccagggctgggccgccgacgccgaggagacctgggagggcgtggccgcggtggccgccccgat

SEQ ID NO: 3362 - DNA, 4066 bp, Unknown
  Kingdom: Bacteria, Phylum: Actinobacteria, Class: Actinobacteria, Order: Streptomycetales, Family: Streptomycetaceae, Genus: Streptomyces
cacctgcacatccgcgccgagctggtgccgggcctcactgcccaggagctggagagcggcgacctgtacgagcatctgcgctccacgcacggggtccacgtccacgaggcggtccaggccatcgaacccaccgtcgtcacccgcgccgaggccagactcctcgacgtcctggagctgtcgccggcgctcctcttcgagcggctgacctccgacaccaccggccgcccggtggagtacgtccactcgctctaccgcggcgaccgttcgacaagaggtgcaaccagagttgcgccccgtgcaacgcggtcggcggtcggcgatcagccgcccgtctggatgtcacccctggtcgaggaggcgatggcgtcgccgtgcgcgaagtcgccgggcgggatgccgggatggtgtccctcccggtcgggggcgacctcggccgccgggccgagcgcgagccgggagacgatccggtagcggtcgccgcggtagagcgagtggacgtactccaccgggcggccggtggtgtcggaggtcagccgctcgaagaggagcgccggcgacagctccgggacgtcgaggagtctggcctcggcgcgggtgacgacggtgggttcgatggcctggaccgcctcgtggacgtggaccccgtgcgtggagcgcagatgctcgtacaggtcgccgctctccagctcctgggcagtgaggcccggcaccagctcggcgcggatgtgcaggtgctcgatagccatcggcgcaccgtcgaccagccgcagccgcgccacgtagacgatctcggcggcgggtgacatccgcagcttgcggccgacgcgggcccccgcctggagcgtggtgaactccagcagccggctcgaccaggcgcccgccgcctgcggcacgctcagcgcccggtccccggcgaccagttcctgagtgatcttggcgggggcgacgaacatgccccggccgtgctcgcgcaccaggagcccggcggcgaccagctcgtcgacggccgcgcgcacggtgggccgcgacacgccgagaagggcgcacagcgctcgctccgaggggatggcgtccccggggctgcgcgactcgatcagctccagcacggcatcgcgggtccgctcccgtttgagcaccgtccccggcctgtccgcgtccacgcgttcccctcccgacggtctgcatatgcttaccagttgatgaccactccggccgaactggcctgctggtcaggcgaagtgtagcgcttcccatgcgcgtcgcgagcaaccccgcttctcgcgaatcatcaaatcccgttgatacgcagggggttgacgaccccattggtctatgccaccttcaacccccatcgagaggtgagctgtccagtggacgtcactggtcaggtggtcaggttgggttcagatcacctcaggtcaggtcaggtcaggtcagtcgcatcgttctgcttccgaggtgaaccgtgaagtaccgcttgctcgccggtgggtccgtgctcgtcctgaccgccgcgctcagtgcctgcagttcgtcgtccggtccggactccgggaacgggggtggccggagaaccgtggacgtctggctgatgcgcgacagcgtgtccgaccggttccagcgggagttcaccgcggacttcgagaagcgccacccgacgatcgacgtgaagatccagatccaggagtgggacgggatcggccagaagatcaccgccgccctggcgagcaacgacgccccggacgtcatcgaggcgggcaacacccaggtggcgcagttcgcggagagcggcgggctgctcgacctcagcgaccgcaccgaggagctgaacggcgaggactggctgagcggcctggccgagccgggatcgtacgagggcaagcagtacggcatcccgtactacgcggcgaaccgggtggtggtctaccgcaccgatctcttcgccgaagcaggcgtcgacgcgtcggcgatcaagacccgtgagcagtggatcgacgccaccgccaagctcaaccggggcggcacgcagggcatctacctgcccggacagatgtggtacgcgctggccgggttcatctgggacgagggcggcgacctcgccgtcgagtccggcgggaagtggtccggcgcgctggacagccccgaggcgctgcgcggcatggcgttctacaagaagctccaggcgctcggcaagggacccaaggactccgacgaggacgatccgccgcaggccgaggtgatggcccagggccaggtggcgcaggtcatccagaccccgggcgcggccggcgtcatcgcggagcagaacccgggcctcaaggggaagctcgccttcttcccgatcccgggcaggacggcggacgctcccggtgcggtcttcaccggcggctccgacctggtcgtgccggccgccgcggcccaccccgacgaggcggtcgccttcatcaaggagctgaccggggacacctggcagaagaagctcgccgtcgccatgagttatgtgccgaaccggaccaccctggcctcggccgtggccgacgacccgggagccgccgcgatggcggccggcgcggccaacggtcacgcgacgcccaacaccccgggctgggcggcggtcgaggcggagaacccgatcaaggactacatgacggccgtgctcaccgggggcgatccggcgaaggaggcggcgaaggcctcggctgacatcacccgggccatgaacgccggttcctgacccgatccgccaccgcagcagtacgaaccaccaccccagcacgaaaggaggcctgccgtgccggtcgtcgaccaacggaccgcaccccgcacaccccggcggcgccctgccccgcaccccgccgcggacaagggcccgtcctcgcggagcagggtgcacggcctctggccgtacgccctgatcgcccccgccgtcggcggcatggtctacctgctggtctacccgctggtgcgggccgtcctgatctcgttccaggacttccggctgcgccaactgatcgtcggcgacgcggagttcgtgggtctgcggaactaccggacgctgctgtcggacccccggttctgggaggtggtgcggcgcacgttcctgttcatggcgatcaacgtcgccctgatcatggtgatcgccaccctggtcgcgctgatggtggaacggctgggccggatcgggcggacggtggtgctgagctcgctggtgctggcctgggcgatgccggtggtggcggcgaccaccgtattccagtggctgttccactcggagttcggcatcgtcaactggtcgttgacctcgctcggcttcgggtccttcgaccggtatccgtggttcgccgacggcaccgcggccttcgcgatcctcgtgacgctgatcgtctggcagtcggtgccgttcgccgcgatcaccctctactcggcgctgaccaccgtgcccctggagctgtacgagtcggcacggctggacggggcgggcgcggggcgggtcttccgctcggtcaccttcccgatgctgcggccgatcttcctgctggtcatctcgctggaggtgatctggacgttcaaggcgttcgtccagatctgggtgatgacccggggcggtccgggtgacgccacgacgatcctgccggtctacgcggtccagaccgccctctccggtcagcggtacgacctgggctccgcggcctcgatggtcaccgtggtcctgatgtccggggtgctcgtcctgtacttccgccagatgctccgccaggaggacgagaccccatgagtccgcgtaccgcacctccccgtaagcccgtacgcccccggctgcggcgcctgccgctgaacatcgccgccgccgcgaccgtcgtcgtctgtctcttccccgtctactggatgatcgccacggccttcaagccgtccaaggacatccggtccgccgacccccagctcttcccgcacacctggacgctcgaccacttccgacgggccgtggaggccgacgggttcgccctgttctggcgcaacagcatcctggtcacgctgggggccgtcctgctggcgctgctggtggcgc

SEQ ID NO: 3363 - DNA, 6939 bp, Unknown
  Kingdom: Bacteria, Phylum: Actinobacteria, Class: Actinobacteria, Order: Streptomycetales, Family: Streptomycetaceae, Genus: Streptomyces
gtccggaggcgtgcgcgcggccgggggcgggaaaggggtcgggcagggcgacgatgccggcgaggccgtcgggacgcgggcgccaggcggagcgcagtccgccccgcagcatggcctgttccatcgcggtgacatcaccgtgatcggcgacgacgcatacgtacggtccctgctcggggaggccgacggaggcggcggtgccgccgagcgtcgcccagtcggccgtcttcccggtcaggagcgcgtcgaggagcagcagccgctgcagttcgtcggcgcgggccagattcaccagcgtgtcccgatagacgtcgttcaccgtccgggacgccgcgtccagcagggaccagagcgccatggaggcctgtgcgatgtcgtccatcgtcgtgccgggctgcttcttggcgcggtcgatgagggcgtctgccaccaggcggtagccgatgaggaaggcgtgcagaaccgcgtcgagggggaccccctgcgtggcccggcggcgcacactctgccgggtgatgtccgtgcgtaccggccggtggtgtgccatgcaggtcaactgctcgcgcagattacgctcgttgaaatcgcgtacgtcggccatgatctcgtcgctcaaccgcgcgtacggcgcgatctccgtggtgatcttgcggaacaggtcgtccgccagggcctcgacccgccccagcagttccgccgcgcacaccgccagcaggggaggaacgatcaggccgccatcggcgtgctggtccgacatgcgcgccagcttacggttcatcctgcgggccgccactgtgcaggtgcacaaggcacacgtcctgtccgaggtcgtccgcccactccgtacggctggcattgtgccgcagcattttcctcccgagccgctgaggagagctgatgctgaacctgtcgtccctgctggagcacaccgcccaggagcacccggaccgtaccgcactggtcttcggtgacacccgcctgacctacgccgcactgcggacgcgctcggaggccgtcgcggaccggctgaggcgcctcggtatcggccgcggtgacaaggtggcgctggcctgtccgaacgtgccggactacccggccgcctacttcgggatactccgtctcggagcggtcgtggtgccgctgaacgtactgctgcgcccgcaggaggtcgcccaccacctcgcggactcccgtgcgaaagccttcctctgcttcgcggacacccccggactgccgctcgcccaggtggggaaggccggcttcgaccaggcgcccgagtgcgggcacttcctcctgctgtccggcggcgaaagcgacggtccggtccctgtcgcaccggtcggaacggtggccaccgccccggaggacacggccgtgatcctctacaccagcggcacgacgggccggcccaagggggccgaactcacccaccacaacatggtgatgaacgcgttgatcgccgaccggctgttcacgcgggcggacgacgaggtgatgctgaccgctctgccgctgttccacgccttcggccagagcgcggtgatgaacatgggcctgctccggggcgccaccctcgtcctgcagccccgcttcgacgcggaggaggcgctccggctgatgcggcgggagggcgtgacgttcttcgccggggtcccgacgatgtactgggcgctgctgcgcgaactcggcggacggacaccgcccggccggctgcgtaccgccgtctccggcggagccgccctgcccgtcgaggtgttcaagcggttcgacgaggccttcggcgtgggggtgcaggaggggtacggcctgtccgagacctcgcccgtcgcctgcttcaacccgccgggacttccgccgaggccgggctccatcggccggccggtgtggggggtcgagatgaaactcatcgacgactcctggcgaacggtcccgggcgacgggccgggcgagatcgcgatccgcggtcacaacatcatgaagggctactaccgacggccccacgacacggactcggcgatccgcgacggctggttccgcaccggtgacatcgcccgccgcgacgaggacggctactactacgtcgtggaccgggtcaaggacctgatcatccgcggcggcttcaacgtctacccgcgcgagatcgaagaggtcctgatcacgcatccggccgtgagcatggccgcggtggtgggcgtgccccacgccacgcacggggaggacgtcaaggcgttcgtcatccccgtggccggcacggatctgcgcgaggacgagctgatcgcctggtgccgcgaacgcatggccgcctacaagtacccgcgcagcgtggagttccgcgacagcctgccgctgacgtccaccggcaagatcctcaagcgcgaactcatcgcggaggccggggggctttgagggcccgctctcggcgggttgcacaaactccgccgtcggtgattgccgcgattgcgcagagacgaccggcgatcgctcccccaggatgtgcgatcaaacaccgatgtgaaccggccgcatcactcggttcaccttgacgtcaggagtcgccgtgctgtggagaaggaaactgctcgccccgttggccgcactcgccctggccctgaccgtgccggcgggcgcgggcacggcggcggccgccacggacaccaccgtggtcgccgccgccgagcccgccgcctcggccgccagtgacttcggggctcccggcccgtacgccactgcggtggaggtcggggcggtcaccaccctgtactacccgcgcgacatcgccggcagcgaccgccgccacccggtgatcgtgtgggggaacggcaccggcggcgtccccctcgtctaccgggatctgctgctccactgggccagtcagggcttcgtcgtcgccgcagcgaacacccccatgtccaacctcgggatctccatgcggtcgagcatcgacctgctcaccggcaggaacgccgacccgggcagcgtcttcttcgaccgcgtcgacctggagcacatcggcgcatcggggcactcccagggcggcgccgccgccatcgtcgtcggctcggaccctcgtatcgacaccatcctgccgatccagcccggtccgctggcgaacatcgacgcggtgcgcgtacccgcgctgctgctggccggtcagcgggacagcatcgtcttccccgccctggtcaaggccttctacaacgccgccgaccacattcccgccctctacggcgaggtgcgcggggcggaccacttcacggtcgtcggcgaccccggcccgttcgccgcaccgaccaccgcctggttccgtgcccacctcatgggcgaccggacggcgcacgcccagttcttcggccccggctgcggcatctgcgccgacaccgccacctggtccgacgtccgccggaacagcctggccctgagcgtcccggccgccactccgtaaccctccccggccgatcgccggcgccgtggcgggcggcgtcccgatccccgtccccgccgtctccccgggccgctcccgcgaccggggagacggcacatctcgtgaaaggacgacatggacatcatcgctgcgacgcgccacggaaaggtacggggccgcgtcgaccggtcaatcgcctcctacctggggatcccgtacgccgccgcgccgttcggagtccaccggttccgcgccccggcgcccgtcgagccctgggaggggatacgcgacgcgctggagttcgggccgaccgctccgcaacgcccctaccggccgcccctggaccagttgattcccgatgtggacatccccggggaggagtgcctcaacctcaacgtctgggctccccaggccgtcgacgaaccgctgccggtgctggtgtggatccacggaggatccctgcggaacggctccgccgccatgcccctgtacgacggccgggccttcgcgcgcgacggtgtggtcctggtctcgatcaactaccggctcggggcggaggggttcggagtcttccccgacgcacccgacaaccggggcctgttggaccagatcgccgccctgacctgggtgcgggacaacatcgccggattcggcggagaccccgggtgcgtcacggtgtgcggcgagtccgccggagccatcagcatcgccgccctgctgaccagtccgcgcgcggcgggtctgttccaccgggcgatcctgcagagcggcccgccgcacaccgtgacgcgcggtgagggcgccaggaccgtgcgagcgatggcgaagacactgcgggtgcccgccacggcggaggggttcgccgaggtggaccgcgaacggctgctggacgtccaggacgagttggtcggcagggccgacccggtcagcggcggaccgggcttccacatcgtggtcgacgacgacgtggtgccggccgatcctccgccgccctcggtcgacctgctgctgggctgcaaccgggaggagtaccggttgtggttcgtgccgagcggagcggtggagcgcgtcagcaggctcaccctgcggctggctctgctgaagttcgggatccccggccgggtggcacggctctaccgggccggccggccggacgcgaagccgggggtgatcctcggtgagatggccaccgacctgctgctgcgagggccgctcaaccggctcgccgactcccggctcacagactcccggccctccgactcccggccctccgactcccggcccgcccggacgttcttctacgagttcgcctggcgctcgccggtcctggggctgggcgcctgccacgcgctggagatcggtttcgtcttcgacaacctccgtcacggtgaggcgctgtccggtcccgacgcccctcagccgctggccgacgtcatgcaccgggcctgggtcgacttcaccacctcgggcgaccccggctggaccgcctgggacacccgccgaccggtcagggtcttcgaccatcccggcacgtccacggtcctcgcgccgcggcaggaggagctgcgggcctggctgtagtggcttccccgccaccgcggggtccgcggccggggttcgccgtcaggcgaggtccctggcgacgagcgccgcctgcaacagccgcgcctcggcggggacggccaggtccagcccggtcagcgtgctcacccggtgcaacctgtagtccagggtgttgcggtggacgcacagctccgaagcactccggctgcggttgtgtccgtgctcgacgaacacgcgcagtgtctccagcaggtacggatgctcctccagcgggtcgagcttggccgccagccgcagcagcgcgtcacccgggcgtgcgagctggtactccaggagcacgtcgtcgagcccgtacagaccgggcgggcggcccagccgctggacgagttcgagtacgcggcccgcctcctgggccgccgcgggaacggcgtccggtccggcggccggggccgcggccgcgaacacccggtgcccggtgtcctccccgagcgaatcccgcagaccggacaggtcgtaaccgcccggcagcagggcgatcccggcgacgtggtccatcagcaccgggacgcccgcgtgggcctccagcgacgactgcaccagccggggcggcggattcggctcgaaggccagggcgaccacctcgtgtccgccggccaccgatacccctgccgcctccgccagttcctcgtacggccgaccggccagcaacgcggtcagcaacgcccgccgtacccgcttgtcctcgctgcggatgtcctcctgggcgttgcggtgggcgagcacgacggcgggcatcgccgcgtgcaggcaggccagcagcttggctccggcgccggtcagctcctcgggttccgccgtctcggccagtacctgccaccacacctcggcgccgacgaggtaggcggcgatcaccgcctccaggggcacgcgctcctcggcccggcgccccgaccactcgatgagccgggtcaggtcgcccgggcccatcacgccgtcctgacgcagggcccgcagcagcagatcgtgcacggccgtgatcgaccgcgtcacctcgccgtcgagcgtacggcgcggcaactccccgtagaaggggacctccgccgcgcagcgagcgaccacggcagcggtgaagtcaccaccgcgagcagccatccgtgcgtgtaggccaagcatcggcgtatcgtcacatcgcccaaacgcttccgtcaatctctcaccgaactcccccgacagggacctgcgtcgtggatcgggcgggcgtgaccgtccgggtccgggaccgcgctcgcgcgccgtctccggcagagccgcccgcggaccgcggcggacgggagggcggaacggctcgtccaggaaagggttcggggagttggagagcaggactatcggggcggcggggctcgccgtgggtacggtcggtcttggctgcatgccgatgagctggggttacagcgcgtcgcagcggctcggcgaccgttcggtgcggacggtgcacgcggcgctggacgcgggcgtccggctgctcgacaccgcggacatgtacggcccgttcaccaacgagctgctggtgggtcgggcactgaagggccgccgccaggaggcgttcgtctccaccaagtgcggtctgctggtgggcgatcagcacatcgtcgccaacggtcggccgggatatgtccggcgggcctgtgacgcctcgctgcggcggctccagaccgatgtgatcgacctgtaccagctgcaccgggccgacccggaggtgccggtggaggagacctggggtgcgatggcggagctggtcaccgcgggcaaggtgcgctcgctcgggctgtgcgcggtgggagcgcgggccccgcgccggtcgggctggggaccgcatgagggaacgatccggcagctggagcggatccagcaggtcttcccggtcagcgccgtcgaggcggagctgtcggtgtggt

SEQ ID NO: 3364 - DNA, 1167 bp, Unknown
  Kingdom: Bacteria, Phylum: Actinobacteria, Class: Actinobacteria, Order: Streptomycetales, Family: Streptomycetaceae, Genus: Streptomyces
gtcgggctgctggtggccgccgtcgccgtcggccgcgcggcgtgggccgacggagacggcggccaccagcagcccgaccgcgccggagaccttggccgacaggcggcgcactccgccgtcggctccgggctgcaggaagtacaggaggtcgccgtcggccgacaggtcggacgtgggcggcagttggagcagggtgtcgggggtgagttcgccgcccgcggtgtgcagcccgcccagtacgtagtcgagcatgacgcggtccaggccctggaagggcaccacccgcccgaactccggagcgtccgggcccggtccgtccggcccggggacggccagtccgatggcggtgaagcgcgccatcggactggtgcggatcatggcccgggtgacgtactggaccagcccgcgctcggacttccgcagccgggtgggaacaggctcggcggcggcgagtgcctcccgccgctgccgggcctcccaccagcggtcgaccagtgggtggtcgaggagcagcgccggccgtggcgcggtgtcgttgtggatggcgcggcgcagcacgatgagctgcccgcgcgcctcccggtcggtggtggcgccgatcagttcgtagagcgcgtcggaacactggccggccagttcgcgcacctcggtggtggccccgtccagcgtgcggagcgctgccaggagcccggggtccgcgagccttctgcggcgcagcgggttgagccgcagcatccacagcggctccgcggtgtcgctcattccgccgccccggcggtggcctgcgccatctcctgtcgcgtctgctccagcctgtcctgccaggaggagccgaggacgtcgtccaccagttcggcgacggcgaagcagaagtagtagcggtgcatgggcggtacgcccaccagcggcagttgctggtagaagaggttgacgagcagccggtaggaggcgaaccactgcggcggcgaggcgatgacgccggactcctccatcgtgcggtggaaggcgctgggttcggtgctcacgcggccgtccccgccgggcgggcccatggtggccaggtcgaacccggcgccgaggccgtcgacgtcgtccagggtcagccttccctgggcgaccgtggcgtcgaaggcccccatggaataggcgaaggcgcgggcccaggcc

SEQ ID NO: 3365 - DNA, 1682 bp, Unknown
  Kingdom: Bacteria, Phylum: Actinobacteria, Class: Actinobacteria, Order: Streptomycetales, Family: Streptomycetaceae, Genus: Streptomyces
gggccaggttcgggtcacgggagcccgtcccggcgctcggcgaggcgttcgatccgtgcgatccgtgtggggcgtcgggggtgttcggggcttcgggggtgttcgggggtgccatcaagtcctcctggtcgacggggcgaccgaaggagcacatcacttttacgggagaaaagggggaagggcagcgccgtaggtcctaggccgaaggactgatcactccggaaccttcctgctgctagcctgctcctgcatataggttgcaataacaactggacggcattcccagcagtcggagggctcgcatcatggccacgtacacgctcccggaactcccgtacgactacgcggcgctcgaaccggtcatcaatccccagatcatcgagctgcaccacgacaagcaccacgccgcgtacgtcaagggcgcgaacgacaccctggagcagttggaagaggccggcgacggcggcggcgagcctctcgcggcggacggcgtgggcgacctcgccgacgcgatcaccgagtccttcggctcctacgcgggcttcaagtcccagttgacgaaggccgccgccaccacccagggttccggctggggcgtgctcgcgtacgagcccgtgagcggcaagctgatcgtcgagcaggtctacgaccaccagggcaacgtcggccagggctcggtcccggtcctcgtgttcgacgcctgggagcacgccttctacctgcagtacaagaaccagaaggtggacttcatcgaggcgatgtggcgggtcgtcaactggcaggacgtggcgaagcgttacgccgccgccaaggagcgcgcggacgtgctgctgctcgccccctgacccggacaccggcgcattaccgcagtcgtcctgcctcgtgatcgtcttctcaaccttcaccacggcaggcggatgaacggagagcctccgcgaggacatgactcgcggaggctttcccatggcgaccgattagctgtttagctcatgtgctaaacatgcacgcatggattcacccgcccacgaagaggcgagcgccttccgcgcgctcgccgatcccacccgccggcagatcctggaggatctgcgggacggcgagctggccgccggggagatcgcgagccggttctcgatcagcgcgccgtccatctcgcgccacctgggcgtgctcaaaggagccgggctcgtcaccgagcgccgggacgccaaccgcatcctctactccctcgccgaggaacggctcgccatgtgcgtggggcgcttcctgagcgccgtgtgccccgagcagatcgtgctccgcaccaccaagtggcgctccgcgccggaaggtgacgcctcatgatccggccccggctctccagcgtcatcgaacgccgcctcctggtgaactaccgggtcgacccgtccgtcgcggcggccctgctgcccgcgccgctgcgaccccagctggtgcacggtcaggcggtggccggtatctgcctgctgcggatcggcggcgtccgccccgcctgggcccccgccgcgaccgggctgaccagcgagaacgcggcgcaccggatctccgtcgagtgggacgggccggacggcgtcgagcgcggcgtctacatcccgcgccgtgacaccgcctcccgcctcaacgccttcgcgggcggccggatctacccgggcgagcacggccgc

SEQ ID NO: 3366 - DNA, 6125 bp, Unknown
  Kingdom: Bacteria, Phylum: Actinobacteria, Class: Actinobacteria, Order: Streptomycetales, Family: Streptomycetaceae, Genus: Streptomyces
gctcccgaggctgccatccggacggctgctcccgaggctgccatccggactgcggcccctgccgctgtccgtttccctgtccgtgcggcggcggtccctgctggtggtgatcgccgccgggcgtccgctgtccgttccccatggaacgtcaccctatgccggaccgtcggacgattcgaacgttcgcgcccggatccccggacgcctccggctcccggactgaccgactccccggatgcgcggcgaacaggccgcgacctgcgcacggacccgcccgtacgcccgacccgggcaccgaaatccgatattccctttgcggcgggagcgggaccggagtggaattgcgtacaggggacagcggtattcggtactcccggaggaaaggacgcgccatgagcgacaccgactggggggacgacgtctaccagccccaggaacccgaggcttccgaccccgacgaacagctcgacgccggggacacgctcatggatccctccggcaccggcgacccgctggacgagggctacgcaccgccggaccgcccctgggtggtcgacggcctcggcacgacggccaacgagcggcacaccggcgagtccctcgaagcccggctgaccagggaagtgcccgagccggacggttccgccggcgacggcgtgggcgatctggtgggcggcgacggtgagccctgggacgacgaggtcggcgtcgcccgcgccggacggctgacccagcaggcggacggaagcgtaccggccaccctcaccgccagcgacgtgggcatcgacggggcggcggcgtcggccgaggaggccgcgatgcacgtgatccccgagccgggggacgacgaagctctcctggaggccggcccggccaccggtggcacggctgcctcgccctcgccctgagcgggccgtcggcggagagcccacccatgaacgcggccacccccgggcccgtactcctctgaccgaaacgcaccacgcaccgcacaccgccgatcgcacggaccgcaccgaccgcaccgacgtactcggatccacaggagcacacagatgagcggcactgctcagatcggcgtcaccggacttgccgtcatgggacgcaacctggcccggaacttcgcccgcaacggatacaccgtcgccctgcacaaccgcaccacgtcccgcaccgacgccctggtcgaggagttcggcgacgagggcgcgttcgtcgccacgcacacgcccgaggagttcgtcgccgcgctggagcggccccgccgtctggtgatcatggtgaaggcgggggaccccaccgacgcggtgatccaggagttcgcaccactgctggaggagggtgacgtcgtcatcgacggcgggaacgcccacttcgaggacacccgccgccgtgagaaggagctgcgcgagcgcgggatccacttcgtcgggacggggatctccggcggggaggagggcgcgctgaacggaccgagcatcatgccgggtggctcggcggagtcctacgcgtcgctgggcccgatgctggagaagatcgccgcgcaggcgaaggacggcacgccgtgcaccgcgcacatcggtcccgacggcgccggtcacttcgtgaagatggtccacaacggcatcgagtacgcggacatgcagctgatcgccgaggcgtacgacctgctgcgcgccgtcgccgggtacacccccgcgcagatcgccgacaccttccgcacctggaacaccgggcgcctggattcctacctcatcgagatcacggcggaggtcctcgcccacacggacgcggcgaccgggaaaccgttcgtcgacatcgtgcaggaccgggcggagcagaagggcaccgggcgctggaccgtgcagatcgcgctcgacctcggggtcccggtgtcggggatcgccgaggcggtcttcgcccggtcgctgtccggccacgccgatctgagggaggctgcccgcggcctcccggggcccggcccgaagccgctcgacggggcggcggccgcagcgttcgcggaccgggtggaacaggccctgtacgcctccaaggtcgtctcgtacacacagggattccaccagatcagagccggcagcgatgcctacgactgggacatcgatctcggctccgtggcggcgatctggcgggcgggctgcatcatccgggcggcgttcctggaccgcatccgcgccgcctacgacagcaggcccggcctggtcagcctgctctccgacgaggagttcgggcaggagatcggcgcggcgcaggacgactggcgggcggtggtggccgaggccgtgcgccagggcgtgccgaccccgggcttcgccgccgcgctctcgtactacgacgggctgcgcgcggaccggctgcccgcggcgctcacccagggccagcgggacttcttcggggcgcacacctaccggcgtacggaccgggagggttcgttccacacgctgtggggcggcgaccggtccgaggtcggagcgggctgacccgcacggtgggggcgcctcccgtgcgctcccccggccgggccctccccgcgtgcggccggggacgggacgtgggttagtggctgcgagccctgttcgtcggggtccgccgaccgccgacgccgtccgcacaccgtcgtcatacagccgtccgtacaccgtcgtaatggagtgcgcgcatgcccgacgccgtccctgatcccgtctccgtccagcccgtcgtggcgccgttgaccagcgcggcgctgttcctggtcggcacgatcgagccgggcggcgagagtgcggtgcgggacgtgctgccggatctcgcggccgtcgcccggtcgctcggtttccggtacccggacgccggtctcgcctgtgtggcgggcttcggctccagcgcctgggaccggctgttcgccgggccgcgcccggctcacctccacccgttcccggagctgcgagggcctctccaccacgccccggcgacccccggcgacgtgctgctccacatccgggccgagcggatggacgtctgttacgcgtgggcggcccagttgctcgacaagctcggcggagccctgcggatcgtggacgagacgcacggcttccgctacctggaccaccgggacctgctcggcttcgtggacggtacggagaacccggtgggtgacgacgcccgttcggcggcgctcgtcggatccgaggacgacccggagttcgagggcggcagctatgtcgtcgtacagaagtacctgcacgacctgacgtcctggaacgcgctctccgtggaggagcaggaacgcgtcatcggccgcaccaagttggacgacgtggagttccccgacgacgagaagcccgccgactcccacctcgcgctcaacacgatcaccgacccggacggcaccgaacgggacatcctgcgggcgaacatgccgttcgggagcttcgggaagggcgagttcggtacgtacttcatcgggtacgccgcggatcccgacgtgaccgagcggatgctccgcaacatgttcctcggcgatccgcccgggacgcacgaccgcatcctcgacttctccacggcggtcaccggttccctcttcttcgccccctgcgccgacttcctcgacgctccgccgcccccgcccgtcctgacccgctccggggaccggccggaaccggtgcccgcaccggtccggcaggagcctgtcgcggccggggcggaccacggttcgctgcgcatcggcagcctgcaagaaagcgcccagtgatgaacaacctgcatcgcgaactcgcgccggtcaccccgtccgcctgggccgagatcgaggaggaggcccggcgcaccttccgccgtcacgtcgccggccgccgtgtcgtcgacgtgtccgatccggccggtccgacgctggccgccgtcggcgacggccatctgaccgatatcgatccgcccaccccggacgtggcggcccgagcccgcacctcgatgccggtcatcgagtggcgggtgccgttcacggtgacccgccgggccgtggacgacgtggagcgcggttccgccgacagcgactggcagcccgtcaaggacgcggcacgcacctgtgcgttcgccgaggacatggcgatcatcgacgggtacggggcggccgggatcaccggcctgcgggacggctcctcgcacgatcccctcccgctgcccgccgacgcgcgggactatccggtggcggtcagccaggccgtgacgcggctgcggctggccggtgtcgacggaccgtaccggctgttgctcggcgcggacgcgttcaccgaggcggccgagacctccgaccacgggtatccggtcaagacgcatctgagccgcctggtggacgacgagatcctgtgggcgcccgcggtcaagggcggggtgctgctgtccacccggggcggcgacttcgaactctgtctcggtcaggacctgtcgatcggctacgcggaccacgacgccaccagtgtccacctctacttccagcaggccttcaccttccggatgctgacgccggaggccgtggtcggcctgatcgcctgaaccccgggggcgctcaccggcgcgttgtcgggcaaccgagcgcccccgttccgccgacgacctgggggcagccatcagggactctggccgtatgacgcagacgacttccgcgcaccacgagggcggcacggcgccgccgcccgcccgcttcgacgccgtcgtccgggcggccgtcggacagggcctgctgggcgagggcgacccggtcgccggattcatcgacacggagggcgtgcgcgcctccgtcgggtccctgcacgacgccttcgccaccacgcccgaggtgctgcacaccttcgcggccaaggcctgctccctcgtcccggtgctgcggctgctcgccgactgcggcatgggatgcgaggtggcgagccccggtgaactgcggctggctctggaggccgggttcgccgcgtcccgtgtcgtcctggactcccccgccaagacccgcgaggagatccggctggcgctcgcactcggcgtggccgtcaacgccgacagtctcgacgaactgcgccgcatcgacgccctccgtaccccgggcaccgcctcggtcctgggactgcgggtcaaccctcaggtgggcggtggctcgatcgggccgatgagcacggcgacggacacgtcgaaattcggggtggggctgcgcgacccgggggcccgcgaggcgatcgtgagggccttccgggagcggccgtggctgacccggctgcacacccatgtgggctcccagggctgcccgttgaagctgatcgcggacggggtggcacggacgtacgagctggccgaggagatcaacgcgacgctgggcgtccggcaggtcaccagcctggacatcggcggcggcctcccggtcaacttcgccgacgagacggtgcgtcccagctacgcggactatgtggcggcgctgacggcggccgcccccggcctcttctccggccgctactccctggtcacggagttcggccggtcgctgctggcgaagaacgggttcatcggagcccgggtggagtacacgaaggatgccgggggccgccggatcgcgctcacccacgcgggagcccagaccgccacccgtaccgtcctcatgcccgacgcctggcccctgcggatcggggcgttcggcccggacggcactcccaagaccgggccgtcgctggcgcaggacatcgcgggaccgtgctgcttcgcgggggacgtggtggcgtacggcagggagctgccggagctggccgaggacgatgtggtcgtgctgtacgacacgggggcgtactacttctccaccccgtgggcgtacaacagcctgccccgtcccgcggtgtacggattccgcgcggtggcggggccgcaggacgggtcggagcaggacggaccggtgacgttcgcgacggtgcgggacgcgcagtcgctggacgacatcgcggcggagagcggcctcgcgcacgcggacgcgctgatcgagcgggacgtctgaacgggcgggccgggtcctggcgccgaccggagccggacccggcctccggtcacgtcccggcgggctgcggctcgggctccggatccggcacggggtccgggcc

SEQ ID NO: 3367 - DNA, 9919 bp, Unknown
  Kingdom: Bacteria, Phylum: Actinobacteria, Class: Actinobacteria, Order: Streptomycetales, Family: Streptomycetaceae, Genus: Streptomyces
gccccggcgagcgcggcgagcgcacccgtacggcggtcccggacctggttgaagccgggcggcccgctcacgtacgcgatggagcggtgcccggcgtccagcagatgccgcaccgccagagctccgcccgccacgtcgtcgaccgacaccgagcactcggtggttccctcggcgacccggtcgacgaggacgaacgggatgccgtggcgccggaacgcctcgatgttgcgcccggtcgcgtcggcgggggtcagcagcacgccccggacccgttgctccgcgaagagcgccagatactccgcctcctcgccggggctctgcgcactgttgcagaccatgacgccgagacccgcctcgcgcgcggcccgctccgcgccacgcgccacgtcgacgaagaacgggttgcccatgtcgaggacgagcagccccatgatccggctgcgtcccgcccgcagctgccgggccgactcgctgcggacgtaaccgaggcgctcgatcgccgacagcacgcgggcccgggtgtcgggaccgaccgtgtccgggcggttgatgacgttggagaccgtgcccaccgacactgcggcggcccgggccacgtccttgatacccaccgaccgggccatcagacggagacctccagaggagtgagggacgcgggaccagggcctgtcgttcggatcgtgccgggctcgcggggtccggcacgcgcatctgcggcgttgtcgtccatcaccaacgctccgcgttgcctcaatcctccgccttgcagctgcacgcaccggaccccgctccctgatccggcctgatccaaacgacaggccctagccctcagcctatccgcgtgcatcagaagtcgaagtcgtcgatgttgtccttgtcgaacaccgtcggcttgccgaggctgatcaccccgtccttcccgatcgtgtaggtgcccaggtcacccgcctcgaaggtctgtccctccgcgccggtgatctgtccggacgccagggcgaccgaggtgtggccggccagctcgccgagcttcgccgggtcccacagctcgaacgcctcgacggtgccgttcttcacgtacgagcgcaggtcgttgggggtgccgagaccggacagcttgaccttgccccggtacttcgaacccgacaggtactgtgctgccgccttgatgccgaccgtggtcggcgagacgatcccggcgagcttcgggtgctcctggatcagcccctgtgtctgctggaaggactgctgggcgtcgtcgttgccgtacgccaccttcaccagcttcacgtccttgtacttcgggtccttcagctcgtccttcatgtagtcgatccacaggttctggttcgtcgcggtctgggcggcggacaggatcgcgatctcgcccttgtagccgatctgctcggcgagcagctggacctgggtgcggcccaggtcctccgcccccgcctgcgagacgaacacatggcggcagccggccgtggtgtcggagtcgtacgtgacgaccttgacgccgttcttcatggcctgcttgagcgcggtgcacagggcgcccgggtcctgcgcggacacggcgatggcgtcgacctgctgctgggtgagcgtgttgacgtaggagacctggcccgaggtgtcggtggcgctggtcgggccgacctccttgaaggtggaccccagcgcctcgacggccttccgtccgcccttgtcggcggtggtgaagtaggggttgttgacctgcttggggaggaagccgacggtcagacccttcttggtgggcgcgtccgggtccgcctcgcctgcggcggcggccggaccgctctccttcttcacatcgttcttggtggttcccccgcaggcggtgacggcgagcgcgaaggaggtgacggccgcgagggccgcacaggtgcggcggatcgatgacgtacgcatggcgggagtcctttacggagggaaggagggcggggtcagggagccggtggtgcggttacggcgcggagcgcgtggtcatggagccgaggccggagccgaggcggctcgccgccccgcccgcgcgacggagatctggcgcgctacgcgggggccgagcacggagacgacgagcagcacgccggtgacgacgatctgcgactgcgccgagacgtctcccaggctcatcacgttctgcagggcgccgagcaggaacacgcccgcgatcgcaccgccgagcgtgccccggccgccgtcgaagtcgatgccgccgagcaacacggccgccacgacggacagttcgagcccggtggcattgtcgaaccgggcgctggcgtagtgcagagcccagaacacgccggtgagggaggccatgagaccggtcaccgtgaacaggatcagcttctgccgcttcacccgtacccccgcgaacctggccgcctcctcgttggcccccgtcgcgaacagggaacgtccgaacggcgtcgcgtgcagggcgagtacggcgacggcgaggagagccaggaacggcaggagggcgtacgggacgaaggtgtcgccgatccgtccggcggcgaagtccaggtagggggaggggaagtcggtgacggcgtcggagcccagcacgatctgcgcgatgccccggtaggcggccagcgttccgatggtcaccgccagcgacggcagtccgagccgggtgaccagcagcccgttgaccagtccgcagaccacgccgagcagcagacagacggggatgatcgcctcgatcggcaggccctggttccacagcgcccccatcaccgcccccgagaggccggccgtggacgccaccgaaagatcgatctccccggagaccaccagcagggtcatcgggagcgcgatcagcgcgatgggcagggtgttgccgatcaggaacgacaggttgagggcgttgccgaagccgtcgacgaagccgaaggacagcagcagcaccacgatcaggagagcgccgacgaccgtgtcccagcggacggcgcgcgcgagtgcggagtcagccatggcgggcgttcctcttcttcagtgcggacgccacgcgcagggcgacgatccggtcggccgcgatggcgaggatgagcaggaagccgttgatcgcgagcacccacacggagctgacgccgagcgcgggcagcacgctgttgacggaggtcagcagcagtgcgccgagcgccgcgccgtagaccgtgccggagcccccggtgaagaccacaccgccgaccacgaccgcgctgacgacggtgagttcgtaacccgtgccggtgcccgagtcgacgttcccgaagcgcgccaggtacagcgcgccggcgagaccggccagcgccccgcagaaggtgtaggcgagcaggatccgccggcgtacgggaatcccggccagccgggcggcctccggatcggagcccagcgcgtacagctcgcgcccgctgccgaagtgcttgaggtagtacgccgtggacaccagcaggaccaacgcgagcatcgcgagccagggcacggccgagatcccgccggagccgaagtccacgaagccgcccgggagatcggccgccgtgatctgccgcgagccgacccagatcgagtcgatgccccggatgatgtagagcgtcccgagggtcacgaccagcgcgggcacctggccgaggctgacgagcagcccgttcagcagcccgaagccgacacccagcaggacggccaggaccacggccaccaccgggtggccgccgccctggagatacgtaccggcggcgaaggcgctgatgccgagcgtcgagcccacggacaggtcgacgttgcgggtgatgaccaccagcgactggccggtggcgaccagcacgaggatcgtcgcgttgagcagaagatccttgatgccctgctcggaaaggaacgtgctgttgcccagctgggtgagcgcgagcatcgccaacagcaccagaaggatggagagttcacgcatccggaggacgcggtccaccagccgggtgccgccggagtcgggtatcggcgcgacgggcgccggttcggtcgtcgtcgccgtcatgcggcggccctcccggtggctgcggccatcacggtctcctcggtggcgtcggaacgagggatctcggcggtgaggcggccctcgtgcatcaccagcacccggtcggccatgccgaggatctcgggcaggtcggaggagatcatcagcaccgccaccccgtcggcggccagcgcgctcagcaaccggtgcacctccgccttggtgccgacgtcgataccgcgcgtcggctcgtcgacgatcagcacggcgggtccggtggcgagccacttggccaggaccaccttctgctggttgccgccggacagggtggacacggcatcggcgatccgggcgtacttcacctggagcctgagcgcccagtcgagcgagcggctgcgctcggcgccgcggtccatcagccccgccctcctggtgacgcgcagaccggtgagcccgatgttccgctcgatggacatgcccatcaccaggccctgggcgcgccggtcctcggggaccagggcgaggccggcggccatggcggtggacggggcgccgttgacgagcgcccgcccggccacctcgacctcgccggcgtcccaccggtcgacgccgaagaccgcccgcgccacctccgtacgcccggcgccgacgagacccgccatgccgacgatctcgccgcggcgcacatcgaaggagacgtcggtgaacacgccctcgcgagtgagccgccggacgctgagggccaccgcgcccgcctccacgtcctgcttcggatagagctcgtcgaggtcccggccgaccatccggcggacgaggtcctcctcttccatccccaccagcggttcactggcgatcagcgccccgtcccgcagggtcgtgacgcgttcgcagacccggaagatctcctccagccggtgcgagatgaacagcacggccgccccctgctcgcgcagggcgcggaccacgccgaagagccgcgccacctcgctgccggtcagggcggccgtcggctcgtccatgatcaggacgcgggcgtcgaaggagagggccttggctatctcgacgatctgctggtcggcgatcgacaggccgcgcgccggacggtcggggtcgagcgcgaccccgagccggtgcatcagggcggccgtggcggtccgggtggcccggtggtcgatccggcgatacgtccgccggggctgacggcccatgaagatgttctcggcgatcgacaggtcggggaagagcgtgggttcctggtagatgacggcgataccggcgtcacgggcgtcggccgggccgtggaacacggccggctcgccgtccagcagaagctgaccggcgtcgggccggtgcactccggcgaacgtcttgatcagggtcgacttgcccgcgccgttctccccggcgagggcgtggacctcgccggggaacaggtcgagggacacgtcccgcagggctcgtacggcgccgaaggacttggagacgtccctcagtgccagtacgggggccggatccttggcggaccggtgggtcatcggtggctcctcaatggcgcggagggcgtcctcaccgcatcgtgaaaggtttcaaatgagttgccgggacggtaggcagggctcttggggcgcgtcaatgggggtgaacgagaattatcaactgccttgtgcattcacagggttccttcgggcccgttgtgccggaagggttgacagcccccgggcccacttctaccttcaagccgcgtgaatcgtttcagattcattcgtgttcacaccgacgtcacaggagcgacgaagtgaccgagcccgctacggtgaaggccgccctcacgtcccaggccatcgagaccccctcatgggcgtacgggaactcggggacccgcttcaaggtcttcgcccggcccggcgtgccccgcaccccccaggagaaactggacgacgcggcgaaggtgcacgagttcaccggagccgcacccaccgtcgccctccatattccctgggacacggtcgacgactacgcggcactcgccgcgcacgcccgcgaccggggcctcaccctcgggaccgtcaacgccaataccttccaggacgacgacttccgcctcggcagcgtctgccacccggactccgccgtacgccgcaaggccctggaccacctcctggcgtgcgtcgacatcatggacgcgacaggatcccgggacctgaaactgtggttcgcggacggcacgaactacccggggcaggacgacgtccgcgaacgccaggaccggctcgccgaggcgctggccgccgtgtacgaacggctcggcgaccaccagcggatgctcctggagtacaagctgttcgaaccggccttctacacgaccgacgtcccggactgggggacggcctacgcccactgcctcaagctcggtccccgggcgcaggtcgtggtggacaccggccaccacgcacccggcaccaacatcgagttcatcgtcgcgaccctgctgcgcgaaggccggctcggggctttcgacttcaactcccgcttctacgccgacgacgacctcatggtgggcgcggccgaccccttccagctcttccgcatcatgtacgaggtcgtccgcggcggcgggctcaccgctgacgtcgccttcatgctcgaccagtgccacaacatcgaggagaagatccccgcgatcatccgctcggtgatgaacgtccaggaggccacggccaaggccctcctcgtggaccgggaggccctcgccaccgcccagcgcaccggcgacgtcctggaggccaacgccgtgctcatggacgcctacaacaccgacgtacgtcccctgctcgccgaggtccgcgaggaacagggcctcgacggcgacccgatggccgcctaccggcgctccggctgggcgacgaagaccgccgaggagcggatcggcggacagcaggcgggctggggagcgtaggacctccgcgcgccccgtccgctccgcgtgccggctccctgcaccctgcccaccccgcgccgcgcaccggcctcgcccagccaccgcacacccgaccctgtccgaactgtccgcactcccgatccgcctctccgcagccccttcgcgaaggacaccgaggaacccatggcactccaccccgaagccgcagcactcctgacccgctcccaccggctcggctccgacccgcgcaacacgaactacgcgggcggcaacacctccgccaagggcgccgcacccgacccggtcaccggcgacgacgtcgagctgatgtgggtcaagggctccggcggcgacctcggcaccctcaccgccgaagggctcgccgtgctccgcctcgaccggctgcgcgcgctgcggaacgtctacgcgggcgtggagcgcgaggacgagatggtcgccgcgttcgactactgcctgcacggcaagggcggcgcggccccctccatcgacaccgccatgcacgggctcgtcgacgccccgcacgtcgaccatctgcaccccgactccgggatcgcgctcgcctgcgccgccgacggggagaagctgaccgccgactgcttcggcgacacggtcgcctgggtcccctggcgacgccccggattccagctgggcctggacatcgccgcggtcaaggaggcgaacccgggagccatcggctgtgtcctgggcggccacggcatcaccgcctggggcgggacgtcgcaggagtgcgaggacaacgcgctccacatcatccgcaccgcggaggccttcctggccgagcggggcaggcccgagccgttcggaccggttctcgacgggtacgaggcgctgcccggggccgagcgccgcgcgcgggccgccgctctcgccccgcacatacgcgccctcgcctcccgggaccgcccccaggtcgggcacttcgacgactccgacgcggtcctggagttcctcgcccgcaccgagcacccgaggctcgcggccctgggcacctcctgcccggaccacttcctccggacgaaggtcaggcccctggtcctcgacctgccggcgaccgccggaccggaccgcgccgtcgagcgcctgggcgagctgcacgccgcataccgggaggagtacgccgcctactacgcccgccacgcggagcccggctcgcccccgatgcggggtgcggacccggcgatcgtgctgatccccggcgtgggcatgttcagcttcggcaaggacaagcagaccgcccgcgtggcgggggagttctacctcaacgcgatcaacgtgatgcgcggcgcggaagccgtctcctcctacgcgccgatcgaggagtcggagaagttccgcatcgagtactgggccctggaggaggccaaactccggcggatgccgaagccgaagccgctcgccacccggatcgccctggtgaccggtgcgggcagcggcatcggcagggccatcgcccgccgcctcgtggcggagggagcctgcgtggtcgtcgcggacctggacgcggagagcgcggccgccgtcgccgaggaactgggcggccccgacaaggcggtggccgtcaccgtcgacgtcaccagcgaggagcaagtcgccggggccttcgaggcggcggtgctcgccttcggcggcgtcgacctggtggtcaacaacgcgggcatctccatctccaagccgctcgcggagaccacggtccgggactgggacctccagcacgccatcatggcccggggttccttcctggtctcccgcgaggccgcacgcgtcatgcgtgcccagggcatcggcggcgacctcgtctacatcgcctcgaagaacgccgtcttcgccggccccaacaacgtcgcctactccgccgccaaggccgaccaggcccaccaagtacggttgctcgccgcagagttgggtgaggacggcatccgggtcaacggcgtcaacccggacggtgtcgtacgcggctccggcatcttcgccggcgggtggggggcgcagcgcgcggcgacgtacgggatcgaggaggagaagctcggcgagttctacgcccgacgcaccctcctcaagcgcgaagtgctgcccgaacacgtcgcgaacgccgtcttcgccctcaccggcggcgacctcacccataccaccggcctccacatccccgtcgacgccggggtcgccggggccttcctgcgatgagcacccgcccgcagatcctcgccgcggccgacctgggagcctccagcggccgggtcatggtcggccgcgtcggcccggacaccctggacctcaccgaggtccaccgcttccccaaccggcccgtgcacctcccggagggcctgcgctgggacatcctcggcctccaccgaggggtgctcgacggactgcgcgcggccggccaggtcgactccctgggcatcgacagctgggcggtggactacgggctgctcgacgccgacgggtccctcctaggcaatccggtccactaccgcgaccgccgcaccgaaggagtcccggagcaggtgtgggccacggtcccgcccgaggacctctaccgggcgaccggcgtccagcacgccccgttcaacacgctctaccaactcgcagccgcccgcgacaccccccaactcgccgccgcggagcggctcctgctgatcccggacctgatctcgtactggctcacgggggagcagggcaccgagctgaccaacgcctccaccacccagctcatcgacccgcgcaccggcgactggaaccgggacctggccggccgcctcggcatcgacctcgggctgttcgccccgctgcgccgccccggcgaccccgccggctcgacgctgcccctggtccaggagctgaccggacagcccggccccgtaccggtgacgacggtcggctcgcacgacaccgcctccgccgtcgccgccgtccccgcccggcgg

SEQ ID NO: 3368 - DNA, 13643 bp, Unknown
  Kingdom: Bacteria, Phylum: Actinobacteria, Class: Actinobacteria, Order: Streptomycetales, Family: Streptomycetaceae, Genus: Streptomyces
gtgtacccggcgaaccaggccgacttgttgtcctcggaggtgccggtcttggccgccgcgtcgtaggcggggctgttggccgcgcccccggaaccggcgtcgacgaccccggtgagccccttggtcacggtgtcggccgaggcgcggctgatgacctgctcccgcttgggcttctcggcgttcaccgtgcggtcgcggtgctcggcggactggaggatgtgcggggtgaccttccggccgtggttgtcgagcgtggcgtacacgccggccatgtcccaggtcgaggcgttcatggtgccgagggtgacggcggggcgctcggggaagttcttgtccggtacgccgagggcgagcgcggtctccttcacggcggcgggcgtcacgtcgacgatcatctgcgcgaagacggagttgaccgagctgttcaaggccttctggacggagacctgaccgtaactgcggtcgtcctggttctgcggggcgaacggggtgtcgctgccgacgacgggccgcttgctggtgccgtcgtacaccgtgttgagcccgatcaggctgccgtcctgcgtcttcgactcgttctccagggccgaggcgagcaccagcggcttgaaggtggaggcgggctggtagtcctggcgggtggcgttgctgatgtagtgcttgatgtagtcctcgccgccgtacagggcgacgaccttgccggtcttcgggtcgacggaggtggcgccggcctggacggtggcgtcgaccttgttgccctcgcggtcgagcttggactccagttggtcgtccaccgacttctccagcgccttctggcgcttcttgtcgacggtgagggtgaaggtccagccgccggcctcgcggtcctcggcggagacgccctgcttctccagctccttgttggcggcctcgaccagatagccggcctggccctccatgccctgggcgggcttgggcttctgggggacggggaactccaggcccgccttctcggactcggtcagccacttcatctcgaccatgttgcgcagggtgtaggcccagcgctccttgaccagcttcttgccggtgtcggtcgcggtgttccagtcgtactggctgggggcctggaggagggaggcgaggtaggcgccctgggagacgttcaggtccttggcgtcgacgccgtagtacgcctgggctgcggcctggatgccgctcgcgccgcgtccgtagtaggcggtgttgatgtacccggcgaggatcttctccttggactcctgctggtcgaccttgagcgagatcaccagctccttgagcttgcggctcacggtggggtcctgcgtcaggtagaagttcttcacgtactgctgggtgatggtcgagccaccctgcttgcccttgccgctgacggtgttgaggagtgcgcgggtggtgcccttcaggtcgacgccgtcgtccttgtagaaggacttgttctccgcggcgacgaaggcgtgctggaccttctcgggaacctcgtccaggtcgacgatctggcggttgacgcccttgccggtccgggcgagcaccgagccgtcgctgtacttgtagacattgctctgccgctcggccatggcgttggcggcggggacgtcgacgtacacgtagagcgccgcgaaggctcccatgcccagcaggacgatcccgaagaacgtgcccagcagcttcttccacgtgaagagtctgcgtatgccgccgctcttcggggcccgacgcgactcccgcgcctgggctcgtcgcgcatccgctcgacccattggtgtgttgctcccgcttctctgctcgaccggctcgctcggtttcctcagttcgctcagacctgccagctaacaccgccgacggggacaaaagacaagcgatccggtcttttacggacgtgacaatcagcacccgttctccaggaaccgactccccaggggtggacaaggttgcgaaagccattaatgtgtaatcacattgatagcgcggtgcgagaccgcgccgaacgggggatcccatgaccgcacagcacgacgaccaccggccgggcacgccggcgggcgacctcgccatcgacgcccccgacatgcccgcaccccaggtcagggaggtcaccgcgcactccatcccgggcggcgtcggcctgctcctgaccgtggccggggtgttcgccggagtcggcctcgccatcgtcggcggggtgaccggggccggcggaaacaacgcggtcggcgtcccgctcctcatcgccggggtgctcctggtgatcacctcgttcttctgcatgagcggtgtgaagatggtcgctccgggcgaggccagggtgatccagctgttcggccggtacgtcggcaccatccgcgccgacgggctgcgctggatcaacccgctgacctccagccgcaagatctccacccgcgtccgcaaccacgagaccgccgtcctcaaggtcaacgacgcctacggcaacccgatcgagctggccgcgatcgtcgtctggaaggtcgaggacaccgcccaggcgctcttcgaggtcgacgacttcctggagttcgtcgccacccagaccgaggcggccgtgcggcacatcgccatcgagtacccctacgacgcccacgaggaggacggcctctccctgcggggcaacgcggaggagatcaccgagaagctggccgtcgagctgaccgcccgggtgaaggcggccggcgtcctgatcatcgagtcgcgcttcagtcacctcgcgtacgcccccgagatcgcctccgccatgctccagcgccagcaggccggcgcggtcgtcgcggcccgccagcagatcgtcgagggcgcggtgggcatggtcgagatggccctggcccggatcgccggggaccggatcgtcgaccggttcggcgcggtacgcacggtgcggaccggcggactgatggccaccgcgggcgggctgctggtcgtgttctcgccctcccccgcggccgcgatgtgcggcttcgcactgctgggcctcggcgtggcggtcgtggtcccgctggccttcgcggcagcgggacgcagcgggtcgaacccgagtcaggccatcgccggcgtcgccaccatcacctacacctccagcctgatcgctccctccgcgatcggctcgctggccgaggccacctccctggtggtgtcgttcggcgtggtgaccgcgctggccttcggcctggtgctgggcgccggggtgctgcggtcggccgaccgcaaggtcaccggctcggcggccgagagcggtacgacgacgaagagcgcgaccgggagctgacgggacaggacggcggtgcgcacgggacgcaacggcccgggacgggtgcggcggccgcgcggcgggtgacctccgcgcggccgccgctcaccgcaccactaccatggcgctgatcttttccgcaggtgaacaccgaacaccgggtcgcagaccggtcggcacaccgagcagaccttcagggagcaaccatgagcctcggcgtgcgctggaccttgcacggcgacgggaagacaccggcgcccggggcggtggtgcggcccgacgagcggctctcctggccccgtacgttcggactcggcgcacagcacgtggtcgcgatgttcggagcgtcgttcgtcgctccggtcctgatgggcctcgaccccaacctcgcgatcatgatgtccggcgtcgcgaccgcgatcttcctgctggcgaccaagggccgggtgcccagctatctgggctgctcgctctccttcgtcggcgtcgccgccacgatccgggcgagcggcggcgacgtcgccaccatcacgggcgcggtgttcgtggtcgcggtggccctcttcctcgtgggtctcgccgtccagcggttcggcgcgcgcatcatccacgcggcgatgccgccggtggtgacgggcgcggtggtgatgctgatcggcttcaacctcgcgccggtgaccgcctccacgtactggccgcaggaccagtggacggcgctcgcggtgatgctgttcaccggactcgccgtggtctgtctgcgcggcttcctctcccggatcgcgatcttcctcggactggtcttcgggtacgcgctgtcctgggtcctcgatctggtgttcggcaagatccactccccgctgggcggtggcgccgccaccgaccactggcgcctgaacctgtccgccgtcggcgaggccgactggatcgggctgccgtccttccacgcgccgagcttcgagtggtccgcgatcctggtggcgctgcccgtggtgatcgcgctggtcgcggagaacgccggccacgtgaaggccgtcggcgagatgacgggcgactcgctggacgacaagctcggcaccgccatcgcggcggacggcgcggcgtccatgctctccaccgccgtgggcggaccgcccaacaccacgtactccgagaacatcggcgtgatggccgcgacccgcgtctactccaccgcggcgtactgggcggcggcctgcttcgccctgctgttcggcctgtgccccaagttcggcgcggtcgtcgccgcgatcccgggcggggtgctcggcgggatcaccgtgatcctgtacgggatgatcggcctgctcggtgcgcagatctggctcaacggccgggtggacctgcgcaacccgctcaacctcgtcccggcctccgcgggcatcatcatcggcgtcggcggggtcagcctgaagatcaccgacaacttcgaactgggcggcatcgcgctcggcacgatcgtcgtgatcaccgggtaccacgtgctgcgggccttcgccccggcccatctcaagacgcaggaaccgctgctggactccggtacttcggcgtacgacgagcgctcggacgacgcgagcgctcacggcgagtcctccggtggcaagggagcggggcccgggaaggcctgatccggcgggtacgccgctccgggtccacgagcgccgatcccctttccgggatcgacgttcgtccgttccgttgaaactccggccggtcggcgccgtggcgggcgccaaactgggacgctccgcgcatgacgcagatcgagcagtccgcagtcccggccggcgacggcgccctgccgacgggcgagtccccggtgatcgaacgtatgcggggactgcgttcccggtggccgtccgggagcggggtcgcggtcttcaacgaggcctatctggacgtcgtggagagggccggcccggacttcggcaggcgcggcctcgacgaccgtgacgccgccgccccgctcggcgtgcgctgcgcggagcgctatctgtcggccgtggagacggcgacggcgggcggccgaccgccggagtgctggcgcccgctgctcccgtaccgtcgccatcccggcgtacgcccgctgcagttcgcgctgagcggcctgcaggcgcacatcgggcacgacctggtcctggcggtggtggacacctgtcatgcgctcggctgcgcaccgccggacctcgatggggagttcgagcgcgtgggcgatctcctggcgtcgctggaggagctgatccacgaggatctgatgccggggcccgagttgctggggatcgcggacccgctgacccacctggtgagttcctggagcctggagcgggcccgcgaggcggcctggtcggcggtccgggtcctctggcggctgcgcggattcccgtcgctggccgaggagttcaggcagcggaccgacgcgggcgcgggcctggtggggcgctttctgctcaccccctgccgctgacgcccgcgccgctccccggcccccgttcagtcctcggggagttccaccggggcgatctcgtcgaagacgtcgccgggtccggggttggtcgcgtcggtcgccccgccgaactggtgcatgacaccccacacggcgttcagcgcggtctgcacggcgccttcggcccagccggccgtccaggagatgtcgtccccggcgaggaagagacctcgcttgtcctcgggcagccgatcctgcatgaagtgggtgaacagccgccgctggtagcggtagtggccgggcaggttcgccttgaacgcacccatgaaccagggctcgttctcccacgagacggtgaccgggttgccgatgatgtggctccggacgtcgacgttcgggtagatctcaccgagcgacttgagcatgacctccatgcgctccttcggggagagcggcagccacttcaggctgtcgtcgcaccacgtgtaggagaggcagatgacggcgggcctgtccgggccgtcgtccaggagatacgtaccccgggtcatccggtcggtgagcgtcatcgacatggtgtcgcggccggtggtcgcgtccttgtccaaccagaacggccggtcgaccgggacgaacagcttggacgactccatgtagtgggtgcgctccatcgccgtccagtggtcgatcgggaagagcgcgtcgtcgcagtcgatcttggagagcagcagccaggactggccggtgaagaccgcggcccggaaggtgcggatgtcgccggcggcgtcggtgaccgtgatgcggttgcccgcggtacgggtcagccgggtcacggcgcctcgcggctcgccgtcgtgcagggaggacagcgaggtgccgagcggccagtggacgatcttctgcggctcgcggtcccacagccgcagcgggagctgctggctgccgccgacgatgccgcggtggtggtcgtcggcctcggtgtagacgacgcgcaggatctccaggatggagttggggaagtcggtgtcccagccgccggtgccgaagccgacctggccgaagatctcgcggtgccggaaggacttgaaggcgtcggagtcgcagaggaagccgtagaaggtctggttgtcgagccgctcgacgagctgcgaccagatctcccggatgcgcgggacgtcgcgctcgcgcagcgcccggttcatgtcggagaagtcggcgccctcctccagacaggcgctccacgcctctgccacgtcgcggtagacctgcggcaggtcgtcgatggtctcggcgtagtgcgactcgcccttgaggtccacgacggtcgagggcgtggccggggagagcgggttggggaagggccgggtctccaggcccaccatgtcgatgtagtgctggagcgccgtggaggagggcgggaagcgcatcgcacccatctcggcggtgagcgaggggtcgcacccgtcgaagccgacggtacgcagccggccgccgatctggtcggcctcgtagacgacgggcttgagacccatcttcatcagctcgtacgcggcgatgatcccggagagcccgccgccgatgacggcgacctcctggccgtgctcggtcgccggtatctgcccgaggccggccggatgggcgaggaagtcgtcgtacgcgtacgggaagtccggcccgaacatggtgatcggcggggcggcagcgtcggtgtgctggacggcgttgggcaccgtggacgtcatggggtacggactccttgcgcgatgactctggggaagggcagccgagggggcgggttcaggcgagggagccgtacaggccggggcggcggtcttcgaggtacggattggcggcgcgcgaggcggccaggaactccgggtccacctcgccgacgacgagttcctcgccgcgtccggcgcgggtgcgcacggtgccgtcggggccggccaggcagctgagcccgacgaactcgaactcgccttccgggccggtgcggttgacgtacgccacgtacatctggctctcgaaggcccgcacggggacgacggattcggcgacgaactggaaggggtgcatctgcgcggtgggcaccagcagcagatcggtgccggccagggcgtgcgcccggacgttttccgggaactcgacgtcgtagcagatcagcaggccgatgcggatgccgtcgaggtcggcctggacgaccgcctggtcgccgggggtgaaccactcctgctcgaagcagccgaacaggtgggtcttgcggtagttcgcgagccgggccccgtcggggccgatgagctgggccgcgttgaagatccgctccccgtcgcgctccgggtagccgtagaggaccgcgaggccgtggcgtacggcgatctcggcgacggcaccggcgccggggccgtcggcgggctcggccagctcggggacggcgtcgccgatggcgtatccggtgaggaacagctcggaggtgaccagcagccgggcaccggcaccggcggcccgtgcggcggcctcgtccagcatcttcaggttctcggcgacgacacccgggcgtccggagctctggagcagggcggtgcgcaacgacggcatggctgacctcgggcggtgcgggcggggtggggagacgtatcgaaggtacgtggcccggatcggcacggacaaggcgcgagcgttgcgcatcaaccgttgattcgttgcgccgggagggtttggtgcgacgaatcgttgcgtggggcgtcatcgcaggtcagcggggtgatgtgcgccactgttcctgggcgggtcctaggcgggcggcccctccgccgaataccgccgcaccagcggcgagagcaccaggacggacttggtccgctcgacgtacggctctcccgcgatccgctccaggacctgttcgaagtggcgcatgtcggcggcgaagacctgcaccaccgcgtccgcctccccggtcaccgtcgaggccgaggcgatctccgggtagcgggcgaggccctgcttgatggcgtccggggaggtgttgcggctgcagtagatctcgatgaagccctcggtctcccagccgagcgccgccgggtcgacccgcacggtgaagccggtgatcgctccctcggcccgcagccggtcgacgcggcgtttcacggcgggggcggagaggccgacgatcgcgccgatgtcggcgtaggagcgccgggcgtcttcggcgagggcgtggacgatgcgttcgtcgaggtcgttcaggcgcacgtcgggcggttcacttctctgcggtgggtcggcttgcgggaggcggagcgtgccgcctcccgcagtagaccatgacccgccgccgcgggcgtgccgggcgcgatggtccccgcccggccgggaccgggcggggaggcgctcagaaggggaactgcgagcggccgtgctggatggagatccacttctgggtggtgaaggcctcgaccatcgagtcgccgttcagccggccgaggccggagctcttctcgccgccgaaggggacgatcggctcgtcgtggacggtgccgtcgttgatgtggatcatgccggtgtggatgcgctgcccgacccgtaccccgcgctcgatgttgccggtgtgaacggcgccgctgaggccgtacggggtgtcgttggcgatgcggacggcctcgtcctcaccgtcgaagggcaccagcagggcgacggggccgaagatctcctggtgcaggacgggcgagtcggcggcgaggccggtcagcacggaggggctgaccaggttgccgtcggcgcggccgtgcaggagggccgtcgccccggcggccacggtctggtcgacgagcttggagatggactcggcctgcgaggagttgatcagcgggccgatctgggtggccgggtcggccgggtcgccgacggtgagcgaggcgaccttggcgacgaacttctcggtgaactccgcctccacggcacggtcgaccaggatgcggttggcggccatgcagacctggccctggtggacgtaccggctgaagaccgccgcgtcgacggcgtagtccacatccgcgtcgtcgagcacgatcagggcgctgttgccgccgagttcgaggacggcccgcttgaggttccgggcgcagacggtggcgacgtggcggcccaccttgtccgagccggtgaaggagatgacctgcggcacggggtgctccagcagggtgtcgccgatctccgcgatgtcggtgatcacgacgttgagcagcccggcgggcagacccgcgtcctcgaagatcctggccagcagggtgccgccgcagatcggggtgttctggtgcggcttgaggacgacggcgttgccgagggccagcgcgggagcgacggacttgagggagagcaggaaggggaagttgaacgggctgatcacaccgacgaccccgacgggcacgcggtagacacggttctccttgccctcggtcggcgaggggaggatctgtccggcggggcgcagcgccagctggatcgcctcgcggaggaactccttggccaggtgcagttcgaaggcggccttcagccgggtgccgccgagttcggcgacgatcgcgtcgctgatctccggctcgcgctcctcgacgaggtgcagcgccttctccaggacggtccgcctgctgtacgggttggtgtccgcccacgcctgctgagcgcgctcggccgcgcggtaggcctggtcgacctcgtcggcggtggcgaccgggatcgaggcgagcttctccccgtcgaacgggttgaagtcgatgatgtcccaggaccccttccccggcctccactcgccgtcgatgtactggtgggccaggtcagtgaagaaggacatgagatcccttaccgcagagaggcagcagctgagtgcgcttcatattacttactattcaacagagttgaagcgcctgcccgacggcctccgggagcccggacacaaccctgccctcaccggcacgaagcgccggagagggcaggggtgttgcgacggatccgggatcaactccagctggcgtgcagcggcttgccctcggcgtaaccggcggcgctctgtacgccgacgaccgccttctcggcgaactccgccagggagccggcgcccgcgtaggtgcaggaggagcggacgcccgcgatgatcgagtcgatgaggtcctcgactcccgggcgggtcgggtcgaggaacatccgcgaggtggagatgccctcctcgaagagcgccttgcgggcgcggtcgtacgcggactcgtccgaggtgcggttcttcacggcgcgggccgaggccatcccgaaggactccttgtagaagcggccgtcggcggactgctggaggtcgccgggcgactcgtacgtccccgcgaaccaggagccgatcatcacgttggacgcgccggcggcgagcgccatcgcgacgtcgcgcgggtgccggacgccgccgtccgcccagacgtgcttgccgtgcttcttcgcctcggcggcgcactccaggacggcggagaactgcgggcggccgacgccggtcatcatccgagtggtgcacatggcgccgggtccgacgccgaccttgatgatgtccgcgcccgcctcgatcaggtcacgcacgccctcggcggcgacgatgttgcccgcgacgatcggcacctgcgggtcgagcgcccggacggccctcaccgcgctgatcatggactcctggtggccgtgggccgtgtccacgacgaggacgtcggcgcccgcgtccaggagctgcttggccttgccggccacgtcgccgttgatgccgaccgcggccgcgatgcgcagcttgccccgggcatcggtggcgggggtgtagagcgtggcgcgcagggcggccttgcgggtgaggatgccgacgaggcgtccctccgcgtcgaccgcgggggcgagcttgcggttggcgccgtcgagcttgttgaaggcgtcgcgcgggtcgatgtccgcgtcgagcaggaccaggtccttggacatgacctcggagagctgggtgaagcggtcgacgcccgtcaggtcgtggtcggtgacgacgcccaccggacggcgatcggcgtcgacgacgacgcccgcgccgtgggcccgcttgggcagcagggacagcgcgtcggcgacggtctgaccgggggccagctcgatcggggtgtcgaggacgaggtggcgcgtcttgacccaggagatgacgtcggtgacgacctcgatcgggatgtcctgggggatgacgacgaggccgccccggcgggcgatggtttcggccatccgtcggcccgcgatggcagtcatgttggcgaccacgagcggaatggtggtgccggttccgtcgggcgacgagaggtccacgccctgccgggagccgaccgcggagcggcccgggaccatgaagacatcgtcgtacgtgaggtcgtacgggaccgcgggggactctgtgtagcgaccggtgcccggctcaagaaaacgcataacactcatattttcatacgaaacggtgcaggccgttccccagaagacacagcaaaagacccccgcgttcgtcttttcctccgaagaggcggccgggggctccgggcaagtgcaacctgccttacccacggacactacccgaacaggattcaatcattcgtgatcaccatccctggaccgggtgacaaggggtcaggtagcttcaaacccgcaggtcccgtgggtgtccgaagcgtcgatcgggctcgtcggcacccctgggcacaccgtttgaccggagaggatcccgatccgcctgtggacagcgaactgccggacatctactgcccgttcccgcagcggaccaatccgcacgtggcgcacacccggatccatctggacacctggaccagacggacgggtctggtccaccgcgagtccgcgaggaagcggttcgagcaagccgatttcgggtcgttcgtcggcatggtctacccgaccgccgacgaggagcacctcgatctggtggccgactggttcgtctggctcttcctggtcgacgaccagctcgacgacggccacctcggacgttcacccgaccgggtgagagacgtcgtcgaccggatgcgcgcggtggtcgacggctccgcccccgagccgctgccgggcgaggacgtcccggccgcggtgaccgccctggccgacctgtggaaacgtacgatgccgaacgccgcaccgcactggcggacccggttcgcgtggcacctggtcacctacctcacgaccgccacgacctgggaggcggggaaccgcgccgaggacgtggtgccctcggaggacacgtacatcgccaagcggcggcacaccggggccatccacgtctgcatggacctcatagagatcgtggcgggcatcgacgccccggagtcgatccacaacgacccccgcttcatcaccgccctggaagccgcgtgcaaccacgtgtgctgggccaacgacgtgtactccttcgagaaggagcaggtgctcggcgagatccacaacctcgtccacctggtccgccaccaccggggcttcggggagcagcaggcgctggaccacgtcgcggagcgcctcgcgatggagaccgagcggttcctgaccgccgaggacgagctgctggagctgtatccggagctgtccgggatgctggtgccctacctcgacgggatgcggagctggatgcgcggcaacctggactggtcgcgccggacgccgcgctacaaccccgccgacgtgggccagtacgaggagcccgaggagtatctggaggagacggtgctgggcgtgccgtccgcgcgcaccgaggcggccgcccccgccccgtgtgcggccgaggctccgccggcgggctgatacgggtcaggacacaccgagggccgtgcaccggatacggtgcacggccctcggtgt

SEQ ID NO: 3369 - DNA, 3289 bp, Unknown
  Kingdom: Bacteria, Phylum: Actinobacteria, Class: Actinobacteria, Order: Streptomycetales, Family: Streptomycetaceae, Genus: Streptomyces
  misc_feature (350)..(351): n is a, c, g, or t
cagggccaccgcaccggccccgatccagacggcgggcaccgtcccgtccgcgaacagccgcggtgagccgtaaccgccctgtgcggcgaacacggcggcgagcaccgcgaccccgagcgccccgccgacctcccgcagcgcgttgttggctccggaggcgatgccctgttccccgggccggacgctggagagcaccaggctcgcggcgggcgcgaagtacatggccatgccgactccgccgatgaccagagcggggagctgggcggtgtagctcaccccgggctcgatgatcagggcgaacagggagagtccgacggcctggagcgcgagcccggtgaccaccaccgggnncggaacagccgcatcggcagcatcgggttctccgcccggatgccgtggcggacgaacagggcgagcaacgccgcgcccgcggtcagcccggtcaggacgaggggatcggtccatccgtggctcgcggtgttgaccagggcgtagacgatgccgaagaggcccgcgctgaccaggaccgtgccacggatgtccaggggtgccttcggcgcgtaggactcggtgagccgcagccgggccagtggcagcagcaccaggcctatcggcacgttcagccagaagatccactgccaggagatgtgctccgtgagcgcaccgccgatcagcgggccgctggcgaccgcgaccccggtcaccgccccgaagacgcccagtgccgctccccgccgctcgggcgggacggcggcgccgatcagggtgagcgtcaacggcatcatgatcgccgcccccacgccctggaccgcccggaaggcgatgagttctccgatgcccggagagagggccgccgcggcggaggcggccgtgaagacggcgagtccggccatgaacagccgccgtctgccgaaccggtccccgagcgcggccccgagcatcagcagcacggcaaaggtcagggtgtacgcgttcaccgtccactccaggtcctccaggccgccgccgaggctctcgcggatggaagggagtgccgtcgtgacgacgaggttgtcgagggccgccatgaatccggcgacgctcgtgatgaccaggacccagaccgctcccccgcggccggtcgtgccgtgctgtgcgttcacttctccccctgctgattagttattgatgactaacttctgcggacagaaaaccgggccgacccggtgcgcgcttgttcactcgacgggcatggccgagtcgtagaaccccgaccaggcgcgatggtcggccgggaagcccagcgatgcgagggtgttgacgagcatgccgaacgccaggaacgtcgtcgtctcgttctcgtcggccccgagcacgatgtggatgtcgtccctcatccgcgcccaggccgcccgcagggtttcgccgaactcgtggttcccggcggcctccgcggcggccacggccgcgtacgtctgcatctgcatcatcagcttctcgccgtcgtggacgatcagccgctggtacgccttggccatggcatgcagcgcctcctccccctccagcccctcggaggccgtcaagaagacaccgcgggtgtcctccaggcagcgttcggcggcggcgatgaagatggcctgcttgttggggaagagccggaagagatacggctgcgaaacaccgacccggcgggcgatcacctcggtggacgtcccgttgtagccaccacgggcgaactcggtgatcgccgcccggacgacgctctcgcgccgctcctccgcactcatccttgccatgtaagtaagttattgctcaataaccaacctgacaagggcctcgggggaacgggcacaagtgaggggcgcccctccgcaggaggaacgcccctcactcgtggctgtcgcgccggtacgcctcaggcgagccggaccacggcccgggacatccccagcaccctcttgccgtcgcacagggcgaccaggtccacccggaccaggttgtcgtccagcttcgccgcgaccttgccgctgacctcgatcagcgcacccttgtcgtcgttgggcaccacgaccggcttcgtgaaacgcaccccgtagtcgacaaccgcgcccgggtcgccggcccagtccgtgaccacccggatcgcctcggccatcgtgaacatgccgtgcgcgatcacatccggcagcccgacctcgcgcgcgaacttctcgttccagtggatggggttgaagtcgcccgaggcgcccgcgtaccgcacgagcgcggcccgcgtcaccgggaacgtccgcgccggcagttccgtaccgacctcgaccgacccgtaagagaccttcgccgtcatcacgcctcctcggcggcgcgcgccaccagcttcatcaacgtcgtgaccaccagttcaccggcctcgtcgtgcacatccccgcggacgtccaggatgtcgttgcccgcgagggacttgatgccctcgatcgtcgacgtgaccgtcagccggtcccccgcccggaccggacgcacgtaacggaactgctggtccccgtggaccacccggccgtagtccaggcccaactgcgggtcctgcacgacctctccggccgcccggtaggtgatcgagaagacgaacgtgggcggcgcgatcacatcggcgtgaccgagcgcacgggcggcctccgcgtcgacgtacgccggatgggggtcgcccaccgcctcggcgaactcgcggatcttctcccggccgacctcgtacgccggagtgggcggataggtccgccccacgaaggactggtcgagcgccatgagctcgctacctcctgagaaacctggtgaaagacgaataagggcacgcccccgtgcggggaacgaccccatacaacgacacgaggccgcccccagaggggacggcctcgtgtacgagcctgattcagcgcgtttcgcggtgcgcggtgtgcgagttgcagcgcgggcagtgcttcttcatctcaagacggtccgggttgttacgccggttcttcttggtgatgtagttccgctccttgcactccacgcaggccagcgtgatcttcgggcggacgtcggtggcagccacgtgagtgctccttggacggacggtggacggatgaacgcataaaagggtagccgatcgaaggaccgacccagcaatcggctaccgttagtagcggtgaccggacttgaaccggtgacacagcgattatgagccgcttgctctaccgactgagctacaccgctttgatgatgagtccccccgccgaagcggggtttcccgatcaccagagccccaatgcggaatcga

SEQ ID NO: 3370 - DNA, 3025 bp, Unknown
  Kingdom: Bacteria, Phylum: Actinobacteria, Class: Actinobacteria, Order: Streptomycetales, Family: Streptomycetaceae, Genus: Streptomyces
gccgcgccgaccgcccagaaacccgcgcaggcgagcgcgctcagcacccgggagacgaagaggatctcgtacgtcggggccagcgcaccggcgatctggccgaggccgaacaccgagatcagcgcgatcagcgtggtgcggcgcggcagccggagcgtggccacggccagcagcggagcgccgaccaccatgccgatcgcgaacgcggatatgaggagtccggcctgcgggatcgacacgttcatgtcgtcggcgatcggcgggagcaggcccgacagcatgaactcgctggtgccgagtgcgaagaccgagaggccgagaatgtatacggccagcggcataggagcgcggcgggagggagagtcgggcatgactcgtcccaacgccggagaacacttccgcattcccggcgtcgggacggggacgcgcctgttcacgtccccgttacgtccacgtccatggccgtcacgtgggaagtacgtccatggctccgtcacgcgggaagggcgtgcggctcacgcgggaagggcgtgcagcttcttgccgtgcagggcgtagacgcgcttgccgtcggtggccaccagccaggagtggtagtcgccggacttgtcgttgaacgtccagcgcaggccacccgtcttcgcgtcgaaggcgtggatgccgccctgcttgtcgaggtcggtggctccgtagagcgtgccgcccaccttgacgaactgccggggcacctgcgcactcgcgtccttgagggccgtggactgccagatcttcttgccggtccccggctcgacggcccacagcgtccgggcgctgtccgcgatgtacagcacgtcctccaggagggtcggctcccggaagctcgtgaactcctcggtccgcacggaccacttctcggacccgtcggacagggcgaaggcctggagctgctgaccctgggggatgatcaccaggtcctggtggatggcgaagggtccgtagctcgtcttcgtcgtcttgtgcgtccacacctgcttgccggtggcggtgtcgcggaccgtgaggttgttcttgaagtcggtgtagacgaggtagcggccctgtacagcggcgtggatgccgttctgctgggtgccgaggtcgcgctgttccttccaggcgaccttgcccgtgccgctgttcagcgcggcgatcacattggtgtgggacgagccgtcggcctccaggatctcggcgatgacgtacacctgctccgcgtccaccgcgaccggcctcggctgccggtactccttgccgaggcggctgcgccacgcctccttgccggaccccgggacgtagccggcgacgctgccgtcgtacttgccgctctccaggtacaggatgccgctgccgagcagcagcggagcaccgggcaccgcgccgtccggcagcgaccaccgctcctcgccggtcgcgccgtcgaaggcgaccagcggatcaccgctcgcgatgaccacgccgtccacggccacgagttcgtcgttgtccccgtaggtctgcgccgacgtcgacttcgtccacagcggctcggggaccttgccgtcggcgggcgccttcccgtcctcgggggaagcgctgggcggcggcgtgctgccttcgccgcccgtcgccagttcgtcctcgcagccggtcagaccggctccgagcgctgccatcgtgatcccgcctccggccaggcgcagtaggcgccgccgggaagttctgccgaccgtcgtgccgagtcccttggacatttcgctgtacccccgtggagttgtctgagcggaaagatgagcggaccgcgatgccgacctgtgtgtgcatctgcgatgcgagacgttagccgtcgccgggcttcaccggtcgtgccagggcgcgaccgggacgacaccgtgaacgaaccggaacattcaccgggcggcgggcggacccgtggtcagccggcgccggacgaggtcagcagttccagctccgtcgccaggttgtgccgggcccgcgcctcccacgaggccgcgccgtgcggggtacggaacagccgcggcaggtcgagaagctgccgcagcaccgccgcccggccctcccggaacgctccgtccgggacgaagccgtactcctcccggacccgggccgcgtacgccccgtactcctgcgggccgcccgccaggaccgcgaggtcggcgtcgcacagcgcctcgccgttgcggtcgccgtcctccgggtcgtgcgtgacggtgaggcggaccagccgggcgacctccgccaccaccgcctccggcacccccgcctcggacagcgcgcgctcggcgagggcggcgctgcgctcctcgttctccgtccggtcgggccggtacaccgcgtcgtggaaccaggcggcgaggcgtaccgcgtgcacatcgtcggcgtgcccggccagggtgtcgatgccgtccaggacgtcggccaggtgggcggtcgtgtgatagcggcgctgcggctcggcccagcgggcgaggagattctcggcgtacggaagcggatcggggccgtccgccccggcgcgcgcggccagcagcgtctcgtgccaccggtcgcggaggccggcgtcggggaggccggtgtcgcgggaggaggcgtcgtcggggccggtgcttccgggatcggcgtcgcgggaagtggcgtcgtgcgggcgggggctgtccgtcatgggacgactctaggacgggccgctccaggacgcggggccgcgcccgtccggcacccggaccaccccttgtcgccccgctggacggtcattaccgtgcgcccgtgatgatggatctcaacgcggacctcggcgagggtttcggccactggaccctgaccgacgacgacgcgctcctcgcctgtgtcacgagcgccaacgtggcctgcggcttccacgcgggcgacgcctccgtgatgcggcgggtctgcgacgcggcggcggccggcggggtacggatcggggcgcaggtctcctaccgggacctggccgggttcgggcgccggtcgatggacgtgccgcccgccgagc

SEQ ID NO: 3371 - DNA, 1804 bp, Unknown
  Kingdom: Bacteria, Phylum: Actinobacteria, Class: Actinobacteria, Order: Streptomycetales, Family: Streptomycetaceae, Genus: Streptomyces
  misc_feature (345)..(346): n is a, c, g, or t
ctgggcgggcacgtccttgcgggggcggcggctcatggggggcacttcccgtcgcggtggggggtggcagcggaccaccgccggtcgggtgatcatcacgactctaccgaggcgccaacggttcgaacaccagcacccgcggccggccgattggggtaatgttgacggctgcgaaggggagtagccccgcaaaccggtcgtcgacatactggagcctccgggttcccggtggccgggctcgtgtgtcctgcagaggattcccacgggcgggcgagaccttcggtcctgtatgacacgcccacgtcctgtgggcggagccgtcatgccgggccgagtggtcctccnngcgttcatgctgctgcgcggcagcggcggggacgacgacgaggaggccgaggtgaagaccgtgaccgggttctggccggtctacacgaccgcgttcatggcggtcttcatcagcgagtggggcgacctgacgcagatcaccaccgccaacctcgcggcgagcaacggcacctggtccacggcgatcggtgcggccgccgccctgatgtccgtctcggccttggccctgctggcgggccggttcatcgcgaagcgcgtaccgctgaagaccgtgcagcgcatcggcgggatctgcatgctgggcctcgccctctggacggccgtggagatcttcaccggctgaggagcgcggtacgggggggcgtacccggcgtcggcgcgcccccgtccgctctcagaacagtgtcggcaccccgtcgtccgtcccaccgctctcgaaggcgagcagccgctgtttgcggtccaggccgccgccgtagccggtgaggctcccggaggctccgatcacccggtggcacggcacgatgatcccgacggggttcttgccgttggccagtccgaccgcccgcgaggcgcccggtttgccgagctcctcggccagctcgccgtaggtacgggtctcgccgtacgggatcttcagcagctccgcccacacgctccgctggaacggtgtgcccgccaggtccagcgggaggtcgaaggtggtgcgctctgcggcgaagtactcggtgagctgctggatcacctcgccgaacggctccggatccgggacgccgaaggtctcctcgggcgggcggtggcgctggtcggtcatgtagagggccgagaggacgccgtcggtggcgacgagcgtcagcggaccgtacgggctgtcgtggaccgtgtgctgcttggtcacccgagaggcgggggcggtgatggtcgtggtcatgggagccgtgtccttgtctgcgtcaggcgggcaggtggttgatggggtggtcgtccaccgtccagaggtactgcacggcgtaggcccgccagggacgccagtcggcggctcgtgcggtgagggcggcgggggtggccggcaggccgagccgctcggccgcccggcggatgccgagatcggtggggaggaaggcgtcggggtcgccgagggcccgcatggcgatggactcgaccgtccaggggccgaagccgggcagtgcggccagttcggcgcgggcccgctcccattcggtgtcggtgtcgagccgcagccggtcctccgcgagggcggcgacgagggtggtgagcgtggtgcggcgggtgcgcggcagcgcgagggcttccgggtcgagtcccgccagcgccccggcggtcgggaaaagatgcgtcagtccgccctcggggtcctcgaccgggacgccgtgggcggtgaccagccgggccgcgtgggtgcgggcggcggcggtggagacctgctggccgagcaccg

SEQ ID NO: 3372 - DNA, 873 bp, Unknown
  Kingdom: Bacteria, Phylum: Actinobacteria, Class: Actinobacteria, Order: Streptomycetales, Family: Streptomycetaceae, Genus: Streptomyces
  misc_feature (1)..(2): n is a, c, g, or t
nnccgagcgccgcggccgtctcctccgtgctcatctgctcccagtgtcgcagcacgacgacgctacgctgcttgggagccagaatgcccaggatgtccatcaacagggcgcggtcggcgcgctgctcgctgccgtcctcgacgctcgcgtcgggaagctgctcggtcgggacctcttcgagcttgcgcgcccgccaccactccgtacgggtgttgatcatgacgcggcgcagataggcgtcggccagggacttgtcggcgatgccgtcccagcggccgtaggtgcgcaccagagcggtctgcagcaggtcctgggcatccacggggtcgggaaccagacggcgcgcgctgcgcagcagcgcctcctgccgtgtgcgtacgtagtcctcgaacgcgagcacctcgccctgcgccatgacaaccgcctccgtccccgaacatccccgtgtcaccccgggccgcgggtgttccgcggtccggccgtcctgctgtcggagacgctacggaggcgttgtcacggcgatgtgcggagcagccgtaggcgggtgcacggctgtccatcggttgtgtaacagtgcgggagagaaggtttcccggggaccggggccaggggccacggattcggggccggggtcaggtcagcggcagccggtaccggccgtcggccagcggttcgaccagcccgtcggccaccagcccgtccagcgcacgggcccgctgcaccggctcctcccacaccgcgtccagcgcggcctgggccacggggctcaccgagtcccgcaacaccgccagcagccgcccgcgcacctgacggtcggtaccggcgtacgtctggcccttgcgcggcggcccctggtgcgcgggcttcccggcc

SEQ ID NO: 3373 - DNA, 2503 bp, Unknown
  Kingdom: Bacteria, Phylum: Actinobacteria, Class: Actinobacteria, Order: Streptomycetales, Family: Streptomycetaceae, Genus: Streptomyces
catacgaagcggggccccgggccgccgcggcggcgtccaacgcgggcaggcgggccggggccccgcttcgtatgtgcgctacccgctgcgccgcgacggcgaacggttccccttcgtctccggcgcggcgcgcggattcgaactgggccgcccccgcgacgaggcggacgcgcaccgggccgcactcgaaggagtcgccttcgtcgaacgcctggccctggaccgggtcgagcgtctcggcgttccggtgctcggccccctgcacgcggcaggcgggggcagccgcagcactgtgtggacgacgatccgggccaccgtcctggaccgcccggtccgggtgatcgagcgtgcggagacggcttttggcgccgcactcctcgccgcggccggcacgctccacgaggacctctcggcgagcgccgcggccatggtgcgcggcggtgccctcgtcgagccggtgccggaggaacgccccgccctggacgacgcccacggtcgcttcgtcgctgccctgcacgagcggggctggctcatcgacgactgacgcgtcgtgcgccgcctcaccgttcctcaacggaaccgtgaggcagggaacttcggcgctggcggggcgtcggaaaagctgtggccgcacgcaccttgccatgccgctcggacccctctacgttcactgtagaaagcgcttgctgtcctgacgctcccggcgtggagcccgggacgccggtgcgctgccgcacgcccccggtggatggagccgcgcttctgtgcggctgtgtgcgggagcgctcccacatgtcatgaacacgtcattgaatgtgttctgtcatccaccacccaccgacccaagacgcatgggagacgaacatgggacgaccagtcgcacggcggctgcaggccgccgtggcaaccctggccctcgcggccgctaccggagcggtgctgtcggcgcccgaggcagcggcggcaaccgggagcgccaccggctacgccacccagaacggcgggaccaccggcggggccggcgggcagaccgtccgcgccaccaccggaacccagatccatgaggcgctgtgcgggcgggccgacagcgccaccccgatcgtgatcgaggtcgaaggcaccatcaaccacggcaacaccaccaaggtgtccggcagcagctgcaacaccgccgcgggtgtcatcgaactcaagcagatcagcaacgtcacgatcgtcggcgtcggcagcggggccgtcttcgaccagctgggcatccatctgcgcgaggccagcaacatcatcatccagaacgtgaccgtccggaacgtcaagaagtccggctcgcccacctccaacggcggtgacgccatcggtatggagtccggcgttcgcaacgtgtgggtcgatcacacgaccctggaggcgtcgggcggcgaatcggaggggtacgacggcctcttcgacatgaaggccaacacgcagtacgtgaccctgtcgtacagcatcctgcgcaactccggccgcggcggcctcgtgggatccagcgagagcgacctctccaacggcttcatcacctaccaccacaacctgtacgagaacatcgactcccgcgcacccctgctgcgcggcggcatcgcccacatctacaacaaccactacgtgcggctcaacgagtccggcatcaactcccgggccggggcccgcgccaaggtggagaacaactacttcgaggactccaaggacgtcctcggcaccttctacaccgacgaggccggctactggcaggtcagcggcaacaccctcgacaacgtcacctggtccagccccggtggcacgaccaaccccgccgggcccgacatgaagtccaccaccacggtggacatcccctacacctaccgcgccgacacggccggttgcgtgccggacgtcgtgagccgcacggcgggcgccggcaagggcctgaaggtctcggacggcaactgcacaccgcagacgcccacacccgcgccgaccgacccgacgccgggaccgaccgacccgacgccgggaccgaccgacccgacgccgggaccgacggacccgacccccggaccgaccgaccccactccgcccaccgggaccaacctcagcatcggagccggctccgacggctccagcaaggccgccggaacgagctacggcgacctgcgcgacggcgacccgaacacctactggtcacccgtcggccccaccggctccgcctcgatcaagtgggcctccgccactcacgtctcctccgtcgtcatccgtgagacagcggattccaccggcgccatcaaggcctggcggctcctcgacggcgacaccggcgccgagctggcctccggcgaaggtgcaggggtcatcggcttcccccgcacctccctgcgcaagatcaccttcgagatcaccggctcggccggcaccccgaagatcgccgagttcgagacctacgcgggctgatcacgcaggccgcgcccaccgtccacgacccgcacctccc

SEQ ID NO: 3374 - DNA, 2107 bp, Unknown
  Kingdom: Bacteria, Phylum: Actinobacteria, Class: Actinobacteria, Order: Streptomycetales, Family: Streptomycetaceae, Genus: Streptomyces
gcgctgctgcgcgaccccgaccacagcgcgaaggccgcgcagggcgtcacgctcgaagtgctgggccaggacgggctgtcgtacgccccggccgacgaccgcaccctcgccgaggtccggcgctccatcaccggctggaacggcgacgggagcgacatcgacttcgactggcgcacggtcggcggctatctggaccgtctcgaccggaacttcggcggccagggcatcgcggtgaacgccgcctacctcatcccgcagggcacggtccggatgtacgcggtgggctgggacgaccggcccgccggcgccgccgagctggcccggatgaaggagctggtggaccgggggatgcgggagggcgcggtcggcatgtcctcgggcctcacctacacgcccgggatgtacgcggacgacgccgaactcaccgagctgtgccgggtggtggcccgccacggcggttactactgcccgcaccaccgcagttacggggccggagcgctcgaagcgtacgaggagatggtgcggctcaccaggaacgccggctgcgccctgcatctcgcccacgccacgatgaacttcggcgtgaacaagggcagggcgccggatctcctcgccctgctcgacggagcgctcgccgccggcgccgacatctcgctcgacacctacccgtacacccccggctgcaccaccctggtggccatgctgccgagttgggtgagcgagggcgggccggacgcgatcctcgcccggctcgcggacgcggagagcgcggagaggatccggcaccacctggaggtgctgggctcggacggctgccacggggtgccgatcgagtgggacaccatcgagatctccggcgtcggcacacctcggctggccgagtacgtgggccgtacggtggcggagtcggcggcgctgcgggacgaggatccctggatgaccgcccggcggctgctcaccgaggaccggctcgggacgacgatcctccagcacgtgggccacgaggagaacgtccagcagatcatgcggcacccggtgcacaccggaggcagcgacggcatcctccagggcgacaagccgcacccccgggcgtacggcaccttcccgcagtatctcggccggtacgtccgggagttgggcatcctctcactggaggagtgcgtcgcccatctgacctcgcgcccggccgcccggctgcggctcgcggaccggggcctggtgcgcgaggggtaccgcgcggacctggtgctgttcgacccggagacggtggcggcgggttccacgttcgaggagccgcgtgcgctcccggtcggcatcccgcatgtgctgatcgacggccggttcgtcatcgaggacggcaggcggacctcggtgctcgccggccgggcggtccggggagcgggcgcggggaccccctgagagctcccacgggatcgaggcggcgcgcgcccggcgaccctgagggtggtcaggaccgcccggcgcgcgccgggatcacgtgtggctatggctacggcttgggcagcgcgcagccttcacgggtgaggtcgatcttgctgccggccccgatgcacgggaccatgttgtacgtctgctgggcgtagttgatgccctcgcggacggtcacctcgccgttctcgtcgacctcgcacgggttgttgtccgtgcactcctggccgctctcgttaccggtgttgttgacggcgaccaccttgccggtggcgtcgtcgatcaccggcgagccggacgtaccgccgatggtccggcactccggggtgtagcggaccgagtccttccaggtccaccggccctccttgagctggtggacgaagccgtcgatgtcgcagctgtaggtgcgcttccagtagccggaggcgaccgtgatggcggtacccgccgtcgggtgggcggtctccagctccagcgcccggatgccgtagctgttctctatctgctggtaggtgctggtgagttcgtagagcgagagatcggtgtcggtcatggtgccgtacgcgatcttgctcgccctcagggtgccgacaccgctgcccgaggcgttgagcagggtgaacgtccgggaggacggctggtcgacgacgacctcgcc

SEQ ID NO: 3375 - DNA, 2939 bp, Unknown
  Kingdom: Bacteria, Phylum: Actinobacteria, Class: Actinobacteria, Order: Streptomycetales, Family: Streptomycetaceae, Genus: Streptomyces
gctcgctgcgggggccttcggcgttgtctcagccctcgttgttctggtctttgtccacaagggcgttcggtgcgggcccccagatggcgtccgcgagcttctgcgccacctccttcagcatggcgtcgggcacgtgcaggtaccgggcgcgcatccgcgaggaggtgcctgcctcccagcccatgatctggtcgatcacacggtccgggatgccgagcagcatgaggacggtggcagcggtgtgacgggcgtcatgcagccgcgcgtcacgtaccccagcgtcctccagcagcttcttccagtcgtggtagtccgtgttcggactgagcggtccgccgagcggcttcgtgaacacgtaatccgactcgctccacaggttgccggcggtcttgcgctcccgggcctggacttcccggtgctttcgcagcatcacgaccagggggcccggcaggggcaccgctcggcggccggcgcgcgacttggtgttcttggtctcgcgccgtacctgctttcggtccgggcagtacccggccttacggccgcagggggctgcctccttgcacccgtgctcgtacttggggcgcagccggttgcggcgcagcttcaggtactcgtggtccaggtccacgtcgacccagcgcagacccagcgtctccccctgtcgcagaccgagggccagcgccagcatccaacgggcgctgttgcggcgcttgttcacctcgatcagcaggctctgcacctcctcgaccgagtagggctcgatctcctcctccggctcctccacccgtggtggcctggccagagcggcggcgttcttcgcggcgtgaccacggcggaccgcctcaccgagggcagtacgggcagtgcggtgtgcctggtgggcggtgccggccgcactgccgttcttcctcatccggcggtacaggctctccaggtgttccggctccaggcggtcgatgcggtgcttgccgattccgggtacgaggtgcacgcggaccgcgacctcgtacccgtcgtaggtgttctcactgacgacatccttagcaatgttctcgacccaatgccgcagccaccgttcaaccgtccacagcttgccgggctgctgagcagtgccctggtcgcgctgcttctccaggcgtcgcacttcgtctttcagtgcgtcttcgtcggggcgcgtgatgtgcctgcggtagggctcgccgttgtccttgtagcccattggcacccgagcgtgccaacggccgtccttaccgaagtagatggccgtttcaccgttcgcccggcgcgtgcgcttctggttctccgccacgggcggactcctttggagttggtgtgagcgcgggccgccacccgggagggggtggcggcccgcgcgtgggggtggttcaggcggcgtgctgttcagcccggaggcgggcgaggtacgcggccggggcgtcagcagggacgcggcggagagccccgatcgtcagggactccagggccccagtgcggatcagggtgaagcaggtggtccggccgacgcggagtcgtcgggctgcttcttcgacggtgagcaggatcagggtcgggtcgtgggccgcgtcgggtgcggctgcgtggaggggcggcactggatcgctccttagcggtgaggttgtccgaggtgtggatttctgcgtcaccgcgtcacccgcgtcacctagggggtgtgacctgcggttttgggtgacgcagcctggtgggtgtgcgtcacccgtgcgtcaccttctgcgtcaccggatgacgcgggggtgacgcgggtgacgcaggggtgacgcaggattcggcgtctgcgtcaccccttccgttgcaggtggggggccgttttccgtccccggtgacgcaggtgacgcagaccttccctacttaggaaaagaaggggggtgtctgtagtagtggcggtggttcttcaggcgaagtaaggggcccttcgggcacgcctcttgggcggcgttccgccgaacagcaagaggagcacccggcgcggcgtgctcctcttgcttgtcccctggggtcgaccggtgcggtcagaacgctgccgcctgctccggctgctcagggggcggggatgcggccgggcgggtcatttcgaggtaccggcctgctttggtgcgcccgctgtcgatgaggacgccccgggcggcgagggtgggttgcaggcgcttgagacggtcggagagcaccttgcccgtggtcggccaccctttaggcagaggacgtagctcctcgccgctgtagaggcggctcaggacgttcagccactccgtggacgtcatgcgctgctcgccgccggggtcgagggtctcggcgtgctggaggacggtctgcgccaacaggtcgccttcgatgacgtcgtcgttcaggtcgtccaggctcgcccggtacgcggtgagcgctccgaggccggtggcggtgtcaagttgagcgcagaggtgggcgaagtccgccatgcgcagatcggtcggtgtctccgcgtcggtggcccggaccttgacggtcaggtccaggagcgagccgaggaccacgggcagcacctcttcgtactccgcccacagctccgcttcggtcctgcggacggtgggccgctccagccgcagaggcaggagccgttccgcgaggtcggggcggaggatgccgacatcgatgccggtcaggaggagcgggcggcggtagcgggcccggtgcacgtccccgtcggtgaacagggcccgcttgacggactcggctccggtgacgatgcagcacatcgcgtcggacagggccggcgtcatgtgggagaggttgtccagggcggtgacccatccggcggccacggccgcgatcaggttctcctcatcgttcggagcccgccgcaggtccccgctcatcccttccacgatccgcaccagcatccggcccccggtcgacttccccgcgcc

SEQ ID NO: 3376 - DNA, 4321 bp, Unknown
  Kingdom: Bacteria, Phylum: Actinobacteria, Class: Actinobacteria, Order: Streptomycetales, Family: Streptomycetaceae, Genus: Streptomyces
gatccccgacgcccggctcgtcctccagcccggcgtcggccacgacatcccgcgcgagcggcacaccgccgtcgccgccgaggtacgagcgctcgcggaccgggccgctcgggtcgacggccacacgtaacgggcgtctccccggtcaggcggcctcgcgcaacacccctcgggtccgacggccgtacgcgacaccacccgggtcctcgggtaaggcgctcacccgcaatgccgcccgcaacggccctcccctcggtcaggcggccagcagcacgccacccatcgggcccgacgggcgcatcgcgccgaccggacccgccggaccggtcgaccgtacggaccggtggccgccgaccgcactcgacccgagcgaacgcggccgggagcgggccgcggcgagactgaccagccgctcccccgccagcgccaggacgtcggcaaggttcaggccgagcgcctgggccgcggcggccagcacctcggaggaggcctccttgaggccccgctccacctcggagagatacggcatggagatccgggccgcctcggcgacgtccttcaacgtccgtccctgggcctggcgttcgcggcgcagcacctccccgacaaggtcacgccagaggggttcccgggggagagccggggccgcccgggtggccgccgccgggagcgggcgcagagggatcacgtcggcctggttcgtcgctcggatgctcaccgtcccagcctaggagcgcggcaccgccccggcacgcatcgggcgttgcgctccgggcggatctgctggtggcgaagtcgcgtgacagacgaccggcaccgggggacggacggttcgaggagacgatgcgcgctcacccggcgacggcgacggaggttcgacgccgccagtaggcgatcgcgagagcgatggtgatgggcccccaagcggcgagaggggtgccgaccaccgtcgccagagcgttccaggcgccgttggagtacccgacggagtcgatgacgccgtacagggtgaggtcgcgaccgccgcccagcgggacggcggtgaacaggaaggtgaggatcaggccgccgagaacggcggggacgacggccgccatcggccggacgcgtctgccgccgatgaacggtatccaggcgggcgccacctctccccagccccggaccagtccgatggtcaggatcgcgacccattccgtcaacacgctgagcccgagaacgtacggaatgctcagccagtaggcaggcaggctgccctcctgagcctcctgccccatcgtgaagtgcacagcgaagggcagccaccacaggcacgccggcagcagaagcagcggtaacgcgtaggccaggcgcatcgcccagcgcggaacgggccgctcggtgtcactgacggacggtggccggtgaaggattttcagcgtcatgactccaccctcgcggagcacgcacgacgaggaatcccccgcgcgagccgacccgctcccccgcccgggggagaccgcacctggcagcctcgcccgcgcgggggagcggttccggcggcgaccacaccggcttcgccgcctccccgcgtacggtcagatcagaccctgcgccagcatcgcgtccgcgaccagctcgaagcccgcgatgttcgcgcccaccacgtagttgccggggctgccgtaccgctccgcggtcgtgtagcaggagtcgtggatgtgccgcatgatctcggcgagccgctcctcggtgtgggagaaggtccacgagtcccgggacgcgttctgctgcatctccagcgcactcgtcgcgaccccgcccgcgttggccgccttgccgggagcgaaggcgacacccgcctcctggaacacccggaccgcctccggggtggtgggcatgttggcgccctccgcgaccgccttgaccccgttgcgcacgaggtccagcgcgtcggcctcgtggagttcgttctgcgtggcgcagggcagggccacgtccacggggaccgaccacacccccgtaccgggtacgaaccgggcgtgtgcgccgcgtcgttcggcgtactccgagacccggccccggccggcctccttgatctccttgaggagggcgaggtcgatccccttctcgtcgacgacatagccgctggagtccgagcaggtcaccacggtcgcgccgagctgctgggccttctcgacggcgtagatggccacgttgccggaaccggagaccgcgacggtctggccctccagcgactcgccacggctgcgcagcatctcggcggtgaacaggaccgtgccgtagccggtggcctccgtacgggcctgcgcgccaccccagccgaggcccttgccggtgaggacaccggactcgtaacggttggtgatccgcttgtactggccgaagagatagccgatctcccggccgcccacgccgatgtcgccggccgggacgtcggtgtactcccccaggtggcggtggagttcggtcatgaaggactggcagaaccgcatgatctcggcgtcggaccggcccttggggtcgaagtccgcgccacccttgccgccgccgatgggcatgccggtgagggcgttcttgaagatctgctcgaagccgaggaacttcacgatgccgaggttgaccgaggggtggaagcgcaacccgcccttgtaggggccgagcgagctggagaactccacccggaagccgcggttgacgtggatgtcgccggagtcgtccgaccacggcacccggaagatcagctggcgctcgggctcgcatatgcgctcgatgatgcgcgcgtcgacgaactcggggcgccgggtcagcaccggcccgagcgtctccaggacctcgcggaccgcctggtggaactcctgctcaccctggttgcggcgcaggatctcggcgtagagcggctcgatgacgcgggccgcggcatcgtgcgtgcgggcggagtcgggcgagtcggggatgaccggcatctgatcaagaccttccgtggtcggctcgtgcgcgtcggcgctcccgccccggggagcgccaccggtccgcctcccccgccggagcctcgcggactccctcccgggaggaccgcgcggccgtcacccggcagggcgatgcgcaggaccgtcgtacggtccgattctcccgtgcggcccgatgatcttcgaggaccatccacatattggccacgatcggccgttttgatcaacgcccggaccgccgcacaaggccctgagcaggccccggtccagtgttccggtcggcccgagcggctcgggtccgtgtccggccgcgatgccccgagtggctgaggtcacctgtcggatcggctctcacgtgagcctcgcagcgcccagagccctcccccggaggcgagcacgatgacgcccgcgccggcgctcagggcgatctggaggccgctttcctcgaccgcgacgccgaggaagacgttggcgacgagcgcggcggacaggacgagccagagcaaggacttcatgacggcgatgcctccgtggtcggtgatacgtccagcctgtcggccggggcgcgccacgaggagggagcgggcccccgtatcgggggtgcagcaggctccaccccctcccgagggcgggcggcgcggaccgggggccatgagagccggtccgcggggaaagcgcgcgtggagccgacggaaggcaaccgtagtggtcccgtgaagaccacgcctcggcacgggagttacccgtcaggaacagggacaccccgcctgacgatcagtcatgatgcccccatgacgaagccgcgggggcgtcggagaggacagtctcctgacgcattacaggcgctgtacggcgtgcgccggaccgggagcagcaccgcccggacccggtccgccccgcccgtgacgccgggcccgcccgtgacgccgggccggtcgccctacgggcacgcgcttccgcgggcggcgtatccggcgtacgcccgctcggcgtatcccgccccggcgccccgggggcagccgcggatccccaagggcacgggcgacatgcggcgctatctggcggtcgggctcgacagctatctgtgcctgctggccgtcggactcctggtgcggtcctgcctggactccggcggaacggggcgcgcggtcgccctgctggtcgtccagttggccgcgctgtcgttcgccaaccaggtgctgctgacgatggccgtccgggcgagcgccggaaagctgatcatgggcgtccgggtgatccggctgcccgacgcgggacggccgggattccgcctgctggtgctgcgctggctgtacgggctcctctggctgccgcgccagccgtggcgccggctc

SEQ ID NO: 3377 - DNA, 1833 bp, Unknown
  Kingdom: Bacteria, Phylum: Actinobacteria, Class: Actinobacteria, Order: Streptomycetales, Family: Streptomycetaceae, Genus: Streptomyces
cccgtacgcagatcggcgtcgggtcccgcgtgggcgtggacggtgtcgacataccaggcctcggccggcccgctggacagggcgcgggcgaggcccatcaggcccatgccgagcgcgatggcccagcccgccgtaccgaggccgatgagggtgaaggccgtgaggttgagcagcccggcgatggccaggacggggcgccgcccgatgacgtcggagaggccaccggtgggcagttccatcgcggcggccgtgagggagtgcacggcgtagaagccggcgatggcggcgaggcccatgccgcgttcggtgaagagcagcactcccgtcgcgatggacatgccgatggggaaccagaagaggaaggagaccgtgacgaaccggcgacgcgcggtcgcctcgtccggaccgtgtgccggggcgggggcggcgacggccggcccgccggtcatgaggcgtctccggcagccgtggcgtccgaagctccggcgtccgtcgggtcgggtccgccggaggcgtccgcgcggccctgaccggccaccggatccggggccagcggcagtcccgcggtgaacaggacgacctgctcggcgcgagggtccccggcatcgcgggcggtcagctcgtccgtcttcgcccggagcacctcccacagctcggcgagggactccggggtcagccggggcatcgagtcgctgacgcccgacggctcctgccactcctgacccagtcggccgctctccaggtccgcctcgtggcggtccagagactgctggaggtgctcgatctggcgtcggtgcagggcgctgaggatcgtgctgccgccggggctgcggcgcatcgcctcattgctccacgaggtcatgtcgtgcaccgacttccagcgccgttcccggctgtcgcggtgttcggcctcggtgacgaacgcgtatttggcgagcacccgcaggtggtagctggtggaggccgaggactcccccgtcctggccgcgagctcgctggcggtggccggcccgtgctgtcgcagcagtccgagcagggtgaggcgcagggggtgggtgagggccttcagggcggccccgtcgtgcgccggatcgagtacgcgacgaccgtcttcgctgtccatgaccgcagcgtagaacggaaggggcactttcccaaagtatttttgcagaatattttttggaaacctgacgggactccggagcaccacccgtcaggactcggccggggtctcccgccgcgcccggagaacctccaccacgtcccggcaccagtcacggttggcccgttcgaagtcccgcccccgccgacaggtgaggtacgggccgacgcgtgcgccacggagcaggaactccgcctcgtcgcactccccgcgcatcctgcgcaactgctcttcgaacagcgccgccttggcctcggcgaaggcgaaccgttcggtgagccgctcgatcagcacgtcggtgtcgagatgatcggcggcctggacctggaccagcaggtcctcccggaggaacgagggtctggcggcggcggaagcgaagctctccagttcggccagcccctcgccggtgacacggaacagccgcttgttggggcgcgcctcctggacgacctcgcgccccgcgaccagcccctccttctccagcctggccagctccgcgtaaacctgctgcggcagggcgtgccagaagttcgcgacgcccgccgcgaacgccttcgtcacctgatagccgctcaactcctcgtcgagcagcgccgccagcaccgcgtggcgcaacgccatcggaccgcctccctctccgtgccggccgggcccacccccccacccccccc

SEQ ID NO: 3378 - DNA, 6889 bp, Unknown
  Kingdom: Bacteria, Phylum: Actinobacteria, Class: Actinobacteria, Order: Streptomycetales, Family: Streptomycetaceae, Genus: Streptomyces
ggccgccagcagccgggcccgcacgtccgcgacccgggcggcgtccacgggccccgtgtcccccggcagccggagcacggaggacccctcctcgaacgtcccctcctccgtcaccccgaagtacgcggcggcgaaggcggcgtcgtcctcgcccagcacctcacgcagctggccgggcgtccacacgtagaaggcgccctcgacgtgcctgccgtccgcgtcctcgctgtccgcgtccagcgcggaggcgaagccgccctcggcggtacgcagctcccgcaccatgaagtcggcggtctccagggcgacccgccgggcctcgtccgacccggtggtacgccacagatgggcgtacacccgacacagcagcgcgttgtcgtacagcatcttctcgaagtgcggcaccacccactcccggtccacggagtagcgcgcgaagcccccgccgagctggtcgtagatcccgccccgggccatcgccgaacaggtgtcggcggccatctgcagggccccctccgaccccgtacgggcgtaatgacgcagcaggaactccaccgccatggacggcgggaacttgggcgcgcccccgaacccgccgtgctgctcgtcgtactcccgggtcagcccgagcagcgcctgcgcggtctcctgctcccccggcaccccgtcaccaccgtgcaccagcgaacgccccgccagatccgcgacgatccgcccggcgacctcggcgacctcctcgcgccggtcggtccaggcggccaccacgccttccagaacctgctggaaggagggcgagccgtgccgggcctcgggcgggaagtaggtcccgaagtagaagggttcggcgtccgccgtgagaaagacggtcatcggccacccgccgtgcccggtggccgcctggacggcctccatgtagacggcgtcgacgtcgggccgctcctcccggtcgaccttcaccggcacgaagtgggcgttgaggtaggcggccacggtctcgtcctcgaacgactcgtgcgccatcacatgacaccagtggcagctggcgtacccgacgctgagcagcaccggcacgtcccgcctcctcgcctcctcgaacgcctcgggcgaccagggccaccagtcgacgggattgtcggcgtgctggaggaggtacggggaggtggtctgcgcaagtcgattggccatgggcccaatcctcgcgcaccctcctccgcgacacccgcgcgccacggggcggggcgcgaacgggcaggtggggcagaggcgcccttccgaggtcgggcgtccccacagcaccggcccgtaggccgcgcccggcagcgccgggactgccgaggctcctcgaaggaggtacaccgtgacctcagcggccggagaccggtccagaaaagggcctggtgcgtgcgggcgcggcgtggtggagccgcggctgccggcccggcggggaagacccggctcctgagcgcggcccgccccttcgtcgcgcccctgccgtcacgcctccgtcccggtcgtcatgtccccgtcctcgccggcggcctggccgggtgaggcgtgcgcgcgctccttgaccctccccttgcccggcgcccctcgcgccggagcgcgccacgcaggacacttgacccgacgcttggtatctgacgcttggtatccgacgctccggaacccgaggtccggagcgcggcactcggagggggacgcatatgcgggacagccatcgggcggaagccgagaggctgttggtgcgcgccgtggaggaggagacgcggcgcaccggcggacggaccgatgccggtgcgctgatgtcgcgggcgcgggccgcgctcgacaccatggccgccggcgcgggcgaggagtacgccgcgtacacgcaggcactggactcgatggcggccggagagcgcccgctctcggagcggttcagccgagcgactctcggaacgcccttgctggtcaccggagttgccgcagccgccgcgttcggtgcggatctggcgctgggtgcgaacaccggcctggcgctcggtgctggcgcggccgtcgcggtggccggcacggcgacgaccgtggcgaaggcgaccgtctcgcactggcccgccgcccaccgtcgcgccggagcggccggacagccgggcggggccgagcagttgcggctccagtggctgaccgccctggaggtacggggcatccgaccgtacctggaccagcagcgcatgctgacgcccaccgcgcgcgccccgaagaagcaggccgccccggtgggccgccagttgcgcggcggggaccgcagcgcggcggcccgcacccgggtggtgctggagcagtccttcgggcatctcccgaaggcggaggggccgttcaccgggcggcgggccgagctggcgcagatcgcccagtgggtgcacgcggcgcgcgcctccacgcagacccggccgacggtcgtcgtcctgcacggtgagcccggggcggggcgtacggcgctcgcggtgcgggccgcccacgcgctcaaggaccagttccggggagcgtgcgtggtcgatctgcgcggccaggtggccggggagagcccgctgccgacccgggacgccctgttgcacctgctgaaccggctgggcgcgccgcgcgagcagttgctgttccgggagggcgcttcggccgagcagcaggtgcggcggctcggcgagctgtaccaccagcacctcacggggacaccggtcacgatcgtgctcgacgacgcgacggacgccgggcaggtccgcatcctggtgccggagcgctcggacagtctggtgatcgtgacctcccgggagccgctggagctgcccgaggatctgctggcctgggtgcaccacctgccggtcggcccgctggacgcggcgggcgcggaggagctgctgcgcgaggtcgccggggaagaggaggcagggccctacgactacccgtccacggacgccgtcgtggaactgtgcggcgggctgccgctggcgctgcgggtggccggttccgcgctcggggcccgcagccgccacaccctggcggaggatctgggggcgtacggtcccgtggacccggtggagcgggccctgtggctgcgctacacggaccagggtgagcaggccaggcggctgctgcggcggctcgcgctggcgggccgggcgagcctgggggcggcagcggcggcctcgttgctcgcggcggacgagcaggaggcggagcggctgctggccgtgctggcgcgggccgggctgctcacccgcgtacggggatcgcgctaccggctgcacgacctggtgcgggacttcgcgctggcccggctgctggacgaggaggagccggccgagcggacggcggcgcaggagcggctgctgacgaactacgcggagctggccgacgcggtgatccggatggtcgacgggaagatgtcgacgcgggccgggcagttcggctcccacggcttcggttcgctggactcggcgctgcgctggctggacgacgagtcgagcttcatcacggcggcgctgcggcacgcggagggcgtcgaccagggcacggtgctgcatctgctgggcgccctgtgcgactactgcctgctgcgcggcgacctgtaccgcctgggggagatcagcgagctgacgcaggcggtggaccagggtctgctggagcgctcggtgcagtggcgtacgggtatcgcggcccggcagctcggcgagctggacaaggcccgtaccacgctgtcctccgtcgtcgggctgtaccacgaggcgcagaacgacgcgggcgaggcgctggcgctgtgctcactgggcatcaccctgcaccaccagggcaatctgacggaggcgtcggcccggctcggcgaggcgctggcgctccagtcgtccgaggcgcaggccgaggaccgggcctggaccctgcacgccctggccgccgtggagcgcgaccggggcgatctggcgcgggcgctgtcgctgctggccgacgcgctgcggctgcaccgggagggcgagtcgctgcacggtgaggcgtggacgcagttccagctgggacaggtgcggctgcggacgggcgaggtcgccccggccgaggaggcgctgaacaccgccctggagctgtacgggcgcacccgcgacgggcgcggcgaggcgtgggcactcacccagcttgcccgggcccggctgctggacgacgatccggcggccgccctggagcagttgcgcgaggcgctggaccgtcaccgggacaacgaggacgcgcggggcgaggcgtggaccctgtactacctggggcaggcgctggaggaggagggcgaggacacggagggcctggacgagcctttctgaaggcgcgggcccggagacattgtgcggccgacttcggacggttggcggcccgcgtccggcggtcagcggtcactgtcctgccagggacgcgcggcggatggtggcgtcgacgagggccagggcgtccgcggcggtgcggccgggatggcggttccaggggccgatcagcccgggccacccctgcgcgcgcagctccgtgatcagccaggcgccggcccggtccacggtgtcgagggagccgtagccgaggcggtgcgcggagatcagggcgccgcagaggcagcgtgcgccacgggcgttccgcagccggtacggggtgttctgccagccccactcgaccaggatctgccgtgcgtagccgagatgggtcgaggggcgcaggtcaccctgcccgacccgccgccagaggtggatacggtcgggcagcatcgcccccagccgcccgggcagcgggcgctcgtgcgggggtgccgcgggcagtgtccgcagcgcgtcgtcgacgagccggtccacgggtacggacaacagaccccgccagtcggcgtcccctgcggacggggggaccgaaggttccgcaggccgtccgtacgccggctccgccgggccgagcgcgggctcgggggcagtgtgttcccagcccgtgacgatctgctgccacgcctgggtgtcgtgcagccgggaagcctggccgtcgagctggtcgggggtgaggacagcggtcgccataagtgcgtcatctccgtacatttcggtcctctgtgtgaggcgaatgtcggtcacgcacggcgattgctctagtggaacgtggcgttcgggtgtgtgacatccgaacggacctgacgcccggcacctgagctcaggtgccgggcgtcagctgccagctgccaattccctggcgtcagctcccggatgtcagctccctggcgtcagctctcggatgtcagctcccggatgtcaggtgggggtgaccgggagtcctgcggcgcgccacgcctggaagccgccgatcaggtcggtggcccggtgcagtcccagctgccgcagcgaggcgaccgcgagactggaggcgtatccctcgttgcagacgacgacgacctggaggtcgtggccgaccgcttcggcggcgcggtggctgccccgggggtcgagccgccattccagttcgttgcgttcgacgaccagcgcgcccgggatcagtccgtcccggtcgcggagcgccgcgtaccggatgtccaccagcagggcccctgcctcagccgccgcggcagcctcgggcgcgccgatccggtcgtaaccggccctgacccgctccagcagctcgtcgatgcccacgggcggcggggcgtccggcacggcctcgtccccgctcgtgttccggtctccgctcactgccagtcctccgggcgctcggtctgctccaggcggagcaccgctccggtgcggctgaaccggcggatccgcggcaggggagggtagtaggcgtggacggagaccgcgtgcgcgacctcggactcgttgaggacctcatggacgtggttctgcccgaaggccctgccctgaccggtcgccaactccctcgaccggtccaccccgtccgtcagctccagcgtcttccagccgtcggtgggcagccgcacggccagcgagtgctccttgagggtgccggccgcggtggtgaacgcgccgaacgagtcggcgtgatcgtgccagcccgtgccggtgcccggcggccagccgatcagccacgcttcgctgccgcccggtccgtcgagccggatccaggtgcggccctccggatcgagggggagcgaggcgatgagcgcctcgtcccgagcggtgccgcggacgaagtccatcagctccgcgactgtcggtgcggtggaggaggtcgcggagccaccggtggcgggggcggaaggggaaggaacagcggcagccgtgggcacggcggagcgaggggaagacacgaggaccgtcctgagagttcgcgcggggttccggccgtgcggaaagcggcacgcaccggcagagggaggcgattcagcaggacgggcgacacacgcagcccgcgtaacggacgaggtccatgtggaccctccgccacaggcgcacatcggtgtcggtcatgatctggagtacaccacgcgcgcccgtgacggtcaatcgatcagttgagcccggcggttccgtccgcgtggacccgtgtccggggccgctgctcgggtcccgcgccccgttcgtccgcgccgtcaccctgttccacgggctcccgcgcttcgcggggtgcaccgcccagagcgacctgtgccgcggtgaacagctcggcgggccgtacgccgccgaaagccgccaccaggtgcccgtccggcctgaccagcaggacggtgtgggccgatgcccccgggtagctctcggtgaccaggagctccgtcgccccggggagcgccgccacggcgtccgtgaggcggggcatgacgcctgcggtctgccagtgccgccggtcccagacaccggtccccggcgcgaccaggatcaccagcgggtgg

SEQ ID NO: 3379 - DNA, 2747 bp, Unknown
  Kingdom: Bacteria, Phylum: Actinobacteria, Class: Actinobacteria, Order: Streptomycetales, Family: Streptomycetaceae, Genus: Streptomyces
  misc_feature (213)..(214): n is a, c, g, or t
  misc_feature (1942)..(1943): n is a, c, g, or t
ggcctcctccgcctgcgccgggtcgtagtaccggtaaccgttcaccgggtcgaccagggcgggccggagcagacccagttcgtcgtaacgcctgagcgccttggcggagagccgggacaaccgggcgaactccccgatcgtcaccagctctccgctcgcggcccccgacgcgcggctttcgcgttccaccccgtacctcctcgtaccgggcgnnggcgggcatgcccgcctccggtcacttccggttgtagagccgcatcgtcaccgcgccgaagaccaccatgagcaccccggtccaacccagcgtccaggcgatgtcggaggccggccagttgcccgccatcaactcacgcaccgccgtggcgaggtgggtgaccgggctgttgttcacgaaagcctggagccagcccggcatcgtcctcgggtcgacgaagacattgctgaggaatgtcagcgggaagatcaccatcatgctgacgcccatcaccgacttctcggagcgcagcagcagcccgaacatcgtccagatccaggagaacgcgaacgagaacacgaccagcagagcgataccggccagcacgccgagcacacctccgcccgggcggaacccgatgatcatgccgatgacgagcatcaccgccgacgccagcagatagcgcaggacgtcgccgagcagatagccgaccatcggagcgggccgccagatcggcagcgtgcggaaccggtcgaagacgcccttggcgatatccgtgttcaccgcgatgcccgtgtacatcgtgatcatcacgacgctcatcaccatgatgccgggcagcaggaactggatgtactcctccgtggagccggccagcgcccctccgaagagatacgtgtacatcaggaccagcatgatcgggaaagccgtcacgtcgaagagctgttccggcacatgcttgatcttcagcatggcgcgccagccgaaggtcatcgatgccgacagggcactgggcctcggcgggcgttcctggcccaccaggagcgccgagaggcgttccttgtccggcgcggcgagcgcgacgccctccagctccgtcttggcggtcgcggtgctcatgccgccactcccttcttgtccgtgagtgcgaggaagacctcgtcgaggctgggctgtcccagcgagaagttgtcgaccgtgatgccgcaacgggccagctcggccagggcacgcccggcctgctccgcagccccctgctcggtgctctgcccgtcgacccgtgcggtcagcgccaccgggtccgcgtccagctggacctccgcgttcagcgcgagcgccagcacctgctgcgcctcggcccgctggccggcgtcccggagccgcagatggacggtgccggcgccgacggaggccttgagctcgcccttggttccctcggcgatgaccttgccgtggtcgatcaccgcgatacgggaggccaactggtcggcctcgtccagatactgggtggtcagcaggaccgtggtgccgtgggcgacgaccgcacgcacgatgtcccacacctggttgcggctgcgggggtcgagtccggtggtcggctcgtccaggaacagcacgtccggggtgttcaggatggacgcggcgatgtcgatgcgccgccgcatgcctcccgagtagttcttcacctgcttgcccgccgcgtcgctcagcccgaacccttcgagcagctgggccgcccggtcgcgggcggccggcctggagtgcccgagcagccgggcgagcaggacgaggttctccaccccggtcaggtcctcgtccacggaggcgtactgcccggtcaggctgacccggctgcggaccgcgtcggcttccttcacgacgtccttgccgaacacccgggccgtgccgccgtcggggcgcagcagggtcgcgagcatacgcacggcggtggtcttcccggcgccgttnncgatgccgtccaccgctcggttgtcgccgaagaccttcaccagccccgtggtctcgatggccagttcagtgctcatgatccattccttgtgggtcgtcggtgggagtctgcgagcgtcggattccgggagctcatgagacgtacgggcggacggcgcgcgcctcgcgcagggcccagccccaccagcccagctggtcgagcatcaggcccacggaccggtcccggccggtgtcgccggggtgctcctccagcggctgccggaggaagtcgagcgagaccccgttcctcagggtcaccgtgtgcagctcggtgaagaccgagcgcagctgctccacggcgtacagcccggcggaaccgtgtccgtagctcacgaaggcgaccggcttggtctgccactcctcgtaggcgaagtcgatggcctgcttcagggaggcggggaacgagcggttgtactccggggtgatcacgacgaaggcctcggccctggcgatctcctcggtgaactccgtcatctgctcggtggcccgccccggatagtgcacgggaaagtcgtaatcggcgagatcgagcacggcgaggtcgagctcgctccggtcccgcgccctttccacgaaccagcggccgaccgcatcgccgatgcggccctcgcgggtgctgccgatgatcaccgcaacgcgcagcggaaggccgctccccgcgtcccggcgctcgtcggcgctctcgtccgtcgtcatcgctcgctcctcctcccgcgacctccgccgcctcccggccccccggccccccgtcaggcccggcccgttc

SEQ ID NO: 3380 - DNA, 1568 bp, Unknown
  Kingdom: Bacteria, Phylum: Actinobacteria, Class: Actinobacteria, Order: Streptomycetales, Family: Streptomycetaceae, Genus: Streptomyces
  misc_feature (225)..(260): n is a, c, g, or t
  misc_feature (548)..(705): n is a, c, g, or t
  misc_feature (1137)..(1236): n is a, c, g, or t
gcgggggccggggaccgcgccgcccgtggaggcggaggggacggctcccgaggccgtacgggagccggaagccgtaccggagccggaacacgaacacgtagagcctgagccggtaccgggtcctgagcccgcaggagagccggaagccgtcccggcgccggaagtggatgacaagcgcttcaccgtccggctggtgaacttcgagggccccttcgatctcctccnnnnnnnnnnnnnnnnnnnnnnnnnnnnnnnnnnnnccgaggtcgaggacgaggcggacctcgcgctcctggaggcgagggacctgcttttcgcccggctgctccagtaccgcgcgtacaagaggatcgccgagatcttccagggccgcctggagtcggaggcccgccgccacccccgtacggtcgggctggaggaccagcacgccgcgctgctgcccgaggtggtcatcagcatcggacccgagggcttcgcgaagctcgccgtgaaggcgatgcagccgaagcccaggccccaggtgtacgtcgaccacatccacgccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagatccagaagatccaggggccgaacggggtcgtcgaggaggaggacgtacgggaatgagcgcgcagcccaccgcacaggacggcggaccggaggacgaggacgcggtcgccgcgctcgatctgaagcccgccctggaggcggtcctcatggtcgtcgacgagcccgccaccgtcgaccacctggccaaggtgctccagcggccccgcagggccgtggcggacgcgctgcgggagctggccgacgagtacaccgtgcagcgccggggcttcgacctgcggctcgtcgccggcggctggcggttctacacgcgccccgagtacgcggcggccgtggaggccttcgtcctggacggccagcacgcccggctcacccaggccgcgctggagaccctggcggtggtcgcgtaccggcagccggtgagccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggcggaggcgggcgcggaacccgaaacaggtgcgatcctgtacaggacgacgaactactttctggagcgaatgggcctgcgcggcctggacgagctcccggagctcgcgcccttcctcccggaggcggacgcgatcgaggctgagacgctagagggtgtgccgtcgttcgatccggacgcaccggacaccccggatactcacgcagacgacaagacggaattttgatgcgaagcagtggcaggaacagcggaagcggcaacggcgggagcggcggccggagcagcggcggcggcaaccggaacccccggagcggcggcgcgagcagcgg

SEQ ID NO: 3381 - DNA, 10627 bp, Unknown
  Kingdom: Bacteria, Phylum: Actinobacteria, Class: Actinobacteria, Order: Streptomycetales, Family: Streptomycetaceae, Genus: Streptomyces
gtcctgggcggcgactgcgccgtcctcgccgagggcgccggcctggcggagcagagcggcgctctgggcggcggcggtccgggcgggagccaggacgtggacggcggaggcgccgccgggggaggcggcccgggcgggagcgtgggcgccgggcttgttgtcctcgccgacgatgtagaggccctcgtcgcgggaggcggcgctgtcctcggaggccggatcggccttcttgccctcggcggcggagtcctcggtcgtggagtcctcgccgtcctgctcggtcttcttcccggccttctcctcctcgccgccctgtacggccttcttctcgctctccgccttctctctcttcgcttccttgtcgtccttcgtgccctcggcggtttccttctccgcctcttcctccgtgccccgggcgtcgcccttggcgcccttctccgcttcgctgccggccttggtgtccttgggcggctggaccgcgccaccccgcgtccagccggcgtccgccagcagggcctgggcctccttggtgttctggtcgccgagcgccccgctgccgtccttgtagccgggctgacccgcgagtgcgaggtggctgccgagcggcttcgccgggaggcccagcggccccagcaccgtccgggccagttcctcgcggtccagggcgcgggccaccgcccgccggacccggtcgtcggcgagggggccggactcgccgttcagcgcgagctgggtgtaggcgggttccagggacttgcggacctcgaagtcgcgcagggccttctgttccgccgtgtacgcgacgacggccttgcggttcttctcccgggcggcctgcgcgatctccgcggcctcctcgtcggagccgtgcgccagggcccaggagcgcagggccgcggcgggcgtggtcccggagcccgggccgtgggcgagcggctggccgttgctgccccggtcgcggcgtgcgagcgcgatgcggtcggcggtgtccgcgtcgatgtcggcgacgtccaccgtgccgtcggcgagtgcccgggtgcggtccccggcggcgaccgcccggaagacgagggtgtccagcttggccttgtcgccccaccagcgcgggttgcgctccagggtgacggtgcccttggacttgctgacgccgcgcaggacgaagggccccgcggtgttcttcagggtggtgcgcgccccgtcgttgaaggcgtccggcgagccggtgatctccttcgggtagagcggcgagaacagcgagcgccagtccccgtacggcttggagaacgtgacccgcacctggaggtcgtccgcgccccgctcgatcttctcgatccgctcgtaaccggagttgcgggcggtccagaacgcggagtccttgcccctgagcgcccgccactgggcgacgaagtcgggggccccgatctcgcgcccgtcgctccacaccgcctgctggttgagcttgtagagcacgacctgcttcggctcgcgctcgatgatcttcgcggactccaggtagtcggggttgagcttcggctgcccggacgcgtccatcgggaagagcgtcgggagcagggctccggcgatccgggtggtggcgctgtccgcgtccgcctggaaggcgttgaaggtggcgggcagcgcgtcgaccgcccagttcaccgtcgagccgtcggagaccgcctgccgggcggcgggtgcgatgtcctggggcactccccgggaggtctcctcgctgccggagctgcagcccgccagcaccgggatcgtgagcacccccgtcgtgaggagcgcgagcgatcggcgctttcgaaccgtcccgcgcgggacgccgacgtgggacatggctgatacctccggggccggcccggaccaccccgtaccggaatggaccggatagtgcgtatgtggtggcatttgcagttgatcacactgattccttccgcccactgaaagggccccctcgcgcgagggggcgcagacacggcgggcgggagccttaagctcactcggccggaggaacgtttcgcccctgcgggccccgtgacgtccggcgcacgttccgcgcggctccgggtggccttgctccccctgcgacccacgatctagggtgaatgcgctttcacgggcctcgtgatcgcatcggcaggcgagcaggccgccggcccggtaccagcacacgcgccaggcgcggcgctacgaaagaagaagcggacggtcggtcgagtgagcgcccccacggtgtacgacgtcgccgagcggtcgggcgtctccattgccacggtctcccgggtctaccggaaccccgattccgtacgtgcccagacccgcgagaaggtcatggaagcggcccgggagctggggtacgtgccgtccggcagcgcccggggcctggccagccggacgacgggcgtgctcgggctctgcttccccgactacgcggacccggacgccgagaccgccgcggcggcgagcgacgcggacgacgaccaggccgtcatgctctactccgaccagatcatccggggcatggagcgggcggcacggcggcacggcgccgcgccgcgccggcacctctaccaggagtcctccagcggctgtgcggtcggctcctgtccggaggaggccgcgctgtactccctgctggaactcgccgagcgggacgccttcctgatcagcttccaccgggcccttccgctgccggagatcacccactcctcgatcaccgatccggtcgcacgggggctgctggcgacagccgcctcgcgcggtttccgggtccatctgctccgcgccacccaggacatcgacctcccggtggtctgggcgatggcggtcaacacacgcgctccgtttccggccacgttctccgccgcgggctccggcatcgacccggtctccgcggtccgcggggcgctgtgggaggtggtccagatggcgaccgagcgcatggactgggaacgctccgaggccgagccgatgctggccgacccctggctggtcgacgagatggacgaccacctgcggctctacgcgctgcccgagatgaaggagcgggtcacgcgcgtgctgggcgggccggagatgagcctgtcggaggcgttcgcgggctggcccgaccggctggaacaggtcgccgggggtgatgtgcgcggtgcgctggactacgtccggggaaggtacgccgaagccggactggaccggatcgtcctggtggactccaccacgcgggaccacgccgacatcggcctggccgccgccaaggccgtggtgccgggcatcgtccccatgtgcttcgggcaggcccagcaacgggtggccgggctgccgcgtctggaggcggcactggccggaaccccctccggcgagctgtcgccgccctacgacccgcacgccttcccctgatccccggacgtcccccaggcccagcaggagcggcggattcgcgccgttgttcaccgaaccaccgaaccaccgaggcatacggagttccccatgacagataccagcgaccggggcggccctgagtcaccgatcccggacgatgccgatgtcatgtcgcgcgacatgcggtggttcacctacgcgacgggtctcggcgtgcgggtggaggcggaggccgttcccgagccacgtccggacaccgaggtcgcgcccgcgctcccggaggcggcgctcggcgaccggacgcccctgccccggggtacggccgagctgctggagcggaccccctatccgcacggccgtgacggctccccgcgcgagaccgccgacgccctcgggcacgccctggtcgcggggttcgggctgcaacggcgggagccggagaacccgttcaacgaccaccgtccctatccctcggtgcgggcgaagtttcccgtccaggtgctcgtccgggacggccgccaccgccgggtgctcgacctctaccggcacgcgctgaccggtgtgggacgccaggacggggcgaccggtccgctggaggtggcactggccgggaggtacacccggctgccggactcctaccggtggttccgcagctccctgatcggcctcgaactgggcgtcaacctgcgtcagttgtgtctgggcctggagctgttcggcctgtccggaaggctgcgactgccggaccggaacgcgtccggcctgctgacggacttcggtctgacgcccgaggcggaatggtccctgccgctgacggtggccctggaggacggcgggccgcccgtcaccgcggccccggtggagcgggctgccgacccggtcctcgacgggattctgaccgtcaaccgctcccaggacttcacgggttcggccgctccgctcggcccgtccgtcccggccggtctgccgggggacggagcgctgtcctgggcggaggtgctgtggcgccgcagcgcgggacggatgccacgcggcatgtacggcatgaccggccgcagacgaccggtacccgagcggaccctgcgcgaggccgtcagctggctgagcgtcccgccccccggcccgcaactggccgccgcctgggaggaactgcgcctgaccgccgtgttccagggcatcgaagggcacgccgacggcgtctggcacctgagggacggccggccgacgctgcaccaggcccgtcccggcgccgcggccgaactggagacgcactacggctaccccgtcaccccgtacgccgggggcgacgtccggcacgcgagcgcggtgtggttcctctccgcgcacccacgacggctcgtggaccggctgggtcccggcggcttcaccgccgcccagtacgcggcgggttgggcggcccagggcatttcgctggccgccgccgccaccggtctgtacgcgaggcccgcgcgcgccttccaggaggtcccgacgaggcaactcctcggcctggaccccgatgagatgatcgtctgcgctgccatcaccgggaccccgcgcttcgaggggctgttgtgcgacctacgcctgtgacgagggagcagaagttgacggacacatccgagaccgcgcgcgccgacggcggtgccggccccggcggatccggcaccgtgtggcgtacctggcatctgcacgtaccgagcggtgaccgcagcatgcacgaccgggtggtggtcgaggcggtcgggccggtgctgcagaccctgccgggccgcccgtggttcttcctgcgctactggcacggcgggcctcatgtccgcctgcgcgtcggggatctgaccgccgatcaggccgccgcggcggagcggcttctcgccgagcggctcgcggacgccgggcggctgcgggagggcgagacggcgatggacccggcggactacgcgcagaccgccgcctccatgaccacggccggggaccagccctcccaccaggaggtcaccggcatgctggatcccggtgtccacagcttcgcctaccacccggagtacgagcggtacggcggccgggaactcatgcccgagagcgaacggctcttcgagctctccagcaggctggttctcgccttcctccggcgtggaccctccaccggggcccgagccctgctggccctgcgcgccaccgtctgcgccgcgcgggcgctcggcgacgaccccgacgaagaggccgccttctacgatcacggactgcgcgcctggcggacgtgggcggccggttacggctacacggagcgacagctcgacgagctgcaccgggccgcccggccgaccgacgagctgcgggccaaagcgaccgggggagacaccggaggcccgctggcgccgtggcaggcggcgctcaccggactgtcggaccggatacggcggcagaccccgctgcacccggcgcaggtcaccatctcccacgtccacatgctgcacaaccgcctcggtctgcggactgtcgaggaataccagacctacgcccggctggcgaggctcttccccgtccggccggccccagaaggcgcaccccctcccgacccatccggcccggcgcagagcagcgcggtcccatcaaccgaggagcaccgatgagcaccagccccaccaccgccaccgcacgcgccggggctccccccaccccggccgtcgtcgcccgggccatcggcgtcacccggcactacggagacaccgtcgccctggacaacgtggacttcaccgtgcgggagggcgagttcatcggcctgctcgggccgaacggcgcgggcaagaccacactgctcaactccctgctgggactgcgcaagccgacctccgggcgcatcgaactgttcgggggctcccccacgaacccggccagccggcggttcatcggcgtcaccccgcaggagagcggcgttccgccgaccctgcgggtggccgaagcggtggacttcgtggccgcgcacttcaaggagaccgaggaccgggacgagctgctggagcggttcgacctgaccaaggaggcccgccgccaggccggcggcctctccggcggccagaagcgccgcctggcgctcgccctggccttcgtcggacgcccgcgcctggtcatcctggacgagccgaccaccggcctggacgtggagtcccggcggatgctgtgggaccgcatccgcgagttccacgagggtggtggcacggtcctgctcaccacgcactatctggaggagatcgaggccctggcgaagcgggtggtggtgatcgcgaagggccgcatccgggcggacgacagcgtgggcgccatccgggggatggcccatatgcagcgcgtgtccatgaacgccggaccgctgccggacctgccgggcgtcatcagcgaggagcggacggaggagcgggtcgagctgatgacccacgacgccgaccagctggtccgggcgctggtgcgtcagggcgtggagttctccggcctcgccgtccagcaggccacgctcgaagaagccttcctggtgatctcccagtcctgatccaccgcacctcccacgaaagtgcctgaggccatgtcatcactgacccttgtccatgcccgctaccagctggtcgagctgagccgtatccccatggcgatcatcggcgcggccttcttcccggccgcctcgctgttcttcttcgtggtgcccaacaccaaggacgaccccgccggggccaccctcgccaccgcctcgatggtggtcttcgcggcgatgatcagcaatctcttcggccacggcaccggcgtggccgaagaccgctcccagccctgggacccctacacccgcacccttccgatcggcccggcggtgcggttcggcagccgcatcatcaccggtctcgcgatgatgctgttctcgatgttcccggtcgtgatcgtggcggcgttcttcacccccgccaccatctcgccggtccgcttcctgctggcgatcggcgtggtgatcatcgtctccgtgccgttcaccatgatggggctggcgatcggctacctgctctccaccaaggcggcgatcgccaccgtccagctcgtcttcctgccgctggccttcgcgggaggcctgctgggcggtccgggagaggcgcccggattcatcgagacgatcgccccgttcgtcccgacgcggggctcggccgagctgatgtgggcgaccgtcggcgactacgacatcaatccggtcgccatggtgtcgctcgcggtctggaccgccggcctggccgccctcgcgttctacgcctaccagcgtgacgagggacgccgctaccactgagagcctgccgggccgctcaggcggagccggcggctgcgcccggcccccgggtggccgggtgcagccgccgccggaagtccgtgatcagcgcggcgagcccgtccgcgtcgggggccgcgccgaacagatagcggtcgggccggatcaggacggccccggccggtatcgactccagccaggccagacagcggccgtcggtgtccagcaccgtgtccggcccgggagccgaaccggcgtcggcgcgcaggacggtcaccacccggccggacaccagccgcagggactccagcgcggcgggggacagggtgtccgcgaggttctcgcggcacagcagtacgaagccggggccgagcacaaagtcggccgggcccggaccctcggggccggtcagccggacctggccgaacagttcacccgccgggggtccgccgtcggcgaggaagcccttggccaggtgttcgcccagcgggctcgcggagcgggccgggccggagggccgggccggttcggacggccgggccgggccggcagggcgcgcggtcatcgcccggtccctgtccgccgccgcagaggggtcggtcacgcagatcaggcgcccgagccgcacggacaggtcgatcgcgtgctgaacgtgggcgcggcgctccagctcgtagctgtcgaggagagcctcgccggcccggccgcccagcaccaggtcgagcttccaggcgaggttcgcggcatcccggaagccggagcacatgccctggccggcgaacggcggcatctgatgggccgcgtccccggccagcagcacccgcccgcgccgccagtgctcggcgttgcgcgcccggaaggtgtaggtggcgtggcgggtgagcgtggcgttgtccggcctggcggagaacatcgacagcagccgccaggcgttctcctcggtgccgaactccgcccggtcctcgccgggcatccgcatgaactcccaacgccggcggcccggtccgcaggagacggccacccgcggccgggcgggatcggcgatctgcagattggacggcgggaagtcctccggccggtgcggcaccacgtcacaggccagccagtccagggcgaagccggagtcggcccagccgacgcccagggagcgccgcacgaagctgccggcaccgtcgcagcccaccacccaggaagcggtgaaggtccgccgctcgccgtcgcgttcgtcctcggccaccagctcggcgccggagtcggagccggtcagctccacggcacgcaggccgcggtgcacgcgcagcgtgggcagttcctcgccgcgagccgcgagtgcggcctccagccccggctggtacacggaggtggagtccggccggcccggcccgtccgggccgcccagagcgatccgcaggagctgccgcccggcggcgtcgctgaccacgtagtcctgcgagggttcggtgatgtccccgatccggccggtgacgccgacggcgtcgagcgtccgggcggcctcggcgtcgaacgccaccgctcgcggcagactgtacggttccggatggcgctcgacgacgacgacccgccacccgtgctgggccagcaggatggacagcacctgtcccaccggcccgtagccgacgaccaggacatcggcctccggagcgccggcgctccgactgcgtgacccagatatcccgttcatgcttctcctgtcctgaatacccatggtgttcgggccgtacgtgggcaaccgtgataatcgaggcccaccgtaccgattcatcaaagcgacatttgtgccccttcgatcggcttccaggcagaggctggtgacaaatgtcagcgccgcttcgagagagattgccagcgccggaagtgaccgaaattatccatggtgccacttctaccgaatggcagtcttaatcaagaagggaaatcaagtcaatgagcatggccattgaggcgatgaacgcggacgccctgttcgactccttcgacatcgaggagctggacaccatggaggtcgccgacggcgtcgccctgcccgagatgggcgcctcgaccggcaacaccatgtgctgctcctcgtcctcctcctcctgctgctgaggtagggacaccggctgtccgtgcggcgggtatcccgacgcgcagacagcgtcaccgaggtgaagcgcatgcccggcgggtggttgtccggcaggaattgatgacaaatatcagcgccgtgccaagggtaattgcgtgccgggttccggacggaaatcgtatgcaccgtcggtctcgtggccggcgggccagagcttggaggtacaccaagatgagcaagatcctggagaccatggacgcggacgcgatgttcgactccttcgacatcgaggagctgggcaccatggagctcgcggacggcgtcgccatccccgagatgggcgcctcgagcggcgactggacctgctgctcctcgtcctcctcctcctgctgctgaggtagggacaccagctgtctgcgcggcgggtatcccgacgcgcaggcagcgccaccgacgagcattgggcatcggcggaggccatttcgtttccggcgggaatcgctgacaaatgtcagcccccggtcgcgggtcattgcgtgccgggtatccggttggaaatcgtgtgcaccgccggtctcgtgagctgtgccgctcgtcccccttctcattctgccgccgatccggcggcagacagcaccacccgcgcaacaagctttcggcaggcggctgtccggcgggactcgctgaccacgtcagcgccgggcccgaagggcgatcgtgtgccgggcaccggttggaaatcacacgcaccgccggtctcctggccggcgggccaagagcttgggggtacacacaagatgagatcgaccctggagaccatggacgcggacgcgatgttcgactccttcgacatc

SEQ ID NO: 3382 - DNA, 3463 bp, Unknown
  Kingdom: Bacteria, Phylum: Actinobacteria, Class: Actinobacteria, Order: Streptomycetales, Family: Streptomycetaceae, Genus: Streptomyces
cggaccccgctcctcaagcgccggaggggctggtaccgctgccctcaaccgccggaagggcttgaggtcagcgtccgacctccttcgtgaccagcgtcaccgcttcctccacgtcgtccgtcacgtggaagagcatcaagtccttctccgaggccttgccctgggccaccaccgtgtcgcggagccagtcgatcaggccgccccagtaggccgtgccgaacaggacgatcgggaagcgggtgaccttgccggtctggacgagggtcagcgcctcgaagagttcgtccagggtgccgaggccgccgggcaggaccacgaagccctgggcgtacttcacgaacatcgtcttgcggacgaagaagtagcggaagttgacgccgatgtcgacgtgcgggttgaggcccgactcgaagggcagctcgatgccgagaccgaccgagacgcccttcgcctcccgggctcccttgttggcggcctccatcgcgcccgggccgccgccggtgatcaccgcgaagcccgcgtcgaccagggccttgccgatcgccaccccggcctcgtactccggcgatccggcgggggtgcgggccgagccgaagacgctgatcgcgctcggcagttcggcgagcgcgccgaagccctcgacgaactccgactggatgcgcatcacccgccaggggtcggtgtgcacccactcggagtcgccctcggagtccagcagccgctgatcggtcgtgccgggctggacctgctccctgcggcgcaggaccgggcccagccactgttcctcggggctgaccgcgccctcgggaacctccgcaccctcagggatccgtgcgtcttcggcgttgcccatgttccgctccctccaccgacccgcgtcgcgctgggtcgtgtcgtactgcgtacggccagcgtagatcggcggaggttacgtgcgggggaatgccgtgcgtccgccggtcagccggtgagccaggagcgcagccggtcctcgcagtgggtgatcttcgcgaccgccacgtgctcgtcgcgcttgtgggcgtacatcgggtcgccgggtccgtagttcaccgcggggacgccgagcgcgccgaagcgggagacgtcggtccagccgaacttgggccgggcggtgccgccgacggcggtcatgaacgcctgggcggcggggtgggagaggccgggcatggccgcgccggagtggtcgtcgatgacgatctcggccacgccgcagtcggcgaagacctcgcggacgtgggcgatggcctcctcctcgctgcggtccggggcgtagcggtagttgacgacgacggtgcaggcgtccgggatgacgttggtggcgacaccgccctcgatgccgacggcgttgaggccctcgtggtattcgaggccgtcgatgaccgggcggcggggctcgtacgcggcgagcttcgccaggatcggggcggcggcgtggacggcgttggaccccatccagctgcgcgcggagtgggcccgctccccggtcgtccgcagatggacccggagcgtgccctggcagccgccctcgacctcgccgtcggagggttccagcaggacggcgaagtctccggcgagccactcggggtgggcgtcggcgatgtggccgaggccgttgaggtgggcggcgacctcttcgttgtcgtagaagatgaaggtcaggtcgcggttgggctcggggaccgtcgcggcgatccggagctggacggcgacgccggacttcatgtcggaggtcccgcagccccagaggatcccgttcccgtcgaggcgggaggggacgttgtcggcgatcggcacggtgtcgatgtgcccggcgaggacgacgcgctcggcgcggcccaggtccgtacgggcgacgacgttgttgccgtgacggtcgacggtgaggtggggcagggcgcgcagggccgattcgatcgcgtcggcgagggccttctcctccccgctgaccgaagggaagtcgacgagccgggcggtgagcgccggtccgtccagggtgaggtcaagggtgctgtcggccatggacccgaccctaagcgacttgggtatcggccccggccgggccctccagtacggtgggctcgtgccccggacagccagccccgcccgtcgcagccgcctcatccgatgggcggcggccttcgccgtgctcgcggccctgggcggctatctggccgtgcagtacgactcctccggctcgaagaacccgccccgctgcgtcgtggaggcctccgacggtgacggcgggacgtcacacacgtacgagatgagcctggcccaggcggtgaacgcggcgacgatctccgcggtcggcaccacccggggcatgcccgagcgggcggtgacgatcgcgctggccaccgcgctccaggagtccacgctccgcaacatcgactacggggaccgggactcgctggggctcttccagcagcgcccgtcgcagggctggggcacgcccgcgcagctcatggacccggtctactcctccggtgagttctacgagcatctcgccgaggttccgggctactcgcggctgccgctgaccgtggccgcgcagcgtgtgcagcggagcgggttcccccaggcgtacgcgaagcacgagccggacgccgcgctgctggccgccgcgctgaccgggcgcaggccggcctcgctgaactgcaccccgtcgacggccacggcgaagggtccaggggactccgcgcaggtgcgggccgagctggtgcgcgccttcggcaaggacgtgctgcccgacgcggtggccgcgggctcgtccgccgcgtcggccgtctcggtgcccgttccggcggccgcgaagcagtcggaggacaagggcgcgcaccgcggctgggagctggcgcactgggccgtggcgcagtccgaggccctgcggatcgagcgcgtgagctacgcggaccgggtctgggaggccggttcgggctggcggacggaacgcgcgaaggataaggaaacgggcacgacggcggtcaggatccaggtcgttcagtagtacgccccgtcacccgtacggaccctggggggcctgtccccggatgttttccgcacgacccctcgcggcctggcggacctcctccgattcccttgcctcccaagggaagtgacggttcatcggactgcggcggtatggattgtttgcccgggttcttccgctgcggataatcggacccattactcagtctttacctttgtccgccgcaacctccccctcccccgaagcggttgtcagtgcgtccgatcaccggacagacagattcgtgcacaacccgctgaaggagcatcatgtccctccccctgacccgtcggatcgctcgcgccgcgctgctgatcgccgcaggcgcagcccccgtggtcggtgcggccggcgccgcgagcgccgcagatctcccggcgaccccggacctcggcggactgaccgcactggacg

SEQ ID NO: 3383 - DNA, 7130 bp, Unknown
  Kingdom: Bacteria, Phylum: Actinobacteria, Class: Actinobacteria, Order: Streptomycetales, Family: Streptomycetaceae, Genus: Streptomyces
caaagcgaccccgcaccccagccgccccagggccacagccacggccacacccacagccacgggccggccgctccggtctcccggcacctccgcaaggtgatcgccgccgtggtgatccccttcgccacggcggtcgtcgtcggcctgatcgcgttctggcctggcggcgctcccgaccacgagcgcaccggcgtcggattcgaccggcagacccaggacggcaaggtcgtccaggtcgtcaaggtcgactgcgcggacgtcaacgccgcgcaggtgcccccgaccggcgacacctccacaccctccggccgggaggccgtcaacgaacaggagggggattgcgcgaaggccaccatcaaggtgaccagcggcgacgacaagggccgcacgttcgtcgaggtggtgcagccggacgcgccccgacaactgaaggagggtcagggcgtggtcgtggcgtacgcccccgacgcgccgcgcgacctccagtactcggtgaccgacgtggaccggaaggtcccgatgacgctgctggccgggatcttcgcgctggcggtggtcctggtgggcaggatgcgcggggtgatggcgctggtggcgctggccgtgtcgttcgccgtactgaccctgttcatcctgccggcgatcctgcagggctcgaacccgctggtcgtggcggtgatcggggccagcgcgatcatgctggcggccctctatctgtgccatggggtgacggctcgtacgtctgtcgcggtcgtcggcacgctgatctcgttgctgctgatcgggctgctgggctccctgttcatcggctgggcgagcctgagcggcaacaccgacgacaacaccggcctcatccacggcctctacccggacatcgatatgagcggtctgctgctggccggcatcatcatcggttcgctcggggtgctcgacgatgtgacggtcacccagacctccgccgtctgggaactgcaccaggccgacccggagatgggttggaagggtctgtaccgggcaggtatccggatcggaagggaccacatcgcctcggtggtcaacaccctggtgctggcatacgcgggcgcggcgttgccgctgctgctgcttttctccatcgcccagagcagtgtggggacggtggccaacagcgagctggtcgccgaggagatcgtccgcacgctggtcgggtcgatcggtctggtcgcctcggtgccggtgaccacggtgctcgccgcgctggtcgtctccgcggaccggccggggtccggcggcgcacaggcggctacggccgcacccgcgcggaccggccggggccgtcgtcgcaggaaggggtgacgggacgccgggtgcacccggtcagcccgcgttctgctcctcggcgaggatgcggccgagcgcatcctccaggttcccgtcgaagtcacccagcgtgtgttcctgaccgagcggcacgagcttgtccgtccggtcgagaaacgccaccagcggcgccgtccccgcccggaacagcgcacggtccgcgccgacctggagccggatgtgcacatcgcccaggccctcgggctcggtcggaccgatgtgcacatctccgtcgccgctcgggctgttgagcccgtccagcagcagttcgcggccgaacgcccaggtcacaggggcatcgccgggcaggtggaacgtcatccggatggcgtacggatcgccgacctcgtaccggagctccaccggaatacggaacgagagctcctcggagacgaggaagctcatcatgacctctgcttgaaccgactcgcgcatcgttcaaccccgcagtagatgaaactggccaggaatgatcccccatggccctattgacgccatcgtggtgcacgcgatagcagatcacaaggagtgatttttcagatactgatagagaacacgaacgaacgcaagaggctggcaacttcgccacgtagctgttcgactgcgggcagcaaccgatcttcccggtccaggggtacggaaatggccatcgccgcaatggtggcaccggccgtgacgggaatcgcggcgcacacggtccccagtgcgtactcctggcgttcgatgaccggttcacctcgtcggagggtgcgcagccgttccagaagtgtggcgcgatctcgcactgagtaacgggtgagggggcgcacggggtggcggtcgaggtggtcctcgcgggccctctcgtcgagttgggcgagcagacactgaccgatggcgtgcgcgtgggcggtttcccggaacgaggcccactcctccaccgccgggatgtcgggagcgtccgcgaccgcgatgagatcgatctcgccgtcgcagtagacggcgcagtacaccggggctccgatgacgtcccgccagtgcccgagggagtcggcgacggacgcgggacgtgggcggcccctgactcctggggcggcggtcaggttctcggcggccgcgccgaagaggaagacgccgttctcgcggcggagatagccctcatgggtgagggtgcgcagcaagtggtacgcggtcgggagcggaagccccgcctcacgtgccagctgcttggcgggcgcaccgtcccgatgggtgcccacagcctccagcagcctcaacgcccgctgaaccgaaccgatcaacgtcgggacagcggtgctcgatgccgtggtcaagggccacccccaggcatggtgacgggccgtcggccctcccgtgggggccgcccccacgggcctgccgcgatcccgaggaccggaggggaccggagatccggcccgtgaccggcgaggaccggtccgggcgccggcgatcgaaggccaacgaccggactgtcgtacccaggaccgatcaggcgatcgatatggtgacggaaggtcacattccggatggcggcagcggtttgccactgtatcggccgcctgtggcagacgggtggtttcccccgggacttagctctgctgggctaatagccccgccgaagctgaccggtctcatgccgcggaccgggccggacagtccggacggaacaggccggcccccgcgccgacccgcgttccgcgtactaccagtcaccgcgcgaggacgacgacgacatgaacttgcgaacgacgaagatcagcccgccgaccaggacgacgaagaccagcgccttgaagagcaggctgaccacgaatccgatcacgctggcgatcaggccgccgaacacgaagatcgcaacgacgggcaccgcgatccacttcacccaccagggcattcccgcgaatatctcccgcacggccatcgcctctacctcgtctctctgagtccttgcctcgatgctaaaggcgcgaaggccctccgcgggggccgggcagcccttgaagacccctgatcgaccccctagggatccccgggcggcgcacccggatcccctggacgcaggctcagctctcgggcggcgagaagacgaccatcaccctcaggtcctcggtgatgtggtggaacttgtgggccacgcccgcgggcacgtagacgacgcttcctctgccgacctgcgtcgtctccatccccaccgtgatcgacgcacgcccgctgacgacgaagtagacctcgtcctgctggtgcggctgctgcggatcgagcgctcccgcgtccagggcgtacaggccgaccgacatagtgcgttcccgcacgaactgcagataggcgccgtcgttggcggcccgctccgcctccagctcatccagtctgaatgccttcatggcccgtcccgccccttgtactcacgctgtcggttgtgcctgtactgccggtgtccaccaccgatcatgtctgccacgatcagacacatgaagaatttcgtagtcaagacgatcgccaacgcgggtgcgctggccgttgccatctggctcatcggcaacatcacgctggagggcggcagcacgggccgcaaggccctcaccctgatcctggtcgcgctgatcttcgggctggtgaacttcctggtgaaaccggtggtccagctgctgacgttccccttgttcatcctgaccctggggttgatcaccctggtggtcaacgccctgatgctgatgctgacctcctggctggccggcgtgttcgacctcagcttccacgtcgaggggttctggacggcggtgctcggcggactgatcatctcggtcgtttcgtgggcgctcaatgtcgtcctgcccgacgagaactgattccggcattccagattccggacctccgggaaggctgctccggggtctctgcaagagtgcgggggacaccggtccaccaccggggagagcggcgaaggagcaggttatgagcaccatgggcgacggaacgcgcgcggtacgcgccgggcttcccgaaccggagcagttcggagccaccctgcccggcccggtgttcgccgcccacttccacctctccggcgaaccggtgggcccttatacctacggccgggacggcaatccgacctggacccacctggagcgggccatcggcgagctggaggctcccggtgaggaggtgggcacgaccgtgttcgcctcgggcatggcggcgatcaccgcggtgctgctctcccaggtccgctcgggcgacgccgtggtcctgcccgacgacggctaccaggcgctgccgctcgtacgggagcagctggaggcgtacggggtcgaggtccggaccgcgccgaccggcggcgatgcccagtcggccctgctggccggggcgaaactgctctggatcgagagcccgtccaaccccggtctggacgtctgcgacatccgtcggctggtcgaggcggcgcacgcggcgggcgcgctggtcgccgtcgacaacaccctggccaccccgatcggccagcgtccgctggagctgggcgcagatttctcggtcgccagtgacaccaagggcatgaccgggcacggcgacgtcctgctcggccatgtgacctgccgcgatccccggctgacggcggacgtacggcgctggcgcaaggttgtcggggcgattccggggccgatggaagcctggctcgcacaccgttcgctggcgacccttcagctacgtgtcgaccgccagtgcaccaccgccctcgctctcgccgagacgctggcgaggcgcgcggaggtcaccgggctgcggtatccggggttgcccaccgacccgtcacacgtcgtcgccggccgccagatgcggcgcttcgggtccgtggtgtccttcgagctggccgaccgggagaccgcggagcgcttcctgtccgcgctgcgcctggtcgacgacgcgacgagcttcggcggcgtccggtccaccgcggagcgccggggacgctggggcggcgacgccgtggcggagggattcatccgcttctcggtcggcgcggaggaccccgaggacctgctcgccgacgtcgaacaggcgctggacacggcggtccggtaggcccggggagtttcagacggccctccacgggccactctcttgccatgaccgaacgtcctgtggtcaagcgcaccgcacgcgccatcctgctcgacggcgacgacctcatcctgatcaagcggacgaagccgggagtcgatccgtactggctcacacccggcggcggggtcgagccggaggacgccaccgtcgtcgaagcgctgcatcgcgaggtcgacgaggagctgggcgccaagatcgtcgacgtggtcccgtgcttcgtcgacaccgtggagcacatcgcggacggcggcgtgacgggagtgaaggtccagcacttcttcgtctgccgactggtgtcgatggacgtctccctgcggcacggcccggagatcgacgaacccaccggggagtacgagatcgtccgggtgccgttcagccgggtcgggatcgcggcggtgcacctcgttccgctgtccctgcggcactacctcgacggcaacatcgaaggcgtacgggcgatgcacgcccccgacctgggctgacgttccccgcggcgggcagacgccccggccgcgccggtgtgcgtactccccagcgggtacccgtggatactcccgctgccggacgccccggggagtcccgctcggcatcgtgtttcacgtgaaaccactcaagcgccccgtacgccgaggaatcctcgtcgcccatgtcgccgtctccgtcggctggctcggcctgaccgtcggcctgctgactctgggtatcaccgcgttcaccaccggagatccgaccgcggcgggcaccgccacccggtccatgaaggtctacggggactggctggtggccccggtggctctgctcgccctggtgagcggcctggtgctgtccctgggcacgccgtggggcctggcccggcaccgctgggtgtggaccaagttctggctgactctggtcacgacgggcctgtcgatcttctccctgcgccccggcatcaacgcagcggccgccgacggagtggtggacatcgacctcgtgatcgcgccgtcggtggccacggccacctatctcttcatcaccgcgatctcggtgctcaagccctggggtctcacccggcgcggcaggcggctacggatctcggccagttccgcgaaatcggtggacgcgcgatcacctcgtcagacagcctgaccccatgcacagcccatcacccctctccctcgtcgacctgccgatccgacgcctggaccggggagacctggtcccctgcgccgatctctgcgaggaccgcggctggccgcgcgacgaacaccggtgggggctgctcctctcggccggcaccgggtacgggatcgacgccccggacggcaagggcctggcggcgacctgcctgaccatgccgtacggatccgacctcaccgcggtcggcatgctgctcgtggccggacgctacggacgtcgagggctcgcccgccggctcatgcggcacgtgatggaagcggtgggggacaccccgctcgccctgtacgccactgagctgggacagccgctctacgaggacctcggcttctcccccgtgggccgcgccgaacgcgtcggcggccgtttcggcgcgggcggcccggacgtctcccccacggcctccccctcccgcccggacatgaccccacgctcgtccgtgaccacacgctcggccgcggcggacgacctgcagg

SEQ ID NO: 3384 - DNA, 5859 bp, Unknown
  Kingdom: Bacteria, Phylum: Actinobacteria, Class: Actinobacteria, Order: Streptomycetales, Family: Streptomycetaceae, Genus: Streptomyces
ccggcccggccggccgcctctcacggggcgtgccggccgggccggtcctcgaccgcgtgcgcccggccgcgggagtcgcccggcgcggtacgggaggtcggtgcggcggtggtggtccgggccgggttgcccgccactgtagggggaccacccgggcggatgaccggctttcgaacaggatgtccggaaccggtgcccctgcgtgaccgttgtacgggtgggagcgtgggcgcccggccgctgtgccaggatggatcggaccggcagcacatcggtgcaaccagtgagcgacagtgcaggcagtgcacccaagggggagtggatgtacggcagttacaccggccggtcccggacgcgcgggcgcgcggcgggcctgcggacgaccggtacggcggcggtgctcggggcggccctgctgctggcgggctgctccggcgacggggagggcgacgagaagaagagcgcgccgaccatcgagcagcagcccaaggacaaggatccgtactgggtcaaccccgacggcaacgcggcccgccaggtcgccgcgtacaccgaggacggcgacgagaagaacgccgagctgatccggaagatagcgcggcagccggtcggcgagtggatcggcccggacacccccgaggccgaggtcaagggcgtcaccgaggcggcggccgccgtggaccgggacgccctgctggtcctctacaacatcccgcaccgcgactgcggccagttctccaagggcggcgcctccgacggcaacgcctaccggacctggctggacagcgtcgccaagggcatcggggaccgcagcgccaccgtgatcctggagccggacgccctgctccacctggtcgacggctgcacgccccaggagttccacgaggagcgctacgacctcctcaagggcgcgatccagcggctgaagcagcagcccgccaccaaggtctacctggacgcgggcaacgcgggctggcagtcgcccgacgctctcttccagccgctccagcgggccgggatcgccgaggcggacggcttctcgctcaacgtctccaacttccagacgacggccgtctccacggagttcggcaagaagctgtcggagaaggtcggcaacaagcccttcgtcatcgacaccagccgcaacggcaacggcccctacaagggtggcgaccccgccgagagctggtgcaaccccccgggacgcgcgctgggcgaggccccgaccacgcagaccggcgacgaacgggtcgacgcctacctgtggatcaagcgacccggcgagtccgacggcgactgcaagggcggcccgaaggccggcgcctggtggccggagtacgcactgggcctggccggcgccacgaagtaggcggcacgcgacgaaggccgcacgcgggaggagaccttctcccgcgtgcggccttcgccatgtacgtcctgtgcgtacgcgtcctactcgggcacctccacccacatgccctccgacggcgtgccctggtcgtcggtgacgaacagcatgtaccaaccggacggcaccagcgcccggttctccggcacggtgacggtgatcccgtcctccgacttcttcaggtccagcgcgatggtgcgctggtcggtgtcggtgacatgggtgaccgccgagggccgcatcagcttcgccgaggcgatcgaggaggcgtgctgggtggtgaacaggcccgtaccgccgcgctcgatcttctcgggcccggccgtcagctccggcttggagtcccggtagaggtagggcggggtgtagatctcgatgcgctgctcgaagacgccgggccgggtgttggccttgtccgagtagagcgagtccgagccgaagatcatgacccggccgtccggcagcagcagcgaccccgagtggtagttccggcccaccgccgggtccgcgacctgtcggtacgtatcgctcttcgcgtcgtacagccgggcctggagcacgtccgaaccgccgcgcccccggtagtcgctggacccgccggtgaccagcagggagtcgtcgggcagcagcgaggcgctggggtagcgggtgccctcggagagggacgcgccgtcggtgaactccgggttcttcttcccgaggtcgaccagccgggacttctcgctggacttctccgactcgccgaccccgccgccgccgatcaccatgaacttctcgtcctgggccggggggagccgcacggtcgccgaggtctccatccggtccgggtcgctcagtccggggatcttcttgaacttgttcgtcgacaggtcccagacgcccgggtcgcggcccacgtccgccggaccgtatccggcgttggagccggagtagaagagcttgccgtcattgaggaggaagaccgccgggtaggtggggaacttccgttcgatgccggtgtactcccactccttggtcgccgggtcgtagatctcgtccttgccggggacgatctgcccgatctcgtccagacccgacagcgcgaggaccttgccgtcctccagcgtcgtcagcgtcggataccagcgggcctcgttcatcgggtcgacgggtatgtacttctccgcgaccgggtcgaactcgaaggcgtccttgatcccctggaagtccttcttgtccagggccagcttctgcgcgatgccgtagacgttgcgggtgtccgagccggacaggcccgccacccggtagttgtcctcggtgccggtctcgtactgcttgccggtcttctgcgcctcgacgtagatccggccgagcccggggtcgttgcgcaggaacgctccggtctgcttgtcgaagaccttcttggccttctccaccagcaccgggtccttggagagatacgtcttgccgttctccttgccggtgaaccgggtgcccgcgggcagggtgatcggcttgtccgggttctcgttgtggacgatcatcaggccgccggccttggtgacgtcgccctggagcttctcgtagcgcttggtgccgccggctatgaggagcttgccgtcgggcagctgggtgtgcccggcgcagaacatgtccttgggagtggggatgtccttgaagacgttcgtcttcgggtcccacagcaccgagcggaagctcttcgcgtcgaagttcttctggttgtttccggagcccgcgacgagcagcaccttgccggtgtgcagcagtgccgcgtggatcgtgttgatccggtgctcggaggggatgtccaggaagtcccagtggccgttggccgccttgtactccggctggttgatcttgtactcgtgatagcgctcggtgctgaagcggtacagccacggcccgttcgcccccgcgagcgcgagaaccaccgccgtactgatcgccaggcggcgggtacggcggctcggacggtacttcatttcttacgtcccccaagggcgatctgggcgatctgcatggtctggtcgttgcccggcgcaccgggcaggggctggggcctcggctccggggccggcccgccgctgcggtgggatccgcccgcccggcgcttcttcttctccgcccggaccgtgtaccgccagccgatgatcggcgccgcggtgatcagcagcgccagcgtggcccaggtgaccatcgcggggtggctgtggcccaggaagaaggaggagatcatcgacgcgccgaagacgaagatgaagaacaggtggatgcggaaggtgccgaacagcgtgtccgggctggacgagtcgcccttgggcgtcaccacgaacgagctcttgcggcgcagcaccgcgtccatcagcgagcgggcgtagatcggcgcggagagcgcggacatcaccatgccggccagaccgccggaaccctcgggctcgtgcggcgagacgttgtggcggcggttccagatgtacaggccgatctggagcgcggaggcgttgccgtacagcatcatccagatcgtcgggtcgatctggacgccggaggcgcccatgccgaggaacagcgcgcaactgagagccgcgaggatccagttcagggccgacatcggatagaagatgatcatcatcgtgtagttgaagagcttgccgggaggcatggtcccgaagcccttccagaactgcccgatgatcgtctcgtaggtgccccgggaccagcgcagctgctgggtgaagaagtccgtccacgcggtcgggccctcgccgacggccaggacgtccggggtgtagaccgagcgccacttcctacccgtggccgggttgcggtggcggtggatctcgaagccggtggccatgtcctcggtgatcgagtcgtacaggccgccgatctgcttgagcgccgagatgcggaccgcgttgctggtgccgacgaacatgggcgagccgtagcggttgcccgcgcgctggatcagggcgtggaagaggaactgctgcgactcggcggccttcgtgacgaaggtgtcgtagttgccgtagacctgcggtccgatgacgaagccgacgtccgggtcgcggaagtagccgagcatccgctccaggtagttcgccatcgggatgtggtcggtgtcgaccgaggcgaagaagtcgtagtcgccgccgtgcgcgtccagccaggcgttgtagttgccgtgcttggtcttggcgcggtgcgggcccttggcctggttccagtgcgccacgcccttgcgggagaagtggtgcacgccgagccgggcgcagacctccttgaccgccgggtcgtcaccctcgtccagcagccagacgtgcatcagaccgcggtggcggatccgcacggccgcctccagggtcttcgtcaccatctccagcggttccttgccggggacgaaggaggtcaggaaggcgaccttggtgccggactccgggatcaccgggaccggatcgcgggcgaccagggtggcatgggcgttcgacaggacattcatcgtgcggaacagctcgatcagaccgatcgagaccagcatgacgatgtcgaggaccagcaggaggtcgttgtccaggttcggatcgcggtccgtccagtggctgggctgcatcagccaggcgaagaggccgagcgagacgaggggagccgcgccgagcaggagcgccgcgcgcacccggtgcggctcctgcgataggagcgagcggtactggacctggtacggcctgcccgcggggggctgcgtcagcggtccggcgagccggctgtagtgctcgtagtcgtagcgcggcagctccttcttggcgcgccgccgcgccgcgccggcccgcagccccgcgggtatccggagctgcgtcgtccgggaagcgtcgttctcctgccggtcgcctggcggcgtcgacgtcatgggtcatccccccgcacgcatggtgcgtgactggtcggtctctcttcgtgcgcggtgggtccccgttcttcaccgggcacgcacacggtggcaagccaccgtccccacagacatggatcggcagccttccggttgcatgatgccccctcggcgtccgcccttgagcgggacccccaccccgcggcgcagacaaccggaacgtcacgctctgctgtgccaactgtacggatcagcagctctcttggacccgatggtccccagacagattgtccgacaccgaacgggaccgcaagggtgaaacagacggtttaccggccatacgtacgatttgaccccggcttgtggagggggtgtgacgaagtggagaccggcgctcactctctctctgtcgctgccccgtcaccgcttcgcggtggtccggagttcgatgagtagctgtgcgtgtacggccgctgggtgtcgccggatgccggacggggaatgatcaaagccccctcactgaacgtgagagggctttgactgtgcgtgcgccgtcagggactcg

SEQ ID NO: 3385 - DNA, 6206 bp, Unknown
  Kingdom: Bacteria, Phylum: Actinobacteria, Class: Actinobacteria, Order: Streptomycetales, Family: Streptomycetaceae, Genus: Streptomyces
ccgcgctcgaccggctcgtcgagcaggccatggcggacggcgccgacgaccgcttcggctacttcggtctgcgtacgctgcacagccgctacctgctgcgccacccgatcacccggcaggtcatcgagaccccgcagcacttcatgctccgcgtggccgcgggcctcgccgaggacgagtcggtgcgggcgctggacgaggtcgccgcgctgtacgggctgatgagccggctggactacctcccctcctcccccacgctcttcaactccggcacccggcacccgcagatgtcctcctgctatctgctggactcgccgaaggacgagctggactcgatctacgaccgctaccaccaggtggcgcggctctccaagcacgcgggcggcatcggtctttcgtactcccgcatccgcgcccggggttcgctgatccggggcaccaacggacactccaacggcatcgtgccgttcctgaagacgctggacgcctccgtggcggcggtgaaccagggaggccggcgcaagggcgcggcggcggtctacctggagacctggcacgcggacatcgaggagttcctggagctccgcgacaacaccggtgaggaccagcggcgtacgcacaacctgaacctggcgcactggatcccggacgagttcatgcgccgggtcgacgcggacaccgagtggtcgctgttctcccccgccgatgtgcccgagctcgtcgacctgtggggcgacgcgttcgacgcggcctaccgggcggccgaggccaagggcctggcccgcaggacgattccggcgcgtgagctgtacggccggatgatgcggaccctcgcgcagaccggccagggctggatgacgttcaaggacgcctccaaccggaccgcgaaccagaccgccgagccgggccgggtcgtgcactcctcgaacctgtgcaccgagatcctcgaagtcaccgacgacggcgagacggccgtctgcaacctgggctcggtcaacctcggcgcgttcgtggcggacggctcgatcgactgggaccggctggacgccaccgtgcggaccgccgtgaccttcctggaccgggtcgtcgacatcaacttctacccgaccgagcaggccgggcgctccaactcccgctggcggccggtgggcctgggcgcgatgggtctccaggacgtcttcttccagctgcggctgcccttcgactcccccgaggcccgcgcgctctccacgcggatctccgagcggatcatgctcgccgcgtacgaggcgtcctgcgacctcgcggaacggtcgggtccgctgcccgcctggtccgagacccgggcggcgcgcggggtgctgcaccccgaccactacgacaccgagctgaactggccggagcgctgggaggccctgcgcgcccggatcgcgaagaccgggatgcgcaactcgctgctgctggccatcgcgccgaccgccacgatcgcctcgatcgccggggtgtacgagtgcatcgagccgcaggtctccaacctgttcaagcgcgagacgctcagcggtgagttcctccaggtcaacgcctacctggtggacgagctgaagcagctcggcgtgtgggacgcccgcacccgtgaggcgctgcgcgaggcgagcggctccgtgcagggcttcgcctggatccccgacgacgtgcgggcgctgtaccgcaccgcgtgggagatcccgcagcgcggcctgatcgacatggcggcggcccgtacgccgttcctcgaccagagccagtcgctcaacctgttcctggagacgccgacgatcggcaagctctcctcgatgtacgcgtacgcctggaagcaggggctgaagacgacgtactacctgcgttcgcgcccggcgacccggatcgcccgtgccgcgtccggccaggcgccggccgccacccccattcccgtacagcaggcgtcggctcccgacgcggacgccatcgcctgctccctcgaaaaccccgagtcctgcgaggcctgccagtaatgagcacgaacgacaacaagaatctgctcgacccgggcttcgagctgaccctgcgtcccatgcgctacccggacttctacgagcgctaccgggacgcgatcaagaacacctggaccgtggaggaggtcgacctccactcggacgtctccgacctcgccaagctgtcgccgggtgagcagcacatgatcggccggctggtggcgttcttcgcgaccggtgactcgatcgtctccaacaacctcgtgctgacgctgtacaagcacatcaactcccccgaggcgcggctgtacctgtcgcggcagctcttcgaggaggccgtgcacgtccagttctatctgacgctgctggacacctatctgcccgatccggacgaccgggccgccgcgttcgacgcggtcgaggagattccctcgatccgcgagaaggcgcagttctgcttcaagtggatggactcggtcgagaagatcgaccggctggagacgaaggccgaccgccgccgtttcctgctgaacctgatctgcttcgcggcctgcatcgagggactgttcttctacggcgccttcgcgtacgtgtactggttccgctcgcgcggtctgctgcacggtctcgccacgggcaccaactgggtgttccgtgacgagacgatgcacatgaacttcgcgttcgaggtcgtggacaccgtccgcaaggaggagccggagctcttcgacgacgcactggagcagcaggtcaccgacatgctgagggaagcggtcgaggcggagctgcagttcggccgcgacctgtgcggcgagggcctgccgggcatgaacaccgagtcgatgcgccagtacctggagtgcgtcgccgaccagcggctcgcccgcctcggcttcccgacggtgtacggctcggagaacccgttctccttcatggagctgcagggcgtccaggagctgacgaacttcttcgagcgccgcccgtccgcctaccaggtggccgtggagggctcggtcggattcgacgacgacttctagaccctccgggaccgaggggtctcagaccctcgcccagcttctgaggtaggggcgccgctcagccgtcaccggctgcgcggcgctccgcgtttccggcggcccggcggcccgccgcccgcgttccgcctcccggagctggcggtcgatacggcgttcgcggacgaggccgaaggccacgggtgcgagaacgagggcgaaaagtgctgctacgaccaggtagttcaggaatgtgttcatgcctctactctggaccgccggaacgaaaatcatcagtggcaggactgccatgggacatcaaatagctgccacacttggcgcatgctgaccaatgtcgccgccctcctcctcgacgaggtccaccccttcgaactcggcgtcctgtgcgaggtgttcggcctggaccgcagtgacgagggcctgccggtgcacgatttcgcggtggtctccgccgagggccccgtcctgaacacccacgcgggcttcaccatctccacgccgcacggcctggagcggctggaggaggccgacctcatcgccgtgccggcgggcagccacttcatgcggcggaagtatcccgaggaggtcctcgacgcactgcgccgggccgtcgcacgcggctcacgggtgctgagcgtctgctcgggagcgtacgtcctgggcgcggccggactgctggacggccgccgctgcaccacgcactggcggcacgcggaggagctgtcccggcgcttcccccgggcgatcgtcgagccggacgtgctgtacgtggacgagggcgcggtgatcagttcggcgggcaccgccgccgggatcgacgcgtgtctgcatctggtccggcaggagtacggccaggaggcggccaacaccctcgcccggcgcatggtggtgccgccgcaccgggacggcgggcaggcgcagtacatcagccgcccgctgccccggaactcctgcgacacggtcggctcgaccctggcctggatggaacagcacctcgaccaggagatgagcgtggaacagctggcggcgctggcgcacatgtcgccgcgcaccttcgcccggcggttccagcaggagaccgggaccacgccctaccgctggctgctgcggcagcgggtgctgctggcccagcatctgctggagacgtccgatctgacggtcgacacgatcgcggggcggacgggcttcggcacggcggcgaccctgcgacaccagttcgtgcggtccctgggcaccacgccgaacgcctaccgccgcaccttccggggcccgtcggccacggccgtgcccgacgtcgcctgagcgtcgccgggcacggagggtcctcccgggaggtacgggaggtacgagaggcgccgggaggtcagataccgcagctgggcgccgaccagaagcggctggggccctggttgacgtgcacgtggtcgttgtggccgctgtagcccgggccgaggattccccggaagccgtggtagcgggcctgcttggccagcgtgcacagcgagtgcggggacgctccgaggtcgaccgcgtcgccgtacatatggcggctgttggaggctccgcccacggccgcgttgcaggagacggagcggaagccgctggtgacgcggatggactggtcgcccagcgcgtggcgcagcgcctccagcttccacatgctgctcagcgcgttggccttggccgtgcccgccgcgaccttcccgcccgcccaggtgctgttgcacttgttcagctcggggtacgtgaagtgggccggggtgcagtcgttgtcctggagcgcgtagagcttggactgcgtcgcggggccggcgaccccgtcggcggccagaccgtaggccgcctggaaccgcttgaccgcggcggtggtggcggggccgtaggagccgtcgatggcgagcaccgcgttgtagcccgggtaaccggccacccggatctggagctgggtgacatcgttgccggtggcgccggccttcagggtgcgggtccaggtgtagcagccgtcggcctgcgcggtgccggcggtcagcaccgcaccacccagagcgaaagtaatggtcatgacaagtccgagcagaacgcgtgcggtgcgtctcagcacaggggcctccctctgaacgtcagggtcgatgtgctcgcgagcctggccgagtcggctacgcgcgtcaaccgcccctggggaaactgcagttatctgccaggggtggagcgaaaaccggcagggacccgacaccggcgaaccggtaccgggtccctgcggggacgtcctcagtcgttcgggacgacctcgtagcgcggagtaccctcgtccatctgccgcagcgcgtccttgcgctcccgcttggagaggcggtcgatgtacaggtagccgtacaggtgatccgtctcgtgctggaggcaccgcgcgaagtagccgctgccccgcaccttgaccggattgccctgcgcgtcctgcccgcgcaccaccgcgtagtcgggtcgggcgagcgaggcgtacgcggtcgggaccgagaggcagccctcgttggagtcgtccagcacccgcgcctcgggagccagctcctccaggaccgggttgcagatgacgccggtgtggcgcaccccgtcgtcgtcggggcagtcgtagacgaagaccttcaggtccacgccgatctggttggcggccaggccgacaccctcggccgtcttctggctggcgaacatgtcgtcgatcagccgcgccagctcgtcgtcgaacgcggtgacgtccttgcactccttgtgcagcaccgggttgcccacgaccgtgatcggacgggaggtgccgcgctcgcggtaggccgcctcgcgctcctcgcagtcctccgtgtcgacgaggaacccctcgtcgtccacgccgatccgcccgtccgtctcctgctgcgacatgtccgccgtacgccttcctgcaaaacctcagactcggtgacccgagagcccccgctgcccgggcgctcggaagaacagcaccgcgatcggtgcgcgtacagcctacgggcacaggtcagcagacttcttcgagatcccgccactcgcggctgtccggactgtcggcgacccagccgtccagcagcccgcgcaccagcccggcgggggccgcgagaccgcactcgcgctccgggacccacaggtccccggcgcccgcggtgcggtggcccagcggccc

SEQ ID NO: 3386 - DNA, 2178 bp, Unknown
  Kingdom: Bacteria, Phylum: Actinobacteria, Class: Actinobacteria, Order: Streptomycetales, Family: Streptomycetaceae, Genus: Streptomyces
cctcgccgacccggacctggtcctggacctcggtctgcactggaccgagtcgggaggcccgatcggcgccgcgatccgtgccgcccacgggctccccgagtccggcggtgccgacgccgacggactggtccgggccggcacggcgctgctcctcgctcccgggtacagcaacaacgagaagctgctgatccgcccggcaggcctgtcgggccccgacgacccggcgttcggcctggtcgagggcaccgtcgccagtcacggcaccggcgatctcctcgccctgcgcgcactgctgggcgaggagaccgacgcgttggcctccgcgggcgcccccgatggctccccgcaccacccggcgcaggacccgacgcgtacggtgccggagctggtggccgaggcagccgatgccctcggcctgagtgcggacgccgccgccctctatctgatgctgctcgccctgcccgaccccacggaccgcaactgcgtccgctggaccgagtggaagccggcacgggtcaagaaggccagggcggaactcgccgccaccgacctcgtagtggaggccaagcgctcccgcgccggccgcgccctgttcctcccctgcggctggctggaacgcggcgctcccggactgccgctggagacctggaaggaacgcctgtaccccgtggccggctccacccggaccctgccccacctccccgtgcccgagctgtacgcagccgcctgggcacgggtacgcgacggcgacgcccccgccttcgaagaactggacacccgcgcaacccggaagggccgccgtcgatgacgaacgacaccacgaccaccccgaccaccacggagagcaccatcacgggcggcgtccccggccaggcggcggcgcccggccgggagcaccgccagatcacgctccccgaggaccggtacgccaccgagctggccttcctcgccgctcacgaccccgggccccggccgcccggctggctgctcaccccgcgcgccgtcgtcaccttcgtgacgggcagcgcgggcgaggcgctgggtctgccgaagggcgccagccccggtgccggggtaccgcgccgcctggcgatcgagcagaagttcgtcggcgaacgcgccctggtcgaacggtgcgtggtcaccctcgccggggagcgcggactcctcctcgtgggggaacccggcaccgccaagtccatgctctccgagctgctgtcggcagccgtgtgcgggaccagcgcacttaccgtgcaggggaccgcgggcaccaccgaggaccagctcaagtacggctggaactacgcgctgctgctcgctcagggacccaccgaacaggcactggtgccctccccggtactcgccgccatgacccggggggccgtcgcccgcgtcgaggaggtcacccgctgcctgccggaggtccaggacgctctcgtgtcgctgctctccgagcggcgcatcgcggttcccgaactcgcgggcggcgaaggcgcacaggtacacgcggcccccgggttcaccctcatcgccaccgccaacctgcgggacaagggcgtctcggagatgtccgccgcgctgaagcggcgcttcaacttcgagactgtgggccccatcggggacctggacgccgagaccgcgctcgtacgacgccagtcgcgggcagccgtcgaacgcgtgggcgccgcctaccaggtggacgaggcggtcctcgaagccctggtcaccgcgttccgggatctgcgtgagggccgctcggcggagggctgggaggtcgagcgcccctccacggtgatgagcacggccgaggcggtctccgtcgcgggctcgctgggcctggccgccgcctacttccccggcgaccgggacgtgctctccctcctgcccggccatctgctcggcgtcgtccgaaaggacgaccccgccgacgcggcacggctgctggggtactgggacgggccggtgcgcaggcgcgccgagcaggggtcggccacctggcgtgccctgtgggacctgcgcgcggtgctggagaactgacggatgagcgagtcgaccgtccccgagacgcgatccaccgcggaggtgtcgcccaccgccgaggcagcgcccaccgtcggcacgccggccgcttccccggcggggagcccggcggccgggcccgccggcccggaagcaggt

SEQ ID NO: 3387 - DNA, 1932 bp, Unknown
  Kingdom: Bacteria, Phylum: Actinobacteria, Class: Actinobacteria, Order: Streptomycetales, Family: Streptomycetaceae, Genus: Streptomyces
ccggaacgccgcccgccacacccccggccggcccgaccggcgaacaccggcgccgacagcccggacgggggcgagacagctccccgtgcgaccaccgccctgccgctcgccaccgacgacgcgccgcccgtcgtcctgctgcacggcttcatcgacaaccgttccgcgttcgtcgtcctgcggcgcgcgctgacccggcacggccaccgtcacctggaatccctcaactactcgccgctgacacgcgacatccgcgccgccgccgaactgctcgggcggcatgtggaggacatccgcgcacgcaccgggcacagccgggtcgacatcgtcgggcacagcctcggtggcctgatcgcccgctactacgtacagcgactcggcggtgaccgacgggtgcgcaccctggtgacgctcggaaccccgcacgggggcaccgccgtcgcccccggggcgggcattcaccccatcgtgcgtcagatgcgcggcggttcctccgtgatcgaggagctgcgcggccccgcacccggctgccggacccggttcgtgagcttctggagcgagttggaccaggtgatggtccccgtcgaaaccgcgtgcgtcgaccatcccgatctcgacgcggtgaacgtacgcgtcaccggcatcggacacctcgcgctgcccgtgcacccgacggtggccgccgcgatccttgaggccctcgatgcgccggaggcgggagaggaccccgccaccgccgccggttcctccaccgggacgacttccgtggcctgaaatagaacatctctcgaacgtagggccaagcctgcgcctgccgtccaccgaaaggcggccgattgcccgtttcctgcgaacgcaaaacctgtcgaagattgtcgtcctcacataccgccgggtacagtcgcggccactgcttccccctgggacccccctgaccgggacccagaacagtcctgctgccgaggcgagagagaagttggtgaacgaccagcacccccacgccgggcatgtcgggtacgacgaccgatcgaccggcagcttcgacaccgacccgctcttcggctcccttccgggcggccacgacaccggctacgacgcgggtcaccccgccgccggatacggcgacaccgcctacggcgccggatacgacaccccgtacgcgaccggacagccggaccacagcgtcccgtacgactcctccgcgtggaacaccgacaccggtgctcagcagacgcccggctacgacgggtacgccgcccaggagcaggccccgcagcagtgggacacctccggagcctggcagcaggtcaccgaccaggacctgaccggccagtgggcgaccgccgacaccggcgcgttccccaccaccggcttccccgccaccccgtacggcacggacaccgcgtacaccacggaggcgtacgacaccgggacgtacgggacgggcgcctacgacaccggtacgtaccctgccgccaccgcgtacggaaccggcgtcatccacgaggccgacgcctacgggaccgggtcgtatccgaccggcgggtacggcacaccggccgtcgccgccgacaccgggacgtacgccaccaccgccttcaccaccggcacgttcgacgcgggcacccatggttccggctcgcacgacaccggttcgtacgacaccggcgcctacgaaaccggcgcttacggcgccggctccaacggcacgggtacgtacgacacgggcgcctacgacgcgaccgcgtggaactccggcgccacgcccggggacaccgcgtacgagcccgaacagacgtcgcacccgctgtacgaacagcagccggccgacgcgacggcactcggcgcgacggccgagccggacggtacggccgaggagtcacccgccggcccgtccgtcaccgccgagttcgccgccctcgcaccggacac

SEQ ID NO: 3388 - DNA, 1970 bp, Unknown
  Kingdom: Bacteria, Phylum: Actinobacteria, Class: Actinobacteria, Order: Streptomycetales, Family: Streptomycetaceae, Genus: Streptomyces
gggggagcagcagacaggcgaacgccgatgcggcgagcgtgcgcaggagtcttctcatggtgcggcccttctgtgggagcgctcccaatcgacggcggcgtgaaggtgagacaggggagggaggcgcgcgaatggggggaggtccgtgggtcggtgggacgtgcgtacggcggaccggtggggcttcggtccgcaaggccgtcgtaggacgagacggtgacagcgggccgtcccggtgtcaatgagtccggcgacggcccacccgcgcatgagtgatcgagaggcttcgggcccgtctcacacggcgggctggtggacgcgggggattcccaggtccggcaggtcgaggtggaagccgcgcccgcgaccggtcatggttccgtcgtaggagaggtcggcgaggccgacgccgagatgccgcagctcctcgacgagcaggcgggcggccgtcgcggcgtgctcggggttgtccatggcgtcggggaagcggcgttgccagaccgagggggaggaatcccagccgttccgcgtcaggcgggcggggtcggccgtgtccggctggtgcaggtggccggtggcttcgatgacgagacccagatcctggctccagcactggacgaagcgccggggatcgtcggcggatcccaggtggaggatgaacctgccggggaagaacggggtgtcgtggtcgagggagcgcagggtctcggacaggcgcttctccacctcttcccaggtggtcccgggcgcgtgcggcgcggcgggcgcgctcggcagaccggcgagctcggcggcacgccagcggccccgggagtagccgcgcccggcggcgttggcgtccgcgtcggacggcaggagttcgaggctcacctcaccctcgtcgtgcgtgtgcacgaggaggcaggcggcggggagtcgccacagcatccacgggccggagtcgcctccccacatcgtgggcgggcccagctcctcctccatgacccaccaggcggcgcgaacgaggccggcggcggtggctatgtcctcggcgggcaggtcgacgacgcgtacgttcagcttgcgcacctgatcgggttccgaggcgtcggcgatcaccgtgccgtagccgccccagggacccttccggggagcgaatctgcgccagacctggcttccgatctccttgggctcccggagttcccagcccagctccgaggtggcgtgctcgaactccggcaggctccacgaaccgaagcggagcggggtgacctctcgcaccagctcgcggaaggtgtcgtcgtcgagccaattgccccgggggatcttgttctccatccggcagagcgtagcgggccggtgtgaacggggccgatgggccgatgttgacggaacggtcccggagggcgacgctcaccccaccagggagaagaggtggagcatggaggcacatgcctcggaactcgcgttcgggcagaaggtgttggaggcccagcccttcagcgtcctgctgggcgcacggctgacggccttcggcgacggagcggcggccctggaactggacgtacgggacgagctgcgccagcagaacggcttcgttcacggaggcgtcctgagctacgcggccgacaacgccctcaccttcgcggcgggcgcggccgtcggtccgtccgtcctgacggccggtttcaccatcgactatctgcgcccggcccggggtgaggtgctgcgcgcgcgagcgcaggtggtccgacccggccgtacccgggtcgtctgtcgctgcgatctgctgatggtggacgccgcaggggtggaaaccctctgcgcggtggcccagggcacggtcgccgtcgccggggaccccggaagctgaccgccgccgtcaccccgcgagcggcggggaggcgcggcccgccgggccacgcctccccgccccgcccggcctccgatgccgcagctgggcgcggaccagaagcggccgctgcccccgg

SEQ ID NO: 3389 - DNA, 2712 bp, Unknown
  Kingdom: Bacteria, Phylum: Actinobacteria, Class: Actinobacteria, Order: Streptomycetales, Family: Streptomycetaceae, Genus: Streptomyces
ccgcagtgccgcagtgccgcagtgccgcggtgccgcggtgcccgactccgcctctgccgccgcttcctctcccccttcccttccgtgccccggcgaccccaccgggcgatcccgtacgcctcgacgtatccgctccgcgaggcgtgcccgaaaggtgcctgagttgtccacgctttcccctgggctgcggcctcctgccgaccgctccgtaccacccgagctccggacgtccgcgcgctccgcacccgggttcgccgctccgcccgagccgcgggcgggtcggttccgccgggcggcggccctcctgacccctgccgaccgtgccgtgctgtggctctacttcctgacccgaatatccctgtggatcacggcccacttcgcccgctggctgtttccggcccactccggcacacgggaggcggcgcccgtcctcgcgcccttccagcggtgggacgcgaatcactacctccatatagcgcgtgacggctacttccccgccggtgcgggtccgtggacgagcggctgggacaaccgggaggcgttctttcccggctaccccttcgttctccgtgccgtgcacacggtggtgcccgactggacggcggccggtttgctggtctcgttcgtcgccggggcggtggccgtactcgccctggcccggatcgcgcgggtgtatctgccggaggacgcggcgggccgccgtacggccgctctcttcctgctctcgccctgcgcggtgttcctggccgtcggctacacggaggcgctgttcctcgcgttcgccctgcccgcctggctcgccgctgtgcggcaccgctgggcgctcgcctccgtactgacggcgctggcgacgacggtgcgcgtcagcggcctgttcctcgccgccgccatcgccctgctcttcgtgctgaccgcccgggagaagcggcaccggcggagctggcgagcggcgggctggacgctgcttccggcgctgcccccggccgcgtacagctggtatctgcacgcgcacaccggcgactggatggcctggaagcacgcgcaggaacgcggttggtaccggacgttccacaccccgtgggaggcgtgggcgaacacctggaacggggcgttcggccacacgcagacaaccggctatgcgctcatgttccaggcggaactcgtggcgatgctggtggggttcgcgctggtggtcgtactcctgtaccgccgccgctggcccgaggcgctgtacgtggccctcagcctctgggccctgggcacctcgtactggtacacgtcgatcccgcgcgcgacgctgctgtggtggccgctgtggatcggcctggcggcgctgagcctgcggcggccgtggttcaggacggcgtacctgagcgtggccgcaccggtgacgacgctcgtcgcgctgacgttcctgacggggaggtgggcggggtgagcccatcccacccaccagcactcaaacatcagggatgtccgccttcgctgcgatgagcatcctgcgggggatgaccacgagacgctcatcgggactgatggagactccgtccggcaggcgcgtccccagggagccggtgagatcgcgtccgatcacagcgatgtcgccgttctccagctcccagatgtccgggcattcgggtccggtgctggtggcgtccagctccagggccgactttccgaggcgtctcttgaagccggtctcaggatcggcttcccagggtctgcccatgctgccgccctcccctcccgagtgggtcaacctaccaggggcgaccaggtcaatcccggtgtcaagtacgctattcggcctgttggggtgagctgcgcaggactggggttccgtcgggggggcaggtgttcaccccggtgcttgatggagccggtccagctccagacccgcaggcggcgggagagggcgggcacagggcgtggcccggaaggattccaggaggtagccgaccagccggcgggacgcggcggcggcttccgggcccgcgccgttcgtcacgccgctgttggccagcagcacgagcaccacgtcggagacgtcgaagtccgggcgcagcgctcccgcctcctgtgctcgccgcaccagcagggccagcccttcctccgcccggtcgcgttctccggcgtaggccgtctcgcccgggaagcgggacaggaacgcgtgggtgaaaccccggtcggcggcctgcatcgcgcagatcttccggaacaccgtgcagaagccgtgccaggggtccgggtcctccagtgcctcgtccagtacgcccgcgcattcggcgagctgctcggcgaacgcttcggcgatcagggaggcgcgggtggggaagcgccggtagagggtggcgacaccgacccccgcccgccgtgcgacggcgctgatcggcacgtcgatgccgtgcagtgcgtacgcctcgcgggcggcccgcaggatgcgctcccggttctctcgtgcgtccgcccggagggcgtcggtggcggggcccgagccggtctggggccggttgtgagaaggctgagcaggcatgtctctcactttaaggtaaatggagggggtcttccggttagccgcctaccgtggaacgtgaggaacgagaacaggacgtccctcctatcggccgaccagaacaggacccaccatcgtgaacgacatgcgcgcggcgctctacgaccgttacggaccgcccgaggtcctctacgagggcc

SEQ ID NO: 3390 - DNA, 10813 bp, Unknown
  Kingdom: Bacteria, Phylum: Actinobacteria, Class: Actinobacteria, Order: Streptomycetales, Family: Streptomycetaceae, Genus: Streptomyces
ccaccagccccgcctgttccgggtgcagcaccagccggagcacggcccaccaccacagcccgccgaggaccagcgccggcacgcatcgccgtttcatcgctgcctcctcggccgacgtcctttccggcagtttcccctggcagcggcggcggtgcatccagaacgcccggccgaggggtcacccacacaggagtgcccccgccgactcggcgggggcactcctgggtccctgatggcgctcgaagggctgctccgaggcagcgggactaccggtcgtcgtcgttgcggagggagtccttgacgcccttcgcgcggtcgccggcctcgtccaccgcgcccttggcccggcccttggcctggtcggccttgccctcggactccttgcggcggtcgccggtcagcttgccgaccgcttccttgcccttgcccttgagcttgtccttggcgctgtcaccactcacgatgtcgctccctttcgctcggacgtgtgtcgcgcgccggtcaggcgctttccgcctggaacatccaggcgtgcttttcgagctccgccgtcagcccgatcagcaggtcctgggtgatcggatccggctcgtcggtcgcctcgatgcgttcccgcatccggccgatgaccacgcccagcgcgtccactaggatccgcacggcgtcggtgtccttgatccagccctcgggcacggacgcgatggcggtctccttggctaccgtgccggagcgcccgtccggattgaccccgacggccgaggcgcgctcggcgaccgtgtcggagtgctgccgggctgtgacgacgacgtcgtcgagctgaaggtgcacggagcggaagcgcggaccgaccacgttccaatggacctgcttggccaccagggaaaggtcgacgaggtcgaccagagcgccttgcagcgccgttcccacgaccttgaggtcgctctcggacaacgtgctcctgaccacagacatatgcgctactcccatccgtcagccttttcactgaccgtctcggtgcatcacccacgatggcacatatgaagcaaaacggtcatacgggccttgttcttcgtgtgcccaatgaccgagggctcacacccgtacgaggcactcggctcacagatcacacggaaggcccggaggtcccggcggtcacatggacgtcctacgcgaaagtcccgaccgaccccggtaggggccgaccgggactccggtcgagcaactgtgccgcgtggatcaggcggcgacgacgtccaccgcttctgcgggcgccttgatggtcacccggcccgacggcacacctgcgaccgacgagacggagttgagcatgggacgaaccggtactgggaccggatcactggcagctgccgactcggccagctcagcgagcgagagctcgtcgctcacttcacgcatgagctcggacatccgtacgtcaagcgcgtcgcaaatcgcggagagcagctcggaggatgcctccttctgcccccgctccacctcggagagataaccgagcgagacccgggcggacgaggagacttcgcgcagagtacggccttggcgctggcgctgccgacgcagcacgtcacccagcaggcgacggagcagaatcatcggtggctccctcctcggaccgcgtagccgcatccttcacgccctaccgtaccgccttgtgctgcggccgtgcggggagcgatgtcgtgttcactcagggctgcaaacatcaattccccccgttctgttccgtatcctgtgcccgcgcattctcaccgagttcgcctgcgagcagttcgagggcgcttcgcacactctcactacggatatccgccctctcaccattcaaccgcagagccgtcactttctcgatgccggagggtccggccacggccacgtagaccgtgccgaccggctgaccgtcctgtggttccggtcctgccacccccgtcgtggagacgccccagtcggcgtcgaggacccggcgcacgccgaccgccatctgcagcgcgacctcggggtccacggctccgcgctccgccagaaggctctcgtcgacgcccaggacgtcccgcttcaggggggtggcgtacgccgtcaccgatccgcggaaggaccgggaggcaccgggtacggaggtcaggtcggcggcgaccaggccgccggtcagcgattcggcgacggcgagcgtctcgccccgcgctccgagaagccggagcacccgggcagcggctgtcaccgctcggcctccgcggcgtcgcgcgcctcggcggcagcgtgtacgtccttcgcgccggacacggctccggcggccgggcccgcgtcggccgcggtgccggcggtgacctggagggcctccgcggcccgctcggccgcggcggcacgctcggcggcgaggccctgacgacgcaggacgacggcctggcgtacgtagtcgagtccggtgacgaccgtcagcacgacggcgaccatcatcatccagaagcgcagcgtcgccaggggtccggtgagcaccaggacgtacatcccggccgccgtcccctgcgcgagcgtcttcagcttgccgcctctgctggccgggatcaccgcgtgccggatgacccagaaccgcatcagcgtgatacccagctcacgggcgaggatcaccccggtgatccaccatggcagatcgcccaggacggacagcgagaccagcgccgcgcccatgatcgccttgtcggcgatcgggtcggcgatcttcccgaagtccgtgaccaggttgtacgcccgtgccagatgaccgtcgaacaggtcggtgatcatcgcgacggcgaaggccgcccaggcgaacgcgcgccagaccgggtcgtatccgccgtcgtggaacagcagcaggacgaacccgggcacgagcagcaaccgcaccatggtcaggatgttggcgatgttccacaggctggcctggttgacggccgcagtgcccagcttgccgccgcggaccggcttcgcgccggaaccgcctgccgcggatgccgggactccggtcatctggctacctccgcaagctcatggtgttcggccaccaggtcgacgccttcggtgcccactgcctttgcctcgaccatacggcccggcacgagtccctcgcgtgtggtgaagaccacctggccatcggtttcgggagcctggtgcgccgcgcgcccgatcgcgacctcgccgtcctcctccgactccacggactccaccagcacctggagggtctcgccgacgcgctcctcggcccgctgcgaagtcagctcctcggccagctgggagatgtgggcgaggcgctccgcgatggtgtcggcgtcgagcttgttctcgtagccgaccgcctcggtgccctcctcgtccgagtacccgaagacgccgatcgcgtcgaggcgggcgccggtgaggaagcgttccagctcggcgaggtcggcctcggtctcgccggggaagcccacgatgatgtcggtggagatggcggcgtccggcatcgcggcgcgcaccttctcgatgatccccaggaagcgctcctggcggtaggagcggcgcatcgccttcaggatgctgtccgatcccgactgcatcggcatgtgcagttgcggcatcacgttgggcgtctcggccatggcggcgatgacgtcgtcggtgaagtcgcgggggtgcggcgaggtgaagcggacgcgctccaggccctcgattgccccgcaggcgcgcagcagcttggagaaggcctcgcggtcaccgatgtcggagccgtacgcgttcacgttctggccgaggagggtgatctcggagacgccctcggcgaccagggcctcgatctcggccaggatgtcgccggtgcggcggtccttcagctccaggacgccgtcggcggagcggcggccggcgaccaggatcttgggcacgccgatcagctcggagtcggtgaacttcacgccgggcgagatgccggggcggtcgtcgaccaggacccgcaggcccgccgcgttgagcttctccgagacgtcgagggccagctccgtctggagggccttgcccgcggcgacgacgtggacgtcggccggggcgatctcgcggggccagcacaggcccttgtcgtcggcggtctgctcggtgagggcggccaccgcgcgggagacgccgatgccgtacgagcccatcgtgacccggacgggcttgccctgctggccgagcacgtcgagctggaaggtgtcggcgtacttgcggccgagctggaagatgtggccgatctcgatggcgcggtccagggtgaggccggtgccgcacttcgggcaggggtcgccctcctcgaccacgacgacgtcgaggtactggtcgacctcgaagtcacggcccgcgacgacgttcttcgcgtgcttgccctcctggttggcgccggtgacccaggaggtgccgggggcgacgcgggggtcggcgaggtagcggaccttctccaggccctggggtccgacgtaaccgcgtacgaggtcgtcgcggccgacgaagtcctcggcggtgaccagctcgacgacggcgggggccaggtgctcgccgagcttgccgaggtcgacctcgcggtggccggggacgccgacggccacgatctcgccgtccaccttgaccagcaggttcttcagggtcgcggaggcggggacgcccaggtgcgcggcgagcgtctcgatggtcggggtgtcgggggtgtccagctcctcgaccgcgccgtgtgccgagccgtcgaccggggcgagcgcgaaggtcacggcctcggtgttggcggcgtagtcgcagttcgggcagtccgcgaaggtgtcctcgccggcggcggcgggggcgaggaactcctcggacgcggagccgcccatcgcgccggagacggcggagacgatgcggtggtccaggccgagacgctcgaagatcttgatgtacgcggcccggtgcagggcgtaggagtgcgcgaggccctcgtcggtggtgtcgaaggagtacgagtccttcatctggaactcgcggccgcggagcacgcccgagcgggggcgggcctcgtcgcggtacttcgtctggatctggtacagcatcaccggcaggtccttgtaggacgagcactggtccttgacggtctgggtgaagatctcctcgtgggtggggccgaggaggtagtcgccgcccttgcggtccttgaggcggaagagcaggtcgccgtactcctcccagcggccggacgcctcgtagggctccttgggcagcagggcgggcagcaggacttcctgggcgccgatggcgtccatctcctcgcggacgacgttggagatgttgtccaggaccttcttgccgagcggcagccaggaccagatgccggccgcgttgcggcggacgtacccggcgcggaccagcagcttgtggctgagcgtctcggcgtccgccgggtcgtcgcgcagtgtcttgaccatcaatcgggacatgcgctggacctgggccatggtgaactcctgctcgcaagggtggtgagcccgaggttaaccgggcggtgcgggctggcggaaatccattcaggccccgggcctcgcgcgcagcagcggcaggggtgcgcccatgaccgcgtagggctgcggggcgctcgggaagacgacctggcgggccagatcgcggtagccgagggagtggtacagggtgcgggccgggctgtccttgtcgatcgccgagaggatcgaccgggggtggccgacggagtcggtgatggcggtgatcagggtgcggccgatgccgcgccgctggtggtccgggtggacgtggagttcggtgatgacgaaggagtcgtcgagccagccgtcggacccggtggcccgcagatagggctcgacgacggtggaccaccactgggcgcggtcgttgggcagcccgtagacgaagccgacgagccgtccgtcgggggcgatggcgccgagtgcgcgggcgtgggggtgttccaggtgtctgaggacgatgtggcggcgtacgtcgatctcgtcctggctcagtccgaaggccgccgcctggacgcgcagggcttcgtcgacgcgggcggccaggtcgacggggccgatctcggcgtcggacgctgcggggcctactccgggggctgctgccatgcgggaaccctactggccgggtcgggcggtcagaaccgcgcgctccggggcgtgcgcgtgacggttcagaacaggacgctcatgaacgcgccgacctcgcggaagccgacacggcggtaggccttgcgggcgggggtgttgtagtcgttcacgtacaggctgacgacgggggcgacgtcggccagcgcgtagcgcaggacggcggccatgcccgtttcggagaggcccttgccacggtgttcgggggcgacccagacaccctggatctggcaggcctgcggggtggccgcgccgatctccgccttgaagacgaccttgccgtcctcgatgcgggcgaaggagcggccggtgccgatgagttcggcgacgcgggcctggtagaggagtccgccgtcgccggcgagcggggagatgccgacctcctcggtgaacatcgccacgcaggccggcatcaggacctcggtctcgtccttgcggatgcggcggacgagcgggtcgggcgtgacgtcggcggagaggctctcggtgaccatgaggggctggttggcccggacctcgcgggcggggccccagctgggttcgaggagccgccacagctgggtggtgggttcggcggggccgacgatggaagagcagcggcggccggccctgcgggcccggtcggcgaaggcgcggacggcctcgggtccggcgcagatggggaccaggttggcgccggagtagcacagggagcggagcatgccgtcggcgtaccagccccacatctcgccgccgaggcgccaggggtcgagtcccgcgacctgcacgcgggacgtcacgaaggcgttggccacgggctcgctctccaggatggcgagcgctgctccgaggtcgctgggttcgaggacccgggtggtggtctgcgtcaacacgagggggcctcaccatgcggtctgctgatttccgcactttaaccgacgagcctgtcgaacgccgctcgagtccggaagacggcctccggacagggcggtggtgcatgcgggagccggtccccggacacgccgccgccccaccgggcgcgggggcccggtggggcggtgatggcgtggaagggcgcgggtcaggcgccgatggagacctggggttcgccggacgcgatgccgtccttctccatctgttcggcgatcttcatggcctcttcgatgagggtctcgacgatcttcgactcggggacggtcttgatgacctcgcccttcacgaagatctggcccttgccgttgccggaggcgacgccgaggtcggcctcgcgggcctcgccggggccgttgacgacgcagcccatgaccgcgacgcggagcgggacctccatgccctccaggccggcgctgacctggtcggcgagcttgtagacgtcgacctgggcgcggccgcaggacgggcaggagacgatctccaggcggcgctgcttgaggttgagcgcctccaggatctggaggccgaccttgacctcctcggccggcggggccgagagggagacgcggatggtgtcgccgatgccctcggagagcagcgcgccgaacgcgacggccgacttgatggtgccctggaacgccggtccggcctcggtgacgccgaggtgcagcgggtagtcgctctgggcggcgagctggcggtaggcgttgaccatcacgaccgggtcgttgtgcttgaccgagatcttgatgtcgccgaagccgtgctcctcgaagagggacgcctcccacagggccgactcgaccagggcctcgggggtggccttgccgtacttcttcaggagccgcgcgtccagggagccggcgttgacgccgatccggatcggggtgcgggtctcggcggccgccttcgcgatctccttgaccttgtcgtcgaactgcttgatgttgcccgggttcacccggaccgcggcacagccggcgtcgatcgcggcgaagacgtacttcggctggaagtggatgtcggcgatcaccgggatctgcgacttccgggcgatcgtggcgagcgcgtcggcgtcgtcctgcgtcggacacgcgacccggacgatctggcagccggacgccgtcagctcggcgatctgctggagtgtggctccgatgtcggacgtccgtgtcgtcgtcatcgactgcacggaaacgggcgcgtcgccgccgaccgcgaccgtgccgacctggatctgtcggctgacccttcggtcggcgagcttggtcggaacggccggcattccgagagaaatcgcagtcatgcgctgagcatccccaaggtgtggatcaaggtcccgagatcggcgggctccagccttcgaggttacggcaccggaggctggacgcacgcaccgtgtcgacatgtccacccgttggtgagcggccggacacggggtgtgcgcccggccgacacctgggggacggcagaggtggacggggctgtcaggagatcttgacggggttcacgatgtcggccaccaggaccagcagcgtgaagcagatgaagattccggcgaccacgtaggcgaccggcatcagccgggccacgtcgaacggaccggggtcggggcgccggaagaccttggccacattgcgccgcagggactcccagagcgcgcccgcgatgtgtccgccgtccagcgggagcagcggcagcatgttgaacaggaacagcgagaggttgaaccccgcgagcaggaacagcatcatcgcgacctggttctgcgccgggatgtcgaggttcatcacctcgccgccgatccgggccgcgcccaccacgccgaccggcgagtcgtcggcccgttcgccgtcgctgaaggcggcgtcccagagggccgggatcttggacggcagggcgatgatcgagtcgacgccgttctcgatcatgtcgcccatgcggacggtggactcgccgaaggaaagcggcacgatctcggtctgcgcggcgaagcccaggtagcccgccttgatgaactggtccgggacgacctggccgttgccgtccttcttcgcgacggcgttctcgcgcaggacggcgttgagggtcacttccctgccgtcgcgttcgacgacgagggtggcggggccgatggtctcgcggatgcggtccgagagcgtcgcccagtcgtcgaccttcttgccgtcgaaggcgacgatcctgtcgccctcccggaggccggcggccttggcgggcgagaccgggtcaccgtccttgcaggtctcgcgcttgtcgctctgcgagatcacgcactgctggacgccggcgacctcggtggtctgcgtctggaagccgaaggtcatcgcgacgcccatgaagatggcgaccgcgaggatcaggttcatgaaggggccggcgaacatcacgatgacgcgcttccacggcttgcgcgtgtagaagagccgcttctcgtcgcccggctccagctcctcgtaggcggcggagcgggcgtcctcgatcatgccgcgccacggtgaggtggagcgggcttcgaggcggccgtcgggtcctggcgggaacatcccgatcatgcggatgtaaccgccggccgggatggccttgatgccgtactccgtgtcgcccttcttgcgcgaccagatcgtcggaccgaagccgaccatgtactgcgggacccggatgccgaacatcttggccgtggagaggtggcccagctcgtgccaggcgatggagaagagcagtcccacgacgaagacggcgatccccaggaccgtcagcaggaccgaggtcagactcatgcgcgcgcctccgctgtcgctttcgccgagagttcccgggcccgtgcgcgggcccacgtttccgcttcgaggacgtccgcgacgctgagcgaggttcccggggcgggggtgccgtgttcggacaccacagcggtgaccgtatccatgattccgttgaagggcagctgtccggcgaggaaagcgtccacgcattcctcgttcgccgcgttgaagacggccggcgcggtgccgccgagcccgccgacgtgccgggcgagaccgaccgacgggaaggcctcggtgtccagcgggaagaactcccagctggaggccttcgtccagtcgaaggcgggggcggcgtccgggacgcgctggggccagccgagcccgatggcgatgggaccgcccatgtccggcggggtggcctgggcgagtgtggagccgtcgctgaactcgaccatggaatgcacgtaggactgggggtggaccacgacctcgatccggtcgaacggaatgtcgtagaggaggtgcgcctcgatgacctccaggcccttgttgaccagggtcgcggagttgatggtgatgaccggtcccatcgcccaggtcgggtgggcgagcgcctgctcccgggtgacgtcggccagttcgtcgcgcgtacggccccggaagggtccgccggaggcggtgacgacgagcttgcggacgtcggcgcgggtgcccgcggccagcgcctggaagagcgcggcgtgctcggagtcgaccgggatgatctggccgggggcggcgagtgccttcaccagcgggccgccgacgatcagcgactccttgttggcgagggcgagtgtgcggcccgccttcagcgcggccagggtgggggcgagcccgatggagccggtgatgccgttgagcacggtgtggcaggcgctcgcggcgagggcggtggccgcgtcgggt

SEQ ID NO: 3391 - DNA, 5986 bp, Unknown
  Kingdom: Bacteria, Phylum: Actinobacteria, Class: Actinobacteria, Order: Streptomycetales, Family: Streptomycetaceae, Genus: Streptomyces
agctgctggcgggcagcagccgcggggtggggtatctgctgaaggaccgggtggcggaggtccgcgagttcgtggacgccgtcgtccgggtggcgcagggcgggacggcgctggacccggaagtggtggcgcagttgctgggccgcagccgcaagcaggacgtgctggccgggctgacaccgcgcgagcgggaggtcctgggtctgatggccgagggccggacgaactccgccgtcgcccggcagctcgtggtgagtgacggggcggtcgagaagcacgtcagcaatatcttcctgaagctggggctctcgcccagcgacggggaccaccggcgcgtcctcgccgtgctgacctacctgaattcctagacatctgacaccctgtcagatgcctgtgggggcggagcgcggaccgtccgcggtcacgcgccggaagcactccgggagcgctccgggggcatagcgcgggtcaggggtgtccgacgggcggcggatgggcacctctgatcaaggaagggccgacggaggcccggggtggccgaggggggcttaggaccaaaggctcaggaggcggccgccttcattccacgatcagggggctggcaaatggtgacaaaccctactaagagggtgtcccaaaacaacgtccaccatatgatcggtccctggagagccacctacgcggacgtagggtggcctctgggatcgccggctggccggatggttccgaaccgccgccccaagggaggtccagttcagtgacgagccaggtcagtagcgcggcagagaaggccgatgaggccaacgacgccgtcctcgggggtcagcgagcccctctgtcaggtacgacgggaaccacgggcggcgacgggaaggaagtccgtcgcctggaccgggtgatcatccgtttcgcgggcgactcgggtgacggtatgcagctcacgggtgaccggttcacctcggagaccgcttccttcggcaacgatctctccacgctgccgaacttcccggccgagatccgcgcccccgcaggcacgctgcccggggtctcgtccttccagttgcactttgccgatcatgacattctgaccccgggcgacgcccccaacgtcctggtcgcgatgaacccggccgcgttgaaggcgaacatcgacgatgtgccgcgcggtgcggagatcattgtgaacaccgatgagttcacgaagcggccgatggcgaaggtggggtacgcgaccagtccgctggaggacggttcgctggaggcctacaacgttcatccggtgccgttgacgacgttgacgctggaggcgttgaaggagttcgggctgccccgcaaggaggcggagcggtcgaagaacatgttcgcactgggtctgctgtcgtggatgtaccaccggccgaccgagggcacggagacgttcctgcggcagaagttcgcgaagaagccgcagatcgccgaggcgaacgtggcggccttccgggcgggatggaatttcggcgagacgaccgaggacttcgcggtctcctacgaggtcgccccggccacacaggccttccccaccggcacctaccgcaacatctcggggaacctcgccctgtcctacgggctgatcgcggccgggcagctggcggacctgccgttgtatctggggtcgtacccgatcactccggcgtcggacatcctgcatgagctgtcgcggcacaagaacttcggtgtgcggacgttccaggcggaggacgagatcgccgggatcggtgcggcgctgggcgcggcgttcggcggcgcgctgggcgtcacgacgacatccggtcccggggtggcgctgaagtcggagacgatcggtcttgcggtctccctggagctgccgctgctgatcatcgacatccagcggggtggaccgtcgaccgggctgccgaccaagaccgagcaggccgatctgctgcaggcgatgttcggcaggaacggtgaggccccggttccgatcgtggctccgcggactccggccgactgcttcgacgccgcgatcgacgcggcccggatcgccctgacctaccgcaccccggtcttcctgctctccgacggctatctcgccaacggctccgagccgtggcggatcccggagacggcgaccctgcccgacctgaagacccccttcgccacgggcccgaaccacacgctggcggacgggacggaggtgttctggccctacaagcgcgacccgcagactctggcccgcccgtgggcgatccccggcacggcaggcctggagcaccgtatcggcgggatcgagaagcaggacggcacgggcaacatctcctacgacccggccaaccacgacttcatggtccgcacccgccaggccaagatcgacggcatcgaggtccccgacatccaggtcgacgaccccgccggggcccgcaccctggtgctcggctggggatcgacgtacgggccgatcaccgcggcggtgcgccggctgcgggccgcgggggcgccgatcgcccaggcccacctgcgccacctcaaccccttcccgaagaacctcggcgaggtgctgaagcgctacgacaaggtcgtcgtcccggagatgaacctcggccagctcgccatgctgctcagggcgaagtatctggtggacgcccacagctacaaccaggtcaacggaatgccgttcaaggccgagcagctcgcgacggccctcaaggaggccatcgatgcctgacaccgacgaactgctccacaacgagctgctgcaactggtgcccaaggccgaggcgaagcagtccatgaaggacttcaagtccgaccaggaagtgcgctggtgccccggctgcggcgactacgccgtcctggccgccgtccagggcttcatgccggagctcggcctcgcgaaggagaacatcaccttcgtctccggcatcggctgctcctcccgcttcccgtactacatgaacacctacgggatgcactccatccacggccgcgccccctccatcgcgaccgggctcgccacctcgcggcgcgacctgtcggtctgggtcgtcaccggcgacggcgacgccctctccatcggcggcaaccacctcatccacgccctgcgccgcaacgtcaacctcaagatcctgctcttcaacaaccggatctacggactgacgaaaggccagtacagcccgacctccgagctgggcaagatcaccaagtcgacgccgatggggtcgctcgacgccccgttcaatccggtgtccctcgccatcggcgcggaggcgacgttcgtggcgcgcacggtcgactccgaccgcaagcacctcaccagcgtgctccgcgcggccgccgagcactcgggcacggcgctggtggagatctaccagaactgcaacatcttcaacgacggcgctttcgaggtcctcaaggacaaggagcaggccgccgaggccgtcatccgcctcgaacacggccggccgatcctcttcggctcccaggagcccaagggcgtcgtgcgcgatccggccaccggcgatctgaaggtcgtcgccgtcacggaggagaaccgctcgcaggtcctcgtccacgacgcccacgcggagtcgcccacgacggcgttcgcgctgtcccggatcgccgacgcggacaccctgcaccacacccccatcggggtactgcgcagcgtcgaacggcccgtctacgacacgctgatgtccgaccagctcgaagccgccgtcgaacagagcggcaagggcgacctcggctcgctcctcgccggcaacgacacctggaccgtcgtcggctgaggccgagcgaggaccgtacccgcaccgtccggggcccgggcccgatctcccacggagatcaggcccgggcctcgtcgtatgcctcgcgcgacgcctgcaccgcgtccacccggcgttcggtccaacgggcgagcgcccacacctgctcggcggcctcgatgccgagcggggtgagcgtgtaatccacccgcggcgggatcaccggcttcgcgtcccggtggacgaagccgtcgcgttccagcgtccggagggtctgggccagcatcttctcgctgaccccgcccaccgcgcggcgcagttcgctgaagcggtacgaacgctccagcagcgctgccagtacgaggacgccccagcggctcgtcacatgctccaggatcagccgggacgggcacatgggctggttgacatcccaggccaggagcgaagacagggccgaaccccgagccggggccgaagccgaggccggatcgaccttcggctccggcctgtccgctcccccggacgcgatcccgtccgcgctctctgaactcttcgcactctccgccatgccagtaccttacttcaaagtgggtactttcttatggttagcgctacccgtagggtcgtaaccgcaccacagaaacggaccgaaccaccgaaatcggagaccctcatgagcatcgttgtcaccggagccactggttccctcggccgcctcgtcgtcgacgccctgctgacctcggtcccggccgacgaggtcgtcgcggtcgtacgcgacaaggagaaggccgccgcgctcgccgcccggggcgtggagctgcgcatcgcggactacgaccgtcccgagaccctcgccggagccttccggtccggcgaccgggtgctgttgatctccggcagcgaggtgggcaagcgggtggcacagcacaccgcggtcgtcgacgcggcgaaggcggcgggcgtcgcacagctcgcgtacaccggcgtgctcggcgggccggacgcggacttcgcgctggccgacgagcacaaggccaccgagcagctgatcctcgactccgggctgccgtacacgttcctgcgcaacggctggtacaccgagaactacaccgccaacctggccccggtcctggagcaccgcgcggtgctcgccaacgcgggcgagggtcgcgtcgcctccgccacccgggccgactacgccgccgccgcggccgccgtactgaccggcgacggccacctgaacaccgcctacgagctgagcggcgacacggcctggtcgctcgccgagtacgccgcgctgctgtccgagctgaccggcgaggagatcacgtacaagaacgtcccggccgccgcgcaccaggaggtcctggtcggcgcgggactgcccgagggtttcgccgcgatcctcgtggacgtggacgaggcgatcgggcggggacggctcgcggggacgagcggcgacctcgcccggctcatcggccgcccgacgacacccctcgccgagaccgtgcgcgccgccctgtccgccgcctgagccgcgacgcgccccctgcctcaccccgtcgcgcggagccctgtcatgagtgtttccatgagacggctatgacacggagctcttccggcgctaccgtcgtgccgtcggcggctccgccgacgcgggcgggccgggagggcacatggaggggaagaacgaacagcgggcaggcctgctgtacggagtcggcgcgtacgggatgtggggtctggtcccgctgttctggccgctgctcaagccgtccggggcgatcgagatcctcgcgcaccggatggcctggtcgctcggtgtcgtcgctgtcgccctgctcgtcgtacgccgctgggcctggatcggcgaactggtccgcgaccggcgcaagctgggcctgatatcggtcgcggcggcgaccatcacggtcaactggggcctctacatctgggccgtgaacaacggccaagtcgtcgaagcgtcgctcggctacttcatcaacccactggtcaccatcgccatgggcgtcctgctgctgggcgaacggctgcggccggcccagtgggccgcggtcgccacgggcctggtcgccgtcctcgtcctggcgatcgggtacggcaagccgccgtgggtctcgctggtgctggcgttctccttcgccacgtacggcctggcgaagaagaaggtgaacatgggcggcctggagtccctggcc

SEQ ID NO: 3392 - DNA, 6456 bp, Unknown
  Kingdom: Bacteria, Phylum: Actinobacteria, Class: Actinobacteria, Order: Streptomycetales, Family: Streptomycetaceae, Genus: Streptomyces
agcgcggcgtctacatcccgcgccgtgacaccgcctcccgcctcaacgccttcgcgggcggccggatctacccgggcgagcacggccgcgcggacttcacggtgcgggaggacgccgacgccgtccgggtggccttcgcgacccgggacggcgaggtggaggtggacgccacggtccggctgccggacgggcggagcgtggtgcggctcgtggtcgcggacgacgggcgcggcgaggacggccgtccgacgacggtgacctggcaggcaccggtctgacccggggcgcccggcggggcggagctcgccgcctcgggtccgcccggctcggtgttcggggtccgcccggctcagtgtttcggggccgcacgcagggcgatccgggtgttggagtgggcgattcccgcctcgcgtttcagccggcgcagcaaggtgtcgagcgccccggggtcggcggcggtggcccgtacgaggtagtcgtggccgcccgtcacgtgcaccacctccgtgattccgggcagcatcagcaccgagcgctcgaactcctcgttcgtcgtgtcgaggcgcagggtcacatcgatgaagacgaccaggcccgaacgggtgtcggcggccgggtcgacgatgacggtgaagccccggatgaccccgtcacggcgcatccggcggacccggtcgcccgccgcgttggcgctgagccccacgcgtacgcccagatcccggtacgagatccgggcgtcctcctggagaatgccgaggatttccctgtccagccgatccataccgcgattgtcccagctcgtggcgatatcggctgagggaaggccgagggcgcccgctgtcccccggtcggcgcagcccggcgggccgtgcggtaggccgcgcccttgactggttggtgtggacacctccgtcaagcagtcccccgagccgcccgccgcggcggcggccgcaccgcccgcggccgcgtaccgcaatctcctcctggccacggtcggcttcgcgctgaccttctgggcatggaacctgatcgcgccgatgtccggggactacaaggaccggctggggctcagctcgttccagcagtccttcctggtggcggtgccggtgctcgtcgggtcgctcggccggatcccggtgggggcgctgacggacaggtacggcgcgaagctgatgttcccgctcgtgtcggcgctgacgatcgtgccggtgctgctgctgatcccggcgaagaactcctacggggcgatgctcgcggtcggcttcctgctgggactcggcgggacgacgttcgcgatcggcgttccgctggtcaactcgtggttcccgcccgccaaacggggtttcgccctgggtgtgttcgggatgggcatgggcggggtggcgctgtcgggctacttcaccccgcgcatcgcgaagcacggcgacaacctgccgttcctcgtggtcgcgggggcgctggtggtctacgcgctggcggcggccgtcctggtcagcgaccaccccggccggaagatcccgacggacacgctggcgcgccggctcggcgaggccgggaagctgcgggtgacctgggagctgtcggcgctgtacgcgatcggcttcggcggcatcgtggcgttcggggtctatctgccgacgtatctgaagacctggtacgagatgtcgccgaccgaggcgggcaccaaggccgccgggttcgccctggtcacggtcgtcttccggcccatcggcggctggctctcggaccgcgcccacccggcgctggtgacctcggcggccctgctgctggccgcgctgatggcgatcgtgcaggccttcgagccgccgctgtacccggtcggcacgatcgcgctgctggccatggcggccgggctcggcaccgcgagcggcagtgtgttcgccctggtctcgcaggtgaccccgcagccgaaggtgggcagtgtgacgggcatcgtcggagcgatgggcgggctgggcggtttcgttccgccgctggtgatgggcgcgatctacagcgccaaggacagttacgcgatcggcttcatgctgctgtccgatctggcgctggcggggtgtgtgtacgcgtacgggcggatgcggaccgtccagcgcgacgggtgaggtatccgcgcacggaggaacggccgcgctcccgccggaacgcggccgtccgtgtgatggtccggtgcggctacccgcgctgccggagctgctgttcgaaccggtccgcccagtacgcggtccggtcgaggtaggccgtctcggcggcctccccggtcctgccgtaggccccctcgaaggtctcgtagccgtggcccgggggcgggctggaggaggccggttcgatggagctgccctcgtgccactcgttgaacgaggtgacggagacccaggtggggtcgccgccgatggccgggtcgagggcgttgttccactccaggtcgtaggacgcgccgtcctcgcggcccagggtgggggtggtgttgccggggacggcccggtcgtcgaggtagccgggggcgaccgagggggcccacaccaggccgttggccttggcgtggtcgcccgcgttcttccagccgggtgcggtggccccggcgatcccgtcgtaggtgtagatcccgccgaagtggtccaccttgctggtgtcggtggtctgggcgaggacgatggcggtgtccttgacggcgtccagcgcggaccagtcctggatcctcaggctctcgaagatgtagtaggcgttgcggtcgccgttcgccgcgtcccggtagaacgcggggtggtcgccgaacttcccttccagataggcgatgtcgtcgacgacggactcggcggtgcggcccccgtagggctcgatgtgccaggcgacctcgatgccgtggcgggcggcggcgtccatgacgtctccggcgagggagtcctcgtaccctccttgcccccaccagctgtagacgatgacacccgcgccggagcgctggacccacttcatgtgctggtcgacggctccggcgatgtccccggagtcgtacgggccgagcttcgggtagaggtcggcgccgatggagtcgggcggggtgtggccgccctgctgccagtgccgccagttccccgagccgtcgggggtgccgtaccaggggtagtagaagaggtgcacgttggacgagccctcgtcctcggtggccggggcgcgggtcagggtgatgcggtcgacgtcgaagagtgcgcccgctcccccggtgaaccgcaggaacagcgggcccgtcccggcggtcagggtggtggtgacctcggtgaaggtctcccagccgccggtgggggcgacgtccgccgagccgaggagcggcccggcggcggagccggagcggacctctatcgtgccgcccgcgccggccgaggagacccgggcggtgaaggcggtggcaccggcggtgtcgagggagtagcccgcccagtcgccgtggtcgatgtacccgagggtggctcccccgcttgccggtccgtgggcggcgctctggacgccggaggaggaggtgtacgcctccgcctccgcgctgtcgccgcccgggtccgggccgcccgcaccgcagtcggcctcgacggctccggccgcgtaccgcacgccaccgaggagcagttggcggaagtcggggtcggcgaaggactcgatggtgtggccgagtccggtgtagaaggagcggccctcctgctgcgggtggcaccaggtgatggggtggtctccgcccatctcgccgccgctgtagctggattcgtccagggactggagtacgtggacgtcggagcgggggttggagcggtagttgtaccactcgtcggtccgcgtccaggtgtcgtccaggtgcgcggtcgccgggtggacgtggtcctcggtggtgaggcgggcctcctggatcgcgggatggctccggaaccaggcgccgacgaggtcctcgtactccggccagtcgtattcggtgtcggccgccgcgtgcacgccgacgaatccgccgccgccgtccacgtaccccttgagggcgctctgctgggtgtcgttcaggacgtcgccggtggtggagaggaagacgacggcctcgtagccggcgaggttcgcgggggtgaaggcggtcgcgtcctcggtcgcggtgacggtgaacccgttggccacgccgagctgttggagggcggtgatgcccgccggtatggagtcgtgccggaatccggcggtcttggagaagaccaggacctggtacgggtcggctgccgccgcgctctgtactccggggctcaggaaggccgccccgagcgtgaggaccacggcgcaggcgagtcggcggatgcgggatcgtctcatcggtggtccacctgcgctccctgcgtgtcgaacgtgaaggcgtccaggtcgaagaggctgccctggcccgtcggacccttgaagacgaagaacaactcggtggatttggtaggggcgttgttcacgtccgccgtgacgtccacgaagttctcccagccgccggtcggggcgacggcgagcgtggacagcagcgtgccggtggcggagcctgcccgcacctccagggtgccgcccgcgccgccggaggcgacccgtgcggtgatggaggtggcgttggacaggacgtacggcgtgaaggagacccagtcgccgttgtccgtgtagccgacggtcgcgccgccctcggcggggccgtgcggggcgacctggacgccgttgtgggcggcgaagtgctcgccctggcggtggcggggctggaggacggagtcgctgtgggtggtgagcccgcccgcgtcggtgtactcggcgtcgaagaccccgtagatgttggcggcggtgtcgtgctccccgtcgacggggacgtcgatggtgccggagcagccgttcttcgaggtgatctgatggcggtggctgtcgtggccgaggaggtaggtgaccttgaccttggagcagtcgatcgtgccgtcctcggggtcgctgacgctcacggtgaaggggacggagtcgccgaaggagaacagcgagccgtccgccggggtgttgagcgtgacggtcggagcactgttgcccgctgtcacgaccaggctcgcggtgccggtgagcccttcggggtcggtgacggtcagggtcggatcgaaggtgccggcggcggtgtaggtgtggctggggttcgggtcggtggaggtcgttccgtcgccgaagtcccaggcgtagctgaggtttccgccttcggggtcggtgctgcctgcggaggagaaggagaccgtgagcggggtgggtccggaggtccggtcggcggccgccttggcgaccggggagcggttgctgcccgcgaggtgttcgacgcggtagagggcctggttgttcgcgccggtgccgtagtcgaggacgtacagcgcgccgtcgggtccgaacgcggagtccatcacctgggtgccggtccacgggaaggtgtcgatggtcccgggtgatccgtcggccttcacctcgaccggcttgatccacttgcggccgtactcggtggcgaagaagcggccgtcgagggaggcggggaacttcacggcggagtcgaggccggcatcgaagttgtatacgggtccggccatcggggactcggagccgccgccgaactccggcggggagccggcgtcgccggcgtaccggatccaggcgggccgggacgggggcagggtggcgaggccggtgttgcggaaggagttgttggccgggccggaggcgcaggcgtacttcccgccggacggcccgctggggaaggtgtactcgccgtacgtctccgtgggcgtgttggtgccggtgcagtacggccagccgaagttgccgggctgggtgacgcggttgaactcgacctggccgctgggaccccgggccgggtcggtgccgccggcgtcgggtccgtagtcgccgatgtagacggctccggacttcttgtcgacggacatccggaacgggttgcggaagcccatcgcgtagatctcggggcgggtgttcgcggtgccgggggcgaagaggttgcccgccgggacggtgtagccgccgtcggccgtgggcttgatccgcagcagcttgccgcgcaggtcgttggtgttgccggaggaccgctgggcgtcgaactgcgggttgcggttcgtgcgttcgtcgatgggggcgtagccggccgactcgaaggggttggtgtcgtcgccggtggtgaggtagaggttcccggcggcgtcgaagtcgatgtcgccgccgacttcgaagcgtggaaagggcatctgaacctctcccgcttcgtcctcaaggccgacggcaccctcgacaccgccagcgagaaggtcgtcctggaagtcgcgagcgaccggggccagtgctgccacgtcggcggcgacatcgacttcgacgccgccgggaacctctacctcaccaccggcgacgacaccaacccct

SEQ ID NO: 3393 - DNA, 2795 bp, Unknown
  Kingdom: Bacteria, Phylum: Actinobacteria, Class: Actinobacteria, Order: Streptomycetales, Family: Streptomycetaceae, Genus: Streptomyces
tcgggacccagcccgcccaagcggcgactgtggacctcaacgcctcgtatgtgctggtccatcgcgacagcgccgcagcgctgacgccgcgacacgtgcccggctccggtgcggggccgtcgcggccggctcggcggaaggctgggcccgcccggtccacccgtgacgtcggcgctcgcgcggcgacggcgcgcgggggcggaggcaggcccgtctgccctcggagcccaagcgctttgcgccatgcggcgttgaagtggcgtgaacggatattgcccgtcccgccacgccatgcgcactgtggaagcgcgggagcgctcccacgctcgctctctcgaccctgtcggcttccccgccccccgctgaaggaagagaccatgaagattgattgtcatgtacgcaacacaggtgtccggcgcagtctgacgctcgtcctgagcaccgtcgcagcggtgcttctcagcatgaccacctggagcggcacagccatggctcacgggtcggtcgtcgaccctgcatcacgtgcctacggctgctggcagcgctggggcagcgatttccagaacccggccatggcacaacaggacccgatgtgctggcaggcgtggcaggccgacccgaacgccatgtggaactggaacggcctctaccgcaacggctccggaggcaacttccaggcggtcgtaccggacggccagctgtgcagcggcggccggaccgagggtggtcgctacaacgcgctggacaccgtgggcgcgtggaaggccgcgagcatcaccgatgacttcaccgtcgagctgtacgaccaggccagccacggcgcggactacttcaaggtctacgtcagccgacaaggcttcgaccccaccacccaggcgctgcgctggagcgacctcgaaccggtcgcgcagaccggaaggtacgggcccagtcagaactactcgatccccgtgagcacgtccggctacacgggtcgccatgtcgtctacacgatctggcaggcatcgcacatggaccagacgtacttcctgtgcagcgatgtgaacttcgactgacctcatcgctcaccgggtgatcccgccggactccacctgcccggcggggctcccgtgtcccgacgccccctcgtgtaccgacgccaccgccgtgcaggcgtcctcgattccggagccgacatgtcgcgacaccgctgggccgtgcagctcctgccgaccctcctgctgaccactctcaccgtatggcccgccgccgcccagtccctcgcggacacccctcccgctaaggcggccaccacaccggccgacgcggcgacgaactcctcctccgtccctcttccgtcgctccgcgcgaccaccacccaggtcgcttccggactgagacggccgaccgccgtcgtcgcacccgatgacggcactgatcgcttgttcatcaccgagaagtccggaaccgtacgtgcctaccacccccgtaccggcctggccccggagccgctggtcgacatcacgtcggccgtggacgagtcgggcaacgagcgtggcctgctcggcatcgccgttccgcccgacttcgacgacagccgcagtgtgtacctggcgtacacggctctgcccgacggtgcggtcaccgtcggccgctaccggctcgacgattcccgcctggaggttttgctctcccagccgcactccgagttcagcaaccacaatggtggacagctggcgttcggcccggacggtcacctgtactggagcatcggtgacggcggcggttccgcggaccccctccgcgccgggcagcgactggacaccctgctgggcaagatcgtgcgcatcgacgtgagccgcggttgcggccggctcccctactgcgtgcccgagggcaaccccttcgcggacacccccggcgctcgcgacgagatctggttgtacgggctgcgcaacccgtggcgattctccttcgacagcgtcgacgggtcgatgtggatcggcgacgtcggccagggccggtgggaggaggtcgatcacatcgggcccggacagggaggtctgaacctcggctggtcctgctacgagggactggagaagttcggcggcggcgactgcgacgccggcgaaacgtacaccgcgccggttttcacctactctccgtacaccggcggctgttcggtcatcggcggtcacgtctaccggggccagaagcacgcgggcatcgtcggcggcacgtacatcgccaccgactactgctcctccaccgtctgggcgctgcgccccgatggcgaaggcggctacgagcaggccgagataggggagatgcccacccaggtgacggcgatcggtacgacggtcgacggggagctctatgcggtcaacgacctgccaggcggcctgcaccgcgtgtccttcgccgaggaggaacccacctgccgagtgcggcccaccgtgcgggcgtggggcaccggtacgacggtcgacctgacggtcaccaacaccggcagcactccggtgaacggctggaggctgcagttcccgctggccctcgggcagaccgtcacctccgactggaacaccgacctcacccaggggagcaacacgatcacggccgccaacacgtcgcacaacgccacggtggctcccggcgcgagcgtcgtcctcggttatctcgcctcccataccggcgactcgtcgtcaccgccgcgcttcatgctcaacggggacgcctgcgcggtcgaccgacctcagccggaggcggtctggacgcggcgggcgtaggcgcgagcggcgcgtccagaccgcctccgg

SEQ ID NO: 3394 - DNA, 5816 bp, Unknown
  Kingdom: Bacteria, Phylum: Actinobacteria, Class: Actinobacteria, Order: Streptomycetales, Family: Streptomycetaceae, Genus: Streptomyces
gatcagggggcgtacgccccggcgttcacgcggtcggctccccgacggggagtacctcggcccggtgcgggacgtggtggcggccgatcgggagcatcaggggccggcccgacacggggtcctcgatgatgcggctgtcgaggtcgaacacggcccgtacggtctcctccgtcagcacctcggccggggtgccggacgcgtggaggccgccgtcggcgagggcgatcaggtggtccccgtaccgggcggcgaggttgaggtcgtgcagaaccatcacgatggtcgtgccgcgcgcgcggttcaggtcggtcaggaggtccaggacctcgatctggtggctggcgtcgaggaaggtggtcggctcgtcgagcaacagcagatccgtctgctgggcgagggccatcgcgatccagacgcgctggcgctggccgccggagagttcgtccaccgcccgctcggcgagcggttcggtgtgcgtggcctccagggcggcggccacggcggcgtcgtccttctcgttccagcgggagaagatcgactggtgggggtgacggccccggccgacgaggtcggcgacggtgatgccctcgggtgccacgggcgactgcggcagcagtccgagggtgcgggccaactccttggcgggcagccggtgcacctccttgccgtccaggacgacgcggccggcccggggggcgagcagccgggacatggaacgcagcagcgtcgacttgccgcaggcgttggcgccgacgatcacggtgatccggccgggcggtacggccaggtcgaggcagtcgacgacggtgcggtcgccgtagccgagggtgagtccttcggcggtcagtcggtggtgcgtggtcatagtgagcctcccgcccggttggtgcggatgatcaggtggacgaggtagggggctccgaggacgccggtgacgacgccgaccgggtagcgctcgccgaaggcgaactggccggtgaagtcggcgacgagcacgagcagcgagccgacgaggcctgcgggcaccagcagggagccgcccgctccggtgatccgggccgcgatgggcccggagaggaacgccacgaacgcgatggggccggccgccgccgtggcgaaggcgatcagcccgacggcggcgacgatcaccgtgatccgggtgcgttccacgcgtacgccgagggcggaggcggtgtcgtcgccgagttggagcgcggagaggtcgcgggcctggcccagcagcagcggggtgaggacggccgccgcgacgagcgcggggacgacctggtcccaggtggctccgttgaggctgccggtcagccagcgcatcgcctcctggaggtcccattcggcggcccgggacaggacgtaggaggtgatgctgtcgagcatcgcggagatcccgatgccgatcaggatgagccgggtgccgacgacgccgcccttgaaggccagggagtacaccagcagggcgacccctaggccggcggcgatggcgaggacggagacctggacctcgccgagcgacagggtcacgatggcgatggccgcggcggcgctcgcaccggagctgatgccgatgatgtcggggctggcgagcgggttgcggagcatcgtctgaaaggtgaccccggccaggccgaagctgaatccggccaccagggcgaggaccgcgcggggcagccgcagccgacccaccgtgaacgacgcgcccggcacctgctccccgaggaccacccggaacacgtcgccgggcgggtagaaggtccgtcccgccatcagcgtcacggcgaacgcggcgaggacgaggagcagcagcgtcaggacgacccggcggcggcgcgaggcgccgcgcacgcgacggcgggtggcggcctctacagacggccgccgggcgaggacgggggcgctcacagggcacgtaccttctgtcggcggacgatgtggatgaagaagggggccccgatcagcgcggtcacgatgccgacgtcgatctccgaggggcgtgccacgatccggccgacgacgtcggcggcggtgagcaggaccgcgcccagcaccgcggagagtggcaggagccagcggtggtcgacaccgacgagcagccggcaggtgtgcgggacgacgaggccgacgaagccgatcggcccggcgacggcggtggccgctccgcagagcagtacggcgccgagggcggccacggcccgtgccagggcgacacgttcaccgagtccggctgccaactcgtcccccagcgcgagcgagttgagggcgcgggccgagagcaggcagacggcgaagccgaccgcgaggaacggcatgacctggccgatgcgttcgaaggacgcgccgccgacgccgccgatctgccagagcttgaaacttccggcgatgtcgttgcgcggcaggatgatcgcgctgacgagcgaggcgaaggccgcggacgtggcggctccggcgagggccagcttgaggggggtggcccctcccctgccgagcgttcccacggtgtacacgaagagggcggagaaggccgcgcccacgatggcggtccagatgtatccggtcggcgaggtgaggccgaagaacgcgaccgccgtgacgacggcgagggacgctcccatgttgacgccgaggatgcccgggtcggccagggggttacgggtcaccccctgcatcacgccaccggcgaggccgagtgccgccccgatgacgacggcgaggacggtgcggggcatgcgcttggtcacggccgcctgccccagcgtgtcgtccgcgccgccgaacgccgcggcgacgtcggaccaggggacgtcgcgggagccgagggcgaccgacgcggccatgaccgcggccagaccgagtacggagaggaggacccacagcaggcgcacgcccgccggacgcccggtgacgacgtccggcggggtacgggtgtcgagctcggtcacttgaccttgtccgcggcctcggcgagcgcggcggcgtagtcgtccagcacgtagccgatcgacagcggcgtcgggttggcggcggtggccagcgggctggtgccgggcaggaggtagacggagccgcgctcgacggcggggatcttggagagcagcggatccttggagatcgtcttcagcagctcaccggtgtcgtcgccgtagccggtgatgatgtcgacgtcgtcgaacgcgtcgatctgctcggcgctcttggtgagggcgaacttcttcgtgccctcggatgccttcgcgacggacccggggatcttcatgccgaggtcctggaagaactgcgtgcgggtgtcgtgggcggtgtagaagccgacctgactgacgtcgttggggtcgacgtgcgtcatgaacatcgccgacttgcccttgagctgggggtacttggcggcggtcttggctatgtccccgtcgagcttcttgatcagcgtctcgccctcgtcggccagcccgatcgccttgctgttcgtccggatgatctcgcgccacggcgtcgcccaggcggcgtccgggtaggcgacgaccggggcgatctcgctgagggtctcgtagtccttcttggtgagacccgagtacgcggccaggatgacgtccggcttcgtgtccgccacggcctcgaagtcgatgccgtcggtctcgtcgaacaggaccggtgtcttcgccttcagctcgtcgagcttctcctcgacccagggcagcacgccgtcgtcgttgtcgtctccgaagttggccgcggccatgccgacgggcacgacgccgagcgcgagcggcacttcgtggttggcccagttgacggtcgcgacgcgcttcggcttcgccgggatgacggtctcgcccagggcgtgctcgacggtcagggggaacccgccggagcggctctcgtcgttcttgttcgcggcgtcggtggtcccgccgcaggcggagacgccgacgagggcggccgccacgacgagcaggcggaggcggtgtgaagacatgggtgtgtacccggctttccggatgtcgggggtgccgcttctcgcacgtccgggcgtgcgcagccgtcagggatcggtgcgcggcgcgtgcttcatcggcttaggtaaggcttgccttcgcactttatgtaaatcgacccactgtcgcaatcaaccgtttaggacatgtgctgtagcgatacggacacccggtccggcggtcattccggccggaaggtccccggggtgagtcccgtcgtacgccggaaggcggcgccgaacgcgctcgccgagcggtagccgacctgttcggccacggtctccacgtcccacccgcgggccagcaggccgatggcgtgctgggcgcggaccgccgccacccagcgcacgaagctcgtgcccgtctcggcggtgaacgcccgggtgaccgtgcgcgcgctgacaccgagggcggacgcccagtccgccagcgtccgccggtcggccggatcctcacggaccgcgtcggcgatcgggcgcagcaggtcggagaccgggatccgcacgagcagttcgcggggcgacggtacgaggacgtcgagcaccagcgcctcggtcgcggcccgcgaggcggccgcgaggccgggttcgccgagccgctccagcagcaggcgcaacagtggggtgatctcgacggcgaccggcgtggcggagatcgacgcggtggtgcggaagccgaagaagctcgcccggaaccaggttccggcggtcgccgatccggcgtgcagggtccccgccggcatccacaggcccagggccggggtgatcgtccagacccggctcccgaccaccgccgtggaggtgccgcgctcgttccagagcagctcgtggaaggggtgggagtgcgcgttccagagcgtgtcgtgggagacgacctcgtcgtagcccgcgatgacgaagggggtctccaccgaaccgggggcgaacgcgggcagcgtccgggtctccctggtcatgggaggtggacctcggtcgtacggtaaccgctcacggcggacggggcgcgcatccgcccagcctagaggccgggggcgcacagaaccaccgagcccctcccactgcctcaacttgacgtttatgcaggtcagttacgtccttcaggtgaaagacccccggctttcgccgcggacgccgctcctcggcggacagtgggtgggccgaccgggcaccgggccgcggtcggagggaacgtgacatgcggagaaaggtgacggattcatgggcattgaggccaccaggcgggtcacgctcgtcttctccctgttcgacgccaacgccaacggcgtcctggaggcggacgacttcgacctcatggccgagcgggtcgtccgggaggcgcacgcgtcggaccgggcggcgaaggacgcgatgcgtgcggcgttccggcggtactggacgactctgcgcaccgagctggacgccgatggcgacggcgagatcagcttcgaggagttcaccgcctgcgtgctgtcaccggagcggttcgacgcgaccgtcggggtgttcgccgaggcgctggccgcgctcggcgacccggacggcgacggtctgatcgagcgcccgctgttcatggcgctgatgacggccatcgggttcgagcccgccaacatcgacgcgctcttcgacgccttcgagccgaacgacggagaccggatccgggtggagacgtgggtcgccgggatcaaggactactacgcgccgggcaaggccggcatcccgggcgaccatctggtcgtcggaaccgccgcgtgaccgggcgcgcacccatacggccgggacggtggaggctctcccgggcttccaccgtcccggccgtatg

SEQ ID NO: 3395 - DNA, 2343 bp, Unknown
  Kingdom: Bacteria, Phylum: Actinobacteria, Class: Actinobacteria, Order: Streptomycetales, Family: Streptomycetaceae, Genus: Streptomyces
gccgcagccgacgtcgagcacccggccgcggagcgcgccctcctcggcgaggcgtacgaggaccgtctgcggccgctggatctcccagccggcgcccggctcgccggcgtagtgacgctcgaagacctcgacaccgctgtcggcacgtgcgccgactccggcgatccggtccgacggctcgctcatggtcttccccccggaatgtgcggtcgatccgccgatggccccgggaagggccgtcggcattctccgcggaaagctagcccacccctggggcctgcgggatcgaagtgatgggggctgtgacacatatcaggaacctgcctccgcgccttgctgtcgcggcgcggatctgtcagggcgacgcggggggagggagtttccccggttccttgtcaccgcgccggggtggttcccctcatgcgcggaccccgatgaacagccccctgccgttcggccagtcgggcaggaactccgcctcacatcccgcctgcctgaaggcgtccaggtattcctcatgggtgaacagcgagtacgtctcgtattcggtgaattcacggattccggtggtttccgcgacggtgtagcgcaccgtcatccggctgatgcgtccgtcccggacggagtgcgacagccggctgacggcccggccctcctcctgggcgagggaggccgatatgaacccttcgacgaactgctccggaaaccaccagggttcggcgacgagcaccccgccgggcgccagatgacgtaccagggtcgccgcgctccgacgcagttcctcgacggtgctcatgtatcccagggagaagcacatgcagagcaccgcgtcgaaggtccggccgagctcgaactgccgcatgtccccctcgtgcacctgggccgccgggactctcctcgtggccgtcctccgcatctcgggggagagctcgacgccggccacggtgccgaaatgttcggcgaaccgctccagatgcgcaccggtgccgcaagcgacatcgagcagcgaatccgcttcgggacaacgttcccggatcagccgggtgatgccgtccgcctcggccgaccagtcccggccccgggccgtgtggatgaaatcgtagatctcggcgtgctccgtgctgtacaccgtcgaagggcgctgcggcgtaaccatcttgatgctccgtccattgcgtggagacctcggcgaactgtccgcgggagccaaggttctatcatcccggcggcccggcccggagggtgccgacaccgcccggtacggccgcttctgcgggccttcggccgttcaccgtgcgcggaccgcgccgcggcggacggttcggcggcacatgacagatgtcaggttccgcccactgctcgttgtccgcggcccggcgcggcggcattgtgagctctgccgggctgcgtcacaccacgtcagacggccgccatctcccgcaacgccttccgatcatgaacgggtacgcagcgtgatcacagacacagcagccgccggtccggacatgtccgaggcggcgggcgtacggctgtactcccgggtgcccatcacgcctcgctggctggcgcagagcgtgctgccggtcagccgccgcctccgcgaggaccaccgggccgcccttctccacctgcgacggggctggctgcacggtccgcacatcgacatcgtcgcccggagcgtgcccggccggccggcgctcgactgggcggggatcgccgccgccctcgacgccggtcccgccgagggcccggccgtgacggacgaggagacctatctcacccaggcccgtgagatgggccggctggaaggcgtcgcaccgccctacctgccgatgcgtgagcacggtgccacagaggcgctgagcctctcgtcggtcgagacctggccgcagccgctccaggatctgcgggaactggccctggaccaactggacaggccgctgaccaccacggtcgagcagctggcccgggagccgcgcgaggcgccggtgcgcgtcatggaggcgttcaccgcgctggccgcggcgcaccagcacggagccgggaacggggcgttctcgatgcgttcgcacgccgaggcgttcttcgcctgggcggccgcccgcaaggacccccgtcccgccttcgcccagcggctcgccgccgacgccccccgcctgcggcccgtcgtggagcgggcgctctccggcaggcccgaccacgggacggcggcctgggcccgcgccttcgcctattccatgggggccttcgacgccacggtcgcccagggaaggctgaccctggacgacgtcgacggcctcggcgccgggttcgacctggccaccatgggcccgccccgccggg

SEQ ID NO: 3396 - DNA, 1828 bp, Unknown
  Kingdom: Bacteria, Phylum: Actinobacteria, Class: Actinobacteria, Order: Streptomycetales, Family: Streptomycetaceae, Genus: Streptomyces
gggcggccacgccgacccgacgtccgtcatgccgccagtgccgcagcgccccgacgggccgccgcagccggacggcccgcacccctggcagtcgcagctccaggcggcccgcgaccgcaacgagcagacccaggtccagtacctcgacccgagccaggacccgctgcgccgccgcccccagcgccagcagccgccacagcagcaccaacagcagcagccgccccagcgccgccagccgcctccgcagcaccagcagtacccgccgcaacatcagcagcagccacagccgcagcgctaccagcagccgcagcagccccagaggcagcagtacgcgcccccgcagccgcagcagccggcgccccgcccgccgcgcgagccgcgtccgccgaggcagcgcggcgccaacccgatgcgcatccccggactcggctgcctcaagggctgcctgttcaccgtggtgctcctgatcgtcgccggctggctcatctgggagctgaccccgctccaggactgggtcgcccagggcaagggctactgggaagcgatcggcgacgcgatcggcaccgtcaccgactggatctccaaggtcggcgacagcacaggcagttcgggcggggcctgacccgtaacggtcgagcggcgtccgacccgtaattctgtccctttgtcgacttctccgggcctattcggcccggagaagtgaaggtcggtgccatccagggcacgtgacaccccgaacgccgcgtaactttgtcgaccgggggtccaccgccagccgctgagggagcagtcttggcacggaatatcggcagccggtacacggcccaccagatcctggggcgcggcagcgccggcacggtatggctcggcgaagggcccgacggcccggtcgccatcaagctgctccgtgaggacctcgcgtccgaccaggagctcgtgggccgcttcgtgcaggagcgcaccgccctgctcggactcgaccacccgcacgtggtcgccgtccgggacctcgtcgtggacggcaacgacctggccctggtcatgacgctcgtacgcggcaccgacctgcgcacccgcctggatcgcgaacgccgcctcgcccccgaggccgccgtcgcgatcatcgcggacgtcgccgacggcttggccgccgcgcacaaggcccaggtcgtccaccgggacgtcaagccggagaacatcctgctcgacatggagggcccgctcggccccggcggcgcgcaccccgccctgctcaccgacttcggcgtcgccaagctgatcgacaccccgcgccgcaccaaggccacgaagatcatcggtacgccggactacctggcccccgagatcgtcgagggcctcccgccgcgcgccgccgtcgacatctacgccctggcgaccgtgctctacgagctgctcgccggattcacgcccttcggcggcggccaccccggcgcggtcctgcgccggcacgtcaccgagaccgtcgtcccgctccccggcatccccgaggagctctggcagctcctcgtccagtgcctggccaaggctcccgcctcccggctgcgcgcctcggagctcgccgtacggctgcgcgatctgttgcccctgctggcggggatacccccgctggaggtggacgagccgggcccggaggagagcgaccaggagtccgccgcctacgacgagcagcagtacaccccggccgccgaggagccgcgccgccgcggggcggtcccgctggtgcccggatccgctcccgactccaaccgggacacccacacgagcatgcgcgtccccgccccggacgagctggcgggcggccctctcg

SEQ ID NO: 3397 - DNA, 8511 bp, Unknown
  Kingdom: Bacteria, Phylum: Actinobacteria, Class: Actinobacteria, Order: Streptomycetales, Family: Streptomycetaceae, Genus: Streptomyces
ccccgaaccgccgccccagtcaccggatatccgcccgatcgcggggaagcgggcggtccgcccgtcgggggtcatgccgacgcagttgatcccggccccgcacaccaccgcgacgccccggggctcgtccaccccggcgcgcaggatcgcgaaggtgtcgttgcgcacctccaccgaggagccccagccgcgggcctccagggccccggccaactcggcctcctccaccggcagatcggcgttggccagacaggcggacacatggccggaccaggtgggcggagccggcagctccgcggccgcccgctccagcgcggcggccagcatgtcgatcgcggcctccaccccgaccacgggcggctggaagccgccgccgcgcgccgtggacagcaccgtgccgtcctcgccgatcagtgccacgtcggtcttgctgttgcccgcgtcgatggcgacgaccgacacgttcacgcccacgcgaggtgctcccggttgtgcgcgatcagccggtcggtgaggccctcggcgtactcgtactggccgatcagcgggtgggcgaggagcgccttgaagacccggtcccggccgccgcgcagcgcggcttccagggcgaggtcctcgtacgccgtcacgttggcgatcagaccggcgtacagcgggtccagcgccgggacggccaacggcgtcgcgccgtcgtgcccgacccgggcctggacctcgatcaccgcgtcgtccgggaggaacggcagggtcccattgttgtacgtgttgaccacctggaccggggagccgccgttgcccagcagggaggccgccaggtccacggccgcctcggagtagaacgcgccgccgcgcttggcgagcagctcgggcttctcgtccagcgtggggtcgccgtacatcgcgagcagctccttctccatcgccgcgacctcggcggcccgggacggcttggtgccgagctccctgaccacctcgtcgtgggcgtagaagtagcgcaggtagtaggaggggacgacgccgagccggtcgacgaggcgtcggtccatgcggaggtcgtcggcgatggcgtcgccgtgctcggcgagcagcttcggcaggacgttctcgccgtccgggccgcccaggcggacgcccagctcccaggtcaggtggttgagcccgacgtggtcgaggtgcacctcggaggggttcacgtccagcagccgggcgaacttccgctggaagccgatcgccacgttgcacaggccgacggccttgtgcccggcctggagcagggcgcgggtgacgatgccgaccgggttggtgaagtcgatgatccaggcgtccgggttggcgcggcggacccgctcggcgatgtccaggacgaccggcacggtgcgcagcgccttggcgaggccgccggcgccggtggtctcctggccgacgcagccgcactccagcggccaggtctcgtccttgttgcgcgcggcctgtccgccgacgcgcagctggagcaggaccgcgtcggcgtccgcgacgcccgcgtcgatgtcggtggtggtcgtgatcctcccggcgtggtcctgcttggcgaagatgcgccgggcgagacctcccaccaggtccaggcggtcggccgccggatcgacgagcaccagctcctcgatcggcagcgtgtcccgcagccgggcgaatccgtcgatcagttcgggggtgtaggtggacccgccacccactactgcgagcttcatgtcagccctttactccggtcagtgtgacgccctcgacgaatgccttctgggcaaagaagaagacggcgatcacgggggccatgaccagaacggtcgcggccatggtcaggttccagtcggtgtggtgtgcgcccttgaaggattcgaggccgtaactgagcgtccaggcggccgggttctcggaggcgtagatctgaggtccgaagtagtcgttccaggcggcgaagaactggaagagggcgatggccgcgatgccgggcttggccatcggcaggacgaccttcatcagcgtgcggaactcaccgcagccgtcgaccttggcggcgtccaggtactcgttggggatggtcagcaggaactgccgcagcaggaagatggagaacgcgtcgccgaaggccatcgggatgatcagtggccacagcgtgccggacaggtccatctgcttcgcccagaacaggtacatcgggatgatgacgacctgcggcggcagcatcatcatcgagatgacgagcatcagcgacagcttgcggccccggaagcggaacttcgccagcgcgtacgccaccgggacggacgagacgacggtgaggacggtgccgacgcccgcgtacagcagggtgttgcgccaccaggtcagaaagcccggggtgttgaagacccgctcgtagttgccccattcccaggtgttcggggtgaggtcgcgggtcagcgcctgctggtcgctcatcagcgaggtcagcaccacgaagacgaacggcagcacgaagaagagcgcggcggcgatcccgagcgagtgcacggcgatccagtgcagcagcgccttgcggcgggcggtgcgcgcggcgggggtccgcggtgagttcttcggggaggcggcggcggtcttttcgaggagttgggtcatggctcagtcaccggcctggatcaggttgttgcggccccgcatcagcagcgcggtgaaggccatggccagggcgaacagaacgagggcgacgacacaggcggcgccgtagtcgaagcgctggaagcccaggttgtagacgagctgcgggagcgtcagtgtcgacttgtcgggatagccgggttcgaaggactggccggagccgccgatgacccccgaggcgacctttccggcgacgagtggctgcgtgtagtactgcatcgcctggatgacgcccgtcaccacggcgaacagcacgatcggtgagatgttcggcagcgtcacgaagcggaacttctgccaggcggacgcgccgtccagctcggccgcctcgtactgctcggtcggcacgtccagcagcgaggccatgaagatgaccatcaggtccccgatgccccacaccgcgagcatggtgagcgccggcttggaccaggaggcgtcgttgaaccagcccggcgtcggcagtcccaggtccccgaggatcgcgttgaccggcccggtgccggggttgagcaggaagacgaaggcgagcgtcgcggcgaccggcggggccaggtagggcaggtagaacagcgtccggaagaccccggtccccgtcttgatcctggtgatcagcatcccgatgccgaggccgaagacgacccggcaggtgaccatgacgaggaccagccacagcgtgttgcgcagcgacggccagaacatcgggtagtcgctgaacacgtacgtccagttggtcagcccgttgaagaccggcgctccgaagccgtcgtactgggtgaaagagaagtagacggtcgagaccatcgggtagacgaagaagaccgagaacccgatcagccacggcgacatgaaggccgccgtgcgcagcgccgacctgcggcgcttcgagcggagtgtgtgcgtcgtcatcgggggctacttggccttggcgatgtcggtgtccatctgcttcgcggtcttctccagaccggccttcaggtccttcaccgcgcccttctcgtactggtagccgaagtcctggatcgtctgctggtacgtggagccgttgacggccccgtcgggggtgttggacttcgggtgctgcgcgatgtccaggaaggtcttgaaacgcgggtcgaacttcaggtcgggggacttcagcgccgcgaaggtggagggcacgttgcggatgccgttggcgaagtccacgaccgcgtcggtgtcgctggtcatgaacttgaccagctcccacgcggcgttctgcttcttgctggccggggcgatgcccacgatggtgccggagaggaaccccttgccgtagctgtccgcctcgtcgtcggcgacgggcatcggcgcgacgccgatctcgaagccgggcttggtgtcctcggccatcccgagccgccactcgccgtccagctgcatggccacctgcccggtgtggaacgggtgcttggccccccactcgtcaccgaaggtgccgcggtacttctccagcttgtcgtagccgccgaggtcctcgacgagcttcttctggtacgtgaacatctccgcgaacgccgggtccttggcgatgttggacttgccgttctcgtcgaagtacttgtggtcccacgaggacaggtagtggtcggcgacggtctcgtagccgtggaaggtcggcatgaagccgagctgctcgtagctgtcgcccttctcgaccgtcagcttcttggcgacgctcgccagctccgacatggtcttcggcggcgcggtgatcccggccttctcgaaggcgtccttgttgtagtagaggccgtaggcatcggtgagcagcggcagggcgcaccgcttgccctcgaactgggtgtagtcgaggaggaccttcgggaaggtcttctccaggtcgagcttcgacttctcgatgaacggcttcaggtccgcgaacgcgccggacgagcagaacttgccgacgttggcggtggtgaaggacgagaccacgtcgggcccgttcgaaccgcccgcgcgcagcgcctggttgagcttgtcgtcgttgatgttgccggagaccttcaccgtgatgttcgggtgggccttctcgaaccggtcgatgttgtccttgaccgccttcacctcggcgggcgcgctccagccgtgccagaagttgatcgtggtcttcgcgttcgggtcgtcggaggcgccggcctcggactggcccgtacacgcggtggcgagcaccgatatcgcggcgacggcgacagcggtggtggtgagacggcttgtgcgcatgacaaaactcccagggacggggaagaggcagacggcggggaacggggggaggagcgtggttcagcgcgaggtgtcgaacacttcgtcgcgggtgtcggcgagcgccctctccagggcgccgcgcagtacgggggtgcggtcgatctcgccgaccacgagccgcggccgggaggcggcgagctcggccagctcggactggatcagggagcgcaggacctcgccgcccgccgcgaccgcctggccggagagcacgatcagcccggggtccaggacggcggtgacggaggcgagaccggtggcgagccgctgggcgtactggcgcagcagctcggtgagcgcctcgtcccgctcgtacgcgtcggccgcccgtgccagcagttcggcggcgaccttcgcgtacggctgctgcggggtgtcgacacccagggccttcgcgagccggggcaccgcctgtgcgcccgccagctcctggaagccgccgctgttggccttgacgacctggcgcacgagcggggtgcccggcaccggcaggaagccgacctctcccgcaccgccggtgaagccgcggtgcagccggccgttgatgacgagggcggcgccgaggccctcctcgttccagagcaggacgaagtcctcgtggccgcgggccgcgccgagacgctgctcggcgacggcgaccagattgacgtcgttctcgtactccaccggcatcggcaggaacgcggccagctcgtccagcagggtgggggagtgccagccgggcaggtgcgaggcgtaccgcagccgtccggtgcccggatcgaaggcgcccggcgtgccgatgacgagccggtggacgtcggcgcgggtgagcccggcgtccttcaccgctccgtccagcgcgtcggcgacctggcgcaccacactgtcggcgcgccggcccggggtcgccagctcgaactccccgacggtccgaccggtcacgtccgcgacggcggcgacgatgcgccgcccgttcacgtcgagcccggccacatgggcggcccgcgcgttcaccgtgtagagctgtgcgttgggcccgggacgcccctcgctggtcccggtcgcgacgaccagaccggccgcctccagccgggccaggagctgggacgcggtgggcttggagaggccggtcagcttcccgatccgggtccgggagagcggcccgtgctccagcagcagatcgagggcggcccggtcgttcatggcccgcagcacccgtggtgtgcccggtgtgccgggtgcgccgggagtggttcccgccatcgtggatgcaccgccctctgtcaggacctccggagcagctccggagaaactctgttaggaaagtttcctattcggttgagaggacggtagggcgcaggtcaccgcaccgtcaatgggtggcccccgtccggcaatcaaagtgttacctgacacggcgacgcccccggtcgccgtcctgggtccaggaagcggccgggggcgctgcggaaggagctacttggtcaggttcgccggcggtatcggggtcgccgccagcgactgcggggaggtcgccgaggcgtacgccgacggggccgccatcgcggccgtcgggtcggccgtggactcgccctccgcctggagcggcaccgtgccgaccatccggatgccggcgtcgtccagcgcctgcttgatgcgccagcgcagctcgcgctccacgccgagcgccttgcccggcatcgtcttcgcggtcacccggaccgtcatggagtccagcaggaccgcgtccaggccgagcacctcgaccggtccccagagccgctccgaccagggctcttccttcgtcatcgtggcggcggcagcggcgatcgcctcgcggacgtgctccagcttctccgtcgggcgcaccgtgacgtcgacccccgctgtggaccagccctggctgaggttgccaatccgcttcacctcgccgttgcggacgtaccagatctcgccgttgtcgccgcgcagcttggtgacgcgcagccccacctcgatgacctcgccggaggccaccccggcgtcgatggtgtccccgaccccgtactggtcctccaggatcatgaagacgccggagaggaagtccgtgaccaggttgcgggcgccgaatccgagcgccacacccgcgacaccggcggaggcgagcaggggtgccagattgatcttgaaggcgcccaggaccatcagggcggccgttcccatgatcacgaacgaggccaccgagcggagcaccgagccgatcgcctccgagcgctgacgtctgcgctcggcgttcaccagcagaccgcccagcgccgtgccctccaccgcctgggcgctgcggttcatccgctcgatcagattggtcagggcgcgccggatcagataacgcagcgtgatcgcgactgccacgatcagcaggatgcgcaacccggtgctcagccaggtggaccagttctcctcgacccagcccgcggcgttcccggcctgttcggcggcttcgcccagcgagccgcccggctcgggaggcggggcggcggccaagagggcggacagcgacacgacagggacctccagggggacgacggctggtcaacaacactaacgaagccgggggagtggatcgttgccgtcgcgggaggagagacgggtctcaccgggaacacctccgctgtggcccatcgcacagtgcggacggccgcgcaggtgacacacctgttcggcaccgaggcgcggcgtgcggagcccggagtgagaaaaatcctcccggcccgttacccgtacgtggtggcgctttgaccaggcctgaggagagactgagatcggatcgtcccggcgcgagccacgcgccgccggcgtacaaggaggcatccaccgtgccgcacgtcctggttctcaacgcgtcgtacgagccgctcggcgtcgtaccgctccgccgcgcgctcgtcctcgtcctggagaacaaggccatctgccttgaagagtccggcaccttcctgcacagtgccacccgtgccgtgcccgcacccagtgtggtccggctcaagcgcttcgtccgcgtcccctaccggggccccgtcccgctgacgcggcgggcgctgttcgcccgcgacggcgggcgctgcatgtactgcggggccgccgcgaccagcgtcgaccacgtcatcccgcgcagccgcggcggacagcacgcctgggacaacgtggtggcggcctgccgccgctgcaaccacgtcaaggccgaccgccatctgcccgagctcggctggcggctgcgccaccagcccgccccaccgaccggcctggcctggcggatcatcgggaccggacaccgcgacccgcgctggctgccgtatctgcaaccgttcggcgcggacgacgtgatggcccggatcgacggcgtgtccgcctaggtcgtgtccggaaagtctcgtccggcccgcgacagagggcggacgacgatactttgcggacactccccagggtccgccgctctcccgggcctgccgtacggctcagtcgtccgcgaccgcgtacgcctccaccgaccagagcgagtagccgtactccgtcgcccggcgctcgccctgcacc

SEQ ID NO: 3398 - DNA, 1103 bp, Unknown
  Kingdom: Bacteria, Phylum: Actinobacteria, Class: Actinobacteria, Order: Streptomycetales, Family: Streptomycetaceae, Genus: Streptomyces
ggggcgcaggtacccgagctgtccgggcagttccccgaggcgggggaggggggccaggagccccgtcaggaggcggtgggcgcggacggttccccggccggcggctgggagcggcggatcgcgggcggactcgcgttccttcggcggcgggtcaccggtgattacgacgtcgacgagttcggttatgacgaggagctcaccgaccaggtcctgatgtcgttgctgcggccgctggcggacaagtacttccgggtcgaggtgaagggcatcgagaacatcccgtcggacggcggggcgctcatcgtggccaaccactccgggacgctgccgctggacgggctgatgcttcaggtcgcggtgcacgacaaccatccggcggaccgtcatctgcggctgctcgccgccgatctggtcttccatctgccggtcgtcaacgagctggcgcgcaaggcggggcacacgctggcctgtgcggaggacgcgcagcggctgctggagatgggcgagatcgtcggggtgatgccggaggggttcaagggcatcggcaagccgttcggcgagcgttacaagcttcagcgtttcggccggggcggattcgtgtcgacggcgctgcgggcgggggcgccgatcgtgccgtgctcgatcgtgggtgcggaggagatctacccgatgatcgggaacgcggagaccctggcccggctgctgggcttcccgtacttcccgatcacgccgaccttcccgtggctggggccgctgggtgcgttgccgctgccgacgaagtggacgatccagttcggtgagccgattccgacggacgggtatccgccggaggcggcggaggacccgatgctgatgttcaacctgacggaccaggtgcgcgagcagatccagcacacgctgtacaagctgctggtgcagcggcggtcggtgttcttctgacctgctgagccacgacgagaaagggggccggtacgcggatcgcgtaccggccccctttctttcgtgcgcgccgggcctgtcgttctacggcttgaggttctcgccgtcgatgccgaggccggggaggagacccgggaggagcgggggcagggtgacgtccgggg

SEQ ID NO: 3399 - DNA, 4090 bp, Unknown
  Kingdom: Bacteria, Phylum: Actinobacteria, Class: Actinobacteria, Order: Streptomycetales, Family: Streptomycetaceae, Genus: Streptomyces
cacgacgtgctcggcgcgcacccgatccccggcggggtgctggtgcgggcgctgcggccgttcgcgcggtccgtcacggtgctggcgaccgggctgcgggccgagctgcacgacgacggcgacggcttcttctccggtgtgctgccggtgccggagatccccgcgtaccggctcgaagtggcgtacgacgacaacaccatcgaggtggatgacccgtaccgcttctggcccgcgatcggcgaactcgatctgcacctgatcggcgagggccgccacgaggagctgtggcgggcgctcggcgcggagccgatggagcaccagggggtcgccgggacccggttcaccctctgggctccgaacgcgcgcggtgtgcggatcaccggcgacttcaactactgggacggcaccggcttcccgatgcgttcgctcggctcgaccggggtgtgggagctgttcctgcccggggtcggcgagggcacgctgtacaagttcgacatctgccgcccggacggttcgcacacggtgcgggcggacccgatggcccggcgcaccgaggtgccgcccgcgaccgcctcgatcgtcaccgctccgcaccacgagtggcaggacgcggactggatggcccaccggggcgaccggcctgtccacgaggccccgttctccgtgtacgaggtccatctcggctcctggcgacccggattgacgtaccgtcaactcgccgaacagctcccggcgtacgtcaaggacctgggcttcacgcacgtggagctgatgccggtctccgagcatcccttcggcggctcctggggctatcaggtcaccgggttctacgcgccgacctcgcggatggggaccccggacgacttccgcttcctggtggacgccctgcaccgggccggcatcggcgtgatcatggactgggttccggcgcacttcccgcgcgacgactgggcgctggccgagttcgacggacgcccgctgtacgagcactccgacccgcagcgcgcggcgcacccggactgggggacgctggagttcgactacggccgcacggaggtccgcaacttcctggtcgccaacgccacgtactggtgcgaggagttccacatcgacggcctccgggtcgacgcggtggcctcgatgctctacctcgactactcgcgcgaggacggccagtggtcgcccaacgagttcggcggccgggagaacctggacgcggtcgccttcctccaggagatgaacgcgacggtctaccgccgcaaccccggtgtcgtcaccatcgccgaggagtccaccgcctgggacggtgtcacccggcccaccgacggcgggggcctgggcttcgggctgaagtggaacatgggctggatgcacgactcgctccagtacatcgccaaggagccgatccaccgcaagtaccaccacaacgagatgacgttctcgatggtgtacgcgtacagcgagaactacgtgctgccgatctcgcacgacgaggtggtgcacggcaagcaggcactggtgaccaagatgccgggcgactggtggcagcagcgcgccaaccaccgcgcctacctgggcttcatgtgggcccacccgggcaagcaactccttttcatgggacaggagttcgctcagggggcggagtggtccgagggacacggtccggactggtggctgctggatccgtcctacggggcctccggcgaccaccgcggggtgcggaccctggtcggcgacctgaacgcggtgtacggggcggtgcccgcgctgtggcagcgcgacaccgttccggaggggttcagctgggtggacggcggcgcggccgaggacaacgtgttcgcgttcctgcggtacgacgcggacggctccccgctgctcgcggtctcccacttctccccggcggtccggagcgactaccgcctcggggtgccggagaccggcacggagggctgggtggaggtcctgaacaccgacgccgcccgctacggcggcggcgacgtgcgcaacgaggagccgctgaaggcggaggcggtacccgcgcacggccgcccgtgcagcatctcgctgacgctgccgccgctggcgacggtgtggttccgcccggcgtagcccgcccggagtgaacggcccaggggcccgtaccgcgtcgacgacgacgtggcgcgggcccctccccgtcgccggcgggtcagtgaccgggggccatcacctcgacgatgctcgaccaggagtcggggccgtggcccttggcgatcgcccggtcggtgacgcccttgagcgcggcgagctgcgagacgtccaggccgcggtccttcgcggtgtgcaggatgtggtcgacgctggccgccatcatggcgaggttggcgccctcgcccgtgtacgtacgcgtgtcgatgtcctccgccgtgtacgcggcgatcggcggcaggatccccgcgatcgtgttgaggtacggggccagcgacgcgccgtcgatgccctccgcacgggccagcgcgaaggcgtggacgaggccgcccatggccccgtagaagaagtccagcatcgccatgtcgtaggcggcggcgagcccgtggtcctcgccgaggaaggtggcgggttcgccgagcgccttgagggtggactcgtgcacctcgaaagcggtccggtcgccggagtggaacaccagcgcctccgccgagccgaccacaccggccggcaccatgatcgctccgtcgagataggccagggagtgcttctcggcccaagcggcggtctgccgcgaacgggcgggggtgtccgaggtgaggttgaccaggacgcgcccctccagtgcaccggccagcggttccaggaccgcgtcggaggcgtcgtagtcgacgaggcagaccacgacgagtccgctcgcccgtacggcctcctccgcggagacggcccgcaccgcaccccggtccacgaggtcctcgccctttccgggggaacggttccagacggtggtggggtggccggcggccaggaaggcgccggccagggcgcggcccatgtcgccgaggccgaggacggtgacgggggtgggttcggtggtcgtgttcgcttgcgtcatgaggaccatgctgggcgggcggacagggtctgaccagaacccacttgactgtcagatacgcacttccgggaaagcatccaggccggtgcggtccaggccggtggggtcgaccggggcgaggacgtcctccagctcctggagaagcctccgcttcggccgggcgccgacgatcgacttcaccggctcgcccgcccggaagaccatcagggtcggtgtcgccagtacgccgtaccgtacggagatcgcggtttcgcggtcgacgtcgagctggacgatcctgatccggtcggcctcctcacgggcgatctcccgcagcaccggggccagttggcgacaggggccgcaccagtcggcggtgaactggaccagcacgggccgtgcggattccagcacctccgccgcgaaggtctcctcggtgacgtcggtgacgccttcggtccggatcatgggtgtcctcccagttcgcagcggggcgccggtccaccgggcaggtcggccgacgcctccagttcggctcgggcgagctgtgcgccgacctcggcgcgcaccgacgtgagctggccgatcagcgcgtccagctcgtcgagcttgcgccggtagacggcgagcgaggcgggacaggagtccccggccgggtggccggcgcgcaggcagtcgacgaagggcctggtctcctccaggtcgaacccgaagtcctgaagggttcggatctgctggaggaggcgcaggtcgccctcgtcgtagctgcggtagccgttctccgcgcgtcgcgcgggcagcagcccgcgcgactcgtagtagcggagcgtccgcgtcgtcgtcccgccccgttcggccagcttcccgattcgcatgggacgaacgtattccttgacgccgacgtcaacgcaagggcgtcggcgtcgggtcaggttgtcggcgtcgggccggagcgtctgcgtcgggccgggccggggaccgcgcggtcagttggcgcgggccgtcgaccgtcggcgtacggcccagatg

SEQ ID NO: 3400 - DNA, 3915 bp, Unknown
  Kingdom: Bacteria, Phylum: Actinobacteria, Class: Actinobacteria, Order: Streptomycetales, Family: Streptomycetaceae, Genus: Streptomyces
ctcgcgcggcaggttgcgcatcagcagccagtagccggctccggcgaccgtgccgatcacggcgcaggcggcccagagccaggcggcgccgtagttgtcgatcacgaagccggacatcaggggcgcgaccagcgcggccaccgaccaggacatcgtgtacacgccctggtagcggccccggccccgggcaggcgacaactgcacgaccaggcccgtctgcgtgggcgcgttcacgatctcggccagggtccagacgcacaccgtcagggcgtacgcggcgaccgacccggcgaagggcgtgagcccgaagccgtacccggcgagcagcgaggagatgatcagcagccggcgcgggtcgtggtgctggatgaagcgggtgacggggatctggaggaccacgatcagcacgccgttgacggcgatggcggtaccgaagtcggagctggagagcccgtcggtacccatggccaccggcagccccacgtacccctgctggaagatcagcgacaccaggaacgacagccccacgacccccatgtagcggccgtcgcgcaggacggtggtcagccgcacctcgtccttgggccgcttgccgccgacggtcttcacggccgcttcctcgggccgcgactccggcaccttcaggaagacgagcacggcgcacacgagcgtcatcagggcctcgccgacgaacccggcgaggtagctgtactcggcgatgaacccggccccggcggaggagatcgcgaagcccaggttgatggcccagtagttgagcgaaaaggcccggacccggtccttcggaggcacgatgtccgccatcatcgcctggacggcgggacgggaggcgttgctcgccatgccgacgaagaacgccaccgcggcgatggcgaaggggtgcaccatgaacccgagcaccgccaccgacaccgcggtggagacctgggcgatcagcatggtgggccgccgcccgagccggtcggtcatcacgccggcgccgagcgacgagatgaccccgccgagcccgtggagggcggcgacgagtccggcgtacgacgcggagtacccgcggtccagggtcagatacagggccatgaaggtcgcgacgaacgccccgaggcggttgaccagcgtgctggtccacagccaccagaactcgcggggcatcccggagacggtctcgcgggcggctgtgcgcagaccggcgacggacataaggattccccccacgggacgtacggaacgaggcctcgggtaacacccccgacgacgtcccagacattacgaagcccggctccccacccgccactggattgacgtcccccgtcaatcgtcgggccgccgacccctcctggaccgggccctgtccgcgttgcgggcgggcgcgcggagcccgcacgggttcgattacgctcggactcatggccgacgcaccgtacaagctgatcctcctccgccacggcgagagcgaatggaacgcgaagaacctgttcaccggttgggtggacgtcaacctcaccgaaaagggcgagaaggaagcagtccgcggcggtgagctgctcaaggacgccggtctgctccccgacgtcctgcacacctccctccagcgccgcgcgatccggaccgcccagctggccctggagtccgccgaccgcctctggatcccggtccgccgctcctggcgcctgaacgagcgccactacggcgcgctccagggcaaggacaaggcgcagacgctcgccgagttcggcgaggagcagttcatgctgtggcgccgctcgtacgacaccccgccgccgccgctggcccgcgacgccgagtacagccagttcgacgacccgcgctacgcgaccctccccccggagctgcgcccggacacggagtgcctgaaggacgtcgtcgtccgcatgctcccgtactggttcgacagcatcgtcccggacctcctcacgggccgcacggtcctggtcgccgcccacggcaacagcctccgcggtctggtgaagcacctggacggcatctcggacgaggagatctcgggcctcaacatcccgaccggcatcccgctctcctacgagctcgacgccgacttcaagccgctgaagccgggcggcacgtacctcgacccggacgcggcgaaggccgccatcgaggccgtgaagaaccagggcaagaagaagtagtccacctcttccccggctcaccgagccctctgtttccgcggatcatccgcgaggcagggggctcgtcggcgctccgggcccgacagggccggcggggcggggcggtcgcgaaccggtcaccacggtgtcgacgtggagccgtccggggcgagaccgtagcgccacaggctctcccaggcggggtcccaggagcggtgcagttccgccaagtggcgcagcgcatcgtgaaagccggcgtccgcggcagcccggtagagccggtcggcgtcctccgtcgccccggattcggcgcgcagtttcgccaggacggccagtgcgtccacgtggcccgcctgagccgcgcgccgggcgtagacgtccgccttcccatggtgccccgcctcttccttgagccggaccacctcccccaggacgctggtctccccctggtcgaccgcgaggtggtaaagccgctcggcctctgccgccgaccccgcttcctcccgtagtcgggcgagctgggccaaggcgcggccgcctcccgccagcgccaggcgttcggctccttcggggtcgtccgcggactctctgcgccgtacgaactcgttgagggcgaagcggttgcccgatcggtcggctcgcagaacgaggcgatcggcctccgcggcgtccccttccttctcccgcaggcgagccagcagcacgagcgctccggcgttcccggcgcgcagggcggtgtccgccaagcgttccgcgccttcgcggtccctcgtctgctcacgccgccagacgagctccagcagagcgaaggtgcttccggcgtccgccgccacgcaggccatggcttccgcctccgcgctcgccccggcctgttcccggaaaagggccagggccgccagtgcgtcggcgctcttccggttggccgcggtacggaacagctggagggcctccgccggatcccccgccttctcccgcagacgggcgagctccatcaacgcgaccgtgctgccctttccggccgccgaacgcagcagactctccgcccgctgcttgtcgcccgccttcctccgcagccgggcgtgttccaccagggcgaacacgcttcccttctgggccgcgtgggccaacagggtctccgcgcccgggacgtctccggagcgttcgcgtgcgcgggccagcatcaggaccgggcggaccttgcccctctccgtggccttggccaccaggtcctccgcgtagcggccggacttctcccgggcccggatcagctccgacagcgcgtacgtgcttccggcctccaacgacgcgaaggcgaagacctccgcgctctcgtggtctccggccgcttcccgggtgcgcaccagctccgcgaaggtgctgtacccgccccgctcggcggcggtcctgcgcaggcgctccgcgccgtgctcgtccccgccttccagccacagctgtgagagcttgatcagacaggtggtgttcccctgatgggccgcgtggacggccaggtcctccgcgcctgcccggtgacccgccagactccgcagccgcacgagcgcccaccgtgcgacgttgtcgttccggtacgccttttcgtagagtctcgctgcctcgtcagtgtctccggcgccctctctcaaccgggcgaggcggggcaggacggcggtgttgccctctgcggcggcccgctggtagagctcggcggccgccctcagccgtccgcgcgtctcggcggcgactcccagcgcggcgc

SEQ ID NO: 3401 - DNA, 6429 bp, Unknown
  Kingdom: Bacteria, Phylum: Actinobacteria, Class: Actinobacteria, Order: Streptomycetales, Family: Streptomycetaceae, Genus: Streptomyces
tacccgagcagcgcctcggcaccgcgggtccagccgatgaccgtgccgtccccggcgatcaccgccgccgcgccgtcggtcgtccgcgccggttcccgcccgtccccggagggcagcgggcctggctccgccggggagccctcatcggcggatgccattgcacctcaccaccctctgtaggtttccatggtcgctcgtcaccccggaccgcgcccggtgcgaggtccgggcgcgggctgtccctcgttcggcggcgtgacggagcgggccgtgtccgcgttggtggtggtgacgagcggttgcttgtccacctgcccccgcgctggacccgtgtgggtggacggctccggctccgacaggagggccggagccgtttccatgcccgggatcagtagcggaagcagatctcgcgctcccgcagccacgggcccagccagtcgccgaacgggacggatacgcaccacccgcgggtgggcggcgccccggcccccggaagcacgggcgagggtgtcaccggggacggccccagggacggcgggaccgtcggggccgccgccggatccgtcggagtggcagtcggctcaggcgtaggcgtaggcgtagacgtcgggctgggcgcgggcgaggccggcgcggccatctcggtcagcatcgtccggaacaccttcgaggaccgcggattgctcctgcactgccagacgccgtgcgggcagtagtccgtgatcgtctggtagagcggcttgtgccggtcgatccattccagcatccgccgcatgtactcggggttgtcgccgttgcggaagagcccccactccgggaacgagatgggcttgccgtgctccgcggcgaagtcgacgtgcttctggaggccgtacgggtcggtgatctggtcgtcgaaggtctcgccgggcggctggtcgtaggagtccatcccgatgatgtcgacgacgtcgtcgcccgggtagcactcggtccacggcaccgcgtcccgcccccgactcggcgtgaagtcgaagcggaagtcctgaccgggcaccgcgcgcatcgccgtgacgatccgctcccagtacgccttccaggacgcgggatcgggaccgcaccgatgcgtgtacgtcgtgccgttcatctcccagccgagcacgatcacggtgtcgggaacgcccagccccaccagtcgctccgcgagccgcgtgaagtgctggtcgtacgctccgtccgcgccggcccggagcagggtgcggacctcgtcgtccgggacccgctcctcgttgcgctccagcatcggcacgttcaggacgaacatccgttcagggtccgcctgtctccagtccgcccaggcttcgaggaagtcgggcgccccctcgatgttcacccagagatcgcccggcaggtaggtgtgtcccacccgcagctccgccccgccgagccagcgcgacagctcggccatcctgctgaccccgtccggcccgtagtccagatacgcgccgtgcgccgtgctgctcgccgttcccggcgggccgggggcggcgccgtcgacggaatcggtgcccggagccgactggcccgcgatgccgccacccgccaggaggctgagagcagccgccgcgatgcacgaaacgatgagacggcgtttagccggcattgctcctcctggctgcggtgaattccggccggttcggcctggtagggagagagtcgcatcatcgtgcaccgagggcatgcgcaggagtccatttatcgtattcggcgttgcggacgtgccgttcaggtgaatgtggggccgaatgtgaagggcagcgagccgacgcggttgtcgaaattcgagtcgaccagttccggatctcccagattccgcatgacaggacgacggccgatcagttcccggaacagggccgtcatttcgaggcgcgccagatgcgctcccaggcagtggtgcgggcccccgcctccgtaccccagatggggattcggcgaccgggtgatgtcaaagcgatccggatgggtgaaaaccgcctcgtcacgattggcggacgcgtaaatgagagcgactttctcccccggaagaaacgtacggccgcccagtgcgtattctgcggtcacagtcctgcggaactggatgatcggcgtcgaatgccgcacgatctcgtcgacggcgccgccgatgtaccggtcgaagtcggaccgcagcagctcccgctgctccggatgccggtcgagcaggaacagcccgtgcgcgatggcgttgcgggtcgtctccaccccggccaccagcagcagtgagaagaaggccccgagctgctgcccggacagcgcctcgccgtcgatgtccgcgctgacgagcgccgagacgaggtcgtcctcggggtgccggcgccgttcccgggcgagcctccccatgacgaactgcatccgagccagcgacgccagaccacgaccgggaatccgcagccgggcccggccccggcgctcgacgccgacgtgctccgaggcgtggtcgatctgttccgcgatccgtgcccggtacgccttcggaatgcccatcaggtcgcagatcacctccagtggcaaccgcgaggccgccgacggcatgaagtcccggggacgctcggagatcagctcgtccaccagccgcccggcgagccggccgacgttctcctcgacgtccgccagcagccggggggtgaaccgccgcgagatgatccggcgcagcgccgcgtgctcgggtccgtccatgttgaccatcgagttcccgaacagtgccttcgcccagccggccggctccggggtggtgacccccggagcgctcgcgaacacctgaggcgtgcggctggcggtccgcacgtccgcatggcgcaccagggcgtggaacggcttgccggcggtgcgcgcggcaccggcccggggagtgaacaggaccggcgcgtccagctcccgcagcagggcgaaggccctgagcctctcggggcgcggcagccgccagaaggccgggtctgccagatcgacgtccgccgcgcgcagtacgcggtccccggacagctggtacggaacggtcatgcccatcacctccacggttcgccaggccatggtccggcccgtcggccgccggaggcctcaccgacgcggcccgtcgccgccgatgaccccgcaccctcacgcgtttgacggaacggaaccaccatgtgtgcgccgtacgccgcgcgcacgagaactgtttcgcccccgcctcgttgtcaacatcgccatcaccagcacctcggacgagttaacgagtcaatgaggcgagtcaacgagaggcaggcagtcatctcatgagccccacccccgcgaaaccgggcggcacccgcattccctcccgccggatcgtcctgcgcggagccttcaccgccgcggtggtcacgggcaccgcaggcgccctgctcccgctgctcgaccatgagcgggccgccgcggcccggcccgcaccggcgcccgaggcgcccgtgaccggcccggaatcccgccccggatccacgacggaagagttcgccgagatgtaccggggccgggagatccggggaacggcgaccgtcgcccccgccggcggcccggacgacgaccgcgtgatggtcgccgccgaaccgggttccgagatccgcatcgacggcaggcagctgcatgtcatgaggcgggcggacggcacctatctgagcgacgtccggcactacgagtcgtacccgacgctgctggagacggcccgtgccgccgtcgacgagctcggagccgccggactcgcacaccccgccgcgcaccgcatgtgaaccaggaggaccagcaccggtgtacacccgcaagaaccagcgcgacctcacgcgcaccgaaaagcgtcggctcgtcgacgcgatcctgaaactcaagcgctcgggccgctatgacgacttcgtcgtcatgcaccgggagtactacgtcatggacaccgagcggcggccgcgcccggcgcacatgacgtcctccttcttcccctggcaccgccagtacctgctggagttcgagaaggcgctccaaagtgtcgacgcgggcgtcagcgtcccgtactgggactggacccaggacgacaagccgacctcctcgctctgggcggaggacttcctcggcggcaacggcagacggggcgaccgccgggtcaccaccggagcgttcgcgtacgaggcgggcaactggagcgtcggcaggggcgtcaccgacgagcactacctcacccgcaacttcggcaggcccggccgcgacccggtctccctcccgaccaagaacgacgtcgcgcgggcgctcaaggatcccgtctacgacaccgaaccctggaacagcgtctgcaccgagggcttccgcaaccgcatcgagggatgggggatccggggagttcgcacggtgggcctccacaaccgggtccaccagtgggtcggcggcccgatggcgggagcggcctcccccgaggacccggtgttctggctccaccactccttcatcgacctgttgtgggaccggtggcgcaaggcccacccgaagtccgcctacctgccgggccgcaagcccgcctcgcccggcccggaccgcgactacgtcttcggcctcgacgaggcgatgcccccctggggcgtgaccccgaggaaactcctcggccacggcaagatctaccgctacgcctgaacccggacgaaggaacggccggccccctccgcgaggagggagccggccgttcccggactaccggagatcagcggccgtagccgtaaccgccgtcgtggccaccgttgtcgtggccgccgtcggcgttgacacaggtgttgccgaaggccgggttcagcaggccgatcacgttgatcgtgttgccgcagaggttcaccggcacgtgcacgggaacctggacgacgttgcccgaaccgacgccgggggaggcggcggcgaggccctgcgcgccggcgtccgcggacgccaggccggcgccgccggcgatcagggcgccggtgccggccacgacagcggcgaccttcgtcatacgagacattgagtactccttgtaaagaagggggtgtgctgcggacgcgaggcccgcaccccctgtcaacgcgaaagacgccggacggtaacggatcagctcataggtgatatctccgactccgctgtccggcgtacaccgcacccgtcagcgcccgatcaccgacagccccgtcaaccgctcgtgccagtccctcgccgccgggaaccgcgccttcaccgtctcgaccgcccgctcccgtacggccacctgcgactcgcgcagccgcagcagcggctccagtcccggccgggccagcagcagccgctggttgaccaccggcaccggaccccagtggttcttgtaccgctccgcgccgcgcagcaggctcagcacctcgcgcccgctgtccgaagcctgctgggcgacctcgcgcagcagcatcgtcgacacatcgaccttccgctcgcgcagcgccggatccgcaccgtacagatagccgcccgtcagctgcccggactgcaacgacaggttggacgccaccacctcgccgttcagccggaactcggtcatggcagccgtaccgtcccccaccatccgccccaccgaccggatcagatggtccgagaaccgggcccggagatgctcggggttgaccgcccggccctcccactgccgctcgtgcagccgcagcagcgtgccgatcgcggcgggcaccccgtcccgcgggatccggtgcgcctcgacgcccagggcgtcgaccttgcgcagcttggagcgcagccgctgagcccgcgagcccgtcagccgcgccaccgtgtcgcccagcggctcggccggcagttccatgcacgtcgagtccgtgagccggctccgggccccggcccaccgtccgaacagcaactgcgccgacgcgtcgggcctgacctcccgcaggtccaccacggtgtgccgggccgcccggtccagaccgcgccccagtgcccccaccgcgtagccggcctcctcctcgtccagcaggatgtcgaagaagtcggagatcgcaccgcccatcgggacgagcagcggcatcggacggtgcaccagcatcagcggcgccgctccgatcagccgacccgcccggcggaccagcagcacccgcagccggccctcctggccgtaggagatccaccacgagtgcagccaggcgtggctctggaacggggtcgcggtggcgcagcggcggtgcagcgcgtcccactccccggcgagcgcgccgaactccccgaagtcccggcacagggtcacgacgaggccgcccgcccggtaccccgtcatcggacgagctcccgctcgtcctgggcgacgttgccgccctcggccgtcggaccgggaacctgtgccggggcggtccggaccgcccggcccaggttcccggtccg

SEQ ID NO: 3402 - DNA, 2136 bp, Unknown
  Kingdom: Bacteria, Phylum: Actinobacteria, Class: Actinobacteria, Order: Streptomycetales, Family: Streptomycetaceae, Genus: Streptomyces
cgtgaccggagacggcgtcggtcacggcccagggggcgatgccgccggacaaccgggaggcgacgccgtctccggtcacggtccaggtgtcggattcgccttcgggcaggatcccggtcggcagatgcttgatgtggtacgccgtcaccggaccaccgccgcgcgcctctgtaggcccatgccgtatgccggtatgcccatgccgtacgccccccgacgctcgctcccccgtgcattaccggccagtcttcccacgccggtcctccctcacacgacatcccacggcacccgcaccgcctcgcgccgcctcacaccgcatcacgcggtctcgcatggcggagagcgctttccggccaagcattccggtccggtaacgacaccctcactgcctgccacaaccctttagggttcctcacagttgtcccttgaacgtgttcaaggggctctcctggggagggggactgcgagatgcgcagtggagcgaaggtcgccgtgatcggcggagcgttcgtcctgatggccggagggatcggttacggggcgtacagcatgctcggggacacggtcggcggggacggcggcacacggagcgcctccgagtcgtcggaggtgaagacggggccgccgagcgcggaggagatagcggagacgtcgaagggcttcctcgacgcgtgggctgcgggggacgcggccgccgcgtccctcctcaccaacaacgagtcgggctcggcgccggtgctcgcctcgtacggcgaggacgcccgcatcggcaaggtgaagatcacccccggcccggccgtcggcacaaaggtgccctacacggtcaaggcgacggtctcgtacgaggggacgtccaagccccttgtgtacgcctcggagctgaccgtggtgcgcggcctgacgacgggcaaggccctggtcgactgggacccgacggtcgtgcacccgcagctgacggagggtgcgacgctgaggacgggcgaggcctcgacgccgacggtcgaggccgtcgaccacaacgggagggtactgaccaaggagaagtacccctcgctcgggccgatcctggacacgctgcgtgagaagtacggggagagtgcgggcggttcacccggcatcgagacgtggatcgagcccgccgacgagacccagccggacgtcaatctgctgacgctggacaagggcaagcccggcaaggtccggacgacgatcgacgcgggcgcacaggaagcggccgagcgggcggtgaagaagtacgcgcaggcctccgtggtcgcggtgaagccgtccaccggggcgatccgcgcggtggccaacaacccggcgaccgggttcaacgcggcgatgcaggggaagcaggcgcccggctccacgctgaagatcatgacggcggcgatgctgctggagaagggcctggtcacggcgaacggggcggcggagtgccccaaggaagcccggtactacacccgcacgatccacaacctggaccacttctcgctgccggacggctccacgttcacgcagagcttcgcccggtcgtgcaacaccgccttcgtcaagctgatcgacgacgtggacgacgactcggcgctcgccaaggaggcgcgggaggtcttcgggatcggcctggactggaagaccggggtcgtcacgaccgacggcagcgttccggaggaagtgcagggtgaggccgcggcccagtacatcggccagggcacggtccagatgaacgccctcaacatggcgtccatcaccgccaccgcccgcacgggtacgttccgccagccggtcatcgtcccgcagtccctggacaaccggcagttggcgacggccacgcgctcgttgtcgccgtccgtcacccagcagctcacgacgatgatgcgcgccacggccgcctggggtaccggtgcgaaggcgatggcctcggtgggcggtgacaagggcgccaagaccggctcggcggaggtcgacgggcaggacacctccaacagctggttcaccggcttcagcaacgacctcgccgcggcggcggtcgtccagaccggcggccacggcggcgacgcggcgggcccggtcgtggcggaggtgctgcgcgcgggcggctgaggccgcagccgttcggtgtacgggtcacgg

SEQ ID NO: 3403 - DNA, 8997 bp, Unknown
  Kingdom: Bacteria, Phylum: Actinobacteria, Class: Actinobacteria, Order: Streptomycetales, Family: Streptomycetaceae, Genus: Streptomyces
cctccctccgccccgcccgaaaggcagtacccgtggcctctcccgtctccccctcggaccacgtcgcgtcgcaggctccgacatggcccgcgcagcacgctgcgtcccgccacgcggtgtggctcggcgccgccgcgatcatcaccgaccagatcggtcgcgtcctgctggtccaccccacctaccgcgaggacgaccggtggctgctgcccggcggagtcgtcgaagccggtgaacacccgcacgacgcctgccgacgcgagatcaccgaggaactgggcctgccggacctgcccctgtcgcgcgtgctcgccgtccactccctctcacagcaccccccggacaccagacccggcacgccctgccccggagagatccggtacgtcttcgacggcggaaccctcacccccggccagacgaaggcaatccacctgccccgggaggagctgtccgagttcgccttcctggagacccgggacgcggtacagcggctgcgccccgttgacgggcagatcatgctcgcctcctaccgcgcccggctcgggaacaccgccaccgcccacctcgccgacggccggcacatcctcgacgttccgccgctggatcgccatgacgtccacgtccgctaccgccctatgtgggacagcccgctccaccgcacccctgtccccgagcggctccccgtgcagcaagcctggtcgtggtgcttcgttcccgacggaagaatcgtcctcctcgccgacccggctccccggggcgctctgccgatgctgcccggcggcaccgtggagaagacggacaccacacccgaggccaccctccaccgcgaagccgccgaggaagcccagctcaccctgaccgatccggtgcggctggggtgggtactggacgagaccggcgaggtctacggcggggtgggacccaacgcccggctccgcctcgccgcccgggtcaccgccatcggaccgaccgccgtcgatcccgccacaggccgccccttcgcacgcctgctcgccacccccgcccaggcagccgccctgctgggatggggcccgcccggagagcggcaggcccagctcgccgcggagacggcgcgcgagcgatggggtctgcccgccgctcgtgtcgcggccgtcgaggagatccccgcggaggggatgcggctgagctgatcgaacgcccgccccgctcgtcccgctccgtgtacctctgaggttgcctcatgccgctgtcgcacgaccacatccgcaccaccgtcgagacctacctcgcgcgccatcctcgcgagcgtgagcagctcggtgccctcctggacgccctcgatcgtcccaccgacatcgccagccgctccaccttcaccgggcacgtcacctgcggcgcgatcgtcgtcgattcgctcggccgcgttctgcacgtgctgcacctggcgagcggcaaggtcctcccgcctggtggacacagcgagccttctgatgcgtccctgggagctacggccctgcgggaactgcacgaggagacagggattccgccccaggccgtctcgccgtgtcccggctacgagacagtgccgctcgacatcgacatccacgacattgacgcccgcccggacaaaggggagcccggccaccagcacttcgacttccggcttctcttccgcctgcacaccgcgaccgtgccgacggtagtgctgcaggaggaagaggtcggcggcatcgagtggcggtccgtggacagggtgacctccccctccctgcgcgagaagctgctcaaggtcccactgactgtcgaaccggagacggccaacgcctccgttctgatgtacaacgaccgcggcgagtacctgcttcacctgcgcgactacttccccggcttgatctgggagccgggcatgtggtccctgctgggcggcggacgagaaccccaggatgccaccctggaacacaccgcacggcgtgaactggccgaagaagccggcctcgacatcgccgacctgaccccgttcggcaccgagtacgcctccgacgacgccggcgaaaccgtgcccatcgccatctacgccggccgctggaacggcgacccccgcgaactccgtgtgacggaaggggtgatgctcgcctggttcgccccggaggacctccaccgcctccgcatcacggacaccaccagcgacctcgtgcgacgccactccgccagccacccgaccagcaccgcatctcagagcgggctcgcaccgcagaaggacaagcgtcgttgcgcctcaccgcacggcacggtcctcaacgtcatcggcgtccacctctacctggaaaggcccgacggaaccgtgctgctcgggctgcgccaccccgactccccgttcgcgccgtccacctggcacgccctggccggccactgcgagcaggagaacgccatcacctgcctgatcagagaggcacgagaggaagccggtctccacatcgagcgccaggacgtcgaactcgtccacgtcgtccaccacatcgacaaggccggggaccagccccgcatgggcctgttcttccgcgcccgagcctggagcggcgaaccggaactgcgcgagccggacaagtgcacccagtgggcattctgggacccgaacgcgctccccgacaacctcgtcccctacaccagggtggccatcggcaagatccagaacggggagctctacagcgagacgggctggcccgcatgaccggtacaccgggccgcgcacaccgtcgcgtgtccactacggctgcggccggccgtccggacactcacctcgtggtgatccgcgccaactcggcgtcaggcaagtcaagcgtggcccagggctcggcctctgcctcgtccataccgccgcagtgcaaaccgtcgcagggagactcaatgaacagtctggtgctgatgtccgatccgcgggtcgccgcgatcccggtgcgcgagtgcggagagccgctcgtcgacgtgcgtgatcacggactccgcgtcgatccccgcaagcaggaccggctgagcgcgttcacccacgtccgcgagggcgtcctggcccggctggaacacgcccgctcgctcctgcccgcaggggtggacctgctgttcatcgagggctaccgcccactggccctccagcagcgctacttcacctcgtaccgggacgagctggccgtcgctcaccccgactgggggcctgaacaactgcaccacgccgccagccggtacgtgtcaccaccggagatcgcgccccattccgcgggcgcggccgtggacgtgaccctcgtcgaccaggacggccacgaactcgacctcggcacccgtgtcaatgcctcccccgaggagagcgacggtgcctgcttcactcacgccccgaacctcagcgatcgcgcgcagtaccaccgcacgctgctgctcaacgccatgggggacgcgggttttaccaactatgcgaccgagttctggcacttctcggcagcggaccggtacgacgcactcatgcggcaagagccgcatgcgctctacggaccgatcgaactttcttagcgtgtcgacagcctcgtccgctaccacgccgcccacgccggtccggcaacacaggagcgtggccaccgcaccccgagccggtagtgatcccaggaccgcaacggacggaccacatcgaacggaggcacgcgtgcctgacgacacccagcaagcgaatccagccgtcccgagcccggcggccggagacggaccacacgagcaccacatccacctgctcgggcgctactaccgccaagtggaagcaggccgcaagacggtcgaggtgatggtggccgctccgcagaagcacgccgtcgcggtcggcgacatggtcgtcttccgggatcgggacaccgggcgggaaatcgatgtcatcgtgcagcggatcaccccctaccgctccttcgaggacctgctcagctcggagaaccctgcgcgcatcgacccgaacgggccgcccgaagagctgctcgccgtcctccgcggcatgtacccgccgggcagggaagccctcggcgttctcgccgtcgccttcgatcaccgccccgcacggcccggccgccccatgccgatgacgcctcgggcgtacgcgcagaccgtcccccaccacacggtgtacggctgcctgtacatccgcgacgaacacgaccggccgattcagctccgctcggtctacggctcgcggctctggcagttcccgggcggcaacctcgacgctcccggcgaggacccgctgcagaccgccctgcgcgagacggtcgaggagacgggcctcgaaatcggtctggacaccccgacgctcctcctgacgcacttcctgcacgccgggccgcgcctgccgctgaacaaggtggggctcgtcttcgacggagggcagctgaccgccgaccagctcggccggatccgactcgatcccgccgagcacgacatgtgggctgtccacgacctgctgacctggcaggagttgatggctccgcgtgccttcgaccgcctcgacgccgtcgagcgagcccggcatggcgagggcccctcctacctgatcacgcacacctgatgttccgcaccgctcacgcaggaggcatcatgctcgccgaggacacattgcgcgaccgcctgtgtcccggtgccccgctgatcctctcgctcctgcacaccgacccgcacggctgcggtccgtccacaaaggtggcgccgcgcgagcagatgatcctgcttcgcgacggcccacccctgcctacgcagatgtgggtcctggcaccgcagctgtgggaggacctgctcaccgcgtccggcttccgcgtcgagaccatcgacctgctaccgccccccgacgagagcgccacggtcgtccagcagctcatccgcgcccggcgcttgcccgaccgaccgtcgcgcgtcacggccggcaccgcctcggcaccttcgaactgcctggcggcagtgtggagggcggggaatccttcgagggtgccgtggtccgcgaactcgccgaggagaccggtctggtcgctcgtgccgaggacgtggtgctcctgggtacgccggcggccgggtgactgtcactcggttgaactgcccgctcatggttgtcgagggtgtcggggaaccggggaagggtgagcggctcaccaccgaaggggtggtaccgcgctggtggtcagcgcccgcgtgtggccctcggcgcacggggtgggcgacggctggccgctcgtcacccggcaggggtgatcgtgccggtcaggtggccgtatgcgacattgcagtggaggcgcacgccttgcgcgagggcgttgtcgttgaggtagaagcgcgggttgtggttggggacgaggccacgtccgccgggagtgggcaccagttcaccgccgtcggtcagctcgccgtcctgcgcgccgagcatcaggtacacgccgccgtacctgttgacgaattcggagacgtcgtcgtacccgagggtcggcggggtctcgaagaccttctcggcaccgacgacgctcttgatgatgggcagggtcgcctcggtccacttcctgaggttgtgtacggcgggcacggcctggaggtagatcacctccgcggtgcagttgtaggcggcggcggtctgttcggccagggtggtgagccgcttttggatgtcggccatgtcttcctcgaccgagcagcggatggtgccccacagggtgacggtgccgggaacgatgttgaagcggccgacgtcctcgatgtgaccgatggtcacggtgatcgggtcgaaggcggggacctgtcggtagagctgtccgatgccgaccgtgatcgcgccggccgcgggcatggggtcgatgcccatccacggggtggagccgtggacctgctgaccggtgagcacgatcttgatcatgctggaggcggcgaactggttgccgacccggtagccgacgtatccgctgggaagcggccccaggtgcatgccgaacgccatcgtcggcgcggggtcgttgcacgccccttcgtcgatcatctgcttggctccggaggactctccggccggtgccccttcctcggcgggctggaagatgaacagcacggtgccgggcagctgctcgcggactccggccaggacggtagcggcgcccagcagcatggcggtgtgtccgtcgtggccgcaggcgtgcgcgaccgggaacggaccgccgggatagttctggtccacgaccgtggaagcgaagctctcgccactgtcctccttgaccggcagcgcgtcgatgtcggcgcgcagcgcgacggcccggtcgccgggcctgccgcccctgagcacaccgacgacaccatgtccggaaataccggtacggacctcgtcgaggttcagggaggtcaggtggtccgtgatcagcttggccgtgttgacctcgcggttggacagttccggattctggtggagatggtgtcgccacgcgatgacctgctcctcgaccgccatggcccgtttgtcgagttcggcgttaatcggatcaccgctcatgtcccagttccttgaagtcgatcctgctgacatccgaaggctatgagcccacctaccgcgccaccgccgctcgcagggcaaacgggtgacggcacagccagggcgtatacgggaagcgggtcttcatccgtgaggcggtgcggtgactgggctcgggtaccgtcgttctcggccgcgatcccggtgccgcgaagacgggcgaccgcgcgacggaagatcgggagttcctcttgcgtgcgcccggaccaagtcccagtgtcacagccactcgttgatggccgcaacgaggacggtcgcctcgtggcggaccgcgagcttgtcgtatcgcctggcgacagctctgtgcctcttgagccggtcgatcccgcactccaccgcgtgccgttcacggtagccgaccgggtcgaagcgcgacggccgaccaccccggaagccgcgtttccggcggttgcgtgcctggtcggccttgtccgggatggtgcaacggatcccgcgtcggcgcaggtaggcccggttcctgcgggaggcgtacgccttgtcggcccgcacgcggtcggagcgtacgcgtggccggcccggtccgacgcgggccacgcgaacctctgccggcatgggttcgaactgcggcgagtccccgcgctgtccagcggctgacgtacctgtcgcggaactgccacgcccgcggatttgcggtacagggcatcggccgggcgcgatatgctgatgcagaatgtgcatgggatttgcagagggggaggtcatggctacgcgggtgactgattcagggacgaaccagagcgtcgagcgagcggtgtcggtgctgcgcgcgctcgactcgggccggcccgaactccgtgtctccgacgtcgccgagttcaccggactgggatcgtcgaccacctcgcgcctgctgtccaccctggaacgcctcgacatggtcgagcgcgatccggtcagcaacctctaccgcctcagcctgggccttcttccgctggccgccaccgccaccaaccgccaccccgtgcaccgggccgcccgcatggtcctccaggacctggcgacccgtaccgggctcggggccaatgtcgcgatccggcgcggcaccgagctgatgttcctgtgcaatttcgagggcgcgcgcgcccccaagtcgtatacgcaggccggacacaccgccccgctgcatgccacgagcatcggcaagtgcctggtcaccggactcgcccccaaggagcgccgcaagctgctgggagatcctctcgacgcgcacaccgagtacacgactacgagtcacgacctcctcgacgccgagctcgacaccgtccggcgcaccggatatgccgtcgaggccgaggagcgtgccctgggccgtgcgtccctggccgcgccggtccgtgacgcttcgggggagattgtcgccgccatttccctctggggcccggcctcggtgctggggggccgctccgacaccggagggcagcgcctcgccctcgtccgcgaggtcatcgaggccgccgacgccatcagtcaggcactcggcgcactctgacgtacagcggcggggggccgatcggccccccggcccccctccgccgtgcggctatgcgccgtacgccttgaaggcgatcacgtgcgtgcgccgcgacccgtgcgtcgcgtcgaccacgagccgcagcgcgtcggtgcgtacggggccgccgtccgctcccctcagttcgtggacgcggtggcggcggcggttgtcggtcaccttcaggagcgtgcgccaggcgccgtcgggttcgcggctctggatgcggtagtcgcggacgagctccggcatgatctcgaacggagtgcggtggcggtgcaggttgttgaggtactcgtcgacgtcgtcgtcgaacaccaggcgcgcttcggcgagttgctgttcgtcggcccagtcgaggcggagccactcggcgtcgccactgggcgctgaggaccacatctgcggaccgccgtagggccgctggtatccgcccactgcccgctcggggtggaacgccgtggtgtcgggggccgcccggaaggcgaaggtctgccggcgcagcccgcgggcctgccactccacgaccagctgaccgtcctcttcggggatgtcgtggtcgacggccgcgtctccctcggccttcctgcgcagcgcgaggacgccgtcggtgcgttcgggaaggaggaccagggccgtgtccgaacaggcccggacgacgaggatcgcgttgcggggggtgtcggggtggtggtccaggcgggccgtgacccagtgggggccgtcgggcggggcggtgaccgtggtcgtgaggagatggtcgacggggaccgcgttctcggggtggcccgtgctccacagctccacggtgagttcccgggaccgtccgtccggggcgccgtggacgagcaggtcgaccgtgtcgagtgcgggatccaccggcagcagcagcgcgaggtcgcgggtgagg

SEQ ID NO: 3404 - DNA, 8433 bp, Unknown
  Kingdom: Bacteria, Phylum: Actinobacteria, Class: Actinobacteria, Order: Streptomycetales, Family: Streptomycetaceae, Genus: Streptomyces
gcgccagggccagagcgagccgctggccctcggagaggtcccgggggtgggtgtcgtccgcgacgcccggcagcagctccgacaccagcgcccggcaggaacccgccaccgcgcccgcgtccctccggcgcacagccgtccagcagatcccgagcagcagcagaccgaggacgatcagcgtggcctcggaggacagctccagaaggtgccccagccactccggggcgtccccgaccgcttcggtcagcgaccggtaggcggatacggaggctccccgggtgacctcggtcgggccgggctcccccaggcctccgggcgacagcgtcccgatcacggccgccgccgtcgccagcagagcggccgatccgaacagtcggacgggccagtggtgttgatgtgtgtgcttagccatacggcgaacgtacgaagccacgccgtcccggagcgggggccgaacggcaggaacggcccccgacgaacgtcagggttgacgccaggacgcgctccttctacggagaggcgccgtccccggagtcccacgtcagcatcctgaacccgccgtcgtcccctgcccccgccgaccggtacgtcgcgagcgccgcctcgttgtccccctccacgccgacccacaggtcgtagcacccccgctcccgggcgatgtccacgagcgccagcgtcagggccctgccgatgccccggcggcggaacggggcgtcgacgccgagttcgtacaggcacatctccgtgcccttgtccgggtgcagcatctcgatgcccgagacgaagccggccgggacgccgtccacgtacgcgatcagcagcacgtgaccgtccgcggcgaggaagcgggcggcccattcctcgcggggcggtgcgtcgtagaggtggccggcggccagcagttccgcgacggtcgtggcgcggcgaatgtccacaagggcctcccggggcaagggtttccgaaggcattctgtaccgcgtccggagtacggcgggtgcgcaccgtacctctcagggaggccgcacacctcaccctggcggcacgcaaccggcttgcatcctccgtttagggtcgagggatggagacccctactgctcgatggcggcgcctgctgccccgtacacctggccggtgggccgcggtcggcgccgcgctcgccgtgctcgtgggcggtggcgcctggaccgccgtcgccgacgacggcacgcccgccgtgcagcgcgaggaccggacgctgcgcatggacggggtgccgatcgacacctcgtacttccacgccgagggttccggtaagcggcccgccgtgctcatcgggcacggcttcggcggcagcaagaacgacgtacgggcccaggccgagaagctggccgccgacggatacgccgtactgacctggtcggcgcgcggcttcggcaggtccggcggcacgatctccctcaacgacccggaccacgaggtcaaggacgtctcgcggctcatcgactggctcgcgacgcggcccgaggtggagctcgacaggaagggcgacccccgggtcggcctcaccggggcctcctacggcggggccgtctccctgctcgccgccgggcacgacgagcgggtcgacgccgtcgcgcccgtgatcacctactggaacctcgccgacgccctcttccccgacggggtcttcaagaagctctgggccgggatcttcatcaccaccggcggcggctgcgagaagttcgagaagcggctctgcgagatgtacgagcgggtcgcggtcagcggcaagccagacgccgaggccgtcgacctcctcaccgagcgttcgccgtccgccgtcgccgaccgcatcaaggtcccctcgctcctcctccagggacagtccgactccctcttcccgctcggccaggccgacgccatgcagaaggccatcagcgccaacggcgcacccgtctccgtcgactggatctcgggcgggcacgacggcggcgacaacgagaccggacgcgtcgaagggcgcgtcggggactggttcgaccgctatctcaaggaggacaccggcgccgacgccgggcccgccttccgcgtcacccgcaccggaggcgtcgactccaccgacggcgccgccctcctgcgcggcgcgagcagcgacacctacccggggctgcgcagcggcggccgggacatcgtgctcggcggcgggacgaagaccttccgcaaccccgccgggtcctcgccacccgccatctccgccgtacccggcgtcggcggcggactcgcccagctgtcctccctcggcgtcgggctctcgctcgacttccccggacagttcgcccggttcgagtccgccccgctggacacctccgtacgcgtcaccggcacgcccaccgtgaaggtgaacgtgacggcgagcggcgaccgggacgcggtgctcttcggcaaggtgtacgacgtgtcgccggacggcaggcagcaggtgctgccccaccagctcgtctccccctaccggatcacccccgaccagcagggcaagcccgtcgagctggcgctgcccgccgtggaccacgagttcgacgccggacaccggctgcggctcgtgttctccgcgaccgacctcggctacgcgtccccggccgagcccgccacgtacaccgtcaccgccgacggaccgctgaccgtccccaccgcgcccgccgtgaagaccgcggcggccaccctcccgtggtggacctggggcctcccggccgccgccctcgtcatcgcggtcggtctgctgttcaccgcccgccggcggaccgcgacgcccgcgccggaccccgcgctcaccgacgtaccgctccagatcaccggactttccaagaagtacgccaagtccgtcgaccggtacgccgtgcgcgagctgtccttccgcgtcgagaagggccaggtcctcggcctcctcgggcccaacggcgcgggcaagacgaccaccctgcgcatgctcatggggctcatcacccccgacgagggcgagatccgcgtcttcgggcaggccatccggccgggagcgccggtgctgtcccgggtcggggcgttcgtggagggcgcgggcttcctgccgcacctgtccgggcgcgccaacctcgacctgtactggcaggccaccggccgcccggccgaggacgcgcacatcgacgaggccctggagatcgccggcctcggcgacgcgctcacccgtgccgtacggacgtactcccagggcatgcggcagcggctggccatcgcccaggccatgctcggcatgccggacctcctcatcctcgacgagccgaccaacgggctcgacccgccgcagatccgcgagatgcgggacgtgatgatccgctacgcggccggcggccggaccgtcatcgtctccagccacctcctctccgaggtcgagcagtcctgcacgcacctggtcgtcatggaccggggccggctcgtccaggccggacccgtcgccgagatcaccggatccggcgacatgatcctggtgaccacggccgaggaggtgtccgagccgctggcggagaaggtcgccgccctgcccggcataggctccgccgtccgcaccgacgacgggcgcggactcctcgtccggctcgacggggccaccacctcccggctcgtctccgatctcgtccggctcgacgtcccggtcaccggcgtcggaccgcaccgccgcctggaggacgccttcctcaccctgatctccggaggagcagcatgagcgcccccgtccagccccccgaggtccggggtgacacagcgcatcccgaggccgccggctaccgcgcccggcgcacgcttcccctccgcgtcgaggccatgcggcagttgcgcagacggcgcaccctgctgatgggaggggtgctcgcggcccttcccttcatcctgatcatcgccttcgcgatcggcggcacgccggacggcgaggacggagggggaggcggtggcggcggtggcggcggccggatcaacctgatggacgtggcgaccgagtccgccgcgaacttcgccgccacctcgctgttcgtctcggccggattcctgctggtggtgccggtggccctgttctgcggggacaccgtcgcctccgaggcgagctggtcctcgctgcgctatctgctcgccgctcccgtgccacgcgtgcggctgctgtggtccaagctcgtcgtcgcgctcggcttcagcctggccgcgatggtgctgctgccactcgtcgcgctggtggcgggcaccgcggcctacggatgggggccgctgaaactgcccaccgggggagcgctgtccgccggggacacggtgccccgcctcgcgatcgtcgtggcgttcatcttcgtctcccaactggtcaccgcgggcctggcgttctggctgtccacgaagaccgacgccccgctcggcgcggtcggcggcgcggtgggcctcaccatcgtcggcaatgtgctcgacgcggtcaccgcactcggctcctggcgcgacttcctgcccgcgcactggcagttcgcctgggccgacgccctccagccgcaactggagtggggcggcatgatcaagggcacggccgtatccgtgacctatgccctgatcctgttcgcgctggccttccgcgggttcagtcgtaaggacatcgtgtcctgaacctgatgttccgccggtttcctgcccgctgttgccgcatcgagatggttccgcaacgctttcgtcgactccggtcggcgactccgtacgtcacattcacagatgtcgaggacatcgtgacgacgtggggggttacacatgcatcaggtaagccggcgacacgagaagcggtcggggggccgggcagggggccgggcgggagccgtggcgctcctgctggcgggcgccatggccctcaccgcgtgcggcagcggcgacagcgactcgggcagcaagcgcgagctgagttcggatacgcgtaacgggcagggatcgaccggcggcggacagcccgcgccggacgcggtggcgcccgaggggggccggtcggccgcaccgacgggagactccggcgacgagagcaagctggacgtcgcgccgcccgactacctctccaccttcgccctggacgtggacaccgccagctacggctacgcgcgccgcactctcggcgacggcatgctgccctctcccgaggaggtacgtcccgaggagttcgtcaacagcttccgccaggggtacgaacggccgaagggccccggcttctcggtgaacgtcgacggggcgcgcatcggttccgggaagggcgggggcggcggaaccggagcctccgactggtcgctgctccgcgtcggcctggccaccgaggccgccccgtcgaccgctgaacggccgcccgcggctcttacgttcgtcgtcgacatctcggggtccatggccgagaccggccgcctggacctggtcaggaagtccctgaacatcctcacggacgaactgcgcgacgacgactccatctccctggtcaccttcagcgacgaggccgagacccggctgccgatgacccgcctcaagggcaaccggaaccggatcaaggacgcggtggaggagatgcagccgacccagtccaccaacgtcgaggcaggtatcaccctcggctacgaggagtcggtcgagggccaccgcaagggcgccaccaaccgggtggtgcttctctccgacgcgctggccaacaccggtgacaccaacgccgacgggattctggagaagatcgactccgctcgccgcgagtacggcatcaccctcttcggcgtcggtgtcggcagcgattacggcgacgcgttcatggagcagctcaccaacaagggcgacgggaacaccacgtacgtcggtgacgaggagcaggcccgcaaggtcttcgtcgaccagttgcccgcccacctggagatccgggcccgcgacgccaaggcccaggtggcgttcgaccggaagaccgtgaagcagttccggctgatcggctacgagaaccgcaaggtcgccgacgaggacttccgcgacgacagcgtcgacggcggtgaggtcggccccggccacacggtgaccgctctctacgccgtacggctgcgcgagggcgcgtccggcaccgtggccaaggccaccgtgcgctggctcgaccccaagacccgcaaggcccaggaggagaccggcaccgcgacgaccggggcgatcgacggatccctgtggggcggcgggagcgaccggctccaggtagcggccgtggccgcctacttcgccgaccacctgcggggcggcgacctgcccggcgcacccggcctcggtgagctcgcctcccgggccgccgggttggcggagacgaccgaggacagttccgtcacgaagctggccaaggccatcggacaggcggaccggatcaagggcggatccggaacggacgacgagccggaaccgggcgagggcgagatcggctgaggccgagcggcccgagggcccgggcggcccgggtggacccaccacccgggccgaaacggttcgcacggtcattcgaaaatgagcgcggtgaaccgccgttccgggtcatgatgtccgccatgaccaccctcttcctggtgctcgccacgatcgtcaacggcctctacgcggggttcatgctgaccttcctgatcgcgatcatgcccggcctcgccgacctgacggacgagcagttcacggcggccatgcgccgcttcaacgagaaggtccccggcccggtcttcctggtcctgttcctcggcgtcgtcgcgctgcccgccgccgcgttcttcaccggcctcggcgagcacggcgaggccgcggggcccgccatcctgggggcactgatctgcggggtcgccggtcatctggtgaccgtgatcgggaacatcccgctcaacaacgctctcgccgcatccgagggcggcgacgacagcgcggcccgcgcggccttcgaatcccgctggaacaccctccaccaggtgcgtaccgcgttcgcactggtggcgtgcgtcctgctggccatcgcgctgtagggcggcgcgcaccccctccgtatccgcatccccatccgtacgcgggcgggagctgaggcgttaccggcggccccctgcctctgcccgccgcggatggcgggggccgagcagcaccacgagtgcggccgcgccgggcacgggtgcgtcgacccgttgccagccgttccgctcgtacaggcgcagcgccgcctcggcccgcacggaggtcagcagccagcaacggccgtccgggaccggccccgtcaccgcgtgcagcaacgcagcgccgatccccgtaccgtgcgcctccggcgccaccgccagctcgttcacctccagcgcaccgcagagccacgcccgtgtccgccggggcccgagcgcctcggcgacctgcccgtagctgcggtcggccggaaagacctccggggtgatccaggccgtggcgaaaccggttaccgtctccccggccgtcgccaccgccgccgtgaacccgggccggagcgcgtctcgcgcgagccgctccgcatagctgtcggccccggccggatcctcgttccagggcggggccgcgaacgcccgcgcgtacacgtcgcggattccgtcggcgtaccgattcagctcccgggcctccaccgttcgtacctcgaccgtcatcacaccgtccctcggatttcgccggtgatccaccgtcggatcaccggggcgccaccggcgcagcgaggaaaccttaggggtcaactgctgtaccgggcacaacccttcgcccggcaggcccgtctgaaggggtgcgagtggccactcgatccgacccctttccgatccagccacgcacgccacggcgttacggggacagcgctttccggccgtcccgcagcgccgtcgcggcgaacgtcccagcagaaggagtccccgtgacatcccgagcactcggtaccggtgtcgtcctggccgtcaccctggccgccgcggtcgtcgccctgcccgcagcggccctgcccgcgccggctcccgacccccacggcccccgcgccgacttcaacggcgacgggtatccggacctcgcgttcgccgcgcccggtgcgaccgtcaaggggttcaaggacgccggatacgtcggcgtggcctacggctcccgcaacgggatcaaggactcagccaagcgggtgttcacccaggcctcggcgggagttcccggcaccccggaggcaggtgacgccttcggcagcgcggtcgcctccgccgatctcgaccaggacggctacgcggacctggtcgtcggttcgcagggcgagaagatcggagcggccgagagcgcgggcggtggcgtgaccgtcctgtggggtgggccgggcggtctggccggcccaccccacatgctgaccggcgaggagtacgacggcctgggccggtggctggccgtcgtac

SEQ ID NO: 3405 - DNA, 873 bp, Unknown
  Kingdom: Bacteria, Phylum: Actinobacteria, Class: Actinobacteria, Order: Streptomycetales, Family: Streptomycetaceae, Genus: Streptomyces
tacgggtcaacccgaccggcacgtcctggctcgccacggcgggcagcggtgacgtgctctccggtctcacggggtccctgctcgcggccggactcgctccgcgcgacgccgcgtccgtgggcgcgtatctgcacgggctcgccgcccggcacggttcggacggggccccggtctccgcgcaggacgtcgcggacggcatccaggccgcctggcgcgacgtgcgggccggctgaaccggggcaagggtggaagcaccggagtggaagggcggtcggcagaggtgagccagagcgaacccgtacgcgtacgcagggtctacgacccgccggaggacggcgacggcacccgggtcctcgtcgaccggctctggccccggggcgtctccaaggagcgggccgcgatcgacgtgtggctgaaggacatcaccccctcggacgaactgcgctcctggtaccaccaggagcgctccggcgcgcgccacgacgtcttcgtcgagcgctaccgcaccgaactggacgactcggcgcacacggaggccgtcgagcggctcgtcggcctggtgcgcgagggcggtcccgtcacgctgatcaccgccgtcaaggacgtggccgacagccatgtcccggtcctggtcgaccacctgacccatgtgatgaaacgtacgtaacgtacataaggccggatatcggcgtgcactgccggggaggcggccgacgcctctgagagactgggcgcgatgaacgagacagcgtccctgagagcccgtgccgagatcgacctcgccgcgctgcgcgccaacgtgcgcgtcctgcgcgagcgtgcggccggggcgcagctcatggccgtggtgaagtccgacggttacgggcacgg

SEQ ID NO: 3406 - DNA, 1693 bp, Unknown
  Kingdom: Bacteria, Phylum: Actinobacteria, Class: Actinobacteria, Order: Streptomycetales, Family: Streptomycetaceae, Genus: Streptomyces
ccgccaccccctccggggggacccgcacccggcccggacgcggcggagatcagcccccgcaaggtccgcatggtcttcctcgggctgatgctcaccctgctgctcgcggcgctcgaccagatgatcgtcgccaccgccctgccgaagatcgtcggtgagctgcacggcctggagaagatgtcctgggcggtcaccgcctaccttctcgcctccaccatcgtcctgccgctctacggcaagctcggcgacctcttcggccgcaagggcatcttccagttcgccatcgtcgtcttcatcatcggctccgcgctggcgggctggtcacgcaccatggacgagctgatcgccttccgcgccgtccagggcatcggcggcggcggcctcatgatcggcgtccaggcgatcatcgcggacatcgtgccggcccgggagcgcggccgctacatgggcctcatcggcgcggtcttcggcctcgcctcggtcgccggccccctgctcggcgggttcttcaccgaccacgcctcctggcgctggtgcttctacatcaacgtccccttcggcctggtcaccctggccgtgatcgccgtcgtcctcaaactgcccaggcccgccgtccggccccggctcgacgtcctgggcgcggtgctcctggccgtcgcctccacctgtctggtgctggtcaccagctggggcggcaccgagtacgcctggggctcgcgcaccatcctggggctcgcggcgggcgcggtcgtcacgacggtgctgttcgtcgccgccgaacaccgggccgcagaaccgatcattccgctgcggctgttccgcgactccgtcttcaacgtcaccggcctggtcggcgcggtcgtcggcatcgcgctcttcggggccgccagttacctccccacctacctccagatggtcgacggggccagcgccaccgaatccggcctgttgatgctcccgatgatgatgggcatcgtcggcggttccatcgtctccggacagctcatcacccgcaccggccgctaccggatctacccgatcctcggcagcgccgtctcggtggtcggcatgtggctgctgtccctgctggaggcggacacctcccccctggcgtacagcttctaccaggccgtcctcggcatcggcatcggactggtcatgtccgtcctcgtgctcgccgtgcagaattccgtacgcccctcggacctcggcaccgccaccagtgccaacaactacttccggcagatcggcggcagcgtcggcgcggcgatcttcggcacgctgttcgccggacggctctccgacgccctcggcgtacggctgcccgccggcgcggagctgcccgaccccgagtcgatcacgccgcagatcgtccacgcgatggagcccgcactgcgcgacgcctacatccaggcgtacgtcgacgcgatgccgcgcatcttcctctacctcgtgccggtgctcgtgctcggcctgatcctcgccttcttcctcaaggagaaaccgctggtgtcccaccacagccccgaagccgccgccgggaccacgccctcccggattcccgccgcccgtgccgactccggccggcccacctccggctacctctccggggtcccggtccacgggagcgtccagcaccccgacggcacctccgtcccccgcgccgccctcaccctcatcgacgtccaggggc

SEQ ID NO: 3407 - DNA, 1324 bp, Unknown
  Kingdom: Bacteria, Phylum: Actinobacteria, Class: Actinobacteria, Order: Streptomycetales, Family: Streptomycetaceae, Genus: Streptomyces
gagcggaccgtcgtcggctccctgccaggggtcggcctgcccggtcgtacggtggacggcgtcctgcgccccctgctcacggccctgctcagcgatcccgccctcaccacgtcgagccggcgtgccgatctcgccctgcgggactacgcacgcggcggcctgtgcgtaccggcgggcgggtcgtccacgctgccggagctgctggcggcctccctgccgccgggcacggtccggaccggggtgcatgtgacggccgccgacatcacctccgtacgcaccaaggagcacggcgaaatggggtgccgctccctgctgctggcgaccggagcgggggccgcggccgagctgctgcccggtctgcgggtgccgtccttccatccggtgacggtccttcaccacaccgcgcccgctccgccgccggcgggcaggtcgctggtgctggacggcgaccggtcgggcccggtggcgtacaccgcggtgatgagcgaggtcgacccctcgcgggcgccggagggccggacgctgatcacctcgacggtgctcggctccccgccgccggacctggaccgctcggtgcgggtgcatctggcggcgctgtacggcgtgccgacggacggctgggagctgctggcggcccatcacgacccggaggcggtgcccgcgatggaggccccgcacgatccacgccgcccggtgcgggtgctggccgggctgtacgtgtgcggcgaccaccgggacacgagcacggtccagggcgcgctgcactcgggccggcgggcggcggaggcgatcctcaccgacctggccgtcccgggggcgcacggggggagtccgcggctgccggaggcggcgtgagccccggcccgggttccgcaggggtcggccccgtgtccgcggaggtcagccgagggcggcgacccggtcgcggtagccgcgtacggcgaccgcgtcccggtagggctccagactgcgctcgaaggcgcgtacgtactccgtggcgcgtaccgagcgcatctcggccgcctgctgggccgcctcagcgcccagcaggcaggcctggtccaactcgcccaggcccagccgggccgaggcgaggaccacccggcagaacagcctgctgcgggcgtacgccggtgcgcgcagctggagcgaccgctcggcgtgctgggcggcggcccggtactgctggaggtcccggtggcagtggcccagttcgtcggcgagctgcgcctcgtcgaaggtgcgggcccagtgcggcacctcgtcgccgggccgtgcggtctccagggcgtgttcggcccgggtcagtgcggcggtgcaggag

SEQ ID NO: 3408 - DNA, 9184 bp, Unknown
  Kingdom: Bacteria, Phylum: Actinobacteria, Class: Actinobacteria, Order: Streptomycetales, Family: Streptomycetaceae, Genus: Streptomyces
gcttcggcggcgggggaggtctcggcgacgtcttcggcgggctgttcaaccgcggcggcgcgggcacccgtgtccagccgcggcgcggccaggacatcgagtccgaggtgacgctcagcttcaccgaggcggtcgacggggccacggtcccgctgcggatgtccagccaggctccctgcaaggcgtgttccggcaccggcgacaagaacggcacccccagggtctgcccgacctgtgtcggcaccggccaggtctcgcgcggcagcggcggcggcttctcgctcaccgacccctgtgtggactgcaagggccggggcctcatcgcccaggacccctgtgaggtctgcaagggaagcggccgggcgaagtcggcgcacacgatgcaggtgaggattccggcgggcgtctccgacggccagcggatccggctgcgcggcaagggcggtgcgggcgaacgcggcggtccggccggcgacctctacgtcgtcgtccacgtcgacgcccacccggtcttcggccgcaagggcgacaacctcacggtcaccgtgcccgtcaccttcgcggaggcgacgctcggcggcgaggtcaaggtccccacgctcggcggccccccggtcaccctgaagcttcccgccggcacccccaacgggcgtacgatgcgcgcccggggcaagggcgcggtgcgcaaggacggcacccgtggcgacctgttggtcaccgtggaggtcgcggttcccagggacctgggccaggaggccagggacgccctggaggcctaccggaaggcgaccgcggacgaggacccgcgggcggaactgttccaggctgcgaagggagcttgagatggacggccgtcgacgcaatccgtaccagctgaccgatgagacaccggtgtacgtgatctcgatcgcggcccagctctcgggcctgcacccgcagacactgcgtcagtacgaccgtctcggcctggtctccccggaccgtacggccgggcgcggccggcgctactcggcccgcgacatcgagctgctgcgcaccgtgcagcagctgtcgcaggacgagggcatcaacctcgccggcatcaagcggatcatcgagctggagaaccaggtcgcggccctccagcagcgcgtcgccgagctctcggcggcggtggacggcgcggcggtcgccatgcagcagcgcgaggcccaggtgcacgcctcgtaccgccgggacctggtgccgtaccaggacgtgcagcagaccagcgcgctggtggtctggcggccgaagccgaagcggccgacggactaggaagcggccggcgggcccttcgtacggctcgctgcggcttacggggcccgtcgtatgcccgaaggggccgggagagcgttcagccgctctcccggccccttcgcgtgtgcccagggggttacggcagggcggtgctgatcgcgtcgaccgccatcatccacatcggctggccgccggtgccgaacgcggcggccagcgtgtagccgatcgccgcgtcggccggctcgacggctgccccggaccgccactcggcgatcacccgccggtcgccgtccgaggagaagtccccgatgtgcttgccgtcgcgggccagccggctgctcgggatggagtcgggcaccagccggtaggacgtaccggcgcagcggacgtcgacccggtaggagcggcggcggagtctccccttgccgggcgtgatcgtcgcttcccggccgtccacggtgagcgtgaggtggcgggggtcgcgggtgccgatgacgatgtggtcgtcgacctccgcgccgggtgcgcgggtgaggacgacgcgggggatccgctcgccgctcacgacgagcatctcgcggtgctcgcccgcgagttcgaccaggatgtccccgtggtggtcgtcctcggcggcggcgggtatgggggtggtgtcggtcatccggtcttcgtggtccttcggtcgcggggcgggaacgcgtcaggtcggtcaggcctgatgtgcggaattctcgcaggtggcgggggagttcaggagttcaccgcccacacgtcggatgcccgctccggtccgtcccggtcacgctcccggctcggggccgagcgcgtgatcggggcctgattccaggattccggatcgtgcgatcaggtagccgagttgagcccggctgttgctgccgagcgcgacgctgagcttcgcgatgtgcgaccggcaggtgcgtacgttcatgccgaggcggcgcgcgatcgcctcgtcgacatggccctcgacgagcagtttggcgatcgaatgccttaccccggaaatgccgtccgtcctggagtcgtacggaatctgttcctgaagaggcaccgcgcggtgccagaactgctcgaagaccttggcgaggtactccacgatgccggggtgccgcagctcaagggctacggtgcggtcgtcggtggccggtatgaaggcgacggtgcggtcgaaaatcatgagccgctctatcagctcttcgagcgtgcggatctcgaccttgctctcggccatccgggccgcgtaattgagggttccatggctgtggcggacggtgtgctgatacagcgtgcgcatgccgacgccacgttccgtgagcatcttgccgcgttccatggcaatggtgagcgcgttctcgctgcgtccgccgcccggctgaatggtgaggacttccgaacggcactcggcgagggcgagttctatcgaggcgttgatacggccgatgccttcgagaaccgtaatcgcgtgggtggtcggcggagcctgggcgctgatcgccatgaagggttcgaacacctcggtgagctccaccgagaggcgccttcgctcctggatctcccgctcgatcggatgaagccgctgggtgagtgccgcggacggcggcaccggccgcagccagttggggtcgtcgggatcgggatgcagcagggcgaattccagcagacacggggcgtcctccgcctcgacgcgagctattttgcccacactcagcgcactggcgtagagccgtgctccctcgtcacacaaggcactaaccgagtggggatgtgccgctttggtgttgtctgtggtcaattctccaccccccaggaacatgaatcagcaggaacatgatgcatcgcttctgtggcgttgacgtgcctggatgagccatcgtcttgttctgcgggggagaggaaaccttggaagtgaggacgaagcccatcatgagttacaaaacgcttcgctcggtgcttgctgttgccttctccgttgggctgacgaccggggcgctgagtgttcttgacctcgttgagggcggcgtgacccacggttcggccggcgcacaggtgcaggccgctccgcctccggacctggcctgggacctgatgcccgcacggacgacgggagcggaagcagcacccgaatcgctgtcggagagcacgcctgccgcacagggccgggcatgagtaccccgccggacgaccgcaccttccggcgcgagatggcgaccgcctatcgctcagggtggcatttcatcgatctgctcacggcactcccccgccgtggcgactcgttgatggtcaccctgttcggagagccgatcgtcgtggtgatggaagaggacgaggacgtccgcgcctatcgctgtctccgtcggccgcggggtgcgccgcagccggtccgctgtgccgtcaggtacggcatgatcttcgtcaatctcgatcagcgggaccatgagctgttcgacgcagaaccactttccgccaccccccgcagtgcctgagcgattcccccgtcgtcacctatcgctccggcgcttcccccacacagcggcgccaccgtgacctgaacacggtggcgccgttgtgctgttcccgtacgggtgcggtgtccgggctcggtcaggccttgccgagcgcccggtcgagggtgatctcgatgacgacccgggtcgggttgatccgcggggcgcggccgtagcgcgcctcgtggcgggcctccgcgtccgcgaccacctccggctccgtgcggatgaccgcgaggccctccagggtcgcccagcgggccctgtcgatctggcagacggccacgcgtgccccgccggggcctgcggcccggatgtgggcgaccttgcggctgcctccgtcggtgatcacgcgcgccacccgggcctccgggtcgtacgtcacgcacaccggcaccacgtgcggcgtgccgtccgggcggggggtcgtcagggtggagaggtggctctcgcgccagaacgcgacgtatgcgggagcggggtcgtgtacgtctgccatgggggcagcgtacgaggccggtccccgggtactcgtgcgcgccccgggtgcccgcggcgcgtgcgcccatcgccttgagtggaatagactcaactttgtgcacgttgattaagtcaacgcatgactgacgcactcacgcgtgacccaccagctgcgaggaggagtgaccacacgtggacgccgagctgaccaacaagagccgggacgccatcaacgcggccaccagcagggccgtgaaggacgggcacgccgatctcacgccggggcatctgctgctcgcgctgctggagggccaggacaacgagaacatcgtcgacctgctcgccgccgtcgaggccgaccaggccgtggtgcggagcgagaccgagcggctgctcgcggggctgcccagcgtcaccggttccaccgtcgccccgccggctcccaaccgcgagctgctggccgtcatccaggacgccgcccagcgggccaaggagctgggtgacgactacatctccaccgagcacctgctgatcggcatcgcggccaagggcggccgtgcgggtgagatcctcgacgggcagggcgccggcgccaggaagctgctggccgcattcgagacgagcaggggagggcgccgggtgaccacacccgacccggagggccagtacaaggccctggagaagttcggcaccgacttcacggccgccgcgcgcgagggcaagctggatccggtcatcggccgcgaccaggagatccgccgcgtcgtgcaggtgctgtcccgccggacgaagaacaacccggtcctgatcggtgagcccggcgtcggcaagaccgccgtcgtcgaagggctcgcccagcgcatcgtcaagggcgacgttcccgagagcctgaagaacaagcggctggtctccctggacctcggcgcgatggtcgccggcgcgaagtaccgcggtgagttcgaggagcgcctgaagaccgtcctctccgagatcaaggagagcgacggccggatcatcacgttcatcgacgagctgcacaccgtcgtcggcgcgggcgccggcggcgactccgccatggacgcgggcaacatgctcaagccgatgctggcccgcggcgagctgcgcatggtcggcgcgacgacgctcgacgagtaccgcgagcgcatcgagaaggaccccgctctggagcggcgcttccagcaggtgctggtcgccgagccctccgtcgaggacaccatcgcgatcctgcgcgggctcaagggccgctacgaggcccaccacaaggtgcagatcgcggactcggcgctggtggccgccgccactctctccgaccgctacatcacctcccgcttcctccccgacaaggccatcgacctggtcgacgaggccgcctcccggctccgtatggagatcgactcctcacccctggagatcgacgaactccagcgctccgtcgaccggttgcgcatggaggagctggcactcaagaacgagtccgaccccgcctccaagcagcgcctggagaagctgcgccgcgacctcgcggacaaggaggaggagctgcgcggcctcaacgcccgctgggagaaggagaagcagggcctcaaccgggtcggtgagctgaaggagcgcctcgacgagctgcggggccaggccgaacgcgcccagcgcgacggcgacttcgacgccgcctccaagctgctgtacggggagatcccgggcctggagcgggagttggaggaggccgccgaggcggagcaggaagcctccaaggacaccatggtcaaggaggaggtcggcccggacgacatcgcggacgtcgtcggcgcctggaccggcatcccggccggccggctgctggagggcgagacccagaagctgctgcggatggagtccgagctgggcaagcggctgatcgggcagagcgaggccgtgcaggcggtgtccgacgccgtgcgccgcacgagggccgggatcgcggatcccgaccggcccaccgggtcgttcctcttcctcggtcccaccggcgtcggcaagaccgagctggccaaggcgctcgcggacttcctgttcgacgacgagcgggccatgatccgcatcgacatgagcgagtacggcgagaagcacagcgtcgcccgtctcgtcggcgccccgcccggctacgtcggctacgaggagggcggccagctcaccgaggccgtccgccgccgcccgtacagcgtcgtgctgctggacgaggtcgagaaggcccaccccgaggtcttcgacgtcctgctccaggtcctcgacgacggccggctcaccgacggccagggccgcacggtcgacttccgcaacaccatcctcgtcctcacctccaacctcggcagccagttcctgatggaccccctggtcaagcccgaggtcaagaagcagcaggtgctggacgtggtgcgggcctccttcaagccggagttcatcaaccggctcgacgacctggtggtcttctccgccctgtccggcgacgagctcgcgcacatcgccggactccagatcgaccggctggcgaagcgcctggccgaccgcaggctcaccctggaggtctcgccggaggcgctggcctggctcgccgaggagggcaacgaccccgcgtacggcgcgcggccgctgcgccggctcatccagacggcgatcggcgaccggctcgccaaggagatcctgtccggcgaggtccgcgacggtgacaccgtacgggtggagcgggtcggggacgggctgatcgtcggccccgccgcgtagcgacctcacccgaggccgtggccgccggtcacggagtgtcgcagtccgtcggtgcctgtccggtccgtgcccggcgggtcacgtccccacgcgctgtctgtcagcttgtggcggatcggggccgcccgggcttgccatgccccgcccgccatgggagaggatggccgtactcgtcacgaagggaaataacggtgagcatcgatccgtcctcgattcctaatttcgggggccagcccgaaccgcaggcggcaggaccggagggccccgtcgtccctgaccaggacctcgtcaagcagctcctcgaccagatggagctgaagtacgtcgtcgacgacgagggcgacctcgccgcgccgtgggaagagttccggacgtacttcatgttccggggcgaggacgagcagcaggtcttctcggtccgcacgttctacgaccgtccccacgacctcgaccagcgtcccgtcctgctggacgccatcgacgactggaaccgccgcacgctgtggcccaaggtctacacccacgcccacgagggcgaggagggcgaggcgggttccgtccggctgatcggtgaggcgcagatgctcatcggcaccggcgtcagcctggagcacttcgtctcctcgacggtgagctgggtccgtgcctcgatcgagttcgacaagtggctcgtcgagcgcctcggcatcgagcccgccgaggacaagacggagggcgaggagcccgcgggcgcctagtcgcgtcccgtcgcgttcgtcgcgtggaacggcccgggaagcggtcaccatgaccgcttcccgggccgtccgcgtactcagcccagccgcgccagccgctccaccgcctcctccaggacctcgtccttcttgcagaaggtgaaacggacctggctgcgacccgcctccgggtcgtcgtagaagaccgagttcggcacggccgccactccgcagcgctccgggagcgcgcggcagaaggcccccgcgtcctcgtcgccgaacggggagatgtcggtggtgatgaagtacgtcccctccggctcgtacacccggaagcccgcggcgcgcagtcccttcgccagcaggtcccgcttgcggcgcatgtcttcgcggaagtcggtgaagaaggcgtcgggcagggcgagcgcctcggcgaccgcgtactggaacgggcctccgctcacgaaggtcagatactgcttcgccgcacgcacggcggccaccagcggcgcgtccccggtgacccagccgatcttccaccccgtgtacgagaacgtcttccccgacgaggagatggagaccgtgcgcccgcgcatcccgggcagggcggcgatcgggtggtgcgcccccgcgaagaccaggtgctcgtacacctcgtcggtgaccaccagcagatcgtgctccaccgcgagggccgcgatcccggccagctcgtcgggggtgagcaccgacccggtcgggttgtgcggggtgttcaggagcaggaggcgggtgcgcggggtgatcagggtgcgcagttcgtcgaggtccgggcggaacgacggcgcgcgcagggtgagcggtacgcgcttcgcgcccgccatggcgatgcaggcggcgtacgagtcgtagtacggctcgaacgcgatgacctcgtcgcccggttcgaggagggcgagcagggaggcggcgatggcctcggtggcgccggtcgtcacgaggacctccgtctccggggaccaggtcaggccgtagaagcgttcctggtgggcggcgacggcggtgcgcagctccgggacgccggggcccggcgggtactggttgccgtggccggcgcgcagcgcccggaccgccgcctcccggatctcctcggggccgtcggtgtcgggaaagccctggccgaggttgatggagccggtccgtacggccagcgcggacatctccgcgaagatcgtcgtgccgaacgcggcgaggcggcggttgagcagcggccgcccctccgccggggttccctgggtcgctcgtccctgtgtcatgggcgccatcctgggccgaagctctggagttgctcaagtcggctttggcacgcggaggcggggggaatccccctgtcacacaacaacggggaagcggcgggggacctcgctt

SEQ ID NO: 3409 - DNA, 5240 bp, Unknown
  Kingdom: Bacteria, Phylum: Actinobacteria, Class: Actinobacteria, Order: Streptomycetales, Family: Streptomycetaceae, Genus: Streptomyces
  misc_feature (144)..(166): n is a, c, g, or t
ccgccgcgcagttccaggctcccggccagcgtccaggggccgacggcctggaccttgagcaggccctcgtacccctgggtgaactcctccagggcgtccaggtcctcccccagccaggagcgagcgcggcgggtgtcgcggccnnnnnnnnnnnnnnnnnnnnnnngcccgcgcgcgggcagttccgccaggtacggcatgccccggccgtcggcgaaggacccggtgacggtcttcgccgcctccctcgcgtctcccccgggcatcgacccgatgccggtcgccggacacccgctgaacttactcttctcgctcacgcgggaagcctacggtccgcggcgggcaacctgctcctcgggacgtcagcggccggggcggacggtgaggtcgttgacctcggcgtcgcgcggcaggtcgatcgccatcaggatcgtggtggccaccgactcggggtcgatccagcgggccgcgtcgtactccttgccctcctgctggtgcaccttggcctgcatggggctggcggtgcggccggggtagacggtggtgacgcgcaccccgttgccgtgctcctcgtggcgcagcgagtcggcgagcgccttgaggccgtgcttgctcgcggcgtacgcgctccatcccgcgtgggcggccagtcctgccccggagttcacgaacagcacctggccctgggagacgcggagctgcggaagcaggaggcgggtgatctcggcgggggcgatcaggttggcgttgagctggaagtgccaggccttgggggtgagctcgccgacttcgccgagctcgacgactcccgcgatgtgcagcagggtgtcgatccgctcgggcatggactgctggccgaacgcccaggacagccggtcggggttggcgaggtcgccgaccagggtgcgcgcgcccgggtagcggtcggcgaactccttggcgcggccggcgtcgcgggcgagcaggacgacgtcgtcgccgcgctcctggagacggcgggcgacagcggccccgatgccggaacctgcgccggtgatgaggtgggtagccatggggcgatcctaggcggaaccgtgatcaccgggcccggcggacgccctcctcactggtgaccggcggactcctccaggtaggcgagcgcgccgacgccgtccttggcgaagaagaccaggtcggtcaggggaacgggcaggaagccctcgtcctccatgcgctggaactgctggcggagcccgtcgtagaagcccgccgtgttcagcaggacgaccggcttggtgtgcttgccgtgcttcttcagctccaggatctcggtggcctcgtcgagcgtcccggtcccgccgaccatgatcacgacggcgtcggccttctccaggaggagcgccttgcgctccgcgaggtcgcgggcgatcaccatctcgtcggcgttctccctggccttcgcggcgaggaagtcgaccgatacgcccacgagccgcccgcccgccgcctgcactccgtccgcgacgaccttcatcaggccactctccgatccaccccagacgagggtgtgcccgcccctgccgagcagctcggcgaactcgcgggcgggcacggtgtagcggtcgtcgaggtcggcggcggagaggaagacgcagatgttcatgggccaaccgtacgacccgtctcggacactcccccgtccgctccctcgttccgggaagaattccggccacagccgagagccggggaagattacggtcccgcacaccgctggaacaggtatgaccgccacgcgaggacaccgcatcaccgtcgagccggggaccgagcacgtccgggtggtgcacgacggacaccttctggccgagagccgccgcccgctcgtgctccgcgagaccggctgcccggtccgctactacctgccgcccgaggacgtccgcaccgatctgctcgacccgtcggacacctccacccactgcccgttcaagggggacgcctcctactggtcgcggcccggggccgccgatctcgtctgggcctacccggacccgaagcccgaagtcgccgccatcaaggaccacttctgcttctacgccacggaaacggtgccggtcgacccggaaacctccccggagaccgcaccgggaacaccggccggctgaccgcccgttcaccctcccagaaattttcttccgccggaacgatgagttttccggaccgccccggtctcctctcccatggacaggattctctccgccgacggcacgccgatcgcctaccgacgccagggcgagggcccgccgctggtgctggtcggcggggcgctgagcgcctcggcggccgacgcgccgctggccgccctgctcgcgccgcgcttcacggtgctcacctacgaccgccggggccggggcgccagcggtgacgccgggcgctgctccgtggcgcgggaggtcgaggatctggccgccgtcgtcggagccgccgggacgggtgcgtcggtcttcgggatgtcgtcgggcggggcgctggccctggaggcggtcgccgccgggctgccggtggaactgctcgcggtgtacgagccgccctatacgccgggcgcttcgggtctgctgttcaaggcccgctgcacggcccggctgcaccggttgttggcggccggggaccggggcggggcggtggagctgttcctgtccatgacgggcgtcgcggaggagacggccgtccgcatgcggcgcaccccgaggtgggcggagctggaggcgatggcgcacacgctggcgtacgacgacgccctgctgggcgacggggcggtcccggtcgagcggttcgcggctgtcgccgcccggacgctggtgatctgcggcggcttcagcagcgccccggcgcgcgcggcgacccggaccctggccgaggccctgccgcgcggccggcaccgcacgctgaccggccagatgcgcgaggtggcgccccaggtgctcgcccccgtgctggcggacttcttcgccagggacgtgtacgcgtaccggcaggcgtcgtagcctcagccgcccgtcgccacccgctcgcggcggaccgtcgtcgcgatggtggccgagccgaccacacgtgtgccgtcgtacaggacgaccgcctggccgggggccacgccccggaccggctcggtgaaggtgacgatcagctcggagccgtccaccagctcggccgtgacctcggtctcgccgccgtgggcgcgcagctgggcggtgtatgtacccgggccggacgggggcgttccgcaccagcgcggcttgatggcggtcagcgaggtcacgtcgagggcctcgacggggccgaccgtgacggtgttgttcaccggggagatgtcgagcacgtagcgcggcttgccgtcgggggccgggtggccgatcttcaggcccttgcgctggccgatggtgaaaccgaacgcaccctcgtgggtgcccagcttcgcaccggactcgtcgaggatgtcgccctcggccgggccgccgaggcggttcgccaggaaaccctgggtgtctccgtcggcgatgaagcagatgtcgtggctgtcgggcttcttggcgacggccaggccccggcgctcggcctcggcgcggatctcgtccttggtggtgagggtgtcgccgagcgggaacatggcgtgggcgagctgcttctcgtccaggacgccgagcacatagctctggtccttggccatgtcggaggcgcggtgcagctcacggctgccgtcctcggtgagcacgacggtggcgtagtggccggtgcacacggcgtcgaagccgagggcgagggccttgtcgagcagcgcggcgaacttgatcttctcgttgcagcgcaggcaggggttgggcgtgcgcccggcctcgtactccgcgacgaagtcctcgacgacgtcctcgcggaagcgttccgccaggtcccagacgtagaacgggataccgatgacgtcggccgcgcggcgggcgtcccgggagtcctcgatggtgcaacacccgcgcgccccggtcctgaaggactgagggttcgcggacagggcgaggtggacaccggtcacgtcgtggcccgcctcggcggcgcgggccgcggcgacggcggagtccacgccgcccgacatcgcggcgaggacacgcagggggcgctggggagtctgagtcatagctcctccagggtacgggtctccgggaaccgaacgctcgcggatatgcgttgacgatcacatggggaacaacgggagcactcggggtgcgggaaagccttcgggaaagtccgcgggctcgtcttcacggaagaagccggcggacggcgtcagccggcgcgcactgctgatcggcggcggtgcggtggcggccgccggtaccgccgccgtgctcgcgcgcgaccgggtgaagcacctgtggtggcaggtgcccggggtccataaaccccgtaagccgggtgagctggactacgcgggggcgacctgggtggccgcctcggaggcgaactggcggcgcgcggaccgccccgacgacttccccgtcgaccgggtgatcatccatgtcacccagggcagcttcgacagcgcggtgaaggtgttccaggaccccgcgcaccaggccgcgacgcactacatcgtggggcaggacgggcgggtggtgcagatgatccgcgagctggacgtggcgtaccaggccggcaaccgctcgtacaacgagcgcggcgtcggcatcgagcacgaggggttcgtggaccggcccaaggacctcacgaaggcgatgtacgagtcctccgcgcggctcacggcgtcgatctgcgcgcggcacgacatacccgtcgaccgggagcacatcatcgggcacgtggaggtgccgggcaccgaccacacggatccggggccgcactgggactgggaccggtacatggaactggtgcgccgggccgcgacggcacccacacctacgcccacgccttcggcgaaggcgtccgggtgacggtcggcaccccccggaccacgggcgtccggccgaggcccgccgtcagctgagcccggccgtcctcgcccgctccaccgccgggccgatcgcctcggccagcgccttcacgtcgtcctcggtcgaggtgtggccgagcgagaagcgcagggtgccccgggccaggtccggatcggtgccggtggcgagcaggacgtggctgggctgggcgatcccggcggtgcacgcggagccggtggagcactcgatgccctgggcgtccagcag

SEQ ID NO: 3410 - DNA, 2771 bp, Unknown
  Kingdom: Bacteria, Phylum: Actinobacteria, Class: Actinobacteria, Order: Streptomycetales, Family: Streptomycetaceae, Genus: Streptomyces
cgcacggaccgacgcacggatctccgcacacgcctcggcccggaccggcacagagggctccgcacgggccgacggtggggtgccgacggcggcccccgtggcggtcggcttcctcgacggtcccgtgctgcgcgtgaccaccgcgcccgacgccgacctcggggcgctcgcggcggacgccgaggacctgctcgtacccggcaccgacgcgaccgacggcctgcccgtacccggttgggaaccggacacggaggagccctggctcgtcttctcctggagcccggagccggtgtcgagccgcgccgtacaggtcaccgagtccgacgcggccgaccgggcgtcggtgcaccgggccgccttcgcgggatccacgttgaccgccgaccactggcgcacgatgaagaagtcccccgccggtcacctcgccgtggagacgctcgtccgcacacccgccggggaacccgcggccgccgcgaccggctggttcgggggcacgggaaggtgcggactgctcgaaccggtcggcacccacgcggaccaccgaggccacggctacgggcgcgacgccgtacggggcgcgtgcgcggccctcgccgaccggggcgcgagcgcggtggccgttctcacgccggccagtaacgaggcggcggtggcgctctaccgatcggccggattcaccgtcgtacgcgagaaccacgactggacgcgccccggcggggtgtgaacacagccgactccggctccggctccgggtccggactgcccactcaccccagccggctcccgaagcggaccgccgacggcgtcacgcccaggctcgactcgccgaaggagacgctgcccttcgtgaccgggcccgtgcggctgcccttgaggagccagacgccgccctggccggtgttctcgccgggggcggccagggccagtgtggccggtacgcccttggccggggccaccacgtggacctcgccgccgaacgcgtcgccctgctcgtcgacgccggggatgttcgccgtggactggccgatcaccttcgtgtcggcccccgtgatgccggaggcgcggcccttgaagaccaggacgccgccggcgtcctgggccgtgcccacgtcctcgcccggcaggcccacgacgacctcgccgtagccgtcgccgtccaggtctcccaccgcggcgctcgcgcccatggcgtcgcccggctcgtcggcgcccggcacgcctgcggtggcctgggtgatccacttcggcttcacggcggtgttctggcccttggggcctccgaggacgaccgccaccgcaccacccttgctcgggaagtccaggtcgctgtccatgccggtgggccggcgggtgaagaccaggtccgggtacgcgtcgccgttgaccgaaccgaccgtcaccgtggagtgctccaggtacgtccccggcgcggtgacgatgggcgtgtacgtgaagcccgtgcccgtcgacaggtacagcgaccgcccgccgcagtccggctcgtcgttgcagccgctgctcaccagcaggtcgtccttgccgtcgttgttcatgtccacggcctgcacgccctcgtagacggtgacgccgttgtccgcggtgagtgccgtgcgggtgccgcccaccgagccgtccgcgccgatgttctcgtccaggacgaccttcccctcccattcggtgctgtcgatcccggccgcgtccgtccggccgtcgccgtcgaagtcgcccagcgcgtacccctggccctggtactcgacggcccgggtgccgaggccgctcctgccgccgaacagaatgacctgcggcccgttgccggccgagaccagcaggtcggtgtaaccgtcgcggtcgatgtcggcgggcgttcccgcgccgaagcgggcgttcgccgcggccgtgccggggacgccggaggtgttctggttgatcacctggtgccgggccggaccgatgcccttcgcgtcgcccgggtagaccaccaggtacccggccttcttgaggccggacacggtcccgtcgggcaccgaggcgtacatgtcctcgtatccgtccccgttgaagtcgacctgctgccgagcggccgtggccggtgcggccgccaccgccgtaccggagaaggccggtacggcggccgtcgtggccgcgagcgtcacgaagatcgccgaagcggttcggagtcgagaagtcttcatcggtcggtcatccccctgttgtgcacgtgctcagcgctcatgtgcttaggaagaccatccgtacggcgaatggttgcccgctccgctgcactccggacccgatcctcatgcgtacgaggctggccccagcgccatcttcttgcgttatgagcaacatcgcatgcagtagacgcaaggccccgtacgctcgatggcatggctcacgcacaccagcaccagcacggacctgcggcggcgcactcctcgtcggccaacgcccacgtccatgcccccgcccatacccatgactccgatgcgacgccgaacggtctcgccgagatcctcgacctcgacgccgccctcttcgcaccccacctgaccgcgctcaccgggcgtatcgcctgtctggccggtgacgacgtccggaacatcgtcgacctcggctcgggcaccgggaccggcacgttcgccctgctggagcggttcccgaccgcccgggtgaccgctgtcgacagctcccccgcgatgctggagcggctcgtctcggcggcccgggaccgtggtctcggcgatcgcgtgcacacgctggaggccgacgcc

SEQ ID NO: 3411 - DNA, 4720 bp, Unknown
  Kingdom: Bacteria, Phylum: Actinobacteria, Class: Actinobacteria, Order: Streptomycetales, Family: Streptomycetaceae, Genus: Streptomyces
  misc_feature (347)..(348): n is a, c, g, or t
ccgacgaggaccgcttcggcgcggagctgtacgacacactcaccaactggctcttcgccgatccggtcctcaccggccgttacccggacgagaacgtcgccgcgctgatgccgggcccggtcgccgacgacctcaaggtcatctccaccccgctcgactggtacggcgtgaactactacaaccccaccctcgtcggagcgcccaggccggaggcgctggacaccttctcgggcttcacgatgcccgccgaactccccttcggcataagggagatcgatggatacgagaagaccggcttcggctggcccgtcgtccccgagggactgaccgagatcgtcaccgccctnngtggacgtgcgcggctacttcacctggtcgctcaccgacaacgtggagtggacggagggtgcctcgcaacggttcggcctggtccacatcgactacgagacgctgacccgtacgcccaaacagtcctacggctggtaccgggacctgatccgcgcgcagaaggcgcagaagcggaatccggcggtcgagggggcttacgcggctccccccgaatgatcaatactcccgccatggtcgcttcatggtggtcccgggcccaactggggatcttcgttcactggacacccgcatccgttcccggctgggccccgccctacgtccccgccgccgaactgccggcggcgggccggcgcgcgccgctgggctggacctcgtacgcggagtggtacgagaacgcgctccgcttccccggctccccggtcgcagcccaccaccgtgccacctacggcgcacgctcctacacggacttcggccgcgacttcgaggacgggctcgccggctgggacccggccgcctgggcccgcgcgttccgcgaggcgggggccggatacgcggtcctggtcaccaagcaccacgacggtttctgcctctggccctcggagacgaagaacccgcaccgctccggctggcacaccacccgggacgtggtgggcgagttcgccgaagccgtacgggccgagggcctgcgcttcggcgtctactactccggcgggctcgactggaccttcgacgcccggcccatcggcaccgcggccgacatgttctccgccgtgccgcgcgggagctaccccgcctacgccgacgcgcagctgcgggagctgatccgccgctaccggcccgacatcctctggaacgacatcgcctggcccgcctccgccggcgagatccgttcactggtcgacttctaccgcttcaccgtcccgcacggtgtcgtcaacgaccgcctgctgccctacgccccgcactggcggggcctgaacctgccgggagcgaaggcgctgtacaactggtgggaccgccggacggtggcgcagggcgagggcttcgtcccgcgcacaccgcccgtcttcgatttccgcaccccggagtacgcccgctacgagggctccgacccgtacgagatcacccggggcgtcgaccacagcttcggctacaaccgggcctcgggggctgacgccttcatcggccgcgaagcactcacctcactggtccgcgacacggcggccgacggcgggaacgtcctgctcaacgtggggccgcgcggcgaggacgcgacgatccccgccgagcagcgcctccgcctggagtggctggccgaggaggccggagccctcacgccagatggacccattcctgggtgatcgggtatccggcgcgggcgaacgcggcggccatcggcacgttgccccggtccgtcgcagccgcgacgaactcggcgccctgttcgacgaggaagcgcgtgcactccaccagcaggtcgtagccgtagccgtgcccgcgcgcctcggggacgaccccgacgaagccgacgcagggccccgacgggttgtgcgcgggcacctgaatgcccgccacctcgccgtccggtgtgtacgcgagccgcaaccactccctcggcgaggggcaccagtggaagaagtccaactcctcccgggccgccgcatccaggcctccggggccctcgatggccttgcgggcgtgggcgtccagcgtggccgagtggacccggcgcaggacgtcgaggacgacctcgtcgtccggctccggacggaaagtgagccggcccgtccgctcgggcagcgggcagccgggggtccaccgatagcggtagcgctcgaccagcggcttcataccggccgccgtcgcggcggagatccgcgcctcgacggcggcccgcaccgccgggtcgtcccgccacccggcgggcgcgatcacctcgtactccttgtcgaacggggcccggcgcaggagttcggcgcccgcctccgcctccccgtccgcgaagtcgaaccagttgagcacgacgggctcggtgtcgtcgggcgctccccaccaggcggccctggcgatcacggtgtcctcgcgaagtgcgacccaggaccagtcgggacggtactcgccgccgtcggccgtcgaggtgtaaccgtggccgaaggcggcccggccgacgaaggggctgtcctggaacgtggtgaaaagtgcggcgtcgctcggggtgagcgcgcggatgaccagatcggtcatgaagatgtcctccgggacggaatgccgcgctcccggtcagacgaggtccgacaccgcccggcggacggggcgggagcgcgaaagtgacgtactgcggatggtggtgcggctgttcctgcgcacgtttctcgcctccttccacgaccggtgccgatgtcggtcccgaccgtagccgtccacgcgccccccgtccaccggttattcggggcgtgcccgggaccgcccctctctccgccgcctcacttctggcggcggctccggcgctgcaacgcctcgcggcgcttgcggagcgcggcctggcggcggtgggcgaccttgcgctcgcgcgcccggcgccggtcctcgggcgtgcggtgcttgcgcgggctgagccggacgaccatcgcgaggccgccgaacaccaggagcaccaggagcgcgacgagaacacccaggaccgtgatggcgaccggttcgtccgcccccagcgcctgccaggggttcaccgccccgccccgctttcttccgcgtcccagaccatgttgaacgcccgctcgaagttgacgtacccgagacgctcgaaggacttcgccatcggtacgttgccgaggtcggtcgccgcccggatccggtccacgccctcggccgccagcacccgggtgccctcggcgaggaggtcgtcgatgtacccgtggccgcgccgggcgggcagtatcccgatgtacgcgatgatcgggttgtagttgttgcgggccgggatgacgaagccgaccggttcaccggtgggcagttcggcgatccgccaccagcccatcggggtggagtatcccgccagctcctcgtcgtagtgcttctcggccgccttgcggacatcgagcccggacgccaggtccgcctgaccgtgggcgtccagggtgccctccatcaccggagccatcagcgcgagcaggtcctcccgcccggcgaccggacggaacaccagccggcccgagtcctcgggcaccggcgtaccggcccgccactccagccgcagccgctccaccagcatccgggccccggtctcctccatcacccggatccgcgcctcgacgacgtcccgggcgacggggtcctcgtgccagtccggcggcacgaaccgcccgtactcgggccgctccgcaccggcgggcagcacggccgccgtcgccgtctccagcagccggacgccgatcgtgacgcgctccgggaccggcagcgcgtcgtccaggtcgaagaaatccagcgccagcggcttgttgcccgccgcgtcggtccaccaggccgccctggcgacgacccgctccccgtccagagcgacccacatccactccgggacgcggcgcccggtggcgaggtcgtcggccagctcatggtcgagaacatacgaaaggccgcagaacaggtcgagttcatcgggcccggccagcggacggaccgtcaaccgaggcgggacagaggtcacagagtctcctcgtggtggatgagcggcagaccctagcaaggggccccgccggggagcggcgcaggtcagcgagggaggaaactcggcctcatctggacaccccgggcccctcggcccgacaatcgtcagcgtgacgtcctccttcgagttccacacgagtcccgcgcggctgtcggacgcccagcgcgaccgtgtcctcggcgtgctcagagacggtgcggcacagggcaagctgtcgcacgacaccttcatgcggcgcatggagctcgccctcgtcgcccggcgcccggaggagctggcggccctcaccgccgacctggaggccggcggcaactggtcccagggactggtccgcgcggtgggcgggatctccgccttccccgggcgactgcgccgcgcctggcagaccgagcggctccccaagctgctgctccccgcgcccggcccgtacccgctgctcatcggccgcgacccggccaacggactgcgcctcaaccacgagacggtctcccggctgcatgccgaactctccgcgcagaacggccgttgggtgctgcgcgacctcggctccaccaacggcacctgcgtcaacggccagcggctcgtcggctccatcccggtgcgggacggggaccaggtgagcttcggccggatgagcttccgcctcac

SEQ ID NO: 3412 - DNA, 7057 bp, Unknown
  Kingdom: Bacteria, Phylum: Actinobacteria, Class: Actinobacteria, Order: Streptomycetales, Family: Streptomycetaceae, Genus: Streptomyces
accggcaccccgcgccgcacccgcgtggcgaacgcaggttcggtgtgcggcgcggggtgccggtcaggggcgggagagagggcccgtctggtccgttccggcggtcacatcagtgagcttcgggaagaagctcaggcctgcagggaggcaaccttggacgccagcgccgacttcttgttggcggcggcgttcttgtggatgacacccttcgagacagccttgtcgagctgacgggaagcgtcgcggacggccgtggtggccttctcgacgtcaccggcggcggcggcctcgcgggccttgcggatcgcggtcttgagcgacgacttgacggccttgttgcgcaggcgcgccttctcgttggtcttgttccgcttgatctgggacttgatgttcgccacgaaagagccttttcaggttcgttggatcttctaggtgagcctcgtcgctcgtcagagccacgaggcacagctgtccacggtagcagtcacccttcgaccggcccaaaccgggcgctggcccgcaggcgtgggacgatggagcctacgtatcgatccgaccgacccgacatcgacccgagacacggcgttcggcgtctcaagaatcaggaccctgcgtgcccgcgactccttccaacgtgcccgagccgagccgtaccgacccggcgctgatccgcaatttctgcatcatcgcgcacatcgaccacggcaagtcgacccttgccgaccggatgcttcagctgaccggagtggtcgaccagcggcagatgcgtgctcagtacctcgaccggatggacatcgagcgcgagcgcggcatcaccatcaagtcccaggcggtccggctgccctgggcccccaacacgggtgaggacacgggcaccacccacatcctcaacatgatcgacaccccgggccacgtggacttcacctacgaggtctcccgttcgctcgcggcctgcgagggcacggtcctgctggtcgacgccgcgcagggcatcgaggcccagacgctggccaacctctatctcgcgatggagaacgacctcaccatcgtcccggtgctcaacaagatcgacctccccgccgcgcagccggagaagttctccgaggagctggccaacctcatcggctgccagcccgaggacgtgctcaaggtctccgccaagaccggcgtcggtgtggaggcgctgctcgaccgggtcgtgcgggacgtgccggccccggtcggcgtcgcggacgcccccgcccgcgcgatgatcttcgactcggtctacgactcgtaccgcggtgtcgtcacctacgtccgtgtcgtcgacggccagctcaacaagcgcgagcgcatccggatgatgtcgaccggcgccacccacgagctgctggagatcggggtgtcctccccggagatgaccccggccgacggtatcggcgtgggcgaggtcggctacatcatcaccggagtgaaggacgtccggcagtccaaggtcggtgacacgatcacctccctgaacaagggggcgaccgaggcgctgggcggctacaaggacccgaagccgatggtgttctcggggctgtatccgctggacgggtcggactaccccgacctgcgcgaggcgctggacaagctccagctcaacgacgccgccctggtctacgagccggagacctccgccgcgctcggcttcggcttccgcgtcggcttcctcggcctgctccacctggacgtggtccgcgagcggctggagcgcgagttcggcctcgatctgatcgccaccgcccccaacgtggtctaccgcgtcgagatggaggacggcagcgagcacgtcgtcaccaacccgagcgagttccccgagggcaagatcgacaaggtgcacgagccggtcgtccgcgccacggtgctggccccgagcgagttcatcggcgcgatcatggagctgtgccagaaccggcgcggcaccctgctcggcatggactacctctccgaggaccgggtcgagatccgttacaccctgccgctcgcggagatcgtcttcgacttcttcgaccagctgaagtccaagacgcgcggttacgcctccctcgactacgagcccaccggcgagcagtcggcccagctcgtcaaggtcgacatcctgctgcacggcgacaaggtggacgcgttctccgcggtcacccacaaggacaaggcgtacgcgtacggcgtacggctcgtcgccaagctgcagaagctcatcccccggcagaacttcgaggtgccgatccaggcggccatcggcgcccgggtcatcgcccgtgagaccgtccgcgccatccgcaaggacgtcctcgccaagtgctacggcggtgacatctcccgtaagcggaagctgctggagaagcagaaggagggcaagaagcggatgaagatggtcggcaacgtggaggttccgcaggacgccttcatctccgtcctgtcgaccgacgagtccgcaggtgagagcaagggcaagaagtagagctccgcgccgacgcctgtcgatgagcagtccggagggcccccacgccgcagtaccgcgcggcgtgggggccctttcgtgtgagccccttcgtccgggctctttcgttatgaagcggcggcccgttgcctcttacgtggcggacaagcgcgctctactctgatcacgactcgatggttactggccagttaaacaagccgtacgagcaggttgcgcaggacgagagcagcaggacgagagcagcaggcagtaggaccacagcagcaagtcgccgtatctaagaagccggtcgtagcaatgccgcaggcccggaggacgtcgtgagcgacacacagaccttgatcgataaccggccgccctccgtggcggccctcttcatcgaccgcgtggcggcgaccccgaacggggaggcgtaccgctatccggtgccgtcggcctcgggcgcgggtcccgacgactggaagtcgttgagctgggggcaggcctcggagcgggtcttcgcgatcgccgccgggctgatcgcgctcggcgtgcggccggaggagcgggtcgcgctctcctcggccacccgggtggaatggatcctcatcgacctcggggtgatgtgcgcgggcgccgcgaccacgacgatctacccctccacgaacgccgaggagtccgcgttcatcctggccgactccgagagccggatcctcatcgcggagaacgccgagcagctggccaaggcccgggagacccgcgagggcctgccggacctcgcccatgtcgtggtcatcgacccggccggcgtcgagcccgccgagaacgaccccgagggctggatcatcaccctcgccgagctggaggcccagggcgccgagctcctggccaagaccccggacgcggtcaccgagcgggtctccgcgatcaccgccgaccagctcgccacccttatctacacctcgggcaccaccggccgccccaagggcgtgcggctgccgcacgacaactggtcgtacatggccaaggcgacggtggcgaccgggctgatcacggcggaggacgtgcagtacctctggctgccgctcgcccacgtcttcggcaaggtcctcacctccgggcagatcgaggtcggccacgtcaccgcgatcgacggccgcatcgacaagatcatcgagaacctgccgatcgtccagccgacctacatggccgccgtgccccggatcttcgagaaggtctacaacggggtcgcgtccaaggcccgcgcgggcggcggcgccaagtacaagatcttccagtgggcggcgggggtcgcccgcgagtacgccaaggtctcccaggacaacttccgccgcaccggcaaggcctccgtccccttcgcgctcggcgccaagcacaaggtcgccgacgccctcgtcttctccaagatccgtgaggccttcggcggccggctgcgcgcctgtatctccggctccgccgccctcgccccggacatcggctacttcttcgcgggcgccggcgtccacatcctggagggctacggcctcaccgagaccagtgccgcctccttcgtcaacccgggcgaggcctaccgcaccggaaccgtcggcaagccgctccccggcaccgaggtgcgtatcgccgacgacggcgagatcctgttgcgcggccccggcgtcatgcagggctaccacaagctgcccgacaagaccgaagaggtcctggagtcggacggctggatccacacgggggacatcggcgagctgtcggccgacggatacctgcgcatcaccgaccgcaagaaggacctgatcaagacgtccggcggcaagtacgtcgcgccggcggaggtcgagggccagttcaaggcggtctgcccgttcgtctccaacatcctggtgcacggtgcggaccgaaacttctgcaccgcgctcatcgcgctcgacggccccaccctcctcggctgggccgccgagaacggcatggagggcaagtcgtacgcggaggtcgtcgccgccccgcagaccgtcgagctgatcgacgggtacgtcaagcgcctcaacgaaggcctccagcgctggcagaccatcaagaagttccgcctcctgccgcgcgacctggacgtcgagcacggggagctgacccccagcctcaagctgaagcggccggtcgtcgagcgggagtaccaggggctcatcgacgagatgtacgcgggctcacgcgaggcgtagcacggacggtgccggggctcggtcccgggaagcgcgggcggggcgttcggtcaccgatgtggccgggcgtcccgccgtgaccggacgccgaccaggacagcgcccgacacccacggcagggcggcagggcggcggtgtgcacgtcagaaatactgctgcacatgaatgatccccgatccatcagcaggcccggccggtccggtctgtcgcgacggctggtccccatgaccgggcgtgacccggaagagcacggccggaccgcctcgccgctggagctcttgttcgacctgaccttcgtcgtcgctgtcggcaccgcgtcgtcccagttcgcggagatgcttgccgagggccatgccgcccaggcgatcaccgggttcgtcctggccatgttcgcgatcagcgtcgcctggatcagcttcagctggttcgcctccgcctttgccacggacgactggctctaccgggccttgacgatgatccagatgatcggcgtcgtcgtgttctccctcggcctgccggcgatgttccattccgtggaagagggcagccacctcgaactgcgggccatggtcatcggatacgtcatcatgcggatcgcgatggtgctccagtggtggcgcgccgcccggcaggccccgtcgttccacgacgtcggcatggccaacatccgctggacgctgatcgctcaggccggctgggtcgtcgtggccttcacgcccaccccgatcgccgtcgtattcgtcgcgttcgccgtcctgggaaccctcgaactcgtcctgcccgtgctcacccagggctccgccggtggtaccccgtggcacccgcaccatgtggccgaacggtacggcctcttcgcgatcatcgtcctcggtgaaggcgtcgtcggcacggtcgcctcctccggcgacctcctgggcggcggagacggcacgcactggacgtggaacgcgatcgctgtggtcgtcgccggtgtggggctgaccttcggtatgtggtggatgtacttcctgacgccgttcggcgacatcctggtgcaccggcgcaagcgcggatacctcttcggctacggccacatccctctgttcatcggcgtcgccggagcaggagccgggctccatgtggcgggcctgtacttggaacaccacgccgaggtctccggaaccgccgtcgttcttgcgctcgctgttccggtcggcctctacatgctcatgatctaccttctgcacaccctcctgctgtccacggccgaccgcttccacctcgttctgatcaccttcaccctcgtcgtgctgctcgtcgcggtactcatggcggcggccggggtagccatcgcggtgtgcctgctcgtagtcatgctcgcgccgttcgtcaccgtggtcggctacgagacgatcggacaccgtcaccagcagaagatgctggagaacctcggtccgcagtaggtggagccgggttcccgggacatggatgcccacccgggcgctcggtcaccacccgcacgtcgtgcacgttccgtggtatctcccgaagccttgcgttcgaatctgctcgattttctgcccacttcggtaactcggtgcttatggatgcggccggtctgtcactctgtcggtgtcgtcggaccgtaggagccgcaccgtggcgcccattcccttgcagcgggacaccgtgcagcgtcccggcaccacccgtaccgggcacgcgcacggcccgcgcctggccagccgcaccagcctgcccggcataccgctcgccccgtccgccgcccgccggttcgtgcgggctgcgctcgcggagtggaccgggctcggggtgcccgccgccgtgggattcagcgaccggctggccgacgacgccgtgaccgtcaccaacgagctggtcaccaacgccgtggtgcacgccgggaccaccgtcgacctggttctcaggctggaggaggaaggcggcgacgacccgtccgccgccctcgtcctggaggtcaccgaccaccacccggcccgcccggtgagcggcgacgagcccgggacggaccccgggccggcgggggcacacccgggggagctgcccgaccccgccgagtacggccggggcctccagctcgtcgccaccctcgccgactcctggggcatcacctaccgcaccggcctcaagaccgtctgggcccgcctccccgtcgacgactggagcgccgcgcccgcaccgcccgacggggaggccctccgacgtggcctgcgcgccgccgagatcctcgcccccgcgacccggcgcaccgagcgcgacgacgcggtctgggacagccggggagccccggccttcctcgccgaggcctccgacctgctcgccgggcagctcgacgagg

SEQ ID NO: 3413 - DNA, 1370 bp, Unknown
  Kingdom: Bacteria, Phylum: Actinobacteria, Class: Actinobacteria, Order: Streptomycetales, Family: Streptomycetaceae, Genus: Streptomyces
gcgggacggtccagagcgtctgtccacgtaccccccaccgttccagcagggcgttcgcggcgaggaatccgctggtggccgcgcgttccatcagggccacgggcagatcggtgcggaccatgtccccggccacggtgaccgtggggtgggggctgcgcacgccgggccggtcccggtagccgcccacggggaacatgggacagtccgcccgccattcgtggcgctcgtccaggatgcgggcgctgcgggtctcagggtagatgcggtgcagttgtcccagcgtctcgtcctggactgcggaccggtcggagtccggtgcgacggcgtaggcgtgcagctcgacgaccgatcccctcgtgcgccgggcccagcgggcggcctctccctcccagcggtcgaggacgctcacgttgtccaacggaccgtagccgctggtgcccaggaaccccggacggtcgtacgccacgggccggtcgagccagagccgtgagaccaggaacggaggggcggtccgcagccgtgcgatccgtgcgcgccagtcggtgtcgcccaactcgggggacgcggcgacgaggcggcgcagggcgccgctgtccagggcgaggacgagggcgtcgtaccggatagtgcggtcgtcagtcgtgaggtccagcccgccgtcgggctggaggcgaacctgccggaccggcgtctgtgtccgtacgtcggcaccgtggacttccaggtagcggtgcagcggttcccacagggctgtggggaacggttcgccgggcacgtcgaagagaaggccctcgctggagccgaggaagtagatgtggaacatcagcgccagttcggccgccgacagttcccgcgggtcggcgaagaagctgcgggagaagacctcgaacgccaggtggtgggctgcttcaggaaagcggatgcggtggaggaagtcggtggcgctgatcccgtcgagtcgttcgtagacctcgggcacccgcacgtccagcagccccagtgccgctctcgggttcatccggatcaggtctcccagaccgaatgtggggctgagagcgacgaaccccatggcgctgagcggaggcgtgcgcggcacccgggcgaagctgtcccgcaggccggaactgtgccgcagcggatagtcgggcagccgggtcagggaaccgaggtccgggtcgacccgacgcagaagacctcgcaggttgtagtactgccggaagaacgcgtggaacccgcggctcatcgtcactgtggtgccgtcggcgagctgggtgggccaccctcctggccgaacgcggcgcacgcgtaactctccacgagcgggaaccgggcctgggcgggagactgtcggggtggcccacccagctcgc

SEQ ID NO: 3414 - DNA, 5077 bp, Unknown
  Kingdom: Bacteria, Phylum: Actinobacteria, Class: Actinobacteria, Order: Streptomycetales, Family: Streptomycetaceae, Genus: Streptomyces
ggacgccgcggcggccgccgcggtgtcctgctgccggggccgggtgcgctcctgctgccgggccgccagaggctgccggccttcgtgggaggtggggtgctccgtcacgcgtgggattccgtccgtccgggccggttgtatgaggcagtcacctcgtggggcgctactgtgccccggcaagcgcgggaagaacaacggctgtcaccggatgcccccgatgaaggggccgaaaccgagcgcctcggagatggccgacaggcgccccctccggcggcggacgcggcgagagggcagcggacagcgtgcacgtctccaccccctcgtagtggcttccgcgaccgagcggaacgtccgggtccgtggcccgtccctccgcgcgaccggtgtcgtgacttgtggtcagttccggtgtggtgcccgctggttgcggcgatcagccctccgtacgaccggacctgccgaccggaccgcccgaagggtctctccagggtctcacgacggcatacgggcaggggtgcggtcccagtcatccggtagcggcggcacctgccaccgcggatcgggccgccagtgctcccacccgtcacggaacggcgtcccccacccggtgatcacgtcgaccgccgccaggcccgcctcccggacccgggccgcggtctcccggtccatcaggccgacctcttgcgcctgggcgaactcgtcctcgtcgagccatttccagctgcggtcggggttcacggagatgtcgagaaagtgatcctcggaatccacgcctccggaccaccgggtccgcggctcctccaggttcacgtaccagttgcggaacatccagccccggtcccagaacagccacaccgaccacgggtccccgggcctggccagcttcagcaccccggagccgaaccaggtcgagcgggccgtggtgcgcggcgcggtgtagcgggtggccagcggctcggcgtgcacctgggtgccgtcggccagcaccggccgcacgcattcggtgccgggcgccatccagacggcgagcagctcgtcggtgtcctggacgacggtcaccggacggcagatgtgcacgggcgggacgccggccgtccggtgggcccggccgttgtcgcggtagcgccagaggatccggtcccccggcgcccagcgtgcgtactctcccgtacctgtcatggagagatcttacggagcgctcccaccggcccgctgcgactcaggtcacccggtcctgatccggccgggagccctcgggcgtcatgagggtctcccgggcgtcaccgggagaccccacgcgtcaccgggctcccggcgacgcgctcacggacgcgtcatccgcagcacgtccagcgcctcgtcgagctgctccgtcgtcaggtcgccgcgctcgacgtagcccgaggccaggaccgtctcgcggatcgtcgtcccgtccttgagggacttcttggcgaccttcgccgcctcctcgtagccgatgtacttgttgagcggggtcaccacggacggcgaggactcggcgtaggcacgggcccgctccacgtcggcggtgatgccgtcgaccgtacggtccgcgagcagccgggaggcgttggccagcaggcgtacggactccagcaggttcttcgcgatgactggcagcatcacgttcagctcgaagttgcccgccgcgccggccgtggcgaccgtcaggtcgttgccggtgacctgggcggcgaccatcaggaccgcctcggggatcaccgggttgaccttgcccggcatgatcgacgaaccgggctggaggtcgggcagcgcgatctcggcgagaccggtgcgcgggcccgacgccatccaccgcagatcgttggagatcttggtcagcgacacggcgatggtccgcagctgtccggaggtctccacgagcccgtcccgcgcgccctgcgcctcgaagtggtcgcgggcctcggtgagcggcagccccgtggcgtccgcgacctccgcgatcacggcggcggagaagccgggcggggtgttgatgccggtgcccaccgccgtaccgcccagaggcagttcggcgagccgggggagggaggcgcgcagccgctcgacgccgtagcggatctgcgccgcgtagccgccgaactcctggccgagggtgaccggggtggcgtccatcagatgcgtacggccggacttcacgacctccgagaattcggccgatttccgccccagggattccgccaggtggtccagggcggggatcaggtcggcggtgacggcggcggtggccgcgatgtggatggaggacgggaagacgtcgttggacgactgggaggcgttcacatggtcgttggggtggacctcgcggccgaggcgctcggtggcgagggtggcgatcacctcgttggtgttcatgttcgacgaggtgcccgaaccggtctggaacacgtcgaccgggaagtgctcgtcccagcggcccgaaacgacctcggcggcggcctcctggatcgcggcggcgatgtccggatccagtactttcaactcggcgttgaccttggccgccgctcccttgatccgggccagcgcctcgatgtgcgcccgctccagacgctgcccggagacggggaagttctccaccgcccgctgggtctgggcgcgccacttggcgtccgcggggaccttcacctcacccatcgagtcgtgctcgatccggaacccgctgtccccgggtgtgtcacctgacgtgtcgaccatggtgtttaaacctcctgaaaaagatgagcacttctcttgttctatgtattcccaagtcgcctaccgaccagtaaataccgtgggtaaccactaccgggaggcgcaatgaggcgcaccagcaccagacttcgagggctcggaagccttcgccggctccgctgtacggtcgcggccaccgtcgctctcgcggccgccgtcggcggtatggccgccgccggacccgcgggcgcgacggagtcgggtaccagctctatcgcatccacccctctcccgcccgcgctggaagccgtccgggccgccgaggccacccagctgtacgggagccccgccgaacggccgctcggcgaccgcaagaccgggctgatctcgctcggcgacagcgagatctccggcgagggcgtcggcacctacgaccccggcaccaacgggccggacaactggtgccaccgctcaccggacgccgccatccaccgcacgggcatcgcggcggacgtcacgtacaacgtctcgtgctccggcgcctataccgggaacatcaaaatcggcgggaacaagcagtacgccgatgagctggtgcagagcgacagcctcgcgatcaaggcccgcaacacccggatcaagatgatcgtcctggtcgccggggccaacgacgacctccagttcggcccggtcatgaccgactgcgtcgtccgctacatcagcctccagggtccctgcgagccgaagtacgcgggcggctggcaggcccgcgtcgacgcgctggtccccaaggtcgagcagaccgtccgtgatctgcgcaccgtcatgacggacgccgggtacgccaacggcgactacaagctcgtcctgatgggctacccgagcccgatcggcccggacttccgcgacaacccgaagttccccggcaagctggtctgcggcggactcggctacgactccgacaccgtctggggccgcaacaccgccgtgcccgccttccaggtcggcatgcgcagggccgccgccgccaccggggccacctacctcgacaactcgcggctcttccacggccacgaggtctgcaccgagaacacctgggcgcgcgggctgttcatcgacgtgaccaagccgggcctgcccgacgagaactccgtccggcagtccttccaccccaacgcggccggccaccgggccttcgcctcctgcctcacccagctgtacgactccgggctgcgcgaggcgagctgtgccgacccggcgagcacggggaacccggtcctgacgggggcggccttcgacgacctgttcgtcccgctgaagaacgaggcgaccggctcctgtgcggacgtgcccgcctcggtcacccgtaacggcaccgcggtcggcggctgggactgccacggcgggcgcaaccagaactggtggtacgacgccggaacgcggacggcccgcaccgcgctgagccacgaccgctgcctggacgtgccgggagcgaagtacgaccccggcgccacgctcgtcgtgtgggactgctcgggcgcggccaaccagaagttcgtccgccaggcgggcaccctccgcccggccgcggcgaccggcctgtgtctgacgctggcgggggccaaggacccgctcaagctccagacgtgcgacggcggcgcgaaccagcgtttcgcgtagccaccgcgtgcgagggggcggccgccgtagtgtggtcgccccctcctcatgcccttctctcacaccccccgtgccagcgcttcggagagcgcccccagcgtcggcgtcagatacagctggcgcagcggcacgccgggcagcccgcgctcctgggcgagcgtgccgatccggatcgcgtacagcgaattgccgcccaggtcccagaagtcgtcgtccgggccgatctcgtcgacgccgaacacgtcccgccagatgcccgcgaggacggcggccggggcttcgggagctccggccgccggagccgccggtcccggcggccggcgtgctccgggcgcgggcagccgggccgggtccagcttgccgttcgcggtgagggggagggccggcagcacggtcaccgtcgcgggcaccatgtgcgggggaagcagccgggcggcccgatcccgtacggccccgggggccgcgcgcgcccccggggccgggaccacgtacgcgtcgatgcgcacggccgccgcgtccccgccctcgccaccggtcacggtgaccgcagcggccgacctgggacggctgctgcccgacgggacgctggagcacctgggccggatcgacgaccaggtgaaggtgcggggcttccggatcgagccgggcgagatccggcacgtgctgctggaggacccgg

SEQ ID NO: 3415 - DNA, 1689 bp, Unknown
  Kingdom: Bacteria, Phylum: Actinobacteria, Class: Actinobacteria, Order: Streptomycetales, Family: Streptomycetaceae, Genus: Streptomyces
ccgccgcctgatcaacctcgtgtgggcgggcctcgccctcgtcggcgtcgtcctgctgggcggcgggaggcgaacaccgagagggcgagcgggccgagcacctccagggtgacggcgatgccgagcgggatccggtccagcgcctggtagaagagcgtgttcatcccgcccatcgcgacgccgaaggcgagcaccgtgccccagtcggcacgcgagtggccgcgcagtttcgggcggcagatcaccagcaggatcagtgcggcggcggccagccgcagggtgacgacgcccagcgcgcccgccttcggcatcaggagcgccgcgacggccgagccgaactggacggacaggcctccggcgaccaccagcacgatcggcgtcagcgccgcccgccggtccgctccggtccgcccggcggacgctcccgtgccggcgtccccttcgagtgccgtcaccgcttcgggtacggcgacggctgcggcggccggttcggcggcgctgcgctggtcgttcacgggaggaccttccgggggacaggggtgggacgaggcggggtggagcggccgtgctgggcgggtgcggttcgaggcaggccccgtacgacagctcagtacactgtaatgaaccgtacggtacgacacggcgcactgccctgccaggggcttcctttcaccgtatggacacccgcgcgttccgtgaaataccgatcacgctcccgttatgctccccacgcatgaacgaagcgccccctaccggccgccctgtggaactccggcatctgcgggccttcctcgcggtcgccgaggagttgaacatcacgcgcgccgccgcgcgcctccggctgacccagcccgccgtgtcccgcaccctcgcggcgctggagcggcacctgggggtccggctcgtcgaccgttccacccaccacctcgccctgacccccgacggcgccgccttccgtgacaaggccgccgcggcggtcgccgccttcgacgaggccctcgactccggacggctgcgcacctggccgctgcggctcgggcacgcctggtccgcgttcgggccgtacaccacgccgctgctgcgggcctggcaggaacggcacccggggaccccgctggaactgctccggatcgacgaccgcaccgccggcctgacccggggcgaggtcgacgcggcgctgctgcgggggcccgtggacgcgccgggactcgtcgccgaggtgctgttcaccgaggtccgggtggcggcggtgaccgcggacgggccgctcgctgggcgggcctcgctcgccctcgccgacctcgccgacggccccgtggtcctgaacaccgtctccggcaccaccaccgtcggcctgtggccgccgcatgcccggccggccgccaccgtcaccgtcgggaacaccgacgactggctcaccgccatcgccgccggccgcggcagcggggtgtccaccgcgtcgaccgcgaccctgcacccgcacacgggggtcgcctacgtcccgctcgacgacgccccgggcgtcccggtcctcctcgcccgccgcgacgcccccggccatcccgcactgccggaccttgccgcgctggcccgggagatcgtcgcccggggcgcgacgcgctgagtcccgggccgggccctacgcgtcgtcccccggttcctcccccacggccgtcgaggcttcctcga

SEQ ID NO: 3416 - DNA, 5951 bp, Unknown
  Kingdom: Bacteria, Phylum: Actinobacteria, Class: Actinobacteria, Order: Streptomycetales, Family: Streptomycetaceae, Genus: Streptomyces
gtcgtggccagcggcatcgtggccgccgacctgggcgccgacacccccgacggcttcctgcccgtcaccgcgctcggcttcggccgggaccgcttcgccccgccgccggcgctcgtacgggaggtggcggccgccacggatgccgccacgggacccgtcctcaccgtctccaccgtgaccggcaccgccgagcgcgcggcggacctgctcgcagcgcacccgggggcgctggccgaggcgatggagggcttcggggtcgcggaggccgccgcccggtccgacgtgcccgtactggagctgcgggccgtatcgaacgccgtgggcccccgcgaccgggacgcctggcgcatcggcgacgcgctggcggcgctcacggacgcgttcgggaagacggcacccgtactggaaggttggaaccggcatgacgaccgacaccgcagctagccggggcccggccgggaaagcgatcgagatcgccttctccccctgccccaacgacaccttcgtcttcgacgcctgggcgcacgggagggtccccggcgcgcccgcgctggacgtgaccttcgccgacatcgacatcaccaacgggatggccgagcgcggtgaactggacgtcctcaaggtgtcctacgccgtgctgccgtgggtgctcgacgactacgtcctgctgccgtgcggcggagcgctgggccggggctgcggtccgctggtcctcaccaaggagctgggcctcgacctgaccggccggaccgtcgccgtgccgagcgagcgctcgacggcgtacctgctgttccggctctgggcggcggagatggtcccgggcggcgtcggcgaggtcgtcgtgatgccgttcgacgagatcatgcccgccgtacgggacggcaaggtcgacgccggcctggtcatccacgaggcccgcttcacgtaccggaacttcggcctgcacaacctcgccgacatgggccggcactgggaggacaccacgggcctcccgattcccctcggcgcgatcatcgcgaagcgctcgctcggcgaggagaccctgcgccgcctggccgactcggtccgcagctcggtccggctggcctgggaccacccggaggtctcccggccgtacgtcctggagcacgcccaggagatggacccggccgtcgcggaccagcacatcgggctgtacgtgaacgagttcaccgccgacctcggcgaggacggttacgcggcgatccgcggcctgctgacccgcgcggcggccgagggactggtaccgccactgggcccggacgcgctggcgtttccctgagcggaccggaaggacaccccacgtgcacacgtcgacagcgcgccactgacccgctcgggcgctgtgcgcgcggccctgggaaggtccacccggctcttcgcggaagagccgggcctgaccgggggccgcgctgcgacagcgcctcggcgggtcgcgtccgctacacgtcgagctggtcggcgaccgccctcagcaggcccgcgatcttcgcgccggcggccttgtcggggtagcggccccgctccagctgcggcgtgatgttctccaggaccgtcgtcaggtcctgcacgatcgacgccagctcgtccggtttgcggcgctgcgccgccgcgacggacggggtggggtcgaggaccaccacggaaagggcctggtcgccgcgctggcccgcgaccacgccgaattccacgcgctggccgggcttgagggcgtcgactccggcagggagaaccgacgagtggacgaagacgtcgccgccgtcgtcgcgggagagaaagccgaagcccttctcgctgttgaaccacttgaccttgccggtgggcacgtctgtcctcgtcctcgtactcgtcggtgtgcggaaagagccggtcttccagggaaaacggctccggatagcagtacagcgggtcaccgtgacccgcccggtcccaggctaatgggcccccggccgatgacaagacgtcgccggagagttcctccgggctgggaactaccctggtcgcgtgagtactactccttcaggcgcaggtgaccggcttgttcaggtcggcgcgatcgtcttcttcgtcggcgcactggccactctggtcacggtcgccccacttttcctgggcacggacccgttccctccggtcgcttacgcggtctgcatgctgatgggtgtcgggttcctgatcgccggggccggcgtcgtgcgctcggcctgggtcaactccccgaaacgggccgcgaaccgcgcctgacgctcctccgcttcacaccacccggtccgcctcgaaggccgccagccaggccgggaagcccgtcaggtcctccagcaccacgtccgcgcccgccgtccgcagctccgccgcgtcgcacgggccggtcgtcaccgcgaccgacagcgctccggccgcccgggccccgcgtacgtccccggtgtggtcgccgacgtacacctgcgcaccgtgctcacgcagcgcctcgcccttggcctccgcccacagtgagccgatcaccgtgtccggttcgatgccgaggtggaccaggtgcagcttcgcgttcggctcgtacttcgccgtgacgacgatcgcccggccaccgagcgcctgaaccgcggccaccgactcccgcgcgccggcgagggtcgtgctcgggactatcccgtggtccgggtagatcgcccggtagcggtcggcggcggcggccaccccgtcggccgggaaccagtgcgccagctccgtctccggcggcgggccgatccggctcaccaccaggtcgacgtcgatcggcacccccgtctccgcggacagcgcccggtaggcggcggcgatacccggccgggagtcgatgagcgtcaggtcgaggtcgaagccgaccgtcagagggcgccggggggagtgccgggcggagtgctgatccgtggaagccatgtctgtcattgtgccgaccggccgggggcggccccgaagcccccgtcggcctggaaacgccgccgcttagactgagacgcgcacttagccaagccttaccgtcctggccccgcgccccggcgttccctcacgttccatcatgtccgcgtccgtcccgattgggtgaaatgtcagcgtcagcgcccgtgcggaccgccgcgccaccccgtaccccccgcctctcccgacgcgcggcctcgacggccgccgccgtgctcgccctgctgctggcggtcctgctgagcctcgccgtgggggcgcgttccatccctccggccgaggtgctcgacgtcctgctgcacggcgggcactccgacgccgccgaggtgatccgcacgatgcgggtgccgcgcacgctcatcggactgatggtcggcgcggcgctggccctcgcgggcacggtgctccaggggatcacccgtaaccccatcgccgatcccggcatcctcggcatcagccagggcgcgtcggtggcggtggtggtggccatcgccttcgcgggggtccacacgctcaccgggtatgtgtggttcgccttcgtgggcgcggcgctcgcctccgtcgccgtgtacgccatcgcctccagcgggcgcggcggcgcgaccccggtgaagctcgcgctcggcggtgcggcgatcaacgcgctgctggtgtcggtgacggtggggatcctcacgacgaacgccgccgcgttggacgagttccgcttctggcaggtcggctcgatcgccggccgggagtcggacgtcgtccagcaggtgtggccgttcctcctcgtcggagtggtcctcgtgctctccgtcgcccgcggcctggacgcgctcgcgctcggcgaggacgtggcgaagggtctcggccagaacgtcgccgcggtccggatcgtcggtggcgtcggggcgaccgtgctgaccggggtcggggtcgccgccgccgggccgatcgcgttcatcggtctcgccgtcccgcacatcgcccgcgcggtcgtcggcaacgaccaccgctggatgctgcccatggcggcgctgatcgggcccgtgatgctgctcgtctcggacgtcgtcggccggatcgtgttcccgccgagcgaggtcccggcgggcgtgatgacggccctgatcggggtgccgttcctggtcgccctcgtacgccggaaggcggtgcccgcatgaaggggacgtcaacggccgtgaccgtgcccgtgcctgtgaaggccgtacgggtccggcccgccggctactccgtggtgagggccgggtcgcgcggccggttcctgctgcaccggcgggcctccgtcgtcgcggccgccctcgtcgtgctgctggccgccgtctgcgtcgcctacctctgcgtcggggagagcttcgtcacccccggcgaggtcgtgaaggtgatcctcgggcagccgtcgtcggccgagctgatcgtgggcacgctgcggctgccgcgcatggtcgtcggactgctggtgggcgccgcgttcgggatcgccggagcgctgatccagacggtggcccgcaacccgctggccagccccgacatcatcggcatcagccagggcgccagcgcgctcacggtcggtgcgatgaccttcggcatcacctcgtacaccgtcctgccctacctctccgtcgtcggcggcatcgcggcggcggccctcgtgtacgccttcgcctggcgcggcggcctgcacgccacccgcttcgtgctcatcggcatcggcttcgccatcgcgctgcggtcggtgaccacgctgttcctgaccaagggcgactatctcgtcgcccagcaggcgcagatctggatgaccggttcgctgaacgggcgcggctggtcggaggccgctccgatcggctggacgctgctgatcctgctgcccgccatcgcctgggcggcccgcgcgcagcgcaccgtcacgatggacgacgacaccgccaccgcgctgggcgtgcgcctggggcgcgtacggctgggactcgtcgcgctcggcgtggtcctggcgtccgtggcgacgggcacggcgggcccggtggacttcgtggcgctgctcgctccgcagatcgcccgccggatgacccggaccgcgcagatccccctgctgtcctcggcgctgctgggcgcggtgatcgtcgtcctcggcgacctgctcgcccgcaagctgttctcgcccaccgaactgccggtgggtgtcctcacggcggcggtcggcgccccgtacctgatctggctgatcatccgcggtcaccgcggccgcagtggaggcaccgcatgagcccgagcccgacgaccgacacggcgcagcggaccggcaggctcgccgcgcgctccctgaccctcgcgtacgaggaccgcaccgtggtccacgagctggatctgaccgtgcccgacgggcaggtcaccgtcatcgtcggcccgaacgcctgcggcaagtccaccaccctgcgggcgctcggccggctgctgaagccgcacggcggggcggtcctgctggacggcacggagctggcgcggatacccacgaagcagatcgcccggtccatcgggctgctcccgcagaccccggtcgcgcccgaggcgatcagcgtctccgacctggtcgcgcggggccgtcagccgcaccagagctggtggcagcagtggtcggacgaggacgagcgggcggtgaccgacgcgatggcccgtaccgacgtcacggcgctggccgaccggtcggtggacgagctgtcgggcggccagcgccagcgggtgtggatcgcgatggcgctggcccaggagacggacctgctgctgctcgacgagccgacgacgtatctcgacatcgcgcaccaggtggaggtcctcgacctggtacgccagttggcgtcgcccgccgacgacggcacccggggccgcaccgtggtcaccgtgctccacgacctcaaccaggccgcccggtacgcggaccgtctggtcgccatgaaggagggccggatcgtcgccga

SEQ ID NO: 3417 - DNA, 10866 bp, Unknown
  Kingdom: Bacteria, Phylum: Actinobacteria, Class: Actinobacteria, Order: Streptomycetales, Family: Streptomycetaceae, Genus: Streptomyces
gtgaagaaggtcgccctggagctgggcggcaagaatcccaacatcgtcttcgccgacgccgacttcgagaccgccgtcgactacgcgctgatggcggtcttcctgcactcggggcaggtctgctccgccggggcgcggctcctcgtgcaggacgagctgcacgaccggttcaccgacgagctggtggcgcgggcccgccggatccggctcggcgggccgttcgacgaggacgcccgcagcggtccgctgatctccgccgcgcaccgcgacaaggtcgaggcgtacgtggccgagggcatcgccgagggcgcggtgctgcggtgcggcggtgcgcggcccgacgatccggcgctggccggcgggttctactacccgcccaccgtgctggacgagtgcgcgacctcgatgtccgtggtgcaggaggagtcgttcggtccggtgctcacggtcgagcggttccgggacgaggacgacgcggtccggctggcgaacgacaccgtgtacgggctgactggggccgtgtggacgcaggacggcgggcgcgcccaccgggtggcctcgcggctgcgggtgggcaccgtgtggatcaacgacttccacccctacgtaccgcaggcggagtggggcggtatgaagcagtccggcttcggccgcgagctaggtcccgccgggctggccgagtaccaggaggccaagcacatctggcgcaatgtcgcggcggttccccagcggtggttcgagtgagtgaggacagcggtccgggccgggggcctgcggcggaggcccgcagccgcgaccaggacgacgacgacgcgctcggcgagctgggctaccgtcccgaactccggcgtacgctcggcaacttccacaccttcgccgccgggatcagctacatctcgatcctgaccggcaccttccagctgttctacttcggcgtcagcttcggcggtcccgcctactggtggtcgtggccgatggtcttctgcgggcagctgatggtggccctgtgcttctgcgagctggcggcccgctatccggtggccggttcgatctacaactgggccaagaagatgggcggtccgcacgtcggctggctcggcgggtggatgatgatgacggccaccatggtcaccctgtcggccgtggcgctggcgtaccagatcacgctgccgcagatcgacgactggttccagttcgtgggcgacgggagcggcaggaacgaccaggcggcgaacgccgtgctgctgggcagtgtgctgattctgttctccacgctggtgaacgcgttcggggtcaagctcatggcccggatcaactccgcgggcgtcttcatcgagctgatcgccgccgtggccctcatcgtcttcctggccgcccacatcacccgtggccccagcagcgccctgacggagacgtacgggctcggcagcggccggtcgctcggctacttcggcgcgttcctcaccgcgtcgctggcctcggcctacgtgatgtacggcttcgacaccgcgtcctcgctcggcgaggagtcgcacgatccgggccgcaacgcaccccgcgccattctgcgggcgctcatcgcctcgttcctgatcggcgcgttcatcctgctcttcgcgctgctcgcggtgccggacctgcacgccgaggagctgtcgacgggcggtctgcagtacgtggtgctggcgacgctcggcgacaccgtcggggaggtcttcctctgggcggtggtcgtcgcgatcacggtctgtgtgctggcggtgcaggccgccgggatccggctgatgttcgccatggcgcgggacaacaacctgcccgccgggtcgaagctggccaaggtcagcccccgcttcgggacgcccgtggtgcccgccgtgctgatcggggtggtcggcgtcgtcatcctggtggtgaacatcaaccagccgcagatcttctcggtgatcaccagcatcgcgatcatcatgatctacgtggcctatctgctggtcaccgtgcccatgctgctgcgccggctgcgcggcgcctgggagccgcgcgagggcgcgttctcgctgggccgctggggactgccggtcaacgtcgccgccgtgctctggggcacggccatgtcgctcaacctggcctggccgcgcgccgaggtgtacaacgcgaccggcccgcagcactggtatctgcgctggggcgcgttcctcttcgtcggcgtcgtcgcgctcggcggcttcgcctactactggttcgtccagcggcaccggaccggcgtactcgccgagcaccggttcgagaagcgggaccccgccggccccgccgctcccccgtccccgcccgccgtctgagtcctggagtcgtgatgtccgacgcaagcccccgttccgagttcgactacgtcgtggtcggcggcggtacggccggagcggtcatcgccgcccggctcaccgaggatcccggcgtcacggtctgcgtactggaggcgggcccctcggacgtcggggacgagagcgtcctgcggctggagcggtggatggccctgctggagtccggttacgactgggactatccggtggagccgcaggaacggggcaacagcttcatgcggcacgcccgcgccaaggtgctcggcggctgctcctcgcacaactcgtgcatcgccttctgggccccggcggaggacctcgacgagtggggcgcgctcggctgtacggggtggagcgcggcggactgcttcccgctgtaccggcggctggagaccaacgacgcgcccggcgaccaccacggccgctcgggtccggtcaccatccggacggtgccgcccctcgatccctgcggcggcgccctgctgtcggcctgcgcggcggcgggcatccccaccgtcccgttcaacacgggctccacggtgatccggggtgcgcactggttccagatcaacgcccgtgaggacggcacccgttcgtctgcctcggtgtcgtatctgcatcctgttctcggctcccggccgaatctggacgtacggaccgggctccaggcgaagcggctgctgttcgagggggaacggtgctccggggtggagtacctggagcccgataccgtccacagcgggacggtgcacgcccggcgcgaagtgatcgtctcctgcggggcgatcgactcccccaagctgctgatgctgtccggcatcggcccggccgggcatctgcgggagaccggggtggacgtgcgggtggactcccccggtgtcggctcgcacctccaggaccacccggagggcgtgatcatgtgggaggcgaagcggcccatggccaccgcctccacccagtggtgggagatcgggatcttcgcggacaccgagccgggtctcgaccggccggacctgatgttccactacggctcggtgccgttcgacatgaacacctaccggcggggttacccgacctcggacaacgcgttctgcctgaccccgaacgtcacccgcgcccggtcccggggcaccgtccggctgcggacccgggacttccgggacaagccccgggtcgatccgcgctacttcaccgacgagcacgacgtacgggtgatgacgtacgggctccggctggcgcgggagatcgtggcgcaggcgccgatggccgactgggcgggcgccgagctggcaccggggccgggcgcgaccacggacgcggagctgttcgactacatccgcgagacgcacaacaccgtgtaccacccggccggaaccgtccgtatgggcccggtggacgacccggagtcgccgctcgacccccggttgcgggtcaagggggtctcgggtctgcgggtggccgacgcgtccgtcatgccgttcctgccgacggtcaacccgtgcatcaccacgatgatgatcggcgagaagtgcgccgatctgatcaaggaaggctgagccgacggcctgccgcctaccgctattcgcacacctgatcgaatagcggtaggctctccccatggccgtacacctgcaaagctcgcttttcgaccaggaggccgaggtcggcaccacccccctgagcggactgcggcgcaccgatctgggccacggggcctggatcgacgtgctgccgcaatggctccggggcgccgacacgctgttcgagacgctggtgcgcgaggtcgactggcgggccgagcagcgcgtcatgtacgagcgcgtggtggcggtcccccggctgctggcgttcttcggccgccgcgatccgctgccgcatccggcgctggaggccgcccgcacccggctcggcgagcactacgcggccgagctgggcgaacccttcaccacggcggggctgtgcttctaccgggacggacgggacggggtcgcctggcacggcgacaccatcggccggggaagcaccgaggacacgatggtcgcgatcctctcgctgggcgccccccggcacctcgcgctgcggccacgccgcccgggacccacccccgtccgcaggccgctcgggcacggcgacctgatcgtcatgggcggcagttgccagcgcacctgggagcacgcgattcccaagaccgcgcgggccgtcggaccgcgcatcagcgtgcagttccggcccgacggggtgcgctgagcccggcgtccggcgggtgcggcccgggtcaccgcggttgtgccggtcgcgggcagggcggattctgagggtaatgaaccgggccggtgtcgcgccgtgagcgcggcgagcacggcggagagcgccgatttccgcggccccctggacatcaccagggcggccacgatggtcctggacgccgagagcaccgtcatcggctggagccccgcggccggcgagctcctcggctacgacccctccgacgccctgggccggcccctgaccgcgttcctctcgggccggccggccggcggcacgctcccggcagagccggcgagggacggcggtcccggccccggaccgccgtccctcgccggcgacgagatccatgtggcccgcacccgggacggccgtgagctgctggtggcgacggcgatgtgtccgctgccgggcggggccggggtgagcggacccggcacgccggaccggatcctggtggcggccgaggtggaggcgctgctgcactgggagtcgcggctcgccctgctccaggggctggccacccagtcgcccgtcggcctggccatctacgacaccgacctgcggctgagctggagcaacaccgcctacgagcgggagatgggacagccgctggcggcgttccggggcaagcgggccgaggagctgtacggctcgggctccttcgtgaaccccggttacccgcacacgctcgccggcgtcatgcgtcaggtgctcgacaccggcgagccgatcctcgacctgcacttccgtgggcagccgcccagcgacccggggagggaccacctgtggtcctgcgcgtactaccggctggaggacgcccacgggcacacgctcggcgtgtgcgaggacgcgttcgacatcaccgaccgctaccgggcccaggagcggctgaccctcctcgtcgaggccggccgccgcatcggcacggtcctggacgtggccaccaccgccgaggagatcgccgaggtggccgtgccggacttcgccgccaccgtacgggtcgacgtcacccgggccgcggtgaccggggagacggcggcggtgggcagcccggcggacatgtccctgctgcgggtggcggaacggtcggcgccggggtcccgtacgccggatcccggtctcccggggagcggaccgaccgggagcggcccgaacgggagcggcccgaacgggagcggcccgacggccacagcgcggggccctgccggtcccggaggcccccggcagccgtatccgccggtggtctatccgcccggatcgccgcagaaccgcagcctgtcctcgggcgggctcgtgctcgacgagtgcaccctggtcgtcccgttgcggaccgggggcggcatcctggggctcgtcaccttcgaccggggcgcggcccccgacgcctcgggccggacgctcgcccccgaccggtcgaccacgttcgacaacggcgaggtcgccctggcggacgaactggcggcccggaccgctgtctgcatcgacaacgcgcgccgctacacccgcgagcgcaccgcttccctcgccctccagcggcagttgctgcctcatcacctgccgccgcagtccgcggtcgagaccgcctaccgctatctgccggccgacgacgtgaccggcgtcggcggggactggttcgacgtgatcccgctgtccgggacccgggtcggcctcgtggtgggggacgtggtcgggcacgggctccaggcggccgccacgatgggccggctccgcacctccgtacgggccttcgcccagctcgacatggcgcccgacgagctgctgacccggctggacgatctggtgggacaacccgcggaggatcggccggacgcgtgcggcggggccgtcgagacctatgacgtgaccaccggggcgacctgtctgtacgcggtctacgacccggtctcccggcattgcgtcatggcccgtgccgggcatctgcccccggcgatcgtcggcccgggaggcgaggtgtcgttcccggacctgcccgccggtccgccgctgggactcggcggcctgccgttcgagtcgatggagatcgacctgccggtgggcagcctgctggcgctcttcaccgacggcctggtcgaggcccaggaccacgacatcggccgcggcctcgacatgctgggccgggtgctcggcgacccgtcggcgtcactggaggagctgtgcgaccgggcggtgtccgagctggtgcccggcggcacgagcgccgacgacacggccctgctcctggtccgcacccgcgccctcgacgcggaacgggtggccgactgggagctgaccgccgaacccgtctcggtgggccgtgcccgcgagctggccaccgggcagctggaggcctggggtctggaggagctggcgttcgcgacccagctggtcgtcagcgagctggtcaccaacgcggtgcggtacgcgggcggtccgctgggactgcgcctcatccgggaccgcaccctggtgtgcgaggtcgcggacaccggccacacctctccgcatctgcggcacagcgcggcggacgacgagggcgggcgcggcctcttcatcgtggcgcagctcgtccagcggtggggtacgcggtacaccccgaccgggaagaccatctggaccgagcaggccctgccgccggccggagccggctgacccgtaccgcccggcagcaccgaccgtgggcagcacccttgttgacaacccaacagatttgaacttaggtatgccttacctaagtcgactgggtgtccgtggttctggttaccgatgccgagaaaggtgctcatctcatgagtgctgttccctccacccgtaccgtcgcccgcgcgggcctcgccgcgttcgccgccgccacgctggccctgaccttcgcctcccccgccgccgcagcgactggcacccgcacggtcaccgacgggggcgccacctacaacctgtcgctcaccgcccccgacaccgcggccgccgggggcgccaacatcaccgtcaccggcagcggttacaacaccggccagggcgtctacgtgagcctgtgcgtggtgaacggggcccagggcgccaacaagccctctccgtgtctcggcggccaggaccagtccggcaccaccggcgcctcgcactgggtgtccggcctgggcggcggcctccccaacacctcgccgttcggcgcgggcggcaccttcagcgtccggatacacgtcaaggccgacctcggcggcggcaacgtctgcggcgacaccgtcgagtgcgccgtcgtgacccgcgccgaccacaccgacaccaacgaccgcaagtacgacgtccacaccccgatcaccttcgtgtagcaccgctccaccacgagtagcgccgatcgacttcgcgcaacacctcccaactcccctgggcaacacagccattcgcccggtcccggccgctcgcgccggggccgggctcccacgcgtcgtgacgaggaatgacatgacatccactccgggcaccgctcccggcaccccaccggccggccgccgcggactcggccggcgcggactcggccggcgcggactcggccggcgggcgggtacggccgccgtcgccgccctgctgcgggcggcgatccccacgggcgcggcggtcagcgccgccgccggcaccccgaggaccgccaccggcccccagggacagaagctcaccgtctcggccaccaccggactcgacccggccggtgagaaggtccgggtgaccggcgaggggtacggcctgaagtccggcatctacgtcgccctgtgcaaggacaacggcgacaaccggacgtcctccccctgcctcggcggcgcggacatgagcggcgggtcgaagacctcgcagtggatcgtgcctccgggcgacccgtacgagggcgatctcgcccgcgccttcgggcccggcgggaccttcgacgtggagatcgagatcgccgcgaagggtgacggcctcgactgcgccgaggtggcctgctccctggtcacccgggccgaccaccgcgccggcggcgaccgcacgcaggacgtccgcatacccgtcgccttcgcggaccaggagcccggcgaaccgggcggcgagggcgtcgacgtgcccgcggggaccgtctcctaccgggccgtcgccgacttcacctcggccggcaagccgctggacctgctgctgcaccccggctcgaagaagctgtacgtcggcgcggacaacctccccgacaccgccgacgtcgacgagcgcgggctgcatgtgctgaaccccgaggacgggaaggccgagagctggatcagccgggcgcccggacccaccggggaggtgcgcgcctcggcggccgcacgcatcgcgggaccgctgccgggcgacggcgtcgtctacaactacccgctgcggggcgtcgggagcgccaggtccggtgacgaggcggcctcgggcgtctggctcaccgggtccaccgtcaccgacatcgcccccggcacgacgccgggcacggtgctggtcgcccagggcgcgaagctctccgagatcgagcgggccaccggcacggccacccggagcctcaccctgccgggcggcgaccggttcgccgccgatcacggacggggcgcgctctggttcggcgacttcgcggccgggaagctgcaccgggtggacctcgcgtcgttcgggatcaccggttccttcgacctgcccggtgcgcagggcatggccgggttcatcgaggcggacccggccaccggcgcggtatgggccggggtcaaccggtccgtgctggtcttcgacgcagcgggctcgctgctcaagacgctcgtcggccaggacctggcccgcgacgccgccttcgacacggcgacgggccgggcctacgtcgcctggcaggacggcggggacctctccgacccggccaacgacaacaacggcacgctgaccgtgtacgacaccgaggacttcgccgtggccgcgaaggacctgtcgctgcccggcaaccactcccagtccggcgcggcctcgctcgccgtcgagccgggcggcgccacggtcttcgtgacgagccccgccgagggaaagatcaccaagctggtccggcaggtctcgccgctggtgacccgcgcacccgccgacctggcggccgaggacggcgcggaggtcgccttcgccgcggaggcggagggatccccggagcccacggtccgctggcaggtcagcaccgactcctcgcagacctggaaggacgtcgagggcgcgaccgggtccgccctcacgttcacggcgaggacggcgcaggacggctaccgctaccgcgccgagttccgcaacgacgccggcaccacgcgcacctccgccgtgacactcaccgtcgtcccggccaccggcggcggggagacgggaggcgacagcggcggtggcgacgcctcgaacggcggtggcagcacggaaggtgacggtacgacgggcggtgacagcggtacgcggtcgggcggcggctcgaccaccgagggctccggctccaccggcgcggcgggcagctccggagcgtccggcggttccggctccacggtcggcggtggcgcggagggtggcaccggggctgccaccacgtccggcggcggcagcctggccgccaccggcgtcacggtgatgtccgcaactctcatggctgcaacacttgttggcgcggggctgctggtccaccggcgcgccaggaggcgcacggacggcgcgttctgacctcgcagcaacgctccaccctcgcggggcgggcggccgaatgcgtgaaccccctggcccggcacgtcgcccgccagggggttcacgcgttccctcccgatcgcaccggatccggagcctccgcaggccgctccccgacccggcccggcacaagcgcttacccgtccgacgctccatcaacatccgtatacacaagccgacatcggacggttccggccgatcggaggtatctggaccgagccgtctgaacttcacgggaactccagcgaaatggcacgtgtgtggatatcgtgcaccgagcgagggcgcgtccgtcagtccatgggatcggcggatgcgtcgcgtttgtgggggtgcaacgggaactggggggttcatggggcatgtcgaaatacctgataccgacctatccggaccggtggggctccggggcgcgccgcgcccccgcaccgccgcgtcccggaatcgcacggcggccctggaacagctctggagggcaccgacagcacagcgcgacccggccggccgg

SEQ ID NO: 3418 - DNA, 2351 bp, Unknown
  Kingdom: Bacteria, Phylum: Actinobacteria, Class: Actinobacteria, Order: Streptomycetales, Family: Streptomycetaceae, Genus: Streptomyces
gcccgcgccgttcggcccgaccagcgcgaccacctcacccgcgtgcgcggtcaggccgacggagtccagcaccagccgctgcccgaggcggaccgacagtccgacggcctcgacggcgggggagccgggagtgacgggcgagggcagctcccgggtgcgtaccgcgagcaggtctctcagcgtcctcatgcccaaccaccttgcttacgacgggtcctgcgcagcagccagaagaagaacgggctgccgaagagtgcggtcagcaccccgagcggcagctcggcgggggccgccaccgtacgggccgcgaggtcgcccgccaccaggaccagggcgccgccgagcgcgctccccgggacgaggaaacggtgaccgggtccgttggccatccgcagcagatgcggcacgagcagcccgacgaaggagatgatcccggcgacggcgaccgcggcggccgtcagcagcgccaccaccagcaccagcacgatccgcagccgctccacgtccacgcccaggtgccgggcgggccgctcgccgagagccagcaggtccagcttgcgggagtggaacggggcgatgaggagccccgccagcgcgcacggcagcacggcgagcaccttgggccaggtggcctgggagagcgaaccgagttgccagaaggtgatctgggtgatctgcgcgttgtccgcgaagaagatgaagagtccgatcagcgcgcccgcgaacgcgttgaccgcgataccggtgaggatcagcgtcaccacctcggtccggccgccggaccgcgagagcgtgtagacgagcaggaccgtggccaggcccgcgacgaacgcgcagacggtgatggtccagttgccgaagaagctcaggccgagcgcgatcgaggcgaccgcgcccacggccgcgcccgccgagatgccgatcacgccgggctcggcgagcgggttgccgaacacgccctgcatcagggcgcccgcacagccgagggacgcgccgacgagcagcgcgaggacgacgcgggggagccgcacgttccacaggacgctctcgccgacccggtccaactcctggccgccgagcccgatccggtgctgcacggaggacaggacgtcgccgagcgggatggagtacgcgccgatcgccgcggacagcagacaaccgacgagcagggcgagggagagtgcggcggtgagcacgaacgccctgctccggggggaccggcgagcgaccccatccgcttcttcgcccggggttttctccacggtcccggtgggttcctcgtacgaggtggtcactggcccgtgccgcccttcgcgtacagctgctcgacgatcccggcgagcacccggtcggtgcgcggcccgtagttgagcagtaccccgtcgtcgatcgagacgacccggcggtccatccccgccggggtctccgcgatgccggggatcttcaccaggccgtccatgccgtccaccgacgcgagccccttgctcatcacgaggatggcgtccggcgcggccttggcgagcgcctcgctggtgatggcggtgaagtccttgtccagacccgactcctttccggcatcgaccgcgcccgccgcctccagcagcgaactggccccggactccgcgccgcccagcagatagacggaggccgatccgcgcagatagaggaaggcgacccggggcttctcgccgcccctgtggtccgggatggacttctggacggcggcgatccgggactcggtgcgctccttgagctccgttccggcggacggtacgccgagggcctcggcgacggtgtcgatacggcggccgacgtcggcgagctccttggcgggctcgacgacgagcagcgggatgcccgcgccgcggatctggtcgatcgcctcggccggcccggtggtggtgtcggcgaggacgatcgtcggcttcagcgagagcacgctctccgccgatacgtcgtgggctcgggtcaccaccgggagctgctcggcctgttcgaaggtggcggtgatgtcccgggcgaccacctgcttcccgaagccgagggtgaagacgatctcgctcagcgacccggtcagcggcacgatccggtcggtggagtcgacggtgaccttcgtgccgtccgccgagtcgaccgtcaccggcagcttcggcgtgggcggggcggccagcggctcgacccgatcggcgtcggcggtgcttccggcggacttcggcgcggagttgccgcctccgtccccgccgcagccggtcaggaccagggcgaaggccacggcggtcggtgagggcggcggccgccctgcccctgtccgggcgccgggcatgaagccgtccggcgtccgggccctcgga

SEQ ID NO: 3419 - DNA, 8014 bp, Unknown
  Kingdom: Bacteria, Phylum: Actinobacteria, Class: Actinobacteria, Order: Streptomycetales, Family: Streptomycetaceae, Genus: Streptomyces
gcatcccggcatcccggcgcgggtgtgcgccgggatgccgggatgctaggaagcgccgcacccgggggagaagccccgcgcgcattgcgttcatagtgttcgttccgggcgcccggcgggtgccaccgggggagcggcgacgggaccaccgacgtgacgaccgacgggaccactggagggaccttcggcggactggacctctgacgggccgcccctccctggcccgcgccgctcacggcgcgtacggtgtggcggcatgaagatcctcatcagcgcggacatggaaggcgccaccggagtgacctggccggccgacgtgctgccggggacgccgcagtgggagcgctgccggtcgatgttcacctccgacgtgaacgcggcggccctcggcttcctggacggcggcgccgacgaggtcctggtcaacgaggcccactggtcgatgcggaacctgctgctggagcacatggacgaacgggtccagatgctcaccggcaagcacaagtcgctgtccatggtggagggcatccagcacggcgacgtggacgcggtggccttcgtcggctaccacaccggagccggcacggagggcgtcctcgcccacacctacctggccaactccatcaccggcgtctggctgaacggcgtccgggcgagcgaggggctcctcaacgcgcacgtcgccgccgagtacggcgtgcccgttgtcctcgtcaccggcgacgatctgacctgcgtggacgccgagggatacgcccccgaagcccggaaggtcgccgtcaaggactacgtgtcccgctacgcagcggtgtgccgcaccccggcccgcaccgccgccgacatcagggcggcggcgaaggccgcctgtgtcctcgcgggccggcgggagcccgtcaccgggtccgcgttcaccgtggagctggagttcgacgccgaacatctggcggccgcggcgaccgtggtccccggcgtggcggtgagcggagagaggcgcgtcgcgtacaccagcgcgacgatgtacgaaggaattcgcacgttcaaggcggtgacgacgatcgtgtcggccgctgtggaggaacagtatggctgaggcccccgacctgctcggacccgtcgaccggcaggcactcgacgaggtggtgacgttcacctccgaactcatccgcatcgataccaccaaccggggcggcggcgactgccgtgagcgcccggccgccgagtacgtcgcccaacggctcgccgacgccggaatcgatccgacgctcctggagcggacccccggccggaccaatgtggtcgcccggatccccggcaccgacccgacggccgacgcgttgctcgtccacggccacctcgacgtggtgcccgccgagcccgccgactggagcgtgcaccccttctccggcgaggtgagcgacggagtcgtgtgggggaggggcgccgtcgacatgaagaacatggacgcgatggtcctctccgtcgtacgcggctgggcccgcgagggcttccgcccccggcgcgacatcgtcatcgcgtacaccgccgacgaggaggacagcgccgccgacggctccggcttcctcgccgatcagcacccggagctgttcgagggctgcacggagggcatcagcgagtcgggcgccttcaccttccacgcgggcgacggtctctcgctgtacccgatcgcggcgggcgagcgcggcaccggctggctgaagctgaccgccgagggccgggccgggcacggctccaaggtcaaccgggagaacgcggtgagcaccctggccgccgccgtcgcccggatcggcgagcacgagtggcccatccggctcaccccgaccgtccgggccgcgatcaccgagatcgccgccctgcacggcatcatcgccgatctggacgagcccggcttcgacgtcgcccaactcctcggcaagctcggtccggccgcgtccctggtcgagaacaccgtccgcaacagcagcaacccgacgatgctggacgccggttacaaggtcaacgtcatccccggccacgccgccgccttcatcgacgggcgcatggtccccggtggcgacgacgagttccacgcgaccctggaccggctcaccgggccctcggtctcctgggagttctaccaccgggagacggcgctggaggcccccgtggactccccgacgtacgccaagctgcgcgccgccgtcgagcggttcgactcggacgcgcacaccgtcccgtactgcatgtcgggcggcaccgacgccaagcagttctcccgcctcggcatcaccggctacggcttcaccccgctgaagctgcccgtcggcttcgactaccagcggctcttccacggcgtcgacgagcgcgttcccgtcgacgccctccacttcggcgtccgtgtgctcgaccactacctgcgcaccgcctgacctgccgacccgcaccggggggacctacgtgaacaccgtgccagcagctccgtacggaacctggccgtcgccggtcgacgcggcactcgccgcctcgcacgacggccgccccgaccacctcggcaccatcggggacgaggtgtggtggaccgagccgcgtcccgccgagaacggccgtcgcgccctgatgcgccgccgcgccgacggcaccaccgcccccgtgctgccggccccctggaacacccgcagccgggtgatcgagtacggcggacagccctgggcgggcaccgtgcgcgaggacggcgaactcctcgtggtgttcgtccacttcaccgaccagcggctgtacgcctacgctcccgacgggcccgacgagccgtggccgctcacccccgtccgggacgtcggcggcgggctgcgctgggtggacccgcaggtgcgcccggaacacggggtggcgggcgaggtctggtgcgttctggaggagttcaccggacccgcacccaccgacgtacggcgcgtcgtcgccgccgtgccgctcgacgggtcggcggccgacgaccgggcggcggtccgtgaactctccgacgaccggcaccggttcgtcaccggtcccaaggtctcccacgacgggcggcgggcggcctggatcgcctgggaccacccccggatgccgtgggacgggacggtggtcatgctggcggaggtcgacgaggccggtgggttcaccggcgcacggcccctcgtcggcgacctcgacgaatcggtctgccaggtggagtgggaccgcgacggcagcctcctgttcgtctccgacctcgccgactggtgggagctccagcgcatccgacccgacgcggtggcgggcggcgcggtccccagcagccgccttctgccgccccggggcgaggagttcggcggcccgctctggaagatcgggctgcgctggttccatccgctggacaacgggctgatcgccgtcctgcacggcaggggcggcatgcggctcggcatcctcgacccggagaccggcgaactcgccgatgtacccggcccctggacctcctgggccgacacgctcgccgtccacggcagccgggtcgtcggcgtcgcggcgagcccccgcagcggccccgaggtcgtcgagctggacaccgcgaccgggcacacccgcgtcatcggcgcaccccaccacgacgcggtcgacccggcgtactacccggtgcccgaggaccgcaccttcgccggccccgacggccgcgagatccacgcccacatctacccgccgcacaaccccgaccgcaccggacccgagggcgagaaacccccgtacgtcgtctgggcgcacggcgggcccaccggacacgccccgctcgtcctcgacctggagatcgcctacttcacctcgcgcggcatcggcgtggccgaggtcaactacggcggctccaccggctacggccgccgctaccgcgaactcctgcgcggccagtggggcgtggtcgacgtggacgactgcgcggccgtcgcctcggccctggtcgaggagggcgccgccgaccccgacaagctcgccgtgcggggcggcagcgcgggtggctggaccaccgcggcatcgctgaccagcacggacatctacgcctgcgggacgattctctacccgatcctggatctcgaagggtgggccacggacgagacccacgacttcgagtcgcagtatctggagtccctcgtgggtcccttcgccgaggtgcccgagcgctaccgggaacgctcgccgctccaccgcgccgaccggctgaacacccccttcctgctgctccagggcctggacgacgtgatctgcccgcccgcacagtgcgagcggttcctcgccgcgctcgccggacggggcgtcgcccacgcctacatcgccttcgagggggagagccacggcttccggcgcgtggagaccctggtccgcgcactggaagccgaactctccctctacgcgcagacgttcggaatcgaccgccccgacgtgccgttcctggagctgacgaggtgatccgtgtggaccacggcccggcggcggccctcgcccggccgccccggctgcgccccggttcgcgggtcgccgtcgtcgcgcccagcggccccgtccccgccgaccggctggaggaaggcctcgccttcctgcgcgactggggcctcgaacccgtcgtcggcgcccacgtccgctccaggcacccggagttggactacctcgccgggtcggacgcgggccgggcggaggaccttgagcgggcgtggtgcgacccgtccgtggaggccgtgctctgcgcccggggaggatacggcgcccaccggatggtcgacctggtcgactggggggcggtccgggccgccgggcccaaggtgttcgtcggctacagcgacatcacggtgctgcacgaggcgctcgccctgcgcgccgggttcgcgaccctgcacgggccgatggtcgccaccgaggcattcctcaaggacgcggcgacccgtgagcacctgcgcgccacgctcttcgcaccggagaccgtcaccaccctcggcctggaatcggcgggtgccctggtccccggccgggcccggggtgtcctgtacggcggttgcgtcagcctgctcgccgccggaaccggcgccccgggcggccggacccacgcccggggcggactgctggtgatcgaggacaccggggaggagccctaccggctggacggcatcctcacccggctcctgcggtccggagccctggacggagtcgccggagtggcctgcggctcctggcaggagtgcggcccgtacgagaaggtccgcgccgtgctcgccgaccggctcggcccgctgggcatacccgtggtcgaggaactgggcttcggacacggtccgaccgcgctgacgattcccctgggggtacccgcgacgctcgacgcaccggaggacggcgggcgttgcgcgctgaccgtcgaggctcccgccctgcgctgacccttcccgtccgcccggatgtgtcttttcgcgcggggaacgtgaacatccgtcaagaaccgctgaccgccacgttgacacggccgtgagctgtgtcacagcatgggcacggcccagtacttaccggtcggtaaggtgtcctcggtgtggaggtcttcgtgtcaggtgctgtttccagagtgcgcggcccgctcgtggcggtcgccggtgcggccctcgtcgcccccctcgtcctcgccggcccggcccgtgccgaggccgatccgtacaccgtcaccccgctgaagttcaccgtcgaggcaggcggccgcacctgcacggtggacgccgatctctaccggcctgccggggccgacgcggaccgccccgcccccgcggtcctcgccaccaacggcttcggcggcagcaagtccgacggctccaccgacgccatcggcaaggccttcgccgagcgcggctacgtcgggctcgtctactcgggcctcggcttcggcgggtccggctgtctgatcaccctcgacgaccccgccatcgacggccgggccgcgagcgaactcctcgacttcctcgggggagttcgcgcggcggacgacgggaccgaggccgacttcgtcacccgggacgccgacggcgacccgcgggtcggcatgatcggcggctcctacggcggcgcgatccagctggcgaccgccgcggtcgacccccgtgtcgacgccctcgtcccgctgatcacctggaacgacctcggctacgccctggcccccaacaacaccggggcacgcaccggcgtcacctccgacacccccggcgtcttcaagtggcagtggaccaacggcttctacctgatcggcgaagggcagccgctcctcaacccgagcctggacccttcccgtgtcaacggcctcgactgcctgcacttcgccacccgtgcctgcgagaccatccggctgctcaactcgggccgctaccccgccgaccggaccgaggagatgctcgcctacgcgcgcagcgtctcgcccgtctcctacctcgaccgggtcaaggcccccacgctcatcgtccagggccaggccgacagcctgttcaacctcaacgaggccaccgccacctaccggacgctcaaggcgcagggcaccgagacgaagatgatctggcagtcctggggacacagcggcggccaggttcccggcgaactcgacctgagccagggcaatctggagaccagccacgtcggacagcgggtgctggcctggttcgaccgctacctccacaagaagacggacacccacaccggacccgccctctcctactaccgcgactggcagagcggctacggctccgcctccggcgttcccaccctctcgcagtccctgtacctctccggcgacggcaaactcgtcgacaaccgctccaaggtggcgcgcggcagccgtcagtacaccaactggctcgtgccgacgagccactccgagagctccatcgccccgctgatcggactgcccgaccccgagccgtacgacaccacgggcacctacctcggctggcgcaccgaacccctcaccgaacccctcgacgtcgtcggcgcgccgaaggccaccctgaaggtcgtctcgccgaagacggaacgggtccagaacagcggcgacgcctccgacaagctcgtcctgttcgccaaggtctacgacgtcgcgcccgacggcggccgtacgctggtgaaccggctcgtctccccggtccgggtccccgacgtcacccggcccttcacggtggagctgcccggcatcgtccaccggtacgagaaggggcaccgcctggagttcgtgatcgccgccagcgacaccgcctacttcggcaaccggggcgtcaagcccgtcaccgtcgtccacgcccccgaggacaccggcgtactggaactcccggtggtcccggccggctgaggtcacccgcccccgttcacccgaacggccgtacagcaccgccccccggacccggcagcccgacatgctgggaccccggggggcggtcgcgtgcaccacggcgggccggacggcgaggagcgagcggaagggccggaccatgagccccaaggacgtatcgagcggcagcgggcgcggcaccgggtggctcaccccgggacgcatcgtggtcgccgtggtggtcgtgctcgtcatcgtgttcatctgcgtgaacacgaaggacgtcaccatccgggtgctgatccccgaggtgacgatgcccctgtggtccgcgctgctggccatgttcctgatcggcctcggctgcggcggctatctcttccgccggaggagcaactgacggagaccggaattccgcgcacccacccgaggtcccggaccgcggcggccgggccgggcgcgcggaaatccggccgacgggactctggtccccgcggccacctgcgtgttccatggtcaccgggggcgcccggacctgcggcggcccgccgcgagggaacgagggtgccttggccacgaccgtacgacgagccgtactgaacctgcccgcagcgccgctcgggccggagaacccgctcccgccactgcggacgcccgccccgccgcccg

SEQ ID NO: 3420 - DNA, 3988 bp, Unknown
  Kingdom: Bacteria, Phylum: Actinobacteria, Class: Actinobacteria, Order: Streptomycetales, Family: Streptomycetaceae, Genus: Streptomyces
gctcccgtcggcgcaggatgatcggcgtgagcggcagcggtccgtcctcgcggcgggacgtcggcaccggcacggcccgcggggtgcgctcggccaggtggccggcgagggctcggggcgtcctgaagaggaagacgtcccggggtgcgatcgacaggccgagcgcccgggcccggttgatcacggtgatggcgacgatgctgtcgcctccggcgccgaagaagtcggtgtcggcgtccacggtcgcaccggggagcgcctcggcgaagatgccggtcagggcggtgagcgcggagtcgccggtggtcctcgggtcctccggctgcgggtcggggcgctgtgcggcccgttcggtcagcgccttgcggtccagcttgccgttgacggtcagcggcaacgcgtccaccggcagcaccaggcccggcaccatgtgcacgggcagcttggcggcgagcaggccggcgaagtccgcgggcggccggccgacgacatgggcgatcagctggtccccaccgtccgccacggtgacggccacgtcgacgacgccgtcgagttcccggatggcgccctccacttcgcccggctcgatccggaatcccttcaactgcacctggtcgtcggcgcgtccggcgaactccagctcgccgtcgagcgtccggcgggccagatcccccgtgtggtacatgcgggagccgtcggaggcgaacgggttcgccacgaaccgcgcggcggtgagcccggggcgcccgaggtagccgagggacagctggtcgcccgcgacgtagatggcgccgacccggcccggcggcaccggccgcagccggtcgtcgaggaggtgggtggtcagtccggggatcggcgcgccgatggggctgacgtcggcgcccagggtgaagtcctcgtccgtcagcacccggtgggtgacatggacggtggtctcggtgatgccgtacatgttgaccagctcgggcgaacccgtaccgtgccgctcgacccagccgcgcagccgcgcgaggtcgagcgcctcgccgccgaagacgatgcggcgcagcgccgtgaccggctcctccgcgtgcaggtcggcctcgatgaaccggtagaaggcggacggcgtctggttgagcacggtcacaccgcgttgccggaccagccggtggaagtcgaccggcgagcgggtcagcgcgtactccggtaccagcagttcgccgccgtgcgcgagtgcgccccacagctcccagacggcgaagtcgaaggagaaggagtggaactggacccacacgtcgtcgggtccgaagtccatgtccgggcgggtgttggcgaggagtgtcgtcaccgcgcggtgcgggacgacgacgcccttgggccggccggtcgatccggaggtgtagatgacgtacgcggggtcctcgggtccgacggcgggcaggccggtgtccagggggtgttcgtcacccgcttcgtcacccgcttcgtcgccctggacgagcacccgggcgtgcacgcctgcccggtccagcagccgggtgaagcggctctgctgctcccggtccacgaggacgacctggggggcggcgtcggcgaggatgtactccagccgttcgtccggatacgccaggtccagcggtacgtacgcgcctccggcggtgacgacggcgaccagggcggcgacctgctccagtgagcgcgggaccgcgacggcgacgcggtgccccggccctaccccggccgcgcacagcgcggaagccaacgcgttcttcatgtccgcgagttcgccgtaggtgagggagcgggtgccgccgtccagcgcgcactgggtgacggcggtggccgccgggtcgcggagtgcggcggcgtcgaacagctcgacgagggtcgtcggggcctcctgcgacggggcgctgccgggcgcggcgaccagcacgtcgaccgggccgtccgggctgccgagcagttcggtgaggttccgggtgaacgtggccaggatcgcctcggcgcgtcgggggcgcaggaggtcgccgtcgtagatcaggttgaagcgcgggtggccgtcctgtgcccgttcgacgacgagggtcaacgggtagtgcggcgctccctcgttgacgatgtcggcgatggcgagggtgtcgcccggtcggcgcagatcggccgcatcggtcgcgatgtcgaagacgaccagcgtgtcgaagagggagcccgcgccgctcagccttccgatccgtgcgagggagacatgctggtgcgccaggacggcgccctggtgccgcttcacggcgtcgagcaggtcgtacgccgtgtcgttcgcggtccaacgggcgcgcacgggaatggtgttgatgaagaggccgaccatgtcccggattccggggagttcggcgtcgcgtccggagacggtggagccgaagaccacgtccctgctgtgcaggatggacccgagggtcgtcgcccaggcgctgtgcacggccacactcagaggcactccggccgtgcgtgcggccacgtcgacgtcgtcgacgggctcggccgagacatcggcgaaccgctgggagggggtgtgcccctcagcgaccagggaggggcccggcagtccggcgagctcctcgcgccacacccggtcgctctcggcctggtcgcgtccggagagccagtccacgtagtcgcggtagccgccgtgcgggtataccgatcccggcgcgtggtactcggccagcagggtgcggagcatcggcggcaccgaccagccgtcggcgatgatgtggtgcacggtctgcaccaggacggtgcggtccgccccggcacggatgagcgtgtaccgcatcaggggtccggtggcgaggtcgaacccggcccggcggtcctgttcggcgaggtcgtggatctcctcgtcggtgagggccgggcggtccagggtggcgaagggcgcggtcctgccacgctcgacgacggagacgaccctgccgtcggcgagggccgtgaagcgggcggccaggttgggatagagggtgagcagccgggtggcggccgcggcgaggcggtcggtgtccacctctccgtccagggtcagcagctgctgctcgacgtaggcgccggtggcgtcgtcgtcgtagacggtgtggaagtagaggccctcctgcagcggggtcagcggcaggatgtcgtggagcgccgggccgtccagggcgtcgacgtcggcctgggtcagcggtaccagcgggaagtcgctgggcgtgtggccaccggcttcgagcgcggcgagtgacgtgagggcggagcggaagtggtcaccgagggtggtgatgtcctcctcggtgaagaggtcctcgggccaggagatggtggtgaccagttcgtacgcgccgttcgcgtcgggttcggcgatcgcgttgaactccagggcgcgcggcagccgcatcgacgggtcgcgcttctcacccaactgccccgtcgtgctgctgagttgccagtcgtccgaggtcccggcgtcgaagcggcccaggtagttgaagaggacctgcggcgcggggccggaggggccgtcgtcggccagatgacgcaggactccgtaggagacgccgttgctcggtacgcgggcgaggtcctccttgaccgccttgagggcggcggcgaggtaggcgggcgcggtgggatcgggcgccgctccgggatcaacgacgaccggaaagagggtggtgaaccagccgacggtgcgggacagttcgggttcgaaaccggccgtgggcgtgacgaagcgcccctcgcggccgtgtccttccagttcgatgtgggcgaacgtctggtcctgcccccggtcacggcgccaccgggcgagggcgacggcgagggcggtcagcaggacgtcgttgacgcctgcgtggaacttcgcggggatctcgcccagcagtgcggccgtggtcccgggtccgacggagacggttcgggtccgttcccgtgccacggtgtcggccgcggtgagcgcacgcctgccgat

SEQ ID NO: 3421 - DNA, 4550 bp, Unknown
  Kingdom: Bacteria, Phylum: Actinobacteria, Class: Actinobacteria, Order: Streptomycetales, Family: Streptomycetaceae, Genus: Streptomyces
cggcgagagcagcctcgccgcggcccgccggatgaccggcgaggcctcgggccgggtggccgtcctcagctacgcctcggcccggaaccccggcggcggctacctcaacggcgcgcaggcccaggaggaggccctgtgccgaggctcagccctccacgcgaccctgctgcgcgcccccgagtactacgcgcaccaccgcgccgaacgcagcgccttctacaccgatcgggtgatccactcgccaggggtgccggtcttccgcgacgaccgcggcgcgttcctggacgccccgtacaccgtcggattcctcacctcgccggcgcccaacgccggggtgatccagcggcagacccccgaggaggcccaccgcattccggcggctctggcctcccgcgccgaacgggtgctggaagtcgcggccgtacggggctaccgcaggctcgtcctgggcgcctggggctgcggggtcttccgcaacgatccgggtcaggtggcggaggcgttccgggcgctgctcggcgagggcggccggttcggcggccacttcgagcagatcgtcttcgggatcctggaccggaactccgactccgacgtccgggccgcctttgcccgggccttcagctgacccggggaccggcgtccggaccgtgcccgccgcgtccacacggctccccgccgcgtccacaccgctccccgcgtccacaccgctccccgacgcctcgccgttcagctccagccgtaccgctcgcgcagccgcccggcgacccgctcgaaccgctcccggtccagggcgcacgcctcccggcgcatcccgtcctcgtggacccgcagcacccggtcgagaccggcccaggacggccgccccgagctgtcccaggggcccgcgcccagcgccacccactcgtgttcccggtcgtgctgcttgctggagagctggacggcgagcagcgtgcccgcttcctcgcgggccacgacgagcaccggccggtccttcccgcgcccgtccttctcctcgaaaggcacccaggtccagacgatctcgccggggtcgggatcgccgtcgcgatcgggtgtgtaggaggtacgcacggggcccacatcgtcgggatcggcccgcaccgtggcggtcggcccgctgctgccgggcacgtcaaaggggttgtcggaacggtacgcgctgtcgtggaacgtcatcgccacaccgtagaacctccaccgcccgatcccgggagcggggcgtcggaccggcgccgcggggcggccttccggccaccgtgaccggacctgcgggccccgggccgaaacccgctcccacgggtctggaagactgcccgacgccatgagccagttacccaagcagcccgccgaagtctccgttccgaccagcgccgatgtcgcgcgcctcgccggagtgtcccgggccaccgtgtcgtacgtactgaacaacaacgccaccgtccggatcagcgaacccacccgacgccgggtcagggaggcagccctccagctcggttacgttccgcacgcggctgcccgcagcctgcgcgccggacacagccgcatggtcctgttgccctccggccacataccggcgggaccactgcaccagtacttcttcgaggaactccagtccgggctgcgccgcctggactacaccgtcgtccagtacggcagcgtcggtctcaccgccgacgaggctgccacggcctgggccgaactgaggcccgtcgccgtcgtcgtaccgccgggcatcgccctcaccccgcacggcacgggcatcctgacccgctccggcgccaaggcggtgatcaccctgggccccggcccggtggccggagcgcacggcctggtcatggaccaacgccaggtcggggccagcgcggtggaacacctgctgtcccgcggccgtcgccacatcggcgtggtcatgccccaggaaccgggccgggcgcccttctccgaaccccgcctcgtcggggcacgcggcgtggccgaaccggcgggggcccgggtatgcccgctcccgctgcggtacgaggaggagtcggcgcaccggctggccgcccgctggccggaactgggactggacgcggtgttcgcgtacaacgacgagtacgccatgctgttgatgcgggccctccaggacgcgggggtggccgtgcccgccgacacagcggtgatcggcgccgacgactccctcatcggcaggctgctgcgtccccggctcagcagcgtccggatggagctcgccatgccgcagccgctggccgagacgatcgaccgcatggtgcagcacccgggcgggccaccggtccatcaggacctgctccgcaccagcgccgtgcaccgggaatccagctgaccgcctccggcgcgacgacatgcgcgacacccggcggatgtctagcgtcggaggcatgagccacccgcagagttatgagctcctcctgatccccgaccacagcaggacgaggactggggcccccggcaggccgatccgatcagcggtcgtcaccgccaccggcgagacgggggcctcgggctacccccggtacgcgggcgagggcatggaggcggacgtcgatccggagacccggacggtggaagccgtgctcatcgacggcgaggaactcgactacggcatgtccgtccgcgtcgccggggccgagggagcgcgccccgcgtcctgagagccggggaaggggcgccgccacgggaacaccggctcgccgctcgcccgatcacggccgaggacgccgacaacgcgggcccatcctgcgccccgggcacgacgaaaggccccgaccgttcacaccgtgtccacggtgtcggtcagggccctgggtcgtaccgcgcgccagtaggacgcttacggggtctccggctgcccctgtcccgcctcggccgcccgcttctgctcctcgacggacttgcggacctcgtccatgtccagcttccgggcctgcccgatgacgtcctccagagccgcctcgggcagagcaccgggctgcgagaacaccgcgacattgtcgcggacgatcatcagcgtcgggatggaacggatctcgaaggccgccgccagctcctgctgcgcctcggtgtcgaccttggcgaagacgaggtcggggtggcgctcggaggccgagtcgtagaccggcgcgaactgccggcaggggccgcaccaggaagcccagaagtcgatcagaacgaaatcgttgtcgctgacgacctgatcgaagttttccttggtgagctcgacggtgctcatgctgggggtacctcttcctctgccggtggagtcctgacggttcctgtccggcacaacggtgactgcacttgcgctattccgcctgcccatgtggccggggggcacacccgcgaggacactgtttccatgactgacgcaggtaagaactccgagcgcttcgagtacgacgtagtggtcatcggcgcgggtccggtgggagagaacgtggcggaccgggcccgcgccgccgggctctccacagcggtggtggagtccgaactggtcggcggtgaatgctcctactgggcctgcatgccgagcaaggccctgctgcgccccgtcgtcgcacgcgccgacgcccggcgggtgccgggactgagcgccgcggtgcagggacccctggacgtggaggccgtgctcgcgcaccgggacgaggaggcgagccattggaaggacgacggccaggtcgcctggctggagagcgtcggagcggacgtccaccggggtacgggccggctcaccggcccccgtgcggtcaccgtcaccgcccccgacggcacggagcgtcgcctcacggcccggcacgccgtcgccgtctgcaccggctcccgggcagtagtcccctccctcaccggcgtcgaggaggcccgtccctggaccagccgcgaagccaccagcgccaaggaggctcccggccggctcgtgatcgtcggcgggggagtcgtgggcgtggagatggcgaccgcctggcaggcgctgggctccgacgtgaccctgctgatccggggcagtggtctgctcccgaagatggagcccttcgcgggcgagctggtcgccgacgcgctgacggaggcgggggcccggatccgtacaggcgtctccgtcaccgccctccggcgccccgcaccggacggccccgtcaccgtcgacctggacgacggcgaccgcatcgaggccgacgagatcctcttcgccaccggccgcgccccgcgcacggacgacctgggcctggagacgatcggcctcgaacccggctcctggctcaccgtcgacgacagctgccgcgtcgagggcacggactggctgtacgcggtcggggacgtcaaccaccgcgccctgctgacccaccagggcaagtaccaggcccgcatcgcgggcgcggcgatcgccgcccgcgccgggaagacccctctggagaccgctccctggggagcccacgcggccaccgccgaccacgctgccgtcccccaggtcgtcttcaccgacccggaggccgcgtccgtcggcctccgggtcggtgaag

SEQ ID NO: 3422 - DNA, 6393 bp, Unknown
  Kingdom: Bacteria, Phylum: Actinobacteria, Class: Actinobacteria, Order: Streptomycetales, Family: Streptomycetaceae, Genus: Streptomyces
ggtggacgtggggcgctggttggaggagttccatccgcgctccctggtcgagctggactacgggggcctcgtgcacgcgttgccggcggagcggctcgccggggaccggtcggcggcggacgtggcggaggggctcgccgcgctgcgggacggcgacggcgacggcgcgggggaggcgtacgcgcggctcgcggagcgctggcgggcggttcggcacctccagttcaccaattgacgtgaaaaggcccacagtggcatcaaggtgatggaaccggggcatccttcatccaggacggccgagaggccgacggacgggccgcgaggccggaccgtacggaaggaggaggaggccgggtcgcctcgacggagggcgacgaagaggggctcggcacacagttgacgggccgtgaacctgcgtcctgtgcggcgcgtgagatgtgtgaggcggaagcgtactccgccgggcctaggacctacgtcctgaaccggggcctttgcctcaagcgtgatggacagcactaacggggcccttgcgcctatccctacccctcatgccaaaataggacaaggagtccggggagggctccttctgtccaagtaagggcaggatgctcgacattgcactctatggggggtctggacgactcctgatcgctctgtgactgatcgtcaccggggcgtgactgtccgctatggcatggtccatcggcttccgtcgctgatgaacacctgggagggcaattccatcggtttggccgacgtggctggacggatggtgtagttgtagtgccgaggacaagccgttcgtcctataaccgactcggcccgcgtccgccatttcgggcaacgcgggtcaaggtgcagaatttagaggaaagaaccgagaaggttcggttctcccgaggaggccgctcatgaccgctcgcacccctgatgccgagccgctgctgaccccggctgaggttgccacgatgttccgcgtggacccgaagacggtcacccgttgggccaaggctggcaagctcacgtccatccgcacgctcggtgggcatcgccggtaccgcgaggctgaggtccgcgcactgcttgcgggtattccgcaacagcgcagcgaggcctgacacacccctgtctcgcagcaatacagcagcacagcatcacaacccgggcagctgcaaggtcccccaaccccagccgcccacccctagctccacacgacggacgcctgccccaacgggcgtcatacctgtgtcctacgggtgccgtcgtatcgatcgcgctggactccgccgggtccagcgcgatcttttttatgccccggacgggcctccccggcccgctcccggccctcgggggcgaccggcccagaaccgggcggtcggttggcttcagggagccgacgtgggcgttcgtgggtctgtgagcgggtctgtgcgggagtgtgggtgagcgtcccggacgcggtgggacagccccggacggaacggtcctcgcgagcccgtcacccccgtgcaattgcacatattaaattcaccagttgtaggggaggcgtaaaatcccccggtctgaaaactcgttcggtgactaccgtcacaccacctgatgcttgccaacgtccagcgtgccactgtccggacgcggaagcatccggccgatggtcatgtcgcggagggtctttcggtcccggccgcgttctcgtcggaccgtccggtggagccctgacgtccggcggcgccctgcggggcctcggaggcgctcccgggtgctctccgctccccgtcgcccccggactccatggcgaggcgcaggaggcgatggcagaccgcgcagtggcgggtgaggtggcgataggcggaagcggccgccagatgggcgcgcagcagcgcgcgggtctcatgtcgtgctgtgggcgcggacatacgagccacctcccggtgggcccggccgtcccccgccgcgtgaagcgccgaggaacgccgagaagcagggccagcctctgcttctacgaggtacccgtggcggtggtcggcgtcaagacgcgagaaagcccggatcgaaacgatccgggctttcatctactgcggtcctgacgggatttgaacccgcggcctccaccttgacagggtggcgagcactccaaactgctccacaggaccaggttttcgccgcttgccttgcggcttgctgcgaaaccagactgtacaggaggtgggagggtcaggtcgacttcactcctggtggtgactccgtcaccgccccgcacccccgctcgcgggccccggtgtcagggcgcgagggcgtcgatcgccttcacgatccgcttgtccgaaacggggaacgcggtgcccagcgcgtgggcgaaatagctgacccgcagctcctcgatcatccagcggacgtccagcacctcctgcgacaccggccggccctgcggaagctgttcgagcagccaggcgtactcgtcctgcatctcgtggaccttcgccatccgcgtggtgtcccgctgcacggccgtcggcatctgctggagccgccggtcggccgccacgagatagcgcatcaggtccggcagccggcgcagtccggtggccgtaacgaaaccgggcggtacgagacgggccagctgctcggtgacgtcggtgacgttggccaccagcgtcaggctgttggtcgacttcagccggcgttcgcaggcctgccacgcggccaggatctgctgcacctggtcgatcgtgcggacggtcaggtccaccagatcggcgcgcaccttgtcgtacagcgtccggaacgccttctcgtcccaggcaggtccgccgtgcgcggcgatcagccggtcggccgccgcggtggcgcagtcctcgaagagcgcctggaccgagccgtgcggattacgggacagggccagcttctgctggttggagagccggtccgaggcgaacttcgccgggtgcaccggaatgttcagcatgatcagccgccgcgtgccgcgccacatggcctgctgctgctcggcctcggtgtcgaagaggcgcacggccacggtgtcgccctggtcgacgagcgccggataggccttgaccggctgcccggcacgacgcgtctcgaagaccttgttcagcgtgccgatcgtccagtcggtgagcccggaccgctcgatggactcgccggacggccccgcggtcgccgcggccgccttggagagcgcctgccgggccttcggccgcagctggagcttcagcgcctccagatccttgtcctcggcgaccttccgccgccgctcgtcgacgatccggaacgtgatcttcagatggtccgggacccgggagaggtcgaagtcgtcggccgtgaccggcacgccgaccatccgctggagctcccgcgccagggtgaacggcagcggctcctggagcgggaccgcccggtcgaggaacttctcggcgtagttcggcgccgggacgtagtgccggcggatcggcttcggcagcgagcggatcagctcggtgacgacctcctcgcgcagccccggaatctgccagtcgaagccctcggacgtgacctggttgagcacctggagcggtacgtggacggtcacgccgtccgcgtccgcgccgggctcgaactggtacgtcaccttgaacttgagcttcccctgccgccaggagtccgggtagtcgtccttggtgacggcgccggccttctcgttgatgagcatggagcgctcgaagtcgagcgcgtccggctcctcgcgcttcttgttcttccaccaggagtcgaagtgcgccccggacacgatgtgctcgggaatccgctggtcgtagaagtcgaacagcgtctcgtcgtccacgaggatgtcgcggcggcgggcacgatgctccaactcctcgacctcgccgaggagtttgcgattgtcatggaagaactggtggtgggtgcgccagtcgccctcgaccagggcgttgcggatgaagaggtcccgcgaggcctcctggtcgatacgaccgaaattgaccttgcgctgagcgacgatcggcaccccgtaaagagtgacccgttcgaacgccatcactgcggcctggtccttctcccagtgcggctcgctgtaggtgcgcttcagcagatgcccggcgaggggctcgatccactcgggctcgaccctggcgttgacccgcgcccacagccgggaggtctccaccagttccgccgacatcacgaaccggggctgcttcttgaagagcgccgaaccggggaagatcgcgaacttggcgctgcgcgcgcccacgtactcgttcttctcggtgtccttcagcccgatgtgcgacagcagcccggccagcagcgaggtgtgcaccgcctgctcggggatggacgcctccgccttgggctcctcgacggtgatgcccatctgcttggcgaccgtacgcagttgcgcgtagatgtcctgccattcgcgaatgcgcaggaagttcagatactcctgcttgcacatccggcggaacgaggacgagccgcgctccttctgctgctcgcggacgtaggcccagaggttcaggtaggccaggaagtcggacgtctcgtccttgaaccgggcgtggttctggtcggcctgggtctgcttctccgcgggccgctcgcgcgggtcctggatggagagcgcggcggcgatgaccatgacctcgcgggcgcagccgttcttgtccgcctcgatgaccatgcgggccaggcgcgggtcgacgggcagctgggagagcttgcggccgagcggggtgagccgcttcttcggatccttctccgccgggtcaagggcccccagctcctgcaggagctgcacgccgtcgcggatgttgcggtggtccggcgggtcgatgaaggggaacttctcgatgtcgccgagcccggcggcggtcatctggaggatgacggaggccaggttggtccgcaggatctccgggtcggtgaactccggccgggtgacgaagtcgtcctccgagtacagccggatgcagatgccgtccgacgtacggccgcagcggcccttgcgctggttggcgctggcctgggagatccgctcgatcggcagccgctggaccttggtgcggtggctgtagcgggagatgcgggcgttgcccgggtcgatcacgtacttgatgccggggaccgtcagcgaggtctcggccacattggtcgccagcacgatgcggcgtcccgtgtggcgctggaacacgcggtgctgctcggcgtgggagaggcgcgcgtagagggggagcacctcggtgtgccggaggttccgtttgttcagcgcgtccgccgtgtcccggatctcgcgctcgccggagaggaagaccaggacatcgcccggggcctcgtggcccagctcgtccacggcgtcgcagatcgcggtgatctggtcgcggtcggagtcctcgctgtcatcttcgaggaggggtcgataccgcacctccaccggatacgtccgcccgctgacctccacgatcggcgcctcgccgaagtggcgcgcgaaccgctccgggtcgatggtcgccgaggtgatgacgactttcagatccggacgcttgggcagcagccgggccagatagccgagcaggaagtcgatgttcagggaccgctcgtgggcctcgtcgatgatgatcgtgtcgtacgccagcagctcgcggtccgtctggatctcggcgagcaggatgccgtccgtcatcagcttcagatacgtcgactccgggttcacctggtcggtgaagcggaccttccagccgaccgtctcgcccagcggcgtcttcagctcgtccgcgacccgctccgcgaccgtgcgggcggcgatccgccggggctgggtgtgcccgatcatgccccggacgccgcgccccagctccatacagatcttggggatctgcgtggtcttgccggacccggtctccccggcgacgatcacgacctggtggtcgcgtatcgcctccaggatctcgtccttcttctggctgacgggcagctcttgtgggtacgacagggccggcagccgggccgcgcgcaccgcgagccgttcggccgccttgcccgcctcggccgcgatctcgtccagcacggactggcgggcctcgggcttgcggatgcggcgcgctccttcgaggcgccggccgagccggttcgcgtcacggagcgagagctgtccgagctgggactggagatcggcgaaggaagtagacatacggctcccaggatctcacccgggcccacggagtggcgacctcatttcgcgcgggctacgtcacgcggcacgtaccatttcgggcagtcgaacgctccgtcaccgtcgcttccgcgagaaaggcccggtcccgtgtcccgtacgcagtggtggggcctgacggcgctgctcgcggt

SEQ ID NO: 3423 - DNA, 8190 bp, Unknown
  Kingdom: Bacteria, Phylum: Actinobacteria, Class: Actinobacteria, Order: Streptomycetales, Family: Streptomycetaceae, Genus: Streptomyces
tggggccgcccatcgggccacccatgggaccgccctgcatcgggccggggccgtgcgggccctgcggaccggggccgtggccgccctgggggccgtggccactgggacctgcgggcagctgcggcgcgccaccgggcagctggggcggacccatctgcggaggctgctgctgctgcggcggtcccgatatggcggcgggaacgggtgcacccgggcggtcctgctgctccgggggcttgcgcataccctgctgctgttgctgctgctggttctgcgcggcggcacgcgtcgcggcggccagcttggcgcgcaggtcctcgttctcacggagcagacgggtcagctccgattcgacctcgtcgagaaaggcatcgacctcgtcctcgtcatagccttctcggaggcggacggtcgtgaactgcttgttccgcacgtcctcgggggtcaacggcatctcttcttcacctctacgtagtcgtcggcagtcggcaagaccgtatcgctcacaacctgaccacaacgctgatcaggatgtagacgatgatcatcagaacgaagaaggacaggtcgagtgccacgcccccgagacgcagcggcggaatgaaccgccgcagaagcttgagcggtggatcggtgacagtgtaagtggcctcaagtacgaccaccatcgccttgccgggttgccatgaacgtgcgaactggaagacgtagtccatgaccagccggaagatcagcacgatgaggaaacacatcagcgcgatatagaccacatccagtgcgacgcccatgtcccgcggttccctctcccctggctctcgtcagctccggcctcgtggccggcaccggcctctcggccgggttgttcccggtgtcgtgttctcagctctggttgaagaatccgccctctgcgatgcgggccttgtcctccgccgtgacatcgacgttagcaggcgacaacaggaacaccttctgcgtcacgcgttcaatgctgccatggagaccgaagacgagtcccgcggcaaagtcgacaagtcgcttcgcgtccgtgtcgtccatctccgtgagattcatgatcaccggagtgccctcacggaagtgttccccgatggtacgggcctcgttgtaggtcctggggtgcagcgtggtgatgcggtacggctcccgctcggacacgaccttgggcatgatcaccggtgcgttcttctccatgttcgggcgttcaggtgtgatggatgccacgggtgcgattcgggcgggtcgcccgctttccgccgggagctgaaccggctcgcgctgggcgggtggttgcactactcgtaccggttcgtccctttcgcgctcacgctcacgatcgcgctcgcgttcccgctccacctggtgcgggggctgatgccgccgccggtcgcgctcgggctccggctcaggttcgaattcgtcatcggggtcgaaccccggaccgtcgtacccatcgtcctccacgaggccgaggtagaccgccatcttgcgcatcgcgccggccatgctccgagtcctccgctctgtggtggatcggcattcgtcaccaagtgcccgcgatccacggtggcctgtccgctgtgagcggcaatgaccatattttctgctgtggtccgacttgcttcgcgacgttacccgagccggggtcggtctccgagtaccgccgtaccgacgcgtacatgtgtcgctccggccgccaccgcgtcctccaggtccccgctcatacctgcggagaccatgttcgcagccggatgaccggcgcgcaggcgggatgagatttccatcagccggtcgaacgcggcccgttgccggcctgcgtactccccggccagcggcgccacggtcatcagtccgtcgagccggattccgggagccgtaccgatcgcggccgccaactcctcgaccccgtccggcgcgacaccgccgcgctcaccgcgctcgccgctctccgcgtccagggctacctggatcagacagccgagttcacgctccccgcgcaccgcggcggaggagagggcggtgaccagcttggcgcggtccaccgactgcacgatatcggcataactggtcacagaacgaaccttgttcgtctgcaattgcccgacaaagtgccatgtcagcgaaagatccgcacaagcagtggctttgggggccgcgtcctggtcacgattctccgcgacatggcgcacaccgagttcatgcaggatccgcacatcgctcgccgggtaggtcttggtgaccacgatcagggtcacttcctcgcgccggcgaccggccgcggcgcaggaggaggcgatcctttcctccacctgtgcgagattcgcggcgagttgcgccttacggtccgtcatgccctatcagtccaaccagacatatccggcgagccgcccggtggtgcggtcgcggcggtacgagaagtggtcgcccgattccagggtgcagtacggcgaggagtgccggtccgccacgccgagagcggcgagctgggcgtggactccgccggtgacgtcgaccgccggggttccccagctggtctcggaccaggtgccggggacggcctcggcgacctcggcccgcatcgcctccggcacttcgtagcaccgtccgcagacggccggcccggtgtgcgcgatgatccgggaagggcgtgcgccgagcgcgaccatggcctcgaccgccgccggaacgactccggcgaccagccccggccgcccggcgtgcgccgctccgacgacaccggcgaccgggtcggccagaagaaccggagtgcagtcggcggtgagaaccgcgagcggcagtccgcgccgggcggtcaccaccgcgtccacggccggaatctccgcgtccgcaccccagggtccgtccaccaccgcgacgtcccggccgtgcacctggttcatccagacgacgccggccgggtcgagaccgaggcgacgggccgcacgctcccggttcgcgccgacggcggcggggtcgtcgccgaccgcgccgccgaggttgagctcaccgtacggagcggcgctcactccgccccaccggtcggtgaaggcgaaatgagcgctgcccgtgacgggtgccgcccggtgctgagctatcacttcaagaagtccggaacgtccagctcttcggcctgggtgtcctggtagggacgggccggcgggacgtgcggcggagagaccggcgggagcgcgctctcactcgaagcggatgcgggggcgggctcggccggagccgggctctcctcgcgcagaggtacggaaccgagtccgcccgtcgggcgcgtggactcggcggaggacctggtcggagcggccggctcctcgcgcttgttgctgttcgcgccgaggacgttctcccggcgggcaggcggctggccgccgtcgaagcccgctgcgatcacggtgacccgcacctcgtcacccagggcgtcgtcgatgacagcgccgaagatgatgttggcctcggggtgcgcggcctcgctcaccagctgggcggcctcgttgatctcgaacagaccgaggtcgctgccgccggagatggagaggaggacaccgcgggcgccgtcaatggaggcttccaggagaggcgaggagatcgccatctccgccgccgccaccgcgcggtcgtcgccgcgcgccgagccgatgcccatgagcgccgatccggcctcggacatgaccgacttgacgtcggcgaagtcgaggttgatcagacccggggtggtgatgaggtcggtgatgccctggacacccgagagcagcacctggtcggccgacttgaacgcgtcgagcacgctgacctggcggtccgagatggacagcaggcggtcgttgggaatgacgatgagggtgtcgacctcttcgcggagttcggcgatgccgtcctccgcctggttcgcgcgtcgccggccctcgaaggtgaacgggcgggtgaccacgccgatcgtcagggcgccgagcgagcgcgcgatgttggcgacgacgggtgcgccgccggtgccggtgccgccgccttctccggcggtgacgaagaccatgtcggcccccttgaggacctcctcgatctcctcacggtggtcctctgccgccttacgaccgacggccgggttcgccccggcgccgaggccccgggtgagttcgcggccgacgtcgagcttgacgtcggcgtcgctcatcaacagggcttgtgcgtccgtgttgatcgcgatgaactcgacgcccttgagaccgacctcgatcattcggttgatggcattgacaccaccgccgccgacaccgatgaccttgatgactgcgaggtagttctgcggtgctgccacgtcgaaggcctctcgcctcgagttacgtgtcgtcgctctgcggtaaccccgcggcgacgactgatgtcgatggggacggtccgaacgccgacccaaaccctaacgttgaagtttagggttaccagtgtgtctgcttcctggactcttccgaacaggacactaagtcgacaagtggcgcacgttcaacgaacacgccgaacctcccgtttttcttttcaccctatgtgatcacccgtagcgctgaccaaccagggtgctggccagcacaaatacccgtcaactcgccgataccgccggggcggtgggagcgcttacgtcgaactgtcccgctttgggggcggctttcatgagtgcggtgaggacgcgcgccttcacccgcccgtcttcgccgctcccccaggtcaccacacgatcccgggtgagccgcaaggagatcgcgtcgtacgagatgacccgtacggcctcggtgtccttggccacacccgccggaaggtcgccggcgacccggaccgcttcccgcaacagaccgtcaccgccgaagcggcgaaggctcgcggacggttcgggagtcagctccagcaggggcacgcccttcggcgccttgtccacggtggcgaagcgcacacccttggcatccacttccacgaaggcgccgcccttttcgaccagcaggaccggcttccgctcggtcaccttaaggccgatgccgtccggccaggaccgaacgacatcaactgtgtcgatacgaggcaacttctggcgcaaccggcgctccatggcatcggtgtccacggagaccagcggggcgccgatcggtgtggcggcaaccgcttccacttcttcgcgggtcaggacctcgacgccgctcgtgctgaccttctcgacacggagccaggaggagccgtagagcacccagatcacgaacgcggtgaggagggcggtcgcgacgccgatcaggatcagcagggtgcggcgcccgatccgggacccctcggggccgatgcgcggcggacgggaggtggtgtccgcccgcccgggtgcgccgcgctgggcggtcgtctgtccggccacgctcgctccttcgccggacccgggacgcccgccccgggtccgcaccgcatcgcgccggacgcctagcggcgcgcggcaatcgcttcgtacaccatgccgacgagcaggtcgtcggcgtcgcgccggccgaactcggccgcggcgcgggacatttcgtacagccggtgggggtccgacagtaccggcaggacgttgccctgcacccactccggggtgagcgccgcgtcgtccaccagcaggccgccgccggcgttgaccaccggctgggcgttgagccgctgttcgccgttgccgatgggcagcgggacgtaggcggcgggaagcccgacggcggagagttcggcgacggtcatcgcgcccgcgcggcagagcatcatgtcggccgcggcgtacgcgaggtccatccggtccacgtacggtaccgggatgtagggcggcatcccgggcatgttgtcgatccgcggcaattcgttcttcgggccgaccacatggaggatctggatcccggagcgctgcagcagcggcgcgacccgctggaccacctcgttgaggtggcgcgcgccctgcgagccgccggagaccagcagcgtgggcaggttggggtcgaggccgaaggaggcgcgggcctccgggcggacccgggcgcggtccagggtggcgatggtgcggcgcagcgggataccgatgtaccgggccccgcgcagcttgctgtcgggggtggagacggcgaccccgtgggcgtaccgcgaaccgatcttgttggccaggcccgggcgggcgttggcctcgtggaccacgatcggcacacccgcccgcttggcggccagatagccgggcagtgcgacgtagccgccgaagccgaccacgcagtccgccttggtgcgctccaggatctgctcggcggccttgatggtgccgcgcagccggcccgggacggtgatcagttcgggcgtgggcttacggggcagcggcacggcgggaatgagcgccagctcgtacccccgctcgggcacgagcctggtctccagtccgcgttccgtgccgagggcagtgattcccacggtcgggtcctgcctgcgcagggcgtctgcgagggcaagcgcgggctcgatgtgtccggcggtccccccgccggcgagtacgacatgcaccgaaattcaccgctctccggacggacgcttcttgacgcgccgtctcatcgtcttccatctcaccccgggcttccgcatggccagggccgccttggcggctgggtcctcccgtgcgaaggcgatcatcagcccgaccgcgaacatcgtcggcagcagggccgaccccccgtaggagaacagcgggagcggaaccccggcgatcggcaacaggccgagcaccgcaccgatgttgatcacggcctgggccgtgatccacgtggtcacgcctcccgcggcaaacctcacgaaggggtcctccgtgcgtccggccacgcggatacccgcatagcctagagccgcgaacagggcgagcacggacagcgtccccgccagacccagttcctcaccggtgatagcgaagatgaagtcggtgtggggttccgggagttgaccccatttttccacactcgcacccagtccggaaccgaaccatccgccggacgccagagcatagatcccgtgtgcggcctgccagcagccgccctccgggtcgggctcgctcacgcccatgcaggcgagccgggacatccggttggggctggtcctgatcaggaggaacgcgatggcggcggcggagccgaggactccggcgaacagccgggtgggggcgccggccagccagagcagaccgaacaggatcgccgtgagaatgatcgcggttcccatgtcgccgccgagcatgatcagtccgagcagcatgaaggcgaccggcacgagcggcacgagcatgtgcttccactgcgtcagcaaccgcttgtcctgcttgcgggccagcaggtccgccccccagaggatcagggccagcttgccgaactcgctgggctggagctggaacgggccgcccagatagagccagttctggttgccgttgaccgacatccctatcccgggcacctggaccaggaccatcaggaagacggtgaccatcagtatcgggtaggccagcgcccggtggagcttcacgggcatccgggcggcgagcagcatcagagcgcccccgatgacggcggcgaggaactgctttccgaagaagtacgtcgcgggcttgctgatgtccagcgccttgatcatcgaggcggagtagaccatcaccaggcccagcacggtgatcaggaggctggagccgaggatcacgtagtaggcggtcaggggccggtcccaggcccgccgcgcccgctcgtaggtgcggcgcggtccgccggcgcgcccggtgcgcgggcccgggccgccgcgtccggagccgcggggcgtctcgggacgccgggcgccggtggcgaggcgcccgcgcagggcgagcccgtcgggcagcggtactccggagggtgcgggcgccgcggcgagggggcggggaaccgaggcccgtgcgcggtcccgccgtacggcgaatctctcgtcggccggcattgtcgctgtcccctccactgctcgtgcccggggcccgtgaccccgggcgcggaggcccggtcggtcaggcgctctcgtcggcgcgtgcgcggaccgcgtccgcgaacgcctcgccccgcttgttgtagttggtgaacatgtccatcgaggcacaggccggggccagcagtaccgtatcgcccggccgggcga

SEQ ID NO: 3424 - DNA, 12296 bp, Unknown
  Kingdom: Bacteria, Phylum: Actinobacteria, Class: Actinobacteria, Order: Streptomycetales, Family: Streptomycetaceae, Genus: Streptomyces
gctcctgatccgggcgaggagacctctggcggccagggtgagccaggcgatccttgtgtgccgggcgaggggtccggtggctgagcccggtacggtccgcgcgtcccgcgcccgggccgggccaggtgcgggacgcggccggacattctcgttcacgccgcatggcgcacgacgccgttcgcacggtactttcccgcccggcacacggaactacctctcccctccgctgggggggcgtcgtgggtgacatgctccggggtcacgcccgcccgggatggtcgcccggcccgtgcgcccggccggccagtggagtgggtgagaggtcggcccgctcctcgccgggctccaacagggtgtccgccgggccgaggatcagcgggtccggtgttcctacggccttctcgtccttgctgtcgtagtcgaaacgccacagaaggctgcgcatcgcctccagcctgccgcgcttcttgtcgttgctcttcaccacggtccacggcgcgtactcggtgtccgtggcccggaacatctcgaccttcgcggtggtgtactcgtcccagagatccaaggaagccacgtcggtcggcgacagcttccactggcgcaccgggtcgacctgccggatcgcgaagcgggtccgctgctcactgcgggagaccgagaaccagaacttcaccagcagaacaccgtcatcgacgagcatccgctcgaactgcggggcctgcttcaggaagtgctcgcactgctccggtgtgcagaagcccatcacccgttccaccccggcccggttgtaccaggagcggtcgaagaagacgatctcgccggcggtcggcagatgtgccacataccgctggaagtaccactgtccgctctcgcgctcggtgggcttctccagggcgaccacgcgcgccccacgcgggttgagccgctcggtgaaccgctggatcgtgccgcccttgcccgccgcgtcgcggccttcgcacaggaccaccagccgctgcccgctctcgcggacccaccgctggagcttcaggagctcgatctggaggaatcgtttctcccgttcgtactccctgcggcgcaccctccggtcgtacggatagttctcccgccacgtctcaaggggacggccctgctcgtcgaggagcacgggctgctcggggcgccggccgtcgacggtcagtcccttcagcagctccgtggggtcggtgttccggccgtcgtcggtcatggtcgtgttccccgttcgcttcacatggtccggtgcggcgggagagggcccacccgccgcggatgagccctctcccgcacgagcatgttccccgacagccgccgggcatgtccgagcgggcgcggtgaccgggggtcagccgcccgacagcacctcggacaggtcgtaggagacgacctcctccaactgcgcgtacgtacagccggcgggggaccggtccggccgccaccgacggaactgggtggtgtgccggaaccggtcgccctccatgtggtcgtaggccacctcgcacacccgctccgggcgcagcggcacccaggactggtccttcttgcccgaccagcggttctgcgtccccggcagccgggactgctcgtgcgccgccgcgtccgcccaggcgctccacgggtgctcggtgaacccgacgcgcagcggcgcgagttccccggccagttcggcgcgccgcttcatcgggaaggccgcacagaccccgacgtgctggagtacgccgtcggcgtcgtacaggccgagcaggagcgagccgacgaccggaccgctcttgtgctcgcggtagcccgcgaccacgacgtcggcggtccgttcgtgcttgatcttgtacatcgcccgggcgtcgggccggtaggggaggtcgagcggtttcgccacgatcccgtcgagtcctgcgccctcgtaccgttcgaaccactcccgggcgacctcgatgtccgtcgtggccggggcgaggaacaccggcgcggacgcttccgagagcgccgcttccagcacctcccgccggtccgcctgccgggtggggagcagagaggtgtcgtcgaccgcgaggacgtcgaacgcgatcaggctcgccggggtctgctcggcgagcagccgcacccgggagtccgccggatggatgcgctcgccgagccgctcgaagtcgagccgtccctcgtgggcgatgacgatctccccgtcgatcacacagcgcggcgggaggttgtcccgtacgacgtcgaccaggtcggggaagtagcgggtcagcgacttgcccgtgcggctgccgatctccacctcgtcgccgtcccggtacacgatcgcccggaagccgtcccacttcgcctcgtagctcatgcccggcgggatggtggacaccgacttggcgagcatcggcttcacgggtggcatcaccggcaggtccatggggccgattctggaccggctgcccgcccgtgtctcccgatgtgcggcatatgtgcgaccggcctacggtgtccgtcatgggagcagcggtggagctggacgcgggcggacgggccgtgaggctgtccaacccggacaaggtgtacttcccggagaagggctacaccaagagggacgtggccgagtacttcctggcggtgggaccggggatcacccgggccctgaaccaccggcccaccacgctccagcgcttcgtggacggggtggagggtgacttcttctaccagaagcgtgctccgaagaaccttcccgagtggatccccaccgcccgcatcgccttcccgagcggccggcccgccgacgagatctgccccaccgagctcgccgcagtcatctgggccgccaacctcggcaccctgaccttccacccctggcccgtccgcgccggggacaccgaccacccggacgaactccgcatcgacctggacccgcagcccggcaccgactacgccgacgccgtcaccgccgcccacgaactgcgctccgtcctggaggaccacggcgtacgcggctggcccaagacctccggcggccggggcatccacgtcttcgtgccgatcgagcccgcctggaccttcaccgaggtgcgccgcgccaccatcgccgccgggcgcgagctggagcggcggatgcccgaacgggtgacgaccgcctggtggaaggaggagcgcggtgagcggatcttcgtcgacttcaaccagaccgcccgcgaccgcaccatcgcctccgcgtactccgtacgccccttcccgcacgcaccggtctccgcgccgctgcggtgggaggagatcgacgacgccgaaccgcgggacttcgacatcgtcacgctcccggtgcgctacgccgaactcggcgacgtccacgccgacatggaccaggaggcgttccggctcgacgccctgctggagctggccgaccgggacgagaaggaacgcgggctcggcgacatgccctatccgccggagtatccgaagatgcccggcgagcccaggcgcgtccagcccagccgcgcccgccacgatgacgacgacggcgagatggcgtgagcgggagcggcgagcggcacggcgcgcacggacgtaccccgaccctccgggagcgctgggaggcgtacaagaacagcccgttcctgcccgcgaccgtgctcgtcctgatcgtcgccgccgcggccggtctcttcgccggctcctacacgtacgcgatggccgaccccaccccgcaccgcattccggccgccctcgtcacccggccggaggtggtccgcggcgaggtgttcgtcgcgggaatggagaaggccctcgacgcctccctcgaactgcgcgactacccggacgccgccgacgcccgccgcgccctcgacgagcagaaggtcttcgccatcgtccgcgcgtccgacgggggagtcgccctcgacgtggccggagcctccggcgcgtccgtggccgagctgctcggcaaggcgggcctggaggtgggcgacgccaccggggtcgaggtcacggtccgggacatcaagccgctccagcggggcgacccgcgcggactcgccctgttctacatttcgctggccgccgtgatcatgggtttcctcggcgcgatccagctcagcgtgcacgcccacggcctgaacccggccgaacgcatcgccttcaccgtggcctacgccctgctcggcggattcgccatcgccgcggccgtggactggtggctcggggcggtggacctgccgttcgtccagtcctggctgatcctggcgttcacgatgttcacctccggcatggtcttcaccatgttcaacacgttgatgggtcgctgggcgatgatccccacctggggcgtcatggtgctgctcggcaacccgtcgtccggcggggcggtgtcctggccgctgctgccctcggcgctcgggcacatcggccgctggctgccgccgggcgcctccgtcaacgcccagcacaccgccgtctactaccagggccaccaattcgtcttcccgtacctggtcctcgccggctgggcgctggtctcctgcacggtgttctgggtgtggcggcaccggcaccccggtggccgcgcccgcacgccggagcatgcggacgcggccacctgagcgttccctgcggtctacagctccttgatccggatgtcgcggtacgagatgacgtcggtgacgccgtgcacctggagcccgatgtagccggaggcgaaccgccggccgtcggtgcccgggtcgtcgccccgcggcggctcgaagagctgaccaccggtgttgtcgaactcgttgatcaggacaccgttgcggtagatctcgtagtgctggtcgaccaccttgatctcgtagtcgttccaggtgcccttcggcgtgacgccggcgccgccgagacccacccggtcgaagccgtacaccgaaccggtcttgtacatgtcgccgtccggccggtcgttgacctggatctcatggccgtacttgatggcgacccactccggacgcgactcctccgggtggtcgtggacgttcgggaagcggacgaagaccccgccgttggcgttgcccgagcccggggcgtcgtcccgccactggagcttgagcgagtagtcgccgtaggcccggttcggcagccacagcatgcccatcccgtccaccgtggtggagctggtgatggagccctcctcctcgttcagctcgaacttgcccccacccacgtgctgccacttggcgagcgaggccgccgtgccgtcgaagagcttggtgtagccctcgacctggcccggcttcccgatgcccgactgcttggcggcctggttgatcgccctgcgttcgcgctggtcgatgacgccgtcggtcttcagcctgtcgagcaccgtcgtcacgtgcttgaggaacagcgcgtgggaggaccagtccttctcgtcctcgatcagctcgttgatcgtgcagcggttgcgcgtgatcctgttgggcacgcccgtgtcgatcgtgccgacgaagacggtgtgccgctcgtcgaactccgcgcagttcggcgcgggaaccccgccgccctgggcgatggtgaacgacaccttcttggcctcggaggtgttgcccgccttgtccgtcgcccggtgggcgatggagtggtaaccgacccggtcgacgatcaccggggtggtgtaggcgaggtacggtccgccgtcgaggctgtactcgaccttgtccacgcccgagtcgtcgtcggtcgccgagacggtggccttggcgctggtgatgaacgcgccgtcgctgttcttgtcgccctcgaccttcaccgaggtctccggggccgtccggtcctgcgacggcggctcgaccacggtgaagtcgacggccttctcgtccgccacgttgcccgaccggtcggtggcccggtagcggaccttgtgctcgcccaccgcgtggaccatcaccggtgcggtgtacggctgccacgcgccgtccgcgccgagcgcgtactcgatggtgttgacgccggacccggtgtcggacgcggtcacggtgaccgtggccatccccaggtacgcgcccgcgtcgtccttctcgcccgagacggtcgccgaggtctccggcggcgtcttgtcgtcggtcggcggcgcggcgaccgcgaagtcgacggttttctccgccgccatgttcccggccttgtcggtggcccggtagcggaccgtgtggtcgccgacctcgttcaccacgacgggcgcggtgtagggctgccacgcgccgtccgcaccgagggcgaactcgacggtgtcgacgccggagcccgcgtcggtggcctcgacggcgaccgtggcctggccgatgtacgcgccgtcgccgttctggtcgccgtcgaccttcgccgaggtcgcgggtgcctcggtgtcctcgccgctgccctcggtgacggtcaggatgccctgcatcatgccgtggccggggatcgtgcagtggtagaagtaccggccgggcgacagcgtgacctccacgctgtgcttgccgccctcggcgtcgcccgggttggccaggatgttcagttggacgtcgttgttgaactccgggtccgacacgctgaacgtcagcgtgtgcggcatgctcgtcgtgttcccggtggccgtgctgttctcgaagacgatggtcgccttgccggccaccgccgtcttcggcgcggacagatagcggtcgatcgggtcgcccgcggtccaggtcagcacctggtcggcggctgccgccgggggagcgtcgtcccccttgccgtacgcggccgtcgaggtgagtccgaggaccatcaggagggaggccagcagggccacccagaagctcggcggacggtgccgcccgcgtgcgaggtgcgggtgatgtctcacttcgctgccgcctttccgacgagatccttggcggccggggtcgcggcgccgcccttgtaggtcacgcgccacagcgcggacttggggtcggaggtgaagaagccgcgcccgtagtccaggacgtacagcgaaccgtccggcgcgaacttccagtccatcaggttgcggatgccgtccgccccgaccgggatgatcttcttcaacgactcggcgtgcgtgggcagcccgcccttgccgaccgtcctcgggtcggtgagcacggcgtgccggggctgggtgtcgtcgtagaagtctccgacgaaccacttgccgtcccagtaggcgggccacttggcggtggactcgctctgcgcgtcgtagcggtagaccgggccgttcatcgtggcctgcccgccgcccttgagccacgggagcagctgcttgccctcctccgccttgtagctcggtacgccgttctcgtcgcgcgggtagtcgaccccgccaccctgcggggagtaccagatggtgttaggggtcaccggcgggatcttgaccaggccgtcgttgtgcggcgactcgttcttcggcgcgtcgcagtcgtaccagcccagcggcttgctcgggtcgggcagattgcggtcccggtagggctggttgttgcccatgcagtacggccagccgtggttgcccgccttggtgatcgcggcgaacgtgtcgtacttcgccgggccccaggtggtggacggggagcccgcgtcggggccgacccagcccgcgtacagcgtgtccgtcgaggcgtcgatcgagatccgggccgggttgcgcacacccatcacatagatctcgccgcgggtcttcccgccgccctcgtccggctcctcgccggtgaagaggttgccggacggcagggtgtacgtgccgtcgtcctccgggtggatccgcaggatcttcccgttgaggttgttggtgttgcccgcggtgcgccgcgcgtcggcgaaaccgacgcccttgtagttcggctccgggttgttgccggagtaaccaccgctgaagcctgaggagttgttgtcaccggtcgcgatgtacaggttgtccttcgagtcccacgccatgccgccgcccgcgtggcagcagctgttgatctgcaccggccagccgagcagcaccttctccgaggccaggtccagcttgccggtcgcggagtcgaaggtgaagcgggagacctgacgggtcgccatgcgcttgtcgcggtcgatcttcgcgtgcggggtgtagtgcagatacacccacccgttggacgcgaagtccgggtccagctcgatgccgagcaacccctcctcgaccttgaccagttcgtcgccgccgcccttgttgccgaagacgtccagcgcacccgccagggtgaccttcttggtcttcgggtcgtagacgtggatctcgcccttgcccttgccgatgttcgggtcgttccagtcgatgacgaccgggacggagctgtcggccccgccgcgcccgatgtagaagacccgcccgtccggtgcggtcaccagaccgtgcggctcgccgatctggtcgttctggcccggctggttgggctgggtcaggcgctcggcggtgtagttggaggtgatcgtcgccttgcagtcggcctgcgaggtccggttcgtccaggcgagggcgccgcgcagatggtcgcggaagtcggtctccgcgaagctgtccgccgtaccgcccatggccgtgtagaaggaccggccgccgtcgtagtcgcggcaccaggagaccgggtggtcccagccgttggcgctcgcgcccggcttgtacgccaactcccgtacacgtgccacggtgtgcacgtcaccggacgggttcttcgtccagttgagccacttgtcgggacgcttccactccagcggcaggttcttggtggccgggtggacccggtccccgatctcgacggtcgcccgctgtacggaagccgggctgttcgcggcggggcgggctccgaccagaccggtgaaccagtccgagtacggctcggtgcgcgccgcgtcatggatgccgaggaagccgccccccgcctccatgtaggcctccaggcccgcttcctgctccgggtcgaggacgtcgcccccgccggtgaggaagacgacggcgtggaacgagccgagccgcttgccgttggtgaagacccgggggtcggccgtggccacggtggcgaaccggccggactccgggccgctcagcccgatcttctcgatcgccgcgataccggcgtccgtgtacggtgcctcgtcgccggccgaggcgtggaagaccagcaccttgacctgcttggcggaaccgggcggagtcggcaaggacaacgttgtcgccatcttctccaccagggcccggtccggcgacggatccgcgctggccgggccgccgctgcccagcatggacacggtcagtgcgccggccgccacggccgccgcgaggccgcgtcgtgatctggaccggtgatgtgatgcgcgctgcatgtggtcactcacccctctgtggtcactgcacctctcggtgactgtggcttgctcactcttcgtcagtacctcttgattcactgcgacagcgcacgaagctagacctcttttcgcggtccgccaataggtatggcagcaatcgtgtgaactttgtcctgggtgtggataaacgagggtgccccggctacggtgtggcccgttccgggatcccgtgagcgccgttccgtttcgacggcatcgccagtttccttatcgcagtggggagttcgacatggaccgaaggaccttcagccggcggatgctggtcggtggcgcagccgtggccacgacgggggtgacatcgttgtcgctcggggcggtggaggcgagctcggccgagaacccgccgcgtacggccccggccggcggcgtggtgcgacggctgaagatgtacgccgagaagttggcggacggtcagctcggctacggcttcgagaagggcaaggcctcgatccccggccccctcatcgagctgaacgagggcgacacggtccacatcgagttcgagaacctcaccgacgtcgacgccagcctccacgtccacggcgtcgactacgacatcgccaacgacggcacccggatgaacaggagccacgtcgagcccggcggcacccggacgtacacctggcgcacccacgccccgcgcctccgcaaggacggcacctacgagccgggcagtgcgggctactggcactaccacgaccacgtcgtcggcacggaccacggcaccggcggcatccgcaaggggctctacggtccggtcgtcgtgcgccgcaagggcgacatcctgcccgacaagaccttcacgatcgtcttcaacgacatgacgatcaacaacaagacggcccacaacagtgtcaacttcgaggccacggtgggggatcggctcgaattcgtgatgatcacgcacggcgagtactaccacaccttccatatccacggtcaccgctgggccgacaatcggaccggcctgctgaccggtccggaggaccccagccgggtcatcgacaacaagatctgcggacccgccgactccttcggcctccagatcatcgcgggagaacgcgtgggcgcgggcgcgtggatgtaccactgccatgtccagagccactccgacatggggatggccgggctcctgctgatcaagaagccggacggcacgatcccgggctacgaaccccaccacgcggcgggcggcacggagcagaagaccgaggagaagtccggcgcgaagggcgccgaggaggaggccgggaaggccgccggggagcaccggcactgagcccgtccgtcacgggtcccgtgccgagggcgggcccggtcacggacggcggtcgtcgtccgcgagccgctgctgctcctcctcgacgatgcgccgggccagcgcggcgtcggagacgtccaccgcgtccggggtggtctccgcgaggtcgctgcgccgggcgtacgcgtcgaagagccggtccttgcgggccagcagctccaccaggcgctggtcgacgctctccgtggccaggagccggtgcacctggaccgtgcgcacctggcccatccggtgcgcacgggcgaccgcctggtgctccagcgtgggtttgatctgcggctcgcacaggatgaccacggaggcggcctgcatgttcagcccggtgcccccggcctggatctggctgagcagcaccgcgtgcccctccaccgaggagaaggcgtccaccagctcctgccgccgggccggcgggacgctcccggagagcggcccgaaggcgtccgggcccagggcgtccccgaccgccgcgaggacctcgcggaagtaggagaagacgaccaccttcaggccgttgtcccgcgcctcgtcgacgagttcgcgcagccgctccagcttggcggaggacccgggcacggcgtaggcggcccggcgcatccgcatgaaccgcccggaggcgaccgcctcgcggtaggcggcccggtcctcggatccgaactcctcccactcgtccacctggaccagcgccgggagttcggccagcacgtcgacctggttgcggcgcagataggcgggggcgacggcccggcggaaggcacgcgaaccggccgcgccgtgcgtggagctgaccgacggcgcgagttcgggccggagttggcgcaccaggctgcggaactcctcgacccggttttccatcggggtgcccgtgaggaacagcacccgctccacgtgctccgcccagccggcgaccgcccgcgaccgacgggccgcggcgttcttcacgaagtgggcctcgtccacgaccagcatcccgggccgcaccgaggccgccgccccgggcagcaggtgcagcgcgtcgaacgtggtcaccgccaccccgccgttctcgcgccagtccgcgaacgcctcgctccgctcagcgccgtgcaccggcactgcgcgcagggtggagcgggcccggatctcccgggtccagttgatcagcacgctcgccgggcagaccacgaggaagtggctctcaccgtgggcggcgagatgcgcgagcgccgcgatggcctgcacggtcttgccgagccccatctcgtccccgatgacgacccgcttctgcaccagcgcgaagcgcgccccgaacgcctggtacccgcgcagggacacccgcagatgggtgtcgtcgaggcggagcgctcgtacccggtccgcgatcccggcgggcaggaacccctcggcggcatcgcggtccggcccgctgccggacagctcggcgagcaggctgtagtactcggcggaccgcagctcgaagtccacccacgcctcggcgggggacgccggtgaccgcagcaggtcggccgaggcctgtgcgaagagcaccggcagttcccgctccagggcgtccgccacggccgtcgactcggtgcgagcggccgtggcg

SEQ ID NO: 3425 - DNA, 5176 bp, Unknown
  Kingdom: Bacteria, Phylum: Actinobacteria, Class: Actinobacteria, Order: Streptomycetales, Family: Streptomycetaceae, Genus: Streptomyces
  misc_feature (194)..(195): n is a, c, g, or t
gccgccacccggctggccgacccctcgttcctcgacgcggagctgatggcctcggtcgcggccgccacccggcgccctccggcgggcggcaacggagcgggcgggtcacactcgtaagaacccgagtgggaggactccggcgtggacgtaccggtgtggctctggatcgtgttcgccgcgaccgtcgtcgtctnntcggcttcaaggaggccgggctgtggagcgcgctgtgggtgagcctcgcgctggtcttcggcggggtcgtcttcctgaccctcgggtcgaccgccggaacggagtacacgaccgcctggctgctggagaagagcctctcggtcgacaacctcttcgtcttcgcgctgatcttcgcgtatttcaaggtgccccgggagtatcagcaccgggtgcttttcttcggcgtcatcggcgcactggtgttccgcgcggtgttcctgaccctcggcgtcgcggtggtcagccgcttcaccttcgtgctgttcctgttcgccgcgatccttttctacagcagctataaaatcctcagcggccaggaggagaatttcgaccctggaaagagcttcgcggtacggctgctgcggaaagtgatgccggtccaggaccactattccggcacgcatttcgtcgtccgcgaggaggggcggcgggtcgccaccccgctgctcgcggtggtcgcggcgatcgaggcggcggacctgatcttcgcggtcgacagcgtgcccgcggtgctcgcggtcagcgacgacctcttcatcgtctacaccagcaacgccttcgcgatcctgggactgcgggccctgtacttcctgctggcgggactgctggaccggttccactacctgagccacgggctggcggtcatcctcgccttcatcgcggtcaagctcatcctgcaggcctcccacaagatgatcagcacctcgatcccggagattccgtcgccggtgagcctcgcggtgatcgtcgtcattctggcggtgtcggtgacgttgagcatgcgccgtccggcgagaagtccgggcgatacggacgcgtccgacgccgatacggacaagtagggtcacggaaagcgacgccattccccggcaacgtaaagggaaagactttccaaaatctcccgtcccgcctatcgtgaataaatggccagcaaagagcgtgacacccgacagcgggccgctttcatgtgcccgacctgcaagcagcccgtcccctccgagatccaccgccacaagtccctcgggatcttcgtccccgtctggcgtgcggggccctgcgagaaccccgactgcgcggaccacgccgccgaggagcggcccgcccggcaccggaccagctcctcgtagccaggagcccggccgccttccctcccggacttgtcccgacgcgcggacccgcccccggctgactagcgttgcccgtgcgggcgggggcccgtacgggcggggccgaagacagggactccagggaaggaccggcaccatggctgtacaacccgagggcaccccatgctgggcggacgccatgttcgccgatgtcgagggtgccaagagcttctacggtgacgtgctcggctggacgttcggcgagagctcgtcggagttcggcaactacacgcaggcgtacgcggacgggaaggcggcggccgccgtcgtcccgccgatgccgggcgcggagggccagtcggcgtggtgtctgtatctcgcgtcgccggacgcggccgccaccgcggagaaggtccgcgcgaacggcggcgacgtgctgatggagccgatgcaggtcggcgagttcggcacgatggcactggcccgcgaccccggtggagcggtcttcggcatctggcaggccggcagtcacgaggggttcgagacggagatgggcgcgcccggcgggtactgctggggcgagatcttcacccgggacccgaagaaggccgacacgttctaccccgcggtcttcccttacaccttgcggaagttcgacgacgagtcgatggacttctccatgttcgacgtccagggggagacggtcctcggccggatggcgatgggtgacgacttcccgccggaggtgcccgcgtatctgaatgtgttcttcgccgttccggactgcgacgccgccgtggcgaaggcgaccgaacgcggcggggtgctgcgtttcgggccgacggacagtcccttcggccggttcgccgccctcagcgacccgcagggcgccgcgttcaccgtgatcgacgtgaccaccaccaagggcgagatgccgacgacgagcccggcgacctgacccggaccgtcacaccgtacgggccgcgaccggagacccggtgcggcccgtttcgcatgcccgggtcagcctgtttcgcatgcccgggtcggttcggtgcgcacgctcggcgtggttcggtgcgcgctcgtacggttcggtgtgcgcccaccccgtacgttcctccgacagatcccgcatctgcgatggatcatcgtccagaggttggtaaatgccagggcgattggcctagcgtgtcgcacatgcagtcctacacaatcggtcaggcagcacgacttctcggcgtcagtcccgacaccgcccgccgctgggcggacgccggccgggtcgcgacccatcgcgacgaggctggccggcgtctgatcgacggccgtgcgctggccgccttctcgatcgaggtcggccagggcgcgggcggcgaggacgaggccgtgtacacctcggcccgcaacgcgttcccgggcatcgtcaccgcggtgaaactcggcgacgtcgcggcccaggtcgagatccaggccggtccgcaccggctcgtctcactcctgacccgggaggcggtggaggagctcggcctcgaggtcggcatgcaggcgaccgcccgggtgaagtcgaccagcgtgcacatcgaccgcgtctgagaccggccggcaacgagcatccaaggagccccgaccctcatgtccccgctgatcaaccgccgccgtgcggcagccgccgtcctggccaccgccctcctgaccccgctcgccgcctgcggcgacgactccggctcggccaaggacaagggcggcggctcgggggctgcgacgggttcccctgcggccgacctgaccgtgctggccgcctcctccctgacggacgtcttcaaggcggcgggggacgcgtacgagaaggagaaccccggcacgaaggtgaccttctccttcgcgggctcccaggaactggccgcacaggtcaggcagggcgctcccgccgacgcgctggtcaccgccgacaccaggacgatggacggcctctccggcgacaccgggaagccgaccgtcatcgccaggaaccgcctcgtcatcgccaccggcgagggcaaccccgagaaggtcgggagcctgaaggacctcgccgatccgaagctgaaggtcgtcctggccgcccccgaggtgccggtgggccgctacagcgagcagatcctcgacgcgcagaagatcgaggtgaagccggtctcccaggagcccaacgtccgtgcggtcctgtccaagatctcgctcggcgaggcggacgccgggctcgtctacaggaccgacgccgcgaccgccaccggcgaggtcgacgcgatcgagatcccggacgggcagaacgccatcgcctcctacccggccgccacactgaaggcgtcgaagcacagcgaggccgccgccgcgttcgtcgcctggctctcctcacccgccgcgcagaagatcctccggggcgcgggcttccagcagccgtgaccgcaccacgtcccggcaggcccgcggcgaacgacccgacaggcccgccggacaccgcactccgagcccgacgaggtcaccgatgaaacgtcccggccgccgcaccgcaggggtccgcgcacccctgctgctgacggtgcccgccctgctcgccgtggcgttcctgatgctgccgctcgtcggcatcctcgtccgcacctcctggggcgagctgggcgaccacctcaccgccgaggccaccaccgaggcgctgcggctctcgctgctggtctccctgtgggcgctcgggctctccctgctgctcggggtgccgctggcctggctgctggcccgggtgcccttccccggcaaggcgttcgtccgttcgctggtgctgctgccgatggtcctgcctcccacggtcggcggcgtcgccctcctgctggcgttcgggcggcgcggactgctcggcccctggctggaggacaccttcggcgtcacgctccccttccacacctcgggagccgtgctcgcggcgacgttcgtcgcgatgcctttcctggtcatctcgctggagggcgcgctcggcgggctgcgcccccggtacgaggagaccgcggcctcgctgggggcctcgccggtccgggtgttcctcaccgtgacgctgccgatggtcgcccccggcctgatcgccggagccgccctgacctgggcgcgggcgctcggtgagttcggcgcgaccatcaccttcgccgggaacctccccggcaccacgcagaccctgccgctccaggtctatctgctgctccaggactcgccggaggccgccacctcggtgtcgctgctgctcctggccatcgcgatgatcgtgctcatcgcgctgcggggccgctggaccggcaccccggggggcgacgaccgggaccgggaccgcgcccgccggtccgttcccgacggctccgacggtacggacgaggcgaccgatgcgtacggagccggcgggtacggggccggcgggacggaggaggccccacgtacgccgaagacccccgcgccgtccgaaccctggccgctgcacgccgacgtcaccggcttcacgcacctgacgctggacgccccgggctccaccaccatcgcggtggtcggccccaacggcgcgggcaagacgacgctcctgcgggccctcctcggcctcaccccccgcgcgcacgccgccctgcgcctcggcgacagcgacgtcaccgcgctccccccgcaccgccggggtgtcgcctgggtgccccaggacggagcgctcttcccgcacctgagcgccctggccaacacggcgtacgggctccgcgcccacggcgtgtcccgtgccgaggcccggcgcgaggcccagagctggctggaccggctcggggtgggccgcc

SEQ ID NO: 3426 - DNA, 3974 bp, Unknown
  Kingdom: Bacteria, Phylum: Actinobacteria, Class: Actinobacteria, Order: Streptomycetales, Family: Streptomycetaceae, Genus: Streptomyces
gtcgaggccgacgtgcagggtgggtgaccgtacggcgctgctcgccgaccagttgcgcagccccgaccgccggcagcgcatcgacgccgtgcggatgagcggcgggctgatacgggcctggcgcggcccctacgaggagttggtggcgctcgtcggcgatcagctcgaagaagactcccgcgcccgcggtgaccgcggccgccgccatcgcgtagttcgcggcgccctcgatctcgtcctcgtcgatctccgcctcgtcgtcctcgtcgaggtcgaagccgccgatgctggtgagcagttcgacgacgctgccgcggtcctgcacccccgggtccacggccagctcgaacaggaacgggatgcacgcgagcgtgcacgcgtacacatcgccctggtggtgcaccgcgccgtacatgccgtcgagcgccgcctcgcgctccgccggatcgtcggacgcgagtccccgcagaagctccggcacatcgtcggcaggcccgtaggcatgctccatcgaggcccagtcgacctcgtcgatccccgagaacacgccatcccctccccacgatcacgacagcgcccggaccggcgcgcccgtggcgcgccctgtccgtcacacccctcccggcgcgccctggagaaagcgcctgcgcagagtgtgcaccacgggtccgacaatccacccgccacttgtggcctttcctcgtgccgtaaccaggtcatgacccggtcaagacgatccggctgtggattcctgtgaaccggggtgtgtcacgagggcagtggacgcgcctgttccgggtcgttgagcggtgcgagcagatcgccgtgccggtccagccgggcggccatgtccccggcacggaacaccagggcgccggcctcccggcaccccgcgatctcgtcccaggtgaccggggccgacacggtgggctcgggccgggcgcgcagggtgtagggcgtggcggtcgtcttcgacgcggcgttctggctgaagtcgacgaagaccttgcccggccgcagggagcgcttcatccggtgcagggccagccccggaagagccgcctccgcctccatggcgagccgcttcgcgtacgcggacacctcgccggacggggtgggctccagcgggaccagcagatgcatccccttggacccggacgtcttcccgtacgcggccaggccgtcggccgcgagacgctcccgcagccagagcgccaccgcgcagcactccacgacggtcgcgggggagccggggtccaggtcgaagaccatccggtcggcgatctccggtgtgtccgtgcgccactgcggggtgtggaactccaccactaggttggccgcccacatgagggaggccagatcccgcacgaccacctgccgggcgcccgggtcctcgctccgggggacggcggtggtctccacccaggcgggcgtaccgggaggcggattcttggtgaagaagacctggccgtccggcccgtccggatagcgcaggaaggacacgggacgttcgcgcagatggggcaggatcacgccgcccgcggtggccgcgtagtagtgcagcacctcgcccttggtcgtcccggtggccggatacaggaccttgtcgagattgctgagcgagacccgtcgcccctccacctcggtgatcggcgtcatacgataagaatcacacgaaaccatgccaaagcgtctccgacgcctcaagggtgctcaacggtcggcaaggggtgaacggtgaggtccatatggaacggcgcgatctccttcgggctggtcagcatccccatcaagctggtcaacgccaccgagaaccactcgatcagcttccggcagatccacctcgccgacggtggccggatccggtaccgcaaggtctgtgaactggatgaggaggaggtctccggcggcgagatcggcaaggcctacgaggacgccgacggcacgatgatccccatcaccgacgaggacctggcccagctccctctgcccacggcgaagaccatcgagatcgtcgccttcgtgcccgccgaccggatcgacccgctccagatggacacggcgtactacctctccgccaacggggtcccggccgccaagccgtacaccctgctccgcgaggccctcaagcgcagcaacagggtcgccgtcgccaagtacgccctgcgcggccgcgaacggctcggcatgctccgcgtcgtggacgacgtgatcgccatgcacggcctcctgtggcccgacgagatccgcgcgcccgaggacgccgcgccggacggtgacgtcacggtccgcgacgccgaactcgacctggcggacgccctgatggacaccctcggcgaggtcgacatggacagcctccacgacgactaccgggaggcggtggaggaactcgtcgccgcgaaggccgccggcgagagcgtgctcccggccgcgcccgaggacaccggcgacggcaaggtcatcgacctgatcgcggccctggagaacagcgtgcgggcggccaggaaatcccggaacgacgagggtgcgggcgacggcgacggcgacggcggcatggccgacgtccaccccatcaagaagacgtcgtcgaagacctccgggaagaccgagcggaccagcaaggccgagcggaccagcaaggccgagcagaccagcaaggccgagcagaccaccaggaccgcgaagaagaccacgcaccgcacccccaccggcaagacggtcacccgctccggaagctccacggcgaagaagtccgcccccaagtccaccggcgcgaagaagtccacgtcgacggcgaagaagtccgccgggagcgccgggagccgaacgaccgccaagaaggcggcgacgaaggccgcgacgaagaagcggacgtcgtcgagcggcggcacgacggcgaagaagtcggcatcctcccgcaagcgcacctcggcctgacggagacgcggcccgagggaggcggacggaggcgagtcccgagaggcggacgggggcgagtcccgagggagacccgcgggtggaccgcggtcgatggcgtgttgcgtttcggtcgtcgtcacggccccggctccccgctgtcgtacgccccccgtacgctacggcccatgagcgaagacgccccctcgggacgggtgatcgacggccgcttcacgctggtggagcggctcggcagtggtggcatgggcatggtctggcgggcccgcgacgaggcgctgcaccgtgatgtcgccctcaaggaggtacgtcccccggacccggcgctcgcggagtacgaccccgaaggcgcccgcaccctgcgtgcccgggtgctgcgcgaggcccgtgccctggcccgggtcgaccaccccaacgtggtcaccgtccaccacatcgtcgaccccggcgaggacggctacccgtggatcgtgatggagctggtggccggctcctccctgcacgaccggctcgccgccgggcccatggagcccgccgaggccgccgagctgggacgcggcatcctctccgccctccgcgccgcccacgcctccggcatccagcaccgcgacgtcaagcctgccaacgtgctgctgcgcaccgacggccgccccgtcctcacggacttcggcatcgccgccatccgcgagtcgaccagcctcaccatgacgggcgccctcatcggctcgcccgactacatggcccccgagcggatccggggtaccgagggcgatccgtcctccgacctctggtccctcggcatgatgctgtacgtcgccgtcgagggccgccacccgctgcaccgggccaccaccctggccacgctggccgccgtgctcgacgaggagatcccgccgccggtacgggccgggtccctcaccccggtgctgaacgcgctcctcaccagggacgtcccggcccgcccggacgccgaggccctcgaccgcctgctggcggaggccgcgcgcaccggcgggaaccccgccccgacacccacggag

SEQ ID NO: 3427 - DNA, 7877 bp, Unknown
  Kingdom: Bacteria, Phylum: Actinobacteria, Class: Actinobacteria, Order: Streptomycetales, Family: Streptomycetaceae, Genus: Streptomyces
gtcgccgccctcgccgccgagtaccagcacggcgagtccggtcagcgcgccggtcacggcggccaggccacctcgtccgaggcgttcgcccagcagcagacgcgccccgacggcgatcaggacgggcccggcgccgagggtgacgacggtgccgacggcgagaccggtgacctcgaccgccgcgaagtacgcgctctggaacaccgtgagaccgatgccggttccgaggatccggagcagtcggcgacgccgggattcgggctcccgtggcgcccggcagggacgcagtacgagcgccccggcgagcaggaggaggccgcccgcgcagcgccagaaggacagagcgagggggccgagatcgctgacccggaagaccagggacgcggccgcgccggcggtgccccaggcgacaccggcgatgacgagatacagcatgctccgcccgacgggcagcgcggaagcaacagggatggacatgtgacttctccggaggaggacaggatggtgggccgctcggctccgcacgcgggcagcgacgaaccgctcggggactgcccgagcccggtcttcgtcaggagtggccgcccgcgctaggcgacagggggcggcagcacagtcagatgcatggccgtcacactaatgcggggcccggccgccggacaactcgccctcgacggccccggccgccgcgccggtgccgacgccggaggcgacgggacccgacggaggcttcggcgcggcggactgggcgatgaacgcgccggtcaggaccacgaatccgccgatcagctgcggtgcggagaggtgctcaccgagcagcacccaggccaggccggtcgcgatgaccgcttccaggcaggcgaccacgccggccacctggggcgagagcagccggaccgagacgaccccggtgacatacgcgagcaccgtggcgagcagcacgatccagccgagcagcagccaggcggggacctcgttgccgttcatggccgcgctgccgccgagcagcgaccagtccatgccccaggggcgggcgacgacggtgaggacggccgcgccgacgatcagtccgtacgcgatgaccccgacggggtgcggaggctcggcgtgctcgcccccgccgtcccggccgtcctgcccgccgtggtcggagaggacgaagtagccgacctggcagcaggccgccccgagcgcgagcagcaggccgagcaggtcgaacttgagcccggaccagacctcgacgacacacgccaggccgcccaccgccagcaccacgccgaccgcggcggcccgggtgacgggcctgcgctgcacgaagcggacccagccgaggaccagcgcgggcgccaggtactccaccaggagcgccacacctaccgggatgcgggagatggaggcgaagtagaaggcctggaccccggccaccgcgaacaggccgaacccggccagcaaggcggggcgttcccgtacgagattccggtggtgccaggcgaccgggagcatgatgacggcggcgcccgcgacgcgcagccagaccacgtgcagcgggtcgagtcccgcctcgatcagcggcttggccgccacacccgaaccgccgaacgcaaaggccgagaccagtgcgaggcccagtccggcacttctgccctgaaatcccgaagacgcttgcatcggcacatcatggcagcagtcgacagcaccgtcatccccgtgacacctgtcgagacggcgctccggtcgcgaccacgggagggaactcgcgcatcatccgtcctggtgcgtctcacccgtgccgcgcggcatcggccgtgagcacgaccacccggtccgccagccaccgcgcgtccacgcccccgcgggagagcacctccacggcacggcattcggtgtcggcggccaatgcggcgagcagatcgaggccggcggcgcgcgcttcgccgcgcgacgccgcgcggtacagcgcgtcctccatcgcggcgagggccgagggcgaccacccctcgaccgccgggtcgcgcaccaccggaacggcgccggagtcctcgaccgagccctgccagcggagcccgtagccgatgctgcgctggacgagatagccgagcaccttggccagttggggcccgccgtcgaaggcctcgcggacttcggggtccgtctcgatcagcgaatgcagcaggtgggcggtgtcgatctgccggtcgccgtcgcgcagcgcgcgcctgcgcgcacccgtcagcaccgatgccagttccacggtgaagcgggcatcgatctcggtgtggttcggtgcgggctggtcaggcatgcgcggcgtccggttttgcacacctctaccccatcagtcccgcggccggaaggcatccccggagcgacccattgagcatcccaccgaagttggggacaccggagcggtccgtcatccttgcggatgagatcgcgccgtacggcacaaccatgacggtcgggagcgcgcgccgccttgcatttcacgcccccacggcaaccggaggcgccgggcggacgtctctcacgccatacgcacacgcgggggcgggaggagaggaacgggtgttctggatggtcgcgctgctcgcccaggacggactgcagtacgtctaccgcgtgtacgcacccgacgacgccctgcccgccgatctcttctggacggccttccactgccacgacgagggtccccacccccgcgcgtcggacaggttcgacgccgcggtgatctggcggaacaagcagccccagcagatctgacgttccgtcagtattgaatgttgacgcgccccccgctaccttccgcgacaccgtaaccggacgaaccaggggtggtcgcatggctgaagtcagcgccgaggcacgcatcgaggcgcccgccgagaaggtctggggccgcctgacggacttctcgacgtacggggagtggaacgccacccacaccagcttccccaagggcggcccggccgaactggaactcgcggccacctacgaggagaacatgaagctcatgggcttcccggccgaggtgacctggacggtcgacggactggaggagggccgcctgctggcgacccggggcaagggcccgatgggggtcgacctggccatgcggtattccctcacccctgagggcgacgtcacgacgatgcgcatcgacggggagttcaccggcgcggcggtctccctgatgggcggcaagctgaaggactccgcgacggcggcgctccaggagtcgctgcgcaaactcggggggctcgtcacgtcctgaccccgcccgcgcagcacgcgcaaggccccgcggaatcgtcccgcggggccttgcgagcacggcccgcgttcacgcagggccgcttcgggtgcggcctgccgggcatgctcagtgctcgtcggcgaggatcaggtagagcttcttgcgcgcgtcgttgatgaccgtcagcgccttcttccgctgatcggcggagccggtcttccagacctgcccgaacgcctccatcagaccgaatccggcctgccggatctcattgacgccctcccagtccacaccgcgcccggcctcttcccagggagcctcggagccggtctcggcctcgctccgcccggcgtcggtgagcgtgaacagcttcttgccgccctcgctggcactgacgatcaggccctcgtcctccagcagctgaagcgtcggatagacggagcccggactgggccgccaggccccgccgctgcgctcgccgatctcctggatcatctcgtaaccgtgcatcggacggtccttcagcagcgccaggatcgacgcccgcacgtcaccgcgccgcgcccgtccccggccgccgccccggccacgtccgccgccgaagggaccgccaccgaacggcggcccgaacggcccgaaagcggcccgacgaccgtcaccctcgcctcggccgtgctgaccgggcccgaagtaccccggcccgtgctcgtatccatgtccgtgtgaacgcatctctacgccctcccatcgttgatctgtcgcgatgcgtcaacgatatatcggaaactatcgggcgacaaggcacccgtcggcgacgcccgactgctggcgacacgactgccctgctcacgagggtggagcggggcccgataaaaaccgctggccccctcgaccgagccgtggttaccctgacggcgttccttggtctgctctgggcttccgtgccccggaaaagagagatttttatgttccggcccgcgccgcgcgcgcctcgctgcaccgtctagccagtagtccgtcttctttctgccgtccttcacggacggcttccggacgtgactctccggtgcactgaatcagtccccgcctccgcccgcacgcttgtcgcgtcgtacggggtgggcctcttcgtcgaggccgctcggcctgctcttgctgtcatcacagacttcccagcaaggagcgccccgggtgtccagcaccagcagaactctctccagcagtccccgtaccgccgtgcacagcgccttctcctgcgcgtggtgcggccggaccgcgtccgccgtcgccgacgacggcacacagcgcaatcactgcccgtcgtgcctgcagttccgtcacgttgtcgaccccgtcgagggcggctccggtgactgccggggccggatgtcgccgatcgccgtcgccgtgccgcgtacgggcggctggatggtcattcaccggtgcgcgcgctgcgacgggctgacctccaaccccacccgcgcggacgacaaccagctcatcctgatgcggctggctgtacggccactggcccaacccccctttccgctcgaagcgttcggcgacctctgaacctgaaggaagaggaccggccatgccgagacgagcgaagaacacccgtcgccgtgcccggggtgcacggcggccgcagcggtacaaggacgtcctgcacagccagggagggcaccggggacacgatttccggtgcgcgcgctgccggctgcaggtgtccgtggacgcgcccggcaccacgcaccgcaatcactgcccgaactgcctggtcagcctgcacgtcgaccgacgggtgccgggtgaccgggctgcggactgccgctcccggatggaagcgctgggcatgtcggtgagggccgacggcgagtggatgatcatccaccagtgcgtgtcctgcggtgcgctcagcgccaatcgcatcgccggtgacgacaacccactggccctggtccgcctggcgctcaaacccctgcgggaccccggcatcgcccatcgcatgcggctcgcgccgtgacccggccgtcccgcgcgatgccgtgtcacaggaggcccacacctcgatgcccaggattcccgcaccccccgtcccgctacagatcgcacccgtgtgcgactcgcaaggagaagccatgcgccccatgaccagggaagaggtgcgcgacgcgatcgtgaacctggacccggccgcgaagagggtccgcctgccggcctttttcgacgatgtccgatggcaccggatcgactacctcggatggagagatccgagatccccgaagcgcgcctacctcgtcaccgaggcggacggccaggcccggggagtgctgctgcggcaggccccgaacgactcggcacacggttcgcgcgcgatgatgtgcgacctgtgccggttcacccgccgcttcaacgaggtctcgctgttcaccgctcaacgcccgtcacgtgacaagcgcgaacgcctgaacgcgatcggtcttctcctgtgcaccgatctcgactgcgcggtgaaggtgcacggcaagccggtccgcgaagccgtcgaccgtccggtcgacgagatcatcaggtcgcgccgagaaggcctgcgctcgcgcacgatcgccttcgttcgttcggtcaccgacccgcggcgggagcggggtccgcgagcccggctcgaaccgaacgactggccctaggtcgtgtccgcaaagtctcgtccggtccgagggcggacgacgatactctgcggacactccctaggctccgtagcgggccgcgagcgtggcggcccggtcgcgcagggcactgcgcaaggactgcggggccagggcttccgcgtccgtgccgagccgccacagcgcccattcggcgtgccgtgcgtcctggaaggtgacctccagccgtggccagccgtccgtgtcgggatcttccgcgcggacggccagcacggtgcccagcagttcctcccgccgcaccgggtccacccgtaccagcgcggtgacgtggtcgccgccggagaggaatcgcgcggaacggtcccgccagatccggtccaggtcgacccggttcggccgctgggccggttcgggcagttcctcggcggccagcacccgtgacagccggtaggtgcggtccgccccggatctcgtggccagcaggtagccccggtcccgtacggtcaccaggccgatcggatccaccgtgcgccactgcggcgcctggtccgtggccgcgtagtggatgcgcagcttgcggccggacagcacggcccggcggacctcgatcatggtgctgtccggtacctggtcgacgaccggccggcgtgagagcaggtcggtctccgggtcgacgagaaacctctgggccgcgtcgctcgcggcggcctgatggctttcgggcagcgcgtcgaccaccttccgcatggccgaggcgagcgccggcccgaggccgaacacctgctccccgcgtcccgatccggcggcgagcagggcgagggtctcgtcgtggttcagcccggtcagctcggtccggaaaccgggcagcagggcgaaccctccgtgccggccgcgttcggcgtagaccgggactccggccgtggacagtgcctcgatgtcgcgcagcacggtgcgggtggacacctccagctcgcgggccagtgtgtcggcggtcagccggccgcgttggcgcaacagcagtaccaacgagaccaatcggtcggcgcgcatgcgggaacggtagcgaaatacatgaccaagggtgtcgtcattcgttggcaggctcccctacgacgtcgaagccggcgaccgccgagccgacggacctctgtactcccctgaatcgaatggagctgaagtggcactggaacgaacggccgtcaacccggtgacgtggtcgatggacctggggttcaaccagggtgaactcgtttccgggcagacccggaccctgtacgtctcggggcagacctcgacgagcgacgacggcaagcctcagcacgacggggacatggcggcgcagttgaccctgagcatcgacaacctggaggccgtgctgagcgaggcgggcatgtcactcgcgaacctcgtccgcctcaacgtctacacgaccgacgtcgatctgctcttccagcactacggcgcgctggcgggccggttgggcgcggccggggtggcgccggccagcaccctgctcggggtggcgcgactggcggtccccggcctgctggtcgagctcgagggcaccgccgtcgcgtgatgcgaccccaccgcccgtaccgttcctgtcggccgaaccggcgggaacggtacgggcggtgagccgattcccggtgcttcgcgtcacggacgccgaggagtaccgaccgggtgaggccgggtagggccggccttgccctccccctcccgtaattgcctttcacccccgcacgccgggagttagcgttccggacgacgaatgacccaccaggagcggagagagacatggccggtcgcccgagcgcgcgctgacgtcggggccggtccggccgtcatcgcgtgctgccccttgaggtcgcggcacggcgagcccttctcccgcccgatgcccgggtgcgctttcgtgcgccgggcacgagacccgcggcccggcgcacgaa

SEQ ID NO: 3428 - DNA, 3346 bp, Unknown
  Kingdom: Bacteria, Phylum: Actinobacteria, Class: Actinobacteria, Order: Streptomycetales, Family: Streptomycetaceae, Genus: Streptomyces
cagacatcggggtgttccagggcgcgttcgctgaggcctacgcgtatctggtaggcgccctggaacaccccgatgtctgggacagcggcaaggtcgattccccggattcggcccaggtgacctacggcggaccggagttgcgctcccgtacccgctaccactggaccgtgcgcgtctgggacgacgaaggccgcgtctccgactggtccgagcccgcgtggtgggagaccggcctcaacgaggcgtcggactggtcggcgcgctggatcggtgccccggcctccctcgtcggcgcgcccgccctcggcgcggcgtcctggatctggttcccggagggcgacccggcgaccggagctccggccgcgacccgctggttccggggtgtgttcgacgtacccgagggtgtgacccgggcccggctcgtgctcaccgccgacgacggatacgtcgctcatctggacggcgcggagatcgcgcgggccgaggcggaccaggctgccgagaactggaggcgtccctcgctcaccgacgtcacggcacggctcacgcccggccgccatgtgctcgccatcgcggcgaccaacgatgtgccaggcccggcaggcctgctgggagctctggaactgaccacggccgacggcgtgcgtaccatcgccaccaacggcgagtggaaggccgccgacgccgaacccacgggcgactggcgtgccttggcctacgacgacggagcctggccggccgcgaaggtccttgccccgtggggatcgggcccctggggtgaggtcgcccccgcctacgctcccgtcgcccagctgcgtcacgggttccggctgcgccgcaagcccgtcgagcgggcccggctgtactccacggctctcggcctgtacgaggcccacctcaacggcgagcgcgtcggcgccgaccgcctcgcacccggctggaccgactacgccaagcggatccagtaccagacccatgacgtcaccgaactgctcaccgtcggggacaacaccctgggcgtggagctggcgaccggctggtacgcgggcaacgtcggcatgttcggcccgcaccagtacggtgaacacccggctttcctcgggcagttggaggtcacctaccgggacggtacgaccgagcgggtgctgtccggcaccgactggcgtgccgccaccggccccatcaccctggccgacctcctcaccggcgagaactacgacgcccgccgcgagaccgagggctggctgcgccccggcttcgacgacgcggcctgggagcgggccgttcccccggcggagaaggtcaccgcagaactggtggcggagcccgacggaccctgccgggtgatccaggaactcacagcacggaagatcaccgaaccccggcccggcgtcttcgtcttcgacctgggccagaacatggtcggcaccgcccggctgcgcgtcaccggccgggccggcaccaccgtgcggctgcgccacgcggaggtactcaaccccgacggcaccgtctacaccaccaacctccgttccgccgccgcgaccgaccactacaccctcaagggcggcggccgggagacgtacgagccgcgcttcaccttccacggcttccgctacgtcgaagtgaccggctatcccggcaggccgccgctcgacgccgtcgtcgggcaggtgatccacaccgacgcgcccctcaccatggagttcgacaccgacgtcccgctgctcaaccagctccacagcaacatcacctggggtctgcgcggcaacttcctctccatccccaccgacacccccgcccgcgacgaacgcctgggctggaccggcgacatcaacgtcttcgcccccaccgccgcgtacacgatggagtccgcccgcttcctcgccaagtggctgagcgacctccaggacgaccagacagccgacggcgcgttcacggacgtcgcgccgcacgtcgagggactcggagcgggctcggccggctggggcgacgcgggcgtcaccgtcccctgggcgctccaccaggcctacggcgacacccgggtgctggagcgggcctggccctcgatgctgaagtggctcgaccacctggacgcgcacagcagtgggcggctgaggcccgccaccgggtacggcgactggctcaacatcgccgacgacacccccaaggacgtcatcgccaccgcctactacgcccacagcgccgacctcgtggcccgtaccgcccgggtcctgggcaaggacccggccccgtacaccgcactgttcgcggagatccgcgaggccttccgcgccgcctacgtcaccgacggcggccgggtgaagggcgacacccagaccgcctacgtcctcgcgctctccatggacctcctgagcacggcggaacgcgtgaccgcggccgaccgcctcgtcgccctcgtcgaggcgaaggactggcacctgtccacgggtttcctcggcaccccgcgcctgctccccgttctcaccgacaccgggcacacggacgtggcgtaccgcctgctgctccagcggaccttccccagctggggataccagatcgaccgcggggccacgaccatgtgggagcgctgggactccatcaagccggacgggagcttccaggacgccgggatgaactccttcaaccactacgcgtacggctccgtgggggagtggatgtacgcccacatcaccggcatcgcccccgccgaccccggcttccgcaaggtcaccgtgcggccccggcccggcggtggcatcacccgcgcccggggccggttcgcctccctccacggcccggtcaccaccgactggaagacggagaagggccgcttccggctggccgtgaccctgcccgtgaacaccaccgccgacgtgtggatcgaggcccgccgggccgaggacgtcacccacaccggagcccgcttcctgcggatggaggacggctgcgcggtcttcgccgtcggctccggacaccaccgcttcgaggcctgacacccccaaggaaacgccggagccgcgcggcggacgaccgcgcggccccggcacccggacagttccgcactcacccctcgcgacgcgaccgccagagcagccagatgaagtacggggcgccgatcacggccgtcagcagtccgaccgggatctgcgccggagcgatgatcgcccggccgaccaggtccgacacgaccaccagcagtgcgccgagcagcgcgctcaccgggatgacccgcacgtgactgcggcccaccagggcgcgtgccgcgtgcggagcgacgaggccgacgaatccgatcacgccgaccgccgccacggctcccgccgtcaggaggacggccaggctcaac

SEQ ID NO: 3429 - DNA, 1639 bp, Unknown
  Kingdom: Bacteria, Phylum: Actinobacteria, Class: Actinobacteria, Order: Streptomycetales, Family: Streptomycetaceae, Genus: Streptomyces
  misc_feature (250)..(251): n is a, c, g, or t
cgccgcgagtgctgcgagccgacgggtggcgcgggagttgtggggggtggtgtggaggttcatccgtgttctccgttggtcgtcctgtggggggactacgagcggagagcgtgccacctcatgagcgaagttgacggtgtgccgacaattgcctcacaagattttgaccagtccttgtacgaatggggagccgcgctgtccggtattcggtgaagtggtggatttccgccgtacgggtcaggcggcgtgnncgcaggccggaggcgtacccctggccgacagcgcggaacttccactcggcgccgttgcggtagagctcgccgaagaccatggcggtctcggtggcggcgtcctcgctcaggtcgtagcgcgcgatctcggcgccgccggcctggttgaggatgcggatgaacgcgttgcggacctggccgaagttctggctgcggttctcggcgtcgtagatggagaccgggaagacgatcttgtccacgtcggccggcagacccgccaggttgacgttgatctgctcgtcgtcgccctcgcccgcacccgtgacgttgtcaccggtgtgcacgatggtctggtccggcgtcgacttgttgttgaagaagacgaagtggccgtccgagacgaccttccccgccgggttgaccgcgatcgccgaggcgtcgaggtcgaagtcggtgccggtggtggtgcggacgtcccagccgaggccgaccgtgacggcggtaaggcccggtgcctccttggtgagcgagacgttgccgcccttggacaggcttactgccatgggaagtccctttcctcgtcgtgtgcgggcttcgtgccatcacgaaagctaccgtcacccgtcataacgcaagcagcggaccacgaggttcctggtcgctttactttctttgccgagcttcgtcccgaagtggagcccgtcaggggacgtgcgcaaaagaaggtgacgagcggggcgccgggaagggaccatgggtctcatgtccgggccctatgtcatccgcggctcggtctccctcccggaggccgagctcatgtggcgtttctcgcggtcctccgggcccggaggccagcacgtcaacaccagcgactcccaggtggagctgcgcttcgacctggcggcgaccgacgcgctccccgaggtgtggaaggcgcgggcgctggagcggctcgcgagcaggctggtgggcggggtgatctccgtgcgggcctccgagcaccgctcccagtggcgcaaccgcgagacggccgccgtacggctcgccgccctcctggccgaggccagcgcgccgccgcccaagccccggatcaagcggaagatcccgcgcgggatcaacgagcgcaggctgcgcgagaagaagcagcgcggcgacaccaagcgcgggcgctcgggccgcgactggtgactccgcaggctgtgcgccgtcagcccagccggcggtagcggcccttgaagtacgccagcgggtcgccctccgggctcggcagctccgccgtgagcacccgcccgatcacgagggtgtggtccccggccaccacgcgctgctcggtgcggcactccagcgtcgccagcgccccgccgatcagcggcgcgcgcgtcacctcaccccgtacgtacgggacgtcc

SEQ ID NO: 3430 - DNA, 2727 bp, Unknown
  Kingdom: Bacteria, Phylum: Actinobacteria, Class: Actinobacteria, Order: Streptomycetales, Family: Streptomycetaceae, Genus: Streptomyces
gacgccggccaacccgacgctggccgagatcgacatccgggccgtcgcccacgcctgcggaactgtgccgctgctggtcgacaacaccttcgccacccccgtcctgcagcgccccgtcgaacacggcgcgcggatcgtcctgcacagcgccaccaagtacctcggcggccacggcgatgtcatgggcggcgtcgtcgcctgcgacgaggagttcgccgccacgctccgtcaggtgcggttcgccaccggcggagtgctgcacccgctggccggctacctcctgctgcgcggcttgtccacgctcccggtacgcgtacgggcggcctcgacgagcgcggccgaactcgtccgcaggctcaccgccgacccgcgcatcgcccgggtgcactacccgcggatcggcggcgcgatgatctccttcgaggtgtacggggacccgcaccgggtgatctccggggtgcggctcatcactcccgccgtcagcctcggcagcgtggactcgctgatccagcacccggcctccatcagccaccgcatcgtggaggagggagaccggcgggcgtccggcgtcggcgaccggctgctgcggatgtcggtcggcctggaggacgtcgaggacctgtgggcggacctgtgccaggcgctcagcgacgggccccttccgtcggcgcggacggccgagcggacccttcagtcgtcagccggtcagtcgtcagccgggcggtgatgacgagcgtgccctcctcgatctggtagtcgaggggcagctccagcgcgcgcatcgccgccaccatgccggtgttgtgggactgcgtgacggcgtacacgctgtcgcagcccgcctccacggcgaggtccaccaggcggccgagcaactcggagccgataccccggcgctgccagtcgtcctcgacgaggagggcgacctcggtctcgtcgccgtcccagaggaggtggcccagcgccaccagcttgccggaggccgtctgcaccgccagggtgcggccgaaacggggggacagcaggtggtcgaggtagcggtccgcgtccgcgaccggaccgtggtagcgcaggcccagggtgcgctgcgagcagcggtcgtgcatggcgcgggctgcggcgagatcgccccggtccgcgcggcgcacggtgatctcgttgccctcgggcagcgtgaggacgtcctcgctgcgcggtacccgcgggccgagccgggcgtcgagctcgaccagggcacgcgcccgcgcgaactcggtgggcgtgaagggcagatagggccgctcgacggagatcaccccgccggacgggtcccgcagccgcatcaccgtctcctccagcacaccctcgaccggggcgctctccccggtcgggcggccggtgacggagaccgcgggcagcgagtggatggtgcaccggccgagcaactggcgcagagcgagcggcagctcggccgcgtcgagcgccgtccgggtggccagcgacagcacccgggtcgggatgtcgaccaggtcgtgggcgtccgcccgctcgatccacgtggacgtgccgccggcggccgcgatctccctcgacagctcctgcgcatggagcgaggccggggcccgcagcaggaactcgtcgacggtcccccgcgcgagcgggtgggtccccagggtgaggatgtccacccggagcccggcgagggccacgcacagcgcggccagactgcccggagcgtcgcgcacggtcgtccgcatccgccacagcgtggtctcctcggcaccggcgatcctgcccgcaccgctgctcccggacccgcccgtcgcttcgtcgcgtgccccgtgcaccgcggcgtccgctccacccggcgcggcggagtcgccctcaccggacgggggagcgtggctgtgccgtcgcgcccaccaggtgtggaacgccgccgtggccaccagcgccaccgccgacgcgatgagcaggtagggcccgtccggctggtgtccgatgaggttggcgatggcgtccgccacggccacggcggtgaacagggcggccagttcgatcaggtcccgccgccagtggtgcggacggcgggcgctcttcgcggaggtcacatcagtcatatcctcactgtgaacgagcggtgttgcctgatcacgaacgccttgtgactgatgggttacgtgttgatctggtcgcctattgtcgttttcggtcagattccgataccggccgctccttgatccttccggtccggtgggagggcttcgccggcccctggggcatcgaggccttcgggggctttcggaagggaaccctccgccccggccgggaacgtggcgagcagccgggcggcctggcggaccgcctgggaggagcccttgcgccccgccgtcgccgcgagccccgctatcgccgggatcccgcccgtaccgcagcgttcggcgcactcggccgccacggacagcaggtcgccgagcccccggggcgtcttctcgtacgccaggagaccgggcagcatcgcggccagcacggtcagcaccgtccgatacgcgccggtcgcggccgccgtgccgagcgcgtcggccgtgcggttcaccttcaccaggtcgcggtcgaccaggatggccagctcccgcccgagcgaggcaccgtccagccggccccccgcggccagcacgagcagggcgtccaccgcagccgtccggtcctccgggtgccgtgcgccgagaccgtaggccagcgcgagat

SEQ ID NO: 3431 - DNA, 6511 bp, Unknown
  Kingdom: Bacteria, Phylum: Actinobacteria, Class: Actinobacteria, Order: Streptomycetales, Family: Streptomycetaceae, Genus: Streptomyces
ccgtcaacaccctggtgatgacggtcctcgaccgccgccgcgaactgggcaccctgcgcctggtcggctcgacccggcgccaggtgctccggatgctccgctgggagagcctgctggtgtcgacggtcggcgtggtcctcggctccgcgatcgccgcggccaccctggtcccgatgatgcgcggcatgaccggcgagtcgccgtacgtgccaccgctgctctacggctcgttcgtggccgccgccggtggactggccatgctcgcggtcacgctgccggcccgggcggcgctgcggcggtggtcgtagcgcgcgtacgcgctcctctgcgacggacggcagtcggcagtcggcagagtcagccgcttcgcgcgaggcggtcctccagtgcccgcggcagcgggtagacgcgctccgcgggaaacagccgctgggatttcgcggcatgcccggcccgtatcagggaagcggccttgtggacctgcggagtgaggtcggtgatgctcaccacccagtcgtcggtgaacgtgcgaatgaggtggcggccgatcccgacctgaatgctgtagtggttcagcgcggcccctcggagtgaacgctccgggtcccactgaacatgcacggccgcttcggagagagctgccgggtccgcggtcgtgagcacggcccgggacagggcctcctcccagccctccctcgatatccgcaccgcgaggacacgctcctggccaggtttacgggcccagttgctgcggtgcatcagccacatgaacgacggcttgatccacgtcatccggtgaaaggagaacggcgtgacgaagcgccctgcccacagtgccgcgtcggcgatggcaggcgcgtacgcctggtagaccacgatggtgcgggcgtcgtagtcggcacgaacctgatagcggggcgacatgcaccgcaccctgccagtccccggacgagacccgcgagcggttttccccgccggtgcggccggtgtgcccaccacggacgcgtccctcacgagaacgggccggcactcccgggggtccgcgcggcgatgacatcgagtgcacggcggcggccctcgccttcccttcggaatcgcctcgcgctcagcccatgctcgccgcgacctcgttgcgcagttgcggcagcttgtcgtgcagcacgcccgggcagagggtgtcgccgaagtccttgtgcccgtagatgcggctgggtgcgatgccgtactggtggcaggtgtacgcgcacagcgccaccaggacctcccactgggcacgcggcggttgcgctccgtcgtggtacgcgccctcgttggcgatgccgatgcccgccccgttctggccggaggtgtgcgcgcccaggacgaagtccctgccgccccgcagtgtgctgaggctctggtggcggccctcggtgatccagccgccccggctgacgaggaagtggtagccggtgtcggtccatccgttcttgtccatgtgcaggtcctggacccagtgcgcgtggctgtgggcctgggcgcgggagacgtcggaggtgttggcactgaccgtgtggtgcacgacgatcatggtcggccgcttccccaccaggctcaccgagccttgcggcggacgggccttccactggacggtgctgtcgatgtccggttcgacgacgtcgacggcgtgggccgtacccggtaaggcgactgccgccaggccgccggcaccggcgagcaggacgtgacggcgggacggatggggaagtttcacggcggactcctggcgtgtggtcgttccgggcctgccggacagcgacagcgacgacggtggtgacagtgacaacggcggtgactgcggcgggtggcggcggtacggccgggtgggggttgtacccacccggccgccgcgaggacggagctgctacgccgtgttgttggcgagggcctggagccgggtcatggagccgttgaacttgttgcggtccacgtcgccggagactccggagacccggccggtggccgagtactgccagatcgtccaggtggggaagccactggggatgttcgggctgctggtgccccagtgggccacccagagcggcgacttggtggccatgccggtccagctcccggtgcaggtgttccaccagctggccgtcgtgtagatcacgacgtcccgggtggtacgcgccttgtacgtgttgtagaagtcgttgatccacgtacgcatctgggtcgtggagaggccgtagcacatggcgccgtacgggttgtgctcgatgtccagcaccccggggagggtcttgccgtccctggaccaccctccgccgctgctcgcgaagtagcctgcctgcgttgcgccgttggagacgtcggggcgggcgaagtggtaggcgccccggatcagaccggcgttgtaggagccggtgtagttggcgctgaagcggctgtccttgtaggtcgtgccctcggtggccttcatgtaggcgaagtcgatgcccgcggccttcaccgagccccagttgatcgccccctgccagtgggagacgtcgatgccctggacgccgctggtgtccatcggtgtcacgccgtccgccgaggacgcgggaccctgctcgatgcgggtccccgcccccatccacgcctgtccggaccggaccggctcaccgggtgcgggcggcgcggcggcggccgtgcccgtgccggtcaggatcagcgccgcggcactgccgagagctcctgccagcagagctcctctggatctcttgagtcggcgggacggagaacggtacgcgggcatagccacctccgggcacgttgacgggaagagatccatggcatccgattaccggacgccatggacatgtcatgagtaacgcacgggcggaggaaggcgtaaagaggctctgcggtctagacctgtgtcgccgcaccccacctgcgaaaacgcgccggaaccgcgagaattttcactcctgaaggtccccggcacccgttcccgccccctgggcacgcgaaggcacacaagagcggcgatcggccgccgggcacgccttgcccccagtactcaaatttgactacgctgctcgcatgaccgagacgaccatcccgatgctgccctgccgtacctcgctgatcgagaccaccgtcgacttctacaccgccctcggcttcgcgacgacgtacctgcagaagagcccgtacgcgtacgcggtcgtcgagcggggagcggtcgaactccagctgtacggcatgaaggagtacgacccggcgtcctcccactccgggtgctatgtcctcaccgatgacgtggacggcctgcatgcggcgttccgggcgggcctcaaggagacctacgggcacgtcccggcacgggggttgccgcgcatcggtccactgaaggacatgtcgtacggcgtgcggcagttcctggtgaccgacccgaccgggaacacggtccggatcgggcagccgatcagcgaggaccagaaccaccggcccacgccgaaggagaccttcgctcgcgccctgcacatggcggacctcttcgcggactccaagcaggacctgcctggcgcggcgaagatcatcgaccgggtgctggggctgacggacgagcacccgactccggcgcagaagttgcgactcctcgtcctgcgcggggacatcgcgcagcgcatgggtgacgcggaggaggccggggtgctgctggaagaggccgcggcggtccggctcgggcccgaggagagggaagccgccgcggacacgctggccaggctcgcggacctgcggggctgatcagccgaagggagcgccggtcgtccacgggccctggacccggcctcggttcacctcggcgggtcctcgcccgtcaggccgtcgacggactcccggatgaggtcggcgtggccgacatggcgggcgtactcctcgatgaggtccaggaggatgcggcggaggttcggacgttcgccgccacgggtgacgtgggcgccgagctggtccaggccgccgcccgcgcggagggccgcgtcgaccgtggcccgggagcgggccgccgattcccgccagagggtgcgcagttccccgggggtgttctgggcggcggagcggtaggcccagtcggggtcgcggtcccagtccaccgcgtcccagggggcgccgaccggaacaccgagccacaggcgggcgaagtggctgtcctcgacgtgcgccagatgcttgagcagaccgcccagggtgacggtggacgcgccgaccgtggtgttcagcccggcggcgtccagaccggagcacttccaggcgagcgtggcccgctgacgctccagcgcgccgaggacggctgccgcctcggtaccggcgaggggaggttcgggccaggcttccacggtgctctccgtcatggcggacacggtagcggagcccgaacagcggaatggggcccggcctcgcggccggacccccctcgctttcccctcccgtcgggacttcccgttccccccggacccctccccggaagtacccgacgccatgtgtgacccgggagggtacgcaaaggttgcagccctttacgatctctttgccatcggggtggcgcaggggctctcagcaggcgtgttgcacatagcgctccgccacttccgccagggcttccgctccgtcgcgggcccacagtgcctcgttgaagatctccacctcgatcgggccgtcgaagccggcggcttccacgagacggcggaactcacggaagtccacgcttccgtcgcccagttggccccggcccagcaggacgcccgccgggagcggggtgatccagtcggccagctggaaggagtggatacggccgcccgcacccgcgcgggcgatctgggcgggcgcccggtcgtcccaccagaggtggtaggtgtcgacgaccaccccgacctggtcggccgggaagcgttccgcgatgtccagggcctggccgagcgtggagacgacgcagcggtcggaggcgtacatcgggtgcagcggctcgatcgccaggcgtacgccgcgcgccgcggcgtacggggccagttccgccagcgcctcggcgacccgctcccgggccccgtacagatcgcggctgccgggcgggaggccgccggagaccaggaccagggtgtcggtggacagggccgccgcctcgtcgatcgccgcccggttgtcgtccagggcgcgggcgcggtcggccgggtcgagtgcggtgaagaagccgccccggcagaggctggtgacggtgagcccggcatccgccaggagcctggccgtgcgctcgacgccgtacgcctgcaccggggcccgccacaggcccaccatgccgatgcccgccttgacgcagccctcggtcagctcgggcagcgaccactgcttgatggtctcctggttgagcgagagacgggagagccggccgtcggtcatcgtgtgcctccgtggaccgcgagcagggagcgcatccggtgttccgccaggtccgggtccgggaacaggcccagcctgtcggccagttcgtacgccttcgccagatgcgggagcgaacgcgccgactggagtccgcccaccatcgtgaagtggtcctggtgaccggagagccaggccaggaacaccacgccggtcttgtagaaacgggtcggcggccggaagaggtggcgggagagttcgaccgtggggtccaggagcgcccggaagccgtccacgtcccctgtgtccagcacccgtaccgcgtgcgccgccagcggtcccagcgggtcgaagatgcccaacagggcgtggctgaagccgcgttcgtcgcccgcgatgagttccgggtagttgaagtcgtcgcccgtgtagcagcgcaccccgcccgggaggcggcggcggacgtcgatctcgcgggccgcgtccaggagggagatcttgatgccgtcgaccttgtcggggtgttcggcgatgaccttgaggaaggtgtccgtggcgtcgtcgaggtcggcgctgccccagtagccctccagggccgggtcgaacatcgggcccagccagtgcaggatcaccggctccgacgcctggcgcaggagatgggcgtacgtggcgaggtagtcctccggaccccgcgcggcgcggaccagcgcgcgggaggccatgaggatcggctggacgccgttctcctcggccagggccagctgctcctcgtacgcggccgtgacctcggccagggtgggctccccgccgtcgggcagctggtcggtgcccacaccgcaggcgatcctgccgcccaccgccttcgcctcggcggcggagcggcggatcagttcggcggcgcccgcccagtccagacccatgccgcgctgcgcggtgtccatggcctccgcgacgcccaggccgtgcgcccacaggtggcggcggaaggcgagcgtggactcccagtcgacggccgccgggtcgtccggaccgatgtccgcgtacgggtccgcgaccacatgcgccgccgagaagaccgtacgggaggtgggggccgccgctccgggag

SEQ ID NO: 3432 - DNA, 4242 bp, Unknown
  Kingdom: Bacteria, Phylum: Actinobacteria, Class: Actinobacteria, Order: Streptomycetales, Family: Streptomycetaceae, Genus: Streptomyces
gtgccgcgcgcgaactcctggaggaagacggcagcgccggcctctcgctgcgcgcggtggcccggcgcgccggggtgtccgcgacagccccctaccgccactacgccgaccgcgaggccctggtctccgccgtggccgccgaggggtaccgcgaactcgccggatccctggcgcaggcccatcccgcgccttcgacacccgacgaactcgctgccgtggccgtggcatacgtacggttcgctctggagcacccggccctgttccgggcgatgttcgccgagccctgcgaccccaccagcgaggaacgggtcgccgcaaccgaggccatctcgcagtacgtccgcaccatcgtcggagccaccttccccggggtggacgcggacgccctgtcgaccacagtctgggcgctcgtccacggcctcgcgttcctgcatctcgacggcaagctcgacgcctcctcctccacgaccgtcgccacccaggtcacctccgccgtccacgcactgttcgacgcctccccagcgatgtcccgcgcggcgacggcctagctcagacaccagcctcaaggtggccgggtgatcacgtgctcgccactgcggcggcctgcgcgtcctgttcgcggagcatccgaatagcggtcgcgggcgaggggtgctgtcccttcttcgcgtcggtgatgatgacgagccgcgtggcgatgtcgcgcaggctcctctcctgctggggcgcgtgcggggttgttcgccgcgatgtccggggtgaagtgccagtccatccgagaccggtgaacacgatcgcgtacgggtcgtaagaccccgtggagccgagtgcacaaaactattccagatgcgggcagtcgaggaagatcgcccaaggggcgcggttgttgccctcgcccgccgacgcctgcggtcaggtcatggccgcgaccccatcgccacggttctcggagggccggaccgtgcatctgctgcagagtgccccggcgtaggcggcgagggcacgtccactgccgaaccgttcgaggttctgcggtgtcaccccgtccgtcgtcgacgaagctcttgagtgggtgatgtccgtgtgtcttcgtccaggtcgcgtcggcttcctgcctggcagagtgggccagtcccagcactccgtcccgcagtggagttcacccagggtctgtgggtccggttcacccccggctgtgtgctctgctcgatcgggtgggcttccgggccgccacccctcgctcgcccccaggtccggcaccgtaatcagcccagccctcattgcgccagcgtatttttgggtgacacggaccggataccttcggcgcgcttccggaatccggcgatctctcgatcagcgccttcgaccgccgcaccgccgggcttcgtacgtcgcacgcctgctccggagcgtcgcggggtcgacactgttcatatccccactcggccacgtgatccggcgagcacggcagaggatgcgggacatggggcgtaaccggatgatcgccctggcaacctgcgccaacgcgggtttctgcccagcatattgagcgtcgaagctgtgatcccggaaagctgattggtgatctactcgtcgtgaccgggtggaggaggctctcactggtggccctagtagaggacgtggtgtcggtgaggcaaggcttgcgtgtcgcggtgctggggggtggcgtggctgggttgacggcggcgatggagctggcggagcgcggcttcgaagtgacggtggtggagcccgccggctggggtggcaaggcccgcagcgcatgggtgccgggaacaggcggaggcgggcggttggacctgcccagtgagcacggttttaggttctttcccggcttctaccggagtctgccggacactctgcgccggatcccggtcgacggcagcaccgaaggggtggcggggaacctgcgggaggcgacgcagatgctctccgcacgctcgggccgaatgggtgagcgggtcactgatgtgtccacggctgcgggtgctcggacgccgatggagtttctgcgtgctgtcgggttggaggcaggaggcagagggctgacgagcgaggagctgctgtacttcgcgaacaggatgctcgtctacatgacaagcagtgacgagcggcggctcggccagtgggagtcgacctcctggtgggacttcgccgcagccgacggcgcctccgaggagtacatcaaggcgtgcgtggtgggcgcgacccgcacggtggtcgcggcacgagccgaggtctgcagtgcgcacacggtcggtgggttcctggaggctttcagctacgggttcctgggccggagcgaggaaccgcagccggcggaccgggtactcaacggacccaccagcacagcctggatcgacccgtggatccggcatctgggttccctgggggtgcggctcgaactcggctggggcgtcgagcaattggtcctgcgcggtcgccacgtcaccggggccgagatacgcggccctcgcggccgacggcgggagctggaagccgactggtatgtctgcgcgctgccggtccaccgcgtcggcgccctgctggaccgtggactggcggaggccgacccggagctcaagagtgtgacgggcctgcacacggactggatggtcggcatgcagttctacctgacccagccggtgccagtcacccacggccatgtcctgttcctggactcgccctgggcgctcacctcgatcagccaggcccagttctgggactgcgacttccctgccacctacggggacgggacggtcgccgactgcctgtcggtggacatctcctcctgggacactccgggcatcctgtacggcagaccggcccgtgagtgcagccgggcgcagatcgcggccgaggtctgggcacagctgtgcgacgggctcaacggcgatggccgaacccgcctgcacgatggtttgctgcactcctgggagctggatccggcggtgcggaacctcgacgggccggagccggccgtcaacagcgagccgctgctgatcaacaccaccggttcctgggaggcgcgcccccgggcggtgacggcggcggcgaatctgttcatggccggggactacgtccgctccccggtgaacctggcgacgatggaaggcgcgaaccaggccgcccgcctcgccgtcaacgccctcctggacgcggccggtgataccggggcccccgtgcccgtgcactccttgtaccagcccggggaactgcgcaggctcaaggaggtggacgccgagctgttcgaacagggccgcgcgcacctcatggacgggccgcctccgtggaaggtcagtgcacgcgtctgaccacggccgtacacagcgcttcgaggtcttcgagagctgagggtagggctgtgagtcggtgcagccggtcgcgtgcggccgtcgcgtgctgggcggcgcgatcactggtccagctccgcccgcccgcctcctcgaccaggcgggcgaggtaggccgtatcgcccccgggctgcgagtagaggcgggcgagttcgtcgccggcaggggtcttggacatcagcgccgcaaccacgggcaccgacatcttgcggttcctcagatcgttgaagacaggctttccggtcaccgccgggtcgccccagataccgagcaggtcgtccacgagctggaaggccatgccgaggtcgtgtccggcgtccgcccactggccgcagacggccgggtcagcgcctccgtagagggcgcccagtcggcaagcgcaggcgaacagcgaggcggtcttgcccgagaccatctccagacactccgccaaggtcacctcggtccggccctcgaagacaaggtccaggctctcgcccaccgccagttggatcagcacgtccaccagggcggccgacgcctcactagccaccggtccgtccggcccgtcggcttccgacaggacgtcgaacgcggtcagcatcatcgcgtccgcggaccgggctgcggacgacgggccgaaaacctgccacgcggccgcgcggtggcgccgcaccgtgtcaccatccaaaacatcgtcgtagagaagcgacaggttgtgcaccatctccaccgccgcagccgccggcaccgcccgccggtccgcacctccaaccgcacgcgcacatgccagagtcagggcagcacgcacgtacttaccgccttgacgtgcaccctcccccgaccagccgaactgataggcagccacctcagcagcggacccctgaag

SEQ ID NO: 3433 - DNA, 6904 bp, Unknown
  Kingdom: Bacteria, Phylum: Actinobacteria, Class: Actinobacteria, Order: Streptomycetales, Family: Streptomycetaceae, Genus: Streptomyces
cggtggcgagggcggtgaggtgctcggtgaagcgcctgcggtcgcgccggccgtaggactgttcgcccccggtcaccagccgggccagcaggccgcgttcgccgctgccgcgcagggtgccgtcctcgggggtccacagcggcgcggtgcgcacccggctgacctggggcggcagccggacccagccctgctcctcctggtgggcggagcggctcagggcgaacaggtcgaactcgtgctgcggcagcccgcgcaccagccggtcgcaccagagtctggactcaccggtcgcatacggataaccaccgtcggtgagcagtccgatccgcacgaatacacccccgatctcccgtgtgggcggccgccgttgaaacggcgactcgcagcgggacgaccgtaagcggatacgccggtggcgcgacggacggttgtccgtcgcgccaccgaaaggggtgaaccgtcgtaactttcccgccccggtcgcgttccgtcgcgatacagcggtcggttgttacggagggtcaggcccgggccagctccttgcgggccgtccggcgagccgccgcgagtccgggatcgagggcgggcacggccgccagcagttggcgtgtgtacgggtcccgcgggtccgcgtacaccgcgtcggcgctgccctgctcgacgatcactccccggcgcatcaccgcgacctcgtcgctgacctgccggaccacggcgaggtcgtgggcgatgaacaccaggccgatgcccagctcccgctggagctccgagagcagctcgacgacctgggcctgggtggtgacgtccagcgcggagacgggttcgtcgcagacgatcagcttcggttcggctgccagcgctcgggcgatccccacgcgctggcgctgtccgccgctgaactcgtgcgggtagcgctcgtagcggccggggtcgagtccgacgcgctccagcagttcgccgacccggtcccggatccggccctcgtcgctctcccccgcggcccgcagcgggtcggcgacggactccccgaccgagcgacgggggttgagggaggcgacgggatcctggaagaccatctggaggtcgcggcggaaggaccgcagctccttctcgggcagcgagccgatctcccgacccccgtaacggaggcggcccgccgtcgggtcgagcaggcggaccagcatccggcccagggtggtcttgccgctgccgctctcgccgacgatgccgagcgtgcgcccggcgtgcacggtgagggagaccccgtccacggcggcgacccgcccgctcccccgtccgaactcgcgccgcagaccgacggcttcgagaaggggtgccgcatcctccgcgacgcgcggcgaaggcaccggcacgactctgcgggtctccacacgcggcacggctgccagcagctccttggtgtacggctcgcgcggcgcaccgaggacccgggcgaccgggccgcgttccacctccttgccgtgccgcatcaccagcacctcgtccacgctctccgccgccacacccacgtcgtgggtgaccagcaggagccccatgcccgtctcgtggcgcagatcgtgcagcagatccaggatctgggcctgcacggtgacgtcgagggcggtggtcggctcgtccgcgatcagcagacccggttcgcaggcgagcgccatcgcgatgagggcccgttgccgcatgccgccggagaactcgtgcgggcgcagccgggagcggcgggccgcgtccgggataccgacccggtcgagcacctcgacggcacggacgcgggcggccttgcgggagacggggcggtgaacccggtacacctcggcgatctggtccccgaccgggtagtacgggtcgagcgaggacagcgggtcctggaagaccatggcggcccccgcgccccgcagcgcccgcagttcacggtcgtcggccgcgttcacgtccgtaccggcgacgcggacgctgccgccgacccgggcgccggttccccggtggaggccgagcagggcgtaggcggaggcgctcttgccggagcccgactcccccaccacgccgagcgcgccgcccgcctccagggtgaaggagagcccgtcgacggcccggacggggccgaagtcgacggtgaggccggagacctcgaccagggggtcgcgcgttgtcatgacagaaccacccgtcggtcggccagcgcgtacagcaggtccgcgacggcgttggcgaggacgacgaagaacccggtcaccagcaccatgccgaccacgacgggcaggtcgacgaccttgaccgcgtggaccagctcgcgcccgatgccggggatgccgaagagggactcggtgagcaccgcgccgccgaacatcgagccgaagtccagcgcgctcagggcgatgacgggggcgaccgcaccccggagcgcgtgccggccgatgatggcccgctcgccgaccccgtacgcgcgaaaggtgcgcacatggtcctcggcgagggtctccagcatggcgctgcgggtgaggcgggcgtacttggcggactcgatgagcgccagcgacgtccagggcagcaacagcccccaggcccactgttcggggttctcggtgaacggtacgtaggagggtgcggggagccactggagggtggagcagaacacgatgatgagcagtagcccgatgacgaagacgggggtggcggagccggccagggtcagccaggtcagcacccgttcggtgagccggcctcgccgccaggcggagagcacgccggtgccgacgccgagcagcagccagccggcgaacgcgccgatcaccagggagccggtgaccgggagcttggccaggatcagctgggtgacctgctggtcggactggtaggagacgccgaggcagggcatcgcgcagtgctcggtgccggtcccggtggagaagtcgcgcccggcgacgatgccctggaggaagtgcgcgtactgcacgtacaccgggtcgtcgagccgcagttgctcggtgacctgagcgacctgggcgggcgagcagcgggggccgcaggcgatctgggcgacgtcgccgggggccacgtagaagatcgcgtagaggagcgcggtgagggccagcaggacgagagccgcgccgccgagccgccggagcaggaagccggtcatgccgcatctccctcggtgttcttggcgccggtgttcttggtgtccgtgttcttggcgccggtgttcttggtccccacacggagccgggaggcggcgcgcgggtcgagtgcggtgcgcacgccctcgccgaggacggtgagcgcgaggacggtgacgaagaggagcccggcggggatcagcaggtacgtcggcgccgcctggtaccaggtgtcggcctcggtgagcatctgcccccaggacggggtgggcggtttgatgccgacgccgaggaaggacagggccgcctcgacgatgatgttggtggggaaggccagggccgcgtacgtgatgacgggcgcggcgagcgagggcagcagttcgcggcgggcgatggaccaggtgccgcgaccggtgagccgggccgccgagacgaagtcgagggacttcagggtgagggcctgggcccgcacgatcttcgatgtgccggcccagttgatgccgccgatgacgagagcgatgaggacgggccgggggaaggtctcggggacgatcgcgaggagcgccagggcgatgaccatgatcggcagggcgacgttgatgtcggtgatcctgctgaggatctggtcggtgcggcggctgccgagggcggcggcgagcccgatgaccaggccgagggcgatctgcaggacggtggcgacgagggcgacgccgagcgagacccgggccccgtacacgatccgggcgaacaggtcgcggccggtgcccggttcgacgccgagccagtgctcgccgctgatgccgccgaaggagccgatggggacgccgccggccgccgagtcgacgaggtcggggtggtaggcgttggggtcctggcccgcgagggcggcgagcagcggtgcggcgagcgcgaccaggacgagcaggaggacgacgagggccgcggcggaggcggcgcgctgggcgcgcagcctccgccagaacagccgggccccggaggcgggtgcgacggccggcgccgctcccgcctcctggaccagaagtgcttcggacatggctacttgaccgcgacctgggagacgtcgaggacgccggtccagtcgctgatgacgatgttcttgacgtcctcgccgtacagccgcttgtagaccgggtggaagagcggcacggtcagcgcctgctcgccgatcttctcgtcgagcgcgccccagcgggcggcggcggccttcaggtcggtgatcttgttgatctcgtcgatctccttgttgaccgcggggtcgttcaggaagccggtgttgaagttggctccgtcctccacgatctggcggccgtcgaagatcggggcgaggaagggaccgccggagggccagtcggctccccagtgggcgaggaagaagccgggctccttcttcgcgctgtggatggtgtcggagtagtcgttgctctccagtccctggagcttcacggtgatcccggccttcttgagcgcggcctggatcgcggtggcgatctcggggctggtctcgaagtccttgtcgttggagtgggtgagggtgatgctcaggcccttgtcgtgcccggcctccttcagcagctccttcgccttctcggcgtcacccgtcctcccggccgggaagtggtcgtagggcgtgtggccgaaggagtcccgctcgggcaggaaggtggtcgcgggttcggcgagcgaggagccgcccgccgcgttgacgatcgaggtgcggtcgacggcgtacgagatcgcctggcgcaccttcgggtcgtcgaagggcttcaccttcgggttgaaggcgatgtagttggtgtagccgaagtggccggtgccgacgcgggcggcgagcttctcgtcgctgccgaccttggcgagttcggccgggccgaggttggtgtcggtggtgacggcggcggcgtccgcgccctgggaggcggagagccgctggttgatgacggcggagtcgagtccggagcggacgtcgatccggtcggggtaggccttgcgctcctcgtcggtcctcgccgaccagtgcgggttgcgctccaggatgatccgctcaccgtcgttctcgttggtgacgaccttgtacgggcccgaggagacggggtgttcctcgtacttggtaccggtgtccttggactgcggcaccggggtggtctgcgtctgggtggcgaggaaggggaactcgccctcgggcttgttgaggtggaagacgatcgtcttctcgtcgggcacctcgatggagtcgaggcccttcttgtccttgtacgggccctggtagtcggccccgccgatcagccagtcctgcaggtagggggcgccgccggagagttcggcggcgaaggagcgctcgatgccgtacttgatgtcggcggaggtgatcgcggtgccgtcctcgtacttcaggccgtccttgagggtgtacgtccacaccgtggcgtccttgttgggcgtgcccaggtcggtggccaggtcggggacgaccttcgcgccctcggccccgtcctcgcggttgcgggtggtgagggtgcggaagacgagagaggggacgttgccgccgccggaggtgtagagccgggcggggtcgaagtcctgctgcgggttgctgttcaggacggtgagggtgccgcccttctgcggcttgcccgcggccccgggggcgccggccgcgccctcgctgtcctcggggccgcaggccgcgacgcccgcggccaggacgagaaccgcggtggacgctgccacgcggcgggatatgacggacggttgacgcatcggaagatgacctctcggactgctgcgagcggaagaagcggaggaagcgaaaacggcggcatccgcgcaggcgacgacgagaaggacgtacggaccccgtggtcggggaacgaaaaggaaaaggccgcgcctgcggacggaatacgtccgggcgcggcagtcatggggcccgccggagccgaaaagggctcacggggaaaagaaagaaaaagggccgacgcgcgctcggacaggcgtcagcgacagagaatgtcggctacgcagtgcccggtcacgccgagaagcgccagctcaagagcggcgatctcggaaggtgcggggctgcgcgacatgccgagaaatatgaacgaccgccttgaccgctgtcaaagcggatcaagacggccgtctcacgatgcggacgcgtggaggtcaactctcggggtgcacccaggggttggccctgcacttgatgccttcgagttcaagggtcttggtctgctgctgcatgaccggagccagggcgccgggagtgcggcagctcacatggttgtggcccagccggtggccgacctcgtgattgatgagcatctggcggtagggcagcaatttcttcggaccgaaggtggcggcgccctgcgcccagcgataggcgttgatcatcacgcggtcggtcgcggcggaatcgcaggagacgttgtcgatcgtggtgtccagaccggatttggcacaccagtcgccggtggtcccgggactggccagcgtgatcacgaagtccggggtccccgaggagatgcgctcgaaggtcatcgcaccgttgtgcgcccaactccggtcgtcgttgagcgtcttctgcacggcttcggcgaaaaggccggcgtcgaggccgagacccttctccacatcgatccggtagcggtgcttctgcccctttccgggggccttcgccagaccgggcaccgcctcgaacgtgccgctcgccgcggacctgaaggcgagcggcacgttcgagg

SEQ ID NO: 3434 - DNA, 2799 bp, Unknown
  Kingdom: Bacteria, Phylum: Actinobacteria, Class: Actinobacteria, Order: Streptomycetales, Family: Streptomycetaceae, Genus: Streptomyces
cttgtccagtgcggacatatgtcctcctcgtcgactttgcgccccccgtcaagcgtcaccgcaccgggcaccgcccgcatccgcgccgggggcggggaggacgccgacagatgggacgggggagggccggaagtgtgaagccgcgcctactgggcacataccggttgaccaggaggaggtggtggcaatgggccgcatccgagttgtcgtccgtcgtcccccgcccccttcggggcccccgccgctggatctgcgcaccccgtccggccgccccctgccgtactgaccgtgggcgcgctccactcttcgaggttcagccacgcgctgcgtgccagcggtgatccgggtggtcagggtggggaccgccgtcgcggtccgtgccgccgcggcccgttctcgtaccgcgtcgcggtcggccccgacatcggcgccagttgctccaccagggcctccagttcctcgacggcgtattccgtctcgcggcggatgttcttgtgctccgcgacgacggccccgagcagcagcgcggtgagcgcgacgcttccgttgagcagcgagagattggccatgatctccatcaggctgtgccccgcgaacggccccagggcatccgtgccggcgatgatggcgagcaccgagacgaccagggcgcacggagcgctgccgggcaactggaagcgcagggccgcccagatgatcaccgggaacaccagatagatcaccgacagcgagctgcgcgtggcgatcagcgacgagacgaccacgacgaccgcgaggaccgatgcctccagccaccggtcggacacgcggggccaccgcaccctgcgcaggaccagcagcacgggggcgaccaccaggacccccatcacgtcccccgcccaccaggacgaccagaccagccagaatcgtcccggcggaaccttgccgtcgagcagcaacgtgaaactcccgatggtggcgctgatcagcattcccgcgaacgcgccgaggaagaccagacagaccccgtcccgcagccggaccagctcactgcggaagccgacccaccgcaggagggcgtacgaggccagcggggcgaccgtgttgccgaacatgatggccagacggctcacggtgaacgcgtcgccgatctcggagaccgtgaccagtgtgcccagcgcgatgcccggccagacgcggacgctcaggcacagcagggcggccagtgcgatgccggtgggcggccacagaggcgtgacgaccgcgccgtccacgacgacctggcgcatcagcccgagacgtcccgccaggtagtaggcgccggccacgcccaggatctgcgccacgtacacggcccgacgtctggctttttcggtgcggatcacaccactcatcagacaccggccgcggcgggactcggcaggtgacacgctcggtacggtccggcgtcaccgaggtccgcggcgggcggcggcatgccgcaggaccaggacggcggcgtcgtcctcgtgtcccgtcacctccgtcgcgcccaggacttcgtcggccagccgcgccgcgctcgccccgacgtgcgcggctaccagctgccggacccgctccaggccgtcctcgatcagcagcgacggtccctcgacgaccccgtcggtgagcagcacgatcgccccgtcggagtcgagggtgcgccgggtgacgggatagccctcgccgggctcgatgcccagcggcaggccgcccgggtcctccgtgacgccggaccggccctccgtggtggcccacacgcacgccacgtgcccggcccgcgcgctgtgcagctcccaggtcgtcgggtccagtcgcatgaaggtgcaggtggcgaagaggcccgagtccacggacaccagcagatcgttcgtccggcccaggacctcgcccggatcggacgccgtgcccgcgatggcccgcatcgcgatacggacctgtcccatgaaggcggctgcctcgacgtcgtgaccctgtacgtcgccgatggcgaagccgagggccccgtccgcgagcgggaaaccgtcgtaccagtcgcctccgatgtccagaccgtggcgggcgggcgcgtagcgtgccgcggactggaggccggggaccgcgggcagggccgccggaagcatgtcgcgctggagcgcctgcgcgagttccaccctggcctggtggaactccacctcgcgccgagcgcgggcagtgaggctctgcagggtgttgagcaggtcttcggcgctagctgagcggggagtccgacgccggttcatgtgccgctccgcggtgcgttatgtccctgaatcatatggcgggccgccctgagcggcgactgcggccgcttccgcgtacccgcaagccccctgggtgccgctcagcgcgggcgggcgcggtacagatcgcggagcagagcgatctcggcaccgtggtgcagcacctcctggttgacccaccagacgatgtcgacgaaggggtcctcggcgtcgctgccgttcggatacgtgctgtacccgacggtgtccagagccgcgtcgtcggcggtgagcagggctgcgcgccaggcggcggacgcggtctcgaaggcggccaccgccccggcggcgtcccccggagtgcggtagccgtcgcgtgtgagcgccctgccgccacaggtgtggtcggcccggagggtgagcatctcggcgagatggctcaggcgccacgcgatggtggtgaacgggggagggtacggatgcggggagtccgccgagtcccggccccagtccccggctcccgccagaacggtcgcccgcgccccggggcggtcgccgc

SEQ ID NO: 3435 - DNA, 5691 bp, Unknown
  Kingdom: Bacteria, Phylum: Actinobacteria, Class: Actinobacteria, Order: Streptomycetales, Family: Streptomycetaceae, Genus: Streptomyces
gagccggtcgctctcgcgcaggccggggagggtggcgacggcgcgggcggcgacgagcagcgccgtggcctcgtcggcggcgaggcggagcggctcggcgacgtcgtcggggttgtgccaccagatccggtcgccgtcggtgtcgatgtcgaggaggtcgccgccgcggaagctggtgccgcacatgggcaggacgtcgaggtccgagatcagctcgtcctcggtgatcccgaaggcccgcgccacgtcctggacgtgggcaccggggcgttcccgcagatacgtcaccagggacagcatccgccgggtctggtcgatcgcgttcgtggccatcgtttccctgcccctagtccttggccacggcgcggagccggtccaccacatcggcccgcagatcggcgggttcctccacgacgacgtccgggccgaactcgacgagccaggcatcgaggccgtgcccgtacgggatctccagctcgtcccagccgtcgccgcgttccctcacggctatcgcgcgtgaccgcagcgggtagccggctccggcgcggagcctgatccgggcggtacgggtcgcggtctcgccggcccagctctcgacggtctcacggacggtgaccacgtcgggcacctcggcgctgaaggccccggcacgggagcggaccttaccggtgatgcgggagagccggaagacgcgctcggcaccgcgttcacggtcccagccggcgaggtaccagtgaccgcgccagcattcgagggtccagggttcgacctgacgctgttcggggcgggcggagttggccttgcggtagtcgaaggtgacggggcgacggtcgcggcaggccagcatgaggggctcgaacgcggcctcgtggacggggatgcggggttcgagggcgctgtggacctcgtaggcgtcctcggtctccggcatgcccgcggcccgcagtttctggagggcgccgctggcggctccggcgaggcgggcctgctgccagaccttggcggcgaggccgagggccgcggcctcctcggcgtccagggtgatggggggcagccggttgctgtcgcggcgggccaggtatccggtgtcgccgtcgaggttctcgacggtctcgatgacgaggccgagctcgcgcagatcgtccttgtcgcgctcgaacatccggttgaaggagtcgtcggagcccgcttcgagataggcctcgatggatccgcggagttcgcgcttgctgagcgggcgccgggttcccagcaggcacagcgcgaggttcatcaaccgctcggccttggcaatcgccatcgacgccctttctcttgttgctctacgaccgtcgaccgtaccgccccggggggtggggaccaaaaggcggaccgctgaccgaacagcgtgagggcccccgccgtacggcgggggccctcacgcgcaccagcggaacggatcagaccgcgacgaggtcgcagacgaagatcagcgtctcgcccggggcgatcttgccgccgccggcgccgcgctcgccgtaggcgaggtgcgcggggatgatcagctcgcggcgaccgccgaccttcatgccctgcacgccctggtcccagccggagatgacctgaccggcaccgagctggaactgcagcggggtgccgcggttccaggaggcgtcgaactcctcgccggtggagaaggccacgcccacgtagtggacggagacggtctggccggcctgggccaccgggccgtcgccctcccagatgtccttgatcgccaggtcggccggcggctcgccacccgggaagtcgacctcgggcttctcgatgctcactgaactgctcctctaaatgatgaactggacaaccgggacagtcttacaccttggcgaggatgtccacggcgaagaccagggtggagttcttcgggatggcctgctgctgctggtcgccgaaggcctggtccggcgggatgacgagcagcacccggctgccgaccttcttgtcgatcaggccgttcttgaggcccttgagggtgacctgggacagcgggaaggtctgggtctttcccgtggtgtacgtgttgtcgaactccttggcgcccttccagatcatgccgacgtagttcacgacgacgctgtcggactccttgacgacctcgccgtcggactccaggacgtagttggagacgagcttcttcggcgggtcgcccttggggatggtgaccgtcggagccttgccgtcggtcttcacgccgaccttgggcaggtcggcgtcgtcctgggcgacctcggtgcccttggcggaggccgggatctgggtggccttcaggatgtcgacgacgaacacgagcgtggcgttgggcttgatgtcgccctggccctgcttgccgtagccgagctcgggcgggatgaccagctcgacgcggctgccgaccttctggccgaccaggcccttgtcccagccctggatgaccattccggcgccgagcgtcagatcgaagggctgcttgcggtcgaagctgttgtcgaacggcttggtggagtcccacgcctggccgaggtagttgacctggatcgcgtcgccgttcttgagcttcgcgccgtccccctcgctgatgacgtcggtcttcagctccttgggcgggtcaccctcacccttggagagggtgggcttctcgccgaacttggcgcccgcggtgatcgcggggaagccgttcttggacgaggcggagtcggaggccttgtcgtcgctgccgcacgccactgccgacagcagcaggaggggggcgacgagaaggccggcaattcggcgcactggttcctcagatctcaggggacacggtgaatcggtcccgcaacactctagggggtgtcctgtcgatccggccggatcggcaagacaccccctgggcccttcgattcggttggggccggactccgcccggacggcccccggcccccaggaccggtgggtcctgggggccggaggccgtgctgcggtgacgtcggctcacatgccggcgatcagcttctccacccgctcgtccacggaacggaacgggtccttgcacaacaccgtgcgctgcgcctggtcgttgagcttgaggtggacccagtcgacggtgaagtcccgccgctgctcctgggcccggcggatgaagtcgccgcgcagccgcgcccgggtggtctgcgggggtaccgacttgccctcgaagatcttcaggtcgttgcagatgcgggcggtctgccccttgcgctccaggaggtagaagaggcctcggcggcgatggatgtcgtggtaggcgaggtctatctgggcgacccgcgggttcgacatggtcatgttgtgcttggcccggtaccgctcgatgagcttgtacttcatgacccagtcgatctcggtgtcgatccggtcgaggtcctcggcctcgatcgcgtccagggtgcggccccacagctccaggacctggtcgacggtgccggtgcggatgccccggcgctcgacgaagtccacggccttctcgtagtactcccgctggacctcgatggccgaggcctcgcgaccgctggccaggcgcaccttgcgctgacccgtgaggtcgtggctgacctcgcggatcgcccggatcgggttctccagggtcaggtcgcgcatcaccgtgccggcctcgatcatgcggagcaccaggtcggtggcgccgaccttgagcagcatggtcgtctcggacatgttcgagtcaccgacgatgacgtggaggcggcggtaccgctcggcgtcggcgtggggttcgtcgcgggtgttgatgatcggccgggagcgggtggtagcggagctgacgccctcccagatgtgctcggcacgctggctgacgcagtagaccgcgccacgcggggtctggagcaccttgcccgcaccgcagatcagctgcctggtgacgaggaacggaatgaggatgtccgcgagccgggagaattctccgtggcgggcgacgaggtagttctcgtggcagccgtaggagtttcccgccgagtcggtgttgttcttgaagagatagacgtcgcccgcgattccctcctcgtgcaggcggcgttcggcgtcgacgagcaggccttcgagaatgcgctcgcccgccttgtcgtgcgtgaccagttcggtcacgttgtcgcattcgggggttgcatattccggatgcgatcccacgtcgaggtagaggcgggcgccgttccgcagaaagacattgctgctgcggccccatgacacaacacggcggaagaggtagcgcgccacttcgtcaggtgacagtcggcgctgtcccctgaacgtgcacgtgacgccgtactcgttctccagcccgaaaatgcggcggtccatgactgaacattacgccttatggcctgagctgaaaccgggttcgacggctccgtttcgatcattttccgatcccgtcacgacggcgggggtacgggcgggagccgcgaggacccttcccgtgctcagcaggaccaccagggcggccactcccccggcccccgcgacggcgaagctccaggcggtcgagccgagttcgacggccggtcccgcgacggccgtgccggctgccgcgcctacgccgaacgtggtgacgagccaggagaacgcctcggtcaccgtgccgcgcggggcgtgccggtcgaccacgatgaaggagcaggcgatggccggtgcgaggaacactccggcgagggcggcgagagccgtcatgacgggcaccgagggagtgagcgtcaacggcagatagcccagcgccagcagcccgacgatgacccgcagccgcttctcgggcgcaccggcccactgccgcgccccgtaggccaggccgccgatcagcgcgccgaggccgagtgcggccatcagccagccgtacaccgactcccggccgtggtcatccgcgtacgccaccccggccaccgtgatggagccgagggcgagcccgacgaagaagaacgcaccgagcagggcgaggagtccgggcgagcgcagggcgccgagccagtgcgcctcgcggggcgcggagcgccaggtgcgcgagggctcggacaggacgaccgagagggcgccgaggacgccgatggcattgatgacgagcagggcggcggccggcgaccagagggagacgagcagcgtcaccaggagcgggccgacggtgaacatgatctcctgcgcgacggcgtccatggcgtaggcccggtgcacctggccctcgcccttgagcacgctgggccacagggcccgcaggccgccttccagcggcggcgtggcgactccggcgacgatgacggcgaggtaggccagcgggagcgaggagaggccggtgaaggccagcagggacatgccgagcgcggagacgacggcggccgggagctggacgcgcggctgcccgtagaggtccaccgcccggccgagcagcggctgcccgacggcggtggccagcccgtaggcggcggcgagcgcaccggccagcgtgtagctgccgccctccgcccgggtgaacagcacgatcgcgatgtgcgcggtgccgttgggcagccgccccaccagggtgcccgtcagcagccgggcggcatgccgcgcccggaggatgtccagatatcctgcggccatgtccgcccctctccgccccggccgactgcgccgtctccgaggtgttacgtataacgtcgaggttcatac

SEQ ID NO: 3436 - DNA, 2456 bp, Unknown
  Kingdom: Bacteria, Phylum: Actinobacteria, Class: Actinobacteria, Order: Streptomycetales, Family: Streptomycetaceae, Genus: Streptomyces
ggcccaggccggccagccggccgcacaccgccgccgggtcgggcacgtcgcacagggcgccgacgtgctccgggtccacctccgcgtcgcgcagggtcgcgagcaggtgcagggtcctcagggccgccgtgtcgaggcggtcgaacagcagaggcagcagcccgtcgatctcggccggccggggcagcctgacctctcccgacgtgtccagccgggccagtccggccgcgcgcagcagcagcaggggacggcccagcgacacctcgcacaggtccacggccacggcgtactgcgcctcggggagggggtgccgcaactcccgttccagcagaccgagtccggcggcccggcccagccccccaagctccaggtccgcgctctccccgagcagggagcgctcccggctcgcgaagacgaacgtcgcgtcgggcgcggcgtccgcgagcaaccgcagccgctcgggcgtcagctccgcgtcgtcgacgtacaccgtgacctcgatcccggtcatcagccggcgcagttccggtccggtcggcgcgtagcccggggcctcgtaacaggcttcgaagatctcctgggcgagatcctcgggctcgcgatgcgctccgttgaggaacagcaccccgtcccggccgggttcgagggagcgggccgcgtgccgcagcagggtgctcttgcccactccgggcggtccccacagctgcaccactccgtgcccgcgcagggcgtcctccagctcttcgaggtccgcctcgcggcccaccggttcgcgctgcctccgggggacgagcgcgacccgttcccggcgcaccggcctgggacgttcctgcggcgggagcaggttcacggtcgaaccgtgggcgtcgatcaccacgttgtggttgcccgcgatcaccgttcccgacgcgtccccggctatgtcgatgcggtggtcgccgcccatcggcgcgccgctctcctcgcggtcggggccgtgcggttcccgcgcgaagccgtccgtctctgccatggcccaccactcttcccgctcatggagtgcgactgcgccgaaccggtgcccggagagtcgtcgtcaccatggccgctgctactccgaaatgccggaatccgcagggcagttgagcatgggatcgcacaactccccctgactccaggtggcgagattagcgagagtcccggcgcacgaaaccgtcgtacgactgtttctgccaacttgctccacactcggccgggcgcgttccggcacgggcggttccggtgcccccggcgggctcaggtctgttcgcggaaggccagatcgctcagccggtcgagatcctccacccgtacggtgcggtagccggtggagatcactcccgcctggcggaacctgcgcagcaccttctgcacggtgggttccgccgtgccggacagggtcgcgagctccggctgcgtgatcggccagcggatcaccgcccccgcgccggaccgctcgccgtgggtcatcacgatctggtgcagcacccgggcgagccgggtggcggcgtcgcagccggtgaagtcgacgcgatgggtgttggcggcccggagtttcgcgaccacggcggcgttcaccgcgtgggcgatgccgggatcatcgcgggtgcaggcgagaaactcctcccggccgacggcccgtgcgaccacgtccccgcaggtcgtgacggtcgccgagcgggggcctccgtccgcggcggcgaactcgcccaccaggtctccgcccatgcggaccgccaggagcgcgtcccggccgtcgggtgcgcgcccggtcgccttgaccacaccgtgcaggaggacgacgacgaacgccgtccgctccccctcgcgcatcagtacgtgatcggctcggtaccgccggatcgcgcccagcgcgaggaggcggccccgggacgccgccgtgagggagccgagcaggctcgacccgggccaggtctcgtcggccgcgggtgcccggccgggtgtcctccggtgcggtgctgtgccgtccatgcgtcctcgcctcccggccctcggcatttcggccgcaatcgtcggcagctcttccgcgtcggcgggccgatccagtattacgacgggatccgccgggttcaatcggaggcacagtggaaccacggacgggacaggacacaacagcacgacagggcaccgccaggagggctgtatggaagaagtgcgggaataccgggccttgttcgcggtggacatcgtgggttcgtcgggtcgcggcgacgtggcgctcgggcagatccggcaggttctgtcggccgcgctccacgcatcgttcacgcgctgcggcatcgactgggaggcctgcctgcgccacgatctcggcgacggcatgcgggtcgtggccccggccgggacacccgagacgagcctgatccacccgctggtccctgagctgacggcgcgtctgctcagggaccagcgggtgg

SEQ ID NO: 3437 - DNA, 5466 bp, Unknown
  Kingdom: Bacteria, Phylum: Actinobacteria, Class: Actinobacteria, Order: Streptomycetales, Family: Streptomycetaceae, Genus: Streptomyces
ggcccgctccggcctcgtcgaggccggagcgggccttggcgagcagttcgagagcggcgggcggcgccgtgctgcggcgcagcacggggtggacatcgccggccggaccggtcagtgagggggcagggctgcctgcgcggcgccgcggggcggcggctgcggacgagctggccatgacgaacctcctgtcgtcgtgtgacggcttcgtggccgtctgtgtccatggtggcgggccccactgacaatcagcctcgatacgcctccgacctgccgttttgcttcgagcgcgagttcggactacctttttgcactgactggtcagtgcaaaaaggggagggtctgtggagagcccgcacggcgcggctgtcgtcgccgaggacttgggactggaagggccgcgcggccgggtcttccggaacgtgacgttcagcgccgagccaggggcgctggtggccatcgagggaccgtcggggtcgggccgcacctgcctgctgctcgccctgaccggccggatgcgcaccaccgagggccacgcgcggaccggcggtctgcgactgcccaagcaggccgccgccgtccgcggcatcgccgccctgggaccggtcccggcggtcagtgagctggacccggccttcacggtcggcgagcacctgaacgagcgcgccctcctccagggccgctacggcacttccctgcgcaccctcctgcgcccgcgcgccgaacggcgggccgccgccggggcccggatcgacgaggctcttgaggccgcgggcctcgacctcgccacgctgcccaaatcggggcgcacctccgtcagggacctggagcggctggaggcgctgcggctgtccgtcgcgctggcgctgatcggcgagccgcggctgatcgccgtcgacgacaccgacctcaagctctcggacgccgaacgcgaccgggcctgggcgctgctgcgctccgtggccgacgccgggacgaccgtgctcgccgtgtgcagcgaagcccccgaggactcccaggtcgttcgcacctcccccgcaaccaccaccgatgaggagacggccgatgcgttcgccgaagctggccgcgcttgagctgaagcggttcgggaggggaaagctgcccgccgccgcgctggtggccctgctgctcctgcctctgctctacggcgccctgtacctgtgctccttctgggacccgtacggaaagctcgacaagctgcccgtcgccctggtcaacgacgacaagggggccaccagcgacgggaagcgcgtcgcggccggggacgagatcagcgagaagctgctcgactccaaggtgttcgactggcacgaggtgagttccgccgaggccgagaagggcgtcgaggagggtacgtactacctctcgctgacgatgccgtcggacttcagcaggaagatcgcgtccagcggcggggactcccccgagaccggcgcactccaggtgcggacgaacgacgcgaacaactacatcgtcgggcagatctccaggacggtcttcggagaggtgcgcaacgccgcctccacgaacgcctcccggtccttcctggaccgcatcttcatcaacttctccgatctgcacgacaagaccgccgaggcggccaagggcgccgacgacctcaagggcggcatctcgaaggcgaagcagggttccaaggacctggcggacggtctcaaggactccaaggcgggcagcaagaggctctccgacggcatcgtgaagctgaaccagggctcgcgcgatctcgccacgggctccacccaggtcgccggcggaacccaggtcctggccgacaaggtcaacgggatcgccggtgacgtacgtcccttcttccaggacaacgggaagtccatccgcgacacggcccgcctggtcgccgacacctccggggcggtacggcacaacctcgacctgctggtgaagagcgcgcccgccgccgccgtcggcgccaaggaggcggccgacgagctgaccgagatccaccgcacccggtgcgaggaggccgaggagcccgacaccgctgtgtgccccccgctggaacgcgcgaaggtcacggccgtcgacgtcgcgaagatagccgccgatgtgaacaccctggtcacgaaccagaacggcgacctgaagaagctgagcacccagctgaccgccttccagaagcaggccgacgacctcgcgaagcgcgcgccgacgctggacgacgacctggcgtcggccgtggccaaggtcaacgaactgaacaccggtgcccacaaggtcgccaagggcgcgcaggcgctgcacaccggactcggcggcgcgcagaccggcgccggcgatctggacaccggcgtcggcaagctgaagaccggcgcggagaacctggacggcgggctcttccggctcggcgacggctcggccgagctggcccggggtctcaacgacggcgtcggcaagatcccggactacgacaagaaggaccgcgacgcgcggaccgacgtcatggccgaccccgtccagctggcctccaagtcactgcacgcggcccccaactacggcaccggattcgccccctacttcatcccgctgtccctctgggtcggcgcgatggtggcgtacatgctgatccagccgctgaacaagcgggcgctcgccgccggggcctcctcgtggcgcatagcgctcgccggctggctcccggtcgccgccatcggcacgctccaggtcggcgccctgatggccgtcctgcactggggtctcggcctccagatgacccacgccgccggaacgatcggcttcctggccctggtgacctgctgcttcgccgcgatcgtgcagtggctgaacgcctgcttcggggcggccggtcggatcctggtgctggtggtgctgatgctccagctgacctcggccgggggcacgtaccccgtccagaccagccccggcttcttcggcgcgatccacccgtacctccccatgacgtacgtcgtcgaggggttgcgcaggctgatcacgggcggccctctcggcccggtgtggctgggctgcgcggtgctgggtgccttcaccgccggcgcgctggccctgaccgcgttcaccgcccgccgcaagcaggtgtggagcctgagccggctgcacccggagctgagcctgtgagcgcgcccgcgagcgcggcggggcctggaagaatcggtctcatggaaagcagtggcaccacgcgccgccaggccacccggcagaagctctacgaggcggcggtgacgctcatcgccgagaagggcttctcggcgaccaccgtcgacgagatcgccgagcgggccggggtcgccaagggcacggtctattacaacttcaagagcaagaccgagctgttcgaggagctcctccggcacggtgtggggctgctcacggcctcgctgcgggccgccgccgaggagtccggggaacgtggcggcacccgggtcgaggcgctggacgcgatgatccgggccgggctcgccttcatcgaccgctacccggccttcacccagctgtacgtggccgagctgtggcgcaccaaccgcgcctggcagtccacgctgctggtggtacgtcaggaggccgtcgcggtcgtcgaggacgtgctgcgggaggcggtggacagcggtgagctgagcgaggagatcgacatcccgctgacggccgccgcgctggtcgggatggtgctggtggcggcattggactggcaggcgttccagccggagcgctcgatcgacgaggtccactcggcgctgtccctgctgctgcacgggcgggtcagcgggcactgagacccgccgggcgccccggtccggagacgtaccgggtccggtccggagacgtaccgggaaagccgaagacgccggccgctggagttcgcatcccccgcgaacctcaccggaccggcgtcttccgtgcttccggaaacccgttccccgtgaccccgtatgtcccccgtggtccccgggcatccgtcgtgcacccccgttgcgtcgggggaaccgcaccgttccgccgccccgtgccggcggtcctggccagcgccccttccgtggtcatcactctgccgtcctcgcagatgggggcctatccgcgtagctactcatctacgtccctgagtacggatactcacggctccgcgccgaaccccacccgcggtcccgcccgcggtcgttacgatcgcctccgtgtcggtcatccccctggtattcacaagcggctgggcaagcggaatcaacgcttacgcggtggtcctgctgctcggcctgttcggcgcgaccggcgtgtccgacgaggtgcccgccgctctgcagcgcaccgacgtcctgatcgtcgccggcgtgctgttcctctgcgaggcggtggcggacaagatcccctacgtcgactcggtctgggacacggcgcacaccgtgatccggccggtgaccggggctgtggtggccgcgctgctggccggggagagcggttcgctgccggagctggcggccggcgcgatcggcggggccacggcgctgatgagccacctggtgaaggcgggcacgcggatggccgtcaacacctccccggagcccttcagcaacgtcgggatgagcatcgccgaggacctcggggtcgccggagtcatcaccttcgccatattcaatccggtggcggccgccgtgatcgcggccgtgctgctcgtgctcggcatcgtcaccgtgctcttcctggcctcgcggattcgccgcttcctgcgccgccgggcccagcgccgcgaggagaagcgcctggccggaacgcgcggtccctggcctcccggctgaactgtcggcaccggtcgataaagtcaccggcatggcacgaattgcagtgatcggcgccgggacgggcgcgatggcggcggccgcccggctcgccgtggcgggcgagaaggtgaccgtctacgagcggtccgcgagctacggcggctcggtcggccgtcatgagcacgagggcttcgtcttcgacaccgggcccggtctgctgcacctccccgccgtccagcgggacctcttcgtgaagaccggcaaggagtcgctggagcggtccgtgacgctgacccaggtcgatccggcgagccgccatctcttcgcggacggcacggccgtgtccctgcccaacgcctcccgggccggggtggccaccgccctggacgacgcgctcggcaccggcgccggggctcgctggagcgacttcatggaccctttatcgaccggtgccgacagttcagccgggaggccagggaccgcgcgttccggccaggcgcttctcctcgcggcgctgggcccggcggcgcaggaagcggcgaatccgcgaggccaggaagagcacggtgacgatgccgagcacgagcagcacggccgcgatcacggcggccgccaccggattgaatatggcgaaggtgatgactccggcgaccccgaggtcctcggc

SEQ ID NO: 3438 - DNA, 992 bp, Unknown
  Kingdom: Bacteria, Phylum: Actinobacteria, Class: Actinobacteria, Order: Streptomycetales, Family: Streptomycetaceae, Genus: Streptomyces
cgttctccctgctggtgggccgggaccacggcgtcggcctcgccctggtcggcgatccgcggatcaccgcggtggggttcaccggctcccgggccggcgggctggcgctgatcgccgccgtccggtcacgcccggcacccgtcccggtccacgccgagatgtccgcggtcaatcccgtgatcatgctcgacggggccctcgccgaaccggaacccgcggccgcctcgtacgtggcgtcgctgacggccggcgcgggtcagttctgcacgaaccccggccttctgctgctgccgaccggatccgcgggcgacgcctttctctcggccgcggcccgggccctgaaggccgcggaggggcaggtcatgctcaccccggacatcgcccgtgcgtacaccgagggcgtggggcggtgggagaacgtccccggtgtacgggaggtggcccggggtgcggccggggccggcccgtacgcaccggcccccgtcgtcctggagtgcgacgcggccgcctacaccgcgcaccaggagctcaccggcgaggtcttcggtgccgccgggctcgtcgtgcgctggtccggcacggatgaactcctccgcctgctggaggagttggagggccagttgacggccacgctgcacgcggcggacggagaccgggcgacggccctggagctgctgccggtactggaggagcgggcgggccgcgttctgtggggcggctggcccaccggcgtcgaggtctgccacgcgatggtgcacgggggcccgtggcccgcgacgagctcgcccggtacgacgagtgtcggcaccctcgccgtcgagcgctggctgcgcccggtctgctaccagtccttccccgacgcctttctgccccccgaactccgcgacgacaaccccctccgggtcccccggcagacagggtccggtcccacgccgggaacctgaactccggcgggaccggcgtcgaggcggccgggcggtacggggcgggcg

SEQ ID NO: 3439 - DNA, 7367 bp, Unknown
  Kingdom: Bacteria, Phylum: Actinobacteria, Class: Actinobacteria, Order: Streptomycetales, Family: Streptomycetaceae, Genus: Streptomyces
gcccagggctggggcggcgcctccggcagggcgaacaccgaactctccacggcacaccggcgggccggcaggcggcgggggttgagcgggtcggccgcaccgtgtgccgtcagcgccaccagccgccgctggagcaggacgggaccggcgggcgcggggcccggggagatgtcggccaccagccggtaggactgccggtggtcggcgcgcagccggtagccgaggtaccagacgtcggtgcccgggaggtgatggaggagcgtgtcggccggccggtcgcggtcgccgataccggtcgccatcaggaggacctgacgggtcgcacggtggccgcgccagaggaaggtgacggcgcgatggccgggggcgtcgtcgagcgcttccacgagcggtgtgccggtgcgggtcacgccgtcccagaacgcctctgtcagggcgtcccgggccgcggtgtcccggacggcatcgagctgtcgggcgagccgggccatccgcgggccggtgaccggccgggggtcggcgtccgccgcacgggccgcgtcactcatcggccggcctcaccgggacgggccgctccgccggtctccgggcgagcaggcctctggggaaagtacgcgtcatcgttccaccgttcgtcgaaggcggtcgcgaccccggcggccaccgtcgccacccacgaccgagcccgacgggacaccgtcccacccacctgaggtcaacttagctaagcctaacctaatctcaggatggggaacgctcgcgcctcgcagacactcccggcgacaaaggggacgggaccggccgccgttgcttcggcgaccggtcccgtcgtgtcccgcgcgtcatgtccgccgacgttccacggtgttacgtggcgttacgtggtgttacacggtgttacgtggtgtccgcgacgctcctcgcggcggtgactaggcgccgaacgccttggactgccccggcttccccttcaccggcttggccccggccagcaggtgcacgggcaccaggtcccgggccggctccgagtagccgaccgagacgatcttgtcgccccggtacgtgaagctcgtcagcgaggccagcgtgcactgccgcttgcgcgggtcgtgccacaggcggcggcgctccacgaaggagcgcaggatccagatcggcagctggtggctgacgcagaccgcctcgtgcccgcgcgccgcgtcccgggcggcgtcgatcgcacccatcatccggacgacctgctcgatgtacggctcgccccaggacggcttgaacggattggtgaggtgcttccagttgtccggcttgcgcagcgcgccgtcgccgacgccgaaggtcttgccctcgaagacgttggcggcctcgatcagccggacgtcggtggcgagctccaggccgtgcaccttggcgacaggggaggccgtctcctgggcgcgctccagcggggaggcgacgacatgggtgacgtcgcgcttctccaggtgctcggcgacccggtcggccatcttccggcccaggtcggagaggtggtagccggggcgacgcccgtagagcacgccgtccgggttgtgcacctcgccgtgccggaccacgtgcaccacggtcaactgctcgtcgccgttcacgtcgtccccgttcggcttgccaccgctcgcgttcccgctcatgcggtggcctccgctgcggcacgggcggcggcgggcagggcggcggcgatgcgctcgaccgcccgctcgtcgtgggccgtggagacgaaccaggactcgaacgccgagggcggcaggtagacaccccgctccagcatcgcgtggaagaacgcggtgaaacggaagacgtcctgcttcttggcgtcgtcgtagtcgcggacgggctcgtcggtgaagaagacggagaacatgttgctcgcggcggacacggtgtgcgcgacgccctccttcgtgagcgcgtcacccaccagggagcgcagctcggcggagaccgcgtcgatcttcgcgtacgccgcgtcgtccagcagccgcagctgggcgagcccggcggcggtggcgaccgggttcccggagagggttcccgcctggtagaccgggccggccggggccaggtgcgccatcacgtcgccgcgaccgccgaaggccgcggcggggaagccgccgcccatcaccttgccgaaggtcatcaggtcgggccggacgccgtcgacgccgtaccagccggccttcgacgtacggaagcccgtcatgacctcgtcggagatgtacagcgcgccgttcgccgcgcacagctccttgagcccggcgttgaagccgtccgccggcgggacgacgcccatgttgccgggcgaggcctcggtgatcacgcaggcgatctcgcccgggtgcgcggcgaaggcggcgcgcaccgcgtccaggtcgttgtacggcagcacgacggtgtccccggccgtggcgcccgtgacccccggggtgtcgggcagcccgaaggtggccaggcccgacccggcggcggcgagcagcgcgtccacgtgcccgtggtagcagccggcgaacttcacgaccttggcccggcccgtgaagccgcgggccagccggatcgccgacatggtcgcctcggtgccggaggagaccaggcgcacctgctcgaccggctcgatccgcgccacgatctcctcggcgagcgcgacctctccttcacccggcgtaccgaaggaggtgccccgggagaccgcctcctggacggcggcgatgacctcggggtgagagtggccgagaatcatcggcccccacgagcacacgaggtcgacatactcgcgaccgtcggcgtcggtgaggtacggaccggtgccggacaccatgaaccggggcgtaccgcccacggcccggaaggcacgcacgggagagttcacgccgccgggcgtcacgacggacgctcggtcgaacagcgactgcgaaactggggcttcgtatgaatacgccactttggtcctgatctgcgattcgggtatcgggaggccgggccgggaaatcactgacaatctcggccaccggtgagcagggagcgcgctcccctcgtatcacgaaagagcgtcagccccctcgcgtctgcgaaactggggcgtcatagggaaagctcacacatgccatggtgtcagaggcacggacggtcttgcgggcaggtgtttcaccgcacgcccgcgggggaggtcactgacacgatgatcgggttgcgcggcgggggctgtgtctcctaagaagtagtcgggtggatgagatatgcatcgcggtggcggagtgggcgaagggaccgacgacctggggcccgagcctgcccggcgagggcggcaccggcgcagggccgagcgcgcccagagcaggggcgcggacagcacgccgccccccgggaccaggagcgggggcgggatgggggtgacgtacaagtacttcggcgccccggacggggcaaccgcggcacgcgtgcccatctcgatgcgcccggaggagctcggcggtgacgagctgggcatgggcggcatgttcaccaagatcaagccggagaccgtggccgccatggtcctgaccggaatccagggcatacccctgcacaaggtccccccgctcgaactggtcgtcctccaccccgactacgccgtggtcaagctcccgatgaccgtcgtcgacccgctgcgcggcgtcggcgaggagtccgtcggcgcggcggccttcatctggtccacggtccccgaccgcggcggcccgcgcgacgccttcaacgtctaccaactgctccacgagtggcaggacttctcccaccggctgcacgacgcggggcaccaggcgtactgcctggtctggccctgatccgggacttcccggcgcactccgtccgaaaccgtccggctcaccgcggggcgacggaccgaagcccgtcgccccggcgtgcgggccgaagccttccgccccagctcagcgtgtggcggtggccagcgccttccagaaggcgtagtggtggtcggccgcgaagtcggtcggcccgatgcggccggatgcgaggcgctgcacatacgggctgcgcggcgtggacggcttccacgcgggcaagccgtgcgcgtccggccggccggtggcggcgaaccggctccagtaggcggtcaccgtgtccgacaatccggcctgctcggcgtcgaggggctcgaagagatcgttctcgaacaggtaggccaggtcgaccatgtggccggtaccgagcggaaagctcgccggccgcggcaccttcctgaagtacggggcccgcgcatcggcgaagtcgtaggcgtagacacggatgtggcgggccatcgcgcgctgggtgtcgagcgccgcggtcgaccactccgagtcggtcagcacggccgccagcgccgctccgggcgccgagtgacgtgcggcgggatactcggccagaatcgcgggagcgtccttcccgaaccgttcggtgatcttctccgcgtacttctcggcggtcagcggctttccggtcatgatctcgtcgagcccggccagtccgctcatctcgtcatgggtggagccgtgcagcaccggcacccgggcgaaccgaccggcggcaatcgcccgtgacggggcctcgggcagcaccgtgccgtccaccacgggccggtagccgtcatggccggagagcgacgcttcgacgagcgcgccggtggacctgcgccgcaggcaggagtcggcggttcgcggatcggcgcagcgcgcggcctcggcgacggtgcgaccgttggcctccgcccgtgcgcgggtgaacgagccgtccggtccggcgcagcccgcactctgcacgatcgccttgtcgaagagtccccgcgctccgggcgagacgagctgggcgcagacgctgtagccgccgcccgactgccccatgatcgtgacgttgccggggtttccgccgaaggccgaggcgttgcgctcgacccacttcagcgcggcctgctggtcgagaaggccgaggttggtcggcgcgcgcaggcccggcgcggtgaggaagccgaacgcgccgagccggtagttgaccgtcacgaccatggcgccctgccgcgcggcggccagctcggccgctcggtaggtggcaccgtcgccgtaggtgaagctgccaccgtggatccagacgatgaccggaagccgttccgccgtccgtccggcgggcgtggtgacgttcagatggaggcagtcctcgctgccgccgccctcgatcgagatcggctggtcggtcggctgcgcgcaggcgctcctcggggttcgggcgtccagcggcgccgaccaggaacgcaccggccgcggcgtcttccaccggcgctccccggtcggcggagccgcgtaaggaatgccctggaacgtgcgcaccgcaccggctaccgagccctggaccgggccttccgcggtcgtcacacgggtctggagcacctgcggctcggagtgcgccggcgcgaggccggccgtgatcagcgtggcggcgagcgtggtggagacggcggccgcggcaagggcggcggcacggaacggtctggtcctcatccggactcccgggatcggtgtggtcgtcgatgaccggaaccgtagtcaggatttgggcaatcgcgcaagacgattgcctaacgcgaacgcatgaggcggtcgcatgagacgtttgcctggcgcggctgcgcagtacgttgctagggtcgacgccatgggaatgggaaaccgggagaagctgctggaagccgccaggcagtgcctcttcgacaagggctacgagcgcacgacggttcgcgacctggcctcggccgcgggcgtcagcatggccgcgatcggctatcacttcggctcgaaggaggccttgctcaaccaggcgctcttcgaggcgctcgactcggggggccaagcattcgggccgtcgtccggcgacggcgacagcgacctcggcgcgctgtggcgtcgcctgatcgaggccttctcggccaacaagacgttctggatcgccaatctggagaccgtgctgcgggcccaacgtgatgcggggctgcgcgagcaggtggccgccgggctgcgacagggccgcagcggcatggcgcgggaggtcaccggagccgccgagagcgagctgtccgagcagacgatccgcgccctcggctcggtgcaactcgccctcgtcagcggtctgatgatgcaacacctcaccgacccggaatccgcgcccaccgccgaggaggtactggcgggcctgcgagcactggccgcccacctgcccgaggaggcgtagggctcgggcctggaccggtccggcgggtccggcggaagcagggtcggggaaggccggcccgacgaagggggcgagaggcggagggactgaaggccctttcgaaggaaaaccggccgcacaaccggtcgaggcgttcaaacaggcgcacccacaccgacacagtcagccaaatccagccatatattacggagctttggccgacagccggtcttcagccgaccctcccggcacgccgatgcacaggacacccgaccatcgaggaggtccgccgtgggcgacgttctgctggccctgtccatccccgtgctcgtcttcggcggcggcatctacgcggcctgcgactgctggtggcgccgcaggcatccggcgcctccgtccccgtacacccaccgggcggcccggctggcggagcaggagatgctgctcctggccgaggagatcgtcgacgacgcgcacgccgcgctcggacccctctacgaggccccggccaccccgcgccccggcggaccgcccgccgggctcaagcccgaggcgtcccaggcgtcccggtcgtcccggtcggacgccaccccgggtcgcggcccgtcacggccagcagtcgctcgaaggcgctagccccctcccccaccgggaacggctcaccgaacatcttcatctcccgggcctgcggagccatggccgcaagacccggtcccagttcgtcgagcacccgctcctccggcacgaagtccgcgcccgtcgcccgtgccaggtcccatgcgtgcaccgtcagatcgccgagcaccatgagccccaccgtccgggccggcagctccatccgcccggtcgtgccctcctcgacgcccggcacgctccacgcctccaccagccgggcggtctcgtctccgaacctgccccgccagtcgcccgccacgaaatccggttcctggccgaaatccacctcctcacgggccgcgagcgcctggaagttcacgaccacctggaacaggtggttcaccagcgcccgtacgtcgtactcggcgcagggcgtaccgccgtccagctgcccgtcgtcgatcccccgcacgacgggcagctggacg

SEQ ID NO: 3440 - DNA, 8022 bp, Unknown
  Kingdom: Bacteria, Phylum: Actinobacteria, Class: Actinobacteria, Order: Streptomycetales, Family: Streptomycetaceae, Genus: Streptomyces
gcatcgccgtggacgccgagaagggtctgatgaccccggtcatcaagggtgcgggcgacctgaacatcgccggcatctccaagaagaccgcggagctcgcgggcaaggcgcgcggtggcggcctgacgccggacgacatgtccggcgccaccttcaccatcagcaacaccggttcgcgcggtgccctgttcgacacggtcatcgtgccgccgaaccaggccgccatcctgggcatcggcgccacggtccgccgcccggtggtcatcgaccacccggacctcggcgagaccatcgcggtgcgcgacatgacgtacctctcgctctcctacgaccaccgtctggtggacggcgcggacgccgcccgctacctgacgtcggtcaaggcgatcctggaggccggtgagttcgaggtcgagctcggcctctgaacacccctgctgtaaccagcctcaccagcggcgcccccgtccggaactcatccgggcgggggcgccgccgtattgtctaagcaccacgggagacctaccgccaccgtgatgatgtaggcagcaccggtctgccctgaaggagccctccatgaccccgcccgtcgtccactcgctgcgcgaacagatccgcgagcacatcgtggaggggatcgtcagcgggcgctggaagccgggtgagcggatcgtggagcgccgcatcgccaccgagctggaggtcagccagacgcccgtgcgcgaggcgctgcgcgagctggagacgctccggctgatcgagtcggcccccaacaagggcgtccgcgtccgcaacctcacggcggccgatctggaggagagctacccggtccgtgccgggctggagcagatcgcggcggagctggcggccccgcgcctcggccgggactgctcggcgctggccccgcacgtggccgcgctgtacgaggcggaccggctggccgacggcgaggcgcaggtgcggcacacggtcggcttccaccgggagctggtgcgggcggccgggaacgcggtgctgctgcacacctgggaggggctgggcatcgaggtgttcacggccctgtcgatccgctggctgggcacggtgcagaagtcgtacgcggaggagcaccaggcgctcatcgacgcgttcctcgccgaggacccggagatcggggccctggtgaaggcgcacgtgctgggctgcgcgccccgcgcgtaggcgtcccccggacccgatcatctggcaccccgtctgctcttccgtgcaggtcagcgcccattttgcgtactatttcgcgtcactccgtgccccatttcgaggcaccccatgccacttttcttcatatcgagaagttttgccttcaatcctttgatcgatcatcgatcagcgccttacagttcatctcgcgggcccaccggccccatcgctctgtcctgccagatagagccttctccacccccctcctctccggaaggcggcgatcatgaccgaccccgtaggaaagcttccgagcgagctcgaccagctcccggaccgtgaccccgaggagaccgccgaatgggcggcctccctggacgccgtcacccaggccgccggcccgcaccgtgccgcgtacctgatgcgccgctcgctgcagcacgccgagggcgccggtctcgcgctgcccaagctgctggagaccgattacgtcaactccatcccgaccgccgccgagcccgcgttcgacggcgacctggagatggagtcgaagatcaccgcgtggaaccgctggaacgcggccgcgatggtcagccggggtgcccggtacggggtcggcggccacatcgccaccttcgcctcggccgcctggctgtacgagaccggcttcaaccacttcttccgcggcaaggagggggacggctccggcgaccagctctacatccagggccacgcctcccccggcatctacgcccgcgccttcctcgacggccggctcaacgagcgtcagctcgacaacttccgccaggagacgggtggcgacggtctgccgtcctacccgcacccgcggcggcttccctggctgtgggagttccccaccgtgtcgatgggcctcggcccgctctcggccatctaccaggcgcgcttcaaccgctatctgaccaaccgcaacatcaaggacacgtcgaactcacacgtctgggccttcctcggcgacggcgagatggacgagcccgaggcgaccgcggccctcgctctggcgtcccgtgagcagctcgacaacctgaccttcgtcatcaactgcaacctgcagcgcctcgacggcccggtccgcgccaacttccgcgtggtccaggagctggaggcgcagttccgcggggccggctggaacgtcgtcaagacgctctggggcaacgcctgggacgagctgttccagctggacaccacgggcgcgctgctgcgccgcctgcgcgaggtcccggacgcgcagttccagacgtacgccacccgcgacgtcgcctacatccgcgagcacttcttcggcgtcgagcccgcgctcgccgagctggcgaagctgctcaccgacgcgaagatcgccgagtgtttctacacctcgcgcggcggccacgaggcccgcaaggtgtacgcggcgtacagggcggccgtcgagcacaagggtgcgccgaccgtgatcctggcccagacggtcaagggctacacgctcggcaagggcttcgagtccaagaacgccaaccaccagatgaagaagctgtcgatcgacgagttcaagggcatgcgcgagctgctcggcctcccgatccccgacagcgccttcgaggacggtctcgtcccctacggccaccccggcgccgactcccccgaggtccgctacctccaggagcgccgtgccgctctcggcggccccgccccggcccgccggatgcacgcttccgcgccgcttccgcagcccgaggagcgcgcgttcaaggccctgtacaaggggtccggcaagcaggagatggccaccaccatggcgttcgtccgcctggtgaaggacctgatgcgggacaaggagaccggcaagcgctgggtgccgatcgtcccggacgaggcgcgtaccttcggtatggagtccctcttcccgtccgccggcatctactcgccgctgggccagacgtacgatccggtcgaccgcgaccagctgatgtactacaaggaagccaaggacggccagatcctcaacgaggggatcaccgaggccggggccatggccgacttcatcgccgcctccacgtcgtacgcgacgcacggcgagacgatgatcccgttctacatcttctactcgatgttcggctggcagcggaccggcgaccagatgtggcagctcgccgaccagctcggcaagggcttcatcgtcggcgcgacggcgggccgtacgaccctgacgggtgagggcctccagcacgcggacggccactcgcacctgatcgcggccaccaacccggcctcgctcaactacgacccggcgttcgcctacgagatcgcggtgatcgtcaaggacggtctgcgccggatgtacggccccgaggccgagaacgtcttctactacctgacggtctacaacgagccgaagccccagcccgcgatgcccgagggcgtcgaggagggcatcgtcaagggcctgtaccgcttcaaggagggcacgcccgcgaaggcggacgcgccgcgcctgcagctgctggcctccggtacggcgatccactgggccctggaggcccaggagttgctggccgcagactggggtgtcacggccgacgtctggtccgccacctcgtggggggagctgcgccgcgacgcgctggaggccgacgaggcgctgctccgcggtgagcagcaggtcccgtacgtgacgcaggcgctctccggtgcgccgggcccggtgctcgcggtcagcgactggatgcgtcaggtcccggaccagatcagccagtgggtggagcaggactggtcctcgctcggcacggacggcttcggcctctccgacacccgtgccgcggcccgccgccacttcggcgtcgacgcccagtcgatcgtggtggcctcgctggcccagctcgccaggcgcggcgaggtcccggcctccgccgtcaaggaggcccgggagcgctacgggctctgagcccactcccgtacagagccggaaccccccggtcaccggagcggacgcgtccgacaacgcgcccgccccggcggccgggggttcctgcgtcgcgcgggcggacggcggccgggggttccggcgtggtccaccgtgccgttgccgcgacaatgggcccatgcgcgctgcccggctgatcaagatggtgctgcttttgcagtcccgccccgcgatgaccgccgccgagctggcggccgagctggaggtgtcggaacgtacggtcacccgggacgcgcaggcgctctccgacgcgggcgtcccggtgtacgcggagcgcggccgggccggcggctaccggctcgtcggcggctaccgcacccggctgaccggcctcgcccgggacgaggcggaggcgctgttcctctccgggctgcccgccgcgctgcgcgagatggggcttcaggacgcggcgtcggccgcccgcctcaaggtgtcggcggcgctgctgccctcccttcgcgacgcctcctcctccgccgcgcggcgcttccacctggacgcgccctcctggtaccacgagccggagacccccgagctgctgcccgtgatcgccgacgcggtctgggacgaccggctgctgcgggcccgctaccgcaggggcgggggccgcgagcaggaggggacggaggtggcgcgggagctggctccgtacggtctcgtcctcaaggccggggtctggtacctctgcgccagggcgggagacgacttccgggtctaccggatcgaccgcttcacggccgtggagaccgccgaggagcgcttcgaccgggacgagaccttcgacctgcccgggttctgggaggagcgggccgccgggttcgcccggtccctgctgcgtaccgaggtgaccgtacgggtgtccgggcgcggggcgcggatgctggcgtacaccggtgaccgggcggcggccgcggcggcgctcgcgaaggcctccgagccgggtccggacggcctgcgcaccctcacgctgccggtggaatcgctggacgtggcctacggccagctgctggcgctgggacccgagttggaggtcctggcgcccgagtcgctgcggatccggttcgcggacgccgccgaacgcctgcgcgagatgtatcgctgaaaggcttcaattcggtgtctgcgcgtgcgggagcccccggcaggctggatgctggacccgtgatggacgaaacggaattctgggagatcatcgacagcacccgcgaggccgccgagggcgaccccgaggaccacgccgacctgctggtggaacggctggtgcagctcgatcccgattccgtgctggacttcgcccggcacttcgaggcccgttacaaccgcgcctaccactgggatctgtggggcgcggccgccgtgctgctggacggggcgagcgacgacgcgttcgactacttccgctgctggctgatcggccagggccgggaggtcttcgagggggcgctgcacgatccggacagcctggcggagctgctggaggacttcgacgaggagatcgacggggacggcgaggagctgggctacgcggccgacgaggcgtacgaacagctcaccggcgtcgtcgcgccggacctggggctgccgccgcaggccgcggagccgctgggttccccggtcgacttcgaggacgaggaggcgctcgccgcccgcttccccgagctgtcggaccgcttcggttcccggtgacccccggccctcggatccgcggcactcaggcccccggcgctcaggcggggccgagcgagcgtcccatgcagacgtcgtcgacgtaacgcccgttcaggaagaactccccgggcagcaccccttcgacggcgaagccctcggaggcgtacagggcgcgggcggggtcgttgtgcgcgagcacccgcagcgtgatccggttggcgccctggcggcgggcctcggcgaacgaggcccgcagcagggtccgccccacgccggcgccgcgcgcccaggtcgccacggcgaggccccgtatctggcggacgtgggcgttggcggcgagcggggtgggcgggacgagacgtaggtacccggcgatccgggccgcgccctccgtctccgcgtccgcctccaccacgaggatgtcctccggtgggttccgctccccgaagaaggggtcgaacgggggcacgggcttcggcaggaccgcgtgcagcgtcgaccaggtggaccggtcgagctcggcgagctggtcgtcgtcggcgagtgcggcggtgcggacggggtggagtgtgagtgcggccatggggtcactttgtcacgcggtgctcccggtgttcgaggcgtttcatggggcaggatgggcccatgccgagctcccgtatcgccgtcagcggatcgtccggactcatcggagcggcgctggtgcgctcgctgcgcgccgacgggcacgaggtgacccgcctggtgcgccgcccggccagaaccggcgacgaggtcgagtgggaccccaagcgcggttacgtggacgcggccggcctcgtcggctgcgacgccgtcgtgcacctggccggggccggggtgggcgaccaccgctggaccgacgcctacaagcgcgagatccgggacagccgggtcctggggaccgccgccgtcgccgaggccgtcgcctcgctcgacaccccgccgcgcgttctgctcgccgggtccgccatcggcttctacggcgacaccggggaccgcccggtggacgagagcgcgccgcccggggacgggttcctgccctcggtctgcgaggagtgggaggcggccaccgccgccgccgaggaagcgggcattcgcacggtgcacgcgcggaccgggctggtcgtcggccgcgagggcggggcgtgggggcggctcttcccgctgttcaaggcggggctgggcggacggctgggcaacggccgccagtactggagcttcatcgcgctgcacgaccatgtcgcggcgctgcgccacctcctggacaccgagtcgttgaccgggccggtgaacctgaccgggccgaagccggtcaccaacgccgaggtgaccgccgcgatgggccgggtgctgcgccgcccgacgctgttccccgcgccggcgcccgcgttgcggctcgtgctcggggagttcgcggaggatgtgctgggcagccagcgggtgatcccggcgaagctgctggactccggcttctcgttcgccttccccggcatcgacggggcgatccgcgccgcactgcgctgagccggccgcgcggggccaccggtcccccgcgagatccgaccggtcgtgccgggacgcgtgtgcgaccccgtgctccggtgctccccggcacgcgcgtctgacccagtatcagccatcctcctagcctcgttgcgaactccggcattccgggggcctgttgggggcaagagccccccaccagtcgcaccgactcggggagggacgcgtgcgcagcacggcacaccacgcagacgtggtcatcatcggggccggaatcgccggcctgtcagcggcccacctgctcatcggggcggggctcggcgtcagtgtcctggaggccgagccccgggtgggcggcaggctcgccaccgacgaggtggacgggttccggctcgaccggctcggcccgctcctctgcacgtcctggcccgagctgaccggcaccccggggctcggcgctccggagctgcgggagttcgcgccgggcgtcctggtccacagcgagggccgccgccatctcaccggcgacatacggagcgcgaggggcgcactcaaggcagtacgcacccgatcgagcgccccccgagccccctgggctccccgcgctccctgggcggcgcagagcgcgtacgggcacgagcacggcgctccgg

SEQ ID NO: 3441 - DNA, 3801 bp, Unknown
  Kingdom: Bacteria, Phylum: Actinobacteria, Class: Actinobacteria, Order: Streptomycetales, Family: Streptomycetaceae, Genus: Streptomyces
ccccgcgtacgcgaaaagcgcgacctctccccggaacccgcgtcgggttccggggagaggtcgcgctccgagtgctgtgcttgcgtgtccatcgcggccgaagcttatccggccacgctgtgaacgcgtgcggcagctcagttgtcgcgcttctccttgatcttcgcggccttgccgcgcagctcacggaggaagtacagcttggcgcgacggacgtcaccgcgggtgacgagctcgatcttctcgaagatcgggctgtgcaccgggaaggtgcgctcgacgccgacgctgaaggagaccttgcggaccgtgaaggtctcgctgacgcccgagccctggcggcggatgacaacacccttgaactgctggatacgggagcggttgccctcgatcacgcgcacgtggacattgacggtgtcaccgggacggaacgccgggacgtccgaccggagggtggcggcgttgacgccatcgagcagggaagtcatggtttctgctttcttcgccgatgccacaggtcatcgacggaatgtcgttgaagagttcggagtgctgatcgcgtcgggcgggcgtctttccccctgtggcaggggcgcacaccggacgtacagcagcggcctattcttccacggcggtgggcctgcgccaaaatcggccgccgggctccggtgcgaagccgaggatggagaggatctcccggtccttcttgtcgaaggcgctcgcctcgcaccgctcgatcaggtcgggccggttgagtgccgtgcgggcgaaggcctggtcccgccgccagcgggcgatcttgccgtggtgaccgctgagcaggacgtccgggatggagcggccgcgccactcgggcggcttggtgtagacggggccctcaaggaggttggccatcgcgcccggggcgaaggagtcgtcccggtgggactcggcgttgccgaggacaccgggcagcagccgggccacggcctccgtgatcaccaggacggccgcttccccgccggccagcacatagtccccgatggagacctcgacgacccgcagccgggtggcgtactcgtcgatcacccggcggtcgatgccctcgtaccgcgccggggtgaagacgagccagggctcggcggagagctcgacggccagttcctggctgaacggccgaccgctgggcgtgggcacgacgagcaccggggagtgcgccccggcctcgtagccgtcggccagggcctcgtcgagcgcctcgccccagggttcggtcttcatgaccatgccggggccaccgccgtagggggtgtcgtcgaccgtgttgtgccggtcgtgcgtccactcccgcaggtcgtggacgtggacgtccagcacgccgcgggcgcgggccttgccgacgagggagacgttcagcggttccaggtactccgggaagatcgtgacgacgtcgagccgcatcaggcgtcgcccttcggcgcctcgtccgcgtccccgggggcctcttcctcttcgtcccgcgaggaggcgatcacggcctcggtctcgtcgatcagtccgggcggcggggtgatgaccgcgcgctgctcctccaggtcgatctcggcgacgatctcctcgacgaaggggatcatcacctcgctgccgtcggggcgctccacgatgaacaggtcctgcgagggcaggtgggagatctcggtgatccggccgaccgcggtgccgtcggcgagcaccacgtcgaggtcgatcagctggtggtcgtagaactcctcctcgtcctcggggagctcctccgggtccacttcggcgatcagcagggtgttgcgcagcgcctcggcgccggtgcggtcgcgcaccccttcgaagcgcagcaggagcctgccgctgtggacccggcccgcctcgatcgtcagcggacccgtcgccgccggttcggtggccaggacggcgccgggtccgagccgcagctccggctcgtccgttcgtacctcgacggtgacctcgcccttgatgccgtgggcgcggccgatccgcgcgactaccaactgcacgctgttctccgattggtggggtggggacgtcgacctgtcggaaacgtccggggggccgacgacaaaggccggggacggcccgaaggccctccccggccctggccggtgttcaactcgcttatcagcgaacctggtccacatcgacgaggtcgacgcggatcccacggccgccgatggcacccacgaccgtacgcagagcgcgagcggtgcggccgttacggccgatcaccttgccgaggtcgtcggggtggacccggacctccagcacgcgcccgcgccgcagggtgcgctcggcaacctgcacgtcgtcggggttgtcgacgatgcccttcacgaggtgctcgagagcctcctcgagcatgctcaggcctcggtcgactcggtggacgcgggggcctcagccgcctcgtccgccttcttgtcggccttcttggccttgggggtgatggcctcacccttggcctcgtcgccgtccgaggacagcgcctcgaacagcgcacgcttgtcagccttgggctccggctgcagcagcggcgcgggggccgggaggcccttgtgggcctgccagtcaccggtgagcttcaggatcgcgaggaccggctcggtcggctgggcgccgacggacagccagtactgcgcgcgctctgcgttgacctcgatgcgcgaggggttctgcaccgggtggtacaggccgatctcctcgatggcccggccatcacggcgggtacgggagtcggcgacgacgatgcggtagtgaggcgaacggatcttgcccagacgcttcagcttgatcttgactgccacggaagtggtgtctcctggtctatgacgtggttgggcacaactagatgccacgtggggttgcggtactcggagtgcccgatggacgcgtcagccggaggagagaggggtcctgtgcgactgtcgagtacagctagccattgtgccacaccacatcggctcaccccaccgcgaccgccgcctccggaatccggaacggcttgccgcagccgccgcagacgatcggcgcctgcgccaggaccgacgggacgacgcggacgttgcgtccgcagtcgcagacggccttgacccgcacaccacccccggaggaaccgtgccgggcggcaggtccgcggaaggagcgcttggtgtcggcggcggtggcgacggtgtgcgccttgagggcgcgctgcagccgttcggtggtcggacggtaccggcgcttggcttccggattcagcgtgaccagcgagaatccgctgctggggtggggttcctcggcatgatcgaggcccagctcctcggcgatcgcgaggaagcgtcggttgtggtaacggccggcgcgggaggtgtctcgtactcctctcgcggcggcgatgccgtggactgcctcgtggagcagtcgctcgaaggagagctcggcgccacaggcggacgaggactctccgatcagggactcgggcgcggcaagatcgggcagctcggagtggtaccgctgaatgtcggcccacgcctgtgccagctctgcggcaagtacaggtggtgtcgtgctcacgtcgtgacaacgagcccgagggccccggtgttcctattccggggcatcccaaataatttgcacgtaccagtcagttgcccttgatgcgtccggacgagggcgggtgcgcagaactgcggagaaggcgcacagctcacaccaaggtggtgcacagcgtgcggtacgcccggagcttcggatgtgaggtgcgcgggcggcccgcgcacctcacatccg

SEQ ID NO: 3442 - DNA, 2357 bp, Unknown
  Kingdom: Bacteria, Phylum: Actinobacteria, Class: Actinobacteria, Order: Streptomycetales, Family: Streptomycetaceae, Genus: Streptomyces
tcgccgagtccaccaggcccatcgtgcggctgcgcgaccagtgggtgctcatcgaccccgaggaggcgcgccgggcccgggagacccaggaccgcaaggtcaccccgatcgacgctctcggcgcggtgctgaccggttcgacggaggtggacggccgtcgcgtcgaggtggcggcgaccggctggctccagcagttgcgggaccggctggccgacccggagtccgccgcccagcagtcgatcgggcagcccgaagcgctcaccgcgaccttgcgcgactaccagctgcgcggtctgaactggctgaacacgatgacctcgctcggcctcggcgcctgcctcgccgacgacatgggcctcggcaagacgatcacgctcatcgcgctgcatctgcaccggcagagcgaccgggacgcggccggcccgacgctggtggtgtgcccgacgtcgttgatgggcaactggcagcgggagatcgagcggttcgcgccgggcatccccgtccgccgcttccacggcgcgtcgcgttccctggaaggcctggtggacggcgagttcgtgctgacgacgtacggcacgatgcgcctcgacgcgccccggctcgccgccgtctcctggggcatggtcgtcatcgacgaggcgcagcacgtgaagaacccgcactcggcgacggccaagcagttgcgtaccctcggggcccgtgcccgggtcgcgctcaccggcacgcccgtggagaacaacctctccgagctgtgggcgatcctggactggacgacgcccggactgctcggacggctcagcaccttccgtacgcggtacgcggcagcggtcgagggcggcaacgatccggccgccgccgagcggctcgccgcgctcgtgcggccgttcctgctgcgccgccggaagtccgacccggggatcgcgcctgagctgccgccgaagaccgagaccgaccgggccgtgtcgctgacgccggaacagaccggcctgtacgaggcggtggtccgcgagaccctcgcggagatctccgccgccgacggcttcgagcggcggggcctcgtgatgaagctgctgacggcactcaagcagatctgcaaccacccggcgcagtacctcaaggaggagcagccgcggatcacggaccggtcggggaaggtcgagctgctggacgaactcctggacacgatcctggcggagcggggttcggtgctggtcttcacgcagtacgtacagatggcccggttgctggaggcacacctggccgcgcgcggggtggacacgcagttcctgcacggcggtacgccggtggcccggcgcgaggagatggtggctcgcttccaggcgggcgaggcgccggtgttcctgctgtccctcaaggcggcgggcaccgggctcaacctcacccgggccggtcatgtcgtgcatttcgaccgctggtggaatccggcggtcgaggcgcaggcgacggaccgggcgtaccggatcggccagacgcagccggtgcaggtgcaccggctgatcgccgaggggacgatcgaggaccggatcgccgagatgctcgcccgcaagcagggcctcgcggacgcggtgctcggctcgggcgaggcggcactgaccgaactgaccgatgcggaactggccgacctggtcgagctgcgagggggcgcacgatgagcgatgactacgaggacgaccacacgtacggggcggagtacgggacgggcgacgcggatgccagcgacagggccgacgacggggcctcgcgcgacggcgggcgcggagcggagcgtgtgttcgcggcgcttccccccgcacaaggccggggtttcgccacgtcctggtggggactggcgtggctcaaggccctggaggacaccgcgctggacggccagcagctcaagcagggccggcggctggcccgggagggcagggtcggtgcggtctccgtgcgaccggggcggatcacggccgtggtgcgggaccgcgacggcacggcctaccgcagcgacgtcctgctccagcagctcggcgcgggcgcctgggaccggttcctggacatggccgtggaccgggccgggcacatcgcggcgctgttggaccgggagatgccgccgcatctggtggaggacgcggcgggcgccggggtcgaactgctgcccggcatcggggatctggagccggagtgcacctgtgaggcctgggaccactgtccgcattcgggcgcactctgctaccaggtggcgcgcttgctggacgaggaccccttcgtcctgctgctgatgcgggggcgcgaggagcggcgactgctggacgaactccaggtgcgcagcgccgcccgcgcggtccgggcgggcggcg

SEQ ID NO: 3443 - DNA, 9970 bp, Unknown
  Kingdom: Bacteria, Phylum: Actinobacteria, Class: Actinobacteria, Order: Streptomycetales, Family: Streptomycetaceae, Genus: Streptomyces
ggtctcccgccaccacgccgaactacggtcgctggccgacggcacctacgagatcgtcgacctcggcagccacaacgggaccttcctcaacggtcagccggtggcccgcggacccgtcggccccggcgacatcgtcggcatcggccactccgcgttctgcctggtcggcgacgccctccaggagttcgtggacaccggtgaggtgtccctggacgtccaggacctggaggtgaccgtcggccgggagggcaagggcggcaagaccctgctggaccgggtctccttccccgtcggcgagaagtgcctgctcggcgtggtggggcccagcggcgcgggtaagtccaccctcctcaacgcgctcaccggccagcgcccggccgacagcggcacggtgctctacgacggccgtgacctctaccgggacttcgccgagctgcgccagcgcatcggcctcgtcccgcaggacgacatcctgcatgcgcagctgaccgtgcgtaaagccctcggttacgccgccgagctgcgtttcccgcaggacaccgcgaaggccgagcggcaggcacgggtcgccgaggtgatccgggaactcggcctcgaacagcgcgccgaccagccgatccactcgctctcgggcggccagcgcaagcgggtgagcgtggccctggagctgctgacgaagccttcactgctcttcctggacgagccgacctcgggactcgaccccggtatggaccgttcggtcatgcacatgctgcgcgggctggccgacgacggccgtaccgtcatcgtcgtcacccacagcgtcctgagtctggaggtctgcgaccggctgctcgtgctcgcacccggcgggcggatcgcctactacggccccccggaggacgccctcgccttcttcggtttcgaggagtggccggaggcgttcgaggcgttcgagaacgaccgcgaccgcgactgggcggccacatacgccgattcgccgttccaccggcagtacatcgtcaatgccacggcgcagccgcatctgccgccggccgcgcccggagcgctggtcacgccgccgccgaagacccgtaactggggcgcgcaactgcgcacgctcgtgcgccggtacgcctccgcgctgagcgcggaccggacgttcctgatcatcatgatcgcgctgcccttcgtcatgggggccatggcccgcgcgctggcgggcagccggctgacccaggagacggcgatgaacgccctgctgatcctgtgcgtgggcggcgtgctgaccggagcggccaacgcggtacgggaattggtcaaggaacgggtgatctaccagcgggaacgggccgtcgggctgtccagatccgcgtatctgatgtcgaagatcgtggtgctcgggaccatcaccgtcctccaggccgtggtgctgaccctggtgggactggtgggagtcgatctcaacgcgccgggcgacgaaggggtgttcctgccaccgctggtggagatcacgctggccgtggccctgttgtccttcaccgcgatgatgctcggcctcctggtctccgcgctggtgcgcaaggaggaggtgacgatgccgttgctggtcctcctcgccatcgtccaggtcgtcttctgcggcgcgctgctgaagctgaacgggacgcccggggtggagcagttgtcgtggctggtgccgtcgcggtgggcgctcggggcgatggccggaacgatcgatctggcgcggatcgtaccgggcgagctgacctccgatccgctcttcgggcactcggcgggggtctggctgctcaacatgggcatgatggtcgttctctcgctcgtcttcggatacgtggtcgcgaaactgctgaggcggcacgagcccgcggtcatgcggaagtgaggcggttccatggcgaccccggcgttccgccccacgcacgtcgtcccgccggacgggctgcccgcctgggagtctcctgacgtcgcccggccgaccgagccgctggacgccctgctgccggtggagctgcgggaccggcgcggggactgggcgtacgtcgcctgctccaacggctggtcggcctgggtcgacgggcggctcctcgtatccgtaccgcagacgcctccggccgctgggcagccgctggcgcgcaccgcggatccgcgaccgctgctggcgagggcggaggagtcgctgacccagtaccgccgcgctgcccaggacctggccgagggccgcagcgacggggagggcttccggcagcggacgcgaggacttcgggtggggatggtggtggacggggagtcggtgtggctgtacgacgccgagcacgagcggtgggtcttctgcgacgggacccggctgagtacgtacgcggcacaggcgggcccgggagcggcggacccggcgtccggggaggcggaggccccggctccggctccctccgtctcgaagaaggcggcggccgggagcgcggccccggcggagggcggcgcgtcgaagagtccgtgacggcggacgcgggtggccgtgaacgacgtgggccgccgcggtccggggtactgccccgggccgcggcggcgttctgcgtgggagacgcaggtcagagaggtgcgggtcagaggttgccgcgcttctcctgctcgcgctcgatcgcctcgaacagggccttgaagttgcccttgccgaagcccatggagccgtggcgctcgatcatctcgaagaagacggtcggccggtcctggaccggcttggtgaagatctgcagcaggtagccgtcctcgtcgcggtcgacgaggatcttcagctcgcgcagggtctcgaccggcacccgggtctcgccggcccactcgccgagggtgtcgtagtacgagtccggcgtgtccaggaactggacgccggcggcgcgcatcgcgcggaccgaggcgacgatgtcgttcgtggcgagcgcgatgtgctggacgcccgcgccgccgtagaactccaggtactcgtcgatctgcgacttcttcttcgcgatggccggctcgttgatcgggaacttgaccttgagcgtgccgtcggcgacgaccttcgacatcagggcggagtactcggtggcgatgtcgtcgcccacgaactccttcatgttggtgaagcccatgacctggttgtagaagccgacccactcgttcatccggccgagctcgacgttgccgacgcagtggtcgatcgcctggaaggtgcgcttggcggccggctcgacgatcggtgaggccgcagtgaagccggggaggtaggggccctcgtaaccggtgcgctccaccagggtgtggcgggtcttgccgtacgtggcgatggcggcgaggacgacggtgccgtgctcgtccttgacctcgtgcggctcggtgaggccgcgcgcgccgtgctcgacggcgtacgcgtacgcggcacgggcgtccgggacctcgatcgcgaggtcgacgacgccgtcgccgtgctcggccacgtggtcggcgaggaaggttccccactcggtggacggtttgatcacggaggtgaggacgaagcgggcggcgccgttggtcaggacgtaactcgcggtctcgcgggtgccgttctccggcccggagtaggcgaccagcttcatgccgaaggcggtcgagtagtagtgcgcggcctgcttggcgttgcccacggcgaagacgaccgcgtccattcccttgaccgggaaggggtcggcctgccgggcggtttcggggctggtgtgcagagtctcagtcatgttcgaaggctctccccacatcgcaaggtgcgcaacagttcacgcatctgctggtcaatctggccagtgaatcgccatgatggccggactatctgtacagggtgaccatcggaggcgggctcatggcgatcgatcatctggacgggcggctcatcgtgctcctggcgcgcgaaccgcggatcggcgtcctcgaagcatcccggcggctcggggtggcgcgcgggaccgtgcaggcgcggctggaccgtcttcagtcgaacggcgtcatccgggggttcggccccgacgtggatccggcggcgctcggctacccggtcaccgcgttcgccacgctggagatcaaacagggccaaggagccgacgtacgagcccatttgggcggcgtaccggaagtgctggagctgcacaccaccaccgggcacggtgacatgttctgccgcctggtcgcccgttccaacgccgatcttcagcgggtgatcgaccgggttgtcggatttgatggcattgtccgggcctccacggcgatcgtcatggagaacccggttccgctgcggatcatcccgctggtggaacaggcggccgcggacaccgaccaccccgagggcccggggcgtcattgatccgaaggagtgccgtgtgagcttctgggagtatctgagcacccgccaccagcagctcctcacggacgcgttccagcacgtcagcgcggttttccagtgcatggtcatcgccaccgtgctgggcgtgctcatcggcgtggtgagctaccgcagcggctggggcggatcgctcgccatcacgtccacctcgacgatcctcaccatcccctccctcgccgcgatcggtctgctgatcccgctggtcggcctcggcgtcgcgccgaccgtgatcaccctgacgctgtacgggctgctgccgatcgtccggaactccatcgtcgggctccggggcgtcgatccgtcgctggtcgacgcggcgacgggcatcgggatgtcgcggccggcgcggctgtgccgggtggagctgccgctcgcctggccgccgatcctgaccgggatccgggtctccacccagatgctgatgggcatcgccgccatcgccgcgtacgcctccgggcccggcctcggcaacgagatcttccggggcatcgcctcgctgggcagcgccaacgcgatcaaccaggtcctcgcgggcacgctcggcatcgtcgtcctcgccctgctcttcgacgccgcgtacgtcctgctgggacggctgaccatcccgagggggatccgtgcctgagaccgagaccgacaccggggccgtcgccgcgggcgggaccgccgccacctccggggccaccatccagctggagaacctcaccaagaggtacccggggaacccgaacccggccgtcgagaacgtctcgatggagatcagggcgggcgagaccgtgatcttcgtcgggccgtccggctgcgggaagtccaccaccctgaagatgatcaaccggctgatcgagccgacgtcgggccggatccggatcgacgacgaggacgtcaccgacatcgacccggtgaagctgcgccgcaagatcggctacgccatccagtcctcgggactcttcccgcacatgaccgtcgcggacaacatcgcgctcgtcccgaagatggtcggctggtccaagtcccgggtgaaggaccgggtggaggagatgctcgacctggtgggcctggacccgcgcgagttccacggccgctatccgcgccagctctccggcgggcagcagcagcgggtgggcgtcgcgcgtgcgctggccgccgacccgccggtgctgctgatggacgagccgttcggggcggtcgacccgatcacccgcgaccacctccaggacgagctgatccgtctccagcacgagctgcacaagacgatcgtgttcgtcacccacgacttcgacgaggcgatcaagctcggcgaccggatcgcggtgctccgggaacgctcgcacatcgcgcagttcgacacccccgaggcgatcctcaccaacccgacggacgacttcgtctccggcttcgtcggcgcgggcgcggccctgaagcggctgaacctgacccgcgtacgggacgtgggcatcgcggacttcccgacggtgacggtcgaggacccgctccagtcgatcttcaacaagctgcgcagcggcccgcacaacgagctgctgatgctggaccgccgcaaccgcccctacaaatggctgcggcgcggcgacctgatgcgggcgcgcggttcgctggcgcgggccgggcagctggtgcacgacacggtgacccgggacgccacgctgcacgacgcactggaggcggtgctgaccgacagcggcggccgggtcgcggtgaccgggcggcgcggcgagttcatcggggtcgtcgacatgaagacgctgatggacaacgtgcaggagcttctggaggccgaccggctgaccgcgatggagcaccagcaccagctggaggagctgcgcgtccaccagacggagcaggagctggaggggggtggcggcggccgatgagtcccagccatccgtccggctccggcaagggcccggccaccccgacccggccgccgggcgaacacgacgtcaagggccacgcgttccacgacgaggagagcgacccctcccccgcccccgaagggccggagcgccggttcacctggcggaaactggtggtcctgccagtggtgctggcggtcatcctggtcgtcacctacgtatggatcaccaacatccacctggactcgatcgcggagaactcgctctccggcggcaatgtgcagctgcgctggtggcagcatgtgcggctgacggcgatctccacgttctgggtgctgatcatcgcgatcccgctgggcatcgccctgacccggcggcggctgcggaaggcggccccggcgttcaccgcgctggccaacatcgggcaggcgacgcccgcgatcggtctgctggcgctgctggtgatctggctgggcatcggtccgcggaccgcggtcatcggcatcgtgatctacgcggtgctgccggtgctctccaacacggtggcgggtctgcgggcgatcgagccgaacatgatcgaggcggcgcgcgggatggggatgtccggccggggcgtcctgatgaaggtggagctgccgctcgcggtgccgctgatcctggccggagtgcgtacggcactcgtcctgaacgtcggcacggcgacgctggcgacgttcggcgggggcggcggactgggcgacctgatcacctcggggatccagacgcagcggatgccggtgctgatcatcggctcggtgctgacggtggtgctggccctgctggtggactggctggcctcgctggccgaactggcgctgacgccgcgcgggctggaggaacgatgaggaggaaactgctgccgctggtggtggtgccggtgctgctggtgggcggctgcgggctcaagagcggttcgccgatggtggacgacgtgtcgcccgggtcggtcggacagggcgagccgctcaagggcgcgacgctgaccgtgacgtcgaagaacttcagcgagaacatcatcctgggccagctgacgggtctggtgttcaaggcggccggggcggaggtcctggaccggacgaacctgccggggtcgatcagcgcgcgcgaggcgatcatcaagggggacgccgacgcgcagtgggactacaccggcaccggctggatcaccttcctcggccacgcggaccccatcgtcgacccgaagaagcagtacgaggcggtccgcgacgaggacaaggacaacggggtgatctggctgccgccggccccgctcgacaacacgtacgcgctggccatcagcaagaggaacaacgccaagtaccagctgaggaccctctcggacgtggccgccctcgcgaagaaggacccgggcgcggtgacgatctgcgtggagaacgagttcgcctcccgcgacgacgggctgcccggcatggagaagaagtacgggatgaagatcccggcgggcaacatccagaagatggacgccgggatcatctacacccaggtgtcggagtccgactcctgcctgctgggcgaggtgttcacgaccgacggccggatcaaggccatgaacctggacgtcctggaggacgacaagaacttcttccccaactacaacgcctccccggtcatccacgaggcgaccttcgagaagtacccggtgatcgcggagctgctggacccgctcgcccggaagctgacgaccgaggtcgcgcagacgctgaacgccaaggtggacgtggagggcgaggacccgcacgaggtggcgaaggactggctggtggcggaggggttcatcgaggaggggtgagttacgaagagctgttgcaaacagttccttgcaaaaaagccttgcaaagctctctttgcaactctaccttcgaaccatggcagagaacgaggacgtccgcccctaccggtacgacggcaccgaccggaagatccacaacgtcgacgcccgaaccttgcgggccatcgcgcaccccctccggatgcggctgctgaaggcgctgcgcgacttcggccccgccaccgcctccatgctcggcgagcggctgggcgagtcgagcggcgcgaccagctaccacctgcgccaactggccgagtccggcatggtcgaggacgccccggagctgggcaagggccgcgaacgctggtggcgggcggcccacgacggctcgaccgtggagagcgccgagttccggacgcacgccgacccggaggtgcgcggggccatcgacttcctcctccacgagacggccacgagccacgcccaggagctgaacacctggctgggcacgatggacgactggccggatgagtggcagcgcagctgggacatgagcgacttcacgatgcgcctcaccccggaactggcactggaactgggccgcaaggtccaggagctggtggagagctaccggggccgcgtccccgacgacaccgagggatcggccgtcgtccggacccacctgcacaccttcccgcgctcctccgaatgagcgccgcgccgccaacagcccaccacccgaagggaatcgccttatgcacgccgacgtacaccacctcctgcacaccgcacgggcaaccgaactccgccacgaggcaacggcgttccgcctcccccgcacccggctgcgcacccgggtcggctggaccctggtcgaggtcggcctccggctgacacagagccgggacacggccgcgaccaccgcaccccgcaccggcgcgttccgcaccgcgtaacggcccgacgacggccccacgacgtgcctacgaccagctcggccggctcggccatcccgggggagacaccgccatggggaaccgcaccccgctcaccgccacgctcgcggccaactccatacccaccgccggtacttcactgaccctgatcggcgtctgctggttcgtcctggagaccaccggcagcgcgggccgggccgggttcgtcgccttttgcgccaccctgccgatcgtcgtcgccgcgctgatcggcggaccggtcatcgaccggatcggccgccgccgggtcgccatcgcctccgacgccgtgtgcgcctcggccatcgcgtccatcccgctgctgcacttcgccggcgtcctcgacttctggatgctgtgcgcgctgatggcgctcaacgggttcgcccacaccccgggcaactccgcccgctacgtcctgatcccggacctggccgcgcacgccggcaccacgctcccccgggccgccagcctcttcgacgcggtctcgcgcggagcccggatggtgggtgcggcgctggccggcgtcctcatcgccttcgccggcgcggagacggtcctgctgctggacgcggcgacgttcgggctgtccgccctgctgatcgccgcaggggtacggggagtgcgcgcggccgagccgcggaaggccgaggccccggtctcgctgtgcgtctacggctccgaactccgcgagggatacgcccacttgctgggcaaccggctgctgctggcgatcgtggtcatggtgatgttcatgaacggcaccgaccagggctggtacgcggtcctgctcccggtgcacgccgaggccgagctgggcggcgcgaccgccatcggcctgctcaccgcgttgttcggggcgggcggactggtgggggccctgctgtac

SEQ ID NO: 3444 - DNA, 2535 bp, Unknown
  Kingdom: Bacteria, Phylum: Actinobacteria, Class: Actinobacteria, Order: Streptomycetales, Family: Streptomycetaceae, Genus: Streptomyces
ctggggtagccgatggagacccgggccatgaagcggtcgcgctgggcctcgggcagcgggtaggtgccctccatctcgaccgggttctgggtggccaccaccatgaacgggtcgggcagctcgtaggagtgcccgtcgatggtgacctggcgctcctccatcgactccagcagcgccgactgcgtcttcggcgaggcgcggttgatctcgtcgccgatcacgatctgggcgaagatcgcgcccggcttgaactcgaagtcccgccgctgctggtcgaagatcgacacaccggtgatgtccgagggcagcaggtccggcgtgaactggatccgacgcaccgaacagtcgatggaccgcgccagcgccttggccagcatggtcttgccgacaccggggacgtcctcgatgaggaggtgcccctcggcgaggagcacggtcagtgatagccgtacgacctcgggcttgccctcgatcacaccctccaccgacctgcgcacccgctctgcggtggtggtcagatccgtgaggctcgctcgatcgtcataggtcgtcacccggccctcctcggcccttttgcgcaggggccgtcgcgcgtacccgcgcggcccaccccgaaaaatcggacactccgccggaagacccggggacgtcacacccgcattcttgttgccgttaccgcttcgtgtcactcgcctgtggataagtgggtgtgaaaagtcagcgtctgtcgcgatttcggcaccgctgggcgcggtgatgagtgcgtgaggtgcagcagagggccgggaagcgaggtgaatgcgttcaggaagcggagtggatctcgcgcagcagaccggtggtcacgtcgaagacgaacccgcgcacgtcgtcggtgtgcagaaggaacggcgaggtgcgcacccgctgcatcgactggcgcacgtcctggtcggcgtccgaataggcctccaccgcccagaccggacgctggcccacctcgcgctccagctcctgccggaagtcctcggtgagggactccaggccgcagttggtgtggtggatgaggaccacgctgcgggtgccgagcgcccgctggctgatggtcagcgagcggatcacgtcgtcggtgaccacgccgcccgcgttccggatggtgtggcagtcgccgagttccaggccgagcgccgcgtgcaggtcgagacgggcgtccatgcaggccaccacggccacctggaggacggggcgcgcgtccatgcccggatcgcggaagtcctccgcgtacccggcgttcagttcgacgagccggtcggtgacctggcccccctcgcggaccgccgcggaggtggacgtcacggactcggcgggagagtgagcagaagtcgacatggatacgacgttagccttcccacctggcctgggtgtgctgtgagggcggacaaaaaacgtcaactcggcttgttgtgagctaacccacaggactcgcagggatgcacccgttcgggtgggtcggccgcatccggacgggtggcgcgactcgctgcccggttcgttgatcgcgaatcgatcgaatggcagggtggactaaagtaacgcgaagtcaccatccacctccgtactcactgccccatcgcaccccctgtacctcctgcatattccgtatttcccccgtgatgtgcggcgtacgtgcgacccggccctctcccgctctcggtcggccgacgcctcttccctggcgccggcggacctccccttcagagcgggcggggaccaggacgtacgtgccggccgcgcgggacagagcctgagagggcgcattgagccagacccgacacgtcccggtgatgctccagaggtgtctggacctgttggccccggctctccaggacccggcccacccggagcccgtggtcgtcgactgcaccctcggcctcggcggccacagcgaggcgctgctcgcctccttccccaccgcgcggctgatcgccctggaccgcgacaaggaggcgctccgcctctccggcgaacggctcgccccctacggcgaccgcgccaccctcgtccacgcggtctacgacgaactccccgaggttctcgcgcggctcgggatccccaaggtccagggcgtgctgttcgacctcggcgtctcctccatgcaactggacgaggccgaccgcggattcgcgtacgcccaggacgccccgctcgacatgcggatggaccagagcaccggcatgggcgccgccgaagtgctcaacacctatccgcccggcgaactggtccggatcctgcgcgcgtacggcgaggagaagcaggccaagcggatcgtctccgccgtcgtgcgtgagcgcgagaaggagccgttcagcaacagcgcccggctcgtcgagctgatccgcgacgcgctgccgcaggccgccaagcgcaccggcggcaaccccgcgaagcggaccttccaggccctgcgcatcgaggtcaacggcgaactgagcgtcctggaacgggccattccggccgccgacgtcgaggcactggacggcggccggaatggcccgt

SEQ ID NO: 3445 - DNA, 11242 bp, Unknown
  Kingdom: Bacteria, Phylum: Actinobacteria, Class: Actinobacteria, Order: Streptomycetales, Family: Streptomycetaceae, Genus: Streptomyces
agggcgccggcgccctcttcgggggccgagaggagggccttgccatccttggtgttggtggcgacgaagctctgttccgtaccgaacttgtaggtgtcccggtacgaggggtcgtccgccctgaggaaaactgccgtactgccgtaggccacgaagaagtcggcgcccgccgggttcccgaccgcgaatccgcgaggttccagcgggccgaacggacccaccacgcgtcgaggtgcccgtccctgctcagcggaccacagttccacgatgcgaccggtggtgagtacggccaggtactggctgtcctcaaggaagaacgccctgaggagttcctcgccaaacgtcagccggaggtcccgccgctccctgccggtccgcagatcgacggcgtacaggttcggctccccgatggcctggaccgcgatcactcccggtacacgatggttggccacgaaataccccggctcctcccgggaggtcaggcgcagacccttcaggtcgatcggagcgcgtaggcggcggccgtcactgatgttccagtgctcgatctgtgtgccggagagcgtcaccagccggccgtcgggttggaagaccagggatacgggctcccgtccctcctttccctgctgggaaggtgggcgcaccacagtgaattcggagaccttctcgagggacggcagccggcgaaccgtgacccggttcacgtccgatacatccgccatgagcgtctgtgctcggttgagagtcaggagttgggacgtggcgggcggcgtcctgaacgtgctggacacctcggacaggacccggttctccccttcggtctccgccactaccagctttctgccttccttccccgtacggaccagcatcgtgctcccgtcccccagtaactgcgggaccccatgcgcagtttcaccttcggaggagaccagcttctgaccgatgacggtggtctctcttcgtgcaggcacaaccggggcgtcgaaggtgcccagcaggggaaacggtgcgctggcgcggaaatcgatctccgggccgacgaacttccgggggcgggcgttcccgctcgtttccaggacctcccactcgatgtcgtagttggtgccccgggcgaacagcttccccgacgcatcgagaagcgtggtctcacagccccagctgtcgtccccgcggtagtcgcgcaggaggcgtccgtcagctacgcgtatcgccttgtagcgcgtgctcatcggcgcattgtcctcgatgggatcccggcaggagagcgccacggttccgtcggcggaaacccagctgccgccctctgccctatgggaaacggtgtcaggcacgtcggtcagacggcgcatctttcccgtccgaatatcgacggcgatcagcgacctgctcgccgattccagtaccagcgtgtgattgtcgggaccgaaccacgccgccgtcgcaatggagtacttcttcggcaacgagaacgggcgccccgtctccagttcccatacccgcaccgggaactccggatggtcgaaaacccccgtggtccagccgtcatccccggactcgaccacaaagcggccatctcgggagaaggctgcaaccttgaattgggagacaccctcgttgccgtccggaaccggtccggtcgggtccggagtttcgagcggatgcgcctgccccaccattctcttcgccgccggggtgacgtcgtgccagacgatcgctccgtcatctgtacgcagatacgcgattcgtcgcccgtcgaagcttacccggggcgacttgacgttgggccgcagccgaagactctcctgccgcactttgccccgcgccgtgcgtacgaacagcagggcacgcccgccatcagtcgtcaccagcgtcaccccgccgtccgcgctcatcgcggcatcctcgaacttcccctcggcccccgacatgctccaggccaggtgccggttctcggtgtaccgccgcagcagtgcgttacgggcctcctgggtcggctcggtctcgtaggcggcgaccgcggccagggccgcgtggccggggttggtgtcgaccagttcgtccgactgcacggacagtgcccgggaacgtgcttcgtcggcccgccgggcgctgtcccgggactccagaacgttgaaggtgatcagcgtcgcgatgagcgcaagcaccagggtgccggccgtccagccggcccgtatccgccagcggaaccttccttgccgcctgtgtgccgcagccaggaacttccgctgttcttcgctcagttcggcttcacgtccgcgcagtcgcttcgttagcgagccgagctggaagccgcccggcaagaggtccggacgccgacccatcccctcccaacggtccaggtcatgctggacatcggcccgcgcgttgaggaaatcggcgtccccgcgcaccacttcggccagctccggccactgcgtgatcagcgcctcgtgcgccagttccgcgctctccggcctgccttccccaccgtgcaggacgagcaaccggcactccttcgcggccatggcctgggccagccgccagcgcctctcacctgcctcttgccgtgtcagcgcgcgccgcagcacagcttccccgctgggcaccacacgtaccagcccggccagcaggcgccgtgcctcctcttccgagccggcggctggcacgcagctgtcccacacccgtccggcgtgctgcctcaaggcccccttgaccccaccgatctcctgatacgtcgcggaactcagccgtccgccgcgctgtcgctcccacagttgttccagcacgaaccccaggaggggcaggacgcccgggtccgtgccggcgtcatccaggatccgcaggtccagacccgggtcgtacgtcacccctggtgcccgtgcgagaggccgagtgatgacggtgtgcagctggccgcgagtcatcggcgacaagggcagagtcaccccggacgtcagcactggagccaatccggggtgctccagcgcggtgttgatgacatcggcacgccacgtggccagtacccgcaggccgttgcggcgcggcgggaacaacagggccagagtctcagcgaggtccggctcggggaggccgaggagggcctccgcctggtcgaggacgacgagcagacgtttcgcggtccggccggtggcccggtggaaggcgtcgacgagccccagctcccgtaaccacgattccactcggtccgcgttctcggcccgcgccggaccggggccgcccgccgcgcgttcgaagagctccgtagccagggccgcccgcggcactcccacgccgctgcagtccacaaccacgatctcccagtcggagcggcgcatccggggaagcacgccggccagggcgagggaggacttgccgctgcccgaagggccgcacagcgtgaccaccgggtggtcgcccttcagggcggtgacgacccggtcgatgtcgctgtcccggccgaagaacacatccttcgcgtcctccccgaacggctggaggccgaggaaaggctttgcggggagaagcatctcccggaggtcgggaacctccccggacagcgcctccgtacgcatcacgaacgcctgctgcgcctcccgtacgggctgcgacgcgacgaccatcccgaccgccacgcccaggacttcgtcccagaccggacttccgctgaaccccggcctcacatggacagcctggccgtccgcccgcgagagctgaaccagggaactgccgacagggccgcgaaagcggcccagttgccagttgccgtcgggagcatcgtcggtgaagccgaccgcccgggtctggtggtcccagacgtccccgacgtcggccatcggcagggggcgggccccgggcagaggggcatggagacgcagcacggccacgtcgccgccctggtcctcccgtacgggcacccagtgcaagaccttcgctgtcccgtgcgggtggccgacggcgaacggcaggtcgagcccgacctcggctcctgcttcgacgatggagtcccggggttgttccaaggcgtcggagaccacgtgagcgcaggtcagtacggtgtcaccggcgacgaggaatcccgcgcccacgattgcgccgtccctgcttctgacccgtacgaccgacgacgccatcgctggctcatgtgtctctccgctcaccggctccccctcagccatggctcgtcccgccctcagccctcgggcgtcggcatcgcgtccgcgttgtcgttacgccaagtgaggctcacggagaagttcgcggtggccgacgatccggcgataaggatcttcgcgtccgccgacagggacatgccgaacgtgagggtggcctcgtcaggctgtcgcgccatgtcccggcaacgcccgacgaacgcgttcgcaaccggccggaccacccccagcatctggtccagcgactcatcggcccgagccaccgcccggctgccccgaccgacccggaccacggagtcgtcggtctcctcgacccgtacccgtacgacatcgtccccttcgccccccaagggcacctcgaccacatggaggggacggtgttcgttcagggccatgggttcctcgtctcaaatccggtccgcgtgtgaggtacacgacgagcgtattcacggcgggctggaggggtggcgtgatcgcctcttctggcgaaaagtatgcgggtgtgctgaggccaagccccgagcgtccgggcctccgcggaggcgctgaagtcggggtggcaggggccgggtctcactagggcttgtctgacaaatgatcacctggctgcttcacggagccagaggatcagggaggccaggacgactcccgcgcggtaccgcttcgagagcttgtcgaacctggttgcgatcgcgcggaactgtttgaggcgagcgaagtatcgttcgaccacgttgcggtcgcgatagatctccgtgtcgaagacgggtggccgaccaccgcggcgcccccggcgccgacggttggccacctggtcgcggcgctcggggatcgtggcagcgataccccgacgcctcagcagatgacggatggccctgctggaatacgccttatcacccagcacacggtccggtgtcgtgcgcggacggcccgtgccgacccgaggagtgcgtaccccattgaggacatcggcgaacgctgtggcgtcgttgacgtttccgggtgtgagcacaatcgacagcggcagcccccggccgtcgacggcgagatggaccttggtggtcaacccgccccgagaccgaccgagtgcctggcacgcctgcgagcggcccggatcttccagttcgtccccgtccacgtcccccctttacgggcgcctgcggcatgctgatgggcccggttgaccgtggagtcgacggcgacggtccactccacccggcccgccgcatcgtcacggacctggacgtgctccagcagcttcgcccatgtgccatcggcctcccagcgggcgaaccgctcgtagacggtctgccacggcccataccgctcgggtaggtcgcgccacggggccccggtccgcagccgcacagcaccccgttgaccacctgccggtgatcacgccacggacggccgcgtccgtccacctgcggcaacaggggctctattcgcccccatgccgcatccgtcaactcacctcgacccgccacaagatcaattatcagaccggctatagagtcctgcccgtggcaaatcatcaggacgacaccaggacggcctacgacggtgtcgtcgagctgtacgcatcgctgttcgcaaaccggctggagacacagcctttctcccgggccatgatcggcaccttcgccgaactggtgcgcgcgacgggcaacccgcgggcagcggacgtcgggtgcgggcccggacatctgacagccatgctgcacgaactcggcctggacgccttcggactcgaccttgcccccggcatggtcgaccacgcccggcaggcccatccggcgctgcgcttccaagaggcgcggatggaatccctgccgatcgaggacggcgcgctcggcggcgtactggcccactactcgatgatccacacccctccgggagaactgccggagctactctccgaacaggtacgcgtcctggcgccggatggcctgctcctggtctccttcttcggaaccgacggacaagaaccggttcgcttcaaccacaaagtggcgcccgcctacagctggccgacagatagcctcgccgaactgctggccgatgccggtctcgatcccttcgcccggctgctccacgatccggcctctgaacggggtttcctcgacgcgcacctgctggcccgccgctcgtaggtcctgcccggcaatacccgccagatgtcggcgcatatccgggctgccagctcgacggacgctcgcttcactgacctggaagtcctcctcgccccaccgcactgatgaccacagcgccagcgcggcacctgcaacggtgtcagcctcaagcagagtcacccaacaggcgagcactcgtcctgcgagcctcaaatggccgacacaagtacccaggcggctgagactgtgccggaatctggagaacctacgggttgaagagggctcactgcgtgattgcacttacgagttgccccgcggttgtgacgtcacgccagtttcgagttggcccacagcacggcccagggtgcggcgtcgttcgcatgccacgaggtgcacagcgttctcttggagaggaaaccgtccgggacggcagcatctgttcgccgccggacccgtctgggatgctgaagatccggctcggcaggggggcagacggtgtatacggaacctatggcgcgagccgttgtggaaccagcagtactcaagctgatacagcaatacccccgcggcaggtcgttctccactacggtcacgttcggcggggacgacttcagcatgtgcgcccacatacgggcgcagtgggcggcacccgggcaggtgaagatcgcactggcctgttgggtcgtcaatatggacaccgcgcgctatttcggtgacaacccacctgccagggaggagatgcggctgccgccggaaggcacagcggagtgggacgaggaactgactagccgggtgatcggccacctcgcagctcgtatgaacgctcttgccgccgctctgccgaccaccgacgaacacctcaccattaccgtgcctctcgacctggcgtagtccggcacaacgttcgttggcccggcctggaccacacacacggacgatcagagccatgggggcaatcgccccggaagctcggtatcggctcggccgagcccctggggccccggagtgcacggggcccgcaacctcttccgccgcttcaggacccggtagcccgaaacaaccacagccaccttacgtacaacccgatacctcagcatcgctcttgcgcacccgtagtgcgcacagcaccggcactcgaggcggcaacgtcaccgccgaacgatcgtcggccacatgcggctcaggtgacgaatgaacctgagcgcgccgccatggacgctgagcttggtgcggacttcacctgggccacccccggcatcaccacgatccgacgcaaccccgcccagcccggcgtccctgccagggtgtatgcggacatacggcgcaccaaccccggcggcgaagtcggcctcccccaggacatggagacagagggccgcgaaatgaaccctgccccgaaggccgtcccgcatgtcgccaacgcccgccctgctggagatcctgcctacgcaggacaggagtcggcacctcgatttcccgggctcgcgcgttgccggtcgagcctccggcccggctccggccaactagaacgctcggtggccaactgcgatgctcagtcacaggtgtgactgagcacgccatttggcccgaatggacgattcttattcagtacggataaaatcggtcatatccgaagccctcccctggtcatggcacccggcccgtccagagatgatcaccgatagcaccatgcccgcgattccctcacaccctgcgctccgactgtcgcgctcagtcgccaaccggcgtgctcaagcgccaagtatcccgctcagcctcaagtcctccgaccgtgcggcccagttggcaccgttcgccatgtgaagtgctcggagtgcggccgtacccgtgctcagtcggtcatcgggccatgcgacagctcgcgtacggcccgtgccacagcctcgccaggagtggtgaagaggccgagatccggagtcaggagccctctgcccaccccgaacgtgccgtcgccgttcgccgtcaggcacggtcccgtccgattcaggtccgggcgcgtggtggtcgagaagcgcagcgcccaatggctggtgaacggatacaggctgcgcagggccgaccggcgtaagcggactcgatcaagttccggtaggcgggtgcccaggggtagggcagttcgctcgcctccaggcgaaggtgctgccactcgctttccgtccggtgcgccggatcggggccgggcagctcgaagcggccggtcagatgcacgaagggagcggctcggctgatgtcgctgagtggctcgccgtcgtgccatgcgcgggcggccacggcgacctgatccaggtcgtccgtcctgccgtcgatcagcgccatgtcgtcgaaggcgtcggtgccccggatcgaccaccgccgttcgtggagccaggcatcgatctgcagggagttgcggtggggcacggggcagtggacagcggcaaaggtcagcgggttgccttccggactggtgagcgcgacggaagccagccgccctcctgccacgaaccggagcgccgcgctgagactgccatggcatgcgacatcgggatacaggaccgcagggtcaggaggtatcggcacgagacatgattgtgccggatccacggatccacgcacccggggatgcacacatggcgccaactgggctgcgtcgtcgtcgcagcaggtgtgctgagcgcgatacctggcctcgatggccgactccgatgctcaacatggcggcaggtgcagggcgtgcaccgggtgtcgcggcctcaccgcatccgcgtagcgcgggtaggtgctttctgtatgacggcacccccgaagccgctgcggagtgagctctacgtaatcaggcgcgactcggtcggcaccggattgctctcctcgtcagtctcgcggccaaccgtctgtaggagaggtgggagcctgcacaagtgacagaacgatacgacggcgtgcgagatcgacgtcgatgatcttcacagtgagggcgtcgccgacctcgacgacgtctctggacgattcatccagctcgctggtgtgcacgagcccctggaagccgtccgctcggtcctcgatgcggacgaagacgccgaacggcacgatcttggtgaccggcccgatgaccacctgtccgatcctctgcgccatctgcggccaggggtcttcctgcagtgctcgaagcgacagcggtacccgttcccggaccatgtcgacgccgaggacctcggctgtgactacctggccgacgctgacgacgtcggacgggtggccgaagggacggtgggacaactccggcaggttgatcatcgcggtgaagccgccgatgtccacgaaggtaacgccgaagctggcgatggtcgttactgtgccggtgaccacctggccgcgccgtagggtcttcaggaaggcccagtcccggtcgccgggcgtcggctcggtctgccagcgagcgcgtagaacgctgtcgctgtcgggcagcacagctgtgaacagcgggagatcttcaccggcatacatggatacgactccggcagcacgcgcgccggcgagctgggaggtcaccgcctcgaaccgggtctcgtccacgaccgtgctcgtgatctgtccgtcctcgtcctcccagacgatctccacaaggccttcgtcgggcggagcggccacggccttgtcgacgtccgtgagcaggtccggccagaccgccagctgggagcgtggggccagctgggagcgcaccgtctccaggttgtcgcgggtcaggcggtgccaccgggaggcgttgacggcgaagacctcctccaggaacaccgcgcggccggaactgacggtccagtccaggagagcccagaagtcggcgtcggccgggcgctgcacgtacgcggcgtcgtcaggcgcgaagtcgtagggcgaggcgtctatgcgttccgggaacaggccgagcgcgcgggtgcgggccagtgcggtttcgcagggcaggttgctgccgatgtagaggtactggtcccagccgacgtgcacggcgaacgctccctccgcctccaagcggcaccaggcgccgttgtcgcggagcatggaccggacgatttccaggccgacggcgatcggcaccagagcgccgtcgtggaacccggctgggccggccgggaacaggtcggtcaggccgtagccgtctaccgggggctccagaccgaagtgggcgaagcctccgatctgtggctcgcggatctcaagctggtcaatgcccgcagcctcggcgaaggcggcgattgccgccaggtaagcctcttcgaccggcccgtggtcactgaccgtgtcctcggcgccggtgtagtgaccgcgctcgtcacggtgggcggggtcgtacctggtgatccggtggacgaacggcggcacgctgctccctgggcggtccgaagggattccagcataggttccgctgccgtgtccgcggtcaggattctcggataaaaccccaggccaccccggctgggcgccctctgcttgccgagtggaatgcacacccgtgacgggtccagtgctcatcggacaggcctgatgctcagtcacaggcacgagtggctgaatcgcagacaccttgaactcgcgtgttcgaattaatgttcgatatagtcgaggtgtaggcgggttgattggtactactttgggggtatctgggcggagggtgtcatgcgaggtagcgtccctcatctgcatgtcagtagtgggttttcggcccgctacggtgcctcgcatccgcgtgacctcatcgcccgggccgccgagcgcggaatcgggacggtggcgctgaccgaccgcgacatggtcaccggcacggtgcgcttcgcgaaggccgccgcagccgctggggtgaagccggtgttcggcgtcgatctgggcgtagccccccacgttccgcccgccgaagtccgccgccgcacccccgtgcgcggcggtgcg

SEQ ID NO: 3446 - DNA, 3794 bp, Unknown
  Kingdom: Bacteria, Phylum: Actinobacteria, Class: Actinobacteria, Order: Streptomycetales, Family: Streptomycetaceae, Genus: Streptomyces
gtgcccggtgcggcctgcggtcacgcggcggccttgcccaccaccggcgcgagccccgccgaccgcgcgacggccccctggtccccgcactgctccagccagttggcgagcatcaggtggccgtgctcggtgagcaccgactcggggtggaactgcacgccctccaccggccggtcgcggtggcgcagccccatgatgatgccgtccgccgtgcgggcggtgacctccagctccgggggcagcgcaccgggttcggcggcgagcgagtggtagcgcgtcgcggtgaacggggacggcagtccggcgaacacccccttgccctcgtgggtcacgggggaggtcttgccgtgcagcagttcgggggcccggtcgacgacgccgccgtacgcgaccgccatcgactgcattcccaggcagacaccgaagaccgggacgccggtgtcggcgcagtgacgcaccatctcgacacagacgccggcctgctcgggcgtgccgggacccggcgagagcaggacaccgtcgaagccgtcctgagcgtgggcgggggtcacctcgtcgttgcgcagcacctcgcactcggcgccgagctggtagaggtactgaacgaggttgaaaacgaagctgtcgtagttgtccacgacgaggatgcgtgcgctcactggtcggctcctgctccaccggcgctcgcgccgtcgacggtcacatcaccgaacggaagcagcggctccgcccacgggaacacgtactggaacagcgcgtagacgaccgccagaaccagcacgagcgagatgacgctccgcacccatgcgttgcccggcagatgccgccagatccagccgtacatgctgacccctccattcggtacccgcaccagactagagggccgcggccggggagggggtcagctgtggaaaagctcgggtcagccggaaagctccggcggccttccgtcgctcaccggccgcgtcgcgtccagatgcgcccaggcgatcagccggtggctgctgccccattccggctcgcacgtggtgagcgtcagatagcgtccggcgccctcgaatccggagccgcggggcaccgggtcgacgacggcggtgtcggtgggcacggtccggtacggcttcttcgcgatgcggtacgtgaaccaggtcgtgccgtcgttcacgagcaccgcgtccccgggccgcagcttcgggaagtccttgaaggggtcgccgtacgtccgccggtgcccggccaccgcgaagtttcccgtgccgccggggcgggccgttccgctgtagtgcccgagccccttctgcagggttccgaccgcggtgttctccagaacgggccattcccagtcggcgccgaagcgggggacgtgcatcatcgcgaagggttttccgtcgcggtacggggccgggacgggggccgtcgacgcgcccgcctccgcggagccgggcggcggggcctgcgccgcgggctcccgggcccactggctctggagggtgtcgatctcgccctcggccgcgtcggccgctttcacgcccgtccagaacaggaagtagacgacgaaaaggatgatcagcgcgcctgcggtgatgcagagttcgctgaaggttctgacgacgagtcgcaccgacaccggacggcctccccggggctcagctcgggctcactccacaggctgtgcgtagtggagatccactgtgcccgagtacccgggaagagtcaccgcctcgttctcgtcgactttccagcccagcccgtacgccttcacgtacagcaggtagttctggatcgcggtggagtcgttgagcgcctgcttgagcttgcccgggtcgccgaccgcggtgaccttgtacggcggggagtagacgcggccctggaggatcagggtgttgcccacgcagcggaccgcgctggtggagatcagccgctggtccatcacctggattccgcgcgccccgccctgccacagcgcgttcaccacggcctgcaggtcctgctggtggatgaccaggtcgttgggctggggctcggggtagccggggttggcggtggcgtcggggggcgcgtcgtcgagcgtcacactgacggagtcgccggagatcttcgtggttccggccgccctctccaggcctttcagccgggcgtcctcggccttggtggaaccgtcgtcgcgctgggccagggcgtcgatgtccgcgcgggcgccggcgaccgcgtcgttcagctcgccgttcttctcgctgcgctccctgatcaggtcggagagcttcagcagcgaggagtcgctgcgcagattggtgcccttggcggtgttggcgctggtgacgaagatcagtccggccagggcgaaaaccgcagcggtgagcccccggaccgcccacgcggaggtgcgccgggccgggccttctggggagtcggcagaattgctcaacgtacccttatctcatcaggcgccagagaagcactacgctaacggacgctcgggggaggcagcattccccctggcaccccgcccccggcgcccgccacagatccctgcgcggtcacgcagcgcatcgacaggagagtccctcgtgccgaagtcacgtatccgcaagaaggccgacttcacgccgcccccggcgaagcaggcaacggctatcaagctgaccaaccgcagttgggtcgctccggtgatgctggccctgttcctcatcgggctggcctggatcgtggtgttctacgtgaccgaaggcgatctcccggtcgacgccctgggcaactggaacatcgtggtcggcttcggcttcatcgccggcggcttcgccgtgtcgacgcagtggaagtgacggaccacctccgcgcaagccttgccctgagttacccacagagttatccacagctgggggaaaaggtcagacgatctgtggataacctccactcacgttgacgccggtgtgactgcagcctccctcgtcgaggggggctgcaccccgttgtcctggcggaaaaacccagctcagcgacaaggggaacgactgttcctcttgccatgcacaagattatgcgcacactgtggacaacttcggccgacctgggggcggaggcccctgttccgcacaggatccggctagattcggctcaggtgagggacatcgtgcgggcgacgatgatcccgatgctcgtcagcaggacgagcgcgcaggcgcccacctgtaccgccgtacgccgctcgcgcggggcgtggaccatgccaatggcgatgacgacacccgcgatcagaccgccgacgtgcgcctcccaggcgatgccgccccaggtgaaggtgaagaccatgttgatcgccaggagcaccagcaccggacgcatgtcgtagttcatccggcgcatcaggacggcggtggcgccgaacaggccgtagaccgcgccggacgccccgagcgaaccctggttgggcgcggcgatcaggtaggtgagggcgctgcccgcgaggccggacagcaggtacagggcgaggtagcgggaccggccgagcgccgcctccagctgtccgccgagccaccacaggcccagcatgttgaacccgatgtgcacgacttcctggtgcaggaacatcgaggtcaccaggcggtaccactggccctcggcgacgccttcgacggatcccggcggcgggctcgggtcccacgccagcccgagcagcgtcaggtcgcccaccagcgcgggacggacggagaccaggaggaagacggccagattgatgccgaccaggaccttggtgaccaggcgcgggtcggcggccaccgcgccgccggccagcg

SEQ ID NO: 3447 - DNA, 3353 bp, Unknown
  Kingdom: Bacteria, Phylum: Actinobacteria, Class: Actinobacteria, Order: Streptomycetales, Family: Streptomycetaceae, Genus: Streptomyces
cccggccgccgccgcgcaggcgtccagcgccacgtgcgcggtcaggtcgcaggagccgtccggcaccggccgcacctcgcgcccggcccggaagccggtcagcgtcccgaaggccggccgggcgtcccgtacgtgggcgtagtccaccgccaccgcgagaccggcggcgagggagccgaccgctcccgcccaggccgtgtcccgggggcggccgatctccgcccgctcgcccggtgcggtcagcggccaccagcgctccagccacgccgcgtccgccccgcccaccgcttcgccgagccgctccgcgccgtccgaggtccgcacctggacgtaccgggggacgccgtccgggtccgcctccgccacctcggccgggacattgtccagccactcgttggcgaacagcagcccggtgatccccgagggcggctttgcgcaccactcgatccgggggtccaggcccgggggccggtccgcgacctcgacggcgtacgcggtcacctccagtcccggtggcagtgcggccagcaccccggtcagcagctcgccgcgccccgccccgacatcgaccagcgcgaccgtgccggtgtccagctcccgcgcggttccggtcagcagccgggccaccgccgccgcgaaaaggggggaggcgtggaccgacgtacggaagtggcccgccggcccctccgggctccgccgcgggctgcgataaaagccctcatctccgtacagagcggcctgagccgcctcccgccacccacgccactcgtccgtcacgtaggcaagtctccaccttggggagtacggtcccaggacccggatcgatcctccggttgacccgggcaccgatcagctgtccctacgctgggttacgtgcagcgcctctacgatttcatccgcagacacccgacgggcgtcgacgtcttctgggccgtcttcctcctcgggctctccggcgtgtcgatggtgtcgggcatgtacgacgcgggacgcgaggagatcgtcgccgttccggtgatgctggggctctccacggtggtggcgctgcgccgcagggctcccgagagaatgctgctgctcgccatcctggtgggcgtcgtgcagctggtgttcgacgtacggcccggcatcgggaacttcgcgatgctggtgatcacgtacaccgtggccacggtcggggagcgctgggcgtcccgcctggccctggtctgcagcctgagcgccgcggccctgtcccagctgcggtgggaagctgagccgggcggctcctggccccaggtcgtcttcgtgacgatcatcatgaccgtgccgttcgtgttggcctgggtgctcggcgactcgctgcggacccggcgcgcctacttcgaccagctggaggagcgtgccgcccgcctggagcgggaacgcgaggcgcagtccaaggtcgcggtcgccgccgagcgggcccggatcgcccgcgagctgcacgatgtcgtcgcgcacaacgtgtccgtgatggtcgtccaggccgacggcgccgcctatgtcatggacgccgctcccgaccaggcccgccaggccctggagaccatctccagcaccggccgccaggcgctcgcggagatgcggcggctgctcggggtgctgcggaccggtgacgccccggagagcggggagtacgtcccccagcccgatgtggagcagatcgaggacctggtcgcgcaggtgcggcagaccggcctggcggtcgacttcaaggtcgagggcaccccccgcccgctgcccagcggcgtggagctgaccgcgtaccgcgtcgtgcaggaggccctgacgaacacccgcaagcacggcggacccgacgccggggccagcgtccggctggtctacttcgacgacggcctcgggctgctgatcgaggacgacggccggggtgcggcgcacgagctgtacgaggacggcggcgccgacggcgccgggcacgggatgatcgggatgcgggagcgggtcggcatggtcggcggcaccctggacgcggggccccggcccggctgctccggtcgtcgcggcctctccggtcgtggccaccgtcccggcccccgatgccgtcccgctcgccgtcgccgtcccggcgtggctcgtcatgcggatacctcgcggcaggcgcggtagaagtccttccagccgtcccgctcgcggaccacggtctccagatactcctgccagaccacccggtccgccgccgggtcccggacgaccgcgccgaggatgccggccgcgacgtcgccggggcgcaggacgccgtcgccgaagtgggcggcgagcgcgaggccgttcgtgacgacggagatcgcctccgcggtggagagcgtgccggaaggggacttgagcttggtgcgcccgtcggtggtcaccccgtcgcgcagttcgcggaagaccgtcaccacgcgtcggatctcggtcaggccctccggcgccgcgggcaggtccagcgaccggccgatctggtcgacccgccgggacacgatgtcgacctcggcgtccggggtggcgggcaggggcagcacgacggtgttgaaccggcgtcgcagtgcgctggacagctcgttgacgccgcggtcccggtcgttggccgtggcgatgagattgaacccgcggacggcctggacctcctgtcccagctcgggaacgggaagcgtcttctcggacaggatcgtgatgagcgagtcctgcacatcggcggggatgcgggtcagctcctccacccgggcggtcatgccctcggacatcgcccgcatcagcggactggggaccagggcgtcgcggctggggccgtgggcgagcagctgggcgtagttccacccgtagcggacggcttcctcgggcgtcccggccgtgccctgcacgagcagcgtcgagtcaccgctgacggcggcggcgagatgctcggacacccaggtcttggccgtgccggggacgccgagcagaagcagcgcacggtcggtggcgagcgtggtcacggccacctcgaccagacggcgcgggcccacgtacttcggcgtgatcaccgtcccgtccggcagggtcccgccctgcagataggtggcgacggcccagggcgacagccgccaacgggcgggcctcgggcggtcgtcggcggcttcgagtgccttcagctcgtcggcgaacgcgtcctcggcgtgcgggcgcagcaccgcggcgcccgtctccggcccgacggccgcggtggtttcggacacggtcatggatccccctccagatcggtcgacctgatgtggttcccaccgtgcaccatgccactgacaacgggccctgaccgcgggtcagggcccgtccgtgaacgcgcgcaaccggct

SEQ ID NO: 3448 - DNA, 2086 bp, Unknown
  Kingdom: Bacteria, Phylum: Actinobacteria, Class: Actinobacteria, Order: Streptomycetales, Family: Streptomycetaceae, Genus: Streptomyces
gcgctgaccgcccgacagctggtgcggccgccgttcggcgtggtcggccagaccgaccgcgtccagcagctccagggcccggcggcgggcactgcgggcggaccccccggacaggtggcgcatcacctggagctgttcggcggcggtcagcgagggcaacaggttgggctgctggaagacgatgccgatgtgctcccggcgcagggccgcccgcccggcccggccgaggcccgccgtcggcgtcccggccaccacgacctcgccggagtccggggtgaccagggtggcggcggcggcgagcaggctcgacttgcccgagccggacggtccgacgacggcggtgagcgtgcccggtggcacgtccagcgagacccggtccagggcggtgagccgtccctcgccgtccgggtaggtgagggtgacgtcggtcagggtgagcgtcatcgggcactcccgagtgcggtgagcgggtcgacggcggtgatccgccggatggacagggcggccccgagcgcgccgagggcgatcatcacggcggccggaacgaggacggtcgccgcgtccagcacgaacggcacggctcctccgccgatcaggattccggcaccggcggcgaggacggtgcccagtcccgtgccgagggcgagcatcacgacggcctggcccagcgcgtcgcgcaggaggtacggggtcgacgcgccgagtgccttcagcacggcgacgtcgccgctgcgctggatcgtccagacggtgaagaacgcaccgatgacgagcgcggagatgacgaagaggaagccgcgcatcaattgcagcgaaccgttctccgcctggtaggagccgatggccgtgagggagtcgtcgagcgtgagcgtgctggtgcccgccgcctcgtcccccgccgcgaggtcgacgccaccggtggtggtcagggcgatcacggtcgcctgttcggcgggcccggcgccgtcgtggccgatctgctgccagtcgtcgagcgaggtccagacgacgggggtgtgactgtacgaggcatccgtggcgacggcggcgatctcgcgctcggtccggccgagcgcgatcgtgtcgcccgccgtgacgccgagctcctcggccgcctcgccggagagcacgacccgccccgggccgatcccgtccggcccgagggtgccgtccggttcgacgccgaaggccgacacggcggcggtccgctctccggcggcggtggcgttgagggtccggatgccgaccggttgcgcggcctcgaccccgggccgtccggcccaggcccgccagtcgtcctcccggacggtcgagtcggtgaacgactccgcctgaccgtcgggtggcgcggcgaaggccaggtggtcggcgtcgagtccggtgacggccgaggtgttctcccgggccagtccggcggtcaggccggacaacaggcccacgagcagcgtgatcagcaccacgaccgaacccatgagcgcgaaccggcccttggcgaagcggaggtctctccatgcgacgaacatggctccagcgtcgtgcggcgcgggcgggaaaacatcgcgcggcggacgggcccgggatcaacctttcgattgaccgggtccggggaggccgcggctacgctggacgaaccatggattcgcgttcgcacacccacgtcacggcagccctgcggctctgtctgcacgcgctgctgatcgggctgctggccctggtggtggtccgcacggtgagcgaggacgcgccgcgggcgccggcggtcgtggtggtggcggcgctgatggcggccctgtacgcggcggggccgctcgcctcctccgtacagcccggaaaccgggcgggagccgtatggctggcgggtctcggcgccctgtgggccgcgctgctggtgctgtcgccggacgctttgtgggtggccttcccgctctacttcctccagctccacgtcctgccgatgcgctgggcactgcccgccgtcgtggtcaccgccgccgccgatcagcggcccgatgaacgcgccgggttcgatctcctgccggtgcacgacgaaggcggtgatcgcggcggcggcggtgaccacgacggc

SEQ ID NO: 3449 - DNA, 5939 bp, Unknown
  Kingdom: Bacteria, Phylum: Actinobacteria, Class: Actinobacteria, Order: Streptomycetales, Family: Streptomycetaceae, Genus: Streptomyces
cgggtcaccgtctgcgacgcgcgaccggtcttcgccaccgcggcacgcttccccgaggccgacgagatcatcgtcgactggccccaccgctacctcgccgggaccgcgaccgacgcgcgcaccgtgctgtgcgtcctcacccacgacgccaagttcgacataccgctgctggaggccgccctgcgtctcccggtcgcctacgtcggcgcgatgggctcccgccgcacccacctggagcgcaacgaccggctgcgcgaggtcggcctcaccgatcgtgaactggcgcggctgcactcgccgatcggcctcgacctcggcgcccgtacgccggaggagacggccctgtccatcgccgccgagatcgtcgcggtccggcgcggaggcagcggcgtaccgctcaccggggctcatactcccattcatcacgacagcagcggacagccgctcgcctcggtggcctgaaacgtccgtcaacacctcgtccaccccgggcgggttaccgccacggcggtttcccgcccgcacggaacgcagcggtcgacccggatctaccggtagatcagctgcatgactccttccccctcctccgttcccggccgggcgagatccgtccgcccaggacgcagagccctgctcctggcgacctcggcggccctgttgggcggcatgctggtccccttcgctggcgccgctggcgcctcccccgcaccgcgcgccgagaccccgcgccccgacgtacgcaccgagagccacaccgtcaccctgatcaccggtgacgtcgtgcgctacgtggacggccccggcgaccaggacaccgtcaccgtggaccgccccgacggcgcgagcgggggcgtccgcatccaacaggcgggcgaggacgtgcacgtcctgccggacgaggccaccacgctgatcgcggcgggcaccctggaccggcggctgttcaacgtctcggtcctggtgcggatgggatacgacgacgagaacgccggctccgtcccgctcatcgccacctacccgcccgcgcgggccaaggcgctgccggccgcgccgcgcggcgcgaagaaggtccgcaccctcgagtccgtcaacggcgccgccctcacggccgacaaggacgacgcgcggacgttctggagcgccatcacccgtcgcgacaaggcccgttcgctcgacggcggaatcgcgaagctctggctggacggccgctccgaggcgctgctgaccgagtcggtgccgcaggtgggcgctccgcgggcgtgggccgacggtttcgacggcaagggcgccaaggtggccgtcctggacaccggcatcgacgccgaccatccggacgtcaaggaccgcgtcgtcggcgcccgcagcttcgtcccgggcgaggaggtcgacgacaagaacggtcacggcacgcacgtcgcctccaccatcgcggggtccggcgccgcctccgagggcgccggcaagggcgtcgccccggccgccgacctgctcgtcggcaaggtcctcagcgacgggggctccggcgccgactccgggatcatcgaggccatggagtgggccaaggccgaaggggccgacgtcgtctccatgagtctcggctccccggtgcccgacgacggcacggacccgatgtcccaggcggtgaactccctctcggcggacggcggtccgctgttcgtcatcgcggcgggcaacgcgtacggggcgggcaccatcggctcgcccggctcggcggagcaggcgctcaccgtcgccgccgtcgacaagcaggacggccgcgccgacttctcctcgatgggcccgctggtccgctcgcacggcctgaagcccgatctgtcggcccccggcgtcgacatcgacgccgccgcctcgcagtccgtccccggcatcgaggacatgtaccagtcgatgtccggtacgtcgatggccacgccccatgtcgccggcgcggcggcgatcctgaggcagcgtcaccccgactggtccggtcagcgcatcaaggacgcgctgatgacctcgtcgaagaagctcgacgcgtacaccccgtacgagcagggcaccggccggctggatgtgaaggcggcgatcggcacgacgatcgaggccaccggctcggtccgggtcgcctcctacgactggccgcacagcccggccgaccaggtcgccgagcgcaccatcacctaccgcaacacgggtggcacggacaccacgctgaacctggccaccgacacggaggaggcggcgtactcgctgtccaccgacacgctgaccgtcccggccggcggcaccgcggaggcggtcctgtccctggacccggccaaggtcgccaacgacaccaccttctccggccaggtcgtcgcgaccgacacggcgggcgcgacggtcgcgcacaccggcttcgcgctcaccaaggagaaggagctgcacgacctgacgctgaagctccgcgaccggtcgggcgagccgatggacggcctcgtcgtcctcgccgagctgggcgacccgcagctcggcctcgttcaggtcagcggtggcgagaccaccctgcgcctgccgccgggcaactacaccgcctgggcctccgtggacatcgacggcgaccgtcccgactccaaggccgtcgctttcctcgccgcccccgagacgattctgagcggctccaccaccgtaaccctcgacgcctccaaggcccgcaaggtcgacgtgcgcaccccgagggagaccgagacccgccagctccgctacgacatggcgcgcaccgccccggacggcactgtccatcgtgacgccttccaaatcccgctgatgtacgaccagttgtgggcgagccccaccaagaaggtcacccagggcagcttcagcttcctgacccgctggcgtcagggcgagaagctgatcgacgtcgaggccgacggccgtgacgtgccggtcttcgtccagggcggcgcggcggtcgccgaagaccgcaggcagcagctgaacgcggtgtacgcgggcaagggcgcacccgcggactaccagggtgtggacgcgcgcggcaaggcggtcgtcatctcccgcagcgccgatgtcgctcccgccgaacgcctcgctgccgcgctggcggccggggccgaggcgctgttcgtcgtcaacgacgagcgcggcgtggcgatggagagctacaccccgtggggcgagcagaccaccattcccgtcgcctccgtccggaagtccgcgggtgagagcctgatcagggcggcgcagcgcggcaagaaggtccaggtcgaccagaagaagttcgcggactacctgtacgacctggtggaccgccacgacggcacgatcccggaccgctcgctggccttcgccccctcgacccgtcagctcgcgaaggtggagaacaccttctacggccacaggaagacgctcggcggcggctaccgctacgacatcccggactacgggcccggcctcggcttcgaggagtacgagcagttcccggccgtccgcaccgaatgggtcaacccgctgccgggcgactccttctggtacgagaaccactcggtcctcaacgcggagcagtcggaccgggcgcacgagatgcgcagcgccgagctggactaccgggcgggcaaggactatcgcgccgagtggttcgccccggtgacccggccccgtctgggcaccggctactggggtccgttccgcacggtgtccaacgacgtccagttcaacatcaccccgtggacggacgcgggcgcgggccactccggctcgatgcccgagaacgagtacgacaccacctcgtacgccttccaccagggcgacaaggagctgaagaagggtgtgggcagggccggttacatcggtgacctcgccgccgagaagctcccgtaccgcctggtcatcgactcggagcgggacgcggagacctggaagacgtcgatccgcacccactccgagtggggcttcgtctccggcgcactggacgtgggcggcgcgtaccgtgccgacatcccgatgctccagctggactacgccgtcgacaccgacctggcgggcgacgtccgggccggccgcgcgacggagatcggcctcgcttccggcacgcaggaatggctgccgggcgcggtgaaggcgaacaaggccgcgctgtcggtcagttacgacgacggcaagcgctggtcgaaggtggagctccgcaagaagaggaccggcgagtggaccgccacgctccgtaccccgtcgaagggcgcgacgtcggtctcgctcagggcgcacgcggagggccccggagggctcgtcgtcgaccaggagatcatccgggccttcggcctgaagtgacctgctgacgtggtcccgcactccctcgggggtgcgggaccacctgcgtcggcgagtcgatttgcctaccccgtaggggtagttgacccggaagcgggccgggctctagtctctcccttgtgagcgagatacccccagggggtatacgtgatacatgatctggaggccccatgtgcaccacttccgccgcatcgcagagcaccccggccgtcgtccgggcaggcacggacgacggcgcgctgcccgactggcatctgcggggtgagtggttcgacgtgtgcagctgcgcgctgccctgcccctgtacgttcgcccagacgccgacgcacggagactgcctcttcacgctggtctggcaggttcatgaggggcacttcggggatgtgtccctggacggcctgggcgtggtggcgctgggcgagttcgccgggaacatgtgggtcggcgatccggaggccacgatgaaggtgatgctctacatcgacgccaagggcgaccgggcccagcgtgacgcgctggagcagatcttcgccggccatgtcggcggctggccgggccagttcggctcgctcatcagcgaactgcgcgaggtgcggcacgcgccggtccacttcgacgccgccgaggacctctcgtactggcgggcccgggtcgccgacaaggtctccgtcggcgcgaccgccctcaccggccccacggccgacccctcccgccgcgtccagctggtcaatgctccgggctccgaggtcggcccgggccagatcgccacgtggggcgtcgtcgagagcgatcgtgcggaagggttcgacttctcgcacgaataccgcggtgggtccagcaagcacttccccttcgactggcgcccctgaccgcggggcaggcggtcaccgtccgcccggcgggcgttcgggagcgcgcgaaccgtcccgccgggccggtgcggttggatatgaccatgagcgttcacgacgtggcccgcaggctgccggacatatccgccctcaccgatctctgccgttccctggcgatgctcgacgcgatcctttgtcccgagtgggaccaccgctggcacagtttcgacgcgcagtggtcgccgacggaggcgatggcctcgatgcgggacgggtcgggcggtgagtactccgtggtcctctccgccgacggcgcgtacgcgcggggcttcgaccacgagtcgccgatgagcccgtacgtggacgacgccccctggcccggggtgctcgacgaggtgccggccgtgttccgccgctacgtcgacgagccctcgttcaccgacgagttcgggatgcccgtcgtcaccgcctgcctctggcgcacgagcgacgacgaccgctggcgggcgggaaccatcgagttcccggaggacggcgaggactccgacggggccgactggctcttccagctcctggtcacgggcacccccgagtcctaccaggagtgggccgaggactatttcgaggtctccgtcgacctcgaagccgtacgccacatctatgcgctgcgaccgctgaccgacgaggtgatcgcggccctggcccccgagcggatccccgccgaactggcggaggacatcaaggagatcgggtacccggcgg

SEQ ID NO: 3450 - DNA, 3606 bp, Unknown
  Kingdom: Bacteria, Phylum: Actinobacteria, Class: Actinobacteria, Order: Streptomycetales, Family: Streptomycetaceae, Genus: Streptomyces
gtaccggacccggaggtgcgccgggccgtcaccgcgctcgccgagaccctcgcccggctcggccaccacgtcgaggaggcccgtccccggtacgggctgatcggcctcgccttcgtaccccgcgccaccgtgggcatcgccgaattcgccgcacgccaccccgaaccggccctgctcgatccgcgcacccgcagcgccctgcgaaacgggacgcgcctgggcggacgcgtggtgcgggccgcccgcgcccgtgaggtgcgccagcaccgcaggatcggcgccctcttcgacgcctccggcttcgacgtgctgctcacccccaccacggccgcgccgccgccccggatcggcgccttcgaccacctgagcgcctggcgcaccgacctcacgatggcggccgcctgtccctacgcctggccgtggaacgtcctcggctggcccggggtgaacgtcccggccggcttcacccggtccgggctccccgtcggcgcccagctcctcggcccctcccggagcgaggagcggctgatcgcgctcgccgcccaactggaggatgccctgcgctggtacgagcaccggccgccggcctgacggccagaacacacccccacccctgggcggtcagctccgcttccacccgttccacggccggcagcgcgccgaacgcgaccgggtggaccagacagtgcccggtgacggctccacccgccaggccttcacgtcctcggaccgcgacgtccccgtcccccgcgccggtcttcgcgtacgagtccgggctggtcgagccccggtcgcggaccgatgagggccgcgccccgggacggtgacgcgtccacggtgcgtgaagccgtgcgggggccttgtggagcccggcacggtgaagagatatcttgatgtcaagcaatgttgcagacgtggagcggagcacccggtgactgactcgaccatcatctatacgcacaccgacgaggcccctgccctggcgacctactcgttcctgcccgtcgtcgaggcctacgcctcgaccgcaggcgtcacggtcgagcgccgtgacatctccctcgcgggccggatcatcgccagtttcccggagcacctcaaggccgagcagcgtatcgatgacgcgctcgccgagctcggcgagctggccaggacgcccggcgcgaacatcatcaagctgccgaacatctcggcgtcgatcccgcagctcaaggccgccatcgccgagctccaggagcagggctacgcgctcccggactacccggacgacccgcagaccgatgaggccaaggacgtccgcgcccggtacgacaaggtcaagggcagcgccgtgaacccggtgctgcgcgagggcaactccgaccgccgcgcccccgcgtccgtcaagaactacgccaaggcccacccgcaccgcatgggcgcctggagtgcggactcgaagacgaacgtcgccacgatgggcgtcgacgacttccgttccaccgagaagtccgcggtcatcgcggaggacggctcgctccgcatcgagctccacggcgacgacggcaccaccgccgtgctccgcgagtccgtacccgtcctcaagggcgaggtcgtcgacgcggccgtcatgcgcgtcgccgcgctgcgcgagttcttcaccgcgcaggtcgcccgcgccaaggccgagggcgtgctgttctccgtgcacctcaaggccaccatgatgaaggtctccgacccgatcatcttcggccacgcggtccgcgccttcttcccgaacaccttcgccaagtacggcgaccagctcgccgcggcgggcctcaccccgaacgacggcctgggcggcatcctcaagggtctggactccctgccgggcgtcggcgccgagatccaggcgtccttcgaggccgagctcgccgagggccccgccctcgcgatggtcgactccgacaagggcatcaccaacctgcacgtccccagtgacgtcatcgtcgacgcctccatgcccgccatgatccgcacctcgggtcacatgtggggtcccgacggcgacgaggccgacaccatcgccgtcctcccggacagcagctacgccggtgtctaccaggtcgtcatcgacgactgccgcgccaacggcgccttcgacccggccaccatgggctccgtgcccaacgtcggtctgatggcgcagaaggccgaggagtacggcagccacgacaagaccttcgagatccccgccaccggcaccgtgcgcgtcgtcgacgcgagcggcgcggtcgtgctggagcaggccgtcggcgccggcgacatcttccggatgtgccagaccaaggacctgcccatccaggactgggtcaagctcgccgtcacccgcgcccgcgccaccggcaacccggccgtgttctggctggacgagagccgtgcgcacgacgccaacctgatcgccaaggtcaccacgtacctcgccgaccacgacaccgacggcctggacatctccatcaagaccccggaggaggccaccgccttctccctggagcgcatccgccgcggcgaggacaccatctccgtcaccggcaacgtgctgcgcgactacctcacggacctcttcccgatcctggagctgggcaccagcgcgaagatgctctccgtcgtcccgctgatgaacggcggcggcctcttcgagaccggtgcgggcggctcggcccccaagcacgtccagcagctcgtcaaggagaactacctgcgctgggacagcctgggcgagttcctggccctcgcggtcagcttcgagcacctggcgaccaccacggacaacgcgcgggcgcaggtcctcgccgacaccctggaccgggcgaccggcaccttcctcaacgaggacaagtccccgagccgtcgcctcggcggcatcgacaaccgcggcagccacttctacctggccatgtactgggcccaggagctggcgcggcagaccgacgacgcgaagctggccgaggcgttcgcgccgctcgccaagacgctggccgagcaggaggagaccatcgtcgccgagctgatcgcggtgcagggctccccggccgagatcggcggctacttccagcccgacccggccaaggccgaggcgatcatgcgcccgtccgccacgttcaaccaggccatcgcgaccctcgcctgacctgaggtgaggcggagccgtccgcctcaccccaccgctccgccccggcaggcctcgcgcccgtcggggcggttcgcgttcggagcccgtacgggggaaggaccaatccgccggggccggggttccgaatgacgaccgtgaggatcccccggaaagccctgacccgttccacatccgccgctctgagcggactgctcgcgggattcgcctcgctggccgtcgccgagctggtctcggcggccgtcaggcccggggcgagtcccgtgacagcggtcggcggagcggccatcgaccggacgcccgccggggtgaaggactgggcgatccggaacttcggcgaggacgacaagctcgtcctgcaactcggcatcgtcgccacgctcgccctcttcgccctggccgtcggcctgtcggcactgcggtatcggcgggtcgcctccgccgccgtcctg

SEQ ID NO: 3451 - DNA, 5009 bp, Unknown
  Kingdom: Bacteria, Phylum: Actinobacteria, Class: Actinobacteria, Order: Streptomycetales, Family: Streptomycetaceae, Genus: Streptomyces
cgcggtgctcgccgccgccctcggagcggtcaccctcggcgccccctcccccgcgtcggcatcgaacaccgccggcgaaggggactacctcgtcgggcgcggcatctccgatgtcaccggcgaggccgccgagaccgggatgatgggctactccagcttcgaccagaagacgtcgggcatccatcagcggcagaggtcgcgcgccttcgtcgtcgtcgaccggtcgagcggcaagcgcgtggtgtacgtcaacgccgacctcgcgatgatcttccagtccgtccagcagggggtcatcgcccgtctgaaggagcgttacggggacctgtacgacgaggagaacgtcctgctgtcggccacccacacccactcggggcccggcggatactcccaccacgtcgcctacaacctctccgtcctcggcttccagaaggagacccaccgagccgtcgtcgacggcatagccgactccgtcgcgaaggcgcacgaggacctggaacccggcacgatgagcctcggcaccgggaccctcaccaacgccagcgtcaaccgctcccgggaggcgttcgaccgcaatccggcctccgaccgggcggccttccccgacgcgatcgacccggcgatgaccgtgctgcgcttcaagcagggcgacaaggacgcgggcgcgatcagctggttcgccacccacaacacctcgatcaccaacaagaacacgctcatcagccccgacaacaagggctacgccgcctacgcctgggagcacgaccacgagggcgtgcgctacctcgacgacgctcccgggttcgtcgcggccttccccaacaccaacgccggcgacatgtcgccgaacctcaacctgaagccggggtcggggcccaccgaggacgagttcgagaacacgcgcatcataggtgagcggcagctcgacaaggcccgcgagatctacgacgacacgcggcccgtctccgggggcgtcgactcccggctcgcctacgtcgacatggagaacgtgacggtacgcccggagtacaccccggacggcgaggagcaccgcacctgccccgccgtcgtgggagcgtccacgctcgccggcagcgtcgaggacggtccggcgatccccggcttcgaggagggaacccgcaccccggtcgcgggcatcatcgacgcgctgcgcatcgacaccccgtcctggctccggacctgccagtacccgaaggcgagcctgatccccacgggcctgctgagcaacgtccacccggtcacgccgaagcgcctccccctgcagatcatgaagatcggggagctgcatctggtggccgctccgggcgagttcacgatcacctccggcctccgcgtacgccgcacggtggccgagcggttgggcgtcccgctggaccgcgtcctgctccaggggtacgccaacgcctacagccagtacgtcacgacgccggaggagtacgacacccagaactacgagggcggctccacgttgtacggccgctacaccctgcccgcctaccagcaggagtacgcccggatcgcggattccctgcgtgagggcaccgccctggagcgcggcgcgacgccgccggacgagtcgggcaggcagttcaccttccagacgggggtcgtgtacgacaacccgcccgcgggcaaggcgttcggcggcgtcctgaaggccccggagacctcgtacgcgcgcggctccaccgcgaccgccgagttcgccaccgggcacccgaagaacaacgtccgccggggctccaccttcctggaggtgcagcggctggagaacggcacgtggcagcgggtgctggacgacggcgactgggagaccacctaccgctggacgcggctgaacggtctgaccggcacctcgaaggccacgatcacctgggacatcgcggcggacgccgtgcccggcacgtaccggatcgtgcaccacggggacgcgaagagcctgctcggaaaaatatcgccgttcaccggggccacggcgtccttcacggtgaactagagagtcacggagtgcgcggggtgggctggaaccaggcgggaccctcggtgagggcctgcttgatccggaacagggcgaactcgccgagcggcgggagcgcgtccagcgggaaccagcccacctccagcgactcgtcgtcgttgaccgccgcctcgccgccggtcgcgcggcagcggaaggtgatgtcgaggtactggcagatgtcgccgttgtcgtaccgcacgggtttcagcgcctgcgtgagcaccacccgttcggccacgcagtggacgccggtctcctccagcacctcgcgctccgccgtcgccgccggctcctcccccggttcggagatcccgccgatgaccgcccacttcccggtgtccgcgcgccggccgagcagtacgcggccctcgtcgtcgaggacgatggccgtcaccccgggcagcaggagcagttggtgcccggcggtggcgcggatgtcacggatgaagtcgggagtagccatggatccgagcctacgtggccggatcaggtgctagggggtgtccgcaaagtatcgtcgtccgccctctgtcgcgggccggacgagactgtgcggacacgacctagcgcgcggtgccctcgctccggcgtgcccggaacgccgagacgctcacccagcccaggcccgccagggccagcagcgcgatgacgccctcgggcaggggacccatccgggtggcgggggtgagcgaggagcgcagcgggacctcgtcgaccagggcgtcgggggtgaacatcccgctcttctcgacgatcgtgccgtccgggcggatcaccgcgctgaccccgctggtgacggggacgacgacggcccgcccgtgctcgacggcccgcacctgggacatggccagctgctggtaggtcatctcgctgcggccgaacgtcgcgttgttgctcggcacggcgatcatctggccgccgtgcttgacggtgtcgcgtacggcgtcgtcgaaggccgcctcgtaacaggtcacgaggcccaccttcgtccccgcgaggtcgaagacgccgacctcggtgccggggacgaactcgcgctgcacccggtcgacgtcctcgctgaagaagcgggcgacggtgcgcatcggcatgtactcgccgaacggctggatgtgccgcttgtcgtaggtgtcgacgggaccctggtcggggtcccactcgatcagggtgttgcggaggctgtcggagcccttctcgaccaccgagccgacgaccgtggggacaccgatcgccttgacggcgtcgtcgatgacctggcgggcgtccgcgttgaggtaggggtcgagatcggaggagttctccggccacagcacgaagtcgggctgcttctccttgcctgccttcacgtcctcggccagctgtgcggtgcgccgggcgtggttgtcgaggacggcgcggcgctgggcgttgaagtcgaggcccaggcgcggcacattgccctggatcgcggcgacggtggccgtgccgttctccgccgagtcgtcgaccaggggcagcgcggcgagggcgccggcgaccggtacgaggacgctcacggcggcgccgacgacggccgcgcgcgggacctttccggtcctgcggtacgcgacggaccggcgcacggcctcgtagagcccgaagccgcacagcacgacggcgaaggagagcagcggggtgccgccgagcgcggcgagcggcaggaaggcgctctcggactggccgaaggcgatcttgccccaggggaagccgccgaacgggatccgggcgcggaccgcctcgtccagcgtccagaccgcggccgcccacacgggccagtacgcgagccgggacaccgcggcgatgccgaggcaccccacggcgatgaagagcgcctccgcggtggccagggccagccacggcaccgggccgacgtcctcaccggtccagtgcagcagcggaagcatgaaaccgaggcccgacagaaggccgaggccgaaggcggcccggagcctgcgcccgtgcagcacccatcccagcagcgcgaacccgggcagcacgagccaccacagggttcggggcgggaagctcgcgtagagcagcagtccggacagcacggcggcggccgggcggaggagccgcggcagcagtccggcggccggggatgcggtggcgggcggcgggtcgtcgacgggagtcatggtggcgctcacccggcggagtctacggtgggcggctgtaagcggcggcgttgacctgcgcggagcagggacgcgggcggctcgcgggcggcaggtccggtcggtcgccgggatggtcgccggtggccggcggtccggtcagtcgccgggacggttgccggtggccggcaggtgcaggcgttgccggatgaaccgtacggccgtctccgcgtcgtcgaccgtgacggtgaaggtgcggccgtcgccgaggcgcagggccatgccctctcccttgcggaccacgacggcggtgccctgctcgggacgccagcggtagccccagccgccccactggcgcggattgatccgggggacgaattccgcgcccgtcacatggctgagcaggatccggcggcgcggcaggccggcgtggccgcagcgcacttccaggctgtctccgtcgaccttgaccgccacgtggacgaaggcgagcgttccgaagaggatcagcagtccggcggcgaggcagccgatcaccgacatgagcagcggagcgatgcccgaggtccaggcgccgtcgacggcgagctcgatgccgagggccacacagcccgcgcccgcgagggccagcagccactggatccggttggtggcgcggccgttccactccgtgggcggcgcctggctcgacccgtgcctcgcactctcggggtggtccgtcatattcagcagcgtagccgcgttccgggctcccggccggggctgcgggggccgatcgggctagccggtcccgatccgccgggcgctcccggcgggccggatcagaggacggg

SEQ ID NO: 3452 - DNA, 9941 bp, Unknown
  Kingdom: Bacteria, Phylum: Actinobacteria, Class: Actinobacteria, Order: Streptomycetales, Family: Streptomycetaceae, Genus: Streptomyces
catcggccgggcgcgccgcctcgcgaccgatgagcgggctcgggcgcggcgggcggcggtgctgaaggttccgctgcgggtcgccgacgtcggcggctgcctcaaggcggcccaggagctgatcgacacggccaccgacgacgccaagcagatggcggaggaggtagacgtcaaggagaccgaggacctcaaggcggcgctcggcggggtggccgggggccggatgccgcgcggtacggcgggggcgatgaaggagctggaggacaagcagaagcgccgcaagacgcgtacgcagcgggacagtctcgatctggcgctgaccgagctcaccgggttctaccgcgatgtgctggcgctccagctcggctcccggatcgccatcgccaatgtcgacgtgcaggactccctcgaccggatcgcggagtcctcgacgcccgcgcagaccctgcgcaggatcgagtcggtgatcgcctgccgggacgcgatggaccgcaatgtggcgccgctgctcgctgtggaggcgatgacgatggcgctgcgggcgggctgaggggatcccgcggtgggccctgttcacccgaatgagcagggaatcggacgactcgtcacccggcggatacgctccctgaatggataccaggcggctgctccgcaccttcgccatcgggatcggcactgccggcctcctcatctccggctgcagcggcagcggctcgtcgccgagtgcttcggccaccggcaccgcggctcccgaggggttgtcgtcgtactacgcgcagaagctgagctggcgcgactgcggggtggaggggttcgagtgcacgacgatgaaggcgccgagggactacgacaagccggatgacggcgacatcgaactcgctgtctcccgtaagaaggccacaggaccgggcaagcggatcggttccctcctggtgaatccgggcggccccggcggctccgcgatcggctatctccaggggtatgcggccctgggctatccggcccaggtgagggcgcgctacgacatggtggcgatcgacccgcgcggcgtggcccgcagcgagcccgtcgagtgcctcacgggacccgagatggacgtctacacccaggtcgaccagacgcccgacgacgcggcggaggtccggaagctgagcgcgtccttcgagaagttcgcgacgggctgcgagaagcggtccggcgagatcctcccgtacgtctccaccgtggacacggcccgtgacatggacgtcctgcgggccctgctcggcgacgagaagctgcattacgtcggagcgtcgtacggcaccttcctgggcgccacctacgcggacctcttcccggagcgggccggccgcctagtcctggacggtgcgatggacccctccctgaaggccgtcgacatgaaccgcgaccagacggcgggcttcgagggggccttccagtccttcgccgccgactgcgtcgagcagccggactgcccgctcggcaccacgtccaccgccgacgcggcgaccgcgctgaagcagctcttcaaggacctggacgccaagccgatcccgaccggcgacgaccgcgagctgggcgagtccctggccaccaccggggtgatcgccgccatgtacgacgaggcggcctggccgcagctccgcgaggcactggcgggcgcgcagcggagcgacggctccggcctcctgtccctggccgacggctactacgagcgcgggccgaacgggaagtacgcgaacctgatgttcgccaacgccgccgtgaactgcctcgacctgccgcccgccttcgacggtcccgacgcggtcgagaaggcggtcccggacttcgagaaggcctccccggtcttcgggcgcggcttcgcctgggcctccctgaactgcgcccactggccgaccgaggccaccggcaccccgcaccgcaccgaggcgaagggagccgacccgatcgtggtcgtcggcaccacccgcgacccggccaccccgtacaagtggtcccggtccctcgccgagcagctctcctcgggcaccctgctcacctacgagggcgacggtcacaccgcgtacggccggggcagcgactgcatcgacacggcgatcaacacgtacctcctggagggcaccccgcccaccgacggcaagaagtgcacctgaccccctacctcccccgggacctgccctgaccagcgcaaacgtctccgggggtgccgtgtgcggagcacccccggaaactgtgtagacttggctccgctgctgatcgcaccatagtgcgacagggcgcgccgccttagctcagttggccagagcaacgcactcgtaatgcgtaggtctcgggttcgaatcccgaaggcggctcagaagaaccccaggtcacatagcccgtgacctggggttttctgttgcttgaggcatgacgggttacacggccgggttgccgtgacgttgcctgcgtgagcgatgcgtgagcggagccgctcgggcgcctactttgtgggcttgcggcgtgtggccttcttggcggccttggcctgggctttcgtcttgttccgcttcggcttgcctccgcccttgctgcccttgctgcccttgccgacgtcggccgccttggccgcagccttcctggccttctccttcttcgcggccttgcgcgcggccttctcggcctcggccttgcgctggagggggacgagcttcgccgtggcctcggcggcactcttgccgacgtgggggaggacgctctggtagatgtcccgcgtgatgcgggtgtcgctgtgcccgagggtgtccgacacgatcttgatgtcgatgtcggcggcgagcatgagggtggccgcgccgtggcgcagatcgtgcaggcggatcggcgggagaccggaggcgacgaccaaacgctcgaagaggtcggtcaccttgccggggtggagccaggagccgtcttcctgggtgaagacgtggccggtctcgacccaggctgtaccccattcttctcgggccgtttcctgccgttcgcggtggtgcttcaggacgtcgacggtgtcgtcgtcgagggcgaccacgcgggagccgctgtcggtcttggggtcggacgcttccacctcccagccgtcctggacgagttgagaggagacggtgagggagtgggtgtcgaggttcgtctccgaccacggctggccgcacgcctcgcctcggcgcaggccgcggaacgcgatcaggtgccacatcgcgtacagccggtcctcggcgacgaagtcgaggaaggcacctgtctgttccggcgtccagaccatcacgggcgacggcttctcgcccgtctgctcccacttggcgacccgctcgtccgtccacacgagcgccttcggcttgcgcacggggtcgatctccacgtgggcggcggggttgaacgtggtgatctgctggccgatcgcgtcgttcagcgccgcgcggagggttgccttgacgtgctgacgagtggcggggccggtgatgcggcggaagggcggcatctcgtcgattgcggccttcatcgccttgcgtcgggctcggttctcggtgcccctccacggcacggtcgccaactcgtcgatcgcggctcgccgctgggcgttgtcctccaggatctgggcgttggcgtcgcggatgtccgtgaacatctcgctcagatggctgacgcgtagccggtccagacgtcggttgccgatgcgcggcttcaggtggacgcggatgtctgtctcgtagcgattgaggccggacttgcgtatgcgcttgccggtcagccagcggtcgagccattcggcgacggtcaggctgccgatgaggtcttggccggagttgagacgccgccgcgtctcctcgacctcgggcagagatgaccgctctcgactgacctcggccagcatctcggcgatgagttcggtgccctcggggtcgtccgagtcggcgagcccgaggagggcgcgtacgtggtcgaggtcggcctgggctgccttgagactcgcgtacccgccacgggcgaaggagcggcggctgccgtcctcgcggggtgagagctcctggcgtacggagtaggtgcagtggctcctgctgttgcgcttggggcaggaggtgccgagttccttgccggtcttcgggtcgcggcaggagcagcggcggtaggtggagcccttcaaagatcattctcctcgctggtttcgggatcgctcccggatgagtcgattacgtcggccaggtcgggccacaggaacgggggcgtgacgccctcttcctcgatgaaggcgcgaactctgcgcaggcggtcttcggcgtcgtccgccgtctcggcggcgcgggcctgggagcggagggcctcggccttccggtcggcattcggggcggtctgggcgtggtagcgcgcgtactcctcgtcgcgtcgcgcacttcgcagccgctcctgggcggcgtgatgggctcggaagtagcggagcatgtcgtcgtccgcgccgagatcggtctcctcccccgtgaaccagcgcagcgcatccagagtggaagtggagtcctggagcgggagccgctgcacgtcctcgatgtagcccacgggatagaggaggcagatgggtggggtgttcagggcttcggccagcaccatgacgtcgaccaagggcaggttggagcggcgtccggactccatgttggcgatgacgttgcgggggatcggatggccgatctccgcgcatctgtcggccaagtcctgtgcgctccaacccagttccttccgtcgtctgcggacctcggcggccacggtggccatgacctggtccacccactccgggacgtcgtcctcgtcgtcggccttgctcgatccatggtgacttcggcgttgtgtcatgcagacacattagctcgcttagcgttgattccaagacctggagacggacgcggaggccgcgttcgccgtgggctcagtcatggatggagtgcgcatgcgtcagaacgaagacgccggaggggcgaaggggatgagtcgcgaggagcttctggggctcccggcggccgttgacctggagacgggtaaccgcgcgctcgggctcggccggagtaagggctacgagttggccaagcgtggccagtacccgtgcaaggtgctcaggctcgggaacgcctaccgggtggtgacggcagacctgttggccttgctggggctggccgcatgaggcacctgatgcgccgtaggcgcttctgcgctgagctgacacagaaacgctggactgtgacacagcgtggacgtactgtccgtggtcgctcgcggtaccgaaacccccgcgagaagagggagagcctccgacggtgcaacgccggaggctccaggactccccagcaatcccttgagatccgacccggcggcaagggcgtgcaagcccgcagccgccagaagaggagccgcccagtgcaacccgagaaccccgactcctattcctcccccgcccgagcggcctggcccgccacggccatccccggccagcccggcgctcatctgggtccggcccaggccgcctctgccacagcggagatgcacgatggtccggctgacggcagcgaggcggacccggcaaggagcctggagaccattcccgacgcggagccgacgccaggctcggatctgctggatgaactgcgctcccacatagcccagttcgtgattcctccctcgtccgaggctctggacgcggtcaccctgtgggtggtggcgacgcagctccagcccgcgtggcagcacgccccacggctggcagtggtgggacctgcgaagcggtgcgggaagtcccggctcctggacgtgctgaccgaaacggtccacgagccgatgctcaccatcaacaccacaccagcggccatcttccgctcgatcaacgaggaggagccgccgacgctgctggtggacgaggccgacaccatcttcggccccaaggtcgcggagaagaacgaggagacacgcggcctcctcaatgccggtcatcagcgcggccggtacgtcacccgggtcgtcggcaacgaccacaccccgcacaagttcgccaccttcgccatggcggccatcgcgggcatcggtgacctgccggacaccgtcatggatcgatccgtcgtcatccgtatgcgccgcagggccgagggcgagaaggtcaaacccttccgctcgcgacgcgacatcccggccctgcacgaactgcgcgaccggatccgcgcctgggccctcccgctactggagaacgctgcgagcctggagccggccatgccggtcgaggatcgggccgccgacacctgggagcctctggtgatcgtcgcggacctggccggcggtcgctggccacgtctcgcgcggatcgcgtgcgcacggatggtcgcggccgaggtggcagccgaggaggatcacccgagtggggcgcgcatcctcgctgacatccgacgggtcttcttcgcgcagcgggaggcggacagcctgtccaccgaagacctcctgcaccacctgaacgcggacgccgaagccccgtggggagagcgtggacgctacggcctgacctcccgggagctcagcgggatgctgcgcgactacgacatccggcccggcaacgtgcgcatggccgaccggactcagcgcaagggctacacgcgcaacaagttcctggacgcctggcggcggtactgcccgaccgtccacccggtcgacgcccgtcgcggcgaaggctgaccctcacctccctggttgccgtacttgccgtccctgccgtgatcgtgcaggtcagggcacacatcagcaagacggcagccgaaggcgagacggcagcgcacgcacctgagcacgtgcagccagcagggcacggcgtccagatccgtcttgccccgtcccaggtgtcctcgccgtatcgacgcaggtcacagtcctgctcgctgggacggctgccgtaaccggccgtcccagcgggtgcaggcgctcgaacacaagccggggcggatccgcttcacccctgtcccgagtcgggacagggcgccagagcttcccgccaagacggcacgccagctgcgctgccgtaccgcgctgacctgcacgtgcaacgcacaagacggcaaagacgcccctcacccactacccccaaggagattcccgcttgaccgccccgcacctcaccacgtcatcgctgcagacacgagatgacgtcccagccgaagagcagcgaccgaagcgtgccgacgcagaacagctcgcgctcggcgcggccggcatcgtcatcgtggccctgacagccggagcgttctggctgtcctacgcgcacctcgccgatgtcgccggccagcacgggctcggcgcatcccccatccgccggtgggcttggcccgccaccctggacgcgttcatcgtcgccggcgaactgctcatgctgcgggctgcgctccggcgtacgaccgacctctgggcggtcgccgtgaccgctgccggatcggtcggctccatcgcactgaacgtcgctggcgtcagcggcgcggacaacggacgcagcgttccgctcctcgactacgtggtcgctgccgtccctccggccgccgcgatggtcgcgttcggcgtgctgatgcgacagatccaccagcttgtggcaccaaccgatgccccatctggtatcggctccgtagctgtgcggaaccggccggtcggtgagcacagtgagggccgatggcaggacgctgccgttgacgatccgtgcccttctggcgaggagcggacggaatctacgcccccggtatcagaggccaaaccagtcggcggccgtcctccgaaggcgaccatcgcggaactgaaggccatcggccgggccaccggtcgccagcacggcaaactcacgcgtgacctgctgcgagctgccgttaaggaacggaatctgacgatcggaagcgcgcggcagaccgaagtcatggagtcgctccggccggaactcgaagccgctggcatcaaggtctccggaggctgacgcctcgcgtgctcgggtgaccggaacccttccggtcacccgagcacccgccggtcgccccgcagatccccacaacctgtggacaacgcgatggctcgcgccaccgggtcgccgtcatcctgtccgccgagccgcatctggagcatcttccatgcagcacagccagcacctacctgacgacacccccgctgagctgcccgcctcgacacggcttcctacgctgcggtcccgtctgcgtcgggcatttgggcggatggccccgggcggagccagtagtagcccgagtccgactcaaggccagtcttcggggatctccgccccgggggtggcggagacggcccagcgccagggggcgcttggccgggaggtcggggctgagggcggccccgaccaggacgagctccacgccgtccagcagcagatccttcgccccgcacatgccaccgacccgacggctggcgaacgagcaccgcagagcgtgcagccgacgattcgccgcttcaccggcaccaagcggactgtccgtgtcggaccgctgcgcttcaccggcgacgagcacgccgcgctccaggaggccgcggccgagcacggctacaaaggggaatccggcttcaccgcggacatcgccctcgccttcatcaccggccggttcaccgcgaacctgccgctgtccgaggaccgccgccgcacccacatgttccgcgcccaggtactgcgcgaactcaaccggatcggcgtcaacgtcaaccagatcgcccgcgccctcaacagcgacctcaccccgcccgacgtacgtcaccgtctcgacgagctgcaccacctgctggacctgatcgcccaggccctgcgtgaaccagctgaggcggagaaggagcaggccgcgtgatagccgccatcaaaccggccggtaccaacacccgtggcctgctcgcctacctctacggccccggccgccacgacgaacacctcgacccgcacatcgtcgcgggcttcgcgatgctcggcatgcccgaccccggacgaaacccggacgccacccttacccagctcgcccaccacctggacgaacctgtgcacctccggaacagcgagttcgggaagaagatcaccgaccatgtctggcactgccccgtccgcgcagcccccgaggaccggcacctctccgataccgagtgggccgacatcgcccagcgcatcgtcgaagccgcgggcatcgccccgcccggcgacgacctcggctgccggtggatcgccgtgcgccacgcggatgaccacatccacatcctcgccaccaccgtccgcgaagacggccgccgccccaagctccacggcagcggcatccgcgtcggcgacgcctgccgccagatcgagaccgactacggcctgcgccaactcaagaagggcgaccgcaccgctggaaagcgccccacgcaggcagagatacacaaggcccaacgcctcggctgggagcagaccagcggcgactggctccaggaccgcatccgcgccgccatcccccacgccagcaacgccgaggaactcctcgcctacctcgaagccgacggcatcgcgatcaaaccccgccgcggaccgtccggagacctcctcggctacgctgccggccgccccggcgacctcaacagggacgggaaacagattttccaccccggcggaaggatcgcccccgacctcaccctccccaagctcaaggcccgcctggaaaccaccgcacccgaagaacaccccaccgcacgccgacagcgccccaccaccccctggcaccaggccaccgacgcactcgacaccctccaccagggcatgaccgacgacacccacgcccaggcccacatcacggcgctcggcgaactcatcgaggccaccgcacagaaggcacctgaccactcccgagccgaactgcgaaccgcagcacagaaattcgccc

SEQ ID NO: 3453 - DNA, 4766 bp, Unknown
  Kingdom: Bacteria, Phylum: Actinobacteria, Class: Actinobacteria, Order: Streptomycetales, Family: Streptomycetaceae, Genus: Streptomyces
gcccgacaccgccacccagccgctggcccagatcaccaccaccgccgggggactgccgaagcgtcgtcgtaagagcccggtctccgcggtgccatcggcggaaccgcagcccgtgcgcaccaacgaggagaccgcctcccgactcggcgcgttccagcgcggcacccggtccggacgcgacacgacgacgacggaaggacccgagttccagtgaaccccgatctgtcctgggtgctcaacgacctgctccaggtgcccggcgcccggcacgcgatcctggtgtccgccgacggcctgctgctcgccaactccagcgagatcggccgggacgacgcggagaccgtcgccgcggcgatgagctccatgcagtccctcagccgggccgtcgcccccttcatcggaacccgtgagccgggccgctggcggcagacgctcctggagtacgaggacggctggatcttcctcatcgccgccggcaccggcgcctacctcgccgccaccgccgccgccgacgtggacatggaggcgatgtccttccggatgcagcagcaggtcaccgcactggggaaggcgatgaccacgccgccccgccagaacgcgagcagcgacatatgacggcgccgggcgaggagcagcaggtcagcagcgggttcgtccggtcctatgtcatcaccggcgggcgggggctgcccgacgcggaggatctctccctcgtcaccctggtcaccctcgcacccgaccgtcagccgccgccgaaccccagccccgaggtcaaggcgatctgggagctgtgctccggcggctatctctcggtggccgaggtcgcggggcacctcggcctgccggtcggggtggcccgtctcctgctccaggatttaaaccagcatggacacctgctgcgccggaaggcgccgccgccggcccagctcgttgacaggaagatcctcgaagaggtgttgcatggactccaagtccggttcggctgagagcatctatgtgccggacgcggtgcagcgcgcggcgaagatcctcgtcgtcgggcacttcgccgtgggcaagacgacgctgatcggcacactgtccgagatcaccccgctgcgcaccgaggagcggatgacccaggccgcggcccaggtcgacgatctgcgcggcgcccccgacaagaagacgacgacggtcgccctggacttcgggcgcctcacgctcagcgacgaactggtgctgtacctgttcggcacgccgggccagcagcggttcgtggagctgtgggaggacatggcgcgcggttcgctgggcgcgctgctcctggtcgaccctgcgcggctggccgacacgttccccgtcatcgacctggtcgagacgtacgggctggagtacgcggtcgccgtcaacagcttcgacccgtactcgcagcacgccgagaacgaactgcgcgaggcgctcgacctgcttccggacaccccggtcgtcttctgcgacgcccgggaccagaactcctccgctcaggccctgatcattctggtccgccaccttctggcgcacgccgcctgacgcacccccagacgtatcccgagccggggccgaccgggccccgcgatcacaccgaggaagccgacatggacccgcagccgggagccaccccgtacagcgcccccgccgggtgccccgtgcaccagcagcaggcgtcgctgtacggaccggagttcgccgccgatccgcaccgtttctacgacgcggcccggacgcacggccccgccgctcccatcgagctcgcgcccggagtggacgccacgctgatcgtccagcacgaggcggcgctgcgggtgctgcagaacccggcgctgttcgcccgggactcgcggcgctgggccgcgctgcgcgagggtgccgtccccatggacagtcccgtcctgccgatgatggtgtaccggcccaactgcctgttcaccgacggcgcggagcacctgcggctgcgcaaggccgtcaccgagtcgctgtcgcggctgaacagcagcaggctgagccgggacgtcgagcggatcgccgactacctgatcgaccagttcatcgagcgcggcaccgccgatctgctcaacgagtacgccaagctcctgccgctgctgctgttcaaccagctcttcggctgccccggcgacatcggcgaccggctgacccgctcgatgtccgccatcttcgacggcgaggacgtgctccgcgccaacgccgagctgaccgagtgcctgatggaactggtcgcgatcaagcgccgccagcccggtgaggacatcacctcttggctgatccagcacccggcggggctgcgggacgaggagctgaaggaccagctggtgatgctgatgggcgcgggcgtggagccggagcgcaacctgatcggcaacgcgctgctgctgatgctcgcgggcgaccagccgggcgcacccgagcggcgcggttcggggctgctcgtggaggacgcgctggacgacgtcctgtggaacaacccgccgatcgccaactacgcgacgcactacccggtgcgggacatcgaactgaacggggtgacgctgaaggcggagacccccgtactgatcagcttcgccgccgcgaacagcgacccgggtctcaccgacgcccgccagaccctgagcaagggcgcccacctggcctggggtgcgggcccgcacgtgtgcccggcgaagtcgcccgcgacgctgatcgcgctgaccgcgatcgagaagatcctcaacaccgttccggacctctcgctggccgtgcccgcctcgggtgtggcctggcggccgggcccgttccaccgggcgctggtcgcgctgcccgtacggttcaccccgacggccgcgcggcgtgcggggaacggggtgcaggccccggcccagacctccgcccaactgcccgacccgttccggaacgcaccctccgcaccgtccgtgacaccccgtcacgcccaggagccggccaagaagcagaagggctggtggagttcgttcctcgacgtgttccgcgtatgacccacaggacgacaattcgcgtatgacaacgggcatttagtgacgattgcatgtgacgggggcaacatggaacgatgcttggcgtcgatatccggaggggtaggttcagggcggtaaccatgggcctaggtcgaggaactctgcgtgagcatcactggcggtacaaccaggacgcccgacggacggcgcgcggtcatcggtctgctccgcagactcaattccccggaaggacaggccgagccgtacggaatactcgcggagctgcggacgatgggtgacgtcgtccgcgctccgtggaacgggtatttcgtcaccggcttcgacgcctgcagccaggtgctccggggccgcaactggctcgtcccggatctcgcctggcaggagcggcaggaggactccaagcagtgggacgcgatcgcgacccgggagatgaccaccaccctctcccggctcaacgcccccgaacacacctgccagcgccgctcgctgggcaatctcttcgaccgttccaccatcgaacgcctcacccccgacgtcgagcgcgacgccgaccggctgcttgacgagctggcggagaagctccgctggggcgaggccgacttcgcctccaccgtcagcgagcagctgccgatcagcaccgtcggcggctggctggggataccgcccgaggactacccggacatcctggagatcacccacaaccaggtgttcgcccaggaactgctccccaccaagtcgcagctcgccgtctccgccgaggcgaccctgcgactgcgggcctacttcaccgatctggtggcccgccgccgggcggagccccgccacgacgtgctgaccggctggatccacacctgggacgcgatggagccggaccgggagcgggcggacgagatcctctaccgactcaccatgttcgtcaccatcgcctcgctggagaccaccgcgacgctgctcacctcgatgacctcccggctgaccgagcccggccggtgggcgtggctgcggaagtacccggaacacatcgacgcggccgtcgacgaggtcctgcgccacgacccgccgatccacatcaacacccggatcgccgccgaggacaccgtcctggccggggtcccgatcaagaaggacagcatgatccacgtcctgtacggcgcggccaaccacgatccgcggcggaacccggatccgggcgccttcgacatcctgcgtggcggcagccacctcaccttcggcggcggggtgcactactgcctgggcgcggcgctggccaagctggaggcacggacgctgctggcgcggatgctggatcgtttccccaccctgcacaccgtctcgcagccggtgtacgcaccccggatggtcttcagacggatcacctccctgggcgtggccctgtgaagctctcgctgcccgacttcctgacccccgccggccgctccgcgacggtacgcacccggcgcgaggggcccgtcctgcaggtcgaactgcacgcgccggacaccggcaacgcggtgaccgaggcgatgctcgacgagctgctcgacatcgttgccgtcccggaccccgaggtgcgggtgctggtgctcagcggcgcgggggacgacttctgcctgggcggggaccgcaccgagttcgcggggtggctggaggaggatcccgccggccgaggcatccgggtcgccggggagaaggcccgccgggtctgcgaggcgatctccggcggccgggcggtgaccatcg

SEQ ID NO: 3454 - DNA, 1748 bp, Unknown
  Kingdom: Bacteria, Phylum: Actinobacteria, Class: Actinobacteria, Order: Streptomycetales, Family: Streptomycetaceae, Genus: Streptomyces
ttcgaggggcggtacggacgcgacggcgccgagaagaccgcgccgggccagccaggtccagtgcggcccgcgccggtacagggcgtgcgggccttcgttggcccggtacggcccgtccgcggtcctggcccggccgccgagcgtccggtggccctcgtgcagggtgacgcgcgcaccggactcggcggcggtgatcgcggcggtgaggccggcgaggccgccgccgatgacgtggatgtgttccatggctggatctccttcgcatctttgatgatgcgacggatcggggacggcggctcgtgacacggtcgccggggcgttgtcagtggggtgcgtcacgatggggtcatggcagcgagcgcgggcaggacgaccaggacgaacaaaggcaagaaggacaccgtcgcggcggcgcggcgtccggaggtgcggctgccgccgctcgttccctacgacggcgggggcctggagccggacggggactacgacggggtgcggttcgagggggtggacctgacggacgcgtcgggccggggggcccggttcatggactgtgccctggacggctgcgccctggaccgcgcggagctggcgcgggcccgcttcatcgacgcggtgctcacgggcgtacggggtgtgggcaccgatctcgcggaggcgtcgctgcgggacgtggaggtggtggacgcgcgcctgggcggggtgcagctgcacggtgcggtgctggagcgggtggtggtgcggggcggcaagatcgactacctgaatctgcgcagggcccggctcaaggacgtcgtcttcgagggctgtgtgctctccgagccggacttcggggacgcgcacctggtccgcgtcgagttccgggactgcgtgctgaagcgggcggacttcagcggcgcccggatggagtcggtggacctgcgcgcggtggccgagctggacatcgcacggggtgtggaccggctggccggcgcggtgatcagcccgttgcagctgatggagctggctccggcgttcgcggcgcagatcggggtgaaggtggaggcgtgaggcccccgggcggccccgggggtctcacagacgagggaagcgggcctggaggtcccagatcacggggttgtcggcgaggccctcgtgcatgtcggccaggtcggcgatcaggtcgtgcaggaagtcgcgggcctcgcggcgcaggagggagtggctgaaggtgagcgggggctcgtcgccgggcatccagtccgcctcgacgtcgacccagccgaagcgccgctcgaacagcatccggtccgaggactcggtgaagtccagctccgcgtactgctgtcggtgcgagcggttgccgcgcgggtcctggtcgatctgctcgacgatgtcgcacagcgcccacgcgaagtcgagcaccggcacccatccccaggctgtggacacctcgcggtccgccttggtgtccgcgaggtagacgtcgccggagaacagatcgtgccgcagcgcgcggacgtccgcgcggcggtagtcggtctgcggggggtcggggaagcggcgggagagggagtagccgatgtcgagcacggatcgatggtgtcatgcccgtccggggcggtcggccacgatcgggtgagcggctccccgggggtccgctccgggaggctttgcccgacggccgcgggcctcggccgtcggacccctccgcggcggaccgggcgggccacgcgccgagccctacgacagcaggcgctgctccttcg

SEQ ID NO: 3455 - DNA, 5138 bp, Unknown
  Kingdom: Bacteria, Phylum: Actinobacteria, Class: Actinobacteria, Order: Streptomycetales, Family: Streptomycetaceae, Genus: Streptomyces
gcgcccgccctgtggaccggagccgtcgtcggcgcggccgctctggtgctgctcgtgctggtggcggcgcgctggtcgccgctgatgtcgctggaccggtcggtcgccgacgcgctgcaccggcacgcggtggacgacccgggtctggtccaggtgagccgggtgctgacggactgggtgtgggatccctggaccatgcgcgccctgatcgccgcggtggtggtcaccttgtggtggcggggtgcacgcccgctcgccctctggttggccgcgacgagcctgatcgcctctctcctccagcaggggctgaaggcggcggtggaccgggagcgcccgcggtggcccgatccggtggactcggcccactacgcggccttcccctccgggcacgccatgacggccgtcgtgagctgcgggctgctcctctggctgctgtggctgtacggcgcgggggccctcgcccggggtgcggtgctggccgtggcggtggtctcggtggtcggtgtggcggcgacccgggtgtacctgggagtgcactggctgaccgatgtggtgggcggtgcgctgctgggggtggctgtggtggcgttgagcgccgcggggtacgcccggtacacggcggcccgggagggcgctcttgtcggcgcgggaacggacggggaaggatcgcgcccatggtgatcaaaggcgtgctgttcgacttctccggaaccctgttccgtatcgagccggtccgggactggctcgacgccgtactgcgtgaggagggcgtcgacgtcaccccggaggatttcgagcggtatgtgagcgggctcacccaggccggcgctctcccgggcggcccgtccccggtcccggtccccgaccggctggccggggcgatgtcccgccgggacctgagcgccgccctgcaccgcgaggcgtacaccggtctggcccggggtgtcgccctacccgagccagggctgtacgacgcgctgtacgaccgccatatgcggccggaggcctggcggccctatccggacgccgcggaggtgctggcggggctgcggagggcggggatcgcggtctgtgtggtcagcaacatcgggtgggacctgcgcccggtcttccgcgcgcacgggctggacgccctgatcgacgcctatgtcctgtccttcgagcacgggctccagaagcccgacgcgagactgttccgcatcgcctgttcgctgatcggccgggacccggcggaggtggtcatggtcggtgacgaccgggtagcggacgggggcgcggcggccctgggctgcgaggtccggttcgtggaccacctgccggtcccggagcggcccgtcggcctgcgctcgctgggtctggtgccgggctgaggcccccagcggacatcagagatcgggccggggtgtgaggcatatcccgccgcgaagggggtataggcaggcgctcgtggccgtagcctggtggacatgtccccgatgtcgtcgtccgtatccgcacgttccgcagccgaggtcaacgcggagatccgcgacctgtggcagcgttcgggcgggtgcctgacgccgcaggacgaggcggagtaccagcggctgctggtggagtgggccgccgccaccggcggaagcgtccgcaccgccgcctgaccgtcgtgccgccgttcgccggcgccgagagcccgtacggagatcgcgcccgatccggcgatcccccgcgtcgccggatccgggcgcacccccggcgtgcctcgtgggacacggccgcggaccgcgccggggaccggagttgcggagtccgccgtcgcagggatccagcatgtccccacccggctcatcggtcaatgaatttccggcggcacacgcggcggggccggtgtctcccgggcggacgtccgcccgggagacaccggcccctgcgtgcagaaaccagggaccgcaggtcctttgagggatcagcggtcgaagtagtccggctgcgtctgcgcgttgagctcgtccagctcgacccgctcggccgggtcggtgcgccggtcgtccagcttcagcacgtcgaagcccttggcgatgtcgctggagtagatgtggccgttgtagtagtacgccgaccaggggccggccgtggtgacctggtccagcgtgaccggaccgcgctcgaagaaggcgatctcctcgggcttcgccgagtcggtgaagtcccatacggagatgccgccctggtaccaggcctggaccatcaggtcgcggcccttcaccgggatgatcgagccgttgtgggcgacgcagacctcggcgtcggcctggtggcggtcgatcttgaagtagctacggaagaccagcttgcgcttgtcgcccttgccgacgatgtcgtagatgccgtcggcaccccgctcgggcccgatctcctcgttgcaggtggccgcgccgccgccgccgagctcgtcggtgaagacgaccttgttcgcaccctggttgaaggtcgccgagtgccagaacgcgaagttcacgttgtcctggacgcggtcgatgatcttcgggttctccgggtcctcgatggagaacagcagaccgtcacccatgcaggctccggccgcgaggtccttggacggcagcaccgtgatgtcgtggcagccggtcgtcttggagaccccggggttctgcggcgctccggggttgccgccgtccgggaagagcaccgggaagttgacgatccgggccttctggggcgccttgaccggcaccttgatgatggagatcccgtcgtgcggcggcttgcagtccgggaacgtctcgttgggcgagtacgaggagacgtacacgtacacgttcttcttgccgtccggcaccagcgtgtgcgtgtgggaaccgcaggcggtctccacggcggcgatgtacttcggctgccgcttgtcgctgatgtcgaagatcttcatgccctcccaggaggacttctccgtggcgggctgggaggtgctggagcaggagtcgtcgctgcgcgaggagtccgtcgacaggaacagcaggttcccggagaccgagatgtcgttctgcgaaccggggcagaggacctgcgagaccgtcctgggcttcttcggcttgctgatgtcgtagatgacgaagccgtcgtagttgccgacgtacgcgtacttcccctggaacgcgaggtccgtgttggtgcccttgagggcgcccttcggcacgttcgtcaggtgcttgatgttggagctgtggacgatctcgtccacgccgggtatgtcaccaccggttatcgcggccctggcctcggcctgctcgctcttggtgacggaaccgcgctcggccggggcgtcgcccgggtcgggggtcgcggccgctgtggtggccgtcagcagcgtggcgaggagtccggctgcggctgccaccgcgcccagacgtctgcgccgcacgcgggtggtgtgcaacgaggtcactgcgtcctcccttgtctccgttcgggatcgaacggttcatgaacccccggcagtatcgtccctcccatgtacacatcaacagatggcaacacagacgtaatgaaagtttttgatcttcacccggtggaagcgtgttaggacggtctgcaacaaaccatgtggcacaggaggtcgtcgtgttgatccatcgccggtccgcaactctgcgctcaaccgctctcgcggcggcggcggttgccgccgtgctcgccctgggagcctgtgacgcggacagcggtgacggagcgtcgggcaaggcacaagacgcaggtccgggcgtggtagcgcccggcagaccgggcgagcccgcccggacgctgtccgccgaggaagccgtcaaggaggccggtcaggacaccgccaactcggccgacttccgctatgcgcagatgatgatcgaacatcacggccaggcgctcgtgatgaccggactcgtcccggaacgtgcctccgccgacaccgtcaaacggctcgcggaccgcatatcggcaggccagaagccggagatcggcgcgatggaaggatggctgaaaaggaacggcggcgaccggcgcaaggagcaccacgaccacaccgggatgcccggtatggcgaccgatgcccagatcgagaagttgcgcgccgccgagggcaaggccttcgacaagctcttcctggagctgatgatcacccaccaccagggggcgatcaccatggccacggaggcgctcaccgaggggaacgacgtcatcgtcgaggagatggcgagcgacgtggtcgcccagcagaccgtggagatcaaccggatgcgcgggctgatggactgagccactcggccgaccgccccgtgcaccgggcggtgcagatcggcccggcggtgccatcctggaaggaacctccgggaagaggtgcgccgtgctctccgtcgccgtcgtcggttccggtcccagcggggtctacaccgctcaggccctgctccagcagtcgctcgtgcccgatgtgcgcgtgcacgtcctggaccggctgcccaccccgtacggactcgtgcggtacggggtggcccccgaccacgagaagatcaagtcgctgcagaacagtctgcgcgcggtgctggaggacgaccgggtcaccttcgtgggcaacgtcggcgtcggcggtgcggaaggagtctcccccgcccggctcgcggagctgtaccacgcggtcgtctactgcgtgggggcatcggccgaccgggcgctcgcggtgccgggcgagagtctgccgggcagctactccgccacccgcttcgtctcctggtacagcgcccacccggacgtcggcgccgacccgttcgtcctggacgcccgctcggccgtcgtgatcggcgtcggcaatgtggcggtcgacgtggcccggatcctggcgcgcggcgccgaggagctgcgggccaccgacgtgccccgtgcggcgctgagcgcgctggaggacagccgggtgcgcgacgtgcacatcgtgggccgccggggtccctcccaggcccggttcaccaccaaggagctgcgggagctgggggcgctccccggggcacgggtcgtcgtcgacccggcggaactcgcgctcgacccggcgtacgccgctccggacggcctgcccggagccctgccgctgcccgccgcggggcggcggaacctggagg

SEQ ID NO: 3456 - DNA, 3439 bp, Unknown
  Kingdom: Bacteria, Phylum: Actinobacteria, Class: Actinobacteria, Order: Streptomycetales, Family: Streptomycetaceae, Genus: Streptomyces
gccgcgacccggctcctggacgcgggcaccgagcaggtgaggtccgtggtcgaggagatgatgcgcgactaccggctggacaaggacaccgcgctgctcgtcggcgggggcggcggcgcggcctccgtgaccccgcatctggcggccgtcaccggccaggagggcaggatcgcccagcacaacgaggtgatcagcccgatcggcgtggccctggccctcatccgggagcaggtcgagcgcatcatcccgggggcgggccaggagcagatcctcgccgtgcgcgccgaggcggaggccgccgtcatcgcccagggggccgccgccgacggggtggaggtggaggtcacggtcgacccgcagaccagcaccgtacgggccgtggcgactggcgccaccgaactgcgcacccaggaccgtgcccaccgggccgacgagacggaccggctgcgcgccgccgcgacgagcctgcggaccgatccggcctcggtgcgggtcctcgcgggcacgcccgcccacaccgtgtacggcacggaggtgcaccggcgtttccgggcagaccggcacccggtgcgggtcgtggacgcggacggcgtcgtccggctgcacgcgccggacgcccgggtggagacgaccaccgtggggcaggcacccgaggtcctcgcggggctggtgaaagaggccacgtcatacggtgacggcggtgtccgcgccccggcgctgcggctgctgctcgggtcccggatcgcggatctgtccggggtgatcgacccggatccgctgctggcgctcgcccgcagcgaactgcgcgcccgcgccgccgacgaaccggtcgtcgccgtggtggaggtgcgctcatgagcgccgcgctgctggaccggacggcgctggcggccatctcggcgctggaggccgacgacgacgtcgagttcggcgtacggctgctcgcgaacacgcccacgcacgaggggcgtgaccctgagctgctgcgccactgggcccgtacggccgacgcgttcggtgcggcgctgccgccggtcgccgcgacggcccggatcgtggagagcgacggtggcctcgcgaaggggctcctggcccgctacacctcccggccggtgcccaccgtcgagctgttcaccgacaccctggctctcgccgaggaggtgatcgacctgctcggctggcgggaccgctatccggccgggtcggtccgggcggcggcgatcgcgcacgaggcggtgcacgagcggctccatcacggtccggcgaagaaggcgctcaagcacgccctgaaccacgtggtgctgagcgccggccggcacaccctgtacggccatgtcgcgggcgccgacgagatcgccgcccatgcccatgcccgcacggtctgcggcctgggccgcagtccgctcctgctgacggccgccctggccaccgcggccgaaccgcggcacgggtccgcacccggatccccgcacggaagagagaagtaacgccatgggcgtcgtcatccttcttgtcatggcggccggtgtcgccgcgatgctcacccgcaggctgcccaccgccttcgcgctcgtcatcctggccgtcgtcatcgccttcgtcgcgggcgccccgctgaccggcgagaacagtgtgctcgacacggtcctccaggagggcgcgccggctctcggcgcgacgatgatcgcgatcctgctcggctcctggctgggcaggctcctggacgagaccggcatcgcgggcaccctggtgcgcaagatcgtcgagttcggcggggaccggccggtggtggtcgccctcggtgtgctcgccgtctccaccctggtcggcacggtcaccggttcggcccccgcggcgatgctcgccgggatcatcggcatccccgccatgatcgccgtcggcatccccaaggtcacggccgccgggacgatcctgatgggcatcgccgccggcatgccgttcgagctgcccatctggcagttcttctccaccgcgctggaactgcccgtcgagaccgtgcgcggtttcatgttcaagctgttcccgttcgccctggccgccgccgtcctcttcgtcctcgtcgagacccgcaggcgcggagtcgagcacgcctggtcgctcaagtcggcttccgcccaaccggtttcacgccgcaagcagctgggcgacgccccgtggtacgcgctgctcaccccgatcgtcccgctggtcctcgccctgggtttcgaggtggcgatcctgccgtcgatgctggcgggcatcctgttcgcgctcgtcacgaccacccggccgcgcgagatgaacaagcggttgctgcggacgctgtacggctccttcgaggtcgcggccgctccgatcgtcctgttcatcgccatcggcatcctgctcgccgcggtgaagctgcccggtgcggtggagtcgctggagccgctggtcaaggccgtcagcccgcagaacccggtgctgttcgtcctggtcttcacgctgctcgtgccgctctgcctgtaccgggggccgctgaacgtcttcggtctcggcgcgggcatagcgggcgtcctcatcgccgccggcatctacccggccgtcgcggtgctgggcctggcgacctcgtacaaccaggtcttcggggtgtcggaccccaccagcacgcagaccgtgtggagcgcgcagtacgcgggggtgacgccgcagcaggtgatgctgcggaccctgccgtacgtctgggccgtggcgctcggcgggttctgcgtcaccgccgccagttatctgtgatcgctcatctcttcgggacggagaacgacatgacacagcacgaggacactccggtcgcggccgccgcgacccacccgagccgccgcgtcttcctgcggggcgcgatagccggtacggcggcgaccgccggtctgatcgccaccggcgcgggggcggggagcgcggtcgcggctcccggcggattcccggactaccgccatctcaagccgctgctgacgccttcccagctgaagtacaacccgacgggcgagatcatcttcccgtgcatccggggcgtctacgacaagctggcgaacccgctgggccgctactacctctactacgccccgcacgacgcgcccggtggcatctgcctggcctacggcgactcgctggagggcccgttcacggagtacccggcgaacccgctggtctccaacgactggcagccgcactacaaggtcagccatgtctcctcaccgcacgtcctgtggaacgaggacgtcaaggagctgtggctctacttccacggcgagaaccacacgacccggctcgcccggtccaaggacggcatcaccttcacgtacgaccggaccgtgctcaccaaggacatgcttccgacgggcaccagcgagacgtcctacgcgcgggcaggtcgtgccggaacacccgcgcgtaggacgtctcg

SEQ ID NO: 3457 - DNA, 8035 bp, Unknown
  Kingdom: Bacteria, Phylum: Actinobacteria, Class: Actinobacteria, Order: Streptomycetales, Family: Streptomycetaceae, Genus: Streptomyces
cgcccacgacgacggcgacggggcgtgggctgtcgtcgttcatgcgtgcccctctcgccgggtcggtgcgctgtgccgggtcctcatcctggagatcgtcgcagtcagtgacgcgtcgggccactggagggttgcccaggagccggagctgccggaacgcatcaggctcgccccctggtggtgagccgcgagatgtggcgggcgtccagtccggacagtccgcgcaccgcgacgtaggccttctcgtggccgggcagcgagacccgtccgcgcagcacggcctcggggtcgcgctcgatccggtcgaggaggcggcggtagatcccggccatcgccgcgacgcaggcgccgctgcggcggtcgagcatcggcagcagccggtagccctcggcgaacagggcacgggcgcggcggacctcgaagtggatgaggcccgcgaagtcggagccggggggcggggtggtccggtggaaccctgccgagcagccgaatttggccaggtcgtcggcgggcaggtaggtgcgcccgttggcggcgtcctcgcggacgtcgcgcaggatgttggtgagctggagggcgaggccgagggtgtcggcgtactccgcggcgcgctcggccccgcgggcgcccggcgcggtgccgaagacgccgaggctgaggcgtccgatggctccggcgacgcaccggcagtaggacttcaggtcgtcccaggtctcgtaggtcgcgccgcggacgtccatcaggacgccgtcgatcagctcgtcgagcccgccgagcgggagcgggaaccggcgggcggcgtcggcgagcgcgacggccaccgggtcggtgtcgtcctcgtcgaccgcgtccttgcggatccgctccagcagttcacgggtgctctccagccgggtccgcttggtctccgggtccagttccccgtcgccgatgtcgtcgacgcgacgggagaaggcgtacagcgccgacatggcctgccgcttctcgtacggcagcagtctgatgccgtaggcgaagttacgggcctgctgtccggtgacggcctcgcagtaactgtatgcggcctgcaccggtggcgacatgtacgtcgtctgtccctccacggtccggctcacctctctccacgcgctcttcgcaagacgattcccacttcgcgcagcaggctgggcttggtgggcttgggcggtccgggcagtacgtcgaacccggcggccgagatcgccgtgagcgcgctgcgcccgcctccgacgaatccggcgaggagcagcttgagcctgccgttgacgctacccaccagcggagggccttcatccagcagctcgctcgcgcgctgggcctcgtacgcgatcagggcgcgcacggaggctccggcggagggcgcggccaggtcggattcggcgacccggaagcgctccatgtcctcggcgggcagatagatccggtcgcgttccaggtcctcggccacgtcctgcaggtgctcgacgatctggagcgcggtgcagaccgcgtcggagcggcggatgcgttccgggctcgcggtaccggtgagggcgaggaccaggcggccgaccgggttcgccgagagctcgcagtaggcggcgagatcggcgtaggtgccgtaacggcggatcctctggtcctggcggttggcctcgatcaggccgaggaagggctcgggggtgagcgcgcggcgccgcaccgtggggcgcagcttgcgcagcaacgggtggtgcggtccctggccggtggtggcgaagacccggcgcagatcggtctcgaaggcgtcgagcatgacgaggcggtcgtcgctctgctccggctccaggccgaggtggcgggcgtcggcgccgccgggggcgaggtcgccgtcgccgatgtcgtcgacgagccgggcgaagccgtagaccgccatcaggtcgtcgcgccaggcgcggggcaggaagaagggcgccacggggaagttctcgtccgcggcctttccgagggtggcgtcaccgatgcgcgtgtcgggggtcgaggtcactgcggaccgcccggcgcggggacggcgaaaccacgccggagctggagatcttccgtcattgccgtcacatctcccgttctacactgctgacccaaaacaacccttttcggacacgccgctcagccttccgagtgcactgcggcagagcggccggtgccggggcgtatcgccctacttgccatgaatcagcaccgctacagcttacgttgtacagctcacaggaggtcggcggggtggagcgcccgccgccgtttcccggccatgctcgtcaaccttccccgcgcgcagtggaattgacgtcatccgccgggaggagatcgcccctggggcctcctgcggacgttccgcacggcgccgggcaccgcacggcccccgccggaccggtccgacgggggccacggagaaccctcgggctacttgcccgtttcgcgctcgtacgccttgaggacttcctcggtgggaccgtccatcaggagttcgcccttctccagccacagcgcccggtcgcaggtgtccctgatcgacttgttgttgtggctgaccaggaagacggtgcccgcctccttgcgcagctcgcggatccgctcctccgagcggacccggaacttgcggtcaccggtggccagcgcctcgtcgatcatcaggacgtcgtggttcttggcggcggcgatcgagaagcgcagccgcgccgccatcccggaggagtacgtccgcatcggcagggtgatgaagtcgcccttctcgttgatgccggagaattccacgatctcctggtagcgctgacggatctcgtcctggctcatgcccatcgccagcccgccgagcacgacgttgcgctcaccggtcagatcgctcatcagcgcggcgttcacaccgagcagcgagggctgaccgtccgtgtacacctgtccggactcggtcggcagcaggccggcgatggcgcgcagcagcgtcgacttgccggagccgttggtgccaatgaggccgatggcctcgccgcggtaggcggtgaaggagacaccgcgcacggcgtgcaccttccggacgcctcgcggctcgcccttgccacgccgcatcatgcggctcagcgcggcggtggcgctgccccggccgccacccgtgccgttgacccggtacacgatgtgcacgtcgtcggcgatcaccgtggggatgcgcccctgtgcgttgtcctcagccacggccgtaccgttcctctgccttccagaagtacacgaatcccacgacgcccagcagcacggcccagcccacgccgacggcccagacgtggtccggcaggttctcggagccgtagccgtcgatcagggcgaagcggaccaggtccatgtagatcgccgccgggttgtactgcagcacgtccgcgatccaggccggtttgtccttgagcatcaccgggatggagaacatgacgccggaggcgtacatccaggtccgcatgacgaacggcatcagctgcgcgaggtcgggggtcttggagccgagccgcgccatgacgagggccaggcccgtgttgaagaagaactggagaatcagggcgggaatcaccagcagccacgacagcgagggatagctgccgaagatgacggcgaccgcgaccagcacgatcatcgagaacagcagctgctggagctgttggagcgagaaggagatgggcagcgaggcccgggggaagtggagggcccggaccagtccgaggttgccggagatcgcgcgaacgcctgccatcaccgagctctgggtgaaggtgaagacgaagacgccggtgaccaggaacggcacgaagacgtcgtgggaaatcccctccctggtccccagaatcagcccgaagatcaggtaatagaccgcggcgttcagcagaggcgtgaccacttgccacagctggcccagtttggcctggctgtactgcgcggtcagcttcgcccgggagaaggccaggatgaagtggcgtcgtccccagagctgtcgcatgtatgcgaacagccccggcctggcgccgctcacggtcaggccgtacttggcggccagctgggccgcgtcgaggccctcgtcggcggacggcggggtcccgagggctaccccaccgtcgtgggtcgtgtcactcacaagttgaaactctcgtcttcacgcgcagccagtcgcgggcgcggctcaggcggacaggttccggaaagaaaatacgcctcatgctctcagaggaaagcctctcagatgaccggaggtcggcccagcctcgtcagccgccacaccgtacgccacttcatggggcgccggggcccgcagggggtcgaccagccttcccggaatccgccgaaccatgccttcagcgcgggtgccgaaggacgtctgaccagggtcagcagcagccagacccccagatagagggggaccagcggagcgggcaggttccggcgggcgagccagacccggttgcgggcgaccatgcggtggtagaccgcgtgccgggacggggcggtggtggggtggttcagcaccatgtccgcgcgatagtcgatcatccaccccgcgtccagcgcccgccaggccaggtccgtctcctcgtgggcgtagaagaattcctgcggcagcggaccgacgtcggcgatgacccgggtgcgtacggcgttggcgccacccaggaacgtcgtcacgcgcgaggagcgcatcgggtcggcggcccgcagccggggcacatgcctccgctgggtggcgccggtgtccggatcggcgatccggaaggtgacgatccccagcttggggtccgccgcgaacgcctgccggcacagctcggcggtgtcccggttcgggagcagcccgtcgtcgtccaggaagagcagcgcgtccacgtcggcgccggaggggccgaacgcctcgatgccgacattgcggccgccggggatgcccaggttctcgggcagttccaccgtccgcacccccgcgggcacatcggggaccggggctccattgcccaccaccacgacctcgatccggtcaccgtgctgggcggtgaccgaatcgaggagggcgcgcagctcgtccgggcggttgcccatggtgatgatcaccgcgcccagtttcatgggaagggtcacttcagcctgctggacgccaggacggacaccaggtgcagcagggtctgcagcagcgcgatgccggccatcaccgcgacggtcaggcgggtgtagaagaggtcgcccccgatcgcgtcgatcacggccaccaggaggatcaccagcgaggcctcgatgccgaggatcagccggtggaacttgagcgccccggccgccctgcgtgccagcgccatgccggaggagcgcggctcggacgccgcctccttcaccggcggcatcccgccctggtggcgggccaccccgaccaggtccgtctcggccttgatgaggatcgcgccgagcgcggcgagcgtcccgaggaaggcccagagccagtcgatccggccctcgccccagatgtcggcggcgcgcaggccgaggccgacgagcaccgccgcgtcgcacagataggcggcgacccggtccaggtagaccccgctgagcgagtactgcttcttccagcgggccagctcgccgtccacgcagtcgaacagcaggtagagctggaccatcaccacgccgagcacggcgccccagatgcccggcaccaggagcgccggggcggccagcgcgccggccagtgtcatcacgtacgtgacctggttcggcgtgacgcgggtgttgaccaggtaacggtccacgcgcagcgagatctcgcgcatgtacatgcgcccggcccagtgctcgccgctgcgccggtccttcacccccggggggtgaacgaccggacggagttcagctactgatggtcgtcgcatagtcggcgtacgcgtccctgatctggtcggtggacaggttgaggtgctccaggatcgtgaagcgtcccggacgcgtctgcggcgcgtagtcgacggcctcgacgaactcgtcgacgctgaacccgatctcctccggcaggaccgggagaccgtggcggcgcagtatcgatgccatcaggagggattcctgacgggcaccgcgcagatgcatggcgaaacaggcgccgaggccgacctgctcgccgtggctggccgcgcgctgggggaacagcaggtcgaaggcgtggttgatctcgtggcaggcgccggaggccgggcgggagtcgcccgcgaccgacatcgagatgccggtcagcacgagcccctcggccagcaccttcaggaaggcgtcgtcgccgaccccgccggggtgacgcagcacggcctcgcccgcctggcgggccatcgcggccgccagaccgtcgatctcctcgccgttgacctcgtgggccagctcccagtcggcgacacaggagatgttcgagatcgcgtcgccgatgccggaacggacgtagcgggcgggcgcctcacggatcacgtcgaggtcgatgaccacggcgatcggggtggggaccccgtaggagccgcgcccgttgtcgttgtccagcgtggcgaccggcgagcacaggccgtcgtgcgagaggttcgtcgcgacggcgaccatgggcagtccgacccgcgccgcggcgtacttcgccacgtcgatgatcttgccgccgccgaggccgacgacggcgtcgtaccggttgcccttgatgccgtcggcgagcttcaccgccgagtcgatcgtgccgtcggacaccggataccagtcggcacccggcaggaccggggcgagcctctcccgcagggcgcgcccggagccgtcgctgatcgcgatggcgagcttgcccgaggaggagatccgctgatcggccaggagacccgccagatcgtccatggcgccgcgccggatgtcgacgacgaccggggacggaatgagccgggtcagtactggcacgcgatctcacggcccttcttgaggtcgtcgtggttgtcgatctcgacccaggtcacggtgccgatgggggccacgtcgacggtgaagccgcggcccacgagctcctggtagccgtcctcgtagtacaggtcggggtcacgctcgaaggtggtcttcagcgcgtccgccagctcctcggcggcctcggcctcgatgagggtgacaccgatgtactcgccggtcgcggtggccgggtccatcagcttcgtgatgcgctggacgcccttgccctcctccgtgatgaccttcatctcctcgtcggcgaggaccttctcggtgtccagggcgaggatgatcttctggcccttgccgcgggcgtccaggagggtcttctcgacggagaccgggtgcacggtgtcgccgttggcgaggatcacgccgcgcttgatgacgtcacgggcgcaccagagggagtaggcgttgttccactcctcggccttgtcgttgtcgatgagcgtgagggtgacgccgtaggtcgcttccagctcggccttgcgggcgtagacggcctccttgcggtagccgacgacgatcgcgacctcggtgagtccgacctcggcgaagttggcgagcgtcaggtcgaggaccgtcttgtcgccgtcgacagggacgagcgccttgggaagcgtgtccgtgtaggggcgcagacgtcgtcctgcaccggctgccagtacgaggccgatcatgcgagttctccttcgtcgtgtacggcgggggccgaggaggacacccagaagcggatggactccacgagcaccaccagagccacggcgaccgcgagcgcggtcagggccgtggtgaaacctggggtgtgggtgagtacggcggcgaggacgaccaccagtgcggtccggccctcgtgtccaccgatcgtccgcaccagccactggggcggcgcgccggtgcctccgcgaatgcggtacaccgtgtcgtagtgatggtaggcgacggccgagaccagtccgaaggccgccggaacagcgtggggaacgtcgctgcgggccgccagcaccaggatcgtgacgtactccgcggcccggaagaacggcgg

SEQ ID NO: 3458 - DNA, 1188 bp, Unknown
  Kingdom: Bacteria, Phylum: Actinobacteria, Class: Actinobacteria, Order: Streptomycetales, Family: Streptomycetaceae, Genus: Streptomyces
gtgcggggtgcgcggtgtgccgctgatcgtcgacatcgacggtcaccagccgtccgcgggccgggtcggtggcgcgacggacccgctgggcgtccagggtgagcgtgaagtcggcgagccggacgtgcgagcccgggacgccctcctggaaggtcctcagcagccgccccagccggtccccgagcgccttgccgaccgcctcggcccgcttctgggcactggcccgggagcggttgccgtgtccggtgacggtgaccgtgggcaggggcaggccgttggcgtggttccacaggccggtacgggccagggagagggccagggcgtccaggttctcgtccgcgtccggcgacagtgtgtgctgctgctcggcgaaccgtacggtccgctggtccgggcggagcgcgtggccgtgcagggcgaccgtggtgagcggattggagacggcgggcgaacgctccgacagcagcgccgcgttgacctcgtgggccgactcgccggggcgcttgctgtaggcccggaagaaccactggtccttttcttcccctaccggtgcggcggaccgcacggcgtcccgggcgcgggcgcgggcctggtccacctcacgctgggccagggcgtgttcgggacggtcctcggtgaagtaccaccgcacgtgctcggcctcgtggacggcggccagggcccgggccgtgcgtgcgaacgattccaggcgggcgacctccaccggggcctccccgtcacgccgggcggtcgcggcacggccttccgactcccgtgccagtgcgttcagtcgggcctcgtcgtagcggccgaggttctcgtcgacgaccgcgtcgagctggtcggccgggagcggtgtgcgggagtgggtctcgttctccagagtgatctggtgggtgccgtcctcgctggccagcaccacctgcgcgaagtggtacggggcgtgcggaccgaccgggtcgccgggcttggcgtggttgtgggtgaagagctgcgcgccgccgtcgttggtggtgctgaccgactggatcagatagccctcgccgacctctgcccaggcgtactcattgaccccggcacgggcggcggcctgtgtcagcggtccgcgccacgcgttgtcctgggtgtggctgagtgctcggccgtatgcctcgcccggggtgggcgcgcccaccactccgccggtga

SEQ ID NO: 3459 - DNA, 2727 bp, Unknown
  Kingdom: Bacteria, Phylum: Actinobacteria, Class: Actinobacteria, Order: Streptomycetales, Family: Streptomycetaceae, Genus: Streptomyces
ggggtgacctggaccaggggcagcaggcagcgggcggcggcggtgagcgcgagggggtcggcgtccggccaccgggcgaggagctcctcccgcagctccttcaccgggcgggggcgctccacgaccagttcctcggccaccgccgcgagccggtccaggtccaccccttccagcccgcgccggaagttcttcagctcccgctcgcgtgccgcctgcaccaggggacgcagggtgagtgcgtcgtccgccgtatgggtgtggagggtggagcggagggtgacgatccggaccacctcgcgggactccatcagggcggacagctcttcggggtcgaagtccgtgagccgggcgtacagctggaagtacggaggcttggtgttctgggcctgaaggccgaggaggtgggcgaccgcgtccttcgcggacatcgccgaccggtgcagcaggagctggcggtccagggtcgcccggttcagtgcgcgggtggagaggacggtggggtgtgcggcggtgcggtgcgtcttcgctgccatgggccgcacgttaccggtgcttgcggacagctacggtccgcaagcggtggcgggcgtgcgttacgcccaccggacccgtgagccgcgcgctcccgcgtgcggccgacgcgtaccccgtcggcggcgggcacgctcgcaccgcgcgaccgccgccaccccccgcgcctcggtgaacgcccgggtcaggcggcggccacgggggtgacccgctcgcccgggggcaccgggcccgggggtgtgccgtcgccgaacgggcgtccgccgagctgttcgcggtggtgcggagcggtccagccggagaggtcggggccgacggggacgatgccggtggggttgatgcccgtgtgcacctggtagtagtgccgcttgatgtggtcgaagtcgaccgtgtcgccgaatccgggcgtctggtacaggtcgcggacgtaaccccacaggacggggtcctcggtcagcttgttccggttgcacttgaagtggccgtggtagacggcgtcgaagcggaccagggtggtgaagagccggatgtcggcctcggtgatggtgtcgccgaccaggtagcggcggtccgcgaggcgggcggagaccaggtcgaggcggcggaacagggcggcgtacgcctcctcgtactcctcctgggagctggcgaacccggccttgtagacgccgttgttgacgtcccggtagatgccctccatgacctcgtcgatctccgcgcgcagcggctcggggtagaggtcgggggcgccgggccggtgcagggcggtccattcggtggcgaggtcgagggtgatccgctggtagtcgttggtgaccagcttcccgctcggtacgtccacgatcgcgggcacgctgacgccgccggggtagtcgcgctcccgggcgtcgtaggcctcgctgaggtagccgatgccgaggaccgggtccttgccgcccgggtcgagggtgaagcgccagctgcggtcgtcctggatcgggtcggcgacggcgagcgacagcgcgtcctccaggccgaggagccgtcgggagaccagcgcgcggctcgcccaggggcaggcgcggctgacgacgagccggtagcggcccggctccacaggccaaccttcgcgtccgtcggcggtgatccggtcggcgaagtggctccgggaccgcttgaacggcttgtggccgtaggaggtgttgccgtcgctcccggcgctgaccgctgtcgtgtcgttcatgccgtgctcctcgatgcgtcgctcggttcgtctgcggtacgtcgtctgccccgtcggtcggctccgacgtcggccagcgccacgatcagggcggccagcacgaacgcgacggacacgacgagcccgtggtcgtaggcgtcggcccagccgtccgggccgacctgggcgaagaacaccgcgccgacggctgcgatcccgatcgcggagccgacccgctgaccggtctgcagggtgccgccggcgctgccggcccgcttcaccggcacctccgcgagggtcagggtctggttcggggcgatgaccagaccgctgcccaggccggcgaggagcagcggggcggccatcgcccagcccgcgccggtgccggggaccaggtggacggcgagggcggtgccggcgaggccgagcgcgaccatggccaggcccgccaccacgagagggcggccgaagcgcccgaccaggcggccgccgatggacgcggcgaagccggagccgagggcgaagggggtgatggcgagtccggccaggagggcggagtagccgaggcccgactggaggtagagggtcgtgacgaagaagatcgaggtgaacccggcgaagtagagcaggatcagcaggcagcccagccagtaggagcgcagccggaacagcgacaggtccaggaccgggtgggtgcctccgcccgtgcaccgcgactcccaggccacgaaggcggtgagcagggccccggccaggacgagcagcagccacttgccgttgccgggccactgctgggcctggacgaacggcagcagcagcgccagcaccccggcgccgagcagggcgacgcccaccggatccaggtcgcgtggccgcacccggccggcggacggggtgtccgggaggagccggtgggcgagcaggaggcagacggcaccgagcgggaggttgacgtagaagacccagcgccagccgtggtccggtccggcggcctg

SEQ ID NO: 3460 - DNA, 7415 bp, Unknown
  Kingdom: Bacteria, Phylum: Actinobacteria, Class: Actinobacteria, Order: Streptomycetales, Family: Streptomycetaceae, Genus: Streptomyces
gcggtcgtcgcgctggtgctcgtggtcgtggcgggcggggtgtacgcgttctccgaccagtggcgggacgagccggcgaagcccgtcgcgaaggagtcgtccggtccgtccggttcggcgtccccgtccggtacccccgcggcaggcggcccggagctgagccacatcccgacgacgaaggaggtcgccgccgcccggaagccgggcgagtcggcggcgtggatcgccgacgaccggacggacctgcccaagcagatcaacatcgtccacgacctgtggatcgtcggtgacaccgcggtccaggccctgcaccggaaggtcacggcctaccggctctcggacggcgccgaggtgtggaacatcgacctgccctcctccgtctgcgagacgccggccaacccgacgcccgacggcaaggtcgtggtcttccaccacgagcggccggacaacgagcggggcaaccagtgcaaccggatgcggatgatcgatctgaagaccgggaagcaggggtggagcaaggaactcgacgagcccggtgaccgggacaacacgttcatcgtctacagcgccatcagcggcgacgtcctgtccgtcgcccggaacatgcaggccatcacctaccggatggaggacgggagcaagctctacgagattccccgggagcacaagaacaagtgcgttcccgacgacgtggcgggcggcgccgcccggctcctggtgacctccaactgcatgatcgccatcgaccggagcaagaactacggccaggtgcgcgagctcgacccgcgtaccggcaaggtcctgtggcgttaccggctgaagaccggctggagcttcggcagtctgatctccatggatccggtcgtcttcaccacctacaacaacgaggacagcgcgaccgactggcggataacggttctggaccccggaggcaagcaccgcgtcaccttcgacgcccggggcaagggtttcgaggagtgcggcggagacgggtccggcggggacatccagccctgtcggggcgccggggtcggcaagggcctcatcatgctgggcggcgcccaacaggtcggcgcgtacgacgtgaagaccgggaagttcctgtgggggatcaagtccgacgagctgcgcaggctgtacccactgcgcgcggaggacggcaagtcgatgctcatctacgaggcggccacgtcgagccgccccggccggacctttctcatgggcccgcgcggcgccggcacggagacgaacgtcgtgaagcacccggtggcgaccgcgcggtgggagtacgagatgtccatggggcacacggcctacgtcgacgggcggctcgtcctgacgtcgacgcacatgagcggcgacgaggagcggaagcccgtgcgcgaggcccgcatgctgtccttcgcgcccgaggcaccctgaccgcccggctccaccccgacgggaagtaaggggtcgcccccggcccggccgtaggggcccggtcgggggccgctcaggggtctgccccatgcccggcgggcggtcggcccggaatgctcgtgagcatggagaagaccaggggacgacggcggctgaagcgggtgctcatcacgctcgcggtgctggtgggggtgctcggggccgcggtgggcggctcgttcgcgtggctgtggaccagctcggacatcagcacggtgggcaaggcccgtttcggcaacgcgctggcggtgccaccgctcgcgccctcgacggtggacaaggacggcacgcgcgtcttcgacctgcggatgcagacggggagcacggagttccgcaagggcgtggcgacgccgacctgggggttcaacggcggccatctgggcccgacgctgcgggccgagcgcggcgagcgggtgaaggtccgggtgcgcaacacgctcgacgaggcctccagcgtgcactggcacgggatgcacctgccggccgcgatggacggcggaccgcaccagagcgtcgaggcgggcggcacgtggaccccgcactggaaggtcgaccagcctgccgcgacgctctggtaccacccgcatccgcacggagcgacggagcggcatgtgcggaaggggctcgcggggatgttcctgctcgacgacgagcgctccggacggctccccctgccgaagacgtacggggtggacgatctgccggtgatggtgcaggacgtcaccttcgacggcgccggcctcgaccacggacacaacttcctggccaacaccggcttcctcggggagcggaccatggtcaacggcacgctcgacccgtacgccgaggtcggcgacgagcgcgtacggctgcgcctgctgaacgcgtcgaccgcccgcgtctacaccttcggcttcgacgacgaccgctccttctccctggtggggacggacggcgggctgctggcggcacccgccgcgatggaccggatacagctctcgccgggcgagcgggcggaggtcgtcgtgacgatgcggccgggcgagcggacggtgctgcgcagctacccgtggcgggacggggacagctgggagcggcggttcaacgggggcgacgactccttcgacgtactccagttgcgggcggccgagcggctacgtccctcccccgccgtccccgcccggccggccgaggacaaggggatggagctgccggaggccggcgacgccgtgcgcagccgccacttcgagctgcgcaggtcgggcatcaacggacggccgatggcgatggaccgggtcgacgagaccgtcacccgggggacgacggaggtctggacgctgcgcaacagcggcgacatgacccacaacttccatgtgcacgacgtgcagttccggatcctggacgtggacgggaagcggccggagccggccctgcggggccgtaaggacacggtggcggtgccggtgggctcgaccgtgcggatcgccctgcggttcgacggaccgtccgatccggacacgccgtacatgtaccactgccatctgctgtcccacgaggacgaggggatgatgggccagttcgtggtggtggacaagggacagcgggcgggtgcgccgcccggtcacgcggggcactaacgtgcggcgtatgacgactgcactgatcacgggcgcgacggcgggcatcggggccgcgttcgcgcggcggctcgcggcccaggggcacaacctggtgctggtggcgcgggacacggcgcggctgcgcgagcaggccaccgaactgcacgaccggcacggcatcgaggccgaggtgctgagcgccgatctgtccacggagggcggtatcgaagcggtggagcagcggctcgcggaccgcacgcacccggtcgatctgctggtcaacaacgccgggttcggcaacaaggggcgcttcctggaagtgtccatggccgatgagctgacgatgctgaaggtgcactgcgaggcggtgctgcggctgacctcggcggccgtcaccgggatgaaggagcggggccggggaggggtcgtcaacgtggcgtcggtcgcggcgttcgtgccgcgcggtacgtacggggcgtccaaggcgtgggtcgtgcagttcacccagggtgcggcccgggatctggccgggtcgggggtgcggctgatggtgctgtgccccgggttcgtgcggacggagttccacgagcgggccgggatggggacggacaacatcccgggctggatgtggctcgacgcggacaagctggtggcgtcggcgctggcggatctgacgcgggggaagacggtgtcgatcccggacccgcgctacaaggcgctgatggggctggtcaaggtcgccccgcggggtctgctcggcggggtcacgtcgcggacggggcggaaatacggtccgcagtagcgccgcacccgctgcggtgcgccgtacggacgactggcgcgcggagccggcggggcacggcaactaccggcggtgcgtgggcatcgcgggcgccgcgcggatcggccgccgggtgccgcatgtggcgggttcgccgggcgatgagatccaccgctgggcggacttcgcgctggccaaggtggcgcggtacgcgagcgggcagccgttcgctgtaccggtgacgtcggaggacctggcacgcatggcctgaccggccggaacgcaccgaggcccggcacccccgcgacggggatgccgggcctcatgcgtaccggaaaggtaccgcgcgtactagtgggagtggccgtggccgccgtgaccggcgtcgccctcgtcctcggccggcttctcgacgaccagggtctcggtcgtgagcagcagcgacgcgatggacgcggcgttctccagggcggagcgggtgaccttgaccgggtcgatgacgccggccttgaccaggtcgccgtactcgccggtggcggcgttgaagccctggcccttgtcgagctcggagaccttggaggtgatgacgtaaccctccaggccggcgttctcggcgatccagcgcagcggctcgacggcggcgcggcggacgaccgcgacaccggtggcctcgtcgccggtcttgccgaggttgccctccaggaccttcaccgcgtggacgagggcggagccaccgccggagacgatgccctcctcgacagcggcgcgggtcgccgagatggcgtcctcgaggcggtgcttcttctccttgagctccacctcggtggcggcgccgacacggatgacgcacacgccgccggccagcttcgcgaggcgctcctggagcttctcgcggtcccagtcggagtccgtggactcgatctcggccttgatctggttgacgcgacccttgacgtcctcggagttgcccccgccgtcgacgatggtcgtgtcgtccttggagacggtgacgcggcgggcggtgcccagcacgtcgagaccggcgccgtcgagcttgaggccgacctcttcggcgatgacggtcgcaccggtgagggtggcgatgtcaccgagcatggccttgcggcggtcgccgaagcccggggccttcaccgcgacggcgttgaaggtgccgcggatcttgttgacgacgagggtggagagcgcctcgccctcgacgtcctcggcgatgatcaggagcggcttggaggcgccggcctggatgaccttctccaggagcgggagcagctcctggatggagccgatcttgccctggtggatcaggatgtacgggtcgtcgaggacggcctccatacgctcctggtcggagaccatgtacggggacaggtagcccttgtcgaaggccatgccctcggtgaactccaggtccagaccgaaggtgttggactcctcgacggtgatgacaccgtccttgccgaccttgtccatcgcgtccgcgatgagctcgccgacctgggtgtcctgcgcggagagcgcggccacggcggcgatatcggacttgtcatcgatcgggcgggcggtcgcgaggagctcctcggacacggccttgaccgcggcgtcgatgcccttcttcagggcggccggggaggcgccggcggcgacgttgcgcaggccctcgcggacgagcgcctgggccaggacggtcgcggtggtggtgccgtcacccgctacgtcgttggtcttggtcgccacctccttgacgagctgggcgccgaggttctcgtacgggtcgtcgagctcgacctcacgcgcgatggtgacaccgtcgttggtgatggtgggagcgccgaacttcttgtcgatgacgacgttgcggcccttggggccgatcgtcaccttgaccgtgtcggcaagcttgttgacgccgcgctcaagggcgcgacgggcgtcctcgtcgaacttcagaatcttcgccatgggctgtgttccctctcaaaaatgaactgcgcccctcgccgcccggctagttatctcgcagggggccaggggcgcagaacacaggcaaacgtgggtgaattacttctcgacgatcgcgagaacgtcgcgggccgagaggacgaggtactcctcgccgttgtacttcacctcggtgccgccgtacttgctgtacaggacgacgtcgccggtcttgacgtcgagcggaagccgctcgccgttctcgaagcggcccgggcccacggcgaggacgacgccctcctggggcttctccttcgcggtgtccggaatgaccaggccggaagccgtggtctgctcggcgtcgagcggctggaccacaatgcggtcctcgagcggcttgatcgcaaccttggagctggtggtcgacacgatccggtctcccccttcggagatctcacggggtttaacagtctgtgggcggcgacctgaccggcccgtcgtcgcgggtgccggacctgccctgtcgcgcagagtgctgttggcactctccaggggggagtgccagcaccgagactatgaccgcgattagcactcggtcaagcggagtgccaattcaccaccctcgcgccgtctcgatcggggctccatcggatcaccgccgaccccgatccggcctggaactccccgccctgcctcaggggggggcgacagcgacgaatgcgcgcgcagcgggggctgagcgcgcattcggggctgtgcggggtgaaggcgggagcggcgcgggtcagacgtagtcctccagtttcgccaccgcgtatcccttgtcggtgatggtcttcatgacccggcggatcatgtcgggcatcgagcccttccagtcctccttgccccggaagtgggtgaggacgatgtcgccggggtgcaggtcccggtcccactcacgccattccatgtggtcggggaaggcctcggaggaccacaggggtacggcggtgatcccgcaggacttggcgacgacgagggtgtcgcggttgtagttgccgtagggcgggcggaagagggtgggccgcttcccgtagtgcttgaggatcttctcctgctggtcgcagatctcccgtttctgttcggcgtaggagaggccgggaagatagcggtggttgagcgtgtggttgctgatgaccactccgcgctgctgcatcttcttgaagtagccgtagtcgtcgttgatgacgtagtcactgaggaacgcgctgtacgggatgtccagttcggtcatcatccgcagcagctcggggtccttctccgccccgtcgtccatcgtcaggaagacgatcttctccttggtcgggacggtggtgaagacgggcggcagcccggcgtcgtcccggacctcgaagcccttgcgggtggtgatgcgcggcttcaccttcggcggctcgggggccgcgagcggggtcttggcgagcccccacttcttcgcggcgacggcccgtgcggcctgcttcttcctgagcgcctcggcgtacgcgtccggagcgcgggcgggcccggccttcggagcggcctcgcccggctgtccggcggcgggcttcgcgggcccgccaccggcacccgcgccc

SEQ ID NO: 3461 - DNA, 6822 bp, Unknown
  Kingdom: Bacteria, Phylum: Actinobacteria, Class: Actinobacteria, Order: Streptomycetales, Family: Streptomycetaceae, Genus: Streptomyces
ggccgggggagggccgtgcggaactcgggtcctgatggtgatgcccgatgtgtgccgggttcacaccccggcccacggaaaccgcccggccccaccaggctcctccgcccggtggggccgcggcgtcgcctcagctctgcgggcgcctgccgtggttcgcggcgttcttgcggcgggccttcttcttacgacgtcgcttcgatgacatcgaaccctccttctctctgctgtgtactccgttgcgggcggtccaccgggcggtgaggcccggagaacaccgggccgcctacccaaggacaccgtggcaaacacccggtgcgggggcaaccggcggcgcgccgccgggcgggtacggacaggtgtgcggatccgtcagttggtcagctcgtcgacgaagtcctccgcgcaccggtcctcggccgccgtgccgttggcccggttcatgcactcctcaaggttcttgaactcctgggagtcgaacacggagacggccaccacgaggacgatcgcggaaccgatgagtccgagcgccccgaacgccgcgccgactatcgccatcacccggcgcggcgcgcggccctggcgggtgcggagcgcggcgatgatcccgaagacgacggcgagcaggccgagcagcagcccgcccaccacggtccagaagaacaggcaggcgatgaggccgagtacgagtgcggcgaccgcgaagccgttcgtccgtgcgggcgcctggccaccgtaggggtcgtggtcggcggcgggctgccccgggtacggggaatccgggtacgagggaagggacatcggggaggtgctcctgttctcctggcttcccgtccacctgccctgtggcccgtcctccatgcaccgttttggtcacactccggcaactagggagtgtccaggcgcttctcggcgcagccgcgccgacaggtggtgctgcagcggccggccgacggcggcgagatcgtggacgaaggcgagcgtgtccggatccgtcagggtgtagcggcggcgggtggcgtcgacctccttggccgtgggagcgagggacacccgctcggtggcgaggtcgacggcgccgtcgcgggcccggccgaccgcgatctccgcgatgccggtgggctgggtgatcagggcctccacccgcccgtccggctgcaggcgccaccatccggtctcgcgggcggacggccgcaggggacgcccgtccgcgtcgatcagccaggcccgggcctcgtacgcgaggaagggccgcccgtcgtggctgaacgtgacctcctgcgcgtaggtgaagtcatcctccagcgtcggatatccgccgcggcccgtaccccgccaggtgccgatgtacccggtcaccggggcgagcagcggatgcggagcgggggacgcttcggggcggagcgcgtcggggaaggggagttcggagacggggtcgtgcatgcgggtgcgctcctgggtcggggccggtacaggttcgcagcctagggtctcggtggcggcgggcgggcacacgcggcggccccgcacacaggagccgacctgctcgccggataccccgacgagcagcccgccgacgaccaggagatccctctcgtctacttcgaccgctagccgaccaggtccgacagcttggggggagttctcaggcgggatcggccgccatgctctccaccaggctcttcggccgcagatcggtccagttccgctcgacgtagtccaggcaggcctggcgggtgtcctcccgatgggccacggcccatccggcgggcacgtcggcgaacgcgggccacaaggagtgctgtccttcgtcgttgacgagcaccaggtagacgccgtcctcgtcctcgaacggattggccaccgcatcctccatgtatttaggtaaggctatcgttactcgatcgctggcgactctacccatccgtgccgcggttgactcaccgaatcccgcaccatccgatcccgagcaccgtccgggcactccgcgagcggtccacccggacacccaggcaggtgtcgagaccgtcgccgccgatcgcgacgacggccgaacggcggcaactgcacgacgaggggcgggagaagtccggtgagaacgagaagtccgccgccgcgcagggcggaccggagggcggtggattccggccgcggcttccgtgtgccggtccggcggccgaggaggccggacccgcgacacgggccggtcagagtccgaggtcgctcagacgggcctcgtagcggatggtgaggtcctcggagtcgccggccgggttgtcccagagggcctccagctcggaacgcacggcgtcgggcagcgcctcgtaccgctcggaccaggtgtcggagttcggtatccagtagccgacgaccttgaagcggtccgccgggagcccgaggtcgcgacggagataacggcgcaccgagcgcagggcgttggtctcccccgcgacccagacgtatccgcccgcgaggtccgtgccgggcgggacggcggcggccaccaggtcggccaggcggctcgggccgtggccgtttccgccgtaggtccaggtcaccttggagtcggagggctcccgcaggggcagcacggccgagggcgcgggcgcctccaggaccacccgggtcctgacgtggtccggcgtgctctccaggagacgggcggcggcgggcagaccggtctgatcggcgaccagcacctgccaggagaggtcggccgggggactgtagaggccggtgggatcgttgacgcccacgacgtccccgggccgcgcctcggcggcccagccggacgccacgccgccctcgtgcagcacgaagtcgatgtcgacctcccccgcctccgggcgcacggcgcggatcgtgtacgtgcgcatcggcgctacgggctgcccctcgggggtctcccacccgccctgctcggtcgtccggggcagggagacctcggtgcggtccgggccgtgcggaaggaagatcctcacgtactcgtcaccgaccccggtggtcctgaagcccgccagaccgtcgccgtggagggtgacgcgggtcatggtctcggtgagcggctgcactcgggcaacgacggctcggtggatcgtcatggactctgccccttcgtacgcgtggtcggcctgagcgcctcgcccgccgggacgagagaaccgaattgacttaggtcagcctaaccttccacgggcaccggttcgatacggcatccgtcacggtccggcgctgtgccaaaatccgacgcatgtccgttcgatatccacgccccctgcggcccggtgaccgggtcggcatcacctccccgtccagcggtgtgcccgaggagctgcgcgagcggctcgccgtggcggtacgcgctgtggaggcgcgggggtacgaggtcgtgaccggccggtgcatggacggcggcgggcacatcagcgctcccgcggccgaccgggcggccgagttgacggcgatgctgacggaccccggcgtcagggccgtggtgccgccgtggggcggagagaccgcgatcgacctgctgccgctgctcgactgggaccggctgcgcacggccgaacccacctgggtggtgggctactcggacatgtcgaccgtcatgacaccgctgaccctcctcacggggacggtgaccgtgcacgggaacaacctcatggacaccccctaccgagtgccggaggggctggtgtcctggctcgacatcgtcgccgcgcagccgggccaccggttcacccagattccgccggagcggcaccgggccacgggctacgacgactacgcggagcacccggacgtccgcacgttcacgctggacaccccgggccggtggacgaggctggacggcggtggcgacgtggatgtcgaggggcggctggtcgggggctgtatcgagatgttgagcaacctcaccgggacgccgtacctcgacacctcctccttcgcccgagcgcatgccccgaagggccttctggtgtacgtggaggccggcggccatgacgcgttcaccatctgccgcaatctgcacggaatgcggctggccggatttttcgaggctgccaacgccgttctcgtcggccggacttcggcgccggacacgaactcgctcacccagcgccaggctgtgctggacgcgctgggcccgctgaacgtgccgatcgtcgcggacgtcgagtgcggccatgtgccgccgtacctccccctggtcaacggagcacggggcagggtcgtccacacgtcgacacgcagcgagctgacgcaggcactcgactgacccgccgggcggcccacgccctcggtcgtgtccgcggtctcgtctggcccgcgacgcctggaggacggacgacgtaactttgcggacacgccctagcatgaagggatgagtcgactgccgaacccccacgcccggcgttccgtactccgcctgttgggcggtgccctcgtgtccgtgccgctagcggcgtgtggcacggaatccgactccccctcaccgtcgcccgccgggaaggcgtccggatcgccctcggccacggtgcgggatgccgggcgcgccttcgccgcgctggagaaggagtacgcggcgcggctcggcgtgtacgccgtcgacaccgggaccgggcgcacggtcgcccatcgtgacggggaacggttcgcctacgcctccacgttcaaggcgctcgcggcgggggcggtgctgcgcaggcacgggctgggcgggctggagcgggtcgtgacgtaccgccgtgaggatctggtcgaccactcccccgtcaccgagaagcacgtggccaccggaatgagcctgggcgatctgtgcgacgccgctgtgcgcttcagcgacaacaccgcgggcaacctgctgttcgacgcggtcggtgggccccggaagctgcaggcggtcctcgcggagctgggggacgacgtgacccggatggagcgtcgggagaccgagctcaacgagtgggctcccggcgccacccgtgacaccagcaccccccgggcactggccgaggatctgcgggcgttcgtcctgggcgacgccctcgccaagcccgagcgggcccggctcacgcagtggctcaccaccaacaccaccggcggcgaactcatccgggcgggggtcccgaaggggtgggtcgtcggcgacaagtccggggcgggcagtacgtacgggacgcgcaacgacatcgccgtggtgtggccgcccgacgcggcgccgctggtgctggcggtgctctccaaccggacggacgcggacgccgaattcgacaacacgctgatcgcgaaggccacgtccgccgctgtcgccgccctcaccgggcagcgggaccgtccgtagagggacggttcagctctcgtcgagcacggcgtcgatctcgccgaggaagtcgtccaggtcgccggggttcctggaggtgatcagcgtccagccggaggcgtcgtcgcggaccaccggcttgtcgacccaggtgccgcccgcgttggtgatgtcggtccgcagtgacgcgtacgaggtgagcgtcttgccccggacgtagccgccctcgaccagcgcccacggcccgtgacagatggcggccaccggtcggccggaagcggcgaacgagctgacgatccgggtggtggcgtcctccagacgcagcgagtcggcgttcagcgtgccgccaggaacgagcagcaggtcgtacgcggcggggtcgacgtcgtcgagcgtgaggtcgggtcgcacggtctcgccgggatcgcggtcgccgacgagggtacggatcccgtcggcggagaccgccgccacgctgacctgcgccccgtggccgcgcaggtgcttcagggggacgacgagttcgtcctgctcgaccccgtagttggtgacgatggccaggatccggcggtcgtcgagagcggtgctggacatggactgctccgttcctgtgatgtcgttcgtccgttgtcgttcaatgccggcggggcggggacggctcatccggccgtgatccggacgcattcggcgacggtgtcgcgcaggctccccgtccgcgccaggatctcgcgctggatccgcgccccgttcccgcgccgctcgacagcggccagggcccgcactgcggcttccaggtccccgctgtcctccagagcgtgccgcacatggtccagcagggcccgcaggacgtccggggcgggctccggccgcagggtgcgggggtggaccagccggtcctccaggcccgcgcggcccgcctgccaggaggccgcacggagtaccgacgtgctgatgtccgggggtggctcgccggcacgccactcgcgtgcggccgtgtccaccagtcctcgtaccagcgtggccagcagcacggtgtcggccgggtccaggcagacgtccgcgatcctgacctccacggtggggtagcggtgcgagaggcgcgcgtcgaagtagaccatcccctcgtcccggagcaccccggtaccgatcagcgaccgcactcgggcgtggtactcctcggcggatccgtggacctccaccgggccggccgacggccaccgcccccacacccggctgcggtagctgttgtacccgctgtcctgcccctgccagaacggggaattggcgctcagggcgagcaggacgggcagccagcagcgcacccggtcgagcacggcgacgccctcctcgtccgaggccaccgagacgtggacgtggcagccgcaggtcagctgctcctgggcggtcagaccgtagcgctccgccatccaccggtaccgctcccccgcgccgatcgtcgggctgaccggaagcggcgaggtcgccagggcggcgaccga

SEQ ID NO: 3462 - DNA, 1761 bp, Unknown
  Kingdom: Bacteria, Phylum: Actinobacteria, Class: Actinobacteria, Order: Streptomycetales, Family: Streptomycetaceae, Genus: Streptomyces
cggtcgcccgggcgaccgacattctcggcatggacatcaagggccacacggtccacaaggtgatgatcgccgagctgtccccggagatcgaggcggagtactacgtctcgtacctcctcgaccgcaccaaccgcaccttcctggccatggcctcggtgcagggcggcatggacatcgaggaggtcgcggagaagacccccgaggccctcgcgaaggtcccggtcaacgccgtcgacggcgtcgacatcgtcaaggcccgcgagatcgtggcccaggcgaagttcccggccgacgtggccgagggtgtcgccgaggccctggtgaccctgtgggacaccttcgtcgccgaggacgcgctcctcgtcgaggtcaacccgctggtgaagaccaaggacggccggatcctggccctggacggcaaggtgtctctcgacgagaacgccgacttccgtcagccgggtcacgaggagctcgaggacaaggccgcagccaacccgctcgaggctgccgccaaggccaagaacctcaactacgtcaagctcgacggcgaggtcggcatcatcggtaacggtgccggactggtcatgtcgaccctggacgtcgtcgcgtacgccggtgagaaccacggcaacgtgaagcccgccaacttcctcgacatcggtggcggcgcctccgcagaggtcatggcgaacggcctggagatcatcctcggcgacccggacgtcaagtccgtgttcgtcaacgtcttcggtggcatcaccgcctgcgacgaggtcgccaacggcatcgtgcaggcgctcgcgctgctcgagtccaagggcgagaaggtcgagaagccgctggtcgtgcgtctcgacggcaacaacgcggagctgggtcgcaagatcctttccgacgccaaccacccgctcgtgcagcgcgtggacaccatggacggcgcggccgacaaggccgccgagctcgccgcggctgcgaagtaaggaagagggactcagaccaccatggctatcttcctcaccaaggacagcaaggtcatcgtccaggggatgaccggcgcgacgggcatgaagcacaccaagctcatgctcgccgacggcaccaacatcgtcggcggcgtgaacccgcgcaaggccggcacctccgtcgacttcgacggcaccgaggtaccggtcttcggctccgtcgccgaggcgatggagaagaccggcgcgaacgtgtccgtcctcttcgtaccgccggccttctcgaaggccgccgtcgtcgaggcgatcgacgccgagatcccgctcgccgtcgtgatcaccgagggcatcgccgttcacgactcggccgccttctgggcgtacgccggcgcgaagggcaacaagacccggatcatcggcccgaactgcccgggtctcatcacccccggccagtccaacgccggcatcatcccgggcgacatcaccaagcccggccgcatcggtctcgtgtccaagtccggcacgctgacctaccagatgatgtacgagctccgtgacatcggcttctcctccgccgtcggcatcggtggcgacccggtcatcggcaccacgcacatcgacgccctcgcggcgttcgaggcggacccggagaccgacctcatcgtgatgatcggcgagatcggcggcgacgccgaggagcgtgccgccgacttcatcgcgaagaacgtcaccaagccggtcgtcggttacgtcgcgggcttcaccgccccggagggcaagaccatgggccacgccggcg

SEQ ID NO: 3463 - DNA, 3561 bp, Unknown
  Kingdom: Bacteria, Phylum: Actinobacteria, Class: Actinobacteria, Order: Streptomycetales, Family: Streptomycetaceae, Genus: Streptomyces
  misc_feature (3212)..(3213): n is a, c, g, or t
gcacccgccgccgcatcctcctcgacttcgccacccacacccaccccgaacaacccgccgtcctcgccaacgcccgcgtcctcggcgaaggcatcgacgtccccgccatcgacgccgtcgtcttcgccgaccccaagaacagccccgtcgacaccgtccaagccgtcggccgcgccctacgccaaacccccggcgccggcaaaaaggccaccctgatcgtccccgtctacctcacccccgacgaagaccccgacgacctcctcggcgccgacgcctacacccccctctggcgcaccgtccaagccctgcgcgcccacgacgaacgcctcaccgcacgcctcgccgacccccgcacccaccgccccacccaagggtccgaagaccccggcgcctggctccacttcgaacgccccacccaacaagaagaagtcgccctcgccctcaccctgcgcgtcctcaaccccaagagcgccgaatggcgccgcggcctcaccgcagcccgccactaccaccgcacccaccaccacctcgacgccccccgaacctacgaagaccccgacggctaccccctgggccgctggctcacctggcaacgacacctccacaccaccggcgccctcgaccccgcccgcaccaccgccctcgaacgcctcggcatcatctggaacccccaccagcacgccttcgaccgcggcctcgcccacgccaccgcctacacccactaccacggccacctcgccgtccccgtcgaccaccaccacgacggcttcgccctcggccgctggctcgccacccaacgcaaacgcgccgacaccctcacccccgccagaacacaggccctccacgacctcgacccgtactggaacccgccctggcccctgacctggcaccgcgcctaccacgccgcccgcagacaccacaacgccggcaaccgtctgaccgacgtgccccggaactccatcaccgatgagggacaccgcctgggggagtggctccacaaccagcgcctccaccccgagcgcctgcaccccgcccagcagcacctcctggccggtctcgggctgatccagaacaccaggccatccccacagaaacggaaagcggctgcccgcaaaccggaacagggcctggccgccgcccgcgccttccaccagcgggaaggacacctcgacgttccccagcgccacgtcgaagacctcgacggcgagcccgtacgcctcgggcagtggatcagcaacgcccgccgccgcaaggaccacctgcccgccgaccgcatccgcgccctcgacgccctcggcatgcgctggtaggggcggcagcggagaggcgggcggcccaccgggatggcggatctgccgtactacctgctggtcgccgtatcggctgtggaactgacggccgcggggctggcgggacaacggcgcggagtcctggccactgacccgatgagccggacctgggtcatccagtgcagacaccgcaagaaacggtgaccgggcgcggcaggcggaccttagacctccagcgggtcaacggatgcgcccgccagctctacggcgccgacgcggtccgcgaggcggtggctgccgcgctccccggcccggaggccgacgacgcgtcttttgctgtcgcggagccgggcgggcggatcaccacccctgcgcgcggaggccgcaggcctcctcgagcgtctcccggccgccccgcggcgcgcggccgaaagcaggagcgacccgccgccgatcccgagcacagcagggtaccgacgcaggccgcggggatctcttccgccgtgctggtgtgccaccgcgaccaccatctcgggccgctcgctcatcgccgtcctcatcagcccgtcccgcctgcggaacaccgccgcgaaggcgacggcgaccgggaacccgccgaggccgtctacagcgcatcggcaacaacctcgccgctctcgcccccgaactgcgggcgcggggcggtgaatccggtggagaccgcctccaccgcgcgggccggcggcacgcgttcacgtagacgccacgtacggctgcctgaccgcacggaggacgatcgccatcggccgaccgcggggtcagctgccgaaaccgaggcccaggcggtcgagggcgcggagccagagatcgcggcggccctggttgcggtcggcccgggcgagagagcgctgggtgacgtcgatgccgagggagcgcaggggctccggcgggaacggcagcggcttgcggcggacgaggtcgagggcggtgcgctcggtgcgggcgccggacaacaggtcgagcatcacctccgccccgaagcgggcggcgccgacgcccaggccggtgaagccggccgcataggcggccttgccgtggtggctggtgtcgaagaagacgcagaaccgggtgctggtgtcgatcgcgccgccccaggcgtggctgaagcgcagaccctccaactgcgggaaggtctcaaagaaatggcgggcgagcgtggcatacgtctcgggacggcgggtgtgttcgaggcggactcggccgccgtggtggacgacgtcataaccgccccacaggatccggtggtcggcggagatgcggacgtagtgaaagcggttggccgggtcggcccagccctgccggttgcgccagccgaccgaggcgagctgccgggcgtccagcggttccgtcatcagcgcgtagtcgtacacggggacggtgtacgggcggtgccgacggaccagcgaggggtaggcgttggtggcgagggcgacgtgacgggtgctgatccggccgtagggggtacggacggtgacggcggcgccgtgctcggccagggagagggccggggtgtgctcgtggatacggacgccgaggtcgaggcaggcacgtttgaggccccaggcgagccgggccgggttgaccatggcgatgtcactcctgttccacacggcccccaggaagaccggggagtcgatctcggcccgcacggcgtcggcgtcgaggaggacggtgtcggcaccgtaccgggcggctgtctcggcctcctcggcgagccagtccacctggtggggttcggtggcgacgacgagggagccggtgcgttcccagtcgcagtcgatggagtggcgtacgagggtgtcctccatcgccgagaggttcgcgcggcccaggtcttcgaggaggccgatctctccgggccagcgggccaggccgttggccagnnccgcctcgtcggcctcgaccaggacgacgtcggtggaggggtcgcgctccttggcgatcagcgccgtccacagtccggtgtaaccaccgccgacgaccaccagatcgcaggtggtgtcgccgaccagggcggagacggcctcggggcggtgtggatcgtccagccagaacggggtgggggcagcgtcccggagtgagaacagcgggtccatgagggcttccttcgagtgaggcggaagcccgggcgcggggcttcctccgaggtgccgctcataagacccggccgcgatctccaaggtcaaggccgttgacataaggctgtccggtgcctgacccccccagcggcgcc

SEQ ID NO: 3464 - DNA, 535 bp, Unknown
  Kingdom: Bacteria, Phylum: Actinobacteria, Class: Actinobacteria, Order: Streptomycetales, Family: Streptomycetaceae, Genus: Streptomyces
ggcgggcagggtggccgcgcacagcagcggcagcacggacgcgtcgctgaccagcaccgccgcggtgaacaggctcacccagccctgccgggtgacggccagcagcacgcccagcaccgcgcaggacaccgcgagcgacggcgggaccgcggcgaccagcgcgtgggcgcagagccccagcgacacccccgcgaagaccgcggagaagatccgcccgccccggaagccgcaggccgccgcgatcacgagagcggccgtcttcaccaccgccatccccgcgaactccccggccgaccagccgtcggggtccccggcgagcaccttcacctcgtcgagccccttgaagagggtgaggtggccgcccagcgcgccgagcagtcccagcaccagcccgcccagcgtcagggcgagcacccgatgccgcagcgccgtgaaggcccggtggaccaccgggaaggcgtacaccgcgagcaggccgaggagcgcgcccgccgaggcgatcagcagggcggagagcagatcgccccagtgcggt

SEQ ID NO: 3465 - DNA, 2385 bp, Unknown
  Kingdom: Bacteria, Phylum: Actinobacteria, Class: Actinobacteria, Order: Streptomycetales, Family: Streptomycetaceae, Genus: Streptomyces
ccgggacacggcgcggggcgagggagagggcggggcccgggaccgctcggcgggggtgacccgccggctttcggcccgtacgccgcacgcgctcgccaccaccgatctgcggccccggctcgtcccgctcgggcccgacaccccgtggccggccaccgaccccgccgaggcgcacgtcgtcgcggagaccggtgcgcactccctgatcgtcgtacccctcaccctgcggggcgcggttctcgggctggtcagcctctaccgctgcggtgcggccgagcccttcgaggacgacgacgtctccctggccggcgcggtggccacccgggctgccctcagcatcgacaacgcccgccgctacgagcgcgagcacgtcatcgcctcgacggtccagcggcggctgcttccgcaggccgaacggcagcaggccgccgtcgacaccgcgcacgtgctgctgcccggccgggacagcggctgctggttcgacaccatcgccctgtccggcgcccgtaccgcgctcgtcgtgggcggcgtcgcgggcgagggcctccagtcggccatcgccatgggccagttgcgtacggtcgtccaggcactgtcgggcctcgacctggagccggaggaggtcctggcccggctcaaggacaccgccgaccgtctcgcccacgaacgcgccgccctccccccggccgacgcgctccagagcgaacctctgagcgcgggctgcgtgtacggggtctacgacccgttcacccgcacctgcaccgtcgcgcgcgccggacacccagcgccgctcatcgtcggtcccgacgggcgggcggtcgccctcgacctaccggaagggccgggactcttctccaccgacagtgctctcttcgcccccgccaccgtcaccctggaggtgggcagcctcctcgcgttctgcacggccgagctgctctccggcgaccgcgccgccgaacgcatcacggagaccctcgcccggccgggccgaagtcttcagcaactgggcgacgacatcgtgtacgcgctgccggacgacacccgatccgccggtgcggccctgctcctggcccgtacgggtacggtctccgaccacctggtcgccacctgggacctggcgcaggaccccacgacccccgccaccgcccgggtactcgtacgcgaccggctccaggggtgggggctgggcgaggacaccgtcgaggcgacggaactgatcgtcagcgagctggtcaccaacgccgtccgctacggcaccccgccgctgcggctgcggctcctgctggactccacgctcacctgcgaggtccacgacggctccacggcctccccgcacctgcggcacgcccggaccgtcgacgagggcggccggggcctgttcatcgtctcccggctcgcctcccactggggtgcccgccacgggccggacgggaaggtgctgtggaccgagcaggatctgccggacgacgagcgagaaggtgggaacggcgcgaacggcgcgaagggtgaacggaatgggacgggcggcgagcggtagcggcgattcctggccgttcccgctcccgccgggatgattcccgcccggacgggcacggtgaccgggccgatcgcgcagagtggtccgtatgacgacacccgcggagctgcttcgctccttcgcccgtacccgtgcctccctcgacggcgaggaggtcacgtactggtggtccggagacgtgtattcctgggcccccgatgagccctaccggcgggtcttcggtttcgagggactcaacgtctcccgtctggtccaggacgcggaggccgggccggacgcgtaccgactgctcacccgcgaggccgcgttctatctggatcccgtcagccgcgagatcctggagacctggcaggacctgccggtggtgcacgtctggaacgacccggcgaaccagaagtggcgtcccttcccgatcccgacgaccgacctcggggatcaggtctgcttcagcctggagatcccgctcgcctacccgtcgccgctgccggtggccgagtatccggcgcactcggcgggggacacgtacaaggccctggagctcttccagttcttcgccgaccgcgccgacctcgcgggcccggcacccggtgtcccggccaccatgtcgtggagccggatgtccccgtggctcccgtggatggcccgggggcagcggcccggcggcctcaccttccactgccggggccgcaagctcggcgcgtacgccgaggtccccgggcgcacccgcgcgtacatcgccggccaccatccggagttcgcccacgctccggagaagtggagcgagccgaacgagacgagctggacctacttccgcaagctcaacccgccccaggggtgagggccgcggg

SEQ ID NO: 3466 - DNA, 1193 bp, Unknown
  Kingdom: Bacteria, Phylum: Actinobacteria, Class: Actinobacteria, Order: Streptomycetales, Family: Streptomycetaceae, Genus: Streptomyces
actgcgctccggcccccggggtcacgccttgccactgcccgcggcccggccgaactgttcgtccagcacggacagtcggcgccagtactcgtcctcgtcgatctcccccgcggcgaagcgacggccgagcagcgcgatcggtgaggactcgccggggacggcccccggagtgcgggcggctccccacggccctcggcgcccacgccacacggtacggcgcagcagggtgacgatcccgatgacgaccgccgcccagacgagcgggaagagcaggacccaggggccgggtccgccggagtgcgccagggtgttcatctcggtcagctccctcgttcacggatggcgggtgccattccggttgctttcgagcctgcccggaggaggcgctccggacgtcgtacacccggcggccgtgtgtgtactccggtgggagcagcgggagtccgcgcctctcctccttcttccgatccgcgggcgcgaggcgggccggcgtggtgctcaggccagggcggcgagggggtcgtcgaggaccggctgccaggccagttcggcggcgcccaccaagctgttgtgggccagggtgcacggcaggatcggcacgctgccgctgcgcccccacaggctccggtcggcgacgacggcgcgcagccgctccgggtccgcctccagcaggtcgcggtggagcccgccgagaatgatccggtccgggttgaggatgttgaccagcccggcgagccccagacccaggcggtcgatcagcgcctcggcggcgtggcgcacggcggggtcgccgtactccgtacggagcaggtttccggcctgcttgaggagggactcctcgggacccggttcgcggcgggcggtggtgaggaaggccagcgggtcggtctccacgtcgaggcagccgcgcccgccgcagtggcagggccgcccctcggggttcacggtgagatgacccacctccagcgcgaggcccgaactcccgctgtgcaggcgtccgtcgagcaccggcacggcgcggtgaggttgacgtcgttgccggtgaacgcgggcccggtgatgcccgcttcgcgtacgcaggcggcgaagatgtcccggaccggggagcccgcgggccaggcgatgtgcagcgggttgagggcggtaccctccggctcggcgaccgcggagggcaccgccctcaacccgctgca

SEQ ID NO: 3467 - DNA, 9067 bp, Unknown
  Kingdom: Bacteria, Phylum: Actinobacteria, Class: Actinobacteria, Order: Streptomycetales, Family: Streptomycetaceae, Genus: Streptomyces
cgtcggcgagcgcgccggtggcgacccgtgcacccagaatgccgaccacgacgcccgaggtcaccaccccgatgttccggccgcgttcggcgggaggggaagccgacgccgcgtaggccaccgcgatctgtaccacgaccgcgaacaccccggccgtcgcgagtcccgcgaacgccggccacgcggccgacgacgacgccgtgagcatcatgcccaccgaggtgatcgccaggtgcgcggcgatgagacggcgcctgtcgaccacatcgccgagcggcaccagcagcaacagccccgccagatagccgaactgaccggtggccacgaaccatccggtcagctcggccggcacgccgaggtcgcgccccatcggtgccaggaccggctgcgcggcgtagacgctcgccacagcgacaccgcacaccaccgccagcagcaatcgacgccatacgttcatcgcagccctcatcaaatcagtagctaattgcaactgttttaacggtacggcatgatggtttcaatctgcaactcattgggaggcgtcatgtcagctgcacctctgcgcggtccggacgcgccgtggtcggatcccgactgccccgtcgcccgcaccctcgacctcgtcggcgaccgatggagccttctcgtcatccgtgacgcgatggacggcgcagcctcgttcaccgagttccagcgacggaccggcatcgcgcgcaacatcctcacggaccgcctccggaagctcctcgcccacgggcttctcgcccagcgcaccgccccatcgggccgccgccaggagtacgtcctcaccgacgccggccgcgccctgttccccgtcatcctcactctgcgccaatggggcgagcggcacgccttcgcgccggacgaggcgcactccgtcctggtcgaccggcacggcgaccccgtgccggacttcacgccggtcggcgcggacggcacccctctgaacaccgacaccactcgcgtacggaagacccggcaggcctgaacgggctcctgcacggcaagaggatcgagtcgtccacacggaccgtcacaccgggcatgacgccgaaccggatgccggcgactgcgtcgtcacggcggccccgaggttgaccatggcctcgacggcatcggtcttcaacgactcttcgatcgcctgatcgaccgcaatccgcccagatacacacatgcgtgcgaaccggtcaacaagcgccgccccgctccggattgttgttgtcatgccccttgcgagaaggggagcggcgcgctccaatggacgcgactcaatggaaaggaaactttcctaatagagctgacctcccggccgagccgtgtccgtacgcccctccacgacgcccctgtgcgttcggcgtccggcgcgtcgcaagagatcggagaaccacgtgcgcatacgcatgccccaccgcctttcccggcgcgttccccgtccggaacgaccaccccgccccgcgcaccgccgccgtcgcaccggcgtgcgcgtcgccctggccatggcgctgaccgcgatccccgccgtggtcgccctcaacaccggacaggccgccgtggcatccggcctcgacgatccggtgaagaaggacatcgccatgcagatcgtctcgacggccgagaactcatcgctccagtggcgcgagcagttcgactacatcgaggacatcggcgacgggcgcggctacacggccggcatcatcggcttctgctccggtacgcacgacatgctcgaactcgtcgagtactacacgggcaaggtgccgggcaatccgctggccaagtacctccccgcgctccgcgcggtcgacgggagcgactcccacgaaggcctggaccccgggttcacgaccgcctgggagcaggccgcggccacccccgagttccgggcggcccaggaacacgagcgcgaccgtgtctacttcgacccctccgtatcccgggcgaagagcgacggactgcgggtactcggccagttcgcctactacgacgccatcgtcatgcacggacagtcgggcttcgacagcatccgcgccgaggcccggaacgacgcccgtacgccggccgagggcggcgacgaaacccagtacctcgacgccttcctcgacgcccgtgtcgtggagatgaagaaggaggcggcgcacgaggacaccagccgggtcgacaccgctcagcgcgtgttcctgaggaacggcaacctcgacctcgacaccccgctggcctgggccgtctacggcgaggacttccgtatcgacaccgacccccggcccgacccggaaccgacggacacctccggcgccgaggcactgatatcgcgcggcaagcccaccaccgcctcgtcgtccgagacctccgccctggcccccggcaaggccgtcgacggcgacgcgaccacccgctgggccagtgccgaaggatcggacccgcagtggctccgcatcgacctcggcgcaggtgcgtccgtctcccgtgtcgaactgacctgggaggccgcgtacgcgaagcagtaccggctggagatctcggccgacggcaccgactggatccggctcgccgcggagacggcgggcaacggcgggaccgacacctggaccggtctgaccggcaagggccgctacctgcgcgtgtacggcaccgcacgcggcaccacgtacggctactccctgtgggaggccgacgtgtacggcaccgccgggggtaccacgcccaccgacccgcccccgaagggcgcgttcaccgtcgtcggcgccggcgacatcgccgaccagtgcaaccagagcgatcccggatgccagcacttcaagaccgccgcacgcgccatggcgatcgacccggccttctacatcaccatgggcgacaaccagtacgacgacgcccacatcgaggacttccgcaactactacgacaagtcctggggccggttcaaggacaagacccaccccgtgcccggcaaccacgaggcgtacgacgactgggacaaccaggacgaggtcgcctaccgtcagtacttcggtgaccgcgccactccccagggcaagatgtggtacagctacgactacggcaactggcacttcgtcgccctcaattccaaccggttcgacgagcgcgaacagctcgactggctgaaggccgacctcgccaagaacagcaagaagtgcgtcgccgcgtacttccaccacccgctgttcagctccggaagccacggcaacgacccggtgagcaagccgatctggtccatgctgcaggcagccggcaccgagctggtgctgagcggccacgaccaccactacgagcgtttcgccccccagagcccggacggccaggctgacccgaacggcatcgtcgagatcctcggcggtatgggaggcaaggacctgtacggccagggtgacaccgtgcagaagaacagccagaagcgcatctgggacaagttcggcgtgatgcagctcgacttcaccgacacgaccttcacctcgaagttcgtcggtaccgacggaacggtcctggacaccggcccgacgtacagctgccactgacctccgcacctgtcaccgaccccgcaccgtccgtcgtggtccggccgccgtgctccggcggccggccacgcccggccggcgaacccgcccggagcaccggttgtgcgaccggagctccgggcaccgcgtaccaggagcgtctgtatgtaccttgccgtcggcagaacccgtccaccggacggaaccgcccccgaccggatccccccatccgtacggcccgccggccgaaggcgcctcaccggcaccgtcgtcgcgctcggcgcggtcagcctcgtcaccgacatctcgtccgagatggtcaccgccgtactgcccctctacctcgtcctgggactgggactcagcccactccagttcggctttctcgacggcctctacaacggtgtcaccgccttcgtcagactcgccggcgggcacgccgccgaccgctggcagcggcacaagctcgtcgccggaagcggatacgcgctgtccaccgtctgcaaactcggtctgctcctcgcgggcagttccacccccgccctctccgccgcgctcgcggccgaccgggtcggcaaaggcgtgcggacagcgccgcgcgacgcgctgatctcgttgagctgcgacgagcgggacctcggccgcgccttcggagtccaccgggccatggacaccacgggcgccatgctcggaccgctcgtggccttcgccgtcctgtgggcgaccgtcgacgcctacgacgcggtcttcgtcgtcagcttctgcttcggcctgctgggtgtactgatcctcttcgcgttcgtccccggccgcgaggcagggccggcacgcccgcccggcagggccgcggccacactgcgggaaaccctgcggctcttccatgtccccgccttccgccggatcctcctcgcggccacggcgctcggcctcgtcggcgtgggcgacgggttcctctacctggtcctgcagaagcggctcgccctcgacgtggagtacttcccgctgctgccgctcggcagcgcggcggtctacctcctgctcgccgttccgctcggccgggccgccgaccggatcggccgccgcatcccctacctgctggggcatgtcgccctgctcggggtgtacgtcgcgctgttctcaccggtggccggctggcccctgacgattctggtgctcgtcctgcacggcacgttctacgcggcgaccgacggggtcctcatggcgctcggcggcccggtcgtgccggcggaccgccgcgcgggcgggatggcactgctgcagaccggccagagtctgggccgcctgttcgcgtccgtcgggttcggagccgtctggacgctgtggggcatggacatcgctctcgtcctggccgccgccgcactcggcgccgtactcgtcctcgcctgcgtactcctgcccgccgtccccgcacccgtcaccgccccggagccctcatgaccctgcctcctctctccctgcgcgcgcggatcatcgcgctcacggcggccgccgccgtactggcaaccgtcgccgtcggctacacggtcgcggcagccgacggcgacggcaggtcgccggagtccgtcgccgctccgggcctcacactcgacaacgcgcccggtctctaccacgcggcgcggaagggcgacgtgcgctcggctccgtacagctcctccggtacgggagcggccgacggcgctcggagcagggccaccggactgtcgtgcgaccgcttctacgcgagcggacggtcggccgtctgtatcgcgagccaccccggcatctcgcagaagacgaaggtgagcgtcctcgaccgaaagctgaacacccgtaggaccgtcgtggtcggcggcatccccaatcgggcgcgggtctccccttcgggccggatggtcgcctggacgctgttcgtcagcggcgactcgtacgcctcgtcctccttctcgacgaggagcggcatcctcgacacccggaccggctatctggtcaagaacgtggagacgctccagctctacctggaggggcggcgttaccacgcgccggacgtgaactactggggcatcaccttcgcggacgacgacaaccgtttctacgcgacggtggccaccaaggggaagacgtacctcgtcgagggcgacgtcaggacgtggaaggcccgcaccctccgccgcaacgccgaatgtccgtccctctcgcccgacggcacccggatcgccttcaagaagcgggtccgcgagggcgcccagaacccgtggcgactgcatgtactggacctgaggacgatgcgtgagactcccgtcgccgagacccggagcgtcgacgaccaggcggcgtggctggacgactcgaccctcgcgtacgcccttccgggccgggtgaagggcacctcggacatctggaccgtgcccgtcgacgcctcggccaccaagccgagcctcctcctgagcgacgcgtcgtcaccgtccatggtcgtggcgggcggctgatcggggtcggccgcacccgctcggggtcggccgcacccgcacggccgaccgacggcatgggaggagctaccggccccccgggagccgcgccggtgcgggtcagtcccggagcggcagcagccggggtacggctctgacgaggacgaccatgccgatgacctcgaccagggtctgggtgaccacgaccacgccggcgacggccagcgcgtccggcagcgcgagggcgagaggcaggacgaccagggagttgcgggtcgcccccgtgaacacgatcgcccgcccggcaggagcgtccaggcggaacaggcgggctacgccgagcccggcgaacgccatcacggcgaggaagagcacatagaacggcacgacacggcccacgtcccccaggctgccggcgtccccgagtttcggtacctgggaggcgaccacggtgagcaggacggcggccattagcggcaccatggtcgtgcccatcgcgtcggcggtcttctgtccggccgggcggcgcgcggcccatgcctgggtgagccaggccagcgtgagcgggatgacgatcagcacgacgaacgcctcgacgaacggtccggcctccaccacctcggccaggtccggtcccatgaaaaggaacagacagaccggcagcagcaccatctgggcgaggagcagcaacggggtggcggcgagcaggcgatcgctgctgccccctgcgagcccgctgaagacgatcacgtaatcgatgcacggggtcaggaggaccagcagcacgccgaggcggaccgcccggtcgtccgggaggaaggtgaacatcgcggcgaccaccagcggcaccacgacgaagttgaccaccagcgtcgcggccaggaagtggcccgcccgcaccgagcggaacaactccgccgcgggcacctggaggaacgtcacgaacaacagggccgccagcaccgggttgatcgcgtgttccaggcccggccccgcaccgggtgcgacccggcccaccaggcctccggcggcgagggcgccgacgtagacggcgacctggtggcgttccatgcccgcggccacgtcggatggcgacgacaacgtacgtactccttgcacaggaagggaagaggggtggtggtccgcgtcatcgcatcgtgctgctggacagttccgcgaggagggcggcgtgcccgtcgtggcccggcaggcctcccccgatgagttctcccaccggacgcagtctgtacctatgtccatcaaccggattcgcccaggagagcatcatgaccgccacctacaccttcgacgtattctccagcctcgacggtttcggctcctacaacggtgacggcgactggggtggctactggggcaagcagggccccgagctcctcgaccgccggctctccctgtacggcgaggatcagcggatggtcttcggggcccacacgtatcgggaattcgtgcggctgctgagcccgagcacgaaggagtccggcgtgggcgacgcatgggtcacgcggatgaggagcctgccggcgacggtggtgtcgtccacgctcgaaggacccctcgactggccggacgcgaccgtcgcgagcggcgacgccgtcgacgtcgtcgcccgcctcaaggaggagtccgaggtgccgttgcgctcgcacggcagcctgtcgatgaaccgggcgctgatggccgccggcctggtcgaccgcgtccaggtgacgctcttccccgtcatcaccggtcggaccggcaccgaaccggtcctccggggtgcggccgacttcgacctcgaactgatcgagagccggacgctcgatggccgtacccaggagctcacctatcggcccaccctgcactgacctgcacggattccgcaccgggccgtgcaggggccgcagtcgccgacgaccgggcagtcctcggccacggaaccgcacggcctcaggcgcggcgggtgcgccagagccatacagccgtaccgaccatcagggcgaggcttcccaggttgcccaggagtgcctgcgtttcgcccgcctcccagccgctgatcacgttccaggtgacgatgacggtggtcggcacaaccacggcgagcagcacgccggtggtcttctggacggcggtccagtgcaccgaggtgcagaggagtaccgcgccggtgacgcggaacaggaaaccgaacaccgggccggggtcgaacgccgcgtcggggccgatggagaagatcatcgtgaagggcagcgagagcgtgagcatcaggagcgggaccagcgggtgcaccttgccgcgccgggcgggtgcgtccgcgtcgctcctgacctgtgtcccggtcgtcccgttccccgcctcggccagcgccgtcgccgcgatcgtgcgggggtcccccagctccgtgagtatctcgccgatcatggcgtcgggacgctccgtacgcgtcacctcgatgtgctcggcgaggtccgcgagcagttcctggcggcggtcggcggggagagcggagctctcccgctccaccgcggagaggtagttgcgcacggggtcggcgaaggtcttcatgcgaggtctccgttggaggtgtgggccccgaaccggcggacgcccttcggaggcccccgtggaaccggtcgtggcgtgaaactctgaatggtggttcacttctttcatggcctaccgcaagacccccgccgaaatccgtcggctcgaagccgcccgggaacatctcgtcgtccgcgccaccgaggtcgtggcggaggtcggctgggcgcaggcgtccgtgaccgctgtcgccgacgcggccggcatcgccgccggctccgtctaccagcacttctcgtccaagtccgcgctggcagtggaggtcttccgtcgcgccgcgcagcacgaggtggacgtgctgggcgaggtgctggagggcgacggcgaccccgccgagcgcttgcgccggggggtggaggtgttcgcccggcgtgccctggagaaccacgggctggcgtacgcgctgctcgcggcgcccgccgaaccggcggtcggcgcggaacgtctcgccttccggcgccgctaccg

SEQ ID NO: 3468 - DNA, 6185 bp, Unknown
  Kingdom: Bacteria, Phylum: Actinobacteria, Class: Actinobacteria, Order: Streptomycetales, Family: Streptomycetaceae, Genus: Streptomyces
gcgtcgccccggccgccggccccgccctcggacgcgaaactcgcccgtgaggcgggccggcacgacctcacgcgcgaacagttctacttcgtgctgcccgaccggttcgccaacggcgacgcctccaacgaccggggagggctgaccggttcgcgtctggagcacggctacgaccccacggacaaggggttctaccagggcggcgacctcaagggcctgacccagaagctcgactacatcaagggcctcggcaccaccgccatctggatggcgccgatcttcaagaaccggcccgtacaggggaccggcaaggaggcctcggcgggctaccacggctactggatcaccgacttcacccaggtcgacccgcacttcggcaccaacgccgacctggagaagctgatcgacaaggcccacgccaagggcatgaaggtcttcttcgacgtcatcaccaaccacaccgccgacaccgtcgactacgcggagaaggcctacggctacaagcccaagggcgccctcccctacctcgacgaggacggccgccccttcgacgaccgcgacggcgtggagaaggtggaccgggactccttcccgtacaccccggtccaggcccccggcaccggcgagaaggtcccgtcctggctcaacgaccccaccatgtaccacaaccggggtgactcgacgtgggccggcgagtccaacgagtacggcgacttctccgggctcgacgacctgtggaccgagcgtcccgaggtcgtgaagggcatggcgaagatctacgagaagtgggtgcgcgacttcgacatcgacggcttccgcatcgacaccgtcaaacacgtcgacctggacttctggacccagtgggccaccgcgctcgacgcgtacgccgcgaagcgcggccgggacgacttcttcatgttcggcgaggtgtactccgccgacaccgaggtgacctccccgtacgtcacccggggccgcctcgactcgacgctggacttcccgttccaggacgccgcccggcagttcgcctcccagggcgcgcccgccgacaagctcgcctcggtgtacggcaacgactaccgctacaccaccgacaaggcgaacgcctacgagcaggtcaccttcctcggcaaccacgacatgggccgcatcgggaccttcctgaagcaggacaacccgaaggccgacgacgccgagctgctgaagcgggcccggctcgccaacgagctgatgttcctcggccgaggcaacccggtgatctactacggcgacgagcagggcttcaccggagccggcggcgacaaggactcccgccagacgctcttcgcctcggagaccgccgactacctcgacgacgaccagctcggcaccgaccggacgcacgcctcggacgcgtacgacacggagcacccggtctaccgctccgtcgccgcgctctcgaagctcaccaagcagcacccggcgctgcgcgacggcacccagatcgagcggttcgcggaaggctcggtgtacgccacctcgcgcatcgcgaccgagcgaccgtacgagtacctggtcgcttccaacaacggcacgagcccgcggaaggtccagctcgccaccgagtcggccgatatgaacttccgtaccctgtacggcggttccggctcggcccgcagcggcaaggacaagaaggtcaccgtcaccgtccctgccctctccagcatcgtgctgaaggcggaccggaccgtcgccacccccgccgccaagcccacgatctcgatcgaggccccggccgccggcgccaccggcaccgtcgagatcaccgccgacgtggacggcggacagctcaaccgggtcgtcttcgccgcccaggtgggtaacgggaagtggacgacgctcggttcggccgaccacgccccgtaccaggtcacccagtacctcgacgagacggtgaaggcgggcaccccgctgcgctacaaggccgtcgtcgtcgaccggaccggccgcacctccggtgccctcgccgagaccaccgcgggagcgaccccgccgaagccgaagcccgtcgccgtcgagcgcgaccgggccgtcgtccactaccagcgccccgacggcgactacgagggctggcagctgaagtccggcgagatgaccgccgagttcatcgggcgggacgcctacggcgcgttcgcctggctcgacctggagaagggcgccgaatccgtcccgtacaccatcgagaaggacggcacggccgacggcccgcagcggacgatcgacctcggtgcgaccggtcaggtctggatcgagcagggcaaggacgggcaggcggccgaagcccccgaggccccgccgcaggacaccacgaaggccgtcctcaactaccaccgcccggacgggaactacgacggctggggactgcacacctgggccggggccaaggagcccaccgactggtcgaagccgctggcgcccacgaagaaggacgcctacggggtcaccttcgaggtaccgctcgtcgacggcgccacctcgctcagctacatcctgcacaagggcgacgagaaggacctgcccaccgaccagtccctcgacctcgccacgtacggccacgaggtctggatgctcggcggcaagcccggctacctgctcccccagaccggcggcggcgcggcccccgacctcgggaaggccgaggcgcagtggctcgacgcggacaccgtcgtctggaaggtgaaggccaccgacgccaccagccagcagctcgtgtacgcgaagaacggcggcatctcggtcgtcgacggggcgctctccgacgagggccagtggctgcggctcaccccggccgcgctcagtgacgcgcagaaggcgaagttcccgcacctcaaggactacccggcgttcaccgtggacgcccgcgaccgggaccgggtccgcgagtccctgcgcggccagctcatcgccacccagcgcgccgccaacggcgctctgctcgccgccaccggcgtacagacggcgggcatcctggacgacctgtacgggaagaaggcggcatccgccgcactcggcccggtcttccgcgagtcgacgcccacgctctccgtgtgggcccccaccgcccggaccgtcgcgctcgaactcgacggccgcacccacccgatggagcgcgacgaccgcaccggcgtctggtcggtcaccggcaagaagagctggcggggcaagccctaccggtacgccgtgaccgtctgggcccccaccgtccagaagctggtcaccaacaaggtcaccgacccctactccaccgccctgaccgccgactccgcccgcagcctcgtcgtcgacctcaccgacccgaagctggcgccgcgcggctggtccggtctgaagaagcccgccgcgaccccgctgcgggacgcccagatccaggaactgcacgtccgcgacttctccgtcacggaccgcacggcgaaacaccccggtgaatacctcgccttcaccgacacccggtcgaagggcatgaagcacctggagaagctcgccgactccggcaccagctacgtgcacctgctgcccgtcttcgacatcgggacgatccccgagaagaagaaggaccagcagaagcccgcctgcgacctgtccgtctacgcccccgactccgaggagcagcaggcctgcgtgagcaaggccgccgccaaggacggcttcaactggggctacgacccgctgcactacaccgtccccgagggctcctacgcctccgacccggacggcacccggcgcacggtcgagttccggcagatggtccagggcctcaaccgggccgggctgcgcacggtcatggacgtcgtctacaaccacaccgtcgcctccggccaggacgacaagtcggtcctcgacaagatcgtccccggctactaccagcggctcctggaggacggcgccgtcgccacctccacctgctgcgccaacaccgcgcccgagaacgccatgatgggcaagctcgtcgtcgactcgatcgtcacctgggcgaaggagtacaaggtcgacggcttccgcttcgacctgatgggccaccaccccaaggacaacatcctcgccgtccgcgaggcgctggacgggctgacgctcgcgaaggacggcgtcgacggcaagaagatcatcctgtacggggagggctggaacttcggcgagatcgcggacgacgcccgcttcgtccaggccacccagaagaacatggccggcaccggcatcgccaccttctccgaccgggcccgcgacgccgtacgcggcggcggccccttcgacgaggaccccggcgtccagggcttcgccaccggcctctacacggaccccaactcctccccggccaacggcacccgcgccgagcagaaggcccggctgctgcactaccaggacctcatcaaggtcggtctcaccggcaacctcgccgactacaccttcaccgacacctccggccgcacggtcaagggctccgaggtcgactacaacggagcgcccgccggatacgcggccgcacccggcgacgcgctcgcctactccgacgcccacgacaacgagaccctcttcgacaccctcgccttcaagctcccggccgacaccacggccgccgaacgggccagggcccaggtggtggccatggccgcctccgtcctctcccagggcccctcgctctcgcaggcgggcaccgacctgctgcgctccaagtccctggaccgcaactcctacgacagcggcgactggttcaacgccctgcactgggactgccgcgacggcaacggcttcggccggggtctgccgcccgccgccgacaaccgggacaagtgggcgtacgcgaagccgctcctggccgccaccggcaccatcgcgccggactgcgcgcagatcgacggggcctcggccgcctaccgcgacctgctcaccatccgtaccaccgagaaggagttctccctcagcaccgcggaccaggtgcggtccaccctgtccttcccgctctccggcacggccgagacccccggcgtgatcaccatgcgcctaggcgatctggtcgtcgtcctcaacgccgcgccgaccaccgccgaccagcggctcgccgcgccggcggggaagacgtacgcactgcaccccgtccaggccgagggcgcggaccctactgtcaaacgagccaggtacgacggggaatcagccactttcaccgtcccgggacgcacggtggccgtcttcgctctgcgctgacctccggcagcactacggtgacggcagacgtcggcaatggagccgcgacagccgtcctgttccaccgggccggtcccgttctccccggagggagaacgggaccggcccggtgcgcgcggcaggagccccacccggggcgggtcggctcgccggcgcaccctgccccagcgtgcggacggtgatgatgaccaaggtgggataccttcccgacgagacgagcagcttcgtcgggaggcgggccgaactggcccggctgcacaccgcgttgaccacccggcggatgaccaccctgatcggccccggcggagtcggcaagaccaggctcgccgtccgggcggcccgcgtggccgccgaccgttacgcggacggcgcctggtgggccgacctctccccgctccccgacgacaggctgctgcttcccaccgtctcggacgcggtcggtctcgccgaccacaccctgcggatgcccgtcgaggcgctctgcgaatggctcggcgacaaacgcctcctgctggtcctcgactccgccgaacacctccggggcccctgctcccatctgctggccgagatcctgaccacctcgacgggcctgaccgtcctggtcaccagcagacagccgctcggcacccggggggagtacgtcgtcgaggtgccgccgctcccggtcgacggcgctcccgacgccctccagctcttcgccgaccggctgcgcgcggccgacccccgcgccggtctcgacgctcccggcgacgaggaggccgccgccgagatctgccgccgcctcgaaggcatccccctcgccatcgaactggccgccgcccggctgcggatgctcaccccgcgccagatcgccgaccggctcgacgaccgcttccgcctgctcaccagcggcagccggaccgtactgccccgccagcagaccctgcgcgccgtcgtcgactggtcctggg

SEQ ID NO: 3469 - DNA, 1106 bp, Unknown
  Kingdom: Bacteria, Phylum: Actinobacteria, Class: Actinobacteria, Order: Streptomycetales, Family: Streptomycetaceae, Genus: Streptomyces
gggtgaggccgtcctcggcgatccgcttgaggccgaagatcagggcgagcatcccgatgacggacatgacggcgctgatgaggtccgggcgagcgaccgaccggtcccggtactcgggcagcaggatcgggccgaggatgagcagcagcagcatcacggggacgccgatcaggaagaccgctccccaccagaacagctccaggaaggtgccgccgatcagcgggccgatcaccgtaccgaggccgaagaagccggtccaggccccgatcgcggcaccttcctggagctgttctggtggggagcggtcttcctgatcggcgtccccgtgatgctgctgctgctcatcctcggcccgatcctgctgcccgagtaccgggaccggtcggtcgctcgcccggacctcatcagcgccgtcatgtccgtcatcgggatgctcgccctgatcttcggcctcaagcggatcgccgaggacggcctcaccctccagtccggcgcctcgatcgtgatcggtctggtgctcgccgtgctgttcgtccaccgccagggccggctgacccagcccctggtggacctcaagctcttcagcaacagcctgttcggcaccgcgctggggatgctggtgctcgccaccctgctctccgccgggctccagttcctcgtgatccagtacctccagctcgtacgcggtctctccccggtccaggccgggctctggtccctgccgatcaccctcggtgtgatggtcggtgccatgggcgggcccgcgctcgccgggcgggtcaagctcagccatgtgctctccggcggcctggtggtcgccgcgatcgggatgctgatgctgacccgcgtcagcggccccgacgacctgttcctcgcggtgggcggtacggccgtcctcggtctcggtctcggcccgatgatctccctcggcaccggactgatcgtgggagcggccccgcccgagcgggccggtgccgcctcagcgctggccgcgaccggtcccgaactcggcagcgccctcggcgtcgcgttgatcggcagcgtcggcttcgcggtctaccgccccgagctgggcgaccggccccccgaggggctctcggcccggg

SEQ ID NO: 3470 - DNA, 1231 bp, Unknown
  Kingdom: Bacteria, Phylum: Actinobacteria, Class: Actinobacteria, Order: Streptomycetales, Family: Streptomycetaceae, Genus: Streptomyces
caagctccgcgccgagcacggcacggtcgccccgatcctgctccacggcgacgtgcccgcctggctcgtgctcggccacagcgagaacctccacgtcacccgtacgccctcgcagttctcccgggactcgcgacgctggcgggccctccaggacggcagcgtcgctccggaccacccgctcgccccgatcttcacctggcagcccgtctgcgtgttcgccgacggcgccaagcacgagcggcagcgcggcgcggtcaccgacagcatggagcgcatcgacacccgcggggtgcgccgccacatcaaccgcttcagtaaccgcctcgtcaacgacttctgcgagaagggcaccgcggacctggtcagccagttcgcggagcatctgccgatgatggtggtgtgcgcgatcttcggcatgcccgaggagtacgacgagcgtctcgtccaggcggcccgggacatgacacgcggcaccgagaccgccgtggccagcaacgcccacatcgtgtccgtgctgacgcgcctggtcgagggacgccgcaacgaccccgcaccggacctggcctcctggctcgtcgagcaccccgcgacgatgaccgacaccgaggtcatcgagcacctgcgcctcatcatgatcgccgcctacgagtccaccgccaacctcatcgccaacgtgctgcgcatggtcctcatcgacccgcgcttccgcgcccggctcagcggtgggcacatgaccgtcccggaggcggtcgagcagaccctctgggacgagccgccgttcaccgccgtcttcggccgctgggcggtcggcgacacggagctgggcggccagcagatcaaggcgggcgacgccctgctcgtcgggatcgcaccggccaacaccgaccccaccgtccgtccggacctgagcgccgacatgggcggcaaccgcgcccacctcgccttcagcgggggcccccacgagtgcccgggacaggacatcggccgggccatcgccgacgtcggggtcgacgcgctcctgatgcgcctgccggacctggagctcggcgtcggggagagcgagctgcgctgggtcggcaacatcatgtcccgccacctggtcgagctgccggtgaagttcgcccccagtccccagcagaagctggacgccgacccgctctcggtgatggcccgtgccacccgcccggccgacgcctgggagatctcccccccggccaggcaggtccccgag

SEQ ID NO: 3471 - DNA, 6524 bp, Unknown
  Kingdom: Bacteria, Phylum: Actinobacteria, Class: Actinobacteria, Order: Streptomycetales, Family: Streptomycetaceae, Genus: Streptomyces
tggctggaggtctggggccgctcccagaacgccgacgacgacgcccgcgcccggcaggccgcgatcgaaggggtctggcaccgagacctggtggcgctgctcgccgagggggtctcgcgcggcgagttccggccggtggacgccgaccggttcgccgcccggctgcgagcgctgctcgacgggttcagcatccatgtgaccgtcgggatcccggggacgggccgcgagcaggtgctggcgcaggcggcggagttcctggacgagacgctgacaccggacgcccactgagcgatgcgaccggcgtcacgaccgcatcctgagacgccgcagtcacgggaccgtcactgtgccagactgctgctgtgtcctcgttcgtcatgattattggcagcaggcgcgccggtccgcagtgaccgtcccgtaccaccatgtacggcgcggccatcgtgccccagacccgcgcgcagacctctcgcacccgcgaggggttttttcgttttccggcccgcaccctggccggggcgaggcgcgcgagatgatgggggcaagtggaagccgatcgtccggatccactcatccgacaggagtcagatcagcatgaccaccaaggccacggccaccgacgacagtttccatgtcttcgacaccacactgcgcgacggtgctcagcgtgaaggcatcaacctgacggtcgccgacaagctgaccatcgcccgtcatctggacaccttcggagtggggtacatcgagggcggctggccgggggccaacccgcgcgacacggagttcttcgcccgcgcccagcaggagatcaccttcgagaacgcccagctcgtggcgttcggcgcgacccgcagggccggcggcagcgcggccgaggacccccaggtgaaggcgctcctgaaatccggcgccccggtgatcacgctggtggccaaggcacacgaccggcatgtggagctggccctgcgcaccaccctggaggagaacctggagatggtccgcgacaccgtctcccacctccgcgagcagggccgccgggtcttcgtggactgcgagcacttcttcgacggctaccgcgccaacccccagtacgccaagtccgtggtccgcaccgcgtacgaggcgggcgccgaggtcgtcatcctctgcgacaccaacggcggcatgctccccgcccaggtccaggccgtcgtctccacggtcgtcgccgacaccggcgcccggctcggcatccacgcccaggacgacaccggctgcgccgtcgccaacaccctggccgccgtcgacgccggcgccacccacgtccagtgcacggccaacggctacggcgagcgggtcggcaacgccaatctcttcccggtcgtcgccgccctggaactcaagtacggcatgaaggtgctgcccgagggcgcgctcgccgagatgacccgcatctcgcacgccatcgccgaggtcgtcaacctcactccctccacgcaccagccgtacgtgggcgtctcggccttcgcccacaaggccggactgcacgcctccgcgatcaaggtcgaccccgacctctaccagcacatcgatcccgagctggtcggcaacaccatgcggatgctggtctccgacatggcgggccgcgcctccatcgagctgaagggcaaggagctcggcatcgacctcggcgacgaccgcgccctggtcggccgggtcgtggagcgggtcaaggagcgcgaactccagggctacacctacgaggccgccgacgcctccttcgaactgctgctgcgcggcgaggtcgagggccgggcccggcgctacttccgtacggagtcctggcgggcgatcgtcgagaaccgtcccgacggcacccacgccaacgaggccaccgtgaagctctgggccaagggtgagcggatcgtcgccacggccgagggcaacggaccggtcaacgcgctggaccgggccctgcgcgtcgcgctggagcggatctacccgcagctcgccaagctggagctggtcgactacaaggtccgcatcctggagggccgcacgggcaccgagtccaccacccgcgtgctcatcaccacgggcgacggcaccggcgactgggcgaccgtgggggtcgccgagaacgtcatcgccgcctcctggcaggcactggaggacgcgtacacctacgggctgctgcgcgcgggcgtcgagcccacggagtagcccggccggaccgcagcacgcgagagccgccgcccgtcaccgggtggcggctctcgcgcgttcaagagatgaacacgcaactctccctgcctggtgggcagatgggtccggaccaatctcggcgtgaagtattgacggccccgaatcggcgcggttaactccagccgcaacgccggtaccggttccggaaccggtaccgaacgcgtcggccgacgtgccgcaggcctgcccgtcgcgccgctccaccctgctcccacctgctcgtttccctacccctgcctggttccgtggaggcccggatgcgtgtcaccatcgccgatgtcgcccgtgaggccggcgtcagcaagacgaccgtgtcgcgggtcatcaacaccaagggcgaggtggaccgctccacagccgcccgtgttcgtgaagtgatcgcacagctcggctacgtacccagttccggagccgtcggtctcgcccgcggttccagccgtacggtcggcatgctcgtgccctcgctgacctggccgtggatgggcgaactgctccagggcgtcgtcgacaccgtcgaggccgccgactacgggctgctgctcttcacctgcaaccgcggggccgagtccgtccagcgcttcaccagccaggtgtccgcgcgcgccttcgacgggctcgtcgtcgtggagcccgagaacaccctcggccacctcaccgacctgcaccgcgacggcctgccgatcgtgctcatcgacgatcgcggccaccacccggaattcccctccgtcgtgaccaccaaccacgagggaggcgcgtccgcggcccgccacctgcacgccgccggacgctcccggcccctggtcctgaccggcccccagcacttcggctgcgtacgggaccggctggacggattccgttcggtgctccccaccgagctggtcgtcgaaggggacttcaccgaacgcggcggccggctcgccgtcgaggaactcctcgcgcgcggcgtcgcgttcgactccgtcttcgcacacaacgacatcagcgcggcgggcgtgctccgcgccctgcgggccgccggacgccgggtcccggacgacatcgccgtcgtcggcttcgacgacatcccgatggccgaacacaccgaaccgcctctgaccaccgtgcgccagcccacccgccggatgggcgagacggcggcccggatgctgctctcccacctcggcggcacgcccgtaccggaccggccggccgtgctgcccaccgaactggtcgtgcgccactcggcgccgtaacggacccggccgcacggccgcgccccgcttcgcacccttccgcccgccgggatctccgacccggcagccccttcctggagtcgccatgtccgcacgccgtcgcaccaccctccgagcggtcgccgcagccaccgtcgcggtggcgctcgccgccggttgctcgaacgccaactcgggtgccaacaaagggggtggagccgcgggcggcgtactgaccctgggcaagccggacgggccgcagacgaacaacagcaacccgttcctcaacacctcggcgggtgcggtcctcggctaccggtacatgatctacgagccgctggccatgacgaacatgatcaagcccaccgagaaggccgacccctggctcgccaccgactgggcctgggaggacaacttcaccaaggtcaccttcaccctggacgagcgggcgaagtgggccgacggcaagcccctgacggccgccgacgtggagtacaccttcaacctcctgaagaagcactcggcgctcaacgggaacggcatccccttcgacgggatcgcggtcgtggacggaaaggtcgtgctgacattcgaggagtcccagttcgtcaaccagaacaagatcatccagaccttcatcgtgcccaagcacatctgggagaaggtcaagaacccggagacctggcccaaccgcaccccggtcggctccggaccgtacaagctcaagacgttcaccccgcagaccaccaccctgaccgcgacgccgagctactggaacggcaccacgaaggtcaaggagctgcgttacaccgcgtacaacgacaacagcgccgccaccaccgcgctggccaccggcaaggtcgagtggtccttcgtcttcatgccgaaccacaagcagctgttcatcgacaaggaccccaagaaccaccagctctggttcccctccggcctcggcatccacggcctgtggttcaacaccgcccgcaagcccttcgacaacccggcgctgcgcagggcgatggcgatggtcgtcgaccgcaaggccatccacatccaggcccaggccacgctctacccggagatcaccaacccgaccggcatcccgctccccgccggtgagcccttcctcgcgcccgagtacgaggacgcctccaccgagcccgacgtcgccggagccaagaaggtgctcgacgaggccgggttcacgctcagcggcggggtgctgaaggacccggacggcaaaccggtgaagctgaccttcaccgacccggccggctggaacgactacatcaccgggctcgcgatcatcaaggacaacatcaagcagctcggcatcgacgccaaggtcaagacgcagaccgccgaggcctggggcgcggacgtcgccaacggcaacttcgacgccaccctgcactggaccaacagcggcgcgaccccctacgacatgtaccagaacatcatggacggggcgatcctccagcccgtcggcaagagctcccagacgggcaacttcgggcgcttcaagagccccgaggccaccgaggccctcaagcagtacgccaacgcgtccacggacgccgcccgtaccgaggccctcaacaccatccagaagatcttcgtcgaggaggcgcccgtcatccctacggccgccgcgcccatcggagccgagtactccacgaagaactggatcggctggcccaccgaggccaacccctacgccccgccgcagcacacccagccgaccgcgctggagatcgtgctcaacctcaagcccgcctccaagtaggcgcggggaagacgggacggaagaaccggccatgaccagcgatcagtccgcgaacgcgcccaccggcaccgacgtggtgctcgaagcgcgcggagtcaccaaacactttcccctgcgacgcaccgcccgcgacctgttcgcccgcgagcgccgcagcgtccacgccgtcgacgacgtctcgctccggctgagacgcggcaccgtcacggccctggtgggggagtccggctcgggcaagtccaccgtcgcccgcctgctcgcccagctccatccgctcacctcgggcgagatacggctgggcggcgagccggtggtggccggtcgcggccggtccttccgccgttacgtacgccgggtccagctgatcttccaggatcccttcgcctcgctgaacccggtgcacaccgtgcgctaccacctgacccgcgccctgaagatccacggccgggcgggcaacgggaaggcggagctggaggagaacctggccgccctgctgacccgggtccagctgacccctccgcaacagttcctggacaagttcccgcacgagctgtcgggcgggcagcgccagcgcgtcgcgatcgcgcgggccctcggcgcggacccacaggtcctcctggccgacgaacccgtctcgatgctcgacgtgtcgatccggctcggcgtcctcaacctgctccacgacctcaaggaacgcctccacctggcgatcctctacatcacccacgacatcgcctccgcccgctacttcgccgacaccaccctcgtgatgtacgcgggccggatcgtcgagggcggcgacagcgagcgcgtcacccagcaccccgctcacccctacacccagctcctgatcgcctccgcacccgacccggaccggatcgtcgccgaggaggaacaggaggagaccggcaccggcgagccgccctccctgatcaccccgcccgccggctgccgcttccatccccgctgcccccgggcgatggagcgctgccgcaccgaactgccgccgcgcttcgacctgcccgacggacagtgggcggcctgctggctgtacgacggagcggcggccgacggcgtaatggcggacggcacagcgccggccgacggcgtaatggcgaacggcacagcgccgcccgacggcaccgccgcgcacggcacggccgcgaaggaggccacccggtgaagtacatcctccagcgcctcgccttctacgccgtcaccgcgtgggccgcgatcaccatcaacttcctcatcccccggctcatgccgggcgaccccgt

SEQ ID NO: 3472 - DNA, 4847 bp, Unknown
  Kingdom: Bacteria, Phylum: Actinobacteria, Class: Actinobacteria, Order: Streptomycetales, Family: Streptomycetaceae, Genus: Streptomyces
cttctcgcacagcgcttccggcgccgccgtcccgcacgaggtgccggctccccgggccgcgaggccgacgcggcagcgcgcccggcgggggaggatcgcgcagcgcttcgtcccgcacgatctgcggcccgtcgcgctgcgggacgagctcaccgaactcggtgaactcttccgcgcctaccagcagcgtgccgaacccgacctcgcgatgctcgccgacctccacgcccgcaaggcgaaggccttcagcgcctgggccgaagtcaccgccgacaccggactgcgcctcgacgccgagcgagccgaacaggccgccgccaccgcccgtctccagcatctgcaccgcagcggccaggctccggaaggcgaaggtcccgctgtggcacggctgttgaccgcttccgcgcagtggaatcacgcacgggcggtcctcgcccatgtggccgaccactcgcccctgccggggccggaggcccgcctgctggtggtgatgctgacgctgcgtacagcgcagtccggcgtcggtaatctcgtcgggcaggacctcaaggggctgcccctgccggatcccgaacagctggtggggcaactggtggagtgcggctggctggaaatcgccggaacggtcgacgaactgatcgcctcccgcccggagaaccccacccgcatcggagtgccgtccctgacgcccgacgagagcgacccgggaccgttcacgttcggcaggaagatgcgcccgaagctcagcggatgggcccagcgagtcgtcggcgagaagaagctccgcaaggccaaggccgcggccgacgcccgtctgctcgccctggccctggccaccggcgtcagcgccgacggacaactggggcccgggggcgagggcctcggcctcgaagacctgtcctcctggtgcgccatcgcccccggcgacctgcgggagctggtggaccggctgaccgcggcggactggctgacggaggcggtcgtcacggacaccgtcctcaccggccggctgaccgaacgcgtcctccccctcagctgcccgctgtcctgagaaaggggagcgggagcagacgaggcccggtgcgcgctcggctacttgaccgtgatcgactccacgaacgcgtccaggtcctccgcgtcgaccgcgtccttcaccgcgttcaggcgcaccacgaacggaactcccttcgagtcgacgcccgcgaccaggaccccggtcatcggggtccccacgttcggggtgtcgtcctggccgtcggccgtgaagtcgtagtcgatccggcgggcttcgcgggcctcgcgtgcgtcgtccgggcccgccaggcgtacgtcctccgtcgtcctgcgggtggagttcatgccgatgccggcgcccgccgcggctgccgccccggcggcgtcgctcacgccggtggcgaagtccagctggaccgagaccatgccggtgcggatgccgtccttctcctggagcgccacggccgcgttgctcttcgcccgctcggcagcgggctgttccgcgtacccctcggtcttcgggtagccgacgctcaggctcctggtctccagcgtgccccagccctcggggacggacgccgtgtcctggccgtcgccgcatccggtcagcaggagggccgctcccatgacggacactcccatgacggccgcgttggtggccgtcatgcggcgccgggtcgtccccgccgccggggtcttccgcgtcctggctctcatcgctcgtgtcaccgccccttcgctcccgtctcttcgcctcgtcagttcgcgcagtagctgtacggaagatacgtgcgcgcgtcgccctgcggggccccgaggaaccgcgcgtccgtcagggtctccttcttctcctccgtggagagggagaatccgaggctcatgccgagcgagatctcgaagccgaactcctgggcgtcgctcgcgccggtgtaccgcatggagctggacagcccgtcctcgaacatcagctgctggaacgggtcgttgccctccgggcggttctccatgccgtggtcgccgaagaggtactcgaacggggcggtgttgttcccggagccgtccagccactgttcggcgacgccccgcttggcctccgtgcccgcgtccgtgtccttgccgaagacgatcgagttcgtcaccacgtcgatgccggtgtcgcccgaggagtccgacgcgctgcccttgccgccgcgcttgtccttgccgctctcgccgttgtcgccgccggcctcgaccttgccggaggtcgaaccgctctccaccgtctgcgtcatgtcgatgcggacgatcttcccggtcttctggtcgcgggtgacggtgatggcgccggtgcggttctgcttgccgccgacggtccccttgaccgggcccacgtttccggcggccttgccctccagttccagcttggcggtgtacgtgtacgactcgttgccgttcacgtcgtccttggtgatcgtcacctcgggcgagaacttcgccttgccgcccagtttcgcgccgagttcgccctcgtcgccgcccttgagggagaggccgccgtccgcgtaggcattgaggccgacggtcgagtaggagatcttcttgtcgccgatcttcctctcgatgtcctccttcttctccgcccacttcatcgcggagtaccagccgccgccgtaaccgccgctgtgcttggtggaggtctcccacatcttcatttcctcgatgtcgtcccgcatcttctgcgcctcctcctcgctcgcgaagatccaggtgtcaccgttggtgatcttgatgccgccgccgatgtcgacgtccgccttgccgaggctcccgagcttgacgcccggggtactggccgtggccccggcggacgcggcgtcggtgaacgtcatggagacgaccttgtccttcccgtcgaccgtgccgtcgccgttcacatcggtgctcgcctgggagaccttctgctggaatccgtactcctcgccccactcgaaccaaccgatcttgaccttgccgcccgccgtgtccgagatgctggagacctggcacatcttgggttcgtagtccttgtccgtcttcggcttcgcctcggggtcctggccgccgcccgagcacgagccgccgccaccggccagcgagctgatcgcgcaccgcaggcgctccccgatcttcccgccgaccccggccatcgccatggcgccgatcagcatggtgacgaggacgacgaggcccaggtactccatcgcggtcgcgccgccgtcccgccagttgtacgagtaccggggcggctccggggtccgggtggcgcgctcctccaggagccggtcgacggccacccccgacgccgcgcccgccgccagcgagacggccggcatgaggacgccctcgatgccgacgacgtccccggcgacggcgaagccgtacagcagaccggccagcggtacggcgagggcgccggccaggtacagggtgcgggaggactcgcggtactcctccgggaggatccgggccgaagccaggaccgtcaggagcgtcacgacgagggcgggcagatggagcagggccagccgccagccgaaggtctccaggcgctcctcggtgcccagcagatcgaccaggacccggctcatgacgaatccgagggcgagatagacgagtccgccgatcacccagctccgggtcaacgcgaagaaccggctgccctgttggccgccacgggcggcgccggcccccgcgatgccgtggcgccccggcggtatgtggcccgcgctccggtctccccaacccccgtcaccgctcacggtgcacctctcctcgaccccgcgcgtgttgcccgacggctgagagcgtacggccgaaaagctgccccggcccgggcccccggccccaaagccgggcccaagtgccaggagcggaagccgtgttgcgccggggggtggcggccgttccgcttggggccgcacgtgggtccgtggacccacgccgccccggtcgcggctcagtacgctcggatgtgccggtggtcgccgaccacgacgccgcgaagaactgcgatgggggtgggcgtcgatggatgccggattcttctactcgtaccacctgggctggacccggctggacgcccggacactgctgggcgacctggaggccgaagggctccgcccggtgcacccggtgaccggccgcacggtgctcgtcagcctcgactccgcctccctgggggcccgttcacccgtcacccgcgagcagttgctgtccatcgccggcctccagcggctgcgcgaggtcggattccggttgtggaccgacgggggcctcgacctcctggtgcgcatccggcaggccaggtccggtgtcgtcgccgtggagttctccgtgggggagctgcccgagccggagcgggagcacgcggtgagcgccatccggcggaccgtcggacgggcctccgtgctctgcatcggcttcgtcgtcgaccggagcggcgcgacggccgccaccgactgggacggcgtcgtcatcgagggcgacgcgcacctccactcctggccggacaccgtcgccgtacgggacgagacggccgcccgccacccgcagctggccgtcatggacggggtggagatgtcgccgtggaaggtgtacgggaacgaggtgctcggcgtctgagcccggcctcggcgaacgccggacactccccggtccccggtccccggtgcggaggaacgccgtccgccgacgtcataatcggccgtatgtccgatcaccagctccgcacccggacgcccgccggtccggccccgggcccccgcacccccgggtcccgggccgccgccgcgttccgggcggccgcgcccgcg

SEQ ID NO: 3473 - DNA, 1764 bp, Unknown
  Kingdom: Bacteria, Phylum: Actinobacteria, Class: Actinobacteria, Order: Streptomycetales, Family: Streptomycetaceae, Genus: Streptomyces
gtcagagggtggggtggaggtgttcggggaggggtggacggcggaacgcttcttccccggcgtgccgccggggtgccgcgactgcctcactgaactggactttcgtcggcttaggaggtttatccgctcttcgtcatacgtgagggggaatcgggtgatggtgaggggttcgccggggatgcgctgggcaactctggtctcgcgacgttgtgaacagcaccggggtggtcggccgactcccccgggaccagccgaatatgaagccacaattccgtttcctggaggaaatgacatggcaagtatccgtaccgctcgtgtcctcgccgctgtcgctgctctgcccctgacggtcgcgctctgtggcggggtcgccatggcggacaacggctccttcgcgaacgacggatcgaacgcggctgtggcgacggtcggcggaagcggcgtcggcggcaacaacgccggcaactcgtccacgacccagcagcaggcggtcgggaccggtgcgtcgaaccagaacacctccgcccaggtcagcaattcggccttcgtgccgatcgatcagtcggaccacagcgtcgcggtgaacttcacgcccattttctggtgatcctcctcgggtgacacggctgacgcggtcgtcgggaccctccgggggtgggtcccgaaaggccgaacagcagcccgcgcgaaggcacttcagtgccctcgtgcgggctgccgccgtcttgacaggggccagtacctgacggacagtcagaaacgtcggatcgcggaccgccggtcgccggatacgccggacgccggtcgggagcgctccggcttttccgtatccgcagctctggaggcccctccgtgcatctcgctccgacggaacgccagcagcggctccgtgccgaactccgctcgtacttccgcgcgctgacgcccgaggcggcggacggcgggaacggcggagggagggacggcggaaaggacagcgggaaggagagcgggaagggcgcgggtgccgggccggacgcgggtgaacagcggcggctgctccgccggatcggcgccgacggcctgctcggtctcggctggccggaggagtacggcggccgtggccggggccccgacgagcagttcgtcttcttcgacgaggcgtaccgggcgggcgccccggtctccatggtcacgctcaacaccgtcggcccgacgctgatggcgtacgggaccgaggagcagaaggcgtacttcctgccccgcatcctccgcggcgacctcgtcttcgcgatcggctacagcgagcccgaagcgggtacggacctggcggcgctgcggacccgtgccgtgcgggacggcgacgactgggtcatcgacggccagaagatcttcaccagcaacgcccagcaggcggactggatctggctcgcctgccgtacggaccccgaagcgcccaagcaccgcggcatctcgatcatcctggtgcccacggactgccccggcttctcctggacgccgatccggacggtgggcggggtcaccaccaccgccacctactacgacggagtacgcgtcccggccaccaacctcgtcggcgcggagaaccagggctggcggctgatcaccagccagctcaaccacgaacgcgtcgccctggccgcgatcggcatgcaggccgaggacttctacgaggaggcactcgcccacgtccgtacccccgatcccgtgaccgggcgccgccggatcgacgagccgtgggtgcgcgcccggtcacgggatcgg

SEQ ID NO: 3474 - DNA, 2116 bp, Unknown
  Kingdom: Bacteria, Phylum: Actinobacteria, Class: Actinobacteria, Order: Streptomycetales, Family: Streptomycetaceae, Genus: Streptomyces
accccgggccgacgcccaggaccccccgtagcaccgcgaccccggcccaccccatgggccggggtcgcttttcggacgcgtatacacagcaggtatacacaccgtgtacagtccttcccatgtctatcggtcacaccctcctcgggctcctggagtccggcccccggcacggctacgacctgaagcggaccttcgacgagaaattcggccaggaccgcccgctccactacggccaggtctattcgacgatgtcccggctcctgaagaacggactcgtcgaggtcgacggcgtcgagagcgaaggaggccccgagcgcaagcggtacgccatcaccgacgccgggatcaccgatgtctcgcagtggctggcgcagcccgagaagccggagccgtacctccagtcgacgctctacaccaaggtcgtcctggcgctcctgaccggtcgcagcgcggccgatctgctggattcccagcgctcggcgcacctgcggatgatgcgcatcctcaccgaccgcaaacgcaagggcgacctcgccgaccagttgatctgcgaccacgccctgttccacctggaagccgatctgcgctggctggaactgacctcggcccgtctcgaccagctcgccaaggtggtggctccgtgattcccgaaggctccctgctcgccgcgcacgatctgcgcaagacctacggttcgacgtccgccctggacggcgcgtcgttctccgtgcaccccggcgaggtcgtcgccgtgatgggcccctccggatccggcaagtcgacgctgctgcactgcctggccgggatcgtcacgcccgattccggcaccatcacctacgcgggccgcgagctgtccgcgatgtcggacgccgagcgcagcgccctgcggcgcagcgacttcggcttcgtcttccagttcggccagctcgtcccggagctgacctgtgtggagaacgtcgccctgcccctgcggctgaacggggtcaggcgcaaggccgccgagcgcaccgccctggagtggatggagcgcctggaggtcgacgacctcggggccaagcgtcccggcgaggtctccggcggacagggccagcggatcgccgtggcccgtgcgctggcggcgtcgccgaaggtgatcttcgccgacgagccgaccggtgcgctggactccctcaacggcgagcgggtgatggagctgctcaccgagtccgcccgctccgccaacgtcgccgtggtcctggtgacccacgaggcccgcgtcgccgcctactccgaccgtgacgtcaccgtgcgcgacggccgggcccgcgacatggagcacgccgtatgacgctgctcgaagagaagcggcccgcggcgccaccccgtccggcgtcgccctcgcggggtgcggtgaccctccgcgacctcggcctcggcatccggttcgccgccgccgggggtcgcgagggctggatccgtacgctgctgaccggcgtcggcgtcggcctcggcgtcgccctgctgctgctcgcctcctccgtaccgcatctgctcgacgagcggagcgcgcgcgagcaggcccgcagcgaggcccggatctccggctcgcccgacgcgaacgacacgaagtcggacagctcggtgctgcggatcaacacgaccaccgagtaccacgaccggaccgtcgcgggctatctgatgcgtcccgacggctcgacgcccgtcctgccgccgggggtcgaccgcttccccgcaccggacacgatggtcgtctcccccgccctgcgggaactgctcgacgagccgggcaacgagttgcttcgggagcggctgccgcacaggatcaccggcaccatcggggacaccggactgcgctcccccggtgaactcctctactacgcgggcagcgacaccctgacgccggccaacggcggccaccgcatcgccgcgtacggcgacgaccgccagggcgatcccctcccgcccctgctgatcgtgctcgtcatcatggtctgcgtcgtgctgctggcgccggtcgcgatcttcatcgccaccgccgtgcgcttcggcggcgaccgacgcgaccgacggctggccgcgctgcgcctggtcggcgcggacatccggacgacccggc

SEQ ID NO: 3475 - DNA, 1919 bp, Unknown
  Kingdom: Bacteria, Phylum: Actinobacteria, Class: Actinobacteria, Order: Streptomycetales, Family: Streptomycetaceae, Genus: Streptomyces
gtcgaggagttcggcgcaggcatggatgagcggttcgaccgaggtgccgacgatggcgaccttggcgatcgagtgcagatcgacgcgctggtactccaggatgcgggacatcgcgccgcgcagcacgctgaacagcggtacgggtttgggccactgacggctcgggcgggcgccgccgagcacggcgatggagtcggcgaggcgtccgatcagcgcggtgccgtggtcgatgcgcagcaggtcgtcgaagacctcggggttgcgcccgtagtggtcctccatctcccgcagttcactggcctggcggtgcacgatcgcctggacgcggcgggcgacgctgacgaaggcgcgctgagcggagtcacgccgcgcctcctcgttgtcgatgacttcgaggacctggtagatctgctcgcgcagcgccttgggcagatggcggttggccacgtccgcgtcgacgatgtcgcgcatcacttcttcgggcgaattgcccacgcggagccgccggatggcggcgggcatgacttccttggtgagccgtaccgtctcggagtcgtgcgagaggatgcggtgttccaggtaggcgatgcgctgttcgtactccgcgcgctggacgcgcatggcgcgtcggcgtcggtgcagcgccacggtgagtacggcgaccacgagcgtggcgatcgcgccgcacacggcgactggtatccgcgcggccggtgcgaccagcgccgagccggcggcggtggctccgaggagcagggccacgggcagcaggactacgcggacgacgggaatttctctgtcggtcggcggtgattcaacacggaccatctaaaaccctctggcggttgattccgggatgtatgcgcgcatgagcggagactgaggaacaagtgctcgaattcatctcaactcgacttcactgcgcgtgagcttagccagatcagaacagtgcttcggcatattcacccaaccctctgcggaagctcgccgagaggaatacactcgccagtttttacacgctgcgctgcgaggtgtgcgcggtgagtgatcgtggctgagaatcgccccccttgagggctatcgcgccagaagaacgggagcagtcaccgccagctaatgtattttttccaggacaaatcacccacacacaagcatcactcaccccgcagaacaagccaacggcacaggtgatcgaaccggatcgaaaggtgcagattcctgaccggcgggcgagtgacgcgcaaaatcgccgcgctgacgcgccccacggggaccctctgccgggccgccggatcagcgccgggctccgccgagccggccttcgagctgtacgagcaactcgcccagcctggagccgagttcgtcacgcgcaccctcgtcgagaccggcgagcaccgtgcgttcgtaggcgagttgctcgggcaggagccggtcgaccaggtcccggccctcgtcggtgagccggacatgggcgaccctccggtcgcgggcgtcaccccggcgctcgaccagggcacggtcctggagagcgcgcagccgcttggtgacggcggccccggaggagaaggtctcgcgggccagctcgccgggggtcagctcccggtccgtcctgcgtacggcgccgaggaggtcgaattcggcgcgggtcagtccggcggagcgcaagggggcgtcctccgcctgctggagcagggcggcgcagcggttgatccggccgatgatctccatcggtccggtgtcgagcccggggttgacggcctgccactgccggaccaccgaggcaacgatgtcgtcggtcactccgctccgatcgaaggggcgtggaccgcggaaggcgtatcgcccccgggcccccgccgttgtgctgtcgcggccgagcgggccggacaccgtacgcccgccgcgacagcacaacggcg

SEQ ID NO: 3476 - DNA, 676 bp, Unknown
  Kingdom: Bacteria, Phylum: Actinobacteria, Class: Actinobacteria, Order: Streptomycetales, Family: Streptomycetaceae, Genus: Streptomyces
ggccctggccgacgtcccggttggccgggacgtcggccagggcctgggccttgagccgggtgtagtcctgcatggccttgagcgtgtggtggcgctgggactggatgacgtcccggatgtcgacgcccggggctcccacggccatggcgagtttgatggccagttcgtcgcggggcgggctggtgcggtccaccggcgtctcgaaccaggtgcgcagctcggcgcggccgtcgtcggtgatcgtgtagaggtcgtgtccggcgtcgtccgagccgtcctggacgatcatgccgtcacgctccaggcggctgagcgtcgtgtagacctgtccgacgttcaggggccaggtggagccggtgcgcgactcgaactcggtgcggagccgggacccgtaacgggggccccgctccagtagggccagcaggccgtggcgaatggacatactgagtatgtataccgagtatgttcgtactggcaagtctcgtcggggagggacccgtgggccgcgacgctcagttcgcccggcgcatacggaacgcgaggaagccgagccccagtccgaccagcgcgatacccgcaccgagcgagacctgctgcacccgccgtacggacgcggcgtccagagcctgtccggaccggtcccccggatcggtgaaggcgctgggcggcggggtgg

SEQ ID NO: 3477 - DNA, 7565 bp, Unknown
  Kingdom: Bacteria, Phylum: Actinobacteria, Class: Actinobacteria, Order: Streptomycetales, Family: Streptomycetaceae, Genus: Streptomyces
ccccccacgccgaccagcccaccgtccactacctcaccaccgcccacccgaacagccaggcacagtgagctgactatcgttccggcgccgcccctcggcccgaggggcggcgccggaacgatagtcagctcactgtgcctggctgttcggctgggcgggggtgaggtagtggacggtggtctggtcggcgtggggggtgaggaggccctggagttcgtgggcggcggacctgaggtggtggccgtcgcgggtggtgttgagggtttcgaggacaaaggcgacgttggtggagtcttcggtgacgcgggtgcggtgagcgtcgcgatggttccagtggcgggtcaggacgctggtggtgtcggtgtagatgatctcgccgggcttgggggcttcggtggtgtcgggttcgccgagcggggtgaacgtctcggtgccgtcggcgtagcggatctcgacatggccggtgacctggtcgaggtcgaaggcgccggcgggcaggccgtggcggacggagacggcgttgtaggagtcgacggccgggttgatgcggggcagggtgcccttcttggccatacggcggccgagggcgtcgacgctggggcggatgcggcgggggttggtgccgaaggaccggtaggcggtgtgccacgcctcgatcctcgggtcgctctcgtcggcgggctgccaggtgccgtcggcgagttcctgttccaggtcttccaaggcggtggtggtggcgggccagggtttccggccgcgcagtccggtggcggtgaccagggcgatgagggtctccgggaaagcttcggcgaccggagtgctgatgcggaaggcagtcatgaggggtggctccgttccttggcgggtcaaaggggtcaggacttccaggggccgatgcggtccagacggcggcgctgctggccggcggcggtcacgtcgagcgcgtgtccgcgttcggtgaggcggtcggcgacatcggtgcgttgctcgacgctcttgtggtcgtcgtacttgaacttcgcccgtacgccggtgacttccaggcgcaggccgcggatgcctggcagcatccggccgtagggcggctggtcggcctcgacgggggcatggccgccgccgggctggaagtgggcgagctgacggcgcagcaggtcggccttggcttcggggtcgtcgacgaggtgtgcgtggccggtgaactggacggctgcgtagtagctggtggggacgccgtcggtgagctcggtgtcgggcctggcgcgccagtggccggggatgaaggcatagtcgccgacaacggtgaacgtgacgttcggatcgtgctcgatcgcctcccagacggggttggggcgggcgaggtggatcagcaggtcgccgccgtcggcagtgaaatgggtggggacgacggcgggaggccggccgggcaggccgttgacgctgagctgtccgaagtcgtgcccctcggcgatccacgtccgccactcggtttggtccagggctgcgtcccatggatggatgagcatgctgctccttgcgtggtcggggtgacagggcagggtcaggtgagggcgaggagactgaccgcgacggccgcggcgcccaggccgaccagttggccgcggtggatgcgctcggcaagtacgctgcgggcgagcaggacggtgccggcggggtacagggcggtgatcacggcgacgacggcgaggtcgccgctgcgcgcggcgaacaggaacagcaggttcgccaccgagtccagcacaccggcggcgaccgatatcgcgtaggccggcttctccgggcccagacgccggaacatcagcccggcggctgccagggtgacggcggaagagacggcacggccgatgatcaggggagcgacgccgctgtcggacggggcctggtgcaggaagatcagctgcagagcaatggctgcaccggcgccgaaggccagcaggatcgccgcgcgcgagggccgggccgacttcgcgccgtgcccggcactgaccagcatcaccgcagccagggccagcggcagaccgaccagcccggccagccccaggcgctctccctgcaccagcccgacgccgaccggcagcatcgccgagaccagcgcggtcaccggagagagcacgttcatcggcccgatcgccagggtcttgtagagcagggcgaacgcggcagccgaagcgacaccggaagccgcgccccagcccagggcacccggactgaaggaggcccccaggaccggccacagcagcagctcgaccacgagcgaggccggggccgcaatcatcacggtgcgcaggacgtgggccttgcgggcgccgaggccaccgaggaagtcggcgcatccgtaggcgagggaactgcccagggccagcagcagagcgatcacggtacatcccttactatgcaatggaacgactagaccgtacaacggaccgaccgccggttgtcaaccgaacgaccaggcggtgcagtggattggtccatgggtgagggagggtgatcggatgaccgagaccgaggtggccctgcgggcgctcgcaagcaacgtcagagcggcccgcacgcgcgccgggctgtccctggacgaactcgggcggcgggccaaagtcagcaagggggcgctcgttgcgctggaaaaggctcagggcaatccgaacttcgcgaccctggtacgccttgccgacaccctcggcgtctccgtgtccgctctgatggagggacggcccgaggggcgtgtgcgtgttgtgtccgccgacgtggtgatgccgctgtgggtcggcgagcagggcagtgaggcccggctcatgctgaccacctccggcccggccccgacggaggtctggcgctggcaactcgaacccggtgaggaataccccagccatccccaccaagccggggtcgtcgaaaccgtcagcgtcaccgcaggccagatgaccctgatcgtcgacggcatcgagcacccggtcgacgccggccagaccgccacctttgacggcgacgccccccacgcctaccgaggcaccggcgcggacacctgccacctgatcatgaccgtccacctgccccccggccccacaggctgaacccagcaacctcaatgccgcaccacgtatggcgccgatgtgccagggtccgggccctggaggccgagccggaggaggtcctgcctccgcgaagggccgcgcgcggttaccccgacgaggagaacctgttcgggccccggcgcggctcacccgtcgaagagttttctccaggcggcacccgcacaactcctgggcccgcagctgctccgttcgcttgggcgtcagtccacggcacccatgagcaacggccgatggtgcgggttggaacgggaccgctctgtcaggcggctggcccagtgaggagccgcctcgtgtcccgcacaagcgcatacaaagcacagaggaagaccacggctccgaacaggagccacagaaccgaggccccagagcggtactcacgaagggcgaaaaagaacagcgtcacgctgacaaagacaccgaagaccgagatcagagcactgatgcgatgagtcacacgcacatcatcaacgacaacctcgaccaacggaagtggtcccgaacgaaacggcctggctgggagctgctgctactggggcgggccagcgtgcgcacgtttccgtgggccatacgggcgtggtggcggtcctcatgacgtgtccgggggtgtttctccactcggagtgtgcgactggcgtgatcgtctctgtatcagagtctgctttcgcgcagcgcgactcctgatctgcagggcacgaacgcatgcgtccgtggtatgcgccaggccgcggtgacgaatcgttcgtcatcaccactgatctcggaaaggcgtgagatgggccgtcgccagcctacggaggacacgctcggcgagttctcacgcccggcctgcaagccgggcgggcgccgtcatcaccccccgtcgtccgaggacgcccaggtcgtggactcggacgtggtcgaggcggtcctgcgtaccgcgcgggcagtgctggcggaccgagtggaggaggcgttacggagcgacgtcttgttctgcgaggagttggcgcagcgagtcgcggacttcacgctggagggcggtaagcggatgcggccccgccttctgtggtgggggatgcgttcctgcggtgcggctgagactgcggcggcgctgcggctcggggtggcgctggagttgattcagagctgcgcgctgattcatgacgatgtgatggaccgttcgcggctccgccgggggaagcctgccgtgcacatcggtctggcagagtgtgcgggcctctcgccggattccgagcggggtgccgtcttcggtgcttcagccgccgtgctggcgggggacctcgcactggcctgggctgacgacacggtggcggaaactgtactttctgccgtccagcgtcgtcgggtcggcgccctgtggcgggccatgcggaccgagatggtcgcaggacagtatctggatctgcgtggccaggtcagtggcgagtcatcagtggcgcaagccctgcggaccgcccgtctcaagagcgcttcgtattccgtggagcggcctctggcgctcggcgccgccctggcgggcgcggatgagcggaccaccgacgctctgcgctccgccggccggtgtgccggtatcgcgttccagctgcgggacgatctgctcggggttttcggcgacccggggctgaccgggaagccgtccggcgacgatatccgcgagggcaagccgacctacctgctggctgtcgcccggaggtgggccgaagcggcgggcgacggacaggcactggcccttctcggtcgcgtcacgggcaacgccgacctcaccgaggaggatctcgcggacgtacgcggcctgctcgatgtgacgggggtgcgtgcccaggtggagcggaaggcggagcgtctccacgaccacgccgtacgtcgtctgggacaggccgtcgacgtggacgcgcacggcggccgccagctgctcggtctgctgcgcacggtctccggagagcggactggcccctcccccaccgccggcgagacgcgcggcagcggggcggtagatgtctcctcggttctgaccgcggccgaaggaggtagtgccgggtgatcacggtcatggggcccgtcgaccatgtggtggtggtcggtgccggtctggcaggactggccgccgcgctgcacctgctgggcgcgggccgccgcgtgacggtcgtcgagcgggaaggcgtgcccgggggccgggccgggctcctggagtcgggaggcttccgtatcgacaccgggccgaccgtgctgacgatgccggatctggtggaggaggccttcgccgcggtcggggagcggatgaccgaccggctggagctgatcaggctggcccctgcctaccgggcccggttcgccgacgggtcccagctcgacgtgcacaccgacggtgctgcgatggaggccgccgtcgaggagttcgcgggggcccggcaggcggtcggctaccgacggctgcggatctggctggagcgcctctaccgggtgcagatgcgccgtttcatcgacaccaacttcgactcaccgctccagctcgcccatcccgacctcgtccgcctcgcggcgctcggcggtttcggccggctcgacgcgcggatcgggcacttcgtctcggacgaacggctgcgcagggtcttctccttccaggcgctgtacgcgggcgtgccgccggcgcgggccctggccgcgtacgcggtgatcgcctacatggacacggtggccggtgtgtacttcccccggggcggcatgtacgcgttgccccgggcgatggcggacgcggcggcggacgcgggggcctccctccgctacgggcagagcgtgacccggctggagcgctcgggtgaccgggtcaccgctgtcgtcaccgaccaggaacgcattccgtgcgacgcggtcgtcctgactcccgatctccccatcagttaccggctgctcggccgcagcccacaccgccccctgcccctgcggcattcgccgtccgcagtgatcctgcacgcgggcacggaccgcacctggccggaactggcgcaccacaccatctccttcggggcggcctggaagagcaccttccacgaactcacccgcaccgggaagctgatgtcggacccgtccctcctcatcacccggcccaccgcgagcgacgcctccctcgcaccgccgggcaggcacctccactacgtgcttgctccctgtccgaacaccgaggtcgggcccggcgtacgggaatggggggagctgggaccccgctaccgggacgttctgctggccgagctggagcgccgcgagatgcccggcctcggcgcggcgatcgagcaggaggggctggtcacgccggccgactggaccgcccaggggcacgccgcgggcacccccttctccgtggcccacaccttcccccagaccggccccttccggccgcgcaacctggtgcggggcacggtcaacgccgtcctcgccggctgcggcaccacgcccggcgtcggcgtgccgaccgtcctgatctccgggaagctggcagcggagaggatcaccggccccagagccgcccggaccccgcgccctgccccgagaggttccagcgcatgaccgtccacgaactcgacgcagcaggcatccacgaccccgcgctccgtgccgcgtacacccgctgccgcgctctcaacgcccgtcacggcaagacctacttcctcgcgacccggctccttcccgtcgaccggcggccggccgtccacgccctgtacggcttcgcccgccgggccgacgacatcgtcgacgatctcgacagcacagccacgcccggggatcgcgcccgcgcgctgctcgccctggaagcccagctggagacggggcggcggggggcccgggccgccgagccggtgatccgtgccctggccgacacggcggaccggtacgacatcgaccatcggcacttcaccgacttcctctcctccatgcgcagcgacctgacggtcggcggctacgcgtcgtacgaggaactcggccggtacatgcacggctctgccgcggtgatcggccttcagatgctgccggtgctcggaacggtggtggcgcgcgaggaagcagcaccgcacgcggccgcgctcggtgtcgcgttccagctgaccaacttcctgcgggatgtgggcgaggacctggaccggggccggctctatctgccggccgagctgttggccgcgcacgggacggaccgggaacgcttcgagtggagccggagtacggggatgccggacgcgcggatcaccgacgtactgcgggccgccgcagcccacaaccgaaccgtctaccgggccgccctgcccggtatcgcgatgctcgccccggtgtcgcggccctgcatccgtacggctttcgtgctgtacagcggcatcctcgacgcgatcgaggcggacgggtacgcggtcctgcaccgccgggcggtcgtcccgcgccgacggcgggccgccgtggcgctggacg

SEQ ID NO: 3478 - DNA, 881 bp, Unknown
  Kingdom: Bacteria, Phylum: Actinobacteria, Class: Actinobacteria, Order: Streptomycetales, Family: Streptomycetaceae, Genus: Streptomyces
aggcccgcgcggtcggccagcccgttcgcgtaaccctggccgaccgcgcgggccttccaggctccgttgcgcaggtagatctcgatgaccacgagcgccgtctcggcgcccagctgcggcggggtgaaggtggcgagcgcgctgccgtcgtccgcgttacgcacggtggcggtgggctcgacgccctggaaggtctggcccgcggcgtccgggctcgcggtgacgacgatcttctcgatgcccggcgggacggccgcggtgtccaccacgatcgcgtcgggcgcggaacccccgccggagcggtaggtcacgccggggcccgagggctggttgtagaagatgaagtcgtcgtcggagcgcaccttgccgtcggcggtgagcagcaggcccgagacgtcgagccgcaccggagcggcgacgtccaccgccacgcgggcggcggagagagggatgttcgagccgggggtcattgcggtcatgcacggggtaacgaacgacccggctttgccgttcccttaccttcggccgtccgggccacggtcctcgtcgtgcgctcagcggcggttgcgcgggtggtcgcgggcggtgcgctcgttgccgtgcttgtacgcgccggtccagcgcgccatcaccaactgggcgtcgcccgagaccgcctcggccaggaacttctccgcccggccaccgcgcagggtgcccgcgggcctgccgtggtgggtgatggtgacgctctggtcgccgtgctgttcgtactggaatccggatggtctcggcatgcccgtatcctgcccgcccggccgcgcccgcgtcgcccggatttccggcgcccgcacccgggtcgccgcttccgcccgcccgcctcccccgtgccgcgtcctggc

SEQ ID NO: 3479 - DNA, 2489 bp, Unknown
  Kingdom: Bacteria, Phylum: Actinobacteria, Class: Actinobacteria, Order: Streptomycetales, Family: Streptomycetaceae, Genus: Streptomyces
cagccgggcgaggcccagcgtcggcagggccaccgcaccctccctcgcgggcacgacgagctccgccgccgtcccggccctcagggcggccaccacggcgacgcccgccaggtgtccggcgtccacccacagcggaggaccggcggaggtcccgtgcaagcggcgcaacgtgtgggcgagccagctccctacctgcggactgagcagcaactcctcggcgcagcccggctttcggccctccgcctgttcgacggtccgccagatggcgcccaggtcggccgggccgaggagcgcgggccgctcctccagccggcgcaacaactcccgcaaaagaacgaggcgtcgggcccgctcgcccgcctcaagaaagccgacagcctccatcgacccaccgcccgacgcgagttcgtcgaacagtcgaccgggcatccgcatcggtccgcgcacccgcgctcctctgtcatggtcccgaggcgacctgcgggaacccgcttccggggaaggccgcacagcgctcagtcggcgcgggcgctgggaggggggtcgccggacagcgtgctggtacgcgcccttcggatctcgtccagcagacgctgtccgggcgccggagcgagggcgcgcacggtggcgacgcccacctccgcgagatccgccatctcggactccaggtagtcgtccggatcgccggccgatgccgtctggtgcaaggccttttcccccttctcggtccggcggcacaccatgccacccgtcccttcccatcatgacgaatgggttgccttccggaaacccgtgcgatcacgccgttcgatcacgaacccggcggaccggtccggccctcggccaggaactcccggagggcttcctccagttcggcggccctgtcggggtcgtcgtcgagcagggtgacggcccggtagaggtcccacggcccctccggacgccgccgcaacgtccgcaggatgcccaggacgtccgtacggggcaccgcgtgccgcggcatccgggccaccaggaccgggtccagctccgcgaccatcgtctggcgttcgtcccggtcgctcatcagcggataggcgaggagagcttcgaccacccggaccagcccgccgcccgtcggaccgggtccggggcgaacgccgttccccgacggcggggtcgccggacgttcgggcaggtgctccgcgtggccgggacggtgcaattggagtgcggggagctgggtgcggctcccctcggcgcgcagccggtcgaaccgggtccggacggccgcgaagagcgcctccgggtcgggagccggaccgccgggcaggtcggccagctcgcgcaggaggatgtccgagaagacacccaggccgcgcacggggtcgttggccgcgcgctgcccccggtcggcggccagcagcacgttctgccggtgcacccgccggcgctgcccggcggggaggctcccgtccgggatcgtgaccgccgggcggtggcgctcctcgaaggtctggcaggcgtcgacgacccagttctgttccgtgaacccgggcaggacatcgctgctcaggcggcggcgggcggactccagatcgatgttgcgccggtcggcgtccgtggcgtcggcgcagtacagccgcaggtgttcgtcccggtcgagcacgccgtgcccgccccaccagacccagagcacgtccccctgccgggcgggcagttcgtggaccaggacccgccgcagggtctcgtggtcggcgccgcggtggccggtgaccgcgtccgtctcctccgccggagcgaggtgcagcaggatgttggcgtccggcacgcccgtggaccgcagccagtcccggaagcgcagcgcgtcgcggaccggccccggcagcgtccagtgcgggccagccgcgtacgcctcgacaccgacgacgagcgccaccacacgtgccgggtcgacaccacccgcgctcacggcatccgctccgcgatggcgcggtagacggccggatcggtccagtaggcgctgtgggcggcggggaacggctgccggttgtcggtcgcgatgtcctcggcccggccggggaacagcggtgcggcggcgaagccgagcaggtcgcggcggtcgtggatgttcagccaggcggggacgtgggcgggcagcggttccgggtgttcgaggtggggcagggctcccgtctcgtacaggaacggcccctgcgagcccaccgtgaccagcagccggacgccggccagtggggcctcgatcagcgtgtcgagggcgatgatcccgccgaggctgtggccgagcaggacgaccgggggctccacggaggcgaccagctcgcgcagggcggcgcgcagggggccgccgcggacgaggaacgtcagcacgtcgcccgccgccgggtgggcggccccggtgagggcgcggcggcggcgcaccgcgtaacgggatccgagccgcagtaccggccgggcggccaggcggcccaccggccctctgccggtac

SEQ ID NO: 3480 - DNA, 3800 bp, Unknown
  Kingdom: Bacteria, Phylum: Actinobacteria, Class: Actinobacteria, Order: Streptomycetales, Family: Streptomycetaceae, Genus: Streptomyces
cgagggcgccctcgcctcgcagccgctgagcgaggcgagggcgccctcgcggagcaggaagccgtggcccttgggggcgtggacggtggtgcggttggcggtcagttcgccgccggcggcgacgaccacgccctcctcaccggagatctcgacgcggaagtcgcggacggtgacgttgccgccgtcctccacgatcagaccgctggtggtggtgtcggagacaccgccaccggccaggtagagggtggagccggaggccacccgtacaccggcgcccgtggggcggacgatctcgcagtcctcgacgcggccccgtgcgtccttggtggccgcgatgccgtcaccggcgggctccaccagccgggcccggcgcagcagcgggttggcgccgccctgcagagccacggctggcgaggatccgatgacctccagacggtccagttccggggccgagtcctcctccaggaagagcccgggtccctcgcagtcgcggacggtcagaccggtcagcgccggggaggaggccccggcgacccgcagggccgcgccctgtgcgccgtcgacccagcagtcctcgaaggtgccgcgcgcccggtcggtgacgaacagtccgtgcccgcgtacgcgcgagacccggcagcggcgcagtacggggtcggtgccggcggcgaggacgatcccgttgccggaggcgccggtgacgcggacgtcctccaggacggagcggcccccggtgctcaggtgcacgccggtgctggtgtcgtggacgacggtccggacgacggagacggcggcgttctcctccagagcgatggagggcttgtcggtggaggagatgtcgcagtcctcgacggtgccgcgggtctcgccgttggcgagcaggccgttgccccgggcaccccgtaccgtgcagtcgcgtatgcgcgcctctccctgttcggcgaggacgatgccgctggtgccgaggtgttcgagcgtgcaggactcgacggtggtgggcgtcgtggaggtcacgacgactcccgcgccctgcgggttgctcacgcggcagtcacgcagagcgagggagccggtcccgccggccagcatcgcggtccaggcggcgccgacgatctcacacccgtcgaaggcggcctgcccgcgccgcacgtccacggcgggcagctcggcgtcgccgccgcgcagggtgagttcggagagcatgacggcgtcggcgcgcagcgcgatgacgctgcccgaacgcggccggatctccaccgttccccgtccttcggcggcggtgagggtgacccgggtgtggatcaccaggttctccgcgtacgttccgggccggacgctgatgagcgcaccggtacgggcggcggcgagcgcctcaccgatcgtggaaaagcggtccgcggggccgaccgtcagtacctggcgcgacacgcaccaacctcctcgctacggcggcgtcctgtcggacgccgctcttcgccggggacgcgggtgggcggtccggcgatgccatcatgcctggcccggcgcggcgtccggatgccaggagccgggctcccggcatccggacgccggggtcaggtgctccacttctggttgtcgttgcccgtgcagtcgaacaggatcaggtaggtctccggacccctgcccttgctgtggttcgggatgtcgacgcacttgccgacgacagtgttgaccaggtcgtgggcgccgttcagggtgaacttctgggcgtcggcgccgttgcaccaggcgagctggatgcgggagccgttgttgaagttcgcgttggccacgtccaggcacttgtccctggcccggatcgtgccgtcggaggcgaagcgccacttctgggcgtcggcgccgttgcagtcccacatgaagagcggctggccgtcgtcgaagttgtgaccgggtacatcgaggcagcggccggagaggtggctgcggaaggagacgggcccgctgaacgtgacggcgggctgggccttggcaggctggttctcaccgtcgccgctctccgcctcgggcttctccttggacgagtcggccttcttcgccgtgtccttggagtcgtcacccttcttcgcctcctccttgccgctgtccgtcgaggggacgaccggcacggggtggccggccttctccggcttcgcctcgtccttcttccccttcccgtcctcggcgggcgcgctggtctcgggcgcggtgacggcgaattcgcccggcgcctccggcccgcttccgtcgaggacggtcccggccgctgcggcgttcgtctgcttgggcccctcgtcgttgttcccggcgagtaggaggaagggcaccgacacgagcaccgcgcccacgacggccgcgcccgcgagtgcggccctgcccggccgtcccacgggccccgcctcctgctggggccggccgatggcggtggcggtcatggtccgtacgagggcggggagccggctctgggcggcggcggatgcgctggggtctgcctcggagtcgggagcggcggcggccccgggggttccggccccgccgtcgggggcctgggcctcgggtcgctcaccctcctcgggcttcccggccttctcgccctccccggcctcggaggacttctcggccgccgaaggctcggctcccgcggcttcgctcttcgcctggacgggagcggagtcgggcgcgtcaggagcgaccggcccgacgagagcaacgctcgcggctgagctcgcggccaccccctcgctctcggcgccggactccgcgcgggcctccggggacgaggaagcgggggtctgctgggacgacgaacgcgtcacggggtcctccctgtggtgtggggcgagggttcggtcgggtcggtgccgtcggccgtggtcacgtggccggagctcacgggcccgagaaggctgtcagccggaacgagcaggggagccgcggcgccggagttgaccgacaacagggcgccggtggccgccaccgaccgggccagctccccggcgggcagggtgtcatggtgaagtgccgcggacatgaatgcgtgtgtgggcgaggtgaacaggagcaccaccggcgccccgtcccgccctgcggccatgagcggaccgccgtccggcccgcgtacgacggtgacgtccgcctccgcgagtgcggccaacgcctcgtccaccgtgccgtatccggtggcggcccgctgggccgcctcgtccaccggatcggtgggctccggccagccgaggacacgggccgagggacggtaggcgggattggcgcggtactcgcccacgctcccgctctcgtccgactgccactcccccagcacggcccactccggcggcgtccgcgccgacgtccactccggatcgacgattccgatccagtgtcccggggcacgacgggcagcgtccttcacggcttccggcaccagggaggcatccggatgggtcaaccggacgctctgcccatcctgttgccgctctccgagcggtatctccacctgaactcttggctccgtaagaatttttgagtgccggacggtcggcagacactctcagcacgccgtcgacagtgatcagatcgggcagccaacaggatgtcatacgagctccgttcacggggcccggcgggaagcccgtatcggccttctacctgcccgtttactgcccgagcggggaactttccgggaccagtgaggcgtgggatgacaaagcgacccacgcgtttcgaggcgagtggcctcccacgctcccggaacggactacgttgggcaggcccccgaggaggagtcagcgcatgccccccgagcc

SEQ ID NO: 3481 - DNA, 2712 bp, Unknown
  Kingdom: Bacteria, Phylum: Actinobacteria, Class: Actinobacteria, Order: Streptomycetales, Family: Streptomycetaceae, Genus: Streptomyces
cggcggccaagaaactgctggcccggctgtcggcggaggcagcggcggatgacgtccccggcgctccgttcgccgagcggctggccgccgtaccggaggccgccgacctgttcaccggtcccggggcgccgaaggacctgctggagccctcgggctatctgggcgccgccgggattctggcggaccgcgtcctggcacggcacgcggcccgttgacccgggtcgtccgtcgcacggcgggggtccggtccggggcgcccgtcatcggatgcggggatccgggcgcccggccggccgcgcggtcaggacccgaccggcctgacggactgcgcgtggtggaagacgttccgctggtcccagcgcgtcttggcgcgctggagcgcggggtagttctgcttccagtagaggtcgtgccagggaacgcccgagcggttgcgccgtacccggtcggtgaggtcggcgtcggggtagttgatgtagcagccgtccgtgacgtcgttgaggacgggcacgcctccggtcgaggcgtagacggtggagtaggcccgccggatgtacgcgaagtgtttcgcgtcgtcgctggggttgccccacgccgtgccccagagcagcttgagcacgctgtcgcggtgcggctgggccgtcgcggtcggcgacacggcgttgacccggccgccgtgcgcggcgatggagacgacgaaggccgggtggtcgtaggcggagtccgtgagcacccggtagaggccggccgtctgctcgccggtgagccccttgcggtggtagctggacttgtacttgtagcggtcggtggggttgctcatccagaacccgggccagccggtggcctggaaccagggcagccggtgcagctcctggtactccacgggcgtcaccccgacaccgtcgttgacggcggccaggaaatcggcgaggagccggggagcgttcggcacggcggtgtccatctgcacggcgagcaggacgctgccggccgccttcggacccggttccagacgcgcggtcagcccggtgtacggggaggcgggcgagctgttctgctcgttccagaggccgtagttgtgtatgagccgggtgaaggcgcgctcgttcagccggtcccagggccactggagccaggtcaccaggacgtcggagggcggcgcgggcagcagggtcgaggggtcggtcccggtcgcggtgggcgagcggaaccagtagcgggtcacgacgccgaaggtgccgccaccgccgccggtgtgggcccaccacaggtcccggttggggtcgtcggcctcccgggtggcgatgacggaacgggcccgtccgtcggggtcgaccacgacgacctcgacggcgtacaggtagtcgacgaccagcccgtggagccggctcaggttgccgtaaccgccgccggtgacatggccgccgaccccgaccgagtagcaggcgccgccgggcagggtgacaccccactgccggaacatcgcctggtacatctcgccgagcgtggcgccgccctccaccgagaaggcccgcatccgcgcgtcgtgggcgaccgcgcgcatggcggacatgtcgatgatcaccttgacgtccgggtggtcgacgaagttctcgtagcagtggcccccgccgcggacgctgatccgcttgcccgccgtcacggcctcctgcactgcggcgaccacctgagcggtgctgttcggcagccggatggcctcgggcctgctgctgaacagctggttctgaccgctggtcagccccgagtaccggacgtccgtcggggccacggtcagcgcgcggatctgacgcgtacgagcgggactcccggacgccaccgcctcggccggcccgaccagcgccgtggcccccaccgccgccgcggtgccggtgagaagtcgtctgcgcgataccggggtcatggttcttcctccgttgtcgacgatgcccggcgagtgccgggtgcctgttccggggaagatgtcatcgcggcgcacaccgccacatcacgtgatcacgtgatgcccggcgcccggctccccggttgacttgagcacggcaacgacgcgacgaccgtgacgaccgtgaggaagccgatgagtatcccgtggggcccgcagggcgctggaacaggatcggaatcgattacgtacgtggctcccggcgaagggcccagcgtctgggcccttcagggcgacaagtacacggtgaaggcgggaaagggcaccaccggcccgggattcaccctgctcgaaggggagatagccccggacaacggtccgccgatgcacatccacaacgacgcggacgagatcttctatctgctcgacggtgaactcaccgtggcgtcgggggaagaagtcatcaaggcggagagcggggcgttcatcttcattccgcgcggcgccaagcacaaattccgcaacgactccagcaaaatcacgaagctgctcttcgtgctcgctccggccggtttcgaaaacttcttcatggaaatcggatcgccggtcgtcccgggcaaggaccgtccggacgagccggtcggctacgaacagctcgtggtgcaacgggccgaggacttcggcatgatcatcgtcccggagtgagcctcctgtcgcggtggccggcgaggggccatcgcgacaggaacaccgcgacagcggcgggaggccgcccaccggaggagaaccggtgggcggcctcccgccgctgt

SEQ ID NO: 3482 - DNA, 5520 bp, Unknown
  Kingdom: Bacteria, Phylum: Actinobacteria, Class: Actinobacteria, Order: Streptomycetales, Family: Streptomycetaceae, Genus: Streptomyces
gccgcatcgcgatgtaccacttcctgggcgacgcggtcgccccgctgaacctcaaggccgtctccgccaacgtcttcaccgacccggagatcgccaccgtcggctacagccaggccgaggtcgacgcgggcaagatcgaggcccgggtggtgaagctgccgctgctgcgcaacccgcgcgccaagatgcagggcatccgcgacggcttcgtcaagatcttctgccgccccggtacggggatcgtggtcggcggctgcgtggtcgcgccgcgcgccagtgagctgatccaccccatctcgatcgcggtcgacaacaacctgacggtggaacagatcgcaaacgcattcaccgtgtacccgtccctgtccggatcgatcgccgaagtggcccgacagctgcacacccgcaagctcaccggcgagggctgagagcccggacagcacggcattcgcggcatctcgccgcaacccggcggcagtccgggcggtgcggcgaccgcctgacgatcaccgccgaacaacaaaggggcctcctataccacttggaggcccctttgaagtacaacttctgttattcggcgcaaactgctgaaaactcaccggtggccaggttactgtcagttccgtgttcgctgcagaacgtcgtcagttgatcctcgaaatggtgcgtgccaacggggcggtatcgctccgtgagctcgcccgcgtcgtccagacctccgaagtgaccgtacggcgggacgtgcgggcactggaggcagaaggactcctcgaccgccggcacggcggtgcggtcttgccgggcggttttacgcgggagtccggctttccgcagaaatcccatctctccaccgcggagaagaccgccatcgccgacctggccgcaggcctcgtaggcgagggcgaggccattgtggtcggcgccggcacgaccacgcaggagctggcccgccggctcgcgcgggtccccggcctgaccgtcgtcaccaactccctgctggtggcccaggcgttggcccatgccaaccgggtcgaagtcgtcatgaccggcggcaccctgcgcgggagcaactacgcgctggtgggcagcggggccgagcagtccctccaggggctgcgggtctcccgggccttcctctccgggagcggcctcacggcggagcgtggtctgtccacctccaacatgctctcggccagcgtcgaccgggctctcgtgcaggccgccgcggaggtggtcgtcctggcggaccacaccaagctcggctcggacaccatgttccagacggtgcccaccgagctgatcacccgactggtgacggacgagcccccgctccacgacgagcgggccgccgccgagctccagtccctggcggaccagggtgtggagatcacggtggccggagcggacacggacgcgtccggcggggacggccccccaccggggcgtcagccccgccgggacatgccgctccccggccagcggcgcacgcagaacggcggcctcgggccgcagctccgcagtgcctccgcgctggcggacgttccgggggagccgcgggcccgggtggcggaccttcggcggcggtagggccgggtcggggggcgctgcccccgaccccccgctcctcaaacgccggaggggttggatctgccgccgcaagagcccgcagcgtcagcgcaggagccgctcaggcgttcacctctcagcccttccggggcggtcacctctcagcgcctccggcgcttgaggagcgagggccggggcggagccccgggacaccccgctacttcagcccgcgcagcgtcagccgcagcagccgctccgccaactccgggtcgtcgggcgactgctcggccgccagcgcgatcgcgttggtgagctggagcagatcgtcgatcgagacgtcggaccgcaccgacccgctctcctgggcccggcgcagcagccccgcgcccgcctcccggagcggcagatggcactgcgcgagcgccgaggtcccgttgcgcgaggcggacatcaggccgtgggccaggccgcggtactcacccgcatgagtgacgatcgcgcccagccagtccaccagcgcccggcacggggcctccgccgccgccagctcccgggagcgctccaggagtgagcacagggcgtcctggaagaccgcgttcatcagggcgtcccggttcgggaagtgccggtagagggtgccgatgcccacacccgcccgccgggcgatgtcctccagcgacgcgtccgtgccgtgctcggcgaaggacctgcgagcctcgcccaccagccggtcgtgattccggcgcgcgtccgcgcgcatcggccgggccggcggctgtgccgtactcgtctccatcgggatcgcccctgccatggcttccgcccctccctcggtcctcggaccctctgtgggttccaggatgccactgtgacgaaggggcccggtccgcgccgtgacgacgcggaccgggccccttcggagtgtgccgggcggtcagtccttgatctcgcagatcagggcgccggaggagacggaggcgccgacctccgcggcgaggcccttgacggtgccggaacggtgcgcgttgagcggctgctccatcttcatggcctccaggacgacgacgaggtcgccctccttgacctcctggccctcctccaccgcgatcttgacgatggtgccctgcatgggcgaggcgaggctgtcgcccgaggcggcggagccggccttcttcgcggcgcggcgcttgggcttcgcgccggcggcgaggccggtgcgggccagggacatgcccagcgaggacggcagcgacacctccaggcgcttgccgccgacctcgacgacgacggtctcccgtccggcctcgtcgtccgcgtccgcgtcggcgggggcggcgaagggcttgatgtcgttgacgaactcggtctcgatccaccgggtgtggacggtgaacgggtccgcggtgaaggcggggtccgcgacgacggcacggtggaaggggatggcggtggccatgccctcgacggtgaactcggcgagcgcgcgggcggcgcgctggagcgcctgctggcgggtcgcgccggtcacgacgagcttggcgagcagcgagtcccaggccgggccgatgaccgagccggactcgacgcccgcgtccagacggacgccgggtccggtcgggggggcgaaggtggtgacggtgccgggggccggcaggaagccgcggcccgggtcctcgccgttgatgcggaactcgaaggagtgaccgcgcacggcggggtcgtcgtagccgagctcctcgccgtcggcgatgcggaacatctcgcgtacgaggtcgatacccgtgacctcttcggtgacggggtgctcgacctggaggcgggtgttgacctcgaggaaggagatcgtgccgtcgacaccgacgaggaactccacggtccccgcgccgacatagccggcttccttcaggatcgccttcgacgcggcgtacagctcgtcgttctgcgcctggctcaggaacggggccggggcctcctccacgagcttctggtggcggcgctggagcgagcagtcgcgggtggagacgacgaccacgttgccgtgggtgtcggccaggcactgggtctccacgtggcgcggcttgtcgaggtagcgctcgacgaagcactcaccccggccgaacgccgcgacggcctcgcggaccgcggagtcgtacagctccgggatctcctccagggtgcgggccaccttcagaccacgcccgccgccgccgaaggcggccttgatcgcgatcggcagtccgttctgctcggcgaacgcgacgacctcgtcggacccggagaccgggtccggggtgccggccaccagcggggcgcccgcgcgctgggcgatgtgccgggcggcgaccttgtcgccgaggtcgcggatggcctgcggcggcgggccgatccaggtcagcccggcgtccaggacggcctgggcgaactccgcgttctccgacaggaatccgtaaccggggtggatcgcgtccgcccccgagtcctcggcggcccgcagcaccttggccatgtccagatagctggcggccggggtgtcaccgcccagggcgaacgcctcgtctgcggcccggacatgcagcgcgtcccggtccggctcggcgtagaccgcgacgctcgcgatccccgcgtcccggcacgcccgagcaacgcggacagcgatttcgccacggttggcgatgagcaccttgcgcacgatgactccctcctcgaaacaagctgagtttagggactaccgacacggctgtacgacccgtccccaatggtgagcttgcccacacggagtgtgatccgaggcttgccccagtagtgaaatcccttgtggcaccacggtacgccgtgatcctcaaccgcacagtaaccagccggtgtggtccaggtctctgtctttaaggtcaacgcctcacggcgtttctttgtggagtccctacgagcggtcgatggattctttgcccgtcgtccgggcaggccccaccccttgtccgaaggaatacccgtgagtagggtccgcgctacgtacgtactgcaggtaacagggggtggatcggtcatgcgcagaccggtggcgatcgtgaccgcgctcgtgctgttcggggaggcggtgggcatcgtgctcatcaacgccgtcctggccacggtcgccgagaaccagaacatgtcgctcgccggcctggacccggacgccatgtccaccggcacctgggtgatgggcggcgtctccgggctgctgctggtcctgtgcgggctgacaaccctgctggccggggtccgtgaccgtgctccggggcgcttcggacgcatcgccctgatcggctgcgcggtcgtgcacggtgtcctcggcgcggtcaccgtcggcctggtgggctggggagccttcgcgttcatgatgttcgtgctggccctgctggtgctcaccctgctggcgtacggccccgaggcccgggccgacgacggcgcgagcgacggagcggcccaggcggcggcccggacggcctaaggcctccgccgccgcctccgccggtctcagacccacagctccgtgacggagacgtccagctcgcccagcaggcggcgcagcagcggcagcgagagcccgatgacattgccgtggtcaccctcgatggagtcgacgaacggggccgagcggccgtccagggtgaacgcccccgcgacatggagcggttcgcccgaggccacgtaggcggcgacctcggcgtcgctcggctcgccgaaccgtacgaccgtcgacgccgtcgccgaggccgtacggccggaggcggtgtcgatcacgctgtgcccggtccgcaggacgcccgaccggccgcgcatcgacttccagcgggcggtggcctcctcggcgtcggccggcttgcccagcgcctcgccgtccagctccagcaccgaatcgcagccgatgaccagagcgcccgccgcttcgggacgctccgcgaccgccgccgc

SEQ ID NO: 3483 - DNA, 2522 bp, Unknown
  Kingdom: Bacteria, Phylum: Actinobacteria, Class: Actinobacteria, Order: Streptomycetales, Family: Streptomycetaceae, Genus: Streptomyces
cacgactgcaaccgcggcactgggcccagtcgaaccaggtgccgcggttgcagtcgtggcatcgggtgagccaggcggttcgaccgcgggtggacgtccagttggggtggccgccgtggcgccgctgggcgttggccatcgcccggtagttgatgttctcggtgtcgccgaaccgtgggtcggaccatgcgctgtacggggcgggcgggtggccgatgaggacgagctcgccgccgtaccagcggcaggtgcagtgctggaagtcgcagtcgcaggcgagggactttccgaactcgatggccttctcgacccgcggtacgccggggcccttgacctccagccaggccccgatgtcggggagcttgaagtcggggatgtacgtggccccggacggcagggtgatcgtctcgggctcgtactcccaggcgatgcggagggtgtcgagggttgcggcccaggacgcttcgagggcggagcggaacgtggtcccgccgtaccaggtggggagcgcctcgatggtcatgccgccgtcgagggcgccgggctggccggggatgtggccggcgcgggtgatctgctggtgcacggccgtctcgacggcctcaccgacggtccagttgtgccagtcgtcttggatgttcaccagatcgctcctgtcggggagtagcccgtgtactggtcggcgtcgatgggggtgtacgaggtccagggccacttctcgccctgcttgatgaacttgggccagtcgcgctcgtcgcgcatgccgcgccaggggacaaccgcccggccgcgggctccttcggtgttctgcgcggacttctcgtcctcgacggggcggaggccgaagccgaactcgggccagcgcatccacagggacgagccgagggggcggagcgagcgggggcccatgttgttgccgtgcggggcgtgggcttccatgaggacggcgcaccgggcggttgagcgggcctcgtcgatgacgacgctgaccttgcgggcgagctcttcgtcgttggggttcccggcgtgaagccggtagacggggccgatgatcagaatgtccgggtcgagcttctctacgcggcgcatcatccaggcccggtcctgaggcttggtcaggtcgaggccttcgggccggcactcgatgtggaactggccgcggttgacgggccgctcgatgtgggcggcagcgtcgaggaggggccggaacttgcggcgggaagcagctgccccgttttcgcagtcgagggtgaggactctggccggttcgatggtgtcccaggtgcggaacgggtggactccggcggcgagggtgacggccatctgtcggagcagggtggactttccgccgccttccgaggcggtgaggatcagccggtcgtggcgttcgaggagtccgggcaccagccagtcgtaggtgtcctcgtgctggatgaagtcgaggatgtcttcggtggggaggtcttcggctgccattccgcggtcacggaggtcgcggctgagggtgacggctcgttcgacgaggtcgctggtggcgtcgttggtgctgtagcccatctgcaccagggatgtgccgagttcgatgagcgcccggcgcagggagcggtcctggacgatgtcggcgtagtagtcggcgttcgcccatgtcggtacggcctggacgagttcggtgaggtactgccagccgccggcccgggtgatgttgcccttgtcggtgaggtacttggtgagggtgatcgggtcgacgggcacgcaggcgctgtgcatttcgctgaccgcggtgaagatcgtggcgtgcgcgggcttgtagaaggcttccgggctgaggatttcgaggacgagcgctcgggctaccggggagagcatgcacgagccgaggacggacatttcggcggcaacgtcatggggcggggtgcgttcgaagacggtgccttcgagagcttcgagatcatcgggcgcgtactgatcgatggtcatttagaagatgcctcgctcttcggggctttggcccacggctcgaaggtggggtcggggtgtgtgcactggggtgccggcggcgggcttgggcgggagttcggcccagccgcgcatgaagtacttcgcggagtcgatcggcgccggcgagcggtcgacggtgcggcgggcgtattcgacgagggcgggggtgccgcacttgctgatgagcgccaggaccgggaaccactggttgccgacgaagggccagcggacgatgacgccgcttgcggtcatgctgtcgacaagggggcgggccgtgtccgggatgccgtaggaggcgtcgggtgcgggctgctccggccgttcgggctgtgcctcttgcttgctgggtgatggggatggggagtgtgggcctgattccggcccactagagggcctgattccggcccactctgggcctgattccggcccactagcgtgatcatggtcagggcttagtgggctcgattccggcccactaggacgggtggcacggggggttagtgggcctgattccggcccactag

SEQ ID NO: 3484 - DNA, 1699 bp, Unknown
  Kingdom: Bacteria, Phylum: Actinobacteria, Class: Actinobacteria, Order: Streptomycetales, Family: Streptomycetaceae, Genus: Streptomyces
tcggggctccgccccggaccccgctcgtcaaccgccggaggggctgaggacgccgccggaggggctgggtccgaccccgacaccgtcactctcgtccccgccctccgtgtcgacgtcgtggccgccgtcggtgccggtgacgcgttcgccgccgggttcctctccgccaccctgcgcgggctgcccgtgcgggagcgggtccggcacgggcacctcatggccgccgccgtcctcaccgtccccggcgacctcaccgagccacccgcccgcgaccacgccgaccgcctcgcggccctcgacgacgacgcctgggggagacttcgtctcggccccggctggaccgcagccgaccgggcccccgaggaggtacgcacaccatgagccagaccgtcgaccgggcactgagcatcctgccgctgctcgcccagggacccgccgacctcggccaggtcgccgagcggctcggcgtccacaagtccacggcgctgcgtctgctgcgtacgctccatgagcacggcctcgtctaccgccaggaggaccagcgctaccgcctcggcgcccggctcttcgcgctcgcgcaggaggccgtggagaatctcgacgtacgcgagatcgcccactcccacctggtcgcgctgaacgaccggtgcgggcacaccgtccacctcgccgtgtacgaggagcaggaagtcctctacatcgacaaggtcgagagccgctacccggtccggatgtactcacggatcggcaagcccgtggcgatcaccgtcgcggccgtggccaagctgctgctggccgacctcaccgagtccgagcggcgcgtcatcgccgagaagctcgactaccccatgtacacgtcccgttcgacgcccaacgccgccgcgttcctcaaggagctcgccgtcgtccgcgaacagggatgggccaccgacctcggtggccacgaggagtccatcaactgcatcggcgcccccatccgcggcgcggacgggcgggtcgtcgcggccatgtcggtgtccgcacccaatgtggtcgtcacggccgaggaactcctcaccctgctcccgctggtccggcgcaccgccgagaccatcagccgggagtactccggcaccacccgacccaagaaagcctgatcagccatgaccgagaagaccgccctcaccccctccacccacaccacgccgccggcgaagttctcgcacggcgtgaagaaggggaacatcctccaggtcgccggccaggtcggcttcctccccgccgtggagggccagaccccgacgcccgccggtcccacgctccgcgagcagaccctccagaccttcgccaacgtgaaggcgatcctggaggagggcggcgcgagctgggacgacgtgatgatgatgcgcgtctacctcacggacgtggaccacttcgcggagatgaacgagatctacaacacgtacttcgccgagcagaacctcaaggaggccccctcggcccggacgacggtctacgtcggcctgcccaagggtctgctcatcgagatcgacgccctcgcggtgctcagctgaccacctcggtcggctgaccgccccggtcggctgaccacctcggtcggttgaccaccccggcccgctgaccaccccggtcagtcgaccaccgccgtcagtcgaccaccccggccacgccgtccccctcggcccgccgacccccgtcc

SEQ ID NO: 3485 - DNA, 694 bp, Unknown
  Kingdom: Bacteria, Phylum: Actinobacteria, Class: Actinobacteria, Order: Streptomycetales, Family: Streptomycetaceae, Genus: Streptomyces
  misc_feature (397)..(398): n is a, c, g, or t
cgggcagctccacggtccgcgcggcccgcgacacaccggcggcctccgcgtgcggtccgtcgggacacgccggatccggggagacgggatcacaggagaaccggcacccgggtacgacggagacctccggcatgagcgcggccagcgcccgcacggcggtggacttggcagtccccttctcaccccgcacgagcaccccgccgacagccggactgacggcgttgagcaacagcccgagccggaggtcgtcctgtccgacgatcgcggtgaagggatacggcgtactcacttggcctcctggtcgacatgaacaacagctgcttccccgagcttctggggcgttgcctccgcggaccgggcaacatcaagctcctggccccttgacccggcggacccnnggtccggggcagcgccccggctctccggagcacccgtgctcgacggcggcgcccccggcggcacgaacggcaaccccaccggcgcacccccctcgatcaaccgccacaacgcatccgtgtccgcgtgctcctccaccagatccccgagccgatccagctgctcctcccgcaacaccccgaaactcgtgtccggcgccggcacgaaccgccgcccggcggcccgggccacctccaccaggaaccgccgccggaaggcgtcgctctccagcgacccgtgccagtgcgtcccccacacc

SEQ ID NO: 3486 - DNA, 14564 bp, Unknown
  Kingdom: Bacteria, Phylum: Actinobacteria, Class: Actinobacteria, Order: Streptomycetales, Family: Streptomycetaceae, Genus: Streptomyces
gcatcggcatcggcatcggcatcggcggaccggagctcgacagcgggtacgcccccgcccgggcctccgatgatcaccggcccccggtccgtctcgatcacctcgaccgtctcggggtccgcccccgccacctcgatcgtctcggtgtgggcgtgggcccggtaccagccgcccgggccgagcgcctccaccccgccgtcctgggtgcggcgcaactgctcccggtacaggtcctggtagtcggccatggcgttggtgatcgcccaggcgactcccccggtgtgcccgaagtgggcgatgccggggacgccggggaccgcgaggccgacgacgtcgaactcgggacaggcgagccggatctgctggtagacgccgggggcctcgatgaagcggtgcgggtcgcccgccaggagcggggtgccggaggccgtgcgctcgccggagagcagccagccgttgctgcccgcggtgccggggccgtcggtcgcgaagagggtcatccggtcctcgccgagccggtgggcgacctcttcgcgccagagtttggtcgggaaccccgcgaacaggatgtgcgtggagagccagacgccgagcggggtccacggctcccagcggccgggagcgagtcccaccgcggcgaactcgggtgcgcgggaggctccttcggcgaggccgtcgttgacgccgtcgacgtaggcccccacccaggcggcggtgtccggcgcgagccggccgaagcagcggcgggcggtgtcggcgagccgggcccgccggacgaaccggtcccagtcgacggcttccgcaccgagaccggaggcgctggtgccgagcaaccggtgccgctcggtctccagttgccaggcccggtcgagggcggtgacgtacccctgggcgcgggccagcgcgagggcgtcggcggcccgcagatgcggtatcccccagtcgtcccggaacaccgcgaaggcgtcgcgggacgcttgcccgtcatccgggaactcctcggaaccgccgtgcccgcccgcgcccggtctctcgctgtcgacgccagtggccatcgtttcgcccatcccctgcttccggtggttttcagccactccccagccttcgggatttaggttagcctaacctaaagtgaccctttgggcagtgggccggggcaccggggcgaggcaggagacaccgtggggcatggctgggaaggcgtcgttctcaaactgttccgggggcgtgacttcacgttcacggtgaccggcacggagcaggtcaccgaccgcttccgccgggtgcacgtgagcgacggcgggctgctggccgcgaccggcggggcccacccgacgatgtgggtgcggctgtggttcgagaaggacggcaaaccgcatcagcgcgcctacaccctggtcgaccccgacccggagacgggcacgttcggtctggaattcgccctgcacgagggtcccgcctgcgagtgggcgaggaccgtcaagatcggcgagacgatcgacgcgacgctccagggcaccggcttcacgctgcccgacccggcaccctcgcggctcttcgtgatcggtgacgctgcggcgctgccggcgatcaactccctgctggacgcgatcccgtcgacctcggcgacgatctggttcgagaccgcgcacgaggaggaccggggactgccgttccgcctcgacgaggcccaccacaccctgcaccacgtggcgcgcggcgaggcgggcgcgcggctcgtctccgaggtgaaggcggccctgccggagctgctgggcgaggaccacacggacgcgtacgtctgggtcgcctgcgacacggcgaccacccggaccctgtcggcgtacctccgcaaggagctgggcctgcccaaggaccgggtgaacgcgctgggttactggcggccgtaggctcgcggaagaagccgtaccggagacctcagtcctcgaccacgagggccggggtctccttcgtcaggatctcgccccggaagaacgccgggctgcggcgctccatcgcgatcatcagcaccacgccgaggagcagcagccccaccccgatgacgaagaccgagccgacgccgaggacggaggacccggagccgtacgccgggtcccacatgtcgtagagggtcttggcgaagacggcggcgagcaggatgccgccgagcagcgggaagagtcccttgaagaccaggtcccgggcggagcgggtcagttcggcacggaagtaccaggcgcaggcgaaggcggtcagcgcgtagtagaagcagatcatgaggccgagtgcgtagatggtgtcgaccaggacgtgctcgctgaccagggtcatcacggtgtagaagacgccggtgccgatgcccgccgtgatcgtcgcgcggccaggggtcttgaagcgggggtggaccttggcgtacgaggccggcatcgcctcgtacgcggacatcgcgagcaccgtgcgggcgaccgggatgaacgtggtctgaaggctggcggcggccgaggcgaggaccgcgaggaagagcaggacgccgaggccggggcccatcaccggtccggcgagggcggcgaagacgttgtcggaggtgtccgggttggcgaggccgagcccggaggtgccggagccgacggccatctgcgccgcgatgccggtggcgaggtaggagccgaccaggacgaccatcgcgatgagggccgcgcggccgggggtcttctcgctgccggtggtctcctcgttggcggtcaggcaggcgtcccagccccagaacatgaagatcgagagggacagcccggcagtgaaggccgcgaaggactggacggcgaaggggttcagccaggaccaggagaagtcgagcgaggacgcgaagtcccctccgccgccgcccgccttgctcagggccatcgtcacgaacacggcgaggacgaccaactggagcccgacgagggcgtactggatgcccttggtggcggtcatgccccggtagctgatggcggtggcgacggcgatgaggaccaggcaggtgaggatgtggaccggcttgctgtcgtccagggcggcgaccggagcgctgccggtgatctcccccgcgagcagccagaagtacgaggtggcgacgcccgccagattggacagcacgatgatcgtcgcgatcaccaggccccagccgcacatccagccgacgcgcgggccgaacgccttcaccgtccaggtgaaggaggtgccgcagtccggcatcgcccggttcagctcgcggtaggcgaaggccacgagcagcatcggcaggaacccggccaggaagacggcgggcatctgcacgccgacctctccggcggtggagccgagggtggacgtcaggcagtaaacgggggcgacggtggagacgccgatgacggcgctgcccatgaggccgacggagtttccgccgagccccttgccccgcacgccaccgcggccgtcaccaccgtcggccggggtgcttccccgtaccgtgtctccggcccgtggccgcgcgtccagctgagtcatgaggaggacgctatgcgctgcgatatccacatccggagcgtgagactccaacgtctcatccttggatatgccagccaacttcccctgaacacttcatcaattcaaggtcacgtttacgtgaaaccttgcattgcatgccgctcagccgagcgcaacgacgtacggtaatcgcagcactgcccgatatctaccgattccaaattttcccgcgccgcgtggaagcgacctcacccgggccagacgatcgcctgcgtctcgctgtaggcgtgcagtgcgtacgagcccacgtcccgccccaccccgctcttcttgaacccgccgaacggggcttccatgttccgcccgaccgtgttgacgccgaccccgcccgcgcgcagtcggcgggcgatccggaaggcgcgggccacgtcggcggaccacacgtagtcgatgaggccgtagtcgctgtcgttggccagggcgacggcctcctcctcgtcgtcgaaggggacgaccacgacgaccggcccgaagatctcgtcgcggaccacccgcatgtccggggtgcagtcggccagcagcgtgggggccacgtagaacccccggtccaggtggccgggccgcacgccgcccgcgacgacccgcgcgccttccttccggcccagctccacgtacgcctcgacgcggtcgcggtgggcggcggagatgaccgggccgacgacggtggcccggtcggccgggtcgccgacggtgagccggttcgcgtacgcggccagcttggcgatcagctcctcctggacgctcctgtggaccaggacgcgggtcggagccgtacagatctgtccgctgtagaaggagaacgtggtcccgatccccgcgacggccgagtccggatcggcatcgtcgagaacgagcgccgctcccttgccgcccagctccatcaactgccgcttcatcccacgcccgcacacctccgcgatgcgctgcccgacggcggtggacccggtgaagctgaccatgtcgacgtccggggagtcgaccgcggcctcccccacctccgcgccggacccggtgacgacgttcacgacacccggcggaacacccgcctccgcgagagcggcggccatccggtagacggagagcgggtcctgcggggcgggtttcaccacgaccgtgttgcccatcgcgagcgcgggagcgatcttgcccgccgggttggcccaggggttgttgtacgaggtgacacaggtgaccacgccgaccggctggcggacggccagcgccccgaagaccccggcccgccccatcggaccggcctcgttgatctggggtgcgacggcctcctcgaccggctccagggcacccttcgcgtaccgccggaagcgggcgacacccacccccacctgcatcccccgggcggtggaggtggtggcgccgctctccgcgcgggcgacctcggcgtgcgcgaggaagtcccgctggacgaggtcggcggcccggtccaggatcgcggcacgctcctcgggccgggtccgcgaccagggcccgaaggcctccttggccgccgcggccgcctcgtacacctgggcgcggctcgcctccggggcgaggccgacgacctcctcggtggcgggatcgatcacctcgtagtggccgccgtcgggctcggtccacgcgccgccgatgaagagcctgccggggcggttgccgctcacgcggtactcaccgtccgggtgtcgcggcccgagcgcagcaccgtccccggcaccgcccccgtcaccttgtcgtcgcgcagggtctcgaccccgttgacgcgtacggagacgatcccgatggccttggagtccaggcgcgggctgtccccgggcaggtcgtggacgagggtggcgggcccggcgccgatccgttcggggtcgaagaggacgaggtcggcgtggaagccctcctcgatccggccgcgctcgcgcagcccgaagagccgggcggggtcgtcggtgagcatcttgacggcggcggtcagcgggacgagcttgcgcccgcgcagacagtcgccgaggaagcgggtggtgtacggggccccgcacatccggtccaggtgcgcgcccgcgtcggagccgccgaggatgacgtcctcgtgttcccaggtccgctgccgcagcgcccaggagtccgggtcgttgtcggtgggcatcggccacaggaccgtacgcaggtcgtcggccgcgcagatctcgaccaggcagtggaaggcgtcctgtccgcgttcggcggcgatgtcgttgacgacccgcccgctgagcccctcgttggcggcgctgtaggtgtccccgatgacgtaccggccgaagttcgcgagccgccggaagactccggcctccttgctgtcggcgcggcgcagcatctcggcgcgggtgccggcgtcccggaggcgttcgatgcgctcggggacggggagggcgaggacctcaccccacccggggatgaggttgagggcgcagaaggtgccgagcgacatgttcatcggggtgaggatcggcatggtgagggccacgatccggccgccggcgcggcgggcgcgctcgctggggatcaactggcgcggcacgcgttcggggacggcggcgtcgatggtgaggacgttccagttgagcgggcgtccggcggcggccgtcatgtcgacgaagaggtcgatctcctcgtcggagaactggtccaggcacccggcgacgatcgcttcgagctgggtgccctcgtgctcgccgaccgcgcgggagagggcgagcagttcctcgggacgcgcgtgccgggaggcgacgggctcgccgtcgccgtcggagtgggtggaggactgggtggtggagagcccccaggccccggcgtccatcgcgtcgtggaggagggcgagcatggcgtccaactgcgcgggggtgggctgcccgccgaccgcgtcggcgcccatgacgtgccggcgcagggcgcagtgcccgaccatgaacccggcgttgacggcgatgcggccttcgagggcgtcgaggtactcgcggaaggtggaccaggtccagtcgacgccttcctccagcgcggcgagcgccatgccttcgacccgcgacatcatccgccgggtgtagtcggcgtcctcgggccggtcggggtggagcggggcgagcgtgaacccgcagttgccgcccgcgacggtggtgacgccgtggttcatggagggggtggcgtaggggtcccagaagagctgggcgtcgtagtgggtgtgcgggtcgacgaagccgggagcgaggacgagcccgtcggcgtcctcgctggtgacggcctcttcggtgatcgtccccggctcggcgacgacggcgatccggccgtcccggataccgacgtcggcggtgtacgcgggcccgccggtgccgtccacgacggtcgcgcggcggatgaggtggtcgagcatgacggttcccttctcgcggttccttctccggctcgggtgggacagctgggacagccggggtacgtacgctttcggccgcggtacgcaccccggctcatcagggcgacggtccgggaagacgccgcccggctgtgggtgggggttctgcccccacacctccgctcctcaatcgccggggggcttggttgtccggcccagacggcacatcgcagcccgcgcggcgaactccagccccgccggcgttcgagacgggtctttccagcccctccggcgattgaggagcggggtccggggcagcgccccggatcagctggcggcggcccggaaccgcgaggtccgatgcacgggatccgtgtcgatctgcggaatcacctgctccccgatcaaccggatcgtgttcatcgtgtcctcgggactgatcccgatcggcagcccgaagctcaactggtccgcccccgcccggtcccaccgccggcactgcttcagcacctcgtcgggatccccgcagatcatcagctcctccgcgatgagcagctcgacgatctcctcggtgtactccggcagcaactgcggccactccgggatcccctccggccggggaaacgtgtcgtggtagcggaacagcagcgactggaggtagttgagcccgccgccgaccgcgatctccacggccttcgcgtgtgtctcggcgcagatcgcggtggacgtcaccatcacgttgtcgttgacgaacgcgcccaccggctcggcgtccttgaccgcgttcttgtaggactcgacgacccactccatgtcggagaccttctgcacgctgaagcccagcacgccgagccccttcttccccgccatggcgtacgaggacggcgacccggccgcgtaccacatggccgggtgggacttcccgtacggcttcggcaggatcttgcgcggcggcagggaccagtgcttgccctggaagccgacgtactcgtcctggagccacatcttggggaactcggcgatcgtctcctcccacagctccttcgtgtggttcatgtcggtgatccccggcatgaacccgaggatctcgtggctgccggcgccgcgtccggtgccgaactcgaagcgcccctcggagagatggtcgagcatcgcgaccttctcggcgaccttcaccggatggttgacgggcgcgagcgggttgaagatgccggagccgaggtggatgcgctcggtggcgtgcgccagatagccgaggtacacgtcattggcggagaggtgcgagtactcctccaggaagtggtgctcggaggcccaggcgtacttgaagccggacttgtccgcctggatgacgtactcggtctcctcgatcagcgccttgtgctctgcctcggggtccaccttggcacgcgcggcgggcacgtacccctgaacaaagagcccgaattccacggaggttcaccgtcctcaagttttcctggcggctttcctgacgcaccgtcagattgcgatgcgaccgactgttccaccgccaccgcgacccgtcaatagctgacgctgcgtcagaaggggctgacccccgccagccaccccccgtcgatgacgaacggctggccggtgatgtacgaggagtcgtccgaggacaggaacaggaccagcgcggcgacctcctcgggccggccgatccggcccatcggcacgagcttgcggtagtacgcgtccagggcagcgccggacgtcgacagatcggcgtccgcgtccagcagggccgggttggtcatcgcggtgtcgacggcccccggacagacggcgttgacccggacgcccttccccgccagctccatggcggcgaccttggtgagccccagcaccgcgtgcttggtcgcggcgtacgcgccgaccaggggcatgccggtcagaccggtgtacgaggacgtgttgacgatcgtcccgccgcccgcggcctcgatctcgggtgcgacggcgcgtatcccgaggaacgcacccgtcatattgacccgcaccacctgctcgaactcccccagcggggtgttgaccagctcgttgaagcgcaggatgcccgcgttgttgacgagcccgtcgatcttcccgaaggcgtccttggccacggcgacggcggcggcccagtcctcctcgctcccgacgtccagccgcacgaaccgggcggcgtcctcaccgaacccctcgaccagctccttcgccagcgcctccccctgctcgaccagcacatcggcgacgacgacccgcgcaccctcggccgcgaagagccgcgcctcctgttcgccctgcccgcgcgccgccccggtgaccaggacgacccgcccgtccagcttgcccataacgctctcccctacttgtcgagacgaggggccacgtccgcaccgaacgccgccatctgatcggtcagttcgtccacgctccggctccggaagcgcacctggatctggtgcactccgatcgccgcgtactcccgcagcgactcggcgagcacctcgggcttccctttgagcgtccgccgtcccacgggccacgccggctcgcccacgtacagcggttcggtgatcgcaccgatgacgatcggcgcttcgacgcccgcctcctcccgcagggcgcgcacccgggcgatctgcgcgggcagccggtcccgggcatcgccctgcggcagccacccgtccccgcgcacggcggctcggcgggtggcggcgggcgaggaaccgcccacccagatcggcacccgttcctgggccggccggggcagctgcccgagcccgccgaacgagaaccgctcccctgcgaactccgggtactcctcgggcccgagcgcggcccgcagcgcgtcgatgctctcgtcgaggacgccgccgcgcccgtcgaagtccgccccgaccgcctcgaactcctcccgtacgtgcccggccccgaccccgaggatcagccgcccgccgctgaggtggtcgagggtggcgtactgcttggcggtgacgagcgggtggcgcaggccgacgacggcgacatggctcatcaggaggacgcgctcggtgaccccggcgagaaaggcgagcgtggcgacggggtcgtaccagacggtgctcatgccttccgccagccgtcgcgggatggtgacatggtcgcagccggcgatgtaggcgaagccgccgtgatcggcggcacgggcgacccggacgagatccgcgggggtcgccgccgcctcccagggttccgcgtagatggcgctctgcgactggaccggcagctgcatcccgtacgacagcggcccgctgggcagtatcggcacggcggcctccttcccctccggcccggcacggtcccgccccgggcgacggccgccatcgtcatacctgacggcccatcagacaaggggtgggtgcacatcggggcgcagccgcgacggtgaccgatgagtttcgccgccgggaagggtcatgagtggcaggcaggacaaagcgggcggccggaacgacccgatccgcacgcggcacgcactatcggcagagcaaggggaacaacgatgacaccacccacgaacgacgacgacaccaccgacaccacgggcatcaccggcctcggcgtcgtcatcggcagcaccgactccgcctccctgatcgcctggtaccgcgccgcactggagcccctgggcgcccgctgggcggaacatctgctgatcgtcggccccggggcgatcatcggattcgacgaacgggacgacgtggcggacaaggccgccgaaccgggccgacagctgatcaacctcaccgtgcgcgacatccgggcggccgagaagcacctcaacacgctcggggtgacctgggtgcggccggtcgaggacaccggaagcggctggttcttctccacgatcgtggacccggtgggcaactacctccagatcctccagggcccgggaacaccctgaatcccctctccgcacggcacgggccgccaggtcgtcgtgcgaggcggcggacagagccgagccggtcgtcacaccgacccaggcctggcctggccgctggaccactccccgctgacgctcccgctcccgggcacgtgcagcgtcgcccacctggaggagaacacggcggcggcggacctcgtgctcacgccggagctgtcggacgcagctggacggggccgggggcgggcacagctggggacggcagaggatccgggcgaccggcaggcggccgggcctgtcggcgtcacgtgccccgtacgacaccgtccggatcgccggcggcctcctcggcgaactccgggaagtccacgttcgccagctggagattcccgtggaccaggtggacggcgtccggcacgacgcgcacctcgcggggcggcggcgcgtcgatgagctcctggtagtacatcgggtcgaggtcctcgtcgtcatcggcacagaggtcgagcgcgagcagcgggcgcaggggcgaacgcatggtggcaccgtcggcaaggaacaccacactcagctcctcgtcccgtgccgccgcgacaagagcctcgtcactcgtgaccccgtcccaccgccggtcgtcgaccaggtgcgccggtgactccgacgccccctcggtcccggcgacgcggtccagctcggcgacgacctcccgccacgcgacgtcatcggtgtggtcggtccggatgacgagcggcgcccactcatcgggcctgacgatctccggcagctccatcacccgttgctccccggacgatttcgatcctgtcactcggaccctctcacccaccactgacagcaccatgtgctcctacagcaccgagccgggaatggtggagagcgcggtgaggcgcgccatctcctgttcacggaaagtggtgacctcacggcagacctggctcatgacgaagcttccgagcgaaacgcagaggtccatgcgctgaatgcatacgcccaccatgaacggaccgcccgcggcccggtagagacggaccccgtagtacccctcatggcagtcacggtcgttgttgaagcgacagtcggcacatgtatcgggaaggcgcaccggccggatgctcttcgcgtacagctcctgcccatcggggagtcggtaacgagtgcgctgatcggaagcacccgcagtgatgacgcgccgctcgggaacggcgcccaagtggtccaccacttcctgcatagcggcgagggaccgtccgccgtcctcaagcgaaaccagcatccgtacgaccaccttcctcccgaagtcctccacgatgcgcagcacccgttcgacatgggtgctgtccgggatcacgatgttggcggacaccttcaccccgcaccgcactgcggcctcgacggttgagcgcaggccatcgagcttccgctgagccaggttcacggagttgaaccgccccgcctggacagcggccagttcctgaggggtggtaccgaacacgctgaggttgatccggtccaggccctccgacgcgcacgcaggcagcacatccgcgccgttctccccgttggaagtgacgcccacccgcagccccagtcgacgagcgatcctgaccagtccaggaagatccgggtgcagggtgggctcaccgccggtcagatgaacctcgtccatggccaggcttccccgcatggccgccagagcaagagcgaagtccgggtcggccttgatcgtctcgggcaggaaactcgcgccgttcgtggagaggtagagagacacccggccggttcgaccaggattgcccgtgaactcggctgccgaacgcaaccggttgtccgaggcgacaggagtgccctcgttgtggcagaagctgcacgcgagaccgcacgcgtcgatgactttgactctcaaggtgctgtccgccaccacggtcaccgggacgggcacgtcatcctgcttcatcgaaccacctccacgacggaccggttctgggccggtcacctcttgtgtgcgcccatcgctcttaggagaaccgcaggtcagagatgccgcccaagtcgattccgtaccgggcgaagattttggtcgtgttctcgctcgtcaactccgacatatcgatggagagccgcgccgcagcaacctggacttcctccgccgtatcgccctcgatctccaggtacggcgggatgagcggccatgagtcgatctccagccttacccccgccaggacccaggagtcccggtggttctcctggtacgagcggtgttggatgcccatgcgtcccagcagcgcgtgagcagtctcgaagtccccgactgcggtctcggtctcgctcgtcccgtcgattgcgtcggaggtgacctccttgacgcacagggtcgtcgccgtcccgtcgtcgcgaagccgcacccatcgcccgtccatcgggggcacggtgtcgtagacataccggcgcataagccggccccctctgtgctcaccgcctgcggcagcgatccgcgccgccatggcggccgggtcgacctccagatacttcgcttcgtactcgacgaccggcatggctctccagctgatcctctgacacagggctcactgcaccggctttcccgagccggcccggagttgaagctagacggatgcggggagtgtcgaccactggattgcacgggattgcagccggcttcgtcggccggtggtgaaccgtcaatggctcgcttgacccagcaaggaccaacaagcgacgctcagtcgcacgagctgaacactcctcgaaggagcacagcatggcttgacgattcctcggtatctggcccaacactcccgacgacggttctcccaccatctggttggaggagtcgaccggcgacctgatcatccagtcctggaaggcggacgaggagactgttcgggcagcgcaggacgtcggttcgattcccgggcactccaccgaagtaccaggccacgaaacggtcatccgactgcccgccaacatgctgcagttcattccccgcaccgagaacgcatcagttgtcacgccgtccccgccggacgccgacagcactttcacggcgcacacattcagcgaggggcagtagtggcaacagtggtacgcgaggcactggccaaggcgcgccatacggccaagcacctggaaatgcgcgacagttacatgcgggacgacccgaacttcgtccgctggcaacagggccaccgcgacgacccctccgatcgggcttcctggtggcgcccctggctcgacgtcgtggccgccgccaccgcacgcggtgtggtgatgcgtcggctgcgtgtcgtgtccgaacccctcagtgactacacgcggtacgagtacgacggaacgttcaccaacgtcgcggcaggtgaggatgtgcgctggctgcaccggtccgccgctctcgacctcctgcttccggccctggacgggtgggtcatggacgaccgcctgctgatcctgcaccacttcagcggcgagggacagtgggcgggtccggggatggaggtctgcgacgacccccaggcggcagagcggtacgcccacgcttacgacgccgcatggctgcgagcgataccgcacgaggaatatcggcccgtctgaatatggacgcatgcccctctccccgcactcccgcgcccaacaagcccggcaggagcttgcgaaccgcctcgc

SEQ ID NO: 3487 - DNA, 7720 bp, Unknown
  Kingdom: Bacteria, Phylum: Actinobacteria, Class: Actinobacteria, Order: Streptomycetales, Family: Streptomycetaceae, Genus: Streptomyces
ctcgcccgccgggtcgacgcccgctccgggctcgcgctgacctgggggcggctggagaccgggcacgcccccaacgtcatcccgcagcacgccgagctctccggcaccgtccgctgcctggacctggacgcctggcgcgaggcccccgacctggtgcacgccgccatcgacgaggtggccggaatgcaccgggccaagaccgtcgtcaactacgtgcgcggtgtaccgcccgtggtgaacgacgccgagagcatcggcctgctggacgccgcgatgaccgagcgccgcggatcgtatgcgatcgaggacaccgagcagagcctgggcggcgaggacttctcctggtacctggagcgggtgcccggcgcgatggcccgcctcggcgtccggaccccgggcgacacgcgcgggctcgatctgcaccgcggcaacttcgacgtggacgaggaagccatcaccgtgggggtcgagctgttcaccgccgcggcgctgttcgacgggaaccgttagcggagcgttgacacagtcttcgtaggccgttcgtggacccgcgggaggccttctgttcacgacgatccgataacggcttccgtacgtgctcttatctgacatctacgcgcgttacgatcgccgcgaaaccagcgccggaagaggcgcttcggtcaggtttgaaggagccttcccttgcgccggatcaccaggatcaccaccgtgggcattgcgtctgcggcgcttgctctcagtgtcaccgcctgtggcggaaaatcatcgtcggacgccggttccgactcgggcggcgacaaggccgccatcgcctacgacatcggcggccgcggcgaccagtcgttcaacgacgccgcctacgccggactcgccaaggcggagaaggaactcgacgtccagggcagcgaggccgagccctccgacggtgagggtgacgcggacaaggtccagcgcctcaccgagctggcccgctccggcaacaacccggtgatcggcgtcggcttcgcctacgcccccgccatcaagaaggtcgcgccgaagttcccgaagaccaccttcggcatcatcgacgacgcctcggtgaccggcgacaacatcgccaacatcgtcttcaacgaggagcagggctcctacctcgccggcgtcgccgccgccaaggtcaccaagacgaagacgatcggcttcatcggcggtgtcgagaccccgctgatcaagaagttcgaggcgggcttcatccagggcgccaaggacaccgacccctcggtcaaggtcctcccgcagtacctgacgcagccgccgaacttcgacggcttctccaagcccgacctcggcaaggccgccgcccagggccagctcgacaagaaggccgacgtgatctactcggccgccggtctggccggttccggtgccatcgaggccgcctccaaggccggcaagtggaacatcggcgtcgactccgaccagtacaagcagaagggcctcgcggcctacaaggagtccatcctgacctcggtcaccaaggacgtcgaggactcggtgttcaacctgatcaagtcggtccaggacggcaagccgaccaccggtgagatccgctacggcctggacaaggacggcgtcggcctgtcgatgtccaacccggcgttcgccaagatgaccgacgtcatcgcggccgtcgacaaggccaagcaggagatcatcgacggcaagatcaccgtcaagaccgctccgtaagcagctcggagcctcctgtcgtacggctggtttcctcaaggccctgtccgtcccctcgccgcactccggccggtggacggacagggccgcgggaccgtccccgccggacggacaggctccccgccgcggtacgcgaacaaccgcggcagccctgaactcccgcggcaccacccgaagaagatccgcctctcgcagtgctctcccacccggtccggactccgcgtccggactgtgacgtgcacctgtgtttcacgattcggcagcgctacgcgtgtagacagccctccggcgcgataacttcaccccgcccctccagggagtgtctgataatcccgcgtgggcgggcgacgtccagcacggcacctcgcggcgttgccgaaaagccctggtagctccgctacgaggactctccggcgccttgcggtgcaccgcaccggacgccgcccgctgatccacgcggaattatcagacaccccctcagcccctccgcccccgctcctgtccggccaaggagagtgcgtcatcaacgcgtccagcagtccccctgccgtagaactgcacggcatcaccaagcgcttccccggcgtcgtcgccaaccacgacatcgacatcacgatcggcaagggcacggtccatgccctcgtcggtgagaacggcgccggcaagtccaccctgatgaagatcctctacggcatgcagaagccggacgagggcaccatcgcgatcaacggcgagcaggtctcgttctccaacccgggcgacgccatcgagcgcggcatcggcatggtgcaccagcacttcatgctcgccgacaacttcaccgtcctggagaacgtcgtcctgggcggcgagaagctgtacggcatcggctccggcgcccggaagaagatcaaggagatctccgacgcgtacggcctgggcatccggcccgacgcgctcgtggaggacctcggggtcgccgaccggcagcgcgtggagatcctcaaggtcctctaccggggtgcgcgcatcctgatcctggacgagccgaccgcggtcctcgtaccgcaggaggtcgacgcgctcttcgccaacctgcgcgagctcaaggccgagggcctgaccgtcatcttcatctcgcacaagctgggcgaggtgctctccgtcgccgacgacatcacggtgattcgccgcggcacgaccgtgggcaccgccgatccggcgtccaccacgaccaagcagctcgccgagctgatggtcggcagcgaactgccctcgccggagacccgcgagtccaccgtcaccgacgtgccgatgctgcgcgtccgcgacctggcgctcacggtcaccgaccccgacggcaccgtccgcgacgtgctcgccggcatcgacctcaccatccaccagggcgaggtcctcggcatcgccggggtcgagggcaacgggcagaccgagctgatcgaggccctgatcggcatgcgcatcccggacggcggggtgatcaccctcgaccaggacgacatctcgcaggtccccacccgcaagcggcgcgaggccggcatcgggtacatccccgaggaccgccaccgccacggcgtcctgctggacgccccgctgtgggagaaccgcatcctcggccacgtcaccgagaagcccaacagccgaggctggctggtggacaacagggcggcacgcgccgacaccgagcggatcgtgcgcgagtacgacgtacgcacccccggcatcgaggtcaccgcggcctccctctccggcggcaaccagcagaagctgatcgtcggccgcgagatgagccacgcgcccaagctcctgatcgccgcgcaccccacccgcggcgtggacgtcggcgcgcaggcgcagatctgggaccagatccgcgaggcccgccgcgaagggctggccgtcctgctgatctcggccgacctggacgagctgatcgggctctccgacaccctgcgcgtcatgtaccgcggccgactggtcgccgacgccgacccggccaccatcaccccggaggaactgggctcggccatgaccggcgccgccaccggtcacctcgaaagcccggaggacgaggcccgatgaagaaattcgacaaggaccggctgatcctgggattcgccggcccggtgctcgccctggtcgtcgccatcgcgctgacgaccgtggtgctgctcgcctccgggcggaaccccttcgagccgtaccggatcatgttcgagtcggccggctacgtcgacgtacaggtcctgatcgtcaaccaggccggtacgtactacctcgccgcactcgccgtggccgtcggcttccggatgaacctcttcaacatcggcgtcgacgggcagtaccgcctcgccgccatgatggccgcgctggtcggcgcgagcgtcagcctgccggggccgctgcacatcgcgctgatcgtgatcgtcgcgatgctggtgggcgcgttctgggcgggcatcgcgggcttcctcaagaccacccgcggggtgagcgaggtcgtctcgacgatcatgctcaactcgatcgccaccgccctggtcgcctggctgatcctgccgaagaacttcggcgagcagcccgcgggatccaacaacctgaccaccggtgagatcgccgagtccggctggttcccggggttgccgatgggcgaccaggccggggagatctacggcttcacgttcgtcgccgcgggctgcggcctcctgtactggttcgtgctgaaccgcacccggttcggcttcgacctgcgcgccaccggcgccagcgagagcgccgcccaggcgtccggtgtggacgccaagaagatgatcctcacctcgatgctgatctccggtgcggtcgcgggcctggccggtatgccgaccctgctcggcgacacccacacctacagcctcgacttccccaccggtatcggcttcaccggcatcaccatcgcgctgctgggccgcaacaacccgctcggcatcgccttcagcgccctgctgatcgccttcctggacaagtcgtcggcctcgctcgaccagtacgggtacgagaaggagatcgccacgatcatgcagggcctgatcgtgatctcggtcgtcgtctcctacgagctggtccgccggtacggcatccgccgccagcagcagaaggtcggcgaggagctcgccgccggccatgccatcaagaccgagaaggaggcggccctgtgagcacgagcaaagccaccgccgcacgcgtcgcccccaccaagggcggcggccgccgcaagctctccctgcccgtcgtcctcctgatcatcgcgggtgcgctcgccctggtctccctggtgcgcctcatcagcggcgccaacgacgtcacctcggtcggccaggtcgccggcgccctggagctggccgtcccgatcggcctcgccggactcggcggcctgtgggccgagcgcgcgggcgtcgtcaacatcggcctcgaaggcatgatggtcctgggcacctggttcggcgcctgggccgggttccagtggggtccgtgggtcggcgtcctcttcggcatcctcggcggctgcctcggcggcctgctgcacgcggtcatcacggtcaccttcggcgtgaaccacatcgtctccggtgtggccatcaacatcctcgccgtcggcgtcacccgctacctctccaacttcgccttcgacggcatccagggcggctcctccaagcagtccccgcgcatcgatccgatcgacaagatcaccatcccagggctctcggactggctgcaggacctgcaacaacagcactggttcctggtctccgacatcgcgggcatcctcggcggcctggtcaccgggctctccctgctgaccgtcgtcgccctgctgctgatccccgccacctggtggatcctgtggcgcacgccgtttgggctgcggctgcgctcctgcggcgagtccccggtggccgccgagaccctcggcgtcaacgtgtacaagtacaagtacatcgccgtcacggtctccggcggtctggcgggcctgggcggagcgttcctcgcgatcgtcgccaccggcatctaccaggagggccagaccggcggccgcggctacatcggcctcgccgcgatgatcttcggcaactggatgccgggcggcatggcactgggcgccgggctcttcggcttcaccgacagcctcaagctgcgcggcggtgcggagaacgtccacgcgatgctgctcctgctggcgatcctgctggtcatcgcggtgttctggcagctgtaccggaagaagtacgtcgccgcggtgatctcggcggccgtctcggcgctgctgttcacctggtacttcctgaccgaccaggtgccgagccagttcgtcgacgccgccccgtacgtcacgacgctgctggtcctctcgctctccgcgcagcggctgcggatgcccaaggctgacggcgtgccgtaccgcaagggagagggcaagtgacgccgcccgccgccgaaggcgcgtccgcccgtgctttcggcgaggccgactgggaggccctgcgggtcgccgcgcgggacgccatgtcccgcgcgtacgtcccctactcgcgctacccggtcggcgtcgccgcccgggtggacgacggccgcacgatcaccggctgcaacgtggagaacgccagttacggcctctcgctctgcgccgagtgcggtctggtctccgcgctccacgccaccggcggcggccggctgacccacttcacctgtgtggacggcaccgggtcgatcctggtgccgtgcggccggtgccggcagttgctgtacgagttcggcggcccggagctcctcctggagacgcccgacgggcggcgcacgctggacgagatgctgccccaggcgttcggcccgcagcacctcgcctgaaccccgttttcctcggcggtggcccttcccctttcctggaagggccaccgctcttccctctctccatccacgcaaaagtcagttggaactcttgcgtacgcacccggccggaaggattcccatggacgccatctccgtcatccgcaccaagcgggaccgaggcgagctgacccccgagcagatcgactgggtcatcgacgcctacacccgcggcgaggtcgccgacgagcagatgtccgccctcgccatggcgatcctgctcaacgggatgaaccgcacggagatcgcccgctggaccgccgcgatgatcgcctccggcgagcggatgaacttcgacgcgctctcccgcccgaccaccgacaagcactccaccggcggcgtcggcgacaagatcaccctgccgctcgccccgctggtcgccgcctgcggcgcggccgtgccgcagctcagcggccggggcctcggccacaccggcggcaccctggacaagctggagtccatccccggctggcgggcccacctctccaacgcggagatgctgcacgtcctcgacaccaccggcgcggtcatctgcgccgccggtgacggactggcccccgccgacaagaagctgtacgcgctgcgcgacgtcaccggcaccgtcgaggcgatcccgctgatcgccagctccatcatgtccaagaagatcgccgagggcaccggggcgctcgtcctggacgtcaaggtcggctccggcgccttcatgaagaccatcgaggacgcccgcgaactggcctccaccatggtcgcgctcggcaccgacagcggtgtgcgcacggtcgcgctgctcaccgacatgtccaccccgctcggcctcaccgcgggcaacgcgctggaggtccgcgagtcggtcgaggtgctggccggcggcggcccgagggacgttgtcgacctcacgctcgccctcgcccgcgagatgctggacgccgccgggctcaaggacgccgacccggagaaggccctcgccgacggctccgccatggacgtctggcgccggatgatctcggcccagggcggcgacccggacgccacgctcccggtcgcccgcgagcagcacgtggtg

SEQ ID NO: 3488 - DNA, 591 bp, Unknown
  Kingdom: Bacteria, Phylum: Actinobacteria, Class: Actinobacteria, Order: Streptomycetales, Family: Streptomycetaceae, Genus: Streptomyces
gtctggccgaagccgttctggagtgggccgcgatcgcccggtccacggcccgcgaacggctcgacatcgcccactgcgtggtgagcgaggccgagggacggcagcgcgcggcacgccacgccctggacaccgagcgtgaacgcgcccgcctccagcagcggtacgaggagaccgtgcggcgcgccgccgccctggaggagcgacgtcccgaacacgaccgctgccaggaacggctggaacgcgcccgcagggccgaccgggtcgctcccgcactggacctgcgcgaggaggcggagcgtgcccaccgccgggccgccgacgccctggaccgggccagggcacagctgccgcccgacctcgccgacgcgggacccgaccggctcaccgagctggagcgccggtaccggcaggaactgggcggcctggagtcggcccgccgggccgaggcacgcagcgcggcgatcgacgaggaacgggaccggctggagcgcgagtcccgggccgacgacacgaccgtccgggacgcggacgcctggctggcgggctgggaggccgtccacgccggactcagggaacgcatcgcgacggcgc

SEQ ID NO: 3489 - DNA, 2247 bp, Unknown
  Kingdom: Bacteria, Phylum: Actinobacteria, Class: Actinobacteria, Order: Streptomycetales, Family: Streptomycetaceae, Genus: Streptomyces
ggacgtcaggtgcgtccggggccagtcggagcgaggggcgttgtaggccgtgaagttgtaaggcgaccggtctccggcactgcacagctttccgtccgggacgtaacccgccccccgtccgcccgcgttggagtcgaggacggcgaaccagttgtacagtgcggtcgcgccgctctcgtcgagcgcggctttgcacgccggatttgtcgggtccagtgcgccggtgccggtcctggcgtccagcatgcagaggtaggtgcgggatcccggtgtcatcgtgacgccgtgcgcctgcgcgttgtcctggcccattaacgtcaggccgattccgccgagcagcgtcgcgagcaccgccgccagcgaggcgaacagcttcttgcgtcggggcatgaggtctcctgttcctatgtgggacggtcttccggttgtgctgtgcttccctcctgcggccaccgtcgggcgaggaggccgggtggtggtggcacctgaagcagaggacgcggtcgagggggagcggagcggcgaggcgggatcgcccggccggtgaggggcgtgcctggtgtgccgtcgtagccgtgggtcccgcccgtggtgggccgcaggtcgccgcggacggaccagcccttgcgccgagggagccggcgatccacggactggatgcggagtgctgggacggcgcgatcaacgtcacctgggtccgcaccctgtgcatggggaagatcatgggggcggggccggctcgtgtgcggatcagttcacggccgtcttgtgggggctgactccgcttcggcggggcccgcggccggcagggccgcgccgggctgggtcagcaggagtgaggaactggctgcgcgaggcaggtggagtgtggtgacgctcgtatgcgggcctctctgtgggggagatgaccggggtgatcgcaggatgggaagcgctcggtcgagctttgggagcgctcccatcgctgataccatggactgtacgagcgttgccgtgctcctgacaacccaccgtgcgaagtggctgtggaccggtgagggtgcggggcaggtcgaggggtgaagcggccgcgttcttccgaagcttcgtgcttcagcgcttttcgataccttcggcggccctagaagccttgtggtcttgggctgtacgacctgacggggcagcaggagccgtacatccgcattctgtcgggccggactcacgtggtggttcacgactgcatggccgccatcccgtgagggtgggtccgtgagggggtggatcctgtccgactgcttgacggcacgtcgtgagtgttcgactttgggagcgctcccgttcctggctccttctgcgggggtcgagtgacccgatcgcctccggggcgggttcctcgttcggcggccgtccggcgcctgtactcggagtgcggcagtggcgctctggcagcgcctcctggtacccaagagcccctgcgagtcccgcggagggccgtcggcccccacggcgaaaagcccgtcagcgtgctgacgggctcccgcgagaatgcagctaatctgctgtcagatcagatcgtcggcgtctcgtcgatgatctccttgtggggttcgacgacgaacttccagccctcgctgggctcgaggaaccgcactcgggtcgggtagatgtccagggcgcggcggtctcggttctggccgttcgcgttcttgcgtcctcgggccggctcctcgtacaggtccaccttgacgtccggtactgcgacgacttcctcgctccaacgctggacgatccccgcaccgaacgcgtcccgggccgcggaatagagcgattccagggactccttgcttccgccgggaacgaagagggcgaggttcagcagaacgccggcactctggagcacctcgatttcctccccttttttgtccgcgacccagatcccgccctcttcagcatcgtcgggaaggacatgaatctcctcaccgaaaaccgtccgcaccgtgaaagatccaccctcgaaattctttcccggctttgtaaggaaagctggtgcgtagcagtcgagggaaatgccatccatccctgccgggacgaagatgccgtcctggaggtccaaacctgcagtctcctcggccgtaagacgtcgagctgtaaccttctcggtattcacgccactccccttttactgcgtcgtcctgctaaatcatcaaaactctaccatgaaaaggatcagaggctggcccaaggttccaccatgatgacgatggtgtc

SEQ ID NO: 3490 - DNA, 3982 bp, Unknown
  Kingdom: Bacteria, Phylum: Actinobacteria, Class: Actinobacteria, Order: Streptomycetales, Family: Streptomycetaceae, Genus: Streptomyces
cgaggaccgcggcggccgtctgaacggggaggcggagagcggccgggaacggcttcaggtcgtggacgaaccccagggcggcgacgatcccggtcccggcgagcagcccggcgacggagccggcggagtcgtccgccgcgccgagccacagggccccgccggctgccgtgccgacgccgagcacgaccgtcgcaccgcctgtcctgcgcagcgccgcggcccgtggcgcccgcccgcccggttcgtccggggcgtgggggcggagcgccgcgcggcgggcgaccttggcgagtgcgaccgtgatgaacagcgcggccacaccggaggcgatgatccccagcacgttcacctgccctgcctttcctcgttcatgacctgcggtgcgggacgccgggcggccggtggaacggcggccgcccggtcccgggccggttgtgggtcgggggacacgggacgccactcgggtggcgtttctccccaacctacgggccgatgtccccattcgccctaaataacacgaaaagggcgacgtattgttctgccacccgactgcggaacgacgcggaccgaccgatccttgaccgtcaaaaggcatgggggtggacggagttgggagagcacgcggacggaggggccgtcagcccccgaagccccgttcggcgttgcgctcggcggcggcgtgccaccagcggggtggagagggaccggtgatcaccgcggtggtctgatcgggatgcaggccaagaccgcgcagcgcgtccgcgcggacccggacgacatactgaccgtgccggtgtccgtccgcgccgacgccgcaggcgagatcgcagcggacgaggttcccggcgaagggcgtccagtcgataccgcggtcccgcagtcaggcgcggagggcagccgcgggtcgcgggcagcccggcaggttctcgtacgacacgacggccacccacgcggcgctcgaccggctctccgccttctccaccctctccgcacgcatggcgccgagcgtagcgtcacctcccggccagggcgtcacggccgtccacgaaggtcccgacgacctcgatgtccccgatccgggaggggtccacccggtgcgggtcgtcgcccagcaccaccaggtcggcgcgcatgcccggcgcgaggacacccgccgactcctcccagcggcaggcgtgggcgccggcgaccgtgtaggccttcagcgcctcgtcgacggtgacggcctcgtccgggccgacgagacggcccgaagcggaggcgcgttcgaccatgaactggatcgcccgcagtggcgagccgtccgcgacagggcggtccgagctgccgacgagggcgaccccgtggtccaggaatcccctgccccggtacagccagccggcccgctcctcccccatcaccgtcgcgtagtcgtcgccgaagtggcgcaggaagctcggctggaccaccgcgctcacgccgagcacggcgaaccggggcagctggtcggggcggatcagcccggcatgctcgatgcggtgacgcgcgtccggacgggggcacagcctctgggcccgctccagcgcgtccagggcgaggtccgcggcgcggtccccgatggcatggacggcgagctgccagcccgcgaggtggccgtcgacgatgaggtcggccatacgtccggggtcgtcctggaagcgtccgacgttgtcggtggtgcccccgtacggggaggtgagcgcagccgtacgcgccatcatcccgccgtcggtgtagatcttcagcgcacccagggacagccagtcgtcgccgaacccggtgcgcaggccgaggtccagagcccgggggaacccgtcgtcggcatgggtggcgcggggacgcaggctgtcgccggacgccatgagctggatccgcaggggcagtcggccacggtcccggagcagttggtaggcgcccagttcgacgggactgtgaccgagcagcccaccgccgatgcccgcctcggcacaggccgtgatcccctcgtcgaggcaggcgcgggcggccagctcgatcgcgtcggccagctcctcctgggagtagggcagccgcagtcggcgggcggtggtcatggcgctctcggcgaggaagccgttctcgtgcggcgtcccgtccggcagcagctccagcacggcggtgttgacgacgcaggcgtgcccggagtcgtgcatcaggaagaccttgcggccgtggctgacccggtccagttcggcggcggtcagatgccggcccagggcccgctggtcgtacccggcgatgtccacccaggcgcccgagggggccggccgccgggccgccgcgtccacgacggcgaggatgtcctcgacccgctcgcacggggcgacgctcggcgtaccggccttcaacccggtccaggccagatggacatggctgtcgatgaagccgggcagcacggtggcgccgcccaggtcgacgacctcgcgggcgggcagggaggtcacagcctcgtccacaccgacgacccgcccccgccagatgcccaggtcgtgggcgacggggtgccgggggtccatcgtgaggatgcgcgcgttcgtcagtcgcgtacagagcatgggcagtccgtccgtcggaggtcctgagggcatcaccggcgcgggacttctcggagccgtacggcggcgaggcctcgccgccgagagctctcgcccggccgtccgccggaatgtactgccgggacgcgggcgggcaccatcggtcccccgaaccggacttgaatcggagatggaccggaggcggagacggacctggcacggggcgagacctcgacgcatccgaccgccaacgcccctaccgctacagggctttgcgaccatccacctcgtcggcgaactcaacgggcgcgaccatcacgcaccgttgatttcttaggtaaggcttgctttactgatgcgccagttgatcgttctcgcagcgggcgggattcctccacgatcgcaccgaggaggacatgcgcaccggccggaaccggcccgccgaagaactggagcgcccggtccgcgaccacggcccggcgatctcgcgcgtacagaccacggacggccacgagctgcccgcgaccgcgtacttcactcgatgggcggccgtaccaccggccgcccctgacgatcgggacctacccatgcgtaccgcacgtgcccggcactacctcatgtgccggcccacctacttcgacgtggtctattccatcaacccgtggatggacccgacgaaacccgtcgacacccccctggccatcacccagtgggagcgactgcgcgaggtctacctgagcctcgggcacaccgtcgacacgatcgaccccgtccccggtctccccgacatggtcttcgcggccaacggtgcgaccgtcgtcgacgggcgggccctcgtggcccggttccgcgacgccgagcgcatcgccgagggcccggcctaccacgactggctgcgcgacaacggatacccggaaccgcgcacggccgcgttcgtcaacgagggggagggcgactatctcctggccggcgactggctgctggcgggcaccgggttccgcagcgacccccgctcccacgacgaggcgcaggagttcttcggacgcccggtgatcggactcaccctcgtcgaccccgactactaccacctggacaccgcactgaccgtgctcgacgagcagacgatcgcctactatccggcggccttctcccccggcagcctggccgtgctgcggcggctgttcccggacgccctcctcgcctccgccgccgacgccgccgcgttcgggctgaacgcgacgtcggacggatacaacgtggtgctgccgcagaacgcgacgaacctggccgggcagctgcgcgagcgcggattccgcccggtcggcgtggacctgtcggaactcctcaaggcgggcggcagcgtgaagtgctgcaccctggagctgcgccgggaggcctgagcggacggcctc

SEQ ID NO: 3491 - DNA, 513 bp, Unknown
  Kingdom: Bacteria, Phylum: Actinobacteria, Class: Actinobacteria, Order: Streptomycetales, Family: Streptomycetaceae, Genus: Streptomyces
gggcgctctcgcttccgccgcaggggagccgcgcggcggcggagccgaggacgcgtacggggcggccgtccagacggacctcccagcggccttccgggagcggtggggcgatcagtgcggagaagcggcacggcgcgtggtcgggggcccggtccgagctcacgtccgagctttctcccgagctcacgtccgaagctccgtgcacgacgggcttcgcgaccgtcgtccccgcgtcgttctccgtgacggcctccgcggtgctttccgcaccggtctccgcggtgtctcccgtgaaggccgccgcgaccgggaccgcctcgtgcagcgtctcgtggtgcaggacgagtcggccgccggacgcggtcgtcgtccccggggccgacgggacatacgtccccgagacgcgcagggccccctccggcgtacgctccacccggtccgcgtacggggaccccgacaggtccagcaccaggtcgcccgcgggtccgcgcacgcgggcgacctggtgctgga

SEQ ID NO: 3492 - DNA, 3905 bp, Unknown
  Kingdom: Bacteria, Phylum: Actinobacteria, Class: Actinobacteria, Order: Streptomycetales, Family: Streptomycetaceae, Genus: Streptomyces
gcgggccgcgcgcggcccgcgccccgcgcagtcccatcagggtgacgaccgctccggccgccatgcccgcgagggccagcggcaggacgctcgcgccgagcgcgctgccgcgtgggtccccgggcggcgcggcgaccacatcggtgacccggaccggggtgtccccggggacggacgccgtcacggcctcgcgcagcagctgggagacgacggggctcgccgccgaggcggtgagcaggtgcggcccctgcggggtgacggcgacggctccgtatacggtccggtcctcgatcgcggtgcgggcggcggcctcgtcgtcgaagcggtgcacgtcgaacgctccgtcgcgctggtcgaagcgctgttccagctgctgggccgccgtcgccgggcccgcgaccccgaccgggaggtcgcgcggcgcgatccgggcggcgggccaggcgaaggcccagagggcgagcgtcaccatcagggggatcagcaggatcaccgccaccgcgcggcggttgggtgcggtggacatgaggggcctcgattcgtgcgagcgacgacggagaattcagagagaaggatcgttcgttttatgttctgtccctactgtcggcacgccttgccgcattgtcaagaaggaacgttcgttttaggttggtgccatggctcgcgtatcccaggaacacctcgacgcccgtcgccgtcagatcctcgacggcgcggcgcgctgcttcgcccgcaacggattccacggcacgtccatgcaggacgtcctcaaggaggtgggtctgtccgccggagcggtctaccgctatttccccggcaaggaggacatcatcgcggccatcacgaaggagaccttcgccgtcatccgcggcgccttcgaggaggcctcccgcatgacgccgccgcccactccggacgcgctgctcggccgggtgctcggcggggtgctcgcgggtgaggtgcacggactggagcggcgggccttcgccgcgctcgtcgtccagctctggtccgagacgctgcgcgacgaacggctcgccgcgctgctcgacgacggttacgccaccatgcgcgtcgcctggacgaagctcgtcgacgcctaccgcaccgccgggctcctgagcgccgacgtgcccggcgaccacgtggcgcgaacgatgatcgcgacggcgcaggggttcatcgtgcaggaggcgctcttcggggacgtacgtcccgaagtgctggagaacgggttgcgcgggctgatgtccatgaacccgcaaaagaccagttaacgcaacggaaaaacttccgccctaacgtgcaatgcctggtcgcgatggcgccgtccccgttcgacgacatgttgagcggggatagggtcccgctgcgtccggagccggagccggacggaagacgatgaggtggaagcgtgcaactgaccccgcacgagcaggagcgtctgctcatccatgtggccgccgacgtggccgagaagcgccgggcacgcgggctgcggctcaatcaccccgagaccgtcgccctgatcaccgcccatctgctggaaggcgcccgggacggccgcaccgtcgccgaactcatggcgtccggacgcaaggtgctcacccgggacgaggtcatggaaggcatccccgagatgctccacgacgtccaggtcgaggccaccttcccggacggcacgaagctcgtcaccgtccacgacccgatcgtctgacggggcgcaccgatgattcccggagagatcctgtacggggacggggacattcccctcaacgaggggcgggcggtcacccgcctcaccgtcctcaacgccgccgaccgccccgtccaggtcggctcccactaccacttcgccgaggccaatcccgggctgcgcttcgaccgcgccgccgctcgcggcctgcggctgaacatcgccgccggcacggcggtccgcttcgaacccggcatccccgccgacgtcgaactcgtccccctcaccggccgccgcgtcgtccccggcctgcgtggcgacaccggaggtgccctcgatgcctgacctcaagcgagccgtgtacgccgatctgttcggacccaccaccggcgaccgcatccggctggccgacaccgatctgctcgtcgagatcgaggaggaccgctcgggcggtcccggacacgcgggcgacgaggcggtgttcggcggcggcaaggtgatccgggagtcgatgggccaggcccgcaccacccgcgccgagggtgcgcccgacaccgtcgtcaccggagccgtcgtcatcgaccactggggcatcgtcaaggccgacatcggcatcagggacggccggatcaccggcatcggcaaggccgggaacccggacaccatggacggcgtccaccccgacctggtgatcggcccggagaccgagatcatcgcgggcaacgggaaactgctcacggccggagccgtcgacgcccacgtccacttcatctcgcccaccctcgtcgaccaggcgctctccagcggcatcaccaccctcgtcggcggcggtacgggacccgccgagggcaccaaggccaccaccatcaccccggggccctggcacctggcccggatgttcgaggcgctggagaccttcccggtcaacatcgggctgctcggcaagggcaacacgatgtcgcaggaggccatgcactcccaactgcgcggcggcgcactgggattcaagatccacgaggactggggtgcgacacccgccgtcatcgacgcctgcctcgccgtctgcgagcggacgggcgcgcagctcgccatccacacggacaccctcaacgaggcggggttcgtcgccgacaccctcgccgccatcgccggccggacgatccacgcctaccacaccgagggagcgggcggcgggcacgcgcccgacatcatcagcgtggtctccgagccgtacgtcctgcccagctcgaccaaccccacccggccgcacaccgtcaacaccatcgaggaacacctcgacatgctgatggtctgccaccacctgaaccccgccgtccccgaggacctggcgttcgcggagtcccggatccggccctccaccatcgcggccgaggacatcctgcacgacctcggggccatctcgatcatctcctcggactcccaggccatggggcggatcggcgaggtcgtcctgcggacctggcagaccgcccatgtcatgaagaagcgtcgcggagcccttccgggggacggccgcgccgacaaccgccgggtccgtcgctatgtcgccaaatacaccatcaacccggctgtcgcgcagggactcgaccgggagatcggatcggtggagaccggcaagctcgccgatctcgtcctctgggacccggcgttcttcggcgtgaagccgcagaccgtcatcaagggcggccagatcgcgtacgcgcagatgggcgacgccaacgcctccatcccgacgccgcagccggtcctgccccggccgatgttcggcgccctgggacgcgcggccgcccacagcgcgttcaacttcgtctccgccgccgcgatcgaggacggtctgcccgaacggctcgccctgcacaagcggttcgtgccgatcaccagcacccggggggtcaccaaggcggacatgcgggagaacgacgccctgccgcaggtccacgtcgaccccgacagcttcgccgtcacgatcgacggcgatccggtcgagcccgcaccggcggcggaactgcccatgacccagcgctacttcctcttctgagtggacccggtcatgtcacgcgcagcactcctcgtcctcgccgacggccggttccccgccggagggcacgcccactccggcggcgccgaaccggccgtcgccgagggtcgcgtccgcgacgccgactccctcgccgacttctgccggggc

SEQ ID NO: 3493 - DNA, 2654 bp, Unknown
  Kingdom: Bacteria, Phylum: Actinobacteria, Class: Actinobacteria, Order: Streptomycetales, Family: Streptomycetaceae, Genus: Streptomyces
gcctcggcgggggcgagggccccgatggtgacggcctccgccccgggccctgtcagaccccggtcctgttccaggatccgctggtggagcgtccgcaggtcgggcccaggctccatgcccagtccctcccgcaggcgggcgtgcgtcatgcggtagagctccagcgcctcgctgtgccgcccgctgcggtggagtgccagcatcagggagccgaccactccttccgccagcgggctctccgccgccagctcccgcagctcgccgatgagatcggcgtgccgccccagctccagctccagccggatgcgttcctcccggacatggcggtggtcctccaccagccgggcccgcaccgacgccgcccactcgccggagctttcggtcagcggttcgccccgccacatgctctcggcggtccgcagcagcccgatcgcccagtccgtacggccctgttccgccgccacggccgcctcggagcggaagcgctggaagcggttcaggtccagatcgttccggtcgcgcatccggagccggtacagccggggctgcacgaggtccacccgcacgagcgggcccacggcgtcatacagatgccgccgcagtttggagaggtaactctggagcgtggccggccccttgggaggcggctcgtcgccccagacccgctccatcaacgtgtccacggcgaccggttccccgcgcgcgtgtaccagaaccgcgagcacgcagcggtgtttcaccgaaccgagcgtgtgctgctggtctccgtgccatagttccagaggtcccagagcaagaaggtccatttcgctcccccgacaggtgccccgcttcctgccgccaccggcagccgccgcacgtctgtgcggaacagtccactgttccctgagccaccggcccggaccagagcgcacagggggcgtgagcggggcgcatggcgcagcgcttttccgcatacagctggaacgcaggattcctgcaagccgcctgtccacgtccgtgggcagatgcgtcccgggccgccgtcagccgcggcctccgcggacccccggtccgcggcgacggaaacggggactgatcagatgagcctgaccatgccggacgtgtaccggccccttgtaccggtgcgcctggacgtcgaacgctgggccacccggcgtacccgcaggaagatcctggccgtggtgcacaccgtcacggcgggacagcggctgctcgaagccgtacggctgctggagggcgacgcccgggtgcaggtgttcttcacccaggcgcccgacgtgttcagccacggggtggaccacttcctggaacggctgggcggcctggtcctgccctggcaccaggcggtccagatgcccttcgacctggcggtggcggccgcccacggcggactccaggaactgcacgccccggtgatcgtgctgccgcacggcgccgggcacaacaagctgatgcccgccgggcagcgcggccgcccggtcgccggacgcgggatctacggactcgaccggcaatggctgatccaggacggccggttggtgcccgagacgatcgtgctggcccaccacgaggacctgacccgcctcggccgcgaatgccccgaggcgctgcccgccgccgaggtggtcggcgacccctgctccgaccggatcacggcgagcctgccgcaacgggccctctaccgcgacgccctgggggtcggagcgcgccagcaactggtgaccgtctgctccacctgggggccgggctccctcctgggccgccagtgggagctgctggaacggctggtcgacgagctgccccgggaggacttccgggtcgcgctcctgcttcacccgcacgtctggaacgcccacggcgaatggcagatccgcagctggctcgcgggactcgtgcgctccgggctcctggtgatcagccagcacgccgactgggtcggggcgctggtcgccgccgaccacgtcgtgggggaccacggctccgtctcgctgtacggggcgatgaccggggtcccggtcctcatgggcaacgtccccgacggcgacctggaccccggctcgcccgccgccgaactcgcctccttcgccccgcggttgcacgccgaccgtcccctggaccgccagctcgcacgcgccgccgctgcctaccgggcggagcggtacgagcaggtgacggcccggatcacctcggagccgggccggttcgccgtcaggatgcgggccctgatctaccgcaagctccggctgcgcgcccccgccgtccggccgcggaccgaccacgcgcccctgccggtgacggtgcgccacgacgaacgggggtccgcccgatgaccgccaccgtacggctcaccgaggacgtcccgcagcgcggagtccgccggaccggagccgctctgctgcaccccgaccgcccgctgcgggtcgtcgacgagcacctgcgcgtccggctcccggccacacacccgatgccgctgctggcggacgtcctggtggcggagcatccgtccgaggcgcggtcaccgtacgaggaccccgcccggtacgccgccgaactcgccgactgccatcccggcgccctggtggtggccgtgtaccggggcccgcgctgctggctgcggctcgcggacgagcagccgtggccggcccccgagc

SEQ ID NO: 3494 - DNA, 10239 bp, Unknown
  Kingdom: Bacteria, Phylum: Actinobacteria, Class: Actinobacteria, Order: Streptomycetales, Family: Streptomycetaceae, Genus: Streptomyces
  misc_feature (10036)..(10037): n is a, c, g, or t
caactacacctccggcagcgtcgccgtgcacccgatcgcggaggacggcacactgggggagcgcaccggcctggtcacccacagctcgccgccgcccggacccggccaggacggaccgcacgcccaccagatcgtcaccgcgcccgacggcggccacgtcctcgccgtcgacctgggcaccgacaccgtctacacctaccggctcgacgcgtccgccgggacgctcaccgaggtctcccgggcggctctgacgcccggctcaggcccccgccacctggccttccaccccggcgggcgcttcgcctacctggcctgcgagctggacaacaccatggtcgtctgcgcgtacgaccccgccaccggcgccctcaccccgggggccgggcagtccaccggtacgggatccggcgtcagctaccccgcccagccggtggtcaccggggacgggacatacgtctacctcgccaaccggggccacaacagcctcacccgttacgccgtggagggcgacggggcggtcctgcggctgctggacaccgtgcccgtcggcggcgactggccccgccagctcgccctgtccccggacagttccctgctcttcgccgcgaaccagcgctcttccaccgtcaccgtgttcggggtcggccccgacggctccctcaccggcgcgggcgaccctttcccggcgccggtcgcggtctgcgtcctgccgctcccgtgagccccgcggccggggctccgcgcgcaccggagcggggccccgtccagcggttacagtcgtggccgagccgcgggagcccgcacccggggcgaggacatcatggaggcacagtgcgcttgagggtggaattcaccaccgagccgttcgatctcgacgaggcgcccacccacgccgtggtggcccgcgaggtgatccagggcgccgggctcgacgccgtcgacgtcggccccttcggcaacaccgcggaagggggcgcggacgaggtgctcaccgccgtggactccttgctgcggcgggccctggcctcgggcgccacccgggtctcgctccaggtgaacgtgatcgagggggaggcgtcatgaccgaatccgtcgatcaccctccggcagcggccgacaccctctcggcagcggccggcactcctccggcagcggctgataacccttcggcaacggtcgaccaccccctcgtgtccgcggtcaagccgcttgtcgacgcgatgggcgcggagctgctgggcccggatcaggcccagccggacgacgtcgtgctcgcctgggagggccaggacgtcatagccgtacgcctgccgcagctctccgactcgctggaccacatcctcgccgcgatggaacgacggcacgggatgccgctcgccgacctggaccgcaaggccaagcagagcgtggtccggacgctggaggcacgcggtgccttttccgtacggcacggagtggagacggtggcgagcgccctgggcgtctcccggttcaccgtgtacaactacctgaaccgggaacatgcggccaagggtgagtagttggccgaacacgccgaacgcacaggaaggccgccgtccgcatgccgggacggcggccttcttcgttcgcgagatttcaacaaagtgttgacgtcgtgttgtggagggcgttagctatccgcagcccgaacaacgcacagcgaaaaacagccacggaggctcccgtgacttcgagctccacaccgggcctcacccggttcaacaccctggcggacggcgaggccactcccgtactgcacgaggtgtgtgccagtgcgacctggggaaacaccattctcgccgggcgtccgtacgccaccgaagaagccctgctctccgcgagcgacgccgccacggcgaagctcaccgcggaggacctggccgaagcgatggcgggccacccgccgatcggccgcccgaagcccggcgacccgacctcctcccgcgaacagcgggggatggccggcgcctccgaggagctcaagaccgagatgctcgaactgaacctggcctaccaggagcggttcggacatgtcttcctgatctgcgccaccggcgccaccggtgagcagatgcgcgacgcggtgaagtcccggatcgggaactcgcccgagcaggagcaggagatcgtgcgcaccgaactgggcaagatcaaccgcatccggctgacccgtctcgtgacggagaccctcgcagaggacgctcccgcacaggactcttgagatctaggagagtgacggtcttgagtaccgacacgaccgcatcggtgtccacccacatcctggacaccagcatcggccgccccgccgcgtccgtcgccgtctcgctcgccgcccgcagcggaagcgacgcgccgtacgtgacgctcggagcatccgcgaccgatgcggacgggcgctgcaaggacctcccggcactgccggagggaacaagccatgtgcgcctcgaattcgacaccgaggcgtatttttccaagaagcaagccgaggcgcagcaggacgccccccgcgtaagggacagcggcgcgttcttcccggaggtgaccatcgcgttcgcggtcgtcccgggcgagcactatcacgtaccgctgctgctcaacccgttcggctactccgtttaccgagggagctagcaccgacatgcccacgattctcggccagaaccagtacggcaaagcagagaaccgcgtcgtcaagatcgtgcgggacggcgacacccaccacatcaaggacctgaacgtctcggtcgccctctccggcgacatggacgacgtccactactccggctccaacgccaacgtcctgccgaccgacaccaccaagaacacggtgttcgcgttcgccaaggagcacgggatcgagtccgccgagcagttcggcatccacctcgcccggcacttcgtctcctcccaggagccgatccaccgcgcccggatccggatcgaggagtacagctgggagcgcatcgcgacctccgacggcaactcccgcttcatcggcgccgacgaggtcaagcactccttcgtccgcaagggccaggagacccgcgtctcccagatcacctacgacggtgagaactgggaggtcatctcgggtctcaaggacctgacggtgatgaactcgaccaactccgagttctggggctacgtcaaggaccggtacacgacgctgaaggaggcgtacgaccgcatcctggcgacggacgtctccgcgcgctggcgctacaactggaccagcgacgagcagcggatgccgaactgggagaagtcctacgagcaggcgcgcaagcacatgctccacgccttcgccgagacgtactccctctcgctccagcagaccctgtaccagatgggttcgcgcatcatcaacagccgcagcgagatcgacgagatccggttctcgctgccgaacaaccaccacttcctggtggacctcgaaccgttcggcctcaagaacgacaacgaggtctacttcgcggctgaccgtccctacggtctgatcgaggccaccgtgctccgggacggcgtcgagccgcagatcccggtcgacatgaccaacctctgacgcggcactgaaccggcccccgtccgcccaccgacgggcgggggccggtcatcccggagggaacacccatggcacagcctgcaaccgggccagcagaaggcccatgcaccacctcaccggccaccgccgccgacaccgcggttcacccggtcgacgagaagcttcctcccgcgcggctcgtccccgccgcactccagcacatcgccgccatgtacgcgggcgtcgtcacccctccgctgatcatcggccaggccgtcggcctggacaccgccgggatgacccggctcatcgcggcgagcctcctgatcgccggactcgccaccatcctgcagaccgtcggcctcggccgcttcgccgggaaccggctccccttcgtcaacgccgcctcctccgccgggatcgcgccgatgctcgccatcgccgagaccagcgcacccggccaccaactccccgcgatctacggggcggtgctcgtcgccggagtcttctgtctggcggtcggccccttcttcggcagactgctgcgcttcttcccgccgctcgtcaccggcgtggtcatcaccctcatcggcgtcaccctcatgcccgtgccggtggcctgggcgcagggcggcgacgccaccgccgccgacttcggcgccatgaagtacctggcgctggccgccttcacgctcgtcgtcatcctgctcatccagcgcttcggccgcggctttctcaagcaagtggccctgctcatgggcatgttcgtcggcacgctggcagcgatcccgttcggactcgccgacttctccgcgctgaagtccgcaccgctcgccgccctgccgacccccttcgccttcggcgcgccggagttccagcccgccgcgatcctctcgctctgcatcgtcatgctcgtcctgatgacggagtcctccgccgggatgctcgccctcggcgagatctgcgaccgccgcaccgacggccgcaccatcacccgcggcctgcgcaccgacggcatcgcgaccctcctcggcccggtcttcggtggctttcccaccagtgcgttcgcccagaacgtcggcgtcgtctcgctgacccgcgtacgcagccggtacgtcgtcgcggccgccgggggagcgctcctgatcctcggcgccttcccggtgctgggcgcggtcgtgtcgctcgtcccgatgcccgttctcggcggcgccggcatcgtcctcttcggctccatcgcggtcagcggcatccgtacgctctccgaggcgggcctggacgacagctccaacatcatcctggtcgccgtcgcgctcggcgcgggcatcatcccgctcgccgcgcccaccttctacgccggattcccggcctgggcgcagaccgtcctcggctccgggatcagcgcgggagcactggtcgcggtcgtgctcaatctgttcttccaccatctcggcacccacagccgcaccgctgtggcactcaaatcctcctagggtcctgccgtgcccacatcgccgatgagagaagaaggaagcaccatggcagcttcggcagaccctcagcgcatcatcatcgagaactgttcgatcgccaccgtcgacgcccacgacacggagtacgcgtccgggtacatcgtggtggcggacaaccgcatcgagtccatcggcgccggcaaggcgccggagggcctgaccggagtcgtccgacgcatcgacgccaccgggcacctcgcgacacccggcctggtcaacacccaccaccacttctaccagtggatcacccggggcctggccaccgaccacaacctcttcaactggctggtcgcgctctacccgacctgggcgcgcatcgacgagccgatggcccgtgccgccgcgcagggttcgctcgccatgatggcccgcggcggcgtcaccacggccatggaccaccactacgtctacccccggggctccggagacctctccagcgcgatcatcggcgccgcccgcgacatgggcgtacggttcaccctcgcccggggctccatggaccgcagcgagaaggacggcggcctgcctccggacttcgccgtcgagaccctggagggcgcgctcgccgccaccgaggccaccatcgaagcccaccacgacgcctccttcgacgccatgacccaggtcgccgtcgcgccctgctcgccgttctcggtctccaccgaactgatgcgtcagggtgccgagttggcccgtcgcaagggcgtacggctgcacacccacggctcggagacggtcgaggaggagcagttctgcaaggaactgttcgggatgggcccgaccgagtacttcgagtcgaccggctggctcggcgacgacgtgtggatggctcactgcgtccacatgaacgactccgacatcgccgccttcgcccgtacgggaaccggcgtcgcccactgcccgtcctccaacgcccgcctcgccgcgggcatcgcccgggtccccgacatgctcgccgccggcgtcccggtcggcctcggcgtggacggcaccgcctccaacgagtccggcgaactgcacaccgagctgcgcaacgccctgctcatcaaccgcctcggcacccaccgcgaggccgccctgaacgcccgtcaggccctgcgcctcgggaccttcggcggagcccaagtgctgggccgcgccgaccagatcggctccctggaggccggcaagctcgccgacctcgtcctgtggaagctggacaccctggcccactcctcgatcgccgacccggtgaccgcgctcatcttcggtgcggccgccccggtgaccctctccctcgtcgacggcaagccggtcgtcgagggcaaccacctcaccacggtggacgaggacgccatcgcccgcgtcacccgcgacgaggcccgtcgcctcgcgcagatcgccgccggagcctgactccgagcggcaccccgtcggagtccgactccgcgcggtaaccccgaccggccggtcgagggggacggcccgagaccggccgccgtggacccgagcggggcccacggcagccggtccggcgggcgcgcgcatggtgcgcgcccgccggaccggtgatgaacgctgcccgcacacaccccagtgcgagcccacccgcacccccctctgcacgacctgcacgacctgcaccacctgcaccacctgagagagccgcaccgccgcacccttacgcaccacctccctgaaccccacgtcgccgacgacgtgtaaccgaccggaggaaccgccgtggccgccaagcccaggtttcgcaaagacgcagatgcagccgcccccgacacgacggccgatatcgccgcagatgcgggagacgaccggaaacacccggtcgacgagaccctccccccactgaagatgttcaccagcggcctccagcacgtggccgccatgtacgcgggcgtggtggccccgccgctcatcgtggggccggccgtcggcctcaccgccaaggagaccgccttcctgatgggggcgagtctgttcaccgcggggatcgccaccctgctccagaccatcggcttctggaaggtcggcgcccggctgcccttcgtcaacggcgtctcgttcgccggggtcgctccgatgatcgcgataggcaaggaccgcggacacgacgggatagccgtcatattcggggcgatcatcgtcgcgagcatcctcggcttcgtcctcgccccgtacttctgcaaactggtccgcttcttcccgcccgtcgtcaccggcaccgtgatcaccctgatcggggtctcgctcctcccggtcgccttcaactggtcgcagggcggcaacgccacggccgacgactacggttcgatgaccaacatcgcgatggccgccgtgaccctggtcatcgtgctcgccctgcgcaaactcctgcgcggcttcctccagcagatcgccattttgctcggcctggtcatcggcacgctcatcgccatcccggccggcatcaccgacttcggcgccatcaaggaagccgacgtggtcggcttcccgacgccgttcgccttcggcaccccgcagttcgagatcgccgccatcatctcgatgtgcatcgtgatgctggtctgcatgaccgagtccaccgcggacatgctggccctcggcaagatcgtcggccgtccggccgacgagaagatcatcgagggcggcctgcgcgccgacaccctcggcagcgccatcagcccgctcttcaacgggttcatgtgcagcgccttcgcccagaacgtcggcctcgtcgccatgacgaagatccgcagccgcttcgtcgtcgcggtgggcggggcgatcctgatcgtcctcggcctcgtcccggtcgccgcctcggtcatcgccctcgtaccgctgccggtgctcggcggcgcgggcatcgtgctgttcggaacggtcgcggccagcggcatccagaccctggccaccgccgccctggagaagggcgagaacgccctgatcgtggcggcggccgtcggcatcggcctgatcccgatcgccgcgccgcagttctaccacgccttccccgaggacctgctggtcgtcctcgactcgggcatctccaccggctgtgtggtggcgatcgtgctgaacctcgccttcaaccacttcggccgcaagcccgaaacggcggacggggaaccggcgccgggcgagcacgtggtgccggccgccgccggggtcggggtccactgacgtcggatgccaccgacgtcggaatccaccaacttcggattccactggcgtcggaagccgccgaccctgtccgccgccacggcccggtgaagccccgtgagggctccgccgggcacgcggcgtgcctcagcccttctcgatccggtagacgtccccgtacaccttccaccgcaacggtgtctccagccggagcttcccctcacgtacgaagacccgctgggcggtctccacccggctggtgtccctgtgcgcgggctccctgaccatcactgcgacccgcgcgtcgaggaacgcgttcagatacgccttctcgtccccgccccgcgcgggcgtccgggccgccgccagcgcctcgcggcgcatcgtccggaacccggccgtgccctctgtgtcgcccgcgccgtgcatcacgtacgcgtcgtagtagatgaactggccgagcgcgccgagcccgtcctcctccgcctgccgcaccgccgggccgaagtacacggcgtcgcgctccgcgtcctgcgcggcccggaaggcggggtcctccgccgccttcgcccaggcccgggtgaacggcttcccgagcccggtgtgcgcgtcgctgccctccaccgcgcgcagcgccggaaggaatcgctccagcggattgccggggcgcgccttcgcgtaccgctccacgacctccgtcatgtcaccggtgccggaacagaacccgatgatgcccgccgtgtacccccggccgtcgccgatgtcctcgatgtacgggtactgcgcctcccagtccagcgaggagttctccgcgctggagaccagccgcatcgcgatccgcttcttcgccgggtcgttcagccccacgtccggggttccgggcggggggccggagcagccggacagggcggcggccatgaggagcgtggcggcgaggggcaggcgcagggcccggacggtgtgcttcacccgcccagcctgccaggccgggcccctggagccggccggcgccggtcggctgtagcgtcaggggcatggaagatcagtctgttgtggatgtcggcgatgtgcgcctcgcgtaccggacctggggtgacgcgttcggctcgcccgtcgtgctgctgcacggcctcggcggttcggccgcgaactgggaggcggccggctccctgctgggccaggagtggcgggtcttcgccctggacctgcgcggccacggcgagagcgactggcccgacgactacgacctggacctgatggtcgaggacgtcgtgggcttcctcgacgaactggaactggaccgggtcggcctcgtcggccacggcatgggcggcgtcgtcgcccggctggtggcccaggagcactccgaccgcgtggagcggctggtgctggtggagaccccggccccgttccccggcgacccgggcccggcgggccgggccgagggcccggtggactacgacgagaacgcggtgcccgccgtacgcgaccagctcgccgaccccggaccggacgccgacgaggctctcggcgacatcgtctccccgacgctgatcatcaccggcggcccggagagcacgatggaacagcatcgccaggccgacgtggcctccctgatcccggactgccggctgatcacggtcccggggggccaccggatgcacgagacccgggcggaccaggtggccgcgcacatcacggagttcttcaccagctgaggcgctttcgtcacggagttcgtcaccggccgggggctgccgccacggagttcgtcaccggccgnngtcccgttccgcgacgagctgttcctcgccgagctggacgcccagccctgggcgtcgtacacccacgcctacggcagtgccgaggacgttcccggctgcctgcgcgcactcgccggggacgacgacgcggcggcggaggaggcgcagagcgagctgtacggcagcatcctgcaccagggctcggtgtacgaagcctccgcga

SEQ ID NO: 3495 - DNA, 1476 bp, Unknown
  Kingdom: Bacteria, Phylum: Actinobacteria, Class: Actinobacteria, Order: Streptomycetales, Family: Streptomycetaceae, Genus: Streptomyces
actccgccggccggcggagtgcgggcgtggctgccgcgccagccggtgtcgaagacccggggcaggtcgtcctccgggatgccgccgcagccgtcggtcaccgacagcacgacgccgccgtcggagcggtgtgccgcgacggccacggtgccgtcgggcggggtgcggcggatggcgttgatcagcagattgcccaggacccggctcatctccttgccgtcgacctccaccggcacctcgtcgatccggtcgccgaccagccgcaccccgtgctcacgggccagcggatcgaccccggccagcgcgtcgccgaccaggtcgtagagggagatccgggccggcgtcagggtgagcgaacccgcctggatccgggagagttcgaagaggtcgccgaccatgccgttcatccgctcgacctcggtccttatctgccgcagatagcgccccgagtcggcggccatgccgtcctccagcgcctcggccatcgcccgcagcccggcgagcggggtgcgcagatcgtgcgagatccacgcgacgagttcgcgccgggaagcctccagagcgcgttcccgctcccgcgagctgtccagcttggcactggtggccgccagttcgcgggcgagttcggccagctcggcggtgggctgtccggcgggcacggcgaaggtgccgccgtcaccgaacgacctcgtggccagggtcagttcacggctgtgggcggccacccaacggcccagcaggacggcggtggccagggagaccagggcggccatggcgacgacggtcgtgacgacgtagagatcgtgggacgagaggaacatcgcccaggcgaccgtcagcgtccccgcgagcatcgccgtgacggcgaccccggcgacgacgctcaacgagaccaccagggaacggtgccgcaggaggcgcaggacgcccgcgccgaggagcccggcggccgccgctcccagaaaggcgaagagtgcgatgagcaggacgtcgttcaccgcgaacggctcccggtcggcggcacgacgggcaccgcggggtcggttccggcgcggcccgggtgcgaacccgtaccggccgggcccacccccgtaccggccggggccgctccggcgtggcggtcccccgtcccggtcccggcccggtcggcgtccgccggtgtgcccgggccctcctcgtccaggtccaggcggtaccccacgccccacaccgtgcggatcagccgggggcgggccggatccgtctcgaccttgccgcggagtctgcggatgtggacggtgaccgtcgagaggtcgccgaagtcccatccccagacctcccgcatcagctcctcccgcccgaacgccttcccggggttccggaggaagaaggcgaggaggtcgaactcccgcagcgtcagggccagtccgcgaccgtcgcggcaggcctgtcgggccgccgggtcgagactgagcccgcccccggacagcgggccgg

SEQ ID NO: 3496 - DNA, 1442 bp, Unknown
  Kingdom: Bacteria, Phylum: Actinobacteria, Class: Actinobacteria, Order: Streptomycetales, Family: Streptomycetaceae, Genus: Streptomyces
tcggcggcctcgccgaccacctcgacgccggtctcctcggtgcggccgatctcggcctgcaccccggtgcggaacatccggtggtcgtcgacgagcacgacccgtacccgccgctccgggcccccggtggcttcggtgttctcggtcattcgctcgccctttccatctccagctcgacctcggtgcccccgccgggcaccgaacgcagccgggcgctgccgccgttgcgctgcatccggccgatgattgattctcgtacgcccatccggtccccgggaacctcgtcgaggtcgaatcccggaccccggtcccgtacggacacgaagaccgtgcggccctcgacctccgcgaagacctggacggcgccgccctcgccaccgtacttggcggcgttcaccatcgcctcgcgcgcggcctgcatctgtgcggtcagcctgtcgtcgagggggcagtcgccgaccacgacgacctccagcggcacaccgtgcttgtcctcgacctcggctgcggcccgtttgaccgcctccgccagggtctccggctcgtcgtcctcgtccttgccggtgccctcggggttgtagagccagttgcgcagttcccgctcctgggcgcgggcgaggcgtctgacctcgccgccgtcatcggcgttgcgctggatcagggtgagggtgtgcagcacggagtcgtgcacgtgggcggcgacctcggcccgttcctgggcgcggatgcgcatcaggcgctcctcggagaggtcctgggtcatccgcaccaggtaggggccggcgagcagggcgatgccggtgagtacggcgatggccgcggtgagcacgttgccgagctgggcggccgagccgcgcaccaccatgaacacggcgaggccgaggccgacgagggccactccggcgaggccacgggccaggtgcagcagcttgcggttgcggccggtctccatccagcgggcgcgacgggcgttgtccgcctgccgccagaccaggacggagcccgcgccgatcaggagggtgggccagatgtagcggtcggcctcgctgcccatgtcgacgttgacgacgaacgcgacggccccgacggtcagggcgaccagcgcgaagacctggcccttgtccggcttacggagcttgcggcggccgtccaccgacgtctcgaacaccgagcgcggggcgtcgacgccgccgacgccgagcggcacgacgatccagaacaccgcgtagagcaccgcgccgaggccgtcggtgaagaacagtccgaggaagaggaaccgcacccaggcgacgggaagcccgagatgtccggcgagcccgcgcgcgacgccgccgagcagccggccgtcggcgctgcggtagagcttgcgcggcgcgggctcctccgggtcggcggcgagggagctggcggctcgggcggtggcggctcgggcggtggcggct

SEQ ID NO: 3497 - DNA, 5551 bp, Unknown
  Kingdom: Bacteria, Phylum: Actinobacteria, Class: Actinobacteria, Order: Streptomycetales, Family: Streptomycetaceae, Genus: Streptomyces
ggaccgtgcggggcggcgcggcgcccgcccggtccggcggcacgggcgggaccgcccgtaccgcgtccgaggacggcgccgcgccgccccgcacggtccaggtgtacaacgcggagcgggactgccggggacgggccgaccgggacccgcggtgcagtctgggtctggcgatcgatcccgtgcggccctgcaccgcggagaacgtcgtgccgaccagggtgtggcacggggacgtcctcggcgccgactgccaggtgcgcgacggggagaccgtcatcgacgaggaggaccgccggtccacccgttggttccgcgtccgtcttccctccggcggggagccccgtacggcgtggctccccgccgtacgggccgaggaacgcccggcgctgccggagtgctcataggccgtactcgcagacgccggggccgtacccggtggccgtccacccgcttgcgaccctggggaccgcacggcacgggttgcaccttccgtagcggtatgtggtccggtgtactcacgtcccgtcccaccgaggaaggcccctgctcatgtattcgtccttcaccccgccgcgccaggtccggatcggtgacgcggcggccttcgtcggcaccacaccgcgggcgatccgtcactaccacgagatcggactgctccccgagcccgtgcggggcggcgacgaccgccgccgctacggctacgaggacatggtccggctgctgtggatccgcaggacggccgatgccgggatcgccctggacgacatccgtgacgccttcgccgacccggcttccgccggtgccgacagcgacgacggcatcgcgagcatcctggagcggctggaggaaacccttctcgcccgggaaggggaactgcggcggcaacggaccgccgtgcagcgcatgcgcaccgagggcagcaggatgggtctgctctccgacttcgtcaccaaccgcctcaagagcctgcccgagggctccctgcgccgggaggacctggacagcctcctggtcaccgagcggatcttcggcccgctcggggctgccgtccaggccacccgcttcatcgccctggcgacgcacccggatctgcggaaggactccgaccgtgtcgatgccgccgaggaggcactcgatgacacggtcgccgtcgacgacccccgcgtggcccgggtggctgccgaacggcacgccttcgaacgggcgctgcgagccgtcatcgaggactccggcctggcggcgggcgaggacgcgctcttcgactcctgggacacctttcaccccgctgccgccgaggagggtgcgggtaacgacgagaccggccgggggcacgaggtcatgagcgtgttcgaagccatcggcaagatgccctacgacttctccccggcccgcctgcgctgcatggaactggccgaagagctcgccgcccgcgacgtctgacgacagcacccggctcacccggggcggtcggctttcggcacatagtgctggggacgtccgcgccgctcctcgggcggcaggttccgggcaggtgtctccaccggacccgacgccgggcggccccgctcgcggtcccagccggcgcgggcgcgcgggtggaagcggcgtcgttcgggaacgcgccgccaggcgtggtgcaccagccggcccaggcggccgagcagccattcgtcccgggtcgtccagcgaagcccgaggcgttcacgcacggccggcggatacatgcccaccgtgatccacagggtcagccggaccatcgggatacgggcgagggcccacagcggcgacggcagcagccgcagaaggggcggcttggcgatgcggcgcatgttcagcacgtcccgtgtcggccggttgtcctccaggacgtcggcgcacatgtggtcccagtaccgctggaagtcctcccaggtccgggggacgggcttcatcgagagtccgtacagcgcgtaccagcggacgtgctcgtcgaagagcgtgtgccgctgcgcttcggtgaggccgccgccgaaccgctcggccacctgcacggtcagcatgaagaacgtggcgtgcgcccagtagaacgtgcccgggttgagcgcgtggtacgggcggccgtgctcgtcgatcccgctgatcgaggcgtggtagccgcgcacctcacgagctgtccggacggcgagcgggccgtcgtagaccactccccctatcgggtacagcgagcggaagagacgctcccagcgctcctcgaagaagcgcgagtgctcggcgacgcccgcgcccagctcggggtgcatgttctgcatcgatccggcccagggggccaggaggagccctctccagtcaccgaaccagcgccaggtgagggagtcggggccgagaggttcgggtctcgggtcggtcgggtccggtccggggactgacggtgtcacgtgtacctccgctgagggattccggtgcggggacgcgctgttcatggcgttcttcgtggcgctgcccgtgacggtgcgccgatgggttcgtccgggcagttgcgtcgagggcaatctgaggacacctgtcctcaggttaaaatgtgcggacacctgtcgtcaattgctcaaccgaaagtggaggcaccggagttggcggaacggagctggggcgggaccaagctcgccgatcgtcgcgccgcccgccggcagatcctcctggacgtcgccgagcggctggccggcgaggagggatgcgcggccgtcacggtccggtccgtctgcagggaggcgcgcctgacggaccgctacttctacgagagcttcaccggccgcgacgacctgctcctcgccgccttcgagcgggtcgccgacgaggccaggagcgccctggaggatgccgtggcgctcagcgacccgcagcgcgacgtccgggcccgggccgccgtgtccgccttcgtcgccctggtcctggacgcgccgcacaaaggccgcctgctgctcctggaacccttcgccgacccggccctcggggctcacagccaccggctcatgccggtcttcaccgacctcgtcggcggccagctctccgggacgggggacgacatcgaccgccgcatggccgcgcacgccctggtcggcggcctcgcgaacctcttcgcggggtggctgcacggcacactcgacgtgccgcgcgagcggctggagtcgcactgcgtggaactggtgctcgcggcgacgacgcgggagtagccgcccagcgcggcgagcggcgcgaacgcgtcgccgccacgcgaaacgaacacggcggaagatttatcaacgaccttctcaaacagtttcccgctcactacggttggggacccatgagtccccccgtcgcccccgtgggctggagtcgctggctggtgccgcccgccgctctctcgatccatctctccatcggccaggcctacgcctggtccgtgttcaaaccaccgctggaggacgcgctcggcctgagcggcacgcagagcgcgctgcccttccagctcggcatcgtgatgctcgggctctccgccgccttcggcggcactctcgtggagcgccgcggcccccgatgggccatgaccgtcgcccttgtctgtttctcctccggcttcctgctctccgcactcggcgccgcgacccagcagttctggctgatcgtcctcgggtacggcttcgtcggcggcatcggcctcggcatcggctacatctcgcccgtctctacgctcatcaagtggttccccgaccgtcccggcatggccaccggcatcgccatcatggggttcggcggcggcgcgctgatcgcctcgccctggtcggcgcagatgctggagtccttcggcggcgacaactccggcatcgcgctcgccttcctcgtccacggactggcctatgccgtcttcatgctgctcggcgtggtgctggtacgggtgccgcgcccgcgcaccgaggagcgggcggacggacggtccgcgacgccggacggaccgcaggtgtcggcgcgccaggctctgcgcaccccgcagttctggctgctgtgggtcgtgctctgcatgaacgtcaccgcgggcatcggcatcctggagaaggccgcgccgatgatcacggacttcttcgcggacacctccaccccggtgtcggtgaccgcctccgccggattcgtcgccctgctgtcggcggccaacatggccggacgcatcggctggtcctccgcctccgacctgatcgggcgcaagaacatctatcgcgtctacctcggcgcgggcacgctcgtgtacgcgctcatcgccctggtgggaagctcctccaagcctctgttcgtactgtgcgcgctggtcatcctctccttctacggcggcggcttcgccacgattcccgcctacctcaaggatctgttcgggacctatcaggtcggcgcgatccacggacgactgctcaccgcctggtccaccgccggtgtcctggggccgctgatcgtgaactggatcgccgaccgccaggaggaggcggggaagcacggcgcggatctgtacgggacgtccctcctcatcatgatggccctgctcgccgtcggcttcgtggccaatgaactggtccgtccggtccacccgtcccaccacctcgacaccgtgccggcgaagaagggagcgtcccgtgcacgacgacagcgggcagagtccgcctgaggtgagggaccggcggccgctgatcgtcctcacctggctgtgggtgggcgctccgctcgcctacggactgtacgaactgatccgcaaggccacccagttgttcaccggctgaccccggacggccctggcccccgtgcatcgcgaggcccgggtccggacggttcgcggtggtggcgggtgggaacgggccggtcaggcggttcccgctccggtcagcctgttcccgctccggccgccgccagccacgcgtccgcgaggacgcggtggccgagcgggctcgggtggacgccgtccggggcgagggccgcggccccgtgctcctcggcggcgtggcgcatggcgaggtcggtgcggaccaccgtcgcaccgtgggcctcggcggcgcgcagaacggcgtcggtgcgcgggacgaggtcgtcgaaccactcccgctgcccgggggtggcgggcagcaggaacggcgtcatgacgaacaggcgtggggcgcacgcttcccgcgcgcgggcgaggacgcggccgtatgcggcctcgaactccggcacggggctgggcagtccgctgtcgtagcggcgccacgtgtcgttgatgccgatcaggacggtgagcgccgagggcgccgccccgacggcgtcggcggtccagcgggcctccaggtcacggaggcggttgccgtcgagacccctgttgagcaccgtcacgggggcccggcccggtggtgtcgaggagcggagagcctccgcgatcatccggacgtatccgccaccgagcgaggaggggtcctcgcggtcgcgtccggtgtcggtgacggagtcgccgatgaagagcagtcggtcgtcctgagtgaaccgcacgtgtgtgtcctttgtccgtccggggccccggacg

SEQ ID NO: 3498 - DNA, 1267 bp, Unknown
  Kingdom: Bacteria, Phylum: Actinobacteria, Class: Actinobacteria, Order: Streptomycetales, Family: Streptomycetaceae, Genus: Streptomyces
cgagccgcggctcgtacgccacctcgcagacctccgtctcctcgctctccgtgaccgggttcggcggcggcaccatccactacccgacgtccaccgccgacggcaccttcggcgcggtcgtcatctcgcccggcttcaccgcctacgagtcctccatcgcctggctcggcccgcgtctggcctcccagggcttcgtggtcttcaccatcgacaccaacaccacgctcgaccagcccgacagccggggccgccaactcctcgccgctctggactacctgacccagcgcagctcggtgcggacccgggtcgacgcctcccggctcggggtgatgggacactcgatgggcggcggcggcagcctggaggccgccaagagccgcacctcgctgaaggcggcgatcccgctgaccggctggaacaccgacaagacctggcccgaactgcgcacacccaccctcgtggtgggtgcggacggcgactcggtcgcccccgtcgccacgcactccgagccgttctacgagtcgctgcccggctccctggacaaggcgtacctggagctgcgcggcgcctctcacttcacgccgaacagctccaacacgacgatcgcgaagtacagcatttcctggctgaagcgattcatcgacaacgacacccgctacgagcagttcctctgcccgctcccgcagccgagcctgaccatcgcggagtaccgggggaactgcccgcacaccgcgtagtcccggcgctgctcgacgagacgtccccgggccctgccgcactgtgctccggcacagcgcggcagggctccggctgggagcacgcaccgcaccgggccgtccccgtccgggacccggacgcggcgcttccaccctcgccgacgcgaacgtacggtgccggtgtgaccccatcgacgaccgtgcgcagtccgctccggctgtacggccgggacgctgaactcgccactctggaaagcctgttggcgcatctgaggcagggcgacggaggcgcgctcgtgctggtcgcgccacccggcctcggccgtacggcgctgctgcgcgccgccgccgacgcacaccgcggccggggtgccgtgctgtacgccaccgccacccccgcgatgcgcgccgtgccctgcggcgggctgcacgccctgctcggctcggcccacgcctccggcccttcgcccggtgccccgccgcccgtcatcgcccccgacgcactggccgcccggctgcgggaactcggcgccgggcggcccctgctggtc

SEQ ID NO: 3499 - DNA, 2878 bp, Unknown
  Kingdom: Bacteria, Phylum: Actinobacteria, Class: Actinobacteria, Order: Streptomycetales, Family: Streptomycetaceae, Genus: Streptomyces
atggtcttccaggacccctacctctcgctcgacccccggctcacgtcccgccgctgcctgaccacggcgctgcggctgcacggccggccggcggacctggccgacggcctgctggaccgggtgggcctcggcgcgcgcgaggcccaggccctgccgcacggactctccggcggacagcggcagcgcctggccatcgcccgtgcgctcgccgtcgacccgaaggtgctggtcctggacgaggcggtggcggcgctcgacgtgtcgatccaggcccagatcctgcacctgctcgacgggatccgccgggacaccggggtggcgctggtcttcgtcagccacgacctggcggtggtgcagcacatcaccgacgacgtcgtcgtgatgcgacggggaacagccgtcgaacagggaccgaccgccgaggtgctcgccgacccccgcgacccctacacccggctgctgctggcctcggtgccgcgcgccggctgggacccggccgacgcggtcgccgcccggtccgccgtggcctgacggatccggtcgtacacaggcaggagccccgctcctccgccgaagcgggggagcggggctccttgggtactgctgtgaacggccgcgatcgaccgacccgggcaactaggccggggtgacgttctcagcctgcggacccttgggtccctgagtgacgtcgaagttcacgacctggttctcctcgagggagcggaacccggacgcgttgatcgcggagtagtgaacgaagacatccgggccgccgccgtcctgggcgatgaagccgaagcccttttcagcgttgaaccacttgacggttccggtagccataagccctccttgggccaaagggttgccctgctccagaacctgcaaacaagtctgaaaactacaaaagcctgcggttacatgctccgcaggctctgtactgcaagggaaaccaaactgcaacttgcgggcgagcctagcacgcggtctccggcgagcggtagagggaaagatcacttcacccgaatgtttgacagcccgccgggcgagcgtcggaagagccgcgcgggggtgtcgcggagtgccttcccgagggggtgcggaccggggtgcgggcacggcgcgggagggggtgtgggccagggtgcgcgggcccccggtgatgctcgcgggaggatgcgggtctagcctcgcgatgtggacaattcaaccgtctccccccgtgaaggcgacgacgaccgtcgcagccggccccgcgtcggacacatccagttcctgaactgcctcccgctgtactggggcctggcgcggacgggaaccctgctcgacctggagctctccaaggacaccccggagcggctcagcgagcagctgatcaagggggagctggacatcggtccggtcaccctcgtggagtacctgcgcaacgccgacgacctggtggccttccccgacatcgcggtcggctgcgacgggcccgtcatgtcctgcgtgatcgtctcccagctcccgctggagcagctcgaccgggcccgggtggccctcgggtcgacctcccgcacctccgtacggctggcgcagctgctgctggccgagcgctacggcgtccggcccgactactacacctgcccgcccgacctgggcctgatgatgcaggaggcggacgccgccgtgctgatcggcgacgccgcgctgcgcgccaacctgcacgacgccccccggctcgggctccaggtccacgacctgggccagatgtggaaggagtggacggggctgccgttcgtcttcgccgtctgggcggcccgcaaggacttcctcgccgcgcaccccgaacagacggcccaggtccacgaggcgttcctggcctcccgggacctctccctggaggaggtcaccaaggtcgcggagcaggcggcccgctgggaggccttcgacgcggaggtgctggagcagtacttcacgacgctcgacttccgcttcggtccggaccagctggccggcgtccgcgagttcgcccgccgcacgggccgggacaccggctacccggccgacgtccacgtggaactgctcggcggctgagcggctgaatggccgggcggccgaatggccgggcggttgaaccggggaatggggggaattccctatccgtccccggacagggctgcggataggactgatggacggggtcgccggacagggaatgggagaggcggcggaacaacacattcgcgcctttccccggggcgaaaagatcccctcctgaccggagaagggggaatggtccagccgtttcccggtgaccgcgccgttggcgccccctaggcttcgctccgggtccggaccgtccacagggtttaccgtccacgggtccaccgtccgcagggttcacagggggagtccatatgcagccgctggaagcgggcgaaccgcacaccatcggtgcctaccggctgctcggcaggctcggcgcgggcggtatgggccgggtctatctcggccgcagcgcgggcgggcgcacggtcgcggtcaaggtcgtccacccccacttcgccctcgacgagcagttccgcgcccggttccggcgcgaggtggagtccgcccggcgcatcggtgcccagtggaccgccccggtcctggacgccgacccggacgcaccggtgccgtgggtggccaccgggtacgtcgccgggccgccgctctcgcaggcgatcaccgagcacggccccctgcccgagcacgcggtacgcaccctgggcgcggggctcgccgaggccctcgccgtcgtccacgggcagggcatcgtccaccgcgacgtgaaaccgtccaacgtgctgctcgccctcgacggaccccgcctcatcgacttcggcatcgcacgggc

SEQ ID NO: 3500 - DNA, 3351 bp, Unknown
  Kingdom: Bacteria, Phylum: Actinobacteria, Class: Actinobacteria, Order: Streptomycetales, Family: Streptomycetaceae, Genus: Streptomyces
tcaccgaggcgggcatcggcggcgagaccgtcctcggcggaggcgagcgccgtgcgcgcccggtcgtaccgctcgatcgccggggcgaggaggcggttgtcgaagtccgggtcggtggccggacccgcgggcggacacagcagttggccctccccgtcccgggccagctcggcccggagcgcggcctcggcccccgaggagccggccggcgggtcgatccaggccagcagtgcgcccaggtgctggtcctccaggctgctctgcccggtcgcccagtgccggttcagcagatccgtgacggcgggcagcagcgaggagccgggcacccgggcacgctccccgtagtgcgtcagccagcggccgagcagcggcacccgcgccggggccggatacggggtgtccggatcgtcctcggcggtacggcggaagcgcatggaccggcccagcagccggacgaactcgacgcccgcccggctcggcacgatcaactgggcggcgtccgtgcacagctcgacctcgaccttggacttcttgccggtcgccgggtccgtctcgttgcgctcggcgggctcgacgacgtccgcgtacgcctcgatgtgcggcaggaccgcctccgccagctcggcccggcgcagccgcagcatgccgcgcagctcctccgggcccacccgttcgtccaggaccgcccccacctgctggagcgtgaagccgaggtccttgagcgcgatgatccggttgagccgggcgagctgggccgcgccatagaggcggtagccggtggcggggtcggtgcggtcgggggtcagcagtccgatggcgtcgtagtggcgcagcatccggggcgacacccgtccgtacctggcgaactctccgatggtgaacatgatggctcccactgcaccccttcacacggggtcaaggtcaagcctcgccggcgcggggtttctcggctgttccgtcagccgtgccgtttcgggtccagcagctgttcgcgcagagcggtcaactggtgcgaggagccgacggcccggtcctcgtccagggtggccagcgccagcagcagcgcgtccgccaccagcagcccggtcagcgactccgccgttatcccggtcggcgtgtgcggcgcggtgagcaccgcctcgacccggtccgcgtacgcctcgcccagctcgtccgtcaccaggacgaccttcgcgccgaccgagcgggcccgttccatcaggaccgacagctccatcagccgccgccccggctggaagatcaccaccgcgtcgccctgtccgagggccagcagctggtccgccagggcgaacccggtctccgagacggcgcgggcccggcggccgatccggccgagcgccaacgccaggtgccgcgcgcccggttcggaggcggcgaccccgtaggcgaagacctcgcgggcctcggccaggacggccaccgcccgcttcagggagtccggcccggtcagccggcgggcctggtcgatgcgctcctgggcctcgtcgaagacatcggtccagatggagtccaggtcctggcccacgtgcgcgatgcgccgcttgagccgtacctcgggcgcgacggccgaggtgaagtcgttggccagctcccgcttgagcgccggtaggcccgcgtacccgaggcgttgcagggcccgtacgacggtggcgttgctggtggagctggccgcgccgagctgctgggcgctggcgaagagcagctgctcgaccggcgcgctcaccaggtactgggccacggcccgttcagaggtggacagatcgttccattggtcacgaatggcgacgcggaggcgcgtcactccggtctcgttctctggaatttccattacaagcattgacttccgtgtgaccggcgttactgtcctgggcagaacgttccaaagggaacgcattctgaaatcgacgttacaggaccgtgccggtccgcgtccgtcggtcgccgaagcgttccgtcgcgaggagaagaatggcaccccttcccacggaacccgtccccgtcccgacggattccgcacccccgcccacggattccgccgcccggatccttcccgtcatcgagatctccggctccccgcgggagcgcggccggcagtacggcgagtccgtccgtccccaactgcacgccgccctcggctactacgaggaggcgttcggccgctccgccgggctcacctgggacgaggtcaccgcccgcgccgcccgctggctggagcccgtacgcgcctacgctccccacctcgtggaggagatgcggggcatcgccgacggcgcgggcaccggtctgctggacgtcctcgcgctcaacgcccgcggcgaggtcatctacgacaagtccttcgccgggatggccgccgccggggccggggaggagccggccgaggaggaacccgccgagggctgcacctcgttcgccgcgtacggcccggccagcggcgacggccacgtctacgccgggcagaactgggactggcgggccggggtcgccgacaccgtcgtcatgatccggatcgtccagccgcccaaacccaccctgatcatgcaggtggaggccggacagatcggccgccagggcgccaactccgccggcatcgccttcaacgccaacggcctcggcggccggttcgacgaccggatcggactgccccagaccgtcgtccggcgcaccgtcctcgaccaggacaacatcgccgacgccctcgacgtgctctgccgcacccgggcccacatcgccagcaacgccctgctcacctgccgcgagggtttcgccatcgacctggagaccacccccgccggacacggctggatgtatccggccgacggtctgctggtgcacggcaaccactaccaggcgggcatccccgtcccgctcgccgccgccggctaccgcccgatgtcctccgactccctggtccgcgtcccccgcgccgaacagggtctggccgccctgcgccactccaccggacccgaggagtcccggaagctgatccgccgggcgatgtccgaccacctcggccaccccgagtccctgtgcacccaccccgacccgcgccgcccggccgtcgagcactggaccaccctcgtctcctccctcgccgacctcaccaccggcgactaccacgtgaccgccggaaccccctgcgaccgcgagtaccagcaccttccctggaacctctacgacggcccgcacggcggcccggaaccgacaggaacccagccatgacccaccgcacgcccgacaccttctgtccgcccgccgctccccgccgctccccgcgccgtgcggtcccggtcgccggagccgtcgtcgccgccctgctcgccgccggat

SEQ ID NO: 3501 - DNA, 1959 bp, Unknown
  Kingdom: Bacteria, Phylum: Actinobacteria, Class: Actinobacteria, Order: Streptomycetales, Family: Streptomycetaceae, Genus: Streptomyces
cctccgcccgggccggccctggtcaccccaggccgcccgggtcccccgcgagcagaccaccggaccccgctcaccgcagccgcggcgggcggggtccgtgcgtcgggatgcggcggacggaccccggcgcggcccccgctccggagccgccacgcacacccaccgggtcacccaccggcacgcgtaccgggtccaccccggcttcaggcgtccggagggcccgcctccggaccaccggcaccggccccggccccggccccggcaccaccctgacgctcgtccccgtccccacgctcctccccgtccgcgctcccgccctcggtgccggagccctctcgctcgaccggcccggagaggtgctgaggagactcgaagcggcgaaaggacacatcgatgtgcgccagcctccgcagcgcgccgaacatcgcctcgccgaggacggtcccgacgacgacgctctcgaccaggtcctctcgggccacccgccgctgtacgtagtcgaggtcggcgcgggcgaccggctcggcggcatccgcgtagaggtccagcaggtcgatgtatccgccgtggccggccctgcgcagcgcggacagcactcccgccagcgactcggcggcggaactctccgcgtcgacctgccagcctcgccgcagcaggagttcggccacctcctcgcgcgcctcctccagttcgggccccgactcctcctcgccggtcggcgtgacgccgtccgccgcgacgccgagcaccttgtgcaccggctgttcgggatcgtccatggcctccaggacctcgccgatggcggcgagcgacaggccgccgacgtccagcaacgcccggatcaggcgcagtctgcgctcgtgtccagggctgtaacgcgcctggttcgggctggtcaattcccctgcggacagcagaccttcacgtaggtagtacttgatcgtcggcaccggcaccccggacctgcgactcaattcaccgatgcgcaccgcgtgttcgccctttcacccttgccagaaaccgcacccatcatagatagtccccctatcggatagcggacagcgcagctatccatactgatcacatcatcactgctcgcatcgtcacagggggtctcccatgtcgtcatggcgttcctggcatcgctcgttagtcgtcttctccgccgcgatggccattctggccctcgtttccgccgtgggcctcctggtggacgaccgggtcctggtgggtgcgccgatctgggcgaagccgttcaagttcgccgtgtccttcgccgcgtactgcctgaccctggcctggatgctgacccacctcacccggggggtgcggaccggccggtgggcgggacacctcgtcgtgctgacgagcctggccgagatggtgatgatcaccgtccaggtggtccgggggaaacgcagccacttcaacaccgcgacccccttcgactcggcgctgtggaacgcgatggggatgaccatcatcgcgctgtgggcggccaccctggtgatagccgtcctgctgctgcgcacccgtatcgccgaccgggcgacagccctggccgtccggggcggggtgctgatcgccctggccggcgcggccctcggtttcctgatgacgctgccgagcgagagccagcgggcggcggggaacctggacaccgccgacatcatcggcgcgcactccgtgggcgtaatggacggcggcccggccatgccgctgaccggctggtcgacgaccggcggcgatctgcgggccccgcacttcgtgggcatgcacgccctccaactgctgccgctcctcctgatcgcactggtgctcctcgcgccccgcttcacccggctgcgcgagggcggggtacggctgcgtctcgtgcgggtcgccgtgggcggctacgcggcgctcgtcgcgctcatcacctggcaggcgctccggggccagcccctgatccacccggac

SEQ ID NO: 3502 - DNA, 3083 bp, Unknown
  Kingdom: Bacteria, Phylum: Actinobacteria, Class: Actinobacteria, Order: Streptomycetales, Family: Streptomycetaceae, Genus: Streptomyces
cccgtacgggtgcgggcgtcctcgtaccgcgcccagtagacctccttgcggcgcgcgtccgtcgccacggcgaacggcccttccaggccgtccaggccggcggcgtacgcgaggccgtccagggtgcacaggccgtggaccggcacggagaggacggagccgaaggtggcggcggtgaccaggccgacccgcagaccggtgtaggggccgggaccgacgcccacgaccacgtccgtcacggcgtcgagcttcgtcccggcctcggcgaggacccggtcgacggcggggagcagcagctccccgtgcctgcgggcgtcgacctgtccggaggaggcgatgacggacgtgccgtcgtgcagggcgacggtgacggcgggcgtggcggtatccatggcgagcaagagcacgcaaacagcctacggctccgccgacggcgttacggcgtccgtacggcgtcccggcccgtccgctcgctgctgctaccgtcaccgggtatccgcgggtacgacgtaaacgcttgtacgacatgcggcaacggcagtcgaaaggggagttcacggtggctaggggaagctcgggaatcgtggccgggctcactgcggcggcggtcgccgcggtcgccttcctcgcttaccaggcctcggcgaacgcccccgcctcggtggcgtccacgcccggcccgaagacctccgcctcggcctcggcccagccctccgccaagccgaagcccacggccgacccgctggcggtcccggcggcgtccggcaagggagagcgcgtcgtgtacgcgttgaaggaccgccgggtgtggctggtcgacgagggcaaccaggcgatccgtaccttcaccgtgatgccgagcccggtcagcccgccgcccggggtccaccgggtcacctcgcgctcgggcacggtccaggggtcggacggcgtgccgatcgaacacgtggtccgcttcgcgaacgtggacgaggtggcgatcggtttcagcgcggcgcaggacggctcgatggccagcccggacccgacgtcgaagaccggcggcgtccggatgaagcgcgcggacggcaacgccatgtggaccttcgcgacggtcggcgcgaaggtcgtcgtcgtcccgtagggcccgagcggctcacggggccgggccgcggaacccggggtgtcctacgccgcccgccgccggacggcgctcccgtggacgctctcctcgtcccggtccgccgctccggatggatccggggtgtcgctcggcggggtggagaccgcggtggccgcggcgcacgaggccagcaggtccttcatcgacagggcggagggagtcggtcgcggctgcggtcgcgctgcgcgctcgggcgtcggcatggatgcctccttggtgctccgatggagggcgtggttaggtagacctaaccacgtctcgtacccatgtgaccacgaccacggccccccgcgcaacagtttaccgacgcactgtcgggaaggtctcgtgaagggggtggcggagtacggccggcgttacgccaggtccgcccgcagccccgcccagcgcgctccgatgccgaccagggtcacctcgcgccgctcgtcgtcggtgtcgccggtcgcgcggtcgatgaggacccgcagccggtcgtcggccagctcctcgaccttgccgtcgccccactccacgaccaccaccgactccggcagcgacacgtcgaggtccaggtcctccatctcgtcgagcccgccgcccaggcggtacgcgtcgacgtggaccagggcgggacccccggtcagcgaggggtggacgcgggcgatgacgaaggtgggcgaggtgaccgcgccgcgcacgccgaggccctcgccgagacctcgggtcagcgtcgtctttccggcgcccagctccccggtgagcatgaccaggtcgccgggggccagcacccgggcgaggcggcggcccaggtcctgcatctgttcgggggaggtgacggtgagcgtcaccgtcacggcctcgggtacggccccggcgggctccggagcggtcgtccccgctgtctccggaacggtctcagcggccgggctgctgtgcggtgcttccatgtccgccaacgttagcgcccggcaccgtgccgctgcgtacgagcaggtcggccagccggtcggtgaccgtctccgggtgttccagcatcaccaggtgcccggcgtccggcacgatcaccagctcggcgtcgggcaggacgtccgcgatggcctcgctgtgcgagctgggggtgaccaggtccttgtccccggccaggatcagcacgggcacgtcccggaacgcgggcagcgcaccgctcttgtcgtgctcggtgaaggccgggtagaactcggcgaccacatcgatcggggtggactcgatcagccgttccgcgaaccgggcgaccgccgggtccacgtcgcgcgaaccgaacgagtaccgcttgatcagcccggcgaagaggtcggccgtggcccgtcggcccttctccaccagctccgtctgcgagccgagcgccctcagcaccccgggcagcacccggcgcaccgcgttcacacccgccaccggcagcccgaagttgacctcgccgagcttgccgccggaggtgccgaccagggcgacggcggcgacccggtcgcggatcagggccgggtactggtcggccagtgccatcatcgtcatgccgcccatggagtgcccgaccagcaccagcgggccctccggggccgccgcgtcgatgaccgccttcaggtcgcggccgagctggtcgatgccgaccggcaccccgtccgcctgggcccggccgcgcccggagcggccgtggctgcgctggtcccagtagacggcgcgcacgaggccgcgcagggcggcccgctggaagtgccaggagtcctggccgaggcagtagccgtggctgaagacgacggtgaccggggcgggggccttgcgcccgaagagccggcggcggcgggggccggacgtgccgggaccctcgtcggccgccggagcgtcctccacctcgtcgatctcgtagtacagctcggtgccgtcgtcggcgacggcaccgagctgtact

SEQ ID NO: 3503 - DNA, 2958 bp, Unknown
  Kingdom: Bacteria, Phylum: Actinobacteria, Class: Actinobacteria, Order: Streptomycetales, Family: Streptomycetaceae, Genus: Streptomyces
cgtggccgccgcgctggccgccgtatgcctgaccgccgcgggatgcggcggcggtccggaagccgacggggccggtgcggcctcaccccggcccggcgcggacgccgcctcctcgacggatccgacgccggccgggaagcagccggagccgtccggaacggcttccccctccgacccgggatccgcgaagacgctgccgaaggggccgttgacgggccggaccgtggtgatcgacccgggacacaatccgcgcaaccgcgagcacacccgggagatcaacgagaaggtcgacatcggcaccggtcgcaaggagtgcgacacgaccggtacgtccaccgatgacggctacgcggaggcccggttcaccctcgacgtgtcccaccggctgcgcacgctgctggaggccgagggcgcccgggtcctgctgacgcacgacgcggaccggccgttcgggccgtgcatcgacgagcgggcccggatcgggaacgaggcggaggccgacgcggtggtctcggtgcacgccgacgggtcggccgtgggcaaccggggtttccacgtgatcctgcccgccggggtgaagggcggcggggccgacacctcgaagatcgtgaagagttcggccgatctcggcgcgaggatcgccggacacttcgtccgtacgaccggaagcgcgccttccaattacatcggcggaaataccggtctggacacgcgtaatgatctcggcggactgaatctgtcgaccgtgcccaaggtgttcgtcgaatgcggcaatatgcgtgacccgaaggacgcggacctgctcaccagcgcgagttggcggcagaaggcggcccagggactggccgacggcattgccggctacctgaaggggtagttctgcggtgatattggggggatagccgctcatgatccgggcacggacgcaacccgcccgggcagacgatagattcatccgtacgatggggagccgctcccgagcttcgagccgcaccggcggcagcgacgaccgccccgacgagacgaccgactaaggaccttcacgtgaatatccgatccctcactcgaggcgacggcgtggtgatcggagcagcggtcgtgctgttcatcgcctctttcctcgacttctccagctacgactgcccgcagggcgtcgactgctcccggttcgacagcccgaacgcctgggactcgctcggactcctgatgagcgtcttcctcgccggcgtcatcggcgcggctctgctgatcgtcagccgtacgatgccgggccgcaaggtcgccggcctcgacctcggccagttcggcgcggcgctcaccgtcttcgcgctgtggaccgccttctggacgatcctcgacgtcaatagcgccggcgcgggcctgatcctcggcctgctggccaccatcgtgctcgtcgccggtgccgtcgccggtccgatgatccccgcgctcaaggccccgctcgtcagcccggcctcccccgcgcagggcgtaggggccgggcaggccccgtacggcgcgggccccggccagggctacggcttcccggccggccagcagcagccgtacggcgcccagccgagccagggttacggctaccccggcgccccccagcagggtcagcccgcccagggcgacccggcgcaggcgcagcaggcccaggcccagcccgcgcagggcggcgcggccccggcgggagacttcaccccgttctggttcgccgttccggtggcccgcccgctgtacggcgaggacggttcgccgaacccgatcgccgagctggcgccgggcacctggtacctcgcggtggagcagcgcggccagagcctcatcgcccagacgcaggacggccgtcgtggcgtcctccaggacaccacgggcatccagcgcggctgatcccgtacgcacacaccgcggcccctcgcccttccgggcggggggccgttgtcgtacagtccaacccggtcacccttacctgacgctacgtcagttacggctggagggaacggaatgcggctcggactcgcgctcggatactggggccgcggcccggaccccggccaactcgccctggtccaggaggccgagcggctcggctacgactcggtgtggacggcggaggcctggggatcggatgccttcacaccgctgacctggatcgccgcccacacctcacggatccggctgggcaccggcatcgtccagatggcagcccgcacgcccaccgcgacggccatgcacgcgctgaccctggaccatctctccggcggccggatgctgctcggcctcggcctgtccgggccgcaggtggtggaggggtggtacggacggccgttccccaggagcccgctgaccgcgacccgcgagtacgtcgaggtgatccggcaggtgctggcacggcaggctccggtcgagctggcgggccgcttccactcccacccgtacgacggcccggacgccaccgggctcggcaagccgctgaagccgatcacgcatccgctgcgggcctcgctccccgtcctgctgggcgcggagggtccgaagaacatcgcgcagacggtggagatcgcggacggctggctgccgctgtactggtcgccgctgcgcacggacgtctacggggcctcgctcgccggacaccgggacggcttcatgatcgcgccgatggcccgcgcgcacgtctgcgacgacgtggccgaggggctgtggccggtgaaggcgatgctcggcttctacatcggcgggatggggcacgcggcgcgcaacttccacgccgacctgatggcccgtatggggttcgaggaggaggcccggcggatccaggagctgttcctccggggccgcaaggacgaggcggtacgggcggtgcccgacgcgttcgccgacgagatctccctgatcgggccgcgcgcccgcatcgcggagcggctggagctgtggcgcgcgggcccggtgacg

SEQ ID NO: 3504 - DNA, 9116 bp, Unknown
  Kingdom: Bacteria, Phylum: Actinobacteria, Class: Actinobacteria, Order: Streptomycetales, Family: Streptomycetaceae, Genus: Streptomyces
cttctcccccttctccccctgcacgtcctttcacgtcccttcgtccctgatgatccgtgtgtggggccgtcccgatggcggtcccatctgacgtgcgccccaattcttgatgtccggtcagcgcgacgactaggcatgacaggtccatggcgacatgctggagcggcctcgtaccacccgacgaggagcacggccaggaccaactcccttcacccccacggaggtcgctcatgcgtcgtcgattcacggttccgctcgccgcggtcgccctgtcgctcccgctcggcctgatcaccgccgcttccgcctcggccgcccccgccgacaaacctcaggtgctcagctcctggacccagaccagcgcctccagtcacaacgcctggaacgccgcccgcaacaaccagggcgcctggtccgcgtacggcttcgactggtcgacggactactgcagcagctcccccgacaacccgttcggcttccccttccagacctcctgcgcccgccatgacttcggttaccggaactacaaggccgccggtacgttctccgccaacaaggcccgcatcgactccgccttctacgaggacctcaagcgcgtgtgcgcccgctactcgggcgcgacgaagacctcgtgcaacggcacggcctggacctactaccaggccgtcaaagccttcggcatctcccccgccaaggcggactccggcaatctacccaaggccgcctgaccgccgggccacccacggcacccgctccacctcgcacggcgccgcacgcacaagggagaggcccccggcgtaccgggggcctctccgtgtcgccgtgacgcgggggagcgtcagccgatctcggcgccgtaggcggccagcgcctccggtaccggctggaagaaggtcgtgccgccggaggagcagtcgccgctgccgcccgaggtcagaccgagcgcggtgtcgcccgcgaagagggcgccgccgctgtcgccgggctcggcgcagaccgtcgtctggatgaggccgttgacgatatcgccgttgccgtagttgaccgtggcgtccagcgcggtgacctcaccgtcgtgcacctgcgtggtggagccgctgcgggtgaccgcctggccgaccgtcgcgtcgcccgcctgggtgatcgcctgggtcgagccgtcgtagaggttcacctcgctggggtgtgcggtgtccgaggtgtacttgaccaggccgtagtcgttctccgggaaactggatccctcgttcgccccgatctccgagccgccctgggtgtccgaccagctggtgaccgactcggtgcagtggccggcggtcaggaagtacggctcgccgcccttcaccacgttgaagccgagcgagcagcgggagccggatccccagatcgcgtcgccgcccgcgatcagcggcttgaactcgcccgccgtcttgttgagttcggtcgtaccgccgagcccctcgaccacggccgagagcttcttccaggccgcaccgtcgaccgtgctgtcggcggtgacgagcaccttgttgctcaccgggtcgaccgcccaggaggtacccgggatcgtcgccttgtcggtgagggtctgccgggccgacttcagctcggcgagggagttctccacgattctggccttgccgcccgcctggcggacccgctcggcgccggcctcgtcgacgacgttcacgacgagggccttcgccgtggtgtcgtagtacgagcctgccgcgtccgcgcccaggtcacggtccagggcggtggccagctttccggccgcgtccgcgctgagggtcttggccgcgaactccggcacatcgtcactggcgttcgcagtctggaacgtgaatcccgctgcgaccagggcgacgacggccgagccggccagcgtcgcgcgcttcctggatatgcgtcgatgcttcaacttcgacctcctgtggggccgtgcacggagcaagtggggtgcccgtacacggaggatggggaacccactattccgaggcggtgaaacgcacacaaggtcgacttccagacgtgcacacgacagcgacgcttcgcacgcgaggcgttcacctgccccgggtcgtgccacgtcggttccgattgcgaacacccggtgcaaccgttgacggcccctgggtgaggactagtcctgtcctgtattcgccttcccggtccgcatggtgtgcccacccgtccggatgccgacggaaatcgtccgacgggagcctcccagtaccttcacagttcctgtcgcccagcagtcccggtaacgcctctgatgggtcatcatcgaaagggcagcacacgccggacacaccgtgtccgggccggccgggtgaccgagcggaggaggaacgggtgcgcaatcgggtgctcgcggcggacgggcggcatctgatggtggagcggatgggcgacccgcggggaagaccggtcttcctcctccacggcactccgggcagcagactcgggcccgctccccgcggcatggtgctgtaccagcgccatacgcagctgatcacctacgaccgcccgggatacggcggcagcgaccggcacgagggccgtcggatcaaggacgtcgtcgaggacgtccgggcgatcgccgactcgttgggactggagcgattcgccgtggtgggccgctccggcggggctccgcacgccctggcctgcgcggcgctgatgccggaacggatcacccggaccgcggcactggtcagtctcgcgcccccggacgcggccggtctcgactggttcgacgggatgaccgcgtccaatgtgctcgcgtactccacggcggccgacgacccgcagagcctggcggagtccttcatcatgcgctccgcgcagatccgtcgggacccggtccggctcctggacgacctgcgccgggagctgaccgactccgaccgggtggtggtcaacgacgcggggatccggtccatgctgctgcgcaactacagcgaagggctgcgcacctcggcgtacggctggatcgacgacgccatcgcgttctgcagcccctgggggttcgatcccggccggatcaccggcaaggttctgctctggcacggagtgaaggacgtcttcgccccggtcggccactcccgctggctggccgggcagataccgggcgccaccgccgtactcgaaccgaaggcggctcacttcgacgcgttccccatgctcccccgcgtcctcgactggctgctggacgagcgggatctgccggacaggaccatgcgggccgccgtgccgggagagtgagccctcccggcacggacggtcacaccgacatcggttccagctctcgcctgaaccgctcctcggtccgggcgatccggaccagtggatggtcgtcgccgagctgacgcgacagctcggggacgatctccgcccgcaactgcaccgcctcgtcgtcccgccccactgcagcgagcgtgaccgccatgttcgaggtcatggccagggtctccgggtggtgtgccccgagcgcctcgcgcagctgcccggacagccgctgctcggtctgcagcacggtgtccagctctccccggtccgctgtcgcgctggccaggttcatcacacagaacagggtgttggggtgctcccggccgaacgtgtcccgcatggaggcgacgaccagcttcagcacccgctccgccgcttccgtctccccgacccccgtcagatagaccccgaggttgttctgcgccgccagggtgtacgggtgcctctcccccggcaccttcatgaactggtcgacgacctcctgtgccgtgtccctcgcctcggcgctctcgcccgccgcgaacaggtccgcggcgaggttgaggtcgcaggccagcgaatcggggttggcgatggtgtacttcgcccggtagcgggcacgggtcgccaccgtgagacggcgggcgtcctccagccggcccgccctgcgcaacgacaccgctaggctcttggcggcgctcagcgtggcggggaagctgcggcccatcgtctccttgaagctgttgtacgtggtgctgagcagccccaccgagtcctcgtaccgtccgacctcccgcaggtcacgggccaggttcatggcggaggacaggctgtaggggtgttccggtccgagcacctgggagcggaggtcgtagacgtcctggtcgatctcccgggcgcgggcgtactggccgacgctgcgcaggttcagggccaggttgttggcggcggccagggtccgggggtgggagtcgtggaagatctgcccgaacccctcatgggcctcggtcgccatctcgatcgcccgggcgtagtcccccagcagaccgaggtcgatggccaggctgctggtggtcatgtacgtgtgcgggtgttcgggacccagcaccgcccgctgccgttccagggtgaactcgtcgagatccttcgcctccacgtaacgcccgcgggtgcgcaggatgttggacaggtggaagcagaggtagaggtactgcaggtcccgctcccccagcttctcctcccagatctcccgcagctcgtcgcccagcgcccccgccgtcctgacgtctccgcgcttccagaggtagcggacccggtcgatcagcagcctgcgggtctccggctccttgcagttgcgggcgtcggaggggccgaggtgcggccagatcgtcgcgaagcgcggccaggtctccgggttgtcgatcggctcgtcgtcgtcgggccgggcgccggcgaggatgcggtggacgacgtgccgggcctcgcgctgctcctcctcgctgagctgcgccttgatcacggcctggacgaggcggtgcacctggatggagttggagacctggtcgaccttggcgagggcgaaccggccgatctcccggatgacccggcccagcaccagcttctcctggagcgaggagtcgtacggcttcagcgcgtcgatcatctccttgctgtagaggaggttggcggagatcggttccggggcgaagaaggcgcagagctggagcagccgcaccgctgcgggcgagcgctccttgagccgggcgatggagatgttccaggtcgcggcgaccggttccgggtagccggccggctggttgagcccgaggacctggggagcctgccggccgagctgttcgagataggcgtcgatgggagtggcggtctccgcgatccaggcggccgcctgctccacggcgagcggcaggtcgcccacggcggtcgccacctggtcggcgtcctcgtcgctgagccccggggcccggcgctggaggtgctcgatcgactcctcgcgcaggaagacgtccacgggcagcgcgtctccgtgctgggaccagctctggttgcgggaggtcaccaggatgtggccggagccgccctgcgggaagtagcggcgcagctgctcgggatcgtccgcgttgtcgaagaccagcagccagcggtccgagggcacgccgcgccgcagcaggtcgacggcctcctgggaggcggcggccatgtcgtcgccgccctgggcgccgagccggacggcgagttcggccagcgaggcgaccacgtcgtcgggctgctcggacgatatccaccacaccaggtcgtagtcggccatgaagcggtgcacgtactccagggccacctgggtctttccgacgccgccgagtccgtacagggtctgcggctgcggcaggacgacggccaggccgccgccgagctggtcgcgcatccgctccaggacgagtgagcggccggtgaaaccggggttgcggggcggcgcgttccagatcctcggcacggtgccggggaagcggggcccgggcgagaccccgtccgccacctgcaccgggcggtccagggcccgcatcacggcggtggtggcgtgcacctcgtccagccggaagaggtcgaccgggttgcggtcgatgtacggagcgctcaggcgtacgtccccgacccgcagggggaccagtcggcggcggccgctgccgacggcctcggcggcggtccgttcccacagctcgaccgcgcgctgggacttcaggtaggcgctggagagcagcaccacggtgcgggcggcgctcgaagggtcgctgtcgtccgcctcctccgggggacgttcggcggagacgtcgcgcgggaccacccggaagccggcccgggtgagaatcgattcgagccagtcggcccacatccggttctccgccacatagctgaggaagagatcggcgggcagggcgggccggcgccgggtgaaggcgtcgcggatccgcaggcgtacctcttcgccgatcggaggcatcgaggtgatctcccggtcggtgatgaccgcggtgagccgttcgaaggcggagagcagcgagttggtcagaccggcctcgtcaccgaaggtggcgagcgtctcctcgtaggcgtagtacggccggtaggggatctccaccgcaccccagtaggcggtgagttcgtcgccggacaggtcgcgcggcagccggtcgaacttgagccgggccagtgcccgtccggcgtccgccttctccttctcaccctcgtcgatgcgcatcggtacggggtagagggcgatggggcggccggtgttgcgctcggcgatctggcgggcgacggaggccgcgccgtcgatggactggtcgctgagggtgaagcagtcgacgagcacgtccgggaggtggacggtgcagatgtcggcgatgtcgctgaggccggtccggctgtcgatgaggacgtagtcgtagttggccttcatgtcgtcgcgcagcgcgtcgaagaagtggccgccgccgaaccggtcgtagaagttgtcccagtcgaaggtggagacggtcgcggagtattcgcggttctgccgtccggcggagacgaagtcgagcgtgccgccctgcgggaactcccagccgagcgactccggtgtcagcgacacggcgtgcggctggatgcgggcgtagtcgcggtgccagtcctcggcgcgctgggcggggctggtcgcggcccacgcgtactcggtgatcaggtcgatcacgccggtggtggcgccgagggtggccgggtcgaggaaggggtggaagaaccggtgcagcccgggggcctccaggtcccagtcgacggcgagcacccgcttgccgttggccgcgaggatccaggcggtgttggcgagcgccatggtgcgcccggtgccgcccttgtacgagtagaaggtgacgatgcgcccgtcacgaccggcactcataggtcctccgcttccgtcgcagggtcgtgcgggtcgggtatgtagctcgtgctgcccatgggaccggtgagccgggtccgctcgccggagccgccgccggacccgggagggtaggccttcgcgtgcttgaggtactgctgggcggccacctcgaccacctggggcaggagttggccgaacgcctccatggtgggcactcctttcgcagcggcacggcagagggcccggccctggcccatcttgatcggcatggtcgcttcgagcttctcggtgagctcgctctccgcggctctgctctggtggtcgtcacggctccagggcacgaccatggtcacccagggccggttctcggcgtcgaaggcggcgagcctgcggcggtggtcctcgtccctgagggcccagcggtcgacgagcaggatctcgggggtggtgggcggggccttgccgtcgtgccggtcctcgtcgaacgaggtgatgacggcctggtagttgagcgagcggaccagttcctccgccacataggccagggggcgggcggcggccgggtagtaggggttccagtcctgggggtgatcgccgtagtggtcgctgttgcggccctcgggcagatcgtggcgggtgggcgccgcgatggtgatctgcatcggccggggggcgccgactccgctgctgggggagccgaaggcgctgggtgcgaggcggtagtcgacggggcgcccggtgtcgatgcggaccgagtcggcgacgctgacgatgcgtttggccagttcgtagacggcccgttcgtattcctcggcgaagagtctgagcttgatcaggccgtagaggccgtcgctgacgtaccgttccccgaaatcacggtggttgaactgcaaccgctcggcggagccgggcagttggctcggtggcaccgggacccagagcgccgggacgatggcctctgcgggctggttggagcgggcgcggtggtggatggcccgctgttcgaaggcgtaccactccttgccgcacatctcgctggcgaagtagcgcggcgagaacagcgggacgaagacccggcaggtggcgaggacgtcgccgagccgttccgaccagccctctccggaacgtatctcccggtccatgaagcccgcgggcgcgcccgcgggtaagtcggtcatggccatcacatggccgcaaaggtcctggaaaagccgctcgacccacatatcggggtccgtgccgccgccgtaccccggcgtgtgggcgtaactcagaaagaaatacggccgatggcccaccgctcgctgttgcgtcgatgcgtgcacacgacccccgtcctgtgtgagcactcgcatcccagaaggaggaagggagtggaagcgaactcatcatttcggagcggaccgctttccacccccctgccgttcggtcattcgaacgtcactttctggtcagatgccaggacgttcgccgcatgaccggacgacgggaagctcctgccgcggtttttcccggccgcactccgtgttccgctgatctccttgcggacagcggagaccagctgtttaccgtcgaccgtcacctccgccgcgttttcgatcttgtcgagagcttccggaacacccgtgaggaagcgcggatcgtaaagcccgagccccgcccgttcgaatgtctcggccagcagccgggagaacgtcacgtgttcgctcccccaaggcgtccgatgttcccaggtaccgtccaaggcgtaaagatccgtcacttcaccgagcgcccgcagtttcgcccggcggaatccgctcagcaggccgagtgccagttccttcgcgtcggccgtcgctccgacgccgagcgcgccgtgcccgtgccgcccgggctcggcagcgccgccggccagcggggtcac

SEQ ID NO: 3505 - DNA, 1406 bp, Unknown
  Kingdom: Bacteria, Phylum: Actinobacteria, Class: Actinobacteria, Order: Streptomycetales, Family: Streptomycetaceae, Genus: Streptomyces
gcccctccgaggccccgacttctccagttacgcgcccgaggacgtcggctggctgctccaggacctctcggacaccgagctggaggcgcccaccgaggagcgtgaggaggcgatccagagcggcggcgcgcactacgcggagtcgctgcccgtcgagtaccagccgagcgccgcgtaccaggccctgttcaccgccgccctggaggcctccgccgcgcgcatcgcccgcgcggtcggcaccgtcaccgagacggtcctcgccgaacgcggcccccgtcccgtgctcgtctcgctcgcccgcgccggaaccccggtcggcgtgctgatgcgccgctgggcccagcaccggcacggcctggacctgccgcactacgccatctccatcgtccggggccgcggcatcgacgccaccgccctgcgctggctggccgcccatcacgacccggccgacgtggtgttcgtcgacggctggacggggaagggtgcgatcacccgcgaactggccgcggccatcaccgagttcgaggcctcgggaggacccgccggcttcgacccggagatctcggtgctggcggacccgggcggctgcgtgcggacgtacggcacccgcgaggacttcctcatcccctcggcctgcctcaactccacggtgtccggcctcatttcccgtacggtgctccgcgccgacctggtcggccccgacgacttccacggcggaaagttctaccgggagctggcggactccgacgtctcgggcctcttcctcgacacgatcgccgcccgcttcgacgaggtggcgggtcaggtcgaggcagaggccaaggaactcctcgccgccgaccgcgccccgacctgggagggctgggccgccgtggagcggatcagcgaggagtacggcatccacgacgtcaatctggtcaagccgggcgtcggcgagaccacccgggtcctgctccgccgggtcccctggaagatcctcgccaagcgcggtgcgggcgcggacctggaacacatccggctgctggccgagcagcgcggcgtcccggtcgaggaggtcgacgacctcccgtacagctgtgtcggtctgatccacccccggttcacgcgcggcgcgacgggcgcggacggcaaggcggtgcagggcgcatgagcgcgacatcaccggccaccctggtggcgagcgacctcgaccgtacgctgatctactcggcggcctcgctcgacctgtcgatgccggacgcgcaggcgccccggctgctgtgcgtggaggtgtacggccacaaacccctctcgtacatgaccgagacggccgccgccctcctcaccgaggtggcgaccaccacggtcttcgtcccgacgaccacccgtacccgcgagcagtacgggcgcatccacctccccggccc

SEQ ID NO: 3506 - DNA, 5596 bp, Unknown
  Kingdom: Bacteria, Phylum: Actinobacteria, Class: Actinobacteria, Order: Streptomycetales, Family: Streptomycetaceae, Genus: Streptomyces
cttcgggggttcggtgcctgtcgtggccggggggtacgtcggggctcctgggggccccggagccgctggggccggtggattcggtggggccgtcgagtccggtggtaggggtggctctgtcggtggtgggcctggcggggccgggtccgcggcggggggcggtgacgccggtgctcacgagcagcggcgcggcgggcctccctcgggcgggttcgctccccccggctagtcggtgtccggcccggatccgggcgacaggtcctggtcggccggggtgccggaggcgcggggagacgggggcgtctccaggtgttcgagctcgatgccgggtgccgcgagaaccacgtcaccggcgatgtggatggtgtgctgttcccccgtgtccagggcgctgacctggtattcgtccacgatcagagggccgttgtcagtggtgtgcgcttcactgttcaccagggcccaggactggtcgacagtcctgggtgcgaggaccgggtccgtgaaggtgaccacgcggacgcgggtcgtgggggaatcgggggtgaggcgcaggagacgggtcatggcgacgaggaacgcgggggacgtgccggcgaaggcgtgggcgcggacgttgccttcggtggcgtggctgccggtcgggtcggtccgtacccaggtgaccccttccagggctgctcctcgcacctgccagctcgcggcatggagttcgagacggatgggccggcccagctcgtccagggcgaggtcgacggagccgaggtggtctccggcgggggatgtggtctgggagacgtagcgccagccggaggggccgggggcgcagtggaagtgttcttcgccgaggggggtgtgatcgtgaaggtcgtggagcgaatacctgccgcggggcatggggtccttcgggttcctcgggctgtgcgggagcggtaacgggagcaggcccccggcacgggggtgcgggggcctgcactcggatctgctgctgagggttctgacgccgctcggtgtccgtgaggccggcctcacggacaccgaggtggatcagtggcctcggatggatcagtagcggtagtggtcgggcttgtacgggccctctacctcgacaccgatgtacgccgcctgctcggggcgcagcgtcgtgagcctgacgcccagggcgtcgaggtggagtcgggcgaccttctcgtccaggtgcttggggagcacgtaaacgtcggtcgggtactcctcgggcttcgtgaacagctcgatctgcgcgagggtctggtccgcgaagctgttggacatcacgaaggacgggtgcccggtcgcgttgcccaggttgaggaggcggccctcggacaggacgatgaggaccttgccgtcggggaacgtccaggtgtggacctggggcttgacctcgtccttgacgatgccgtcgatcttcgcgaggccggccatgtcgatctcgttgtcgaagtggccgatgttcccgacgatcgcctggtgcttcatccgggccatgtccttggccatgatgatgtccttgttgcccgtcgtggtgacgaagatgtccgcctgctccacgacgtcgtccagcgtggccacctggtagccgtccatcgccgcctgcagcgcgcagatcgggtcgatctccgtgatgatcacccgggcgccctggccgcgcagggactccgcgcagcccttgccgacgtcgccgtagccgaagacgacggcggtcttgccgccgatcaggacgtcggtggcgcggttgatgccgtcgatgagggagtggcggcagccgtacttgttgtcgaacttcgacttggtcaccgcgtcgttcacgttgatcgcggggaacaggagggaaccgtcacggtgcatctcgtacaggcggtgcacacccgtcgtcgtctcctcggtgacaccgcggatctcggacgcgagctgggtccacttctgcggggcctcgccgagggtccggttcagcagggtgaggatgtgggcgtactcctcgctgtccgcggtcgacgggtccggggcggcgccggccttctcgaactcgacgcccttgtggacgaggagggtggcgtcgccaccgtcgtcgaggatcatgttcgggccgccggtgggggtgttcggccaggtcagcgcctgctccgtgcaccaccagtactcctccagcgtctcgcccttccaggcgaagaccgggacgcccgcgggggcttccggagtgcccttcgggccgaccgcgatggccgcggcggcgtggtcctgggtggagaagatgttgcaggaggcccagcggacctcggcgcccagggcgacgagggtctcgatgagcacggcggtctgcacggtcatgtgcagcgagccggtgatccgggcgccggccagcggctgagcggcggcgaactccttgcggatcgacatcagaccgggcatctcgtgctcggcgagcgtgatctccttgcgcccgaaagcggcgagggagaggtcggcgaccttgaagtcctggcggttggtggccgtcgtcataacgggctgctcctcgtgatgggtcgagggtgggctgtctgggctgactctgcggcacggcgggcatacgaatgcccgggtgttcgcagggcagtccgtcggaggccctctgtccctcgcccggctcgctcccgccagccggtcgaccgccatcagcagcgacgtctgttatccgtatccgaatctacaccgaacggcccagtgagccccagcccgttcgtggagaggggcgtgtgtgaggggtcactgggccgatcggggccggtgtgcggtgggtcagtggccagaatccttcgaggccgggccctcgcccgcgctctcgtccgtgtcggtgcccgttcccgtggcggaccccgttccgccggtggcggtgtccgggacttcggtcgccttgcccgggttggttccggtcgctgcggcctccgcgttgtagatgtccggctccaggtagatgacccgggcgatcgggcacgctgcgcggatgcggttctcggcggcgttgatggcgtcggcgacctcggtcgcggtctcgtcgtgccggaccgcgatcttggcggcgaccagcagttcctcggggccgaggtgaagggtgcgcatgtggatgatgcgggtgactgtctcgccgtccaccacggccgccttgatgttctcgacgtcctcgaggccggcggactcgccgagcaggagggacttcgtctcgacggccaggacgatcgcgatgacgatcagcaggatgccgatgcagagggtgccgatgccgtcccagacgccgttgccggtgccgagggcgaggccgacgcccgcgagcgccaggatcaggccgacgagcgcgccgaggtcctccaggagaacgaccgggagttcgggcgccttggaccggcggacgaattcggtccaggagcggtcgccgcgcgtctggttggactcacggatcgccgtacggaaggagaagatctcggcgatgatcgcgaagaccaggaccccgaccggccagtaccaggcctcgatctcgtgcgggtgcttgatcttctcgtagccctcgtagaccgcgaacatgccgccgaccgagaagaggacgatggagacgaggaacgcgtagatgtagcgctcgcgcccgtagccgaaggggtgctgaggagtggcttcgcgcttcgccttcttgccgccgagcagcaggagtccctggttgcccgagtcggcgagcgagtggacgctctccgcgagcatcgacgacgaaccactgaagaggaacgctacgaatttggccacggcgatcgagaggttggcgacgagtgccgccacgatcgccttggttccgcctgacgcgctcatgagtgcgtggtgtcccttcgtcggtgcgcggcatgtgccgtcgcggtgaggcggcacattgttgcagccgtcgcgacagtccgtgggtcaggccgccacggtggcccggaagagcgttcccggccccgctgcctcgacggtctcgtcggccgggacgtatgcggactcgcccggccccagggtgagttcgccgacggtgaccgagccggccgtgcagagcaggatctggggcgcgggggcggtcagttcggtgggggccgcgcctgacgcgagggtgtagcgggacagggcgaactcgtcggcgggggtctcgtagagctcctcgcccgacggggccgcctccgggcgcagcacgccgggctcggtggcctcgaaccggacgatccgcaggagttcggggacgtcgatgtgcttgggggtcaggccgcagcgcagcacgttgtccgagttggccatgatctcgacgccgaggccgtcgagataggcgtgcgggacgcccgcgccgaggaacagggcttctccgggctggagttggacgtagttcagcagcatcgcggccagtaccccggggtcgccggggaagtggtgggcgatacgggcgtacggggcgtggtcgccgccgaggcgctcggcggcggccgctgcctccgccacggtctcggccatctccgccggttccgcgccgaggatcgccgtgagcacctcgcggagggccgcctcctcggggtgggcgcggaggaggtccacgtacggcttgagggagtcgactcccagcgcctccatcgcgtccgccgcctcggtgggcctgcggaagccgcagagtccgtcgaagggggtgagggcgcagatgagttcgggcttgtggttcgcgtccttgtacgtgcggtgcggggcgtcgatcgggacgccccgggcctcctcgtcggcgtagccctcgcctgcctgctccaggttcgggtggacctggagggagaggggggctccggcggcgaggagcttcaggaggaaggggaggcggggaccgaaccgggcgaccgtcggcgcgccgagctccccctgcgggtcggcgtcgatggcctcggtgagggcaagctccgtctcgccggaggcggtgctacgggtgatccgcgagggcgctcccgggtgggctcccatccacatctcggcctgcggttcgccggtgggcgcgatgccgagcagggcgggaatggccgtggtggacccccaggcgtaggggcgcacggtgttggacagccgatccatggagtcgtcctcgggtggggcggagcgggtgagtgtgtcaccaggggtatcagtgttacgtgaggtcctggcgtcgtgggggtggccggggggtgacgcggtccctggaggtgctccctgtggggtgttccgtggggccctggggggggtgcgatctctgtgggtgcggtccctctgcggtgttcgtgtgcggtgttcgtgtgcttctgtcagggctgggggttcgcggccagtgacaggtagaccgccgcgaagtcggtgatcgcgagcagttcggccacggcctccagatcgctgccctcctccggctccagctcgctcaccggggtgtcgtggccgagcgcgagctcccgggccgccgggtaggcgctgaggcctcccgtcgggcggtcccggagcaggacgacccgggccctcagcgtctcgccctcgtcgacccggtcgcggaagaagtcgtcggggtccgcgccggccgcgaagt

SEQ ID NO: 3507 - DNA, 2295 bp, Unknown
  Kingdom: Bacteria, Phylum: Actinobacteria, Class: Actinobacteria, Order: Streptomycetales, Family: Streptomycetaceae, Genus: Streptomyces
gcaggccgaggtgatggccccgatccgcagcccgatccgcccgacgtccaccttcgggtcgcagtgcacgccgatgatccgcccgacgccctccagcaccccggactcgatggcgtcgaccgcaccccccggcaggacctcctcggcgggctggaagatcagccgcacggcgttgggcagcagcccctcccggtcgagcccggcgagcacgaggcccgctccgagcacggtggtggtgtgcacgtcgtgcccgcaggcgtgcgcccggtcgggcacggtggaccggtagggcacgcccgccttggtgtccgggatcggcagcgcgtcgatgtccgcccgcaacgccagcatcggcgtcaccccgtcccactcccccacgtcgcacatgaccccggtcccgacggcgaggaccttcggcttcagcccggccttctccagccggtccttgatggccgcggtggtgcggaactcctgattgcccagctcgggatgcatgtgcatgtcccggcggaaggcgatcagctcggcacgcagttcgtcggagagcctgccgggcagcgcacctcccccgggctggccggccgggttgtgggggcgggaggcacgggacttcaactggttcaccctatgaagcgtaggccccccgccccctcaactggccacagatcaacaaaacttcagccgctcaggcgaacaaatttcctgtgaggacgtgtgacgcagggtggttgcgggtatacccgttcgccttccgcaccggggtccgcgcccttgcgggaaaggcgcaggacacacggcgagagccttcataggatcgcgaagaaatcatggacatcctgtgaggagccctatgaacagtcggtccgactccaccccgagcagaaagagacggaacagaaagggacgactccgtcacggcaccctcctggtggccgtcgccgcgtccctcggtacggtcgccgccctggccccgcccgccgcggccgcgccgggcctctcccgtaccaccgcgtccgccgaccgcgcgcgcccggcgaacacaccccccgagataccggaccgcctggccacgagccccgcgaccgcgtgcgcgggcggattcatcggcaatacacggacgacgctcatggcccgggtgcaggacgccgactcgccctccctcaccgcacagttccaggtcttcgacgccgacggcacggacccggtggccgagcgttcggtggccgccacggcgggcggcaccgccgcggcctcgtcgatcgacctgccttccggcgactaccgctggcgggtccgggccacggactccgggggagccgcctccgcctggaccggtttctgcgccttctcggtcgaccgcgtacgtccggaccggccgccgaccgtcgtgtcggaggagttccccgacggggacgccggacagccggcggacaccggggacgcccgcactcccggcaccttcaccctgggcgccaacggcgtcgaggacgtcgtctcctacgtctggtacagcaccttcgacccgcggcagcgggaggtctccgtctcccccggtgggacggcggacgtgacggccactccgctgaccggcggcccgcacatgctgtacgtgtacagcctcgaccgctccggcaaccgctcggacacgaccacgtaccgcttctacgcccggggcatcaccacacccgacgcccccggcgacctcaacggggacggcgccaaggacatctggagcctggacgaccggggcgagctgctcacctacgcgggccggggcgacggaaccttcgccccggcgaccgacgccgggctgtccgcgtccggagccggcacgtcctaccgcaccgactggaacgacgacggatacgtcgacctggtgacgctggagtacaaccccaacacgcggcggaagcagctctgggtccatcccaacagcggcctggggagggtcgacggcacccggggccggcagctcctgacggtcgactgcccggtcccggacgaggactacggctgtgtgggcgagcccggctggaccggcgacgaccactggggcgacgcggagcaggtgatcgcccccggcgatctgaacggtgacggcaggagtgatctcctcgtccgggagggcggccggctgtggatctaccacggcaagcacgggatgcggctggatgtgccggtggcggtcggcggctcggactgggacgacttcaccgtcctcgcgcccggcgacctcgacggtgacggcctggccgacctgtggttgcgcgacaacgccaccggcgacctccagcc

SEQ ID NO: 3508 - DNA, 4809 bp, Unknown
  Kingdom: Bacteria, Phylum: Actinobacteria, Class: Actinobacteria, Order: Streptomycetales, Family: Streptomycetaceae, Genus: Streptomyces
cgcggtggccaccgcgccgaccatcagggtgcggtcgagcagccctcccttgcgcagggcggcggtcactccggcgctcagcccgagcaccagccacaggcaggcggcgccgaacgccagcgagacggagacgggcaggcggtccatcagcaggtcccacaccggcagggcgttctcgtaggagtagccgaggcaggggaagccgcaccgcagcgcgtgggggccgctgcccagctcgcgaccggcgaagatgccgacgaggtagtcgccgaactgccggtggacgggctggtcgaggcccatgaagtggcgtacttccatgaggcgttcggggctgcacgtcttgccgcaggcggccgaggcggggtcggcgggcagcaggtagaagatgacgaaggtgacggcgcagatggcgagcaggacacctgcgacgccgaggagcctgcggaccaggtaggcgatcacgggtgtcctccctgggggtccaggatgtcgcgcagcgcgtcgccgaggaccgtgaaggcgaggacggcgacgaagaggaaggcgctggggacgatgaagtacatggggtccgtctcgtagtaggcgacggcctcggcgatcatctggccccaggagggggtgggcgggcgcacgcccaccccgaggaagctgagcgccgcctccgtgctgatcattccgggaatcagcagcgtggtgtacgcgatgacgggtccggagatgttgggcagcacctgccgggtgagaatgcgccagggtccgctgccgcaggcgcgggcggcctcgacgaactcgcggttacgcagcgagagcgcctcggcgcgcaccacgcgggcgatgccgggccagccgaagacgccgatgacgacggtcatcaggacgacccggttgacgtcctgggccaccgacatcatcgcgatcatgaagatgagcgaggggaaggacatggtgaggtccatcagccggctcagtacggtgtcgacgcgcccgccgaagtacccggccgcgatgcccgctgcggtgccggtgacgacgacgatcgcggtggcggcgaaggcgatcagcagggacacctgcgcgccgtggacgacgcgtgcgaacaggtcgcggccggtgaccggttcgacgccgagccagtgttcggcgctgatgccgccgagagcgccgtgaggcaggccgccgaggtaggggtcgatggcgtcggcgtcgaaggcggtgggcgaccagccacccagccggctgagcaggggcgcgctgagggcgacgaggatcagcagggcggcggcgatcagggcggtccgactgccccggtcaccccagaggcggcgccaggtggtccgccacggggtgtcgggcagggcgggtgagccgggtccaccagttgccgggacatcgcccggtccggtgggcggggcggagacgatgctcatgggaatgcgtcctcgtcccctcatcccttgcttcgggacgggtccttgagaccgatcacggcgaagtcgaactggccggtccaggaggggtgtccgaaggctccggcgacgttgtcgccgacgaggagcggtttgcgctcccagagcagggggacggccggggaggtgcgctggatctcccggtcgagcgcggtccacgcctcgttggcggcggtcgcgtcggacatcgcggcgatctcgtccatgcggcgttcgacggccttgtcgcggaactgggagacgttgccctggttgcccttgggtttgatggtgcggccgtcgaagacgaacggcaggaaggtggcggcggacgggtagtccgggcaccagccgctgatggccatgtcgggggcgttggcggtgtcgccgatggtgtcgtagtagaccgaggggtcgacggtctcgatccgcagccgtatgccgacccgggccaggctctgctggagcgcctcggcgcgggtcttgtccccggtggacacggtgatcgtcgtctcgaagccgtcggccctgcccgcctcggcgagcagcttctcggccttcttcacatcaccggtggccggcccgccgtggaccgcggcggcggcacggccgcccgtgagggacggcggcagataggcggtggcgacgtcgttgagggccggtccgccgttggcggtcacctggacctccttgtcgacggcgtactgcatcgcccgacggagcttcgggtcgtcgaacggcgcccgggaggtgttcagcgcgagcatgtccgtacagccggtgcgctcggcggagagccgctgccggatctccggcttcggcaggaccttggcgacgctggagggctggaggtcggaccactcgaccgcggaggcgtcgacacccgcgctctcgatgatgcggtcgtcgatctggccgcccttgagcccctggatcacgacgatgcggtcggggtaggccttgcgcaccgggtcggtcgccgcgtcccagtgggtgttgcgggccagcaccagcttcttgccgcgcgcgtagctctcgatgcggtacgggccggaggagaagggccgcaggtcgtactggacgcccttctcgcgggactcgggcacgggcgagaaggtgggcagcgtgaccgtgtaggagaactcggcgacgggtctgcgcagcgagaagacgatggtccggtcgtcgggggtccggatcgagtcgaggtgtttgccgtccagcgggccggcgtacccctcggcgtcggccagatagcgctgggcgtagtcgggtccgccggcgaggtcgggggcgaaggaccgctcgacgttgtacttgatgtcgcgggcccggatcggggtgccgtcctcgtagacgaggccgggcttgagggtgaaggtccaggtgctgccgccgtcggaggatctgccgaggtccgtcgcgaggtcggggacgatctcgctgcccttcttcccgggtgcggcgcggaaggtggtcagggtgcggtagatcagccgggtgccgaagtccatggtcggcatgacccagttgcgggccgggtccaggtgggcgaagtcctggttggacaggacggtcagggtgccgccccgcttcggcgtcccgccgatgacggtgccggtcgccactccgggctgtcgcttgtccgggtcgcggtcgtcacctccctgcgtcgagcaggcgcccagcagggccagggcgagcgaggtgttcagggatgcggacagcatccgggtgcgacgggacatgggtgcactcctcgtacggggaaagggacgcggccggggaaagggacgcggcggaaccgggaacgggccgaaggaagaagcgggaacaggccggaggaaagggacggcccggagtggcccggtgatccgggcggccgagcggcccggagggcgactgcttgcggaacgcgaggcggagcgggccgggaattgcgtccgcatccgtgtggtgtgacccgtaacatagtaatgtgaaattgcacagccaaggcgtgcgtcatcccgttaccgaaacgtgtcccccaggacgcgggccgtccggcgtcccgagagcgccgcggtcaccggggccgacggcaggatcaccggagtgcgcaccgccgacggcacggtgctgcccgccgacgccgtggtcaacgccgccggcacctggggcggcgaggtcggccgacggctcggcgcccccgtcgagatccttccccgccggggcttcgtcctcgtcaccgagccgctgccgccgatgatccggcacaaggtctactccgccgactacgtggccaatgtcgcctccagcgacgagggactggagacctcgtgcgtcgtcgagggcacccgcgcgggcacgatcctgatcggcgccagccgtgaacgcgtcggcttcgacacctcgatgaacccggccgtggtggccacgctcgccgcccgggcgtgccgcctcttccccttcctgcgcggcgttcacctgatccgcgcctaccggggcttccggccgtactgcccggaccatctgccggtcatcggcccggacccccgcgtccccggcgttctccacgcgtgcggccacgagggagccggcgtcggcctggcccccgggaccggcgccctggtcaccgcccagctcctcggccgtccgtggcgcggcgccgatccggccgcccacaccggcctcctgcccgaccgattccttaaccctggaggggtgccgaagtgaccgcagtgaccgcgttcaccgtggacggcgaaccgctgccgttcgtaccgggacagaccctggccgccgcgctcgtcgcctcgggccgggtcgcctggcggaccacccggggcgggcgacggccccgggggatcttctgcgggatcggcgtctgttacgactgcctggtgaccgtcgacggaacgggcgggcagcgcgcctgcctggtgcaggcccgcgcgggcatggccgtcacgaccggggagggcgacgatgactgagtcccgtgacctcgtggcgccgagcgagtcccgtgacctcgtcgtggtgggcgcgggcccggccggcatggccgccgccgtcaccgccctggacggcgggctgcgggtcgtcctcatcgactcgggagccgccccgggaggccagttctggcgacaccccccgccggccgcgcgcgcggccgtgccgaccgccgatctgcatcacgggctgagcacctaccgggcgctctgtgccaccctctccgcccacgagcgcaccggacggctcacgctgctgctgaaccaccatgtgtggaccacggcccgctcctcgggcgcccggcggcggtccatggcgtggacggcgaagccgtcctcctcgcgggccgtggtccacacat

SEQ ID NO: 3509 - DNA, 808 bp, Unknown
  Kingdom: Bacteria, Phylum: Actinobacteria, Class: Actinobacteria, Order: Streptomycetales, Family: Streptomycetaceae, Genus: Streptomyces
tcctcgggagtggcgggcgaggtgtgctccggcgtgcgccgggcggtgtgcgcccgctggtgccgggacggcgcggaggccttggagcccttccgcggatcggaggccttggcggtgcggggcggcttgaccgtcccggaggaccggcggtgggcctggcggccgtgcccgcgctcggtgagggtgcgcaggcaggtccagcgggccagcgcgtacagccaggatctacgttcctcctcggccgtggggccccgggcgtcctgccggtccgcgatcgacaggacggcgccgagcgcttcggtggccgcttcgtggtcgcagagcacggagaggcagtaggtgaagagcccgtcgagatacggctcgtaacgtacgggcggtcgctgtgccggggcgtggggtgctcggcggtgcgcccggtgtgcgccggtggtgtgcgtaggggtctccagcctgctgctcgtcacccggcgaccgtaggcaaaggagcacacaccccaagtaccccttgagcacatttaatccttacgggtgaacgtatgcctcgaaagaggacagggatcacggattccgcccgtagtgctccggtgcgccttcgtgcgcccctgcgcgcggtggggcagcgcacgccgccgcccgggaggcgttgtcgtaccccacctatacggtggcgccatggctgcccgtacgaaatccgcgaaggaccggccgtcctaccgctgtaccgaatgcggctggaccaccgccaagtggctcggccgttgccccgagtgccaggcgtgggggacggtcgaggagttcggcggcg

SEQ ID NO: 3510 - DNA, 3963 bp, Unknown
  Kingdom: Bacteria, Phylum: Actinobacteria, Class: Actinobacteria, Order: Streptomycetales, Family: Streptomycetaceae, Genus: Streptomyces
ccgcttcagcttcagcgacggcgtcagatggcccgcctcctccgtgaagtccacggccaggaccgtgaacttacggaccgactccgcgcgggagaccaggcggttggcctcgtcgaccgccttctggagcgacgtgcgcaggtcctcgtcgtggaccaggtcccgcatcgggatgtcctgcttcttggtcatctggcgccagtgctggaggccgtccggctccagggtgatcagggcggtgatgaacgagcggttgtcgccgacgaccatgcactgactgaccagggggtgggcgcgcagccagtcctccagcggggccggggtgacgttcttgccgcccgacgtgatgaggatgtccttcttgcggcccgtgatcgtcagatagccgtcctcgtccagtgcgcccaggtcgcccgtggggaaccagtcgtccggcaggagcgccggggtcacctccgcccgttcgccgtcccagtagccccggaagacctgaccgcctctcaggagcacctcgccgtcgtccgcgatacgcaccgacgtgccgggaagcggccagccgaccgtgcccagccggggtttgaggggaggggtcaccgtgtgggcggccgtggtctccgtgagtccgtagccctcgaagatgccgatgccggcgccctcgtagaacgcggcgagtcggcggcccagcggggagccgccgcagatcacgtaccggacccggccgccgagcgccgcccggatacggcggtagaccagcgggtcgtacagggcgcgtgcggcgcgcaggcccaggccggggcccggtcctgtgccgtgttcggcggcctcgaccgccttcccgtagcgctcggctatgcgggccgcgcggtcgaacgaggaggcccggcccatcttctcggccgtcgcccgccccgtgttgtagaccttctccaggacgtacgggatggcgagcaggaaggtcgggcggaagcccgccaggtccgccagcaactcctccgtctggatggacggcgcgtggcccaggcgcaccctcgcccgcatgcagccgatcgccaccatgcggccgaacacatgggagagggggaggaagaggagcgtggaggccgggtccttcgagaccgacttgaagaccgggtggaggagttcgatggcgttgtcgacctcggcgaagaagttgccgtgggtcaggacgcagcccttcgggcggcccgtggtgcccgaggtgtagatcagggtggcgggggtgtccggttccagggaggcccggcgggccgtgaccgccgcgtccgggatgtccttgccgagggccttcaggtggccgatcgcccccgtgtcgaactgccacagatgcgccaggccgccgagctgcttgcgctcctggctgatcacgcggccctgttccttcgactccaccgcgcacgccaccgcgcccgagttctggaggatccagcgggcctggaaggcggaggaggtggggtagatggggaccgtcaccaggccggccgcccaggacgcgaagtccagcagcgtccactcgtacgtcgtccgggccatgatcgcgacccggtcccccgcgcgcagtccctccgccatcaggcccttggccacggccagcacctcggcggcgaactcggcggccgtcacgtcctgccactctccctcggcgtccttgcggctgagcaccgggtccgccggggcctcccgggcgttgtcgaacgggatctcggcgagcgagccgcgttccacgaccggtgcgaacctcggtacggagacctcctggattctcccgtcgggacctcgcttcttcgtcggctcgaccagaacgggtgtggctgcggatgcggttgcggcggcggaaggtggcgttgacacgtgcggctcctcggttcgggggtcgggcgggtcggtccgccgggtcgtccgtccggcagggatgcggcaagaggcaagcaggtcagggtcgttccaggatggccgtcaccccctggccgcccgcggcgcagatcgagatcaggccccggcccggcgcgtcccgttccgcgaggagcttggccagggtggcgacgatccgggcgcccgtcgcggcgaacgggtggccggtggccagggaggacccggccacgttcaagcggctccggtccaccggggccaggccctgcttctcccaggcggcgagcgtggccagcacctgggaggcgaacgcctcgtggatctcgtacaggtcgaagtcctcgatgccaagaccggcccgctccagcaggcgcggcaccgcgtacgccggggccatgaggaggccgtcgtcgccgtccacgtagtccaccgccgccgtctcgtacagggagaggtaggcgagcggttccagaccccgctcccgcgcccactcctccgtcgccagcaggacggtcgccgccccgtccgtcagcggcgtcgaattgcccgctgtcatcgtggggttggggtcggagactccgaacaccggcttgagcgtcgccagtttctcggccgttgatcccgggcggaggttctggtcgcggtccaggccgcggtacggaaccaccaggtcgtccaggaagcctcgttcgtacgcggccgccaggcgctggtggctcgtggcggccagcaggtcctggtcctggcggctcaccgcccagcggcgggcggtgacggcggcgtgctcgcccatcgacaggccggtgcggggttcggcgttgcgcgggatgtccgggacgaggtggcggggtcggacggcggccagcgccctgaggcgcgcgcccggcgtcttcgcgcggcgggcggcgagcaggacgcggcgcagttcgtcgttgacgccgagcggagcgtcgctggtggtgtcggagccgcccgcgacggccgagtcgacggacccgagcgcgatcgtgttcgcggcggcgatcaccgcctggaggcccgtgccgcaggcctgttggatgtcgtacgccggggtgcgcgggtcgagcgcggagccgaggaccgtctccctcgccaggttgaagtcgcggctgtgcttgaggacggcgcccgcgacgaacgacccgacccggtccccggccaggccgtaccgctccacgaggccgtcgagcgcggccgtcagcaggtcctggttggaggcggtcgcgtacgggccgtcggagcgggcgaagggagtacggctgccgccgatgaccgcgacgcggcgcggctgcggcagggcgagggggatcgaggggcgcggtgtcgtcaccgtgaccatctcgtctcggtcggtccgggattgttcatctcgaccagctcctgactcttaagtaaccttactcaggagtaaatctacgaccgagcagggagtcaggacaatggccgatcgctatctgcacctcaccggcacagcacccggccgcttcctcacccggcggctcggcctgccgcaacccgccccgctgcgccgctggactcttcagaacccgcgcctggacgggccgctgctgcacctgaccgccgggaccccggcgatccgggacggtctggcgaaggtgctggccacgaccgggctcgccgtcgaggcgcgggcgacgcggcccgccgggatcgtcctggacgccacgggggtcgcctccgcccagggactcgccgaggtgcacgccgccctccatcccgtcgtacggtcgctggctcccggtggccggatcgtcgtcctcggcacgccgccgaccgtagaggaccaccatcaggccgcggcccagcaggcgttggagggtttcgtccggtcgctgggcaaggaggtcgggcggggctccacggtccagctcctgcggcttccggccgacgggacgccggaagccgccgagtccaccctccgcttcctcctctccccccggtccgcgtacgtcagcggccaggtgatcgagctgacctccgcctcccccggctccgtgtccgactgggcggccccgctcgccggccggaccgccc

SEQ ID NO: 3511 - DNA, 2107 bp, Unknown
  Kingdom: Bacteria, Phylum: Actinobacteria, Class: Actinobacteria, Order: Streptomycetales, Family: Streptomycetaceae, Genus: Streptomyces
cgctcaccccgtcccgtacgaccgccacagcggcccgcgtcctgcggcagctgatccacgacccccgcacgatcgcgctcctcgtgatcgtcccggtcctgctgatcacgctgctccgttacgtcttcgacggcgcgaccggcaccttcgacgcgatcggggcctctctcctcggcatcttcccgctgatcacgatgttcctggtgacctcgatcgccaccctgcgcgaacgcacctcgggcaccctcgaacgcctcctcgcactcccgctcggcaagggcgacctgatcgcgggctacgccctcgcgttcggcgcggtcgcggttctccagtcggcgctcgccacggccgtctccctctggctgctcggcctggacgtcgtcggctcgccctggctgctgctcctggtcgccctgctcgacgccctgctcggcaccgcgctcggcctgttcgtctcggcgttcgccgcgtccgagttccaggcggtccagttcatgccggcggtgatcttcccccagctcctgctgtgcggcctgttcaccccgcgcgaggcgatgcaccccgtcctggaggcgatctcgaacgtcctgcccatgtcgtacgccgtcgacggcatgaaccaggtcctccaccacccggagatcaccggcgacttcgtccgcgacatcgccgtggtcgcgggaagcgcgcttctggtcctctgcctcggcgcgatcaccctccgccgccgtacgccgtgagaaccccgatgcgaggatgacgggaggacggcccgaaccagacagagcacagcccagcaccgcccggagggtgaacgcatgacccagacagtcgcagtcctcggcaccggcaagatcggcgaggccctgctcagcgggatgatccgggcgggctggcgaccggccgacctcctggtgaccacccgccgcggcgaccgggcccaggaactccacacgcggtacggggtcgagtccgtcaccaacgcggaggcggccaagaacgccgacatcctcatcctcgcggtcaagccgcaggacatgggcaagctcctggacgaactcgccccgcacgtcaccgccgaccgcctggtcatcagcgccgcggccggcatcaccaccgccttcatcgaggagcggctcaccccggacaccccggtcgtgcgggtcatgcccaacaccccggtcctcgtcgacgagggcatgtccgtcatctcggccggcagccacgccaccggcgcgcacctcgccaccgccgaggagatcttcggcggggtcggcaagaccctgcgcgtcccggagtcccagcaggacgcggcgaccgccctctccggctccggccccgcctacttctacttcctggtcgaggccatgaccgacgcgggcatcctgctcggcctcccccgcgcccaggcccacgacctgatcgtccaggccgcgatcggcgcggccgtcatgctccgggacagcggcgaacacccggtcaagctccgcgaagccgtcaccagtccggccggcacgaccatcagcgccatccgcgagctggagaaccacggtgtgcgcgcggccctcatcgccgccctggaagcggcccgggaccgcagccgcgagctggcctccggcaacggctgacgcccagctcggacccaccgtccgcccccggccaccggcaccaccggccgggggttgacacactccggacacatccgtagtgtgctccgagttgtccgacgtgagcgccgaccccggtcggtccccggacagccattccgcagtaaccacgacaggacgcgcgaccccgtgtcgcatgctttttcgtgtccctgcgcgaaatgaggaatccgcgttcgaaggaacgcacgccgattagcgtcggggaccgggattccgctaaagtctcactcgtcggaacggcccaacagccgggaagacaaaccccgctgactgggaatcaggcccgaaaggatctgatagagtcggactcgccggaaagggaaaacgcgaaagcgaagcacctggaaggtgagagatgcgagacccgcttcgaccgggaatcggacacgaaagagtctgatagagtcggaaacgcaagacagcaggacaaagaagaa

SEQ ID NO: 3512 - DNA, 3022 bp, Unknown
  Kingdom: Bacteria, Phylum: Actinobacteria, Class: Actinobacteria, Order: Streptomycetales, Family: Streptomycetaceae, Genus: Streptomyces
ccccccgttcgaagggcaagcagcctccccacctcctcgtcatgaccgccacccccatcccccgtacggtcgcgatgacggtcttcggcgacctggagacctccgtcctggaccagctcccggccggccgctccccgatcgccagccacgtcgtccccgccaaggacaaaccgcacttcctcagccgcgcctgggaacgcgtccgcgaggaggtcgagaacggccaccaggcgtacgtggtctgtccccgcatcggcgacgacgcggaagaggcggaggggaagggagggaagaagacgaaggccaagaagcaggccgccgaagaggaccccgagaagcggccgccgctcgcggtgctggagatcgccgacgaactgcgcaagggcgcgctggccggactgagcgtcgaggtgctgcacgggcggatgcaccccgacgacaaggacgacgtcatgcgccgcttcgccgccggagacgtcgacgtcctggtcgccaccaccgtcatcgaggtcggggtcaacgtccccaacgccaccgccatggtgatcatggacgccgaccgcttcggcgtctcccagctccaccagctccgcggccgggtcggccggggctccgcccccgggctctgcctgctggtcagcgaggcccacgaggcgagccccgcccgcgcccggctctcctccgtcgccgccaccctggacggcttcgagctctcccgcatcgacctggagcagcgccgcgagggcgatgtgctgggccaggcccagtccggagtgcgctcgtcgctgcggatgctcaccgtcatcgacgacgaggaggtgatcgccgccgctcgggaggaggccgtcgcggtcgtcgccgccgaccccgagctggagcacctgccggagctgcgcacggtgctggccgccctcctggacaaggaccgcgaggagtacctcgacaaggggtgagagcaggtgcgcggccacgggcaggacagaggcggacgggccggtggacgccgtacgccatatcgtggacgcacggcacgcgcacagcgcgcgtaccgaccaccgacggcccgtgcgccgtacgtccacgaccccgaggaccccacacccatgacccgcgtgatcgccggctcggccggcggacgccgcctggccgtcccgcccggcaccggcacccgccccacctccgaccgtgcgcgcgagggcctcttctcgacctgggaagcgctgcgcggcaccctggaaggggccagggtcgccgatctgtacgccggatccggcgccgtcggcctcgaagcgctctcccgcggcgcggtccacgccctgctcgtcgaggccgatccgaaggcggtccgcaccgtccgcgacaacgtccgcaccctcggtctgcccggcgcggaagtccgcaccggcaaagccgagcagatcgtgacaggaccggcgccggccgacccgtacgacgtcgtcttcctggacccgccgtacgccgtcaccgacgacgatcttcgcgagatcctgctcacactccgtgctcaggggtggctcgcggacgatgtgctcgtcacggtggaacgcagcacccggggcggagaattcggctggcccgccggattcgagccactgcgctcccgtcgctacggcgagggaacgctttggtacggtcgcgccgccgctacgtgcgaagacgcacgatgaccggaccggagagcgagggaatcacagtgcgccgcgccgtctgtccggggtcgttcgaccccatcaccaacggacatctcgacatcattggccgagcctcgaagctgtacgacgtggtgcacgtggcggtgatgatcaaccagtccaagaaggggctgttcaccgtggacgagcggatcgagctgatccgcgaggtcaccgccgacttcggcaacgtcgaggtggagtccttccacggcctgctggtcgacttctgcaagcagcgggagatcccggcgatcgtgaagggcctgcgggccgtcagcgacttcgactacgagctgcagatggcccagatgaacaacggcctctccggcgtcgagacgctcttcgtgccgaccaatccgacgtacagcttcctgtcgtcctcgctggtcaaggaagtggcgacctggggcggcgacgtctcccacctgctgccgccgaccgtgcacgaggcactcgtgaagcggctgggcgaacgctgagccgctgacggaccgtcaccaggtgtcgggcggcggccgactggccttacagtcgtcccgtccgtctccaacggagcagcagcttcaacagagcagcagagagtggcgagcacacggtggacgtgcagaagaagctcgacgagatcgtcgaagcggtcgggagcgcccgatccatgcccatgtcggcctcgtgcgtggtcaaccgcgccgagctgctcgccatgctcgaagaagtgcgccaggccctgcccggctccctcgcccaggcgcaggagctgatcggcggccacgagcagctcgccgtccaggcccggcaggaggccgagcggatcatcgaatcggcccacgcccagcgtgcctcgctgatctccgagaccgagatcgcccgccagtcgcagagcgagtccgaccggatcctgtccgaggcccgccgcgaggccgaggaggtccgggccgaggccgacgactacgtcgacagcaagctcgccaacttcgaggtcgtcctcaccaagaccatcggttcggtggaccggggccgcgagaagctcctcggccgcggccagggcctggacgagcagggctaccaggaccccgacttcgccgaggcccccgagcgaagcgccgacccggagaccctgcggcagcgggccgacgcctacgtcgacgccaagttcggcgccttcgaggccgtcctcgcgaagacgctggaggcggtcggccggggccgccagaagctccacggccgggtcgccagcgacgacctcggcgcgcacatggccgcccaggacgccgcgggcggccaggggcacaccagcgacgccgactacc

SEQ ID NO: 3513 - DNA, 538 bp, Unknown
  Kingdom: Bacteria, Phylum: Actinobacteria, Class: Actinobacteria, Order: Streptomycetales, Family: Streptomycetaceae, Genus: Streptomyces
  misc_feature (271)..(410): n is a, c, g, or t
ggcccgccgcgccctcgccggcaccggctacgcggccccgcacctccccgccccgtacggactgggcgccggacccgtacagcaactggcgatccagcaggagtcgagggaacagggcgtccgcctcagcgacctgtccatcgccacctgggtggtgccgtccctcgtcgcgtacggaaccgaggaacagcgggagcgctatctgccggccaccctgcgcggcgacctccagtggtgccagctcttctcggaacccggcgccggatccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggactcacctacttcctggtcgacatgaagaacgccgaaggcatcgatatccgcccgctcaaggagatcaccggcgaggccctcttcaacgaggtgtacttcgacgacgtcctgctccccgccgacg

SEQ ID NO: 3514 - DNA, 640 bp, Unknown
  Kingdom: Bacteria, Phylum: Actinobacteria, Class: Actinobacteria, Order: Streptomycetales, Family: Streptomycetaceae, Genus: Streptomyces
gcccaccggtcgcgcgaccggtgggccaggacgaccaggacgagcgcgccgaagcaggtcgtgacgatgccggtgggcacctcggcccccgcctgggcaccgaacaccgcgcgcagagccacgtccgcgccgagcaccacgagcacgcccgcgagcgccgacgcgggaatgaacgcgtggtgccggaccaggccagggatccaggtgctgagcagccggaccacggcgggcgcgcacaggccgacgaagccgaccggccccgcgacggccacggacaccgctgccagcagcaccgcgaggatgacggcgacgctgcgggtcagccgggggctcacccccacgaccgcggcgccgtcgtcgccgagggcgaggatgtccagccgccggccgagcagcatcagtccggcgaacgccacgagcgcgaccgggacgagccggtcgatggactgcatgccgatctgggcgagcgaaccgttgccccaggcgaacagcccggtcgtctgctgggagcgcaggagcagcagcatcccgctcagcccggacagggcgagggtgagcgccgaacccgccagcaccagccggatcggtccggctcccgcccgggagaggccgaggacgacgcccgccgccagcagcccgc

SEQ ID NO: 3515 - DNA, 747 bp, Unknown
  Kingdom: Bacteria, Phylum: Actinobacteria, Class: Actinobacteria, Order: Streptomycetales, Family: Streptomycetaceae, Genus: Streptomyces
  misc_feature (279)..(318): n is a, c, g, or t
cgccggtcgacgacggcgagaccacgcagaaggaagcggtgaaggagctcaacgcctcctccaaggcgtacgccgacctcaagaccgaggtcgacgcgctcgacaccaaggaccaggcgaagttcgccgacgggctgaagggcatcgccgacgagctgaacaagatcagcaccagcggtgaccaggccctgaagaagctccagtccggcgaggtcggcgtcgcgatgtcgaagcagaagggctgccagaagccgactgcctccaccggcccctccggcnnnnnnnnnnnnnnnnnnnnnnnnnnnnnnnnnnnnnnnncggacaaggacgccgcggagaagaagggctgagcgccgctcttccggcccggacacccggcgggtgcccgggccgctgccattgtcggtgggagcggacacaatgggtgggtgagtaagagcagccttcccgcacccgaccacgccgccgtcctccgtgaggccctgctcgccgcggacttcaccgcggacgggctcctcgaccgcctcggcgcgcccgcctatgccgcactcgcccgcagcgagacggtccccgccctgcgggccacccggggcgacaccccgctcgacacgctggtgcggctgttccttctgcagcgccccgtcgccgaggagcgggcccgtgccgccctgccgctcgccgagtgcgtcgcggacggctgggtgacccgggcggacgggaccgtccgtgcgggcgtggacgtacggc

SEQ ID NO: 3516 - DNA, 5736 bp, Unknown
  Kingdom: Bacteria, Phylum: Actinobacteria, Class: Actinobacteria, Order: Streptomycetales, Family: Streptomycetaceae, Genus: Streptomyces
cgagctgggcggcgtccgcgcccgccgcgaggacggcggcgatctgcgcgccgcgcatcagtccgccggtggcgacgatcgggatctgcacggtctcgcggacctgggtgatgagggagagcagcccggtgccggtctggtcgacctgcgggtcgtcgcggtgggtggactggtggccgcccgcctcgacgccctggacgcagacggtgtcggcgcccgcccactgggcgctctgggcctcctcggccgaggtgaccgtgacgacggtgtgcgtgccggccctggcgaaggcgtccagggtgtcgcgggtcgggcagccgaaggtgaaggagaccaccggaaccgggtcctccagcaggatcgcgaccttcgcctcgtagccgtcgtcgccgctgctgtccgggtcgccgagcggggtctcgtaccaggcggcctccccggcgagctggtggcggtagacctcgacggcgctggggtcggcgagcgcgggctgcggcatgaagaggttgacgccgaacggtccgccggtgagccggcgcagctgtttgatctcgttgtacatcccgtccgccgttttgtacccggcggccaggaatccgagcccgcccgcttcggcgacggccccggcgagctggggtccggacgcgccgcccgccataggggcctgcacgatcggataccggcagagatcggtcaactcggaggacatgaccgcatcgtgccacgtcccgtgcacggggccgaatcagccagtcgccgaccctgaccggttctcccgccgtacgccgcaccgcccgccggttcggaaccggcgggcggtgcggtgaaaggcggaaagcggttcagcggccgttgaacgcgtccttcagacgggaaaacagcccctgctgacctggctgaaactggcccaggggacgttcctcaccgcgcagcttggacagctcccgcagcagccgctcctgttccgcgtcgagcttggagggggtcatcacctcgacgtgcacgatcaggtccccccggccgccacctcgcagatgcgtgatgccgcgcccgtggaggggcacggactggccggactgggtgccgggccggatgtcgatatcctccaggccgtccagcgtctccagcggacacttggtgccgagggccgcggccgtcatggggacggtgaccgtgcagtgcagatcgtcgccgcgccgctggaacacggcgtgcggcagctcgtggatctccacgtacagatcgccgggcgggccgccgccggggccgacctcgccctcgccggcgagctggatacgggtgccgttgtcgacgcccgcgggaatcttcacggtcagggtgcgccgcgagcggatgcggccgtcgccggcgcattccgggcacggggtgggcacgaccgtgccgaaaccctggcactgcgggcagggccgcgaggtcatgacctggcccaggaaggaccgggtgacctgcgagacctcgccgcggccgcgacacatgtcacaggtctgggcggacgtgccgggggccgcgccctcgccgctgcaggtgttgcagacaacggccgtgtcgacctggatgtccttggtggtgccgaaggccgcctcgttgaggtcgatctccagccggatcatggcgtcctggccccttcgggtccgcgaacggggtccgcgctgcgcggcgttgccgaagaacgcgtccatgatgtcggagaagttgccgaagccgccggctccgaaaccgcctgcgccgccaccaccgccactggcggagagcgggtcgccgccgaggtcgtagacctgcttcttctgcgggtccgagagcacctcgtaagcggcgttgatctccttgaaccgctcctgggtcttcgggtccgggttgacatccgggtgcagctcgcgggcgagccgacggaatgccttcttgatctcgtcctgagatgcgtcgcggcgcacgccgagtacggcgtagtagtccgtggccacttacgactccgccaggatctgtccgacgtaacgtgccactgcgcgtaccgctcccatcgttccggggtagtccatgcgggtcggtccgaccacgccgagtttggcgactgcctcgtcgcccgaaccgtagccgaccgcgacgacggacgtggagttgagcccctcgtgggcgttctcgtgcccgatccgtacggtcatgccggagtccgtggcctcaccgagcagcttcagcaggacgacctgttcctccagtgcttccagcaccggccggatcatcaccgggaagtcgtgtccgaagcgggtgaggttggaggtgccgccgatcatcagccgctcctccgtctcctcgaccagtgtttcgaggagggtggaaagaaccgtggaaaccgtcccccggtcctcgctgtcgaaggattccggcagctcctgcaccagctgcgggacatccgcgaagcggcgtccgacgacccggctgttgagccgggcccgcagatccgcgagcgatgcctcgccgaacggcgcagggcagtcgatcatacgctgttcgacccggccggtgtccgtgatcaggacgagcatcagccgggcgggggcgagcgccagcagttccacgtgccgcaccgtcgaacgggtcagcgaggggtactgcacgacggcgacctgccgggtgagctgcgcgagcagccgcaccgtccggccgaccacgtcgtcgaggtcgaccgcgccgtcgaggaagttctggatggcccggcgctcgggcgaggacagcggcttgacgcccgcgagcttgtcgacgaagaggcggtaccccttgtcggtcgggatgcgtcccgcgctcgtgtgcggctgggcgatgaagccctcgtcctccagcaccgccatgtcgttgcggacggtggccggggagactcccagccggtgccgctcggtcagcgccttggagccgacgggctcctcggtgccgacatagtcctggacgatggcgcgcagcacttcgagtctgcgttcgctgagcatcgcgcacacctccagctgtttctccggtgtctgtctggcactcggtgcgttcgagtgccagcaatccccgcggccagtgtacgggggtggggtggggccggggcaagggcgaccggccacgctcccacgagaccgcgcaggtcgttgccgatagcgtcgtggtatggacgtcgcttgggaagacttcggctgggagcggttgggcaacggtatcggcaggcgacgcctccccggctgggatgccaccgccgcgctggtcgccggaccggacggcgcactgctgtacgacaccggcgccacgctgcgcgagggggtcgagctgcggcggcaggccgaggcgctgctcgggcggagggtgacgcatatcgcactgagtcatccgcacttcgatcatgtgctgggcaccgccgcgttcgccggggtccaggtctacggagcggtgggcgtcgcggacctgctgcgcgacggggccgagagcatgtgcgcctcggcggtgcgccacggggtgccggagggcgaggccgcccggtcggcggacacgctggtggtcccgcaccacgaggtgtgcggcgactggaccctcgacctgggcggccgtcaggtgctgctggcgaacgtgggccccgggcacagcggccatgacctcgcggcgctggtgccgggcacggacggtgagcctccggtggtgttctgcggcgacctggtcgaggagtcgggcgagccgcaggcgggccgggacgcgatcacctcgcgctggccggccgcgctggagaggctgctggcgctgggcggcgagggcgcgctgtacgtgccgggacacggggcggtggtggacgcggcgttcgtgcgtgcgcagcgggcgtcgctggcggaccgcttcgacgtggacctcgacgcggaacccggcgcgggacccggcgcgggatcccgcgcggacctcgacgtggacctcaacgccggactcgacgtgggatgagccctgacgcgggtgcggcgaatatcgtcgtgccatgcgcagctaccagccggacctgaccccgccgtggaagaggtccgcccccgtgcccgaggtgcccgccgagcccgatctggtcgtggaggaggtatccaccggcttctgcggggcggtgatccgctgcgagaagacggcccaggggccgacggtgaccctggaggaccgcttcggcaagcaccgggtgttcccgatggagccgcgcggcttcctgctggagggcaaggtcgtcacgctggtgcgcccgggtcccggcggtcccgtgcgtcccacccgtacggcctccgggtcggtggcggtacccggggcgcgggcccgggtggcacgggccgggcggatctatgtggagggccggcacgacgcggagctggtggagcgggtgtggggggacgacctgcgcatcgagggtgtggtcgtggagtacctggagggcgtggacgaccttccggcgatcgtcggggagttcgcgccggggcccgacgcccggctgggggtgctggtggaccatctggtgcccggctccaaggagtcccggatcgccgagcgggtgaccggcgcgcatgtgctggtggtggggcacccgtacatcgacgtgtgggaggcggtgaagccgtcctcggtggggatcgacgcctggccggtggtgccgagagggcaggactggaagacgggcgtgtgccgggcgctggggtggccggagaacaccggcgcggcctggcagcacatcctgtccaaggtccgcagttacaaggacctcgaaccccaactgctgggccgggtggaggaattgatcgacttcgtcacccttccggactgatgtccggggtctgataccggcccggtaccggcccgttgcgggactgtcgcagaggatctcgtaccgatccctatgaatgcctgcgtcccacacgcaccatcggttattgaggggatgaacgggcaggcggttcacgagccgaacggctcacgggggaagggcacggggcgatggtgcgcgaggtctggcgggacagtgcggacaacgaggcggcctcggccgtcttccacctgatgcagcagttgatcgaccggtaccgggtcaaccggccggtgatgccgctcgtggtggtccaggcggcggacgccggggccgggccggagatcgacgcgcgggtggagcagctcgtgcatcaggtgcaccgggcgaacgagctgcggcgggtgccggtgcggctgctggacggcgcgggagcgactccgtacgaggcggcgctcgccatggtgcgcacgctctccgagaagccgtgggagacccgcgagaacacccagtacaagaacttctcctttccccgctcccggctgctcggggcgatcgagcaggccaccgcgacggtggtcgagcaggccgacgggaacacctccgagatacgcgaggaaaggattctggaacagctgagccggctgcggtggcggtccggccggccgcgcgggggcacccggtggacctcgctgcggcagtcggtgcggcccgagacgttcgtcggcgcgctcttcatcgccctgctcagcgtgctgctcggggagatcgactggctgctgacggccctggtggcggccgtcgcgctgatcgggctcgccgtggtgggcctggcgagccgggccgcgccgccgctgctgtggctgcgccgggccagccggtggttcgccaccacctcgtccctggccgcgtccagcaccggctacccc

SEQ ID NO: 3517 - DNA, 7741 bp, Unknown
  Kingdom: Bacteria, Phylum: Actinobacteria, Class: Actinobacteria, Order: Streptomycetales, Family: Streptomycetaceae, Genus: Streptomyces
ccggggcgccagccctccatgacggtgatgcggcccgcctcggcctcgaagacgcggcccgtgaccccgtcgctcgcggcggagccgagccagacgacgaggggcgagacgttcgcgggggccatggcgtcgaactccccctcccccggggccgccatcgtctcggcgaaggtccgctcggtcatccgggtcctggcggccggggcgagggcgttgacgtggaccccgtaccggcccagctcggccgccgcgaccagggtgagggcgacgattccggccttggccgccgcgtagttgccctggccgacgctgccgaggagtccggcgccggagctggtgttgaccacccgggcggccggtgggcggcccgccttggcctcggcccgccagtgggcggcggcgtgcttcaggggcaggaagtgaccccggaggtggacccgcatcacggcgtcccagtcgtcctcgtccagattgacgagcatccggtcgcgcaggaagcccgcgttgttgaccagggtgtcgaggcggccgaaggcctccacggcggtggcgaccagggaggccgcgccctcggccgtggcgatgtcgccgccgtggacgacggcttcgccgcccgccgccacgatctcctcgacgaccccccgggccgggccggtggatcccccgtccccgtcgggtccgacaccgaggtcgttgacgacgacccgcgccccttcggcggcgaaggccagggcgtgggcccggccgagcccccgcccggcacccgtgacggcgacgacccggtccgcgcagagtccggcacggtgtgcggtgggtgcggtcatctcatctccccatgatcgacggcttgttgacggttgacgaccggttggcggccgggactgcgactgctaccgtccacctaacaaatgtttggtggaaaggtagctgatcctccgatgagtgtctccaccgcccgctcctcggacggcgtccgcgtcgtcaccgtggaccgtccccccgtcaacgcgcttcctgtgcagggctggtacgacctggcggacgccgtccgtacggcgggccgtgaccccgaggtccgctgcgtcgtcctggccgccgccggacgcggcttcaacgcgggcgtcgacatcaaggagttgcaacgcgatacgggacacgaggccctgatcggcgccaaccggggctgcgccgaggcgttcgcggcggtgtacacgtgcgaggtcccggtcgtcgcggcggtgcagggcttctgcctgggcggcggggtcggactcgtcgggaacgccgacgcgatcgtcgcgagcgaggacgccgtcttcggcctgccggagctggaccggggcgcgctcggcgccgcgacccacctggcccggctggtcccgcagcacctgatgcgcacgctgtactacacctcccgcacggtcaccgcggcgcaactgctcgcccacggatccgtctggcgagtggtcccgcctcacgaactgatgcacgccgcacgggagctggcggaagagatcgccgccaaggacggccatctgctgcggctcgcgaaggccgccctcaacggcatcgaccccgtggacgtccagcgcagctaccgcttcgagcaggggttcaccttcgaggcgaatctcgccgggaccgccgcccgggtccgcgacaccttcggcaaggaggcctgaaccatgagcactccccctcatgtgcgcgacaagacgatgacgcccgaggaggtcgtcgaccggctgagcagcggcatgacgatcggaatcggcggctgggggtcgcgccgcaagccgatggccctggtcagggcgctgctccggtcgcccgtcaccgacctcacggtgatctcctacggcggcccggacgtgggactgctggccgcggggggccggatccgccgcctggtcacggcgttcgtgacgctcgactccatcccgctggagccgcactaccgggcggcgcggcagcgcggggcatgcgcgctgacggagatcgacgaggcgatgttcatgtggggactgcacgcggcggcgaaccggctgccgttcctgccggttcgcgcgggcatcggatcggatgtgatgcgggtcaaccccgagctgcgcacggtgacttcaccgtacgaggacggcgaggagttcgtggcggcgccggccctgcggatggacgtggcactggtccacctcaaccgggccgaccggctcggcaacggccagtacctgggtcccgacccgtacttcgacgacctgttctgcgaagcggcggacgcggcctacgtctcctgcgaacgcatcgtagagacaagggagttgaccgagaactccaccgctccgcagaccctcctcgtccaacggcacaccgtcaccggtgtcgtggagacgccgggcggagcgcacttcacctcctgcgtacccgaccacccgcgtgacgagccgtttcagaaggcgtacgcggccgcggcggcggacccgaccgcctgggcggagttcgcggcccgcttcctgccgccggacggcgacgagaagggctaccagcaggcggtccgcacctggcacgaggagcagaaatgaacgcgtcggtcaccggaagcatcacccgcgccgagtactgcgtgatcgcgtgcgcggaggcctggcggggcgacggcgagatcctggccagcccgatgggcgcggtgccgtcggccggtgcgcggctggcccggctgaccttcgcccccgacctgctgctcacggacggcgaggcgacgctcgtcggcccggacggcgaggcggagggctggctcccctaccgcaggcatctggccctggtgaccggcgggcggcggcacgtgatgatgggcgcgagccagatcgaccgcttcggcaaccagaacatctcctgcgtcggcgactgggaacaaccctcgcggcaactgctgggcgtacgcggagcgccggtcaacaccctgaataatcccgtgagttactggatcccacggcactcaccccgcgtcttcgtcagccgcgtcgacatgatctgcggggtgggccacgacagcgcgcgggcggcaggcccctcggccacccgcttccaccgcatcccgcgggtcgtcagcgatctcggggtcttcgacttcgcgacgcccgaccgttcgatgcgcctggcctcggtccaccccggcgtcacggtggaccaggtccgcgaagcgacgggcttcgcgctctcggtccccgccgacgtcccgtacacccgcgccccgtccgccgccgaactcgccctgatccgcgaggtcgtcgacccggcccgcgcccgggacggggaggtccggccctgatgcgcaccgtcctgaccgacctcgtcggcgtccggcacccgatcgtgcagaccgggatgggctgggtggcgggcccccgcctggtcacctcgaccgcacgggccggggcgctcggcatcctggcctcggcgaccatgacgccggatcaactgcggtccgccgtacgggaggtgaagtcccggacggacgcgccgttcggggtgaatctgcgggcggacgcgggggacgcccgggagcgggtccggatcatcgtcgaggagggcgtgcgggtggcgtcgttcgcgctcgccccgtcgaaggagctgatcgcggagctgaaggacgcgggcgtggtcgtcgtcccgtcggtgggggcccggcggcacgcggagaaggtcgcggcgtggggcgcggacgcggtgatcgtgcagggcggcgagggcggcggccacaccggcgaggtcgccaccacggtgctgctgccgcaggtcgtggacgcggtggacatcccggtggtcgcggcgggcggcttccacgacggccggggcctggtggcggcactggcgtacggggcggcgggcgtcgccatgggcacccggttcctgctgacctcggattcgacggtcccggacgcggtgaaggcccggtatctggcggcgaccgccaaggacatcaccctgacgagggcggtggacgggctcccgcaccggatgctccgtacggagatggtggcggaactggagggtgcgggccggctgcgctccttgtaccgggcgctgcgccgggcgtccggcctccgccggatctccggcctgagccggccgggcatggtccgcgacggcctggcgatgcggcacggcaaggacctgagctggagccaggtgctgctggcggcgaacaccccgatgctgctgagggcgtccatggtcgacggccgcacggacctcggcatcatggcctcgggccaggtggcggccctgatcgaggacctgccgagcgtggcggagctggtggaccggatcctgtccgaggcggaggcggctcgcgcgcgtctggtcgacctaccccagccacatcgtcccgagcccgggccctcggccgaccccaacaacccggcggccacacccagcccgtccgacgcctgagaaccagcccccggccacacccagcccgtccggcgattgaggacaagcctccggccacatcggcccgggactggcccctcggcctgcaccaacggccgggccatcctatccagcccgtccggcgattgaggacaagacctcggccgacgtcggcccgagaccggacgaccggaccgccacacccagcccgtccggcgattgaggacaaagccccggtccggggctttcggggctctgccccggaccccggtcctcaatcgccggacgggcttggttttggcgtcccggtccgtgacgtgacgggaggcggacgggcttgatttcggcgttccggtccgtgacgggaagcggacgggcttggatgtggcgtccaggtccgcgacgggggacggaccggctcggattttggcgtgccggtccgtgaagagggctgccgttagctgaagatgatcattgagccctgggccaggctgcgggtcgccgccgcgtggaggccgagccagacgtggcgttcccgggcgaacgggctgtcgtcgtgggggatcgggtccgccggttcctccagggccgtggggccggagggcggttgcggggcggccggcgggttggccgggtcgatgccgatggacggggcgacgaactccagctcgcgcagcagcccgtgcgcggagcccagcggtccaccgcccgccaggagcgcgtcgtcggagagcggggccgggaagtccaccgggacgtacgccccggcgtggtcgtagtgccagaccaggtgcgactgctgggcaccctgttcgaacatctccaggagctgttcgtagtctccgtcgagacccgcgacgggggtgacggcgaggccgctcagctggagcaggtaggcgcggcgcaggaagtgcagggcgtcgtagtcgaagccggccacgggtgctacttccccgttgaggcccggcatgtaggcgtagacggggacgggcggcagcccggcgtcgttcaacgccttgtcgtagacggcgatctcttcggcgaacggattgtcggcgctgtggcacagcacatcgacgagggggaccagccacaggtcacaggccacgaagtctcgctctcggaagggttcgggcgatcgtcgggacagcgtaatgcggggcgaacctcacgcacagtgccccggggcctccggtgcctccgaggactccggcggcccggggccgtccccctcggccgcccgcgcctccagccggtccgcccaggcgagcgcgtgcgcgtagtaggagtgcatggcggcgtggacctgctcgtgatcgctccgggagatggcctcgaccaggtcttcgtggccgaaccacagcacgtcctcgtccatgccgtcgcggcgcagccggtgcacggcgaacacccaggcctggacgcggagccgggtgaggaagtcggcgatgtacgggttgaggacgaactgccccaactcccgccagaaccgcaggtcgtacccgatcagcacgtcgaggtcgccgcccttcgccgcgcggaccgcctccgcggcccgtcggcggatcgaggcgagcccctcgggccggacggcgacccgctcggcggagttgcggaagaggccctcgacgacgagggcgcgggcctcggccatcgcgcggtagtcggcgacggtgaactcgcgcacctggaagccgcgatgctggtcggaggcgagcagtccctgcgcggagaggtcgaagagcgcctcgcggacgggcgtcgcggagaccccgtactgctcggcgatctgcttgacggtgaactcccggcccggcggaagacgccctgccagcacctcgtcacgcagcgcgtcggcgatctgctggcgcagggtgttgcgcgtcacacctccgctcggactcataccggcccccatccgtccgtccctgtccgtccccgttcgccgacgtttcggcgggggccacttctggctcgggtcaccttaagccagggccgccgccgtgcccgattccgggcacggcggggaggcgcacagggtcgatcacctacggaacaaggtcatccggttacccggcgtacgggccggagctccgttacgcgccctgcaccgtgtacgtgtcggcgacggagagagcgacgtccagggccgcgagcccttccttggcctccgcctcggagacgttgcaggccgggacggcgtgggtccggttcatgttgatgaacggccacagcccctgcttcttcgccgccgcgccgaaggccgccatcggggcgttggcctcgcccgacgcgttgtacggaacgagcggctcgcgggtctcccggtcgcggaccaggtcgagcgcccagaacgcgccgaggccgcgcacctcacccaccgaggggtggcgttcggcgagttcgcgcagaccgggaccgaggacggtctcgccgatccgggccgcgtgctcgacgaccttctcgtcctccatcacgccgatggtggcgacggcggcggcgcaggccagcgggtgtccggagtaggtgaggccgccggggtagggccgggtctcgaaggtcgcggcgatctcggcgctgatggcgacgccgcccaggggtacgtaaccggagttgacgcccttggcgaaggtcagcaggtccggcacgacgtcgaagtggtcggcggcgaaccaggcgccggtgcggccgaatccggccatcacctcgtcgagcacgaagacgattccgtaccggtcgcagatctcgcggacgcccgcgagatagcccggcggcggggtcatgatgcccgccgtgcccgggatggtctccaggatgatcgcggcgatggtggccgggccctcgaaggcgagggtgtcctccaggtgctggagggcgcgagcgcactcctcggcctcggtggcggcgtggaacggcgagcggtagaggaacggggcccagaagcggacgacgcccgccgagccgttgtcggagggccagcggcgcgggtcgccggtgaggttgatcgcggtggaggtcgcgccgtggtacgagcggtaggcggagagcaccttcggacggccggtgtgcagccgggccatgcggatggcgttctcgacggcctcggcgccgccgttggtgaagaagatcttgtccaggtcgcccggggtgcgctcggcgatgaggcgtgcggcctcggagcgcgcctcgatcgcgaacgcgggcgcgaaggtggcgagtttgcccgcctgctcctggatcgcggcgatcacggtggggtgctggtagccgatgttggtgtagacgagcccgctggtgaagtccaggtagcggttgc

SEQ ID NO: 3518 - DNA, 1550 bp, Unknown
  Kingdom: Bacteria, Phylum: Actinobacteria, Class: Actinobacteria, Order: Streptomycetales, Family: Streptomycetaceae, Genus: Streptomyces
cagttcttcgatgcggcgatcggcctgctgacacgggtgcgggacgaggaggcggacagcatcgccgcatcgaagaactgaccggccagcttgctgtcgctcatcgggagagacctttcggcgggggagtaggagcggggtgggacgggtggtgcggcgagcgtcccgcggtgcgggaatgccggtgccgccgatcacgttgcggtctggaccagtggactgtcaatagcgcctcgtggccccggccgtacgcacttccaccggtcttccaccggggcggcacggttgtcggcgctatgcgtcagaattggtgcagggccatcgcacgacgttttctagtcacagcatcgaggggcacgtatgtccggactgatcgacaccacggagatgtatctccgcaccatcctcgaactggaagaggaaggcgtggtccccatgcgcgcccgcatcgccgaacggctggaccagagcggtccgaccgtcagccagacggtggcccgcatggagcgcgacggactggtccaggtcgcgggggaccgccatctggagctgaccgaggagggccgccgcctcgccacccgcgtcatgcgcaagcaccggctcgccgagtgtctgctcgtggacgtcatcggcctggagtgggagcaggtccacgccgaggcctgccgctgggagcacgtgatgagcgaggcggtggagcggcgggtgctggagctgctgcggcacccgacggagtcgccgtacgggaaccccatcccgggcctggaggagctgggggagaaggccgaggccgacccgttcctggacgcctccatggtgagcctggccgagctggacccgggtgccgagggcaagaccgtggtggtgcggcggatcggggagccgatccagaccgacgcccagctgatgtacacgctgcgccgggccggggtgcagcccgggtccgtcgtcagcgtgaccgagtcgcccggcggggtgctggtcggctccagcggggaggcggccgagctggactccgatgtcgcctcgcacgtcttcgtcgccaagcgctgacacggtcgcagccaagcgccggcggaagcgtcgcccagcactgacgcggttgccgcccggtgtctgacgggttcgtcgaccggggccggcccggcggacggccgtgtgccggccacggcaacacaaccgtgatgtgcgcttgccgatttccgtccggaatggcagcggccggacgcgtcacatgccaggctgaggccaggcagaggacctgagggtgtcggccggctccggccggcacggtcggggagggagcagggaatgcgcccgtcgtaccatcacgcgccccgcgcggcgcccggcgcgcttcgcaacgccctgatcccggccgctgcggggcggttcgcgccgcggcctgccatcgttgtcgaaggtgccggggggtgcccccggacagggggcggccccggcgtcctgagacgccggggccgttcctcccctgtgctgacccggagccccgagctctcaaggtcagttcccgcgggcccctgtccccgagc

SEQ ID NO: 3519 - DNA, 4169 bp, Unknown
  Kingdom: Bacteria, Phylum: Actinobacteria, Class: Actinobacteria, Order: Streptomycetales, Family: Streptomycetaceae, Genus: Streptomyces
ggaggggaggggacggtgcacgagatgcggccgcggaagaagacggcatcgaagaaggcggcctcgtccggaaaggctgccaccggccggaagacgagcgcgtccgggaagacgaccggccagaaggcgggcgccaggaagacgaccgcggcgaagaggacgaccggcgccaaacgcacggcgaggaagcggagcgcctcctgaccgaggaccgggacggctccgtggcgcgtctgccgcgcgtcgcaccgatgctcgcgacccccgggcggctgcccccgccctcggaggacacctcgtacgcgtacgaggtgaagcaggacgggcagcggtgcatggtctacgttcccggcgacggttcggtacagctgcgttcccggtccggcgccgacatcacccccgcctaccccgagttcgcgagcctgggaacggtgctgggttcccgtccagccgtgctggacggggagatcgtcgcgccggacgacgaggggcgcagcgacttccagcggttgcagccccggatggggctggccggctccccggtcagggcggcccgcatggccgcgaaggcgcccgtgcacctgatgttcttcgacgtcgtgttcctcgacacgagccggctcacccgcaccccgtactccgagcgccgcgccgtcctggagtccctggacctgagcgggcccgcgtggtcgactccggcggcggtcgtcgggcacggtcagcgggcgctggagatgacgcggaccgccggtttcgaaggcctcgtcgccaagcgccgcacctccttctacgagccgggtgtccgctcccggtcgtggatcaagatccggcacgtgcggaccgaggacatcgtcgtcggcggctggctgcccggccacggccgcctcgcctctctgcccggcgccctcctcatgggccgcccggcccccggcgggggactccgctacgtcggcggcgtgggcaccggctggagcgacgacgaacgcagcaccctcgcggccctcctccacgctgcggcgaccgacatctgcccgttcaccgagcggcccgcggtggccggggcccgatgggtggcgcccaggctggtcggagaggtccgctacacgacccgcaccagggccggacgcctgcgccagccctcctggcaccgcctgcggcccgacctcacacccgatgacctccactgagccgcggacgggtgccggtcctccgtcgagcgagcgacgtaccgtctcctccgctgaaccggtgggtggcgatccctcggccgacccggtgaccgccggtacggaccgccacatacacgcttgttagggtcggccgcatgctgagactcggaatgcctgtcgtaggtgtcacggacatcccccgagcggtggccttctggaccgcggcgttgaatctggtcgccagtcaggagcgggagagcgacacctggcgaaccctcaaccacgctgacggctccggccgggcgctcggcctgctgcgcagcgactccccggccgagtcgcgcccccgtatccacctggatctgttcacggattcggtcgaggagcagcagagggaggtccggcgacttctcggtctcggcgcgcgcagcgtcgactgggacctgtacccgcccgaaccggacttcgttgttctggccgacccggacggcaacatcttctgcgtcgtggacctgagccgcacttccggcgacgggagctgatcggcggcgtcccgacgtcccggcggaccgcacgtccggcccgtggtcgacgtgtccgcctcgcgtacccccgtggggcgatgaggaccctcggcacacccggcacggacgccggctcttcacttcaccgccgaagccgccgccgcgcaaaagaggggtgtccggtgtcatcggatgcgcgcatcgccaccatcgcccatttccttcgtgcatacgtccggagcacaggggcaggcgaatgtcagccatggacgacggaggccgatcgtcagcggtcatccccggcgacaggtgaaggatgagcaccgagaagaagaccgatgaagagcacgacggaaagcgtgtcgacgttcctactgccatgcggcaggcctctgcgcagctcacggaattgctccagtgcgagccgggttccgtttccgcggtgaaggccaccgaggacggttggacggcggacgtggaactggtcgagctggaaagagtgccggacaccatgagtgtcatggcctcctaccgggttcaactcgacccgcagggaaggctgttgtcctacgagcgactgcgccgctacgccaggggccagatcgatcgtcgctgaaattccgtcgtcagacgtaacgaagatcaccgaaaggagttccccgtgacactcgttcagcagagcaatgcgacgtccggtgggagcggctcgggaaatctctacgacgttcttgaactcatactcgaccgagggttggtcatcgacgcgttcgtccgcgtctccctggtcggtatcgaaattctcaaaatcgacgtgcgggtggtggtagcgagcgtcgatacctatctgcggttcgccgaagcctgcaaccggctcgatctggagtccggacgtaaggcgccgagtcagctcaccgacctggtcggagacatgacggagaacggcgccaagggcaagtccaagggcgcactgagcggcgccgtcgaggcgttcagcgagtccttgcagggcaagcgcgatgagcccgaggaggagccgcgcaagcggccggcccgtaagtcgacgtccagccgccagacccagcgacgcgaggagtagcggtgcccacctacatctacgccattaccggcgccgaccacccgctgcccctgaacggcctgcggggcgtgggcgatccgccctccgccctgcgtaccgtgcacaccgactcgctggccgccgtggtcagcgacgcgcctcccggactccgcgccaagcgacgcgacgtgatggcgcatcaaggtgtcctggaagcgctgatggcgggtggtgcgaccctgcccatgaggttcggcctggtgggccccggcgacgacgaggtcgccgaggtcctggaacgggaggccggcgcgtaccgggatcggctgacggagctggacggccgggtggagtacaacctcaaggccggtcgcgacgaggacgacctcctgcgggagatcatgaccgagtccgacgacatacgggaactcaacgaacggacacgcgcccggggcagccacgacgaccgggtcgccctgggagagctggtggcccgcgaggtgaccgcccgccaccagcgggaggcggaggacgtcgcggcccggctggcggacatcgccgcccgcagctcgcacgcggagccggccccgcagcagttcctcaacctgtccttcctcgtgtcccgggcggagaccgagtccttcgtggccgcggtccgacgtgaggcggagcagcgcggcgacgcgtactcgttcaccctgaccggcccgctgccgccgtacagcttcgtctgaccgccggggcgcgggcccgaccggcccccgggagcggaggtgatctgtccgccatgggcctcatcagcagcatcctgaccctgccgctggcccccgtacgggggacggtctgggttctcgaccaggtcgtccaggccgccgaggaggagtactacgaccccgagccggtacgcgcccggctcgcccagttggaacaggacctggtcaacggccttgtcgacgaggacgagttcgaccggcgcgaggacgagctgctcgaccggctcgacgagatcgaggagtaccggaagagcaggcgccgcacgccgtgaccatcgaccacaacacacgtgaccgggggagagcagaggtgcatcgcacatgacgaagaacgccaagataggcgcggctctggtgggtggatacctgctggggcgtaccaagaaggccaaactcgccctggggttcgggatgttcctcctcggcaagaagatcgatctcgacccgcggcaggtcggcaggatgctggccgactcaccggtcctgggctccctcaacgaccaggtgcgcaaggaactggtcgatgccaccaggacggcggccaccaaggccgtcacacagcgggccggcagcctggccgactccctgcagcagcgcacgcaggcgctggggaccggccccggggccg

SEQ ID NO: 3520 - DNA, 5078 bp, Unknown
  Kingdom: Bacteria, Phylum: Actinobacteria, Class: Actinobacteria, Order: Streptomycetales, Family: Streptomycetaceae, Genus: Streptomyces
ccacggcccgtactgccgcacaccgcgcgagctgtacgtggtgaagcggctgctcgacggacgccggcgccgggtgttcgcgtacggcggggagagccgcttccatccggtccatgtgtccaacgcggcggagctgatccggctggccgcccggcggcctggatcccgtgtgctgaacgcggcggaccccgaggcccccacggtcgcggagatcgcgtcggcgatcgacgacgtgctcgggcgggagacagagacggtgctggtcgacggcgcttccccggaggggcacgtcggggtgacaccgtggagcggcgcccaccccgtggtctacgacatgacggccgccgaggaacagctcggctaccgcccggtgaccgggtacgtggagtcgctgccggaaacggtcgagtggctcgccggagagctggcggagcgcgactggcgggaggcgttcccgaagatgctcaacaattacggcgcatggctcttcgactacgcggaggaggacgcctggctggaggcgtacgaccgggagcggcgctgaacggcgggccgggcgggccgtcccggaggacggcccgcccggtccttgaccgtgctgccggtgttacggcttcggtgtggcgtgcggggagcacgtcacatcgcgccggtcggtctccccggtgagcaggtacgtgtccacccgctcgttgacgcaggggttgaccagtccggtgacgccgtgggacccggcgtccttctcggtgatgagccgcgagcccttgaaccgcttgtgcagctcgaccgcaccctggtaaggggtggcggcgtcgcgggtggactgcacgatgaggaccggcggcaggcccttgccggtcttcacgtcgagcggggtctgctgcttggccggccaggtggcgcagggcaggttcatccaggcgttggcccacgtcatgaacgggtacttctcgtgcagccgggtgttgtcccggtcccaggtgcgccagtcggtgggccacttggcgtcgacgcactcgacggcgctgtagaccgcgttgccgttctcggcggcggcgttgcccgcgaggtcgctcatgtcgggggcggcggcgtcgaccagggcctgggtgtcaccggcccggtaggcgctccaggtcctggcggtgggggcccaggcggagtcgtagtacggcgcgccctggaagaagccgatgagctcggccggcccgacgacgcctccgatgggctccttcttggcggcggcccgcaacgtcagccaggccttctcgaccttctgcggggtgtcgccgatgccgtagacggaatcgtgcttcgcgacccaggccttccagtcgtcccagcgcgtctggaaggcgatgtcctggttgaggttcgcccggtaccagatgctcttccgcgacgggtcgaccacactgtcgacgaccatgcgccttacgtgggccgggaagagcgtgccgtagacggcgcccaggtaggtgccgtaggagacgccgaggaagttgagcttcttctccccgagcgcggcccggatgacgtccaggtcgcgtgcggtgttgggtgtcgtcatgtgcggcagcatcgcgccgctgcgctcgccgcacccttcggcgtactcgcgggccagcttgcgctgggcgcgcttgtcggcctcgctgtcgggtaccgggtcggccttgggtgccttgacgaactcctgcgggtcgacgcaggagatgggggccgagtggccgacgccgcgcgggtcgaagccgacgaagtcgtacgccttcgcggtcttcgtccagagcgggttcttggcggtgatccgggcggggaagcgcagtcccgaaccgccgggtccgccggggttgtagagcagtgcgccctggcgctcgcccttcgtgccggtgctgacgtgccggtcgacggcgagcttgatcttcttgccgttcggccgggcgtagtcgagcggcacggtgacccagccgcactggatgggggcggcgagtccccagtcctccgggcagtccttccagtcgatcccggcattcgccgcccggtgcgccgcgacggcgaccccgcgagcctccgcgtcgtcccggccgtgatggcggccgtcggcgttggcggcgggtgcggccatcgcccccgctatgagcgtgcctgcgacgagagccacggccgaaccgagcaccgttgtacgtctcacgtggaacctcccccttcgtccgatccgccgccggaggcgacgcgttcatcggtacgtcgcggggatcctttcgtcagtggggcacccggggccagggcgtacacctgtttctttaccgaacccataaccggtgaaggaggttcgctgagcggactcagccggtgcggtccgccttcagcccgtccagcagttcgcgcgcggcgtcgtccaggatcccgcgcaacaggcgggcgtcggcggccacggcggtcaccaggacggcggggccggcgagcggggtgagggcggccagcaggcgcgccgcgtcggggtcggcgtcctcggcggcggtctggagggtggcggtgaggttccccggcagccgtgcgaggacggcggcgacctcgtcgacggaggcgtaccgggcgatcacggtgaccggcccgaagcactcctccagcaacgcgtcgtgcgggccttcggcggtcagccgggcggccgggacggtgaggaatccggcggagacggtgtgctcgccgcccgcgcctggggtgacgggtgccccgacgtcgggcagcgcggcccgctcccgtacgcccgtgacgaaggcgttccgcatgcggtggtccagcaggacaccggaaccggtggagctgaccgtctcggtgagggtcttgaggagctggtcgcccgtcgcgccctcggggaccaggacgaagccgggcttggtgcagaactggccggcgcccagggtcatcgagccgccgagcccggtgccgatctccccggcacgctcggcggcggcggccccggtgacgacgaccgggttgagggagccgagttcgccgtggaaggggatgggtgcgggccgggcggccgccgcgtcgaacagggcgcgtccgccgcgtaccgatccggtgaagccggcggcgctcaccagcggatggcggatcagctcgacgcccgcgtcgaagccgtgcaccagggtcaggacgtcctcgggcagtccggcgcgggcggcggcacggcggaggaccgaggcgcagagttcggaggtggccgggtgggcggggtgcgccttgaccacgaccgggcagccggcggcgagcgcgctggcggtgtcgccgccggggacggagaaggcgagcgggaagttgctggccgcgtagacggcgacgaccccgagcgggatcttgtagcggcgcaggtcgggccagggcgggacccgggtgccgtcctggtggtcgatgtggacgtcgaggtaggcgccttcgtccacgacctccgcgaaggccctcaactgggctgcggtgcgggccagttcaccggtgagccgggccgggccgagggcggtctccgcgtcggccgcctccacgatgtgctgaccggactcctccagcagatcggccgccgtacgcaggaacgcggcgcgtgccgcgcggtcggcgagggcgtcgcggacggcatgggccgcccggaccgctcggtcgacctcctcggcggtagcctccaccgcgacctgctcgcgcgggttcccggttcgggggtcgacactccagactggtgctgcgctcaccgtgattccctcccgtggtgcgaccgtccgccggccgacttccggccggcttcggccgcacatcagcaagtgttcggtattctgaacagagttcctgaacgtgaatgtcctgggactctatttgcgggtgttccgtgttggcaatcgtgtggcggcttttcggacgccgaagcggacgagaagtcgatgagctggagaagggggcgtgggcgatgtcggtcgccgagtccggtggggcacaggtcaagtccgcggtacggaccgtggaactcctcgagtacttcgcgggacggcccggcatgcactcgctggccgccgtccaggaggctgtcggctaccccaagtcgagcctctacatgctgctgcgcaccctggtggagctgggctgggtggagacggacgcgacgggcacccggtacgggatcggcgtccgcgccctgctggtcggcacgtcgtacatcgacggcgacgaggtcgtggccgccgccaggcccaccctggacaggctgtccgacgacaccacggagaccatccacctggcccgcctcgacgggacgaacgtggtctacctcgccacccggcagtcccagcactacctgcgccccttcacccgggtcggccgccggctgcccgcgcactccacctcgctcggcaaggcgctgctggccacccacagcgacgagcaggtccgcaagatgctgcccgagtcgttgcccgcgctgaccgagcacaccatcacggaccgcgagaagctcatcgaggagctgcggctggtccgggagcagggctacgcggtggaccgcgaggagaacaccatcggcctgcgctgcttcggcgtggcgatcccctaccggacgcccgcgcgcgacgcgatcagctgctcggtgccggtcgcccggctcacccccggtcacgaacagatggtgaaggacgccctgttcgacgcccgggaccggctcaccctcgcgacccggcgcctctgatggccgagctggtcctgcgtccggtccaggacggggacctgccgctgttcttcgcctggatgagcgaccccgaggcgacccgcgtcgccgcgttcaccgccgaggaccccaccgaccgggccgcgttcgacacccactgggcgcggatccgggccgggacccgcgtagtgatgcgcacggtggtggccgacggtgcggtggtgggccatgtcggggagtacggggaccccggcgaccgccaggtcacgtactggatcggccgcgcgcactggggccggggactggcgacggccgccctgcgggcgttcctcgacgagacccccacgcgcccgctgcacgcgcgggcgcg

SEQ ID NO: 3521 - DNA, 4957 bp, Unknown
  Kingdom: Bacteria, Phylum: Actinobacteria, Class: Actinobacteria, Order: Streptomycetales, Family: Streptomycetaceae, Genus: Streptomyces
gacgcagcaccgccgaccggccgacgccgtcaggtgccgccgcagtgcgtgagccgtacgacgaaatgggcttcaggttcgcttcagttcgtgctgttagagtgcagtcctgcggcggcaattcgccggacggctttggcacttcaacccacgagccgaatcgaccgggacaaagggagcgtagtaatgcgctgcagggagatgctggccttctacgccggtatcgccgtgctcctgatgatttccgcgttcacactcggctcctccgctcagaccctgcagaccgtcggcacggcagctcattctcacgccgcgtccgtattcgacgggtcagggccgagcactccgctggagggcttggacggtgacgtcacgctccagcaccgccacaaagcgggaagtgcgacggcctcgcctcccgtgcaggccggcattccctccacctcaccggatcttcacgactgcgcgacggatgtcgcccggcagcattcttcgcacacaggatcgcgaagccctgcccgtgtccagatccttcgctgctgagcggaccttccgatcaccctgcggcaacccgccgggctcgtttcgcccggtgccgtccagcagctccgccctgtcgaatcggagagttgcgccatgctcgacctttcggtgagcaggcccccggcgcccaggctctgatctcccgctcgcggatacgtgccatcacgcaccgcgtccccctgcattccgccgcgatgcgcacatgaatgggcctcggattcctctcccggtatccggtcggaccctgcggatttccggccccaaagataggacgccgggttggtcaacaccccgacctcggccccccgacccagtcctggagcagacgcacatgcagtattcccctctcgcctcggagccggcgagcggcatcgcagggtgggcgaccggccttgtcgaaaccatgggcggccccggggccgggctggcgatcgccctggagaacctcttcccgccgttgccgagcgaaatcatcctgccactcacgggtttcgccgcggggcagggagtgatcagcctgttctccgccctgttctggacgacgctgggatcggtggtgggcgctgtcgccctctatcagatcggcgcgctcttcggccgggaccgcatgtacgccctgtgggagcggctcccgctggtgaaggtgtccgacctgaagaagaccgaacagtggttcgtcaagcacggcatgaaagccatcttcttcggccggatgattccgatctttcgcagcctgatcagcgtcccggccggcgtcgagcggatgcctctgccgatcttcgtacttctcaccgctctgggcagcttcatatggaacttcatcctcgtcatggccggatacctgctgggtgaccagtgggacctcgtggagagttacgtcggggtgctctcgaaggccgtcctggtgctggtggtcgcagcgctggcagtggcggtcggtcgcaggctgcgttcccgccgaggcgatcggcagagggacctcgcatgatcggtgccgtgtgccgcccggagctgttggcttcgggcggcccaccggtcaccggtcgagggccgccaacgggcggtccacgaagaatggttgcaacggtccgcgcacgtcgcgcggacatcgatccgatcgacaaggtggcacgcatggctatgtgggaccgcatcaaggaccaggccaagggactccagcaacagcagtcgcagggcacgaggggccccggcggccagcggcaggcgggtacgggagccgccggcggctcgaaggagaagctggtggggctgctcaagtcgcagctcggctcgctcaagacggagctcaagagcggggcgtaccgggacgccagcatggcgatgtgtgcgctggtcgcggccgcggacgggtccgtcgaccccgccgagcggcaccacgtggaaacgctgatcctgcagaacgacgtcctgcagaacttccctcccgagcagttgcggcagaggttcaacaagcatgtcgatcagatgatgttcaacttccagcagggcaagaccgaggccatgcaggagatcgccaaggccgcgaagaagcctgtggaggccaaggccgtcgtccagaccggcttcgtgatcgccggcgcggacgggtacatcgccccggccgaggcgcaggtcctgcgggaagcgtgcatggcgctcggggtgtccccgcaggagttcggcctctgatccggccggtgcgcttcccgtagcgcgggaacccggcgggcgtgcgtgaccgtgtcgcgtcccgccgggccccggtccctcagtcgtcggtcaaggacaccgctccgaccgggcaggcccgtacggcctcccgcaccagtggatggtcctccgtcctctccggtcggccggggagcatctcgctgaacccgtcgtcgtcctgcgtgaacacgtccggcgcggtcagcgcgcacatgccggcccccacgcagcgttccttgtcgacctcgattcccatgccgctcaccaggccacgggcagttccagcaggccctggatcgtgtccccgggtttgtgctggatctcgtgcgcgggcacggcgagcctgagggccggcagtcgctcgaagagcgcacgcagggcgatgtcgagctcggtgcgggccagattctggcccaggcactggtggacgccgaagccgaaggcgaggtggtggcgggagggccggtcccagtcgagcgtctccggatgctcgtacacctcggtgtcacggttgatcagggaggtcgagaagaacacgccctctccctcgcggatcgtcgtcccggccacctcgatgtcctcggtggccagccgctgcagtccgtcggcgatggacaggaaccgcagcagctcctcgaccaccgcggccgtcgtcgtctctccggaccgcagcgccgccagttgctccgggtgcctcagcagcgtgaacgtaccgagcgagatcatgttcgccgtcgtctcgtgccccgcgacgagcaggatcacggcgaacgagacgaggtcctcgcggtcgacgggcccgtccgggtggtcccggtggatcagttcgtccaggagcccctcccccggctccacccgcttgcggtcgatcagggcgcccagatagtcctccagctcgatccgggccttgtccacatcggccgcgcccggcccccgcaggagccgccgcgagcagccctcgaagaactcgtggtcggcgtacggaacaccgaggagcgcgcagatcaccatggacggcaccggcagagcgaagtcggcgaccagctcggacggcggtcccttccgctccatcgcgtccaggagtccgtccaccgtttcctggatgcgggggcgcagcgcggcgatccgtttcacggagaagctcggaatgagcatcctgcgctgggcgttgtgctcgggatcgtcgacgccgagcagagccacgcgccgcccctgcacgttcgcgaaccgctcggccggaacagggaagtcggcacgggttcggtcggtggacagtcgcggatccgccagcagccgacgggccagggcgtggccggtgaccgcccagaccggacgtccgtcgaagagggtgacccggctcaacggccggtccgcgctgagctgttcgtacccggtgggcgggtggtaggggcactcgcggtcctgcgggaacggtgtcgcggaggccggttgggtcgaagggccggtgagagcggggtcctggcgggccggttccgtcgtggattccgtcatgggagcggtcgcctcgcagtgctcggtgataggtgcggagcgggtcgctccgcccctcactcccaattggatgccccaggcacctattgggtcgacgtccggaccggccacttcgcgggaccgcggatctggccggtgtctttcgcacacggtcgaacggtttcccatccgctcaggtccagcgggtgcggcgagcggcaccggagccggcaccgtcccttccacggccggaaccgttcaccgcgacgtccggaaccttgccgtcggccccctaggccgcgatcagcggaggcgcacgcgtgctgcccgtgccgcacggcgacgcccccgcggaacgcgtcgggtcacgctctcaccttggcgatgaacgccgcgaggttcgccacggttcgctcgatctgctgctccagggtgagggactcgcggagccgtgacccggcacccgcgtccttcttcccgcgcacgtagagcgagcaggcgaggtcgctgcacatataggcgccgaccgagttgccctgctggcccgccttcccggacctgggggccaccagcagggagacgcctccggtgtggacggtcacgcacagcgaacacatgctgcggcgggtctgccaggacccggcgtcggaggagcgcagctggatgccgacgggaccctcgtccgaggcgagcacgaggtaggcccggtcgggggcctgcgggtcgcgccagcccaggaagtccaggtcgtcccagggccggtcggccaggtctcggggaatggacaggcgcttggcctcgcccttggtgcagttcacgaaggcagtacggatctcttgctcggtcaggggcttcatggagctcacgctacgtttgcctaatctcattaggcaaacgtatattttcttaggcaaccgcgggtgagcgttcggagggtcgcatggcacgagcaggactggccgcggaacgcgtcgtacgggcgggggccgagctggcggacgacatcgggttcgagcacgtgaccccgtcggagctcgcccggaagctgggcatcaggaccgcgagcctgtactcgcacgtcaagaacgcccacgacctcaagacgaagatcgccctgctggccctggaggagctcgccgaccgggcgtcggcggcactcgcggggcgggcgggccgggacgcgctcggcgctttagccaacgcctaccgcgac

SEQ ID NO: 3522 - DNA, 1151 bp, Unknown
  Kingdom: Bacteria, Phylum: Actinobacteria, Class: Actinobacteria, Order: Streptomycetales, Family: Streptomycetaceae, Genus: Streptomyces
gcgcagccgggccacctgctcggcgatacggtcgcccgccgcgccgaggcccagctcgtcggtgaccgcgaggagggcggccaggtgcccggcgagctggatgtccagctcctcctcgcggctgcggtgcggaaagtccgcgtcgtcggccggggtgtggaccgaggggctgcggatcggctcgtacatggatggcctcccgatggtgcgtggaaccatcctacattggaatgagtctaaagttgtgtccggtccggaagagtgatgggcctaaggctgtccgtaaccgtccaggaaggtgccgatccgggtcacggcgtcggtcaggtcctcgaccgtcggcagggtgacgatccggaagtggtcgggctcgggccagttgaagccggtgccctgcacgaccatgatcttctcggcccgcagcaggtccagcaccatctgccggtcgtccttgatcttgtagaccttgggatcgagccgggggaagagatacagcgcccccttcggcttcacacaggtcaccccggggatcgaggtcagcaggtcgtacgccacatcccgctgctccaggatccggccgcccggcagcaccaggtcctggatcgactgccggccgccgagcgccgtggccaccgcgtgctgcgagggcatgttggcgcagagccgcatgttggcgaggatcgtcagcccctcgatgtacgaggtggcgtgcgccttcgggccgcagacggccatccagccggagcggtagcccgccacgcggtagttcttggagagcccgttgaaggtcagcaccatgaggtccggggccagcgccgccgtcggggtgtgggtcgcgccgtcgtagaggatccggtcgtagatctcgtcggagcagacgaccaggttgtgccgccgggcgatctcggtgagaccgcgcagcatctcgtcgtcgtacaccgcgccggtcggattgttcgggttgatgatcaccagggccttggtgcggtcggtgatcttccgctcgatgtccgcgaggtccggcatccagtcggcctgctcgtcgcaccggtagtgcacggccgtaccgcccgccagcgagaccgaggcggtccacagcggatagtcgggggccggtacgagcacctcgtcgccgtcgtccagcagcgcct

SEQ ID NO: 3523 - DNA, 4574 bp, Unknown
  Kingdom: Bacteria, Phylum: Actinobacteria, Class: Actinobacteria, Order: Streptomycetales, Family: Streptomycetaceae, Genus: Streptomyces
cacgcggaccggccggagcgcgagcccggcacctcgctccggtgatccacgtcgtgaggggacgcccgacccccgaggaactggccgtcgtcatcaccgtgctgctggcccgccaggagggcggcaccccggcacccgacccggcgcgccgggccaccggtcggcgacgcgtcgtgcggacccctggctacccgtcaccccgcagttggcagtcgcgcgcggatgggtgaaagcgcccgggcgcggcggtcgcacgccgagcccccaacccgaacaggagagcactgatggatgctgcattggacgccgaggtcgtgatcgtcggcgccgggccgaccgggctcatgctcgcgggggagctgcgcctggccggggtcgaggtcgtcgtgctggaccggctggccgagccgaccaccgaatcacgcggcctgggcttcaccccgagaaccatggagatcttcgcgcagcgcggcctggtggaccgtttcgaggggccggctctgccgctccagaccaccacccgcggccacttcggcggactgccgctggacttcgggatcttccccgacgcccatccggccgtcgtgaacctcccgcaggtccacaccgaggcgatgctgcgcggctgggtcgcggagttcggctgtgatctgcgccgtggccacacggtcgtcggcctggccgacaccggcgaggctgtggaggtctcggtcgagggtcccgacgggccgctggtgctgcggacgcgctacctggtcgggtgcgacggcggccgcagtacggtccgcggcctggccgggttcgacttccccggcacccccgccaccctcgaactcttcctcgccgacgtacggggatgtgccatccggccgcgcttcatcggggagtggctgcccggcggggtggcgatgtcggctcccatcggtgacggcatcgaccggatcgtggtgtgcgaacggggtaccgctccgcaacagcgcgccgagccaccggagttcagcgaggtcgcagccggctggcagcggctcacgggggaggacatcggccacggcgaaccgctgtgggtgagcgccttcggagacgccacgcggctggcgaccgagtaccgcagggggcgggtgctgctcgccggtgacgccgcgcacgtccacctcccggcgggcgggctcggcatgaacaccggtatccaggacgccttcaacctcggctggaagctggcggcagtggtgcgcggacaggcccccgacgccctgctcgacacgtaccacgacgagcgccacgcggtgggcagccggctgctcaacaacacccgcgcccagggtctgctcttcctgggcggtaccgagatgcagccactccgcgacgtgatgggtgagctcaccggccacgaggtcgtgcaccggcacctggccggcatggtcagcgggctggagatccgctacccggtcggcccgggcgaccacccgctgctcgggctgcggatgcccgacctcgaactggccgacgagacgggcccgaccacggtctacgcgctgctgcgcacaggccgcggcctggtcctggacctcaccgacgacgcgtccgtacgacggaccgcgcggccgtgggccgaccgggtggacgtggtgaccgccaagccggccgccgatgcctcggcgccgcgggtggacgccgtgctggtacggcccgacgggcacgtggcctgggccgcgcccggcggccaggaggagctgaccgacgcgctgggccgctggttcggcgctccggccgccccgctggactgagagcacagggaggacgcggatgacgcaggacgcaggtacctggagccgcctcgcggaccggatggacgtccgggagctggtcgaccgctatctggcctgtctggacgaggcggagttcgacgacgcctgggcacggtcggtcttcaccgaggacggccggttccagttcctgatgggcggtcacgagggggtggccggcatggcccggttcaccgcctcgatgatgggcaagtggcgccgcacccaccacgtggcggccggccacctggtcgagatcgacggggaccgggcccgggtgcggggaaacctgatcgccacccacctgcaccccgaggagaagccgcccggccggccgggcgggcaagagacgccgggggctcccgagcccttccaggtcggggaccgcttcgagggcgaggcggtgcgcaccgacgccggctggcgcttcgcgcggctcgcgttcgaggtggtctggacccgcggcacaccgccggggcgcgtcgccatccacgacaactaggggcatgtacgtgcgcattctcatcgcggtcgcaccgctgaccgctcacctgtaccccagcatcccgcttgcctgggcgctccagagtgccgggcacgaggtgcgggtggcgagcaacaccgcactggccggggagatcaccgcggccggtctgaccgcagtcgatctcggtgaacgcacctctccgcccgcgcccgtcaccgacgcggcgctggcccgcttcagcgacgcgctcgggttcgaggccggctccgacttcgaccagctctggcgcgccaccggctactacctgctggcggcgtacgggcgttaccacccggacgaggagggacgccaggagctcgcggaccacctggtcgaggccgcccggagctggcggccggacctggtgatctgggacccggcgtgtccggtgggctcggtcgcggcccgcgagagtggggccgcgtccgtccggatgatgtggggtcccgactacttcggctggatccgccaccgcctggccgagcggctgggcgacccggcgtccggggtgagcgcgcggacggacccgctggccgccctgctggcaccggtgttcgggcggttcggccacgacgtctccgaccacctgctcttcggtgacctcacggtggacccgatccccgcgcagctgcccagacccgccggggtgcgccggatcccgatgcgctgggtgccgtactccggtgccgctccggtgccgcgctggctctcgcagccgccctcgcgtcctcgggtctgcctctcgctgggcgtcaccgggcgtacggtccgcgacgggcgggacccgcggatcacggccgccttcgaggcggtggccggcatggacgtcgaggtggtggccacggtcaccgccgcccaggtgggggacgggccggtccccggcaacgtacggatcttcgactacctcccgctcacccagctgatgccgacctgcgcggccgtcatccatcacggcggcttcggcacgttcttcgcggcggccgcgcaccgggtgccccagatggtcgtcatggaggagctgggcagcgcgctgaccagcacccgctacctggaggccaggggtgccggcgtggtcctccccagcgacggtctgaccgccgggcaggtggccgacggcctctccaggatgctgaccgaaccgtcgttccggcagggggccgccgccgtctacgcggacctgactgccgctcccggccccggcgagatcgtgccggtcctggagcgggtggccgcgcagcaccgcgagagggactgaccggtcatggacgtggtcgaggtccgggtgccgggcgcgtacgtgttcaccccgaagcagatccgcgacgagcgggggacgttcttcgaggcgttccgctccgaccgggtcgaggcggtcaccgggcgcccgttccggcccgaacagatcaactactcggtctcccggctgaacaccctccgcggcatccacggggtggccgtaccgccgggacaggccaagtacgtcacctgcgtgcgcggggcgctccgcgacatcgtcgtcgacctgcgggtgggctcgcccaccttcggcgagcaccacgtgaccacactggacgccgactccggccggtgcgtgtacgtgccggaaggcgtcgggcacggcttcctctccctcaccgaggacgcctgcatctgctacgtggtctccacgccgtacgtgcccggcacacagatcgacctcgacccgctcgaccccgacctggcgctcccgtgggggttcagcgagccgcctctgatgtcggagaaggacgcgaacgcgcccggggtgcgagccgcgctcgccgcggggtcgctcgccgactggcatgccgtgcgctgatcccgccggacggacggggcggagacgacttttcggggccgcctcttcggccaccccggccgaaaatcgggtcttgacctcaattcagcttgaggttctagggtttggccgtcccgcgccaaaagacaacgcaatggagatcgaattgactaccgacggcggtcagccggcagcaccacaggcgacccggagagaatggctggggctggcggttctcgcgcttcccaccatgctcatcgcgatggacctgacggtgctgcacctggcgttacccacactcagcgcggacctgcggcccggcaacaccgagttgctgtggatcgtggacatctacggcttcctcatcgccggcttcctcatccccatgggcgcgatcggtgaccggatcggccgccggcggctgctgctc

SEQ ID NO: 3524 - DNA, 4912 bp, Unknown
  Kingdom: Bacteria, Phylum: Actinobacteria, Class: Actinobacteria, Order: Streptomycetales, Family: Streptomycetaceae, Genus: Streptomyces
ctcctgcggcccgccgggcacgaccgcgccgccctcggccccgaactgctcgtccagggcgaggccaacccgctcttccgggtccgctacgcccacgccagggcctgtgccctcacccgcggagccgccctcctcggcttcaccgccgagcccgcagggcacgttccgtacgccgaacgcgcctcggacagcgaaagccacgccgggaccgccccgcgcgccgggcacgtccagcactctccgtacggcgagcacgccccgtacggcgaaggccccctcccgtacgacggcgcggcccgtcccctcctcgacctcatcgccgaccaccccggcgtcctgctcgccggggcccgtcaccgtgcgcccgaccgggtcgcccggcagttggaagccgtcgcgcacgcgttcttcgacttccacgactcctgcccgccgctgcccgccggtgacgagaaaccctcggccgcccaccgtgcccggctggctctcgccgaagccgccgggacggtgctggcaggcggcctgtccctgctcggcatccgtgcgcccgaacacctctgacgcgatcagaagagacccgagagaacaccacgatgagccgctccgcacaccccgcaggaccccgtcacgccgacgtcttcaccgagggccactacaccgcgcccgccgccgacctcaacgtcctcgacgagaaggtctggtcgcgcaccgtcacccgcgacgcggacggcgctctcaccgtcggcgggatcaccgtcgcccggctcgcggaggagttcggcacccccgcctacttcctcgacgagagcgacttccgggcccgttgccgcgcctggtccgaggccttcggtccggacgccgacgtcttctacgccgggaaggccttcctctcccgcgccgtcgtgcgctggctgaaggaggaggggctgaatctcgacgtctgctccggtggtgagctgaccaccgcgctggacgccgggatgcccgccgagcgcatcgccttccacggcaacaacaagaccgtcgccgagatcgagcgggccgtcgaggcgggcatcgggcggatcgtgctcgactccttccaggagatcgtccgcgtcgcccacatcgctcagcggcacggcgtccgccagcgcgtgcagatccgcgtcaccgtcggcgtcgaggcccacacccacgagttcatcgccaccgcgcacgaggaccagaagttcgggatcgcgctcgccgacgggcaggccgccgaggcggtgcgccgcgccctctccctcgacggcctcgacctcatcggcgtccactcgcacatcggctcgcagatcttcgacatggccgggttcgaggtctccgcccggcgcgtggtgcagctgctcgccgagatccgcgacgagcacggcgtcgaactgcccgagatcgacctcggcggcggcctcggcatcgcgtacacctccgaggacgacccccgcgagccgcacgagatcgccaaggcgctccgcgacatcgtcacccgcgagtgcgagtccgcgaagctgcgcaccccccgcatctccgtggagccgggccgcgccatcgtcggaccgaccgcgttcacgctgtacgaggtcggcacgatcaagcccctggaggggttgcggacgtacgtcagcgtcgacggcggcatgtcggacaacatccgcaccgcgctgtacgacgccgaatacagcgtcgcgctcgtctcccgcacctcggatgccaaacccatgctcgtccgggtcgtcggcaagcactgcgagagcggcgacatcgtggtcaaggacgccttcctccccgccgacctggcccccggcgacctgatcgccgtccccgccaccggcgcgtactgccgttccatggcgagcaactacaaccacgcgctgcgcccgccggtcgtcgcggtccgcgacggagaggcacgcgtcatcgtccggcgcgagacggagggagatctcctgcgtctcgatgtcggctgatgaaatagtcatctcaggatccggacgagggtcagaaacccccgtccggtgagtgagactggtccacacatgagtatgaccctccggcgatggggggtgggagaaggagcggggttgggtgcgtgcagctgcgaggcggaggattgaggcatggcggagccatggtgattgaccacaacgccgcagctgtgcgtgcccagcaccgcgacaccgctcccccgtcgccggagggtctaggtatgagaaacgaggtcggatgatgcgtacgcgtccgctgaaggtggcgctgctgggctgtggagtggtcggctcagaggtggcgcgcatcatgacgacgcacgccgacgacctcgcggcgcgcatcggcgcgcccgtcgagctcgtcggcgtggccgtccgccggccctccaaggtgcgtgagggcatcgaccccgcactgatcaccaccgacgcgaccgcgctcgtgcagcgcggcgacatcgacgtcgtcatcgaggtcatcggcggtatcgagccggcccggacgctcatcaccaccgccttcgagaacggcgcgagcgtcgtctccgccaacaaggcgctgctcgccgaggacggcgcggccctgcacgccgccgccgagaagtacggccgggacctctactacgaggcagccgtcgccggagccatcccgctggtgcggccgctgcgcgagtcgctcgccggggacaaggtcaaccgggtgctcggcatcgtgaacggcacgaccaacttcatcctcgacaagatggacaccagcggcgccggctactccgaggcgctcgacgaggccaccgccctcgggtacgcggaggccgacccgaccgccgacgtcgagggcttcgacgccgccgcgaaggccgcgatcctcgccgggatcgccttccacacccgcgtgaagatcggcgacgtgcaccgcgagggcatcaccgaggtcaccgccgccgacatcgcctccgcccgccggatgggctgcacggtcaagctgctggccatctgcgagcgcgccgccgacggcgcctccgtcaccgcccgcgtccaccccgcgatgatcccgctcagccacccgctggcctcggtccgcgaggcgtacaacgcggtcttcatcgaggccgacgcggccgggcagctcatgttctacgggcccggcgccggcggctcgccgaccgcctccgcggtcctcggcgacctcgtcgcggtctgccgcaacaaactgggcgaggccaccggtcccggtgagtccgcctacacgcgcctgccggtcagccccatgggcgaggtcgtcacgcgctaccacatcagcctcgacgtggccgacaagccgggcgtgctcgcccaggtcgcgacggtcttcgccgagcagggggtatcgatcgataccgtccgccagcagggaaaggacggcgaggcgtccctcgtcgtcgtcacccaccgcgcgcccgacgccgccctctccgggaccgtcgaagcgctgcgcaagctcgacaccgtgcgcggtgtcgccagcatcatgcgtgttgaaggggagtaaaggacccatgaccagcaagggcacccaccagtggcgcggcatcatcgaggagtaccgggaccggcttccggtcacggccacgacgccggtcgtcacgcttcgtgagggcggtacgccgctcgttccggcgcaggtcctctccgagcgcacgggctgcgaggtgcacctcaaggtcgagggcgccaaccccaccggttcgttcaaggaccgcggcatgaccatggccatcacccgggccaaggaggagggggcgaaggccgtcatctgcgcctccaccggcaacacctcggcctccgccgcggcgtacgccgtgcgcgcggggatggtctgcgccgtcctcgtaccgcagggcaagatcgcgctcggcaagatgggccaggcgctcgtgcacggcgccaagatcctccaggtcgacggcaacttcgacgactgcctgaccctggcccgctcgctctcggacaactacccggtggcactggtcaattcggtcaatccggtccgcatcgagggccagaagaccgccgcgttcgagatcgtcgacgcactcggcgacgcccccgacatccacgtcctgccggtcggcaacgcgggcaacatcaccgcgtactggaagggatacaccgagtacgccggtgacggagtctcgacccgctccccgcgcatgtggggcttccaggcctccggctccgcgcccatcgtgcgcggcgagatcgtcaaggacccgtccaccatcgccacggcgatccgcatcggcaacccggcctcctggaactacgcgctggccgcacgtgacgagtcgggcggtttcatcgacgaggtgacggaccggcagatcctgtccgcgtaccggctgttggcctcccaggaaggcgtcttcgtggagcccgcgtcggccgcgtccgtcgccggcctgctcaaggccgccgaggagggcaaggtcgaccccggccagcgcatcgtctgcacggtcaccggcaacggcctcaaggaccccgactgggccgtcgcgggcgcaccgcagccggtcacggtcccggtcgacgcggccaccgccgcggagaagctcggactcgtctgatccggtcccgggccgggcgtcggcaggcgccgcggccggtccgggcaaccgcgacaacccgctcaaccagctcctttccggggcggagagcgcatgagaggcgggcgacacgcatcgtgcgcctcctgtgcgccctatgtcgccacagaaccttccttcgataagctgtaccccatccgcccggcatccgcccgccggaccgccaggcctgcggtccccgtcgtggccgtcgggccggccgccggattcccgcaccgtttcggagccctccgcacagccgcgacccccaccgccatgacc

SEQ ID NO: 3525 - DNA, 7949 bp, Unknown
  Kingdom: Bacteria, Phylum: Actinobacteria, Class: Actinobacteria, Order: Streptomycetales, Family: Streptomycetaceae, Genus: Streptomyces
cggcggcgacgagttcgccgtcctgctgccgcacaccgactcgaccaccagcgcccagcaggtcgcccgtcatctggtcgccgaactgtcctccccgctcgacctcgacggactgaccctcgtcctggaggccagcgccggggtcgccgtctaccccgatcacgcgctggacgccgagggcctgctgcggcgggcggacgtcgcgatgtaccaggccaagcgggaccgcacgggcgtggaggtctacgagtccaagcgggacagcaacacccccgaccggctcggactcctcggcgacctgcgccgggcgctggacgcgagcgaggtcgagctgcactaccagcccaaggtccgcttcgacgggcaggtcgccggcctggaggcgctggtgcgctgggtgcacccggagcgcggccgggtccccccggacgagttcatcgccatcgccgagtcctccggtctgatgccgcacctcacggagtacgtcctggagacggcgctcgcccaggtcgcccgctggcgggcccagggcctgttcgtgcccgtcgcggtcaacgtctccccgcgcgacgtccacaccccaggcttcgcgggcggcgtcgcggcccgtctcgcgcgtcacggcgtgcccgcgggagcgctccaactggagatcaccgagcatgtgctgctggaggacccgcagcgcgccgccgacaccctggccgggctcaccgcgcacggcgtgaagatgtccctcgacgacttcggtaccggctactcctcgctggtccacctgcgcagactgccggtcagcgagctgaagatcgaccggtccttcgtggcccggctggcggtcgaccacgaggacgcggagatcgtccgctgcaccatcgacctggcccactcgctcggcctggtcgtcgtcgccgagggtgtcgaggacgacgagacgtgggagcggttgcgggacctcaggtgcgacgcggtgcagggctggctggtggcggccgcgatgccgccgcaggagacgacggcctggctgcgggcgcgcggcgagcacggctggcgcaggcccgccgagctgaaggcccaggcggcggccgccgctaccgggtcggccaccggctcgatgaacgcgtcgctgaacggtgcggtgaatggtgcggtgcagggcgcggtgaacgggacggcggagaccgaaagcccctgaaggtcgccccgcggaacaccttcgtccgagccccgggccccggcccggggctcacccctttccgggcgccgccgcccggaatggcgtagcccgatcggggcggggcacccgtcccccggagaccccataggattgggggccggtgggaaatgtgccaccggccccggccaaaaccacacaccaacccctgaggatcgctgcatgcctggcatcacgcgcgaggaggtcgcccacctcgcccggctggcgcgtctggagctgaagggcgaagagctcgatcacttcgccggtcagctcgacgacatcatcggcgcggtcgcccgcgtctccgaggtcgccgaccaagacgtaccgccgacctcccacccgctgccgctgaccaacgtcatgcgcgcggacgaggtccgtccgtcgctcacccccgcgcaggcgctctccggcgccccggcccaggagcagcagcgtttcaaggtgccgcagatcctgggggaggactaaccgccatgacggacatcagcaccatcatcaagctcaccgcggccgagatcgccgggaagatcgcctccggcgagctgaccgccgtcgaggtcaccgaggcccacctggcccggatcgacgcggtcgacgagaaggtccacgccttcctgcacatcgaccgcgagggcgcgctcgcccaggcccgtgccgtggacgcgaagcgggaagcgggcgagaagctcggcccgctggccggagtcccgctcgcgctgaaggacatcttcaccaccaaggacatgccgaccaccgtcggctccaagatccttgagggctgggtgccgccgtacgacgccacgctcacgcggaagctgcgcgccgccgacgtcgtcatcctcggcaagaccaacatggacgagttcgccatggggtcctccaccgagaacagcgcctacggccccaccggcaacccctgggacctcacccgcatccccggcggctccggcggcggctcctccgccgccctcgcctcctacgaggcgccgctcgccatcggcacggacaccggcggctcgatccgccagcccgccgccgtcaccggcacggtcggcgtcaagcccacctacggcggcgtctcccgctacggcatggtcgccttctcgtcctccctcgaccagggcgggccctgcgcccgtacggtcctggacgcggcgctgctgcacgaggccatcgccgggcacgacccgctggactcgacgtccatcgacgcgccggttccgccggtcgtcgaggccgcccgcaacggctccgtacagggcatgcgcgtcggcgtcgtcaagcagttccgcggcgagggctaccaggccggagtggtccagcggttcgacgagtcggtcgagctgctgaagtcgctcggcgccaccatcgtcgagctggactgcccctccttcgacctggcgctctccgcgtactacctgatcgcgccgtccgagtgctcctccaacctggcccgcttcgacgccatgcgctacggcctgcgggtcggcgacgacggcacgaagtcggccgaggacgtcaccgcgctcacccgcgaggcgggcttcggcgacgaggtcaagcgccgcatcatcctggggacgtacgcgctcagctccggctactacgacgcgtactacggttcggcccagaaggtccgcaccctcatcacccaggacttcgagaaggccttcgagcaggtcgacgtgatcgtctccccgacgacgccgaccaccgccttcccgatcggcgagcgcgccgacgacccgatggccatgtacctcgcggacctgtgcaccatccccaccaacctggccggcaactccgccatgtcgctgccctgcggcctggccccggaggacggtctgccggtcggactgcagatcatcgcccccgccatgaaggacgaccggctctacagggtcggagcggccgtcgaggccgccttcgtggaaaagtggggccacccgctgcttgaggaggctccgtcgctgtgagtgccatggcaaagaaggccagtaacttcaagaagtccaagaccgggctgtacgtctcgctcggcagtaccgcgttcggcgcgatcagcatcgtcaagcaggcgaagctcgcgcgcgaggacaacgacgtgctgcggctcgtcgacgcggcggtctccgcggccgccatcgtcaccggactcgcgatcctctatcgcgaactgaagcgtctcggcgacgacgacgttctgctgggctgagagggaaagtttcaccgtgactgtcactgacctggtgtcgtacgaggacgcgctcgcgtcctacgaccccgtcatgggcctcgaagtccatgtcgaactcggcaccaagaccaagatgttctgcggctgctccacggagctgaagcaggacgccaactcccagacctgcccggtctgtctcggactgcccggcgcgctgccggtcgtcaacgagatcggcgtggagtcggccatcaagatcggtctcgcgctcaactgcgagatcgccgagtggtgccgcttcgcccggaagaactacttctatccggacatgccgaagaacttccagacctcccagtacgacgagccgatcgcctacgacggctatctggacgtccagctggaggacggcgagatcttccgggtacagatcgagcgcgcccacatggaggaggacaccggcaagtcgacgcacgtcggcggcaccaccggccgtatccacggcgcgtcccactccctgctcgactacaaccgggccggcatcccgctcatcgagatcgtcaccaggccgatcgagggagccggcacccgcgcccccgaggtcgccaaggcgtacgtcgccgagctccgcgagctgatcaaggctctcggggtctccgacgcccgcatggagatgggccagatgcgctgcgacgtcaacctgtcgctgcgcccgcacggccgcgaggcgttcggcacccgctccgagacgaagaacgtgaactcgctgcgttccgtcgagcgggccgcgcgcttcgagatccagcggcacgccgccgtgctgtcctcgggcggcacgatcgtgcaggagacccggcacttccacgaggaggacggctccaccacggccggccgcatcaaggacaacgccgaggactaccgctacttccccgagccggacctggtgcccgtggcgccggcccgcgagtgggtcgaggagctccgcaagggtcttcccgagcttccccggctgcgccgggcgcggctcaaggaggagtggggcgtcaccgagcacgacatgcagtccatcctcaacgcgggcgcggtcgacctgatcgtcgccacgaccgaggcgggcgcaccctcggaccaggcccgcaagtggtggatgggcgagctggcccgtaacgccaacgagaccggccgcggtctggacgagctgccgatcaccccggcgcaggtcgcccgggtggccgcgctcgtcgccgcgggcgacctcaacgacaagctggcccgccaggtcatcgagggcgtcctcgcgggcgagggcgacccggacaccgtcgtcgagaagcgcggcctgaaggtcgtctccgacgagggcgcgctgtccacggccgtggacgaggccatcgcgggcaacgcggccatcgcggacaagatccgcggcggcaaggtcgcggcggcgggcgcgctcgtcggcgcggtcatgaaggccacccgcggccaggcggacgcggcacgcgtgcgcgagctgatcctggagaagctcggcgtcgagggctgatcacctgatcgtccccgaaggggcggtgtacccgtacgtactcatccacgtgcgggcgcaccgccccttcagccgtcctccgccgaaccccgaggtccaccctgaacaccgtcaccgccgagctcgtctccttcgccctgctgctgggcgtcctcgccttcgccgtcgtacgcccccggggcctgccggaggcgaccgtcgccgtgcccgccgccgctctcgtggtggccctgggggcggtgtcctggcccgaggcccgcgagcaggtcggcgagctgctgccggtcgtcgggttcctcgccgcgatcctggtgctggcccagctctgcgccgacgaagggctgttccgcgccgccggggatttcgtggcccgtgcctgccgggggcagaccggcccgctcctcggcggcgtcttcgccgtcgcctcgatcgtcaccgccgtcctcagcctggacgccaccgtcgtcctgctcaccccggtcgtcctcgccaccgcagcccgggtcggagcgcggccgcgcccgtacgtctacgcctgcgcgcacctggccaactccgcctccctcctgctccccgtctccaacctcaccaatctgctggcgttcaccgcgagcggcctctccttcacccggttcgccgcgctgatggcgctgccgtggctcgccgccatcgccgtcgagtacgccgtgttccgccgcgccttcaaggccgacctggccgccggggcgcacgcgccggatcccgacgcggagcgcacgcccgtcccggtcttcacgctcgtcgtgctggcgctgaccctggccgggttcgtcgtgacctcgttcgagggggccgagccgctgtgggcggcgctggcgggggctctggtgctggccgtccgggcgctggccaagcgggagaccacaccgctcgccgtcgtccgctcggccaacccgctgttctgcctcttcgtcctcgcactcggcgtcgtcgtccaggccgtcgtcgacaacggtctcggcgacggcatcgccgccctgctgccggacggcgactccctgcccgcgctgatcggcgtcgccgtggtggccgcgctgctcgccaacctgatcaacaacctgcccgcgatcctcgccctgctgccgatcgtcgcggcggccgggcccggaccgctgctcgccgccctgatcggggtgaacctcgggccgaacctcacgtacgtcggatcgctggccaccctcctgtggcggcgcatcctgcacgcccacggggacgccccggagctcggccacttcacccggctgggactcgcgaccgtaccggcgacgatcctggcctccacgctcgcgctctggggatcgctgcacctcatcggggtgtgagcgggtcgacacgaggggttggacttccggaccgacctcttggacgttcaccaccggtccgtacgcagtccttcccgacgccacctgggctgactagcttcccggctgtaaccaccggaaccaggaggctcctttgaccacggacatgtcacggcgacggctcttcgcgctgggcggcggcgcactcggcgccgctgcggccggatcgttcctgccgccgtcgctccaggccgccatcgccgcgcagcccgcccacgcggggtccggcgggggaggcctcggctccatcaagcatgtggtgatcctgatgcaggagaaccgttccttcgaccactacttcggcaccctgcgcggcgtgcgcggcttcggtgaccgcaacgccatcgagctgcccaccggcgggacggtgttcgaacagcccgccgctgccggctccaccgtgctgcccttcccggtgcgcggagcggccgaggagcagaagaaggacctccagtacatcggcgccctcgaccactcctggaacggcggcgcgagggcctggggcggcggctggatgaacggctggatcagcgcgaagaccgcggccacgatggcgtactacgaccgccgtgacatcccgctccactacgagctggccgacaccttcaccgtctgcgacgcctaccactcctcgatccacacctccaccagccccaaccgcaaccacctctggagcgggaagaccggcttcgagccgaacgggaagcgggctgtcggcaacgacgcgtacaacgagggaacccaccccggctacgactggtccacctacgccgagcggctggagaaggccggtcgcagctggcggacgtacaccgagtgggagaacttcaccgacaaccagatcgagttcttcgccaccttcaaggcgatcgcccgcaaggcgctcgccaggaccggcgggcacacctacatggaagccttctacgcgaaggtccgggacgcgtccgagaccgagcgcacccggctcctcgggctgcttgaggagggcgtcgccaccctcgaccggcgcgagcgcagcctgttcgagcggggactgcgccgggttccgaccgggacgctggcggacgagttcgccaaggacgtggcggccgggacgctccccgcggtctcctacctggtcccctcggcgatcgactccgagcacccgagcacctcgtcgccggtgcacagcgccaccatcgtctacaagatcctcgacgcgctcggcaagcaccccgacgtgtggcggcacaccgccgtgctcatcaactacgacgagaacgacggattcttcgaccacgtcccgccgcccgtcgcacccgccgaggtcgccgacgaacagtgggagggccggcccaccggcctcgggatccgggtgccgctgctggtcgtctcgccgtggaccgtcggcgggtacgtctgctccgaggtcttcgaccacacctccgtgatccgcttcctggagcgctggaccggcgtgcgggaacccaacatcagcgactggcggcggcgcgtcaccggcgacctcacctccgccttcgacttcacccgggcccggcggcagcccgccgtcgagcagccgggggcgatcccgccgctgagtggacg

SEQ ID NO: 3526 - DNA, 4972 bp, Unknown
  Kingdom: Bacteria, Phylum: Actinobacteria, Class: Actinobacteria, Order: Streptomycetales, Family: Streptomycetaceae, Genus: Streptomyces
ggtcggcctcgaccagcggggccacggccgcagcgacaagcccgccgacggcccgtacacccgcgacgcctacgtctccgacgccgaggccgcgatcgaacagctcgggctcggccccgtcaccgtcgtcggccacgccatgggagcgctcacaggctggcagctcgccgccaagcgtcccgacctcgtccgcgcgctcgtcgtctgcgacatgcgggcctccgccctcggggcggcctcccagcgcgagtggagcgactggttcgactcctggccgctccccttcgccacccttgccgacgtacggaagtggttcggcgaggacgacccctgggtggagcggccgaacccctcgcgcggcgagttctacgccgaggtgatggccgagcgggaagacggctggcgccccgtcttctcccgccgccagatgctccgctcccgcgccacctgggtcttcgacgcccactgggaggagctggcccaggtccagtgtcccgcgctggtgctgcgcggcctcgacggggagctcggccgcgcggaggcccaggagatggtccgggtcctgccccgcggccagtacgcggaagtggcggacgcgggccacctcgtccactacgaccagccggacggctggcgggccgcggtcgaacccttcctggaacagctcgccgaggacgaccgggacgacgaccgcgaaccggtctccccgtagccccggcggacctgacctgagcggcccggcagcccccggtcctcagcccttgctgaccgccgccaggatctccggcagccgggccgccgtgcgccgcgcggcgatccgcagccccgcccacccgacgagcgctccgtacgcgagcccgcccggcaccaggagccacagcgcgtcgtggtggtccgtgacgtgcatccagatggccggcacgatcaccggcgcggccagcagcgcggcggccagcatgccgccgaggatcgagatccaggccagaccaccctggcccggcaccacgttcttgaacgcgccctcctgcggaatcgagtacgggaacagcgccgaggccaccgcccccgtcgccagcatcgagcccagcagcgcgaaggacaggcccagcgcccccggcagcggtcgccagtcaccgatcaccgccgccgtcaccgcacagacgatcagcgtgaacggcagggtgagcagcagcaggacgaacgcccgcgcccgcagttcgacgtacgcgtcccggggtgaggagatcgtcagcgccaccatccagaaggccgaggtgtcctggccgaactggttgtacatctgcatgccgagcatcccggcggcgaagcacgcgaagtagaccgagccggtgccctggaccgcgttgagcagcggcacgatcgccccgaccgccagcgccgtcacccaggccgccttggtcttcgggtccctcgccacgtaccgcaggctgcgctgcatcaccgtcgcggtgcggccctccggcagcagtgccgacagaccgccgcggccggactcctcacgggccggctcggccgccgccatggtcgaaccgtccggcgaggtcatcagcctcaccaggctccgctgccacatccacatcagcgccgccagggccgccaccgtgatcaggagctgggcgacggcgatcccgtacgaaccgtccgaggccgcgtccaccgacgccacggcggaggcgccggcagccagcgcaccacgtccgccgccgggtccagcgtggagagcccgcccgcctgaccgagccgctgcgcaccgaagttgacgaactggatgcccaccgcgatgaccagcccgctgagcaccgcgaggtcgcggcccttacgggagttcagcagccggacgttggccgtggtcaccgcccgggacagggccacgcagagcagcatcgtcagcgggaccgcgagcaccgcgaacacgatccccgccgcaccgtgcgccagcgcgaggaccgaaccgaccgccaggcacagggtgaacagcgggccgatgccgatcatcgaggacaccagcagggcccggatcagcggctcgggctggagcggaagcatcaccagccgggtcgggtcgagggtgtcgtcaccactggggaagaacagcggcagcaccgcccagccgagcgccacgacacccgtgagcagcaccacgacggtgcccgcgtgctcgttgccgcgcagcaggaccaggcccagcacctggcctgcggcgagcagcagggtgaagaccagggagacgacgaacaccgccctgcgcccggaggactgccgcaggccgttgcgcagcagcgtcagcttcagcgagacgaagaccggggtcagccccgtcgtcggcgccgccggggcggccgaggtcaccggggcgtccagcacgctcatcgggagccgcccagccagtcgagggagtcgccggcgtcccggccgcccgcgccgaccagttcgaggaaggcgttctgcaacgagggggcgtcgccgcgcacctcggccagcgtgccctgcgccttgatccggcccgccgccatcacggcgacccagtcgcacagcgactcgaccagctccatcacatgactggagaagaccacggtcgccccggaccgggtgtagcgctccagcacaccccggatggtctgcgccgagaccgggtcgacgccctcgaacggttcgtccaggaagagcacttcggggttgtggagcagggccgccgcgagcccgatcttcttccgcatgccggtcgagtagtccacgaccagcttgtgctgcgagcccgcgagatccagcacgtccagcaactgggtggcccgcttgtccacctcgtcccccggcaggccgcgcaaccgcccgttgtaggcgagcagttcacgtcccgagagccgctcgaacagccgcaacccctccggcagcaccccgatccgggacttcacctcgaccggatccgtccacacgtcgtggcccgcgacctcgatcttccccatgtcgggccgcagcaggcccgtgaccatcgagagcgtcgtcgtcttgcccgccccgttgggccccaccaggccgatgaacttccccgcgggcagctccagatcgatccccgcgacggcgacctgatccccgaaccgcttccacagcccctgtacgcggacggcgggccgcgcctcccgcgcaccgcccgccgacgcgtccgtctccacgcctgtcttcgtacgtgcatctgcccggtccggcatggcacagcctttcgatatccccatagatggggaccaccctacgaaaggcctgaccggaacccgggagacgccgtccggccgctctacgggacgcgcgtacgggcgtcggccgcctcccgtgcgcaggcgtacgccagtgggctgatcagctcgtccacatcgggcagccaccggttggcatgggtgggcctccgggcccactgcacggccccccgggcgccgacccgggtgggcggcgcggcgacgtagtggccctcgccgcggccggtcaggtcgatcgtcccggcgttccagccgagcccgcgcaccagctcggaggcctgggcggcggcgcccggcagcacgaagaacagcatccggcggtcgggtgtgcgggtgaccgggcccagcgtcaggtccatccgctccatccgggccagcgccaggaaccccgcggactccgggacctccagcgcgtcgaaggcccggccggtcggcagcagcaccgaggcgcggggctgcctggtccacatgcgccgggcggcggccccgctgccggtcgcctggcccgcccagtcgggccggtccgcgtgggccccgggcagggcacagccggcgtcgccgcacgaacaccgttccacgccgcccgccgcctccagccaggtgccggggaacacgtcccaatgacgctcctccgcataccgcacggcggcgtcgagcaggtgctcgccccgctgctgagggacctgcgcggcttcggtgactccgatgggctcttccacgcccagcacaactcccgtcgtcacctggggttacggcctcccctgaaccggggcccggcgcaccgaccccacacgcggggcgcatgggtgcacgagcgggggcgcgcgtgaggtgtcgcaccgaagggcgggtaaccacctccaggaccgccgcccagggccgctcccggacctccgtgacggtgcaacgcgccatgcccgtaccgaatgccgatggaatatgcgcatttcttgtgtatgtgacgggcagtgatcccttccaccgatcactgcacataaccgatgtttcagggggacatatggctgcaaggcctctcgtagcccgccagcccaacgaacggctccagacgctcatccaggaagccgcctgttccaacgcgggcctcgcgcgccgcgtgaacatggtcggggccgagcggggcctcgatctgcgctacgacaagacctccgtggcccgttggctgcggggacagcagccccggggccgggctccggggatcatcgccgaggcgctgggccgcaagctcggacgtacggtcacgatcgacgagatcggcatggccaacggcaagaacctggcctccggcgtcggcctccagtacgcgccgaccgtcgccggcgccgtcgagcaggtctgcgagctgtggcgcagcgacgtgggacgccgcgatctgctcaccgggtcggcggtcgccgcgtccgcgctggtcgaacccagccgggactggctgatctcgggtccggacgcacacgtcgagcggacggcgggggcccgggtcgggatgtccgatgtcgaggcggtgcgggcgatgaccgccgcgctgaccgacctcgaccaccgcttcggcagcggacatgtgcggccggtgctcgtgcactacctcaacagcgtggtctccgggctgctctcgggggcgtaccgcgaacaggtggggcggcagctgttcggcgcggtggcccggctcgccgagctcggcggctaca

SEQ ID NO: 3527 - DNA, 3942 bp, Unknown
  Kingdom: Bacteria, Phylum: Actinobacteria, Class: Actinobacteria, Order: Streptomycetales, Family: Streptomycetaceae, Genus: Streptomyces
ccgcgcggcggcgtccagcacgtcgccgcgaactccttcgacgcacccggcagccgcaggggtgcgctccccggcgtacgggggcctccgggcaggaccaccggtcccacgaccggtcatccgtcctgttctgccgatccggcgccgcgtcctcactgaggtgagggcgctcggcgccccaccggaggatttccatgactcgcgccaccgcggtgcgagcggttctggctgtcgccgtgctgctcgtctccgtctacatcagcctgaccatgtcgcccagactcggcctcgatctccagggcggcacccgtatcgtgctccaggcccgggacaccgccaccgtcgaggcggaccgggagaccaccgaccgcaccctggaggtgctgcggcagcgcatcgactcgctgggcgtctccgagccgaccctgacccggtccggcgaggaccggatcatcgtcgaactgcccgacgtccaggatccgcgccaggccgccgaagtgatcggccggacggctcagctcaccttccacgcggtcgagggcccggcggtcgaggaaccggaggagaagccctcgggctccgaccccaccgccgacccgagtcccaccgccgaccccggttccaccgccgaccccgacgggctgaccctttccgacgagcagggccgcgccctcgccctcggtcccgcccggctctccggcgcgggcgtcgaggacgccaccgcgggcttcgaagcgcaggggggcgcgggctggagcgtctcgctcgaattccgcaaggacgccggccaggactggaagcggttgaccggcgaggccgcctgccatcccgccggggacgaccgccggagggtcgccatcgtcctcgacgagaaggtcatctcctcgccgcaggtcgacccctcggtcggctgccgggccggactgccgtccggcgccacccagatcaccggctcgttcagcgcggacgaagcgcgtgacctggcgctgctcatcaagggcggggccctgcccgtgcccgtcgagatcgtcgagcagcggacggtcggcccgacgctcggcgcggcggccatcgacgcgagtgcccgggcggcgctcatcggcgcagccgccaccgcactcttcatcaccctcgtctaccgcctcttcggcgcgctggccgccgtggcgctgggtgcgtacggggtgatctcctacgccgcgctcgtcgccctcggcgtcacgctgacgctccccgggctggccggtttcgtcctcgcgatcgggatggcggtcgacgcgaacgtcctcgttttcgaacgggccagggaggagtgcgccgaacggccgaaacgctccctgcgctccgcgctgaccaccgggttcacgaaggcgtggagtgcggtcgccgactccaacgcgaccacgctgatcgcggccggactgctcttcttcctgggctcgggtccggtcaagggcttcggggtcacgctcgccatcggggtcatcgcctcgatgttctccgcgctggtcatcgcccgcgcactcaccgagatcgccgcgaactcccgcttcgtcagcgactacaggagcgtgaacggcatcgcgcgccccggcgccgtacggacctggctggtccgcaaggacccgcagctcttccggaaaccggtccgctggctcgtcgtctcggtggccctggtcgccgtcgcggtggccgggatcgtggtgcgcggggtcgatctgggcgtggagttcaccgggggccggctggtggagtactccaccagccggcctgtcgacgtcgaaacggcccgggacacgctcgccgccgccgggttcggcgacgccgaggtcaccacggccggggacggcgacctgtccgtacgcaccgggaagctcgacaacgacggcgaacacgacctgcggacggccctcgccgagaagggcggcgagacgacgaaggttcgggacgagctgatcggcccgagtctcggcgacgaactgcggcgcaacgccctgatcgccctgggggtcgccgtggccgtgcaactggcctacctggcggtgcggttccgttggacgttcgccgtggcctccgtcggggccatggtgcacgacgtgatcctcgtggtgggggccttcgcctggctggggcggccggtggacggcatcttcctggccgccctgctcaccgtcatcggctactcggtcaacgactcggtggtggtcttcgaccgggtacgggagctgtggggggcgaaccggcggacgccgctggacaccatcgcccgtcgggccgtcctccagaccgttccgcgcacggtgaacaccgggatgggcgccctgttcatcctggccgccctcgcggtgctgggcggcgattcgctcgccgacttcgcgctcgccctgctcgtcggcatctgcgtcggcacctggtcctcggtgttcaccgccgtaccgggggccatcctcctggagcggaacgccaagaccccgccgcccgcccccgggaagcggaaggggaagagctcggcacgcgggcgcccgggtgcgtcccggcgcgacccgctcgacaacggagcgcgcgtctgaggtgatcccgcgctccggcgccacgaccggcccccggcgggtcgtggcgccgggggccaggggtcaggacgggacgtgggcgtgcagataggcggccgtctcccggtcggcggggaggaacgtctcgatggccagctcggccaccgtcacgtccatcggcgtgttgaacgtcgcgatcgacgacacgaacgacaggacccggcccccgtgttcgagcagcatcggcagcgcgaacgcggcggcgcgctccggccccgtaccggccgctccggcggcgcggtccgcgccggccgcccgcgcggggaccggatagccggccacctcgtcgtacagctcacgcagctccggcgagcgtacgagggcgatctggcggtccatctgcgccagcaggtccgcccgccactccgggagattcacgatgcgcggggcgagcccctccgggtggagggtgagccgcatggcgttcaccggcggggccagcagcttctccggcaccccttccagcagcaggccgatcccccgattggccgccaccaccccgtagatgccgtccaccacgagcgccggatacggctcgtacgccgcgagcagccggtcgaggctctcgcggagggacgccatcgcggggtcgtcgagcggcgtctgcgcgtagcggggcgcgtaaccggccaccaccaggagggcgttgcgttcacggaccgggacgtccagttgttcggccagccgcaggaccatgtcctcgctgggccgggcgcggcccgtctcgatgaacgagatgtgccgggccgaggagtccgcgcgcagggccagctccaactggctgatacgccgctgctcccgccagtcccgcagcagcggccctactcccgtgtcgggcaagacagtcgtcatgcgaagaccgtaacgtcaccggcgggccggggccggtacgggccgccccggcccgatgttgacgcatgcgccgatccaccgagacccacgggagccgttccatgagcgcagaaccgctgtcgccgaccgagatcgaccgccggctggagagcctgcccggctgggcactggaaggagaccggatcacccggaccttccggctgccctcccacttcgccgccgccgcgctgacggtccacatcgcgcggatccaggacgagctgaaccatcactccgacctgacgctcggatacaacacggtggccctctccgtccacacgcacgacgcgggaggcgcggtcaccgagaaggacctcgcgctcgccgcccgggtggcgtccgccgccccggcgcacggagccgagtagtccggcgggccgaacagcccgcggcagcaccgcggtcggcggcccggacccgcgccgggctcaggccaccgtgc

SEQ ID NO: 3528 - DNA, 1223 bp, Unknown
  Kingdom: Bacteria, Phylum: Actinobacteria, Class: Actinobacteria, Order: Streptomycetales, Family: Streptomycetaceae, Genus: Streptomyces
cgcccgcctcgcgcgcgccgtcctcggcgccggcccccgtacggactgggaggccttcgaacgggactacgccaccatccgcgaccgcatctcgcgcgtcgtccccggcttcgaggacttcaacacccgcgtcgcccgacccggcggcttcaccctcccccacgccccccgcgacgagcgccgcttccccaccgccaccggccgcgccaacttcaccgccgcacccgtcgagttccccgaactccccgacggcaggctcctgttgcagacgctgcgctcccacgaccagtacaacaccaccatctacggcctcgacgaccgctaccggggcatcaagggcggccgccgcatcgtcatggtcaaccccgaggacgccgccgccctcggccttcccgacggcgcgtacaccgacctcgtcagcgagtggaaggacggcgtcgagcgccgcgcggacggcttccgcgtcgtccactaccccaccgcccggggctgcgccgccgcctactacccggagaccaacgtcctggtccccctggactccacggcggacaccagcaacaccccggccagcaaatcggtcgtcgtccgcttcgagaacacccactgaccccgacccggaccggggcaccccggcccgggcccgcccgggaactccccctaagcgttcgctcagccgtctgataagaacagtgcagacagcaacgaacgagcgcaccgaaacggagccggacccatgggcgagcacaccgcacccctcttcccgcaggaagtcatcgacgagtacgcggcactcggcgtcgacctgcccgccctcttctccgccggccacctcggcgagcgcatgggcgtgaccatcgtcgaggcctccgccgaccgcgtcgtcggcaccatgcccgtcgagggcaacacccagccctacggtctcctgcacggcggagcctccgccgtcctcgccgaaaccctcggatccatcggctctatgctccacggcggagcctccaagctcgcggtcggcgtcgacctcaactgcacccaccaccggggagcccgcaacggcctcgtcaccggcgtcgccacccccgtacaccggggccgctccaccgccacgtacgagatcgtcatcaccgacgaacaggacaagcgggtctgcaccgcacgcctcacctgcctgctccgcgacgccccccggcccgaagcggactgaccccaccccggaccaaccc

SEQ ID NO: 3529 - DNA, 3702 bp, Unknown
  Kingdom: Bacteria, Phylum: Actinobacteria, Class: Actinobacteria, Order: Streptomycetales, Family: Streptomycetaceae, Genus: Streptomyces
  misc_feature (3486)..(3487): n is a, c, g, or t
agctgggccacctcgtcggagaatcccgccagcagggtgaactcccggccaccacggccgaactcatcgaccacgcgctggagttctccgagcggaacctgggcgaggtgatggtgccgcgcgccgacgtggcgttcgtccgccgggacgccctagccgccgaggccgtcgagctgatcgcccggcacgggcactccaactacccggtgctcggggaccacccggacgaccccgccggagtcctcggcgtacgggagctgatgcggctgcccgccgccgacgtcgggcgcaccaccgtcggctccctggcccgccgccccctcctgctgccggagctcctcaggctcccggcggcggtcgcgcagatgcgggagcgcgacgacgagttcgccgtcgtcctggacgagcacggcggtctggcggggatcgtcacgtacgaggacatcgccgaggaactcgtcggggacatcgccgacgagtccgacaccgtcgtcgaactcgcggtcgccgaccgctccggctggatcgtggacgcgggccgccgcctcgacgagatcgaggaggccaccggcgtcgaactgccccaggagagcgacgactacgacaccctggccgggctgatcatcgaccggctcggacgcttccccaccgtgggggaccggatcaccgccggagcggtccggatcgaggtgcgcaccctcgaccggcacgtcgccgagtacgtccgcatcgaacccgtcgatcctgccgcacccaccgcacccaccgatcccgccgcacgtacggaacgtggcggacccaccggacgggagccgcaggcatgagcttccccatggcgctcttcgtgacggtgctgctcctgatcggcagcggattcttcgtcgccgccgagttcgccctggtcgcctccaagcgacaccgtatggaacaggccgccgcccgggggcagcgcggggccagggccgcgctcgccgggatgcgtgagctgtcgctgatgctcgcgggagcccagctcggcatcaccatctgcaccctgggcctgggctccgtgtccaaacccgcgatctcccacgagctggacccgctgctggcgcggctcggactgcccgcgaccctcagctacggcatcgccttcgctctggcgatgatcgtcgtcgtcttcctgcacatggtgatcggcgaaatggccccgaaatcctgggccatcgcccacccggagcgctccgcgatgctgctgagcccggccttccgggccgtggtgggcgccgtacgcccgctgatccgcctgctgaacgcgatcagcaacgcgctggtgcggctgtgccgggtcaccccgcgcgacgaactcgcctcggtgcacaaccgcgaccagctcacccacctgatcgaggagtccgagcgcctcgggctgatcagcaagggcgactccggactgatgacccggtccctgaccgaaccggggaccccggtctccgcgctccggatccccgtggagcggatcgcgacggtcccggcggacgccgggctcgaccggatcctggccaccgccgccgaggccgaccgcacccgcctgctggtacgggacggggaggagatcctcggctcggtgcacgcccgggacgccctcgtggcccgcgccggaggccgcgacgtcctcgcccgcgacctggcccgtcccgtcccggaactggcctcggacgcgactgccgcacatgcggtggaacagttgcgcgaacggcgggccacgatcgccgtcgtacgcgacgagggcgggctcaccggactggtcagcctggacgacctgctcgcccggctgctgcacccgccggcaccccccgagcacaccctctagagggtgtcccgctcgatcgtctccccgcggatgacgcggggggacgaccgcggccggccgctgtcctcgtccttgagcgcctgcttctcgctcttgaggatgcgcgcggcctttccggccgaccgcacgaggtcgggcagcctcctcacggccagcaccgccacgatcaccaggaggaggatggtgagttcgccgatcccgaacatggttgctgccttcttctggacgagtgggtgcggagatgtccggatccctgacgggtggccggcagaccgtaatctacaggcctgtagagcatctgtccccggcccttgtcagcgcttccggaggccgccgccgcgcgggaccggcctcggggccgggacgaggcggaacgccgtgttgaggacgtggtcgatcacatcgcgcgagggcttgtccgtcaggtccgtgagcagccgggccagcgtgttgaggaggaacggcgatcccatgacgtaccggttgagcaccggctggaagcccgagcggctgaagatcaggtcggcggcggtgttgcccagccggtagtagcggccccagcggcggttcatctccaccgggtagccgcgcagtacctgttcgcggcggggccctcgggggtgggccagagcgagggccgcggtcccggcggcgacctcgcccgcctccatcgcctgggcgatgccctcaccgttccaggggctgaccatcccgccggagtcgccgaccagcagaagcccgcgcgcgtacagcggatggcggttgaagccgagcggcagggcggcgctgcggaccgggccctccgcgttctcctcgcgcagtccccagtcctccggggtccgggccagccactggtccagggtggcgcgcaggtccgccttgccgtgccgccggtggggaagcgccccgaggccgacgttgacccggccgtcgcccatcggaaagatccagccgtagccgggaagatacgggcccccgtcggggaagcggaggtcggcccacagctccaggtactcctcctgggagcgttcgggactgcggtagtagcgccgggcggccgtcgcgatctgccgccggggatcccgctccactcccagcgccagggcgaggcgggcggacgccccgtcggcggcgatgacgaccggcgcacggaagtcgaccggctccgggacgtccggggagtccgaggacgcggcgaccccggtgacccggcccgcccggtccgtcagcgggcgctccgccttccagccgctgtgcagccgggcccccgccgcaacggcgtgccgggccaggatgtcgtcgaagtcgtgccggctgcgggagagcccgaagtccggataacggcccagcgcgggccagtcgacgtgaacgcggtgctccccggcaacccagcgcataccgcgcgaacgggtccagcccggtgcggtgatgtcgacgcccatccggatgagctggtgcaccgcgcgcggagtgaggccgtcgccgcacaccttctcccgggggaagcgggccttctccagcaggatcacgtccactccggcccgcgccaggtgatacgcggccgaggagccggccgggcccgcccccaccacgatcacctgggcgtcctctcccgtacgggacacctcccgtanntcccgtacgtccgtcgtcgccgggtccggtggcagttcccgcatcacaaccccttcgtcccaacggccgttgctcctgccggggcggcggcccaggacaacatcatcgatcaggacgggccggggcggtaccaggcgtcggaaaacctcgggcgaccgagtgaacaggccgtctacgctccgtcggtgtccactccgccggacgtaacgatcatc

SEQ ID NO: 3530 - DNA, 1725 bp, Unknown
  Kingdom: Bacteria, Phylum: Actinobacteria, Class: Actinobacteria, Order: Streptomycetales, Family: Streptomycetaceae, Genus: Streptomyces
accgggggcttcggacccggtctcgaccgggccagggccgacgcggtggagccggtgctgcgcctgctgatcggccaccgctccgagcccgcggaggcagccggatgacgacgaccacgacgacggacccgggtgcgacggacccggcgggggagacgatggaacggacgacggcacaggcctcggggaccgcgcggcccacctccccgcacgcgcccgacgccgaacggctgcggcgctggcggatggtgctcggcgcggacagcgccgagagcaccgggtgcaccctcacgggccaggacgcggcgatggacggtgcgttgaacgctctgtacggcggtggcgccgggaagaagcccggcggccggggctccggtggccgttcggcgggactgggcgcgtcggcgccctccgtcgctcgctggctcggtgacatccggacctacttccccagctccgtggtccaggtcatgcagcgcgacgcgatcgaccggctcggcctggcggccctgctcctcgaaccggagatgctggaggcggtcgaggcggacgtccacctcgtcggcaccctgctctccctcaacaaggcgatgcccgagacgacgaaggagacggcgcgcgccgtcgtccgcaaggtcgtcgaggacctggagaagcgtctggagagccgcaccagggccaccctgaccggcgccctggaccgctcggcgcgcaccagccggccgcgccaccgggacatcgactggaaccgcaccatccgggccaacctcaagaactaccttcccgtcccgggaccggccgggacgggaggcgcgggggacccgggaggagcgggaggcgccgaggggaggggcacgatcgttcccgagcgcctcatcggctacgggcgcgcctcccggtccgccaagaaggacgtcatcctgtgcatcgaccagtcgggctcgatggccgcgtcggtcgtccacgcctcggtcttcggggcggtgctcgcctccatgcgtaccctctcgacccgcctcgtcgtcttcgacacggcggtcgtcgacctcacggaccagctcgacgacccggtcgacgtcctcttcggcacccagctcggcggcggcaccgacatcaaccgggcgctcgcgtactgccagtccaagatcacccgtcccgcggacaccgtcgtcgtcctcatcagcgacctctacgagggcggcatacgcgacgagatgctcaagcgggtcgccgcgatgaaggcgtccggcgtgcagttcgtgacgctgctcgcgctctccgacgagggggcccccgcgtacgaccacgagcacgcggcggcgctcggagcgctgggcgcacccgcgttcgcctgtacgccggatctcttcccggacgtcatggcggcggcgatcgagaagaggccactgcccataccggacaaggagacccaaccgtagcgagggacttgcgtgacccccacgggctcgtgcgagcatcgacccgtcgttcgcggaggggagcattccgccgcctgcgtgtaccagggaggagccaccgaggtgaccgcaaccgccgctgcccgcgcagccgtcgacccgcgcccggcgcggggtacggcggggcgccgcgcggtccaggcggtgctgttcctcggcgggctgctggccctgggcctcctcgcgggtggccgcgcggaagcgcaggaccgacccgaaccgggcctgctaaccgcctccgtggcgg

SEQ ID NO: 3531 - DNA, 2495 bp, Unknown
  Kingdom: Bacteria, Phylum: Actinobacteria, Class: Actinobacteria, Order: Streptomycetales, Family: Streptomycetaceae, Genus: Streptomyces
cgcccatgtcggcggcggccggtgcggccgctccgagccgccgggcggcagtcgcgtcggcctccgcctgctcctggtcgccgccgccggggaagacccggacgtaggacgcacccaggtcccgggccagcttcaccagctcggacagctccgccaggaccggttcgtcgtccccctcggcagccgccttcacatacccggcgagggccaggatctccaccccgccggccttgaacgcctcgaccacatcggcccgttccagcgacgagagcccgaggtgcaccggctcctcggggtggacgcgcagctccaccccccggtagccgttcccggccgcgagccggacgacctcggagaccggcgttcccggcaccccgagagtggagaatgcgagcttcatcgtgcgtttccttccctagtgccgtcgccccgctcctgcccgccgggccggtggccactcccggacaccgggccggtgatcactcccggacgccggcctcctcagccggtgccccgcagcagtcgctccaggctacccagcagcttcagcgcgtcctcgcgccgcgcaccctccagcacgcccgcgccggacgcagcgcgctgctcgtcctcccgcacccgctccggggtgatcacccgcagggcggcggcggcctgccgggcgaacatcgcgagcaggtccagctcccggacgcccgaccgggcctgcggggaggggtccagcacctccagcacgccgaggatccgggagtcgctgatgagcggggccgccatcagggagttcggcacgtacgcggtcgactcggccagcgagcggtcgaaggccggatcggtgctcaggtcgtccaccaccatcggttcgccggaggtcgccacccacccggcgatcccgcggccggccgggaaccggcggcccacgaggaactcctcgccctgcccggacacggcctggaagaccagctcgtccgcctcctcgtcgagcaggaagaccgaactggcctcggccccgaagatggcgcgggccacatcgacgaccgactggagcagttcgctgcgcggcgcgtcggcgtccggggtggcggtgggggagagggacggggcggaatcagttctcggagtcatcacggatatctcctgccgcagtggaaggacgcggcgtgtggcgcacattcgccgcggacagatagagggcgttcttgagctggaaggccgtcatccggggatgcgccgacaggacgcgggcgcagagcccggcgacgtacggcgtggcgaagctgttccccgtggtgcggatcgtccggccgcccagccacggcacggtcacgttctggccgggaccgaagaactccaccgggggatccgggttgtacagatgcagttcggggtcgtcctcctggtggctgccgaccgagatcaccgaggcgaaccgccaggggaagctctccaccggggtgttgtgggccgaggcgacgatcaccgtccgggcgaagtaggcgctgtcggccaggctgtgcagttcctgggcgaaccgggtgcgggtggtcgacagactgaggttgatcacgtcgaaaccctgctccaccgcccagcgcagcccggccatcaggacgtcgccggtgccggagaaccgctccccgagcacccgcacactgtggatctcgcattccggggcggtccggcggacgatgcccgcgcacgcggtgccgtggccgcaggtgtccccggtggtcgtcggctcgaccgtgatctccccgctccccgcgtccttgacgaccacccaggaaccggccagcgggccgatcagcggatggtcccgctccacgcccgaatccaccacgcacacccgtacgccgcgcccggtggcgggcccggcggggcggccgagcggcggcccggggtccgccagcaccggtacgtcctccgggccacgcccgcgcagactccaggtcagcccctcccccggggtcctgcgtgcacccggggcaggccgcggctctcccggccccgtccgttccggttccgtggtcgtcatcggtcagctcctctccctcgtcgtggccatgggccggggcgggttcgcgaggaagccggagacccggcgcacccccggcagatgccccttgcccgtgaagtgcgccccggccgtccgggccgagacccctgcctccggccaccggcccaggacggcgagcacctgcgcccggtccagctcggccgtcgcctgcaccagcggggagtccgtgagcagcgaggcccggaccgcccggtccgcgtgttccgcagcctcttccgggcggtcccgcaccgccagccgggcccgcagtcccgccagatccaccgcgtccgcacggctaagacccgaggtgtcgccgacacccgccagccgtccggccgcccggtcctcccggcccgcgtccagctccagccgggccgcctccagcgccaccgccgtccgcatcccggccgcacccgtgcgccgggccgccgcgtccgcc

SEQ ID NO: 3532 - DNA, 1293 bp, Unknown
  Kingdom: Bacteria, Phylum: Actinobacteria, Class: Actinobacteria, Order: Streptomycetales, Family: Streptomycetaceae, Genus: Streptomyces
agccaggcccgtcggagccgggcgccccaccggcgcgctgcgccacgagggcgtcgcggatctccttcagcacctccagctcgctcacctccagcgtctcctgcacgccttccttggcagcctgcgaggccgcccgcctcgccaggtacttggccatcggcaacaccatcaggaagtacacgacggcggcggtgatcaggaagccgagagcggcgctgagcaccgagccccacaggatctcgattccgtccatctccccggtcttcgggtccgtggtgcaggggccctggaggcaggagctgtagttgtccaggtcctgggtgccgaacgcgccgaccagggggttgatgacgcccttgacgacagcgttcacgatgttggtgaacgctgcgccgatgacgacagccaccgcgaggtcgatcacattgccgcgcgtcaggaaggctttgaagccctccagcaggctgaccttcttctcgctcacaggtgagccttctttcgcatgggcggtgaggggagcaaactgctccgccacctaaggcgggagaaggcgacactgtccaacccgctaattcccccgggtgacgtgaggggacgtcagttcgcatcggacaccgccacggccagccgtcccgaagtgcccgcgccgaggagcgccgtggccgtcgaccgctccacggacaacaccaccagcgccccggcctccgcccccgctcgtccgatgtcatccgaccctcccgtaccgtccgctccggtgccggaaacgtccgccgtgtgtccgccgggtcctgagcccgggtacggcaccttcgccacgcgcacccctcgcgccaccacgcgcgcttcgtcgtcggcgtcatcgaccgcgatcacatcgacccggtcccccggacgcagtagtcgtaccgtctccgggtccgcgatcctgaccggcgcggagaccagccgcacggacgatcggtcggcccccggcggagcattcggtgggcgggcctctccgccggtgctgctcaggcccgtggtggccagcgcggcacccgccagcgcgatccccgcagcagccgcccgccgctgtcggcgcagcatccggcgcagccggtccgcgccaccgccccgcacgcggaggggtccgaacggccccaccccgcacggcgcgggcaccggcgccggagacggtgaagggcaccgggacaagggtcgggacagggacgccgaggcagaccgggaaggggatcgagacgggaaagtggacgtggacgtggacgtgggcatcggcgtggatgtggacgtcgg

SEQ ID NO: 3533 - DNA, 7374 bp, Unknown
  Kingdom: Bacteria, Phylum: Actinobacteria, Class: Actinobacteria, Order: Streptomycetales, Family: Streptomycetaceae, Genus: Streptomyces
cgcccgccgcccgcgaggtcccggtcgttctggtgaactgtttcgacgcccggggagccctgccctcggtggtccccgacgaggtcgcgggcggccgcaccgcgacccggcggctcatcgaggcgggtcaccggcggatcggtttcatcaacctggacgcgggcattccggcggccgtcggccgccgccagggttacgagcaggcgctgcgcgaggccggcctccccgtcgacgaggacctcatcgccccggggcacgccaccgccgacgccggatacgccgccgcccgcgccctgctggaccgccccgaccggcccaccgcgctcttctgcggcaacgaccgcacggccatgggcgcctacgacgccatcaaggaacgcggactgcgcatcccggacgacatcgccgtcatcggcttcgacaaccaggaactcatcgccgcctacctgcggcccggcctcaccacggtcgccctgccgttcgaactcatgggggcgaaaggcgtcgacatgctcggcgctctcacagcgggcgagccgctcgacaccacacaggtgacggtcgactgcccgctgatcgaacgctcgtcggtctgactgcgaatcagcccgacgggaatcctcacccgtcttcggcctatgtgaagagagagaagagacctcattatgtcatcgtcgatacgtgtccggcgcgcccggagagcagccctgctcgccaccgccgccgccacggccctgctgctctccggctgcagcggcgccgggacgtccggtgcggcggacacctccggcaagcagctcctcaccattccccgtgaggacttcgccaccttcacccgcaacttcaacccgttcgcccccggccaggtggtcgcaccgctcaccagccaggccgtctacgaggcgatgctcgtctacaaccccgccgacgggaagaccaccccgtggctggcgacctcctgggagacggcgcccgacgggaagaccctcaccttcaccctgcgccccggcgtcaagtggtccgacggcaagccgctgaccgccgaggacgtggcgtacaccttcgccctccagaagaagctgctcggcggctacgagtacctggagtcggcgcgggcggaagggacgggcaaggtcgtcctcacgctcaacaagccctactcgccaggggtcttcgagctgggcaagcagatcatcgtgcccaagcacgtgtgggagaaggtgaaggacccggcgaaggagaccaaccccgacccggtcggcacaggcccgtacacccaggtcgccgccttccagagccagtcctacgagctgcggaggaaccccgagtactggcagccggacaagcaggccgtcgaaggtatccgggtcctcggcttctccgggaacgacagcgccaacctcgccttcgtcaacggggaggcggactggacccagtccttcatccccgacgtcgacaagagcttcgtcgccaagaaccccgagcacaacaagtactggtacccgcgcaccggttccctggtcgagtggacgatgaacaccatcaaggcccccttcgacgacgtggcggtacgcaaggccctcagccgggccgtcgaccgcgagagcgtcacgaaggtcggcatgaacggctacaccgaacccgccgactgcaccggcctgtccggcggttacgacaagtggcgcgacaagtccctcgcgaaatcctgcacctggacgaagcacgacgcggccgccgcgggcaaggcgctggacgcggccggatacaagaagggcaaggacggcaagcgcaccctcaggaacggcaagccgttcgccttcgacatctcggtgggatcggcctcctccgactggctctccgtcgccaacatcatcaagcagaacctcgcggagatcggcgtcaccgccaccgtgaaatcccccgactgggcggccgtcgtgagcggttacgagaccggcgactacgacaccggcatcgtctggagcgacaacggggccaccccgtaccagttctaccgcaacaccctgggcaccgaatcggtcaagccggtcggcacccgggcactgaacaactaccaccgcttcggcacgaagaaggccgacgcgctcctcgacacgttcgccgcctcctccgacgaggcgggccagcgcgagcagatcggcgccctccagcggctcttcgacgagcaggcgcccgtggtgccgctctttcccggcccggagtggggctcgtacaccgacacccggttcaccggctggcccaccgaggacaacccctacgccacgctcaccaaccgcggcgacacgaccgtcctggtcctgacgagcctgaagcccgtcaagcgctgacccactcccgtcacccggtggtcccgtccgtcacaccttccggcggggccgccggcccctcagagagggaccccgtgcgttacctcctgcgcaacctgggcttctacctgctggccttctgggcctccatcaccctcaacttcctgctcccgcgcctcatgccgggcgaccccgtctcccggatgttcgcccgctcgcagagccggatgcagccggaacagatcgaacagatccgccgactcttcggcctggacgaccgcccgatgtggcggcagtacatcgactacatcggtgacgtctgcaccgggaacatgggcatctccctgtcccgcttcccgacccccgtctccgaggtcatcgcctcccagatcggctggaccctgctcctcggcggcaccgcgctggtcatcgccgtcgtcatcggcaacctgctcggcatcctcgccgcctggcggcgaggcggcgtcctggactcggtcttccccccgctgctcgtcttcgccggctcgttcccgtacttctggctcgccatgggcgcgctctacctgttcggcatggtgctcggctggttcccgctgcggcacgccttcgacgtcgggctgagccccgaactgtcctggacgttcatctccaacgcctcctcccacctggtgctccccgccctcaccatcgtcctggtgtcggtcggcggctggatgctcggcatgcgcaacacgatgatcgccaccgcggccgaggactacatcaccatggccgaggccaagggcctctccaccggccggatcatgttccgctacgccgcccgcaacgcgatgctcccctcggtcaccaacttcggcatggcgctcggcttcgtcgtcggcggcgcactgctcaccgaggtcgtcttcgcctaccccggcgtcggcttccaactgctcgcggcggtccagggcctggactacccgctgatgcaggggatcttcctcaccatcaccgccgccgtcctgatcgccaacttcctcgtcgacctcgtctacgtccgactcgacccgcgcgtgcgcgtccgctgagcggctgagaaggagaagaccctcatgcgtgtcctcgacccccgagcgacccccgcggcaacggccgccccacccgacggcacgccgcccgcgccgaggcgcggccggaccggactgctccgctccctgctcgccaaccggaaggccctgttcggtgcggccgtcctcgtggtgttcgcgctcctcgcggtcctggccccggtgctcgcccccggcgacccctcgaagatcaacagcaccggcgcgtcggagccctccgccgtccacccgttcggcaccaccgcgaagggtcaggacgtcctcgccctgaccctctggggtgcccgcagctccctgctcgtcggcttctcggtcgggctcgccgccaccgcgctcgccgtgctcgtcggcatggcggccgcctacttcggccggatcaccgacgacctgctgtccctgatcaccaatgtgttcctgctggtccccggcgtaccgctgctggtgatcctcgccgcgttcatgccgcccggcaccaccaccgtcatcctggtcctggtgatcaccggctgggcgggctccgcccgggtgctccgcgcccaggccaagtcgatccggggcaaggacttcgtcgccgccgccgtcgtgtcgggcgaacgcccgctgcggatcatgttccgggagatcctccccaacatggcctcggtcgtcatgacgaccctgctcggctgtgtcatcttcggcatcggcgcccaggccggcctggagttcctcggcctcggcgacgcctccgtcgtcagctggggcaccaacctctactgggccggcaacgacggcgccctgatgaccggcgcctggtgggtcttcgtcccctccggcctctgcatcgccctcgtcgccttcgccctcgcgatggccaactacgccgtcgacgagatcaccaacccccgactgcgcacccgccgcaccaaggcccgggccgtcaccggagtccgggccgtcaccgaggccccggccgccgccaccgaggccccggccgtcacccggaaggagagctgaaccatgacctcgtccttcgacggacccgtactggacgtgcggaacctgcgggtcgcgtacggcggtgacggccgcagcgtcctcggcgccgacgacgtctccttctccatcggacccggtgaggtcttcggcctcgccggggagtccggctgcggcaagtcgaccgtcgccaacgcgatcatgcggctgctgaagccccccgcggtcatcaccggttccgtgagcttcaagggccgcgacgtcctcgccctggacccccgcgaactgcgcgccttccgctggcgcgagatcgccatggtcttccagtccgcgatgaactccctcaacccggtcctcaccgtcggtgagcagatcggtgacatcttcaccacccacgagaagctcaagaagcgccacgccagagcccgttccggagagctcctcgaactcgtcggcatcgaccccacccggctgaagtcctacccccaccagctctccggcggtatgcgccagcgtgtcgtcatcgcgatggccgtcgccctgaagccctcgctcctcatcatggacgagccgaccaccgccctggacgtcgtcgtccagcaggagatcatggcgcagatcggagacctccagcgcgagctgggcttctccgtcctgttcatcacccacgacatgtcgctgatgatcgaactctcccaccgcatgggcgtgatgtacggcggacgactcgtcgaactcgcccccgccaaggcgctgttcgccgagcccctgcacccgtacacccaggccctgatgggcgccttcccgccgctcaccggcccccgcgtccacctctcgggactctccgacgcgcccaggaccgccggcaactgcggcttccacgccgtctgcccggacgaccggtccgactgctcgcaccgcatccccgacctgcgcgaggtggccgagggccgcctcgtcgcccgtaccgccggaggcccgcgatgacgccccaggcacccgccaccaccaccgccgcccgcacgcccgtgatgagcgtgcgcggtctcaccaaggacttcacctccggagggctcttctcccgagcgcgccaccgggccctgaacgccgtcgacctcgacatcccgcacggccggatcgtcgccctcgtgggggagtccggcagcgggaagtccaccctggcgcgctgcctggcccgcctggagcagcccacccggggcgagatccgcctcgacggacaggacgtgctgaggacccagaagcgcggcgcgtcccgcgcctaccgaggcgcggtccagatggtcttccaggaccccttcggctccctcaaccccgtccaccgcgtcgaacacttcctgcgccgccccctgctgctgcacgggaaaccggcacaggagagcgacctgcgcgccctgatgaccaccgtcggactcgacgccgccatgctccagtcctacccgcacgagctctccggaggacagcgccagcgcgtcgccgtggccagggccctggccgtcgacccccgactcgtcctcgccgacgaaccgacctccatgctcgacgtctccgtgcgcgtcggcatcctcaacctgatgcgccggctgcgcgacgagcgctccatctccatgctctacatcacccatgacctcgcctcggcccgctacgtcgccgacacgacccaggtgctgttcgccggggaactcgtcgagggcggcgactcgctcgctctgatggaccggcccgcccacccctacacccagctcctgctctccgccgtacccgacccggaacgcaccgagccctacgacccggttcggcgcgccgccctccgggccgccgtcctcacccccgagtcctgcccgtacgcggccgagggaacctgcagccgcaccacccccgtacgccatgtcatcggcgaggccgacggcgaaccgcactgggtgcgctgccacctctacgcccccgccacccccaccgcgcgccgcgtcctgacggcagcggtgccggaaaccgagaacggctgaccatgacccacgacctcaccctgccccgcgccggccaccaggacgcgccgcagggcctggccgagcgtgccgtgctcgacccgcaccggccccgcttccacttcaccgcccccggcggctggctcaacgaccccaacgggctggcccaccgggacggggtctaccacctcttctaccagtacaacccgctcgccgccgcccaccaccgtatccactggggccacgccaccagccgtgacctcgtcacctggaccgacgaacccgtggccctggtacccggcgccgagggccccgaccgcgacggctgctggtccggcgtcctcgtcgacgacggcggcacacccacgctcgtctactccggccggcacggcgaccgcgaactcccctgcgtggcgaccggatcgcccgatctgcgcacctggcgcaaggacccggccaacccggtgatcgccgccccgccgccgggcgatctcaccgccttccgcgaccactgcgtctggcgggagggcgggctctggcggcacctggtcggctccggcgtccggggtgagggcggcacggccttcctgtacgagtccgaggacctgcgcacctggcggtacgtcggccccctgctcaccggcgacgcgtccaccggcaccgccgccgaccccgactggaccggcaccatgtgggagtgcgtcgacctcttccgcgtcgacggcgccgacatcctcgccttctccgcctgggacgacggcaccacccaccaccccctctactggaccggccgctacgagggcgacacgttcaccccggaccggctgcaccggctcgactacggcgggcgctacttctacgcaccccagtccacccgcgacgaccggggccgccgcatcatgttcggctggctccaggagggccgcgacgaggacgccgcggccctcctggagccag

SEQ ID NO: 3534 - DNA, 4153 bp, Unknown
  Kingdom: Bacteria, Phylum: Actinobacteria, Class: Actinobacteria, Order: Streptomycetales, Family: Streptomycetaceae, Genus: Streptomyces
ccacggccgccggacgggcctccccgcccgtggtcggtggtgtacgacgagcggagttgaggcggtgccgccgggctaaccgatgtcctgttcgcgttcacggtccgcggcctgtcgcagggtgcggtagcggtcgagcgccggtgggtccccggcctgttcggctgcggcgagtgcggcgtcgagaaccccgtccatccagagcctgggaacccctcgcaggtgctcgtcactgacggcgaaccgacgacgggctgtggcgtcgtccggtgtgtgcgcgacgacgaggaagcattccttgacgaaatgccgccacagccccgcgcgcgacccccgcttctcggcgggcatgacgttccgcgtctcttcgagtgttctccacgcgctcgtggcatcgccggctcgtcgctgcagccggccgagcgtgagcaggttgaacgccgttgcctccggcggagcgtcgctgaccgcgatgacctctcgctgtaccgccaccgcttcggtgagaaagccgagttgggccaggtgatgctgcaacgtgttgagcgtgccctcggtgcgtggctcgcccgccgcccacgcggtcatgaacagacgggacgcttcccgctcacccaggcccgcggcgtggtgggcccacgaactgaggctctcctcggccgggtcggaagggaacagcgcacgttgttcgtcgagccactgctccacggccgcgtcggtgtggcgatccgcggtgatgtcgtccagaatgcggccacgatcggggtgggcgctcgcgcgcacggtgtccacggcagcggcgacgccacaggtcagcagatggtagaggtgatatccgagagccgtgtcgaagctgacgttcttggcggaccagtgcagccacaggtcctccggctgccggtgttcggcgaccaggaagcccaccagtgtcaggtccgatgccagtccccaggggacgatctccctgtagaacagggtctcctgctggaggagaaaccgcagaagccgcaggtcctgagggcgacggtcgtattggagtgcccacagaacgctccggcgggcggccttgccccggtcgatcacccggccctcggcggtgtggtccgcggagaaggccagatcgggccagctctccggtttccgccgagctcgctcgagagcgcttctcggcgcacgcagaagccgctcccgctcgtcggagaaactcatcgttcttcccttcgctcgacccttggcctcctctgcccggcacccggcacccgagctttccgtccacgcccgtggactgcgaaaatagtgcccgtggcatctcagcagcgaagagcctggcgcgggtccggtgcaccccgccgccgaggtgcaccggcggcggggtgcacggcctgcgtctaccgccggggcttgcccgcgaagacccaccggttgcccgccagcgcgtcgttccgctcgggccgcgggccgcgtccgtgcacgcgggtgaagtcgaacggggtgcggaccgaggcggaccagcccttgtccgtcagattcccggcggagtcgggccgcgggttcctgtcgaacaggtccagcaggtcgatgccgatctgctgcttcgtggaggtgtagagcgggctgtcgcggtactccaacagatccttgtcgagcttgacctcgaaggccagagcgcttccccccgcactcagccggtccaccgtatcgatgaggtacgtctcggcggcgggcggcagatagaacagcaacccctcgaccagccagacactcggcgcggccggatcgaagccggcgccgggcagggcaccggcccagtcgccgcgcagatccatcgggaccggtacgcgtgccgccttcggcgtggccgaaaggcctccgagcacctggtgcttgaacgccaggacctcctcccggtcgacctcgaagaccacgcaaccggcaggccaggcgagccggtacgcacgcgagtccagccccgccccgagcaggaccacctggcgggcgttccccgcgtgcaccgatcggaggaggaagtcgtcgaagacccgcgtgcgcagtccgaagtaccgcgcgaaccgcccccacagcgggttctcgtccccgtccggaacctcccgcaggtggaccggccagctcttggacgccggagcgccgagcacgaagtgctccgcgtagacgtcctgcgccaggctgtcggagcgatgcgtctcgatggcccgtgccgcggcgaccaggagagcggtcgcaccgacccctcccgccacaccctccataccgtcgttccggtgcgccgtgtcgaccatgtgcactcccttggtgttgatggagacaacgaacagtgagcagcgcgggggaacctgcgtgctgacctatggaatgaggaccggcttcaccacacggcccgcgtcgcagtcgcgttccgcctcgttgatgtcggcgagcgggtacgtacggatcagctggtcgaaagggaaccgcccggcctgccacagcccggtcagccgggggatcagcagcgccggtaccgcgtccccctcgcagatgtgggagaccttccggccccggtccagggtccccggttcgagcggcaacgcggtgtgcagccgtgccaccaggcccaggtgcccggtcgggcgcagcgaccggagagcgtcgttgatcaaccgggcggaacccgtggtgtccagggcgtactgcgcgccgccgccggtcagccgctggatgcggccgggcaggccggccgaggcggcgtccagcgggaccgcgtggaaccgctcggccctggccagccgctcggggtgcctgtcgaccgccacgacgagggccccggcggcggtggccgccatgaccgcggccaggcccaccgctccggcgccgaagaccgcgaccgtgtctccggggccgacgccgaaggagtggaggaccgccccggctccggtgaggaagccgcagccgagcgggccgagcagttcgagggggagggaggcgtcgacccggacggcgttgcgggccgggaccatcgcgtactcggcgaacgaggactggccgaaccaccggggcgccagcgcctccccggctccgtcggtgaaccgggccgcgttctcggtgcgtcccccgaagaggttgagcgcggcgaaccggtcgcagtaggcgggggccccgcccaggcagctccggcaccgcccgcaggagtcgaagctcagcacgacatggtcgccgggctccaggccggtgtccgggccgcccgtctccaccaccaccccggccccctcgtggccgagcaccgccggcagcggtgagcggcccgccgagtgccggacggcgaggtcggtccggcagagtccgcagcccgcgatccggaccaggatctcgccgtcggccggtcccgcgtcgaggatcacctcctcgacggcgaacgcctcctcgtaaccgcgcagtaccgccgcgccgaacctcatcgtcaggcctccaggggacggtggacgacgaacggccgcaggttcccgtacagcccccacggcccgcccgcgacgccgacgccgctctccttcataccggcgaagggctggccgagggagagttcggcgtggtggttgatccacgccgtcccgcactccagccgctcggcgaccgccccggccaggtccaggtcggtcccccataccgagccgccgagaccgaagcgggtggcgttggccgcctcgacggcttcgtcgaggcttccgtacggcagcaccggcaggaccgggccgaactgctcctccgtcaccaccgggctcccgggacggacatcggtcaggacggtcggagcgtagaagtagccgggccggtccaggcggtggccaccggccgcggcgcgggccccgtccgccagggccgtggccgtgtaccgctccacccgggccagttgggcggcgttgttgaggggtcccagctccgtggcccggtcgagaccggctccgacgaccacgcgcttcgcccgttccgcgagggcctcgaccacccgggagtggagccgggccggggcgtagacgcgcttgaccgccatgcagacctgtccgcagttgcggaacgccgcccagaacagccggtccgcgatccgctccacatccacgtcgtccagcaggacggcggcgtcgttgccgcccagctccagggt

SEQ ID NO: 3535 - DNA, 2045 bp, Unknown
  Kingdom: Bacteria, Phylum: Actinobacteria, Class: Actinobacteria, Order: Streptomycetales, Family: Streptomycetaceae, Genus: Streptomyces
ccgcggtccacacgccgatggcgagcgcccgctcccggcggtcggggaagacctggcgcaggatcgacagcgtggcgggcatgatcatcgcgccgccgacgccgaggagggcgcgggccgctatcagaacggccggggtgtcggccgtcgcggcgagcgcggaggccacgccgaacagcgcgtagccgaagagcagcacgcgccgtctgccgatccggtcacccaacgtgccgaagaggatgagcagcgaggcacagacgagggggtaggcgtcgacgatccacaggagggccgtgccgctcgggcgcaggtcctcggtgagcgagggaacggcgacgtggagcacggtcgcgtcgagcgcgacgaccaggagactgaggcagaggaccacgaggacgacccagcggttggcgtcgtcggcggctttgcgcagccggaccccggccgtggtcgtcccggtcatctacgtacctcccgatgagtccctcgcgctcggcggaccgacggtgacgtggggcccggcatcgactggcaagtgagccgtcagcgtacgcgagtccggcgaggtcacacgtggtccacgtcataccccggtccgccgcacagtgtggcgtacgccattccggtcccggccggggggctcccgtcggaggagccgggacgcccgccgcgccgggggccccggcgggcaccccggggtgcggcgcgacggcgcgcgcctctcccgaatggcgggatcaattgccatggattccggtgcgcccctttttccgagagatcaaacacgcttacgaacggaaccggcgggcaattggccgcaagatcacggaggttcttctccgcacccggaaaagacgccgttccgagacaaagtccacatcacatcgtcatcacaaagagcccggattggcctgctcgcacactcactcgctgtaacgtcgattgggtgcgtaccgacatctttgcccggctggaccgggagccggaaccgccgaagatagaggcgccgcggatgagccgtcaccgcatcgccctcttcggcgggacgttggcgttctatctcgccatcgtcttcgcggtgctgatcacgtcctggctggtcgccctggactggaaggtcatgctgttccggccctaccagcagtggcccgaactgcacgccttcctggactactacgtcgtgctcggccagcgcggtcccaccgcggtgatggtcgcctgctggctgggctggcgctcctggcgtcagcacacgctccggccgctgctggtcctcggcacgtccctgctgctgctcaatgtgaccgtgggcgcggtcaagctgggactcgggcggctcggcccgcactacgcgacacagatcggctcggccgagatgttcgccggcggcgatatatttccctccggtcacaccgcgaacgccgtcgtgacctggggaatcctcgcctacctggccaccacgccacgcgccaggcgctatctgtcggcggtgtccgcgacggtctcgctgggcgtcggcctcaccaccgtgtacatcggtacgcactggctcagcgatgtcgtactgggctgggcggccgggctgctcatcctgctggcgctgccctggttcgagccgctgatcgcccggaccgaggcctggatcttcgtgatgcgcgagcggtggcgcgagcgtcgcggcggcgtccgtccggcacccgcgaccggggccgggccgcaccccgtgctgctgccgcagtcgatggccaccgacggcctcgccgccgagaccgtgaccgccgagatcgccatgatgatcagcgcgaggtgggcctgggacaggtcctggccctcgaccagcgggaccacgagcccggccgtcgtgacgatcgcgacggtggccgagccctgggcgacgcgcaggacgacggagatcagccaggcgagcaggatgaccggcaggccgacgtcgttgaaggtgtcggccagcgcgtccgcgatgccgctgcccttgaggacggcgccgaagatgccgcccgcgccgaccaccagcaggatgttgccga

SEQ ID NO: 3536 - DNA, 5418 bp, Unknown
  Kingdom: Bacteria, Phylum: Actinobacteria, Class: Actinobacteria, Order: Streptomycetales, Family: Streptomycetaceae, Genus: Streptomyces
ttccggggagaggtcgcgcttttcgcgtacgcgggtccgtgtcgtctccgttctgtcctggaggcgggtgctcaccggggtggtcctggccaccgtcgccctgctgctgttcagctcctacgtggtccagcccttcctgatccccagccgctcgatggagcccacgctgaaggtcggtgaccgggttctcgtcaacaagctggcgtaccgcttcggcgccgagcccgagcgcggcgacgtggtggtcttcgacggcaccggctcgttcgtccgggaggacctcgacgcgaaccccctgaccgggctggtgcgcggggcggcctcctccctggggctcacggagcccgccgacaccgacttcgtgaagcgggtggtgggcgtgggcggtgaccgcgtcgtctgctgcgacgcgcggggaaggctcgcggtcaacgacgtagcggtggacgagccgtatctgtaccccggtgacaccgcttcccgggtgcccttcgacatcgaggtgccggccggcgccctgtggatgatgggcgaccaccgcagccgctccagcgactcccgggaccatctcggatcgcccgggggcggcatggtccccgtcgagcgggtgaccggccgggtggactggctgggctggccgcccgcccggacgggttcgctggaggggaccggcgccttcggcggcgtacgggcgcccggcggggcgcatgggtaaccgcggccgtccgcgcggcgcccccgaccccgacgcgtccctgccgaccgggaccaggcccaccgggccgcgctcgctgcccacccgggcggaacgccgccggctcgcccggaaggtccggcgcaagcgccgcgggtccgcggtgagggagattcccgtcctcgtcgtcgtggcgctgttgatcgcgctcgtcctgaagacgttcctggtccaggcgttcgtgatcccgtccgggtcgatggaacagaccatccggatcggcgaccgggtgctcgtggacaagctgaccccgtggttcgggtcgaagccgcagcgcggcgacgtcgtggtgttcagggaccccggcggctggctccagcaggagaaccccggggagaagaaggacccgccgatcggcgtcaagcaggtcacggagctgctgacgttcatcgggctgctgccgtccgacgacgagcaggacctgatcaagcgggtcatcgcggtcggcggcgacaccgtgaagtgctgcggcgaggacggccgggtcaccgtcaacggcgtaccgctggccgagacgtacctccaccccgacgaccgaccctcgaccatctcgttcgaggtggaggtccccgaggggcggttgttcatgatgggggaccaccggtccgactccgccgactcccgcttccacctcgacgaacccgaccgggggacggtctccgaggaagaggtcgtggggcgggccgtcgtgatcgcctggccgttcggcaactggagcaccctggagcagcgcgacgccttcaccgcggttccggacgcgcgcgcatcggaggcagcggctgcggccccgtcgaatagtgtggcacctccggatccctatggaatggtccggctcccgacccctgcggaactcccgctcgttatgggagtggtgggcctgcaccggatcgggcgcgggcagtggcacgtattgaggagtggatgtgggggatttggcggtcggcgcacgatccggacacgacgaacccgaggacctgccggagcgcgacgagtctcccgcgggcggggcggcagtccccccggaggatgagggcgacaccccgggcggcgacggcggcaggccacccaggaggcagcgttccttctggctggagctgccgctgctcgtcggcatcgcgctggttctggcgctgctgatcaagacgttcctggtccaggcgttctcgatcccctcggactccatgcagaacactctgcagcggggagaccgggtgctggtcgacaagctgaccccttggttcggctcggagcctgagcgcggcgaggtcgtggtcttccacgacccgggcggctggctggaggacaccgtggccccggagcccaacgcggtgcagaagttcctgagcttcatcggcctgatgccgtcctccgaggagaaggacctgatcaagcgggtcatcgcggtcggcggcgacaccgtggagtgcaaggagaacgggccggtcatggtcaacgggaagagcctggacgagaagtcgttcatcttcccggggaacaccccgtgcaacgacaagcccttcggcccgatcaaggtgccggacggccggatcttcgtcatgggcgaccaccggcagaactccctggactcgcgctaccaccaggagctcccgggacagggaacggtctccacggacgaggtcgtcggccgtgccgtcgtggtcgcctggccgctgggccgctgggcgacccttccggtcccggacaccttcgaccagcccgggctgaacgcggccgccgcgatggcgccggcggcactgggcgtagccggagcggtgcccctcgtgttgtggcgccgccggaggctgaccgccgggcgtaccgccgggtagggtgccgactcggatcagcgattgtcgatctccgacgggggagcgctgggatgagcggtacaggacgcaaggaagacggccgcggccggctcggcgccatggtgtcgggcttggccgtggccgtcggctgtgtgctcttcctcggcggtttcgcctgggcggcggtggtctaccagccgtacacggtcccgaccgactcgatgtcccccacggtggagcccggggaccgggtgctcgccgagcggatagacggcgccgacgtccgacgtggtgacgtggtggtcttcaccgacaaggtctggggcgccacgccgatggtgaagcgcgtcgtcggggtcggcggcgacaaggtggcgtgctgcgaccgggagggacggctcaccgtcgacggaacccccgtcgacgagccctacctcgaccgggccccggccgccccgggcacgaaggcgccggcctcgccccaggacttctccgccaccgtgccccagggccagatcttcctgctcggcgacgaacgggccacctccctggactcccgggtccacctccaggacgccggcaagggctccgtgcccctgagcgccgtacaggcccgggtggacgcggtggcctggccgatggacggcatgatcgaccggccctcgtcgttcgccgcgctgcccggcggggtgtccgccgccgggccgctgccgctccagctgggcgcgatcctggtgggagtcgcactgatcctcggcggctcggtgtacgcacccgtggcggcgcgcctcgcccgccggaggacggtcaccggaggggcccggtgacctccggagcccgcagggtcgcccgggtggtcctcctggaccccgacgaccgcgtcctgctgctgcacggccacgagccggacgacccggccgacacctggtggttcaccccgggcggcggcctcgagggcgacgagacccgggaagaggcggcccgccgcgagctggcggaggagaccgggatcacggacgtcgagctgggcccgctgctctggacccggatctgttccttcccgttcgacggccggcgctgggaccaggacgagtggtactacctggcccgtacgacgcagaccgccaccgccccgcagggtctcaccgagctggaactgcgcagcgtcgccggtctgaggtggtggacttccgccgaactgctcgcgacgcgtgagacggtgtacccgaccagactcgccgagctgctccgcacgctcctcgacgagggtcccccgtgtgatccgctggttctggcccccgaaatcgtctaatcgtccaggggtgccggaggctggcgcacaatgggggcacgcacggctgaaggggaaacatgccatgagcgccgaggacctcgagaagtacgagaccgagatggagctgaagctctaccgggagtaccgcgatgtcgtcggtctgttcaaatatgtgatcgagaccgaacggcgcttctacctcaccaacgactacgagatgcaggtgcactccgtccagggtgaggtcttcttcgaggtgtccatggcggacgcctgggtctgggacatgtaccggcccgcgaggttcgtcaagcaggtccgcgtgctgaccttcaaggacgtcaacatcgaagagctcaacaagagcgatctggaacttccgggaggctgaccccgcgctgcccgctgccgggccgccgatacgcgcgttgcaggaacgacccggtcacccgtgtgggtggccgggttttccacatccgcggagttgtccaccaagatccacatcttggcgcgggccgggtcacagtcggtgccggaggtggtgccgatatgaacgcacggggggcactcgggcggtacggcgaggatctggcggcgcggctgctgaccgaagccgggatggcggtggtcgagcgcaactggcgctgtcgcgccggagagatcgacatcgtggcgtgggacggcgacgccctggtcttctgcgaggtgaagacgcgccggtcacacgggttcgaacaccccatggcggcggtcggcccgatcaaggcggaccggctgcgacggctcgccgagatctggctcgaccggcacggcgggtcaccgcccggcggggtccgcatcgacctgatcggggtgatcgtgccccggcgcggagccccggtcacggagcatgccaggggggtgtcctgatgggcttcgcgcgggcgtgttccgtggcactggtcggcgtcgagggcgtggtggtggaggtccaggcggacctggagccgggggtggcggccttcaccctggtcggactgccggacaagagcctggtcgagagccgggaccgggtgcgggccgccgtggtcaattccggtgccgagtggccgcagaagaagctcacggtcggcctctccccggcctccgtaccgaagagcggttcgggcttcgacctcgccgtcgcgtgcgcggtcctcggcgcggcggagcggatcgaccccgccatgatcgccgatgtggtgatgatcggcgagctgggtctggacggccgggtccgtccggtacggggcgtgctgcccgccgtcctcgcggcggccgaagcggggtacgagcaggtcgtcgtccccgagcggacggccggggaggcggccctggtgccgggggtctcggtcctcggcgtccggagcctgcgccagctcatcgccgtcctgtgcgacgaaccggtccccgaggaaccggtcgagggccagggtcgccccgacgccatgctggccgggctgatgatccccggcacgggcctcggcacggggctcgccccggccgccgcgcggggtgacggacacccgccggacctggcggac

SEQ ID NO: 3537 - DNA, 2385 bp, Unknown
  Kingdom: Bacteria, Phylum: Actinobacteria, Class: Actinobacteria, Order: Streptomycetales, Family: Streptomycetaceae, Genus: Streptomyces
cccggcggtcgcgcccgccgccaccggcttcttcctcgtcctggagggcggcgacggagcgggcaagtccactcaggtcgaggcgctcgccgactggatccggtccaagggccacgaggtcgtcgtgacccgcgagcccgggtccacccccgtcggcaagcggctgcggtcgatcctgctcgacgtgtcctccgcgggtctgtccaaccgggccgaggccctgctgtacgccgccgaccgcgccgagcacgtcgactccgtcgtccgcccggcgctggagcgcggcgcgatcgtcatctccgaccgttacatcgactcgtccgtggcctaccagggcgcgggccgggatctggccccgaccgagatcgcccggatctcgcggtgggcgacgagcggcctcgtaccgcatctgacggtgctgctggacgtcgacccggcgaccgcacgggagcggttcaccgaggcgccggaccggctggagtcggagcccgccgagttccacgagcgggtgaggtcggggttcctgaccctggccgccgccgacccgacccgctatctcgtggtggacgccggccaggagccggagtcggtcaccacggtcgtacgtcaccggctcgaccagctcctgccgctctccgaggccgagatcgaggccatcgaggaggcccggcgcaaggccgaggaggaggcccggctccgcaaggaggccgaggcgcagcgcctggagaagcagcgcaaggcagaagaggccctgatgcgcgccgaggaggcccgccgccgggccgaggccgaggctgccgcccgtacggaggcggcccgggccgaggcccagcgtgcggaggaggcgcgggcgtcccgtacctcccgtgcctcccgtacggagacctcctcgcggtcggagggcccgtccgttccggagaacgagctcacggtgcccacaccgatcgtgaacccgaacgagatcacgcagccggtcccggcgatccggccggaggacgacgaccgtccttccggatccggtacgggctcgggtgcacgtccgggttccgctctcggggatgacgagacggcgatgctgccgcgcttctcggaccagcggccggcggaccggccgcaggcccgggacgcggacgagacggcgatgctgccgccggtctccgccgatcagccctccgaccgggtgccccagggcttcttccgggacgagagctcggagtcctcgcccgcggagagcgagaacgagcgcacccgggaactgccgcaggtcgaggacccgaacgcccgggagaccccggaccggcagcagggccgccgcaagcgcccccgtccggactgggcggaggagaccccgctggacgatctgccgaccctggcggacgagctgctcgggggccaggaggacgacggtcccgcaggtcggggacgtcgcccgcgcggctgacggctctgccccaccgccgacggtgaagtcccggcccgtccgcccctcagggggcgggcgggccggactgtcagtggcgtcccccacaatggagagcgacgggacggacagcgcaccgcactccctccgtccccccgccgaacgacgctcgaaacgccaccgccacaccacagcacgcaccacagacagcacgcaccacaagcagcacgcaccacaagcacggcacgacgccaccgccgcaccacagcacggcacgacaccaccggaagggcggtgacccatgaccgtatgggacgacctggtcggacagatccgcgtgcaggaacagctcgccgccgctgccaaggacgccgacgctctggtcaccgccgtgtccgacggcaagccgctggaccagggctcgaaaatgacgcacgcctggctgttcaccggaccgcccggttccggccggtccacggcggcacgggccttcgccgccgcgctccagtgcacgagcccggaccgggcgctgggcggcgcacccggctgcggtttctgcgacggctgccacaccagcctgatcggcacacacgccgacgtccaggtcatccgtacggatctcctctccatcggcgtgaaggagacccgcgacctggtccggcgtgcccagctctccccggcggtcggccggtggcaggtcatcgtgctggaggacgccgaccgcctcaccgaaggcgcgggcaacgtcctgctgaaggccgtcgaggagcccgcgccgcgcacggtctggatgctgtgcgcaccctcgctcgaagacgtcctgcccacgatccgctcccgctgccggcacctcaccctgagcaccccgccggtggaggcggtggccgacgttctgatccgccgcgacggcgtcgaccccgagcgggcgcactccgcggcgcgcgccacccagggacacatcggcc

SEQ ID NO: 3538 - DNA, 1645 bp, Unknown
  Kingdom: Bacteria, Phylum: Actinobacteria, Class: Actinobacteria, Order: Streptomycetales, Family: Streptomycetaceae, Genus: Streptomyces
ggagccgatgctggccccgggcgtgcggggcggcctccgggtcgacggcgaccaccaggtggacccccgacgcctcgccgccgcgctgctgaccgcgtgcgaacgggccggggccagcatcggctccaggcggcggcactcacggccgctcagccagaccgactccaggcccgaacgctcctggagggcgtgcagttcgcgcagatgcgcgcggtcgtcggagtccagcgcgacggcgagcgtgccgcaggcgcggaagccggtgtcccggccgctcgcctcctccagttcggccacgaacgagggataacgggcggcggaggcgaggttgagcccgagcagcatctgctcgccgtagtgcagttcggtgacggcggccagcatgcccgccgcgacctgagcggcgccgccgcccggttccgggtccgcgaccgtgacgcgcagcccccgctgggcggcccgccaggccgtgaccaggccgatgatgccgcccccaatgacgaggacgtcggatccggaggtcttccccgagacgcgcatgagtgtccagcccctcccttcgccggcatgacccggagcaggttcgtacggtcggaggccgtccagcctccctctcagcccggtgcgtccgggctcccgcgagtgttctaccttggccagcctagaccccctcgcccgcggttcagtaagggagcgcccaccatggcccgttcactcgacggactcgtcctgtcgcccgtcgccgaccaggcccccggccaggtcgggacccgcacccgcttcacgtaccacgagctggacggccggatctgggccgagtacgcggggggtgacgtggtccgcggccatctcgtcggcacccgcgacggggacgcgctggacttccgttacgtgcagctcaagcaggacggaacgacctcgtccgggcactgcctctccaccgtcgtcgacctccccgacggccgggtgcggctggaggagcggtgggcctgggagtcccaggagggcagcggcaccagcgtggtggaacagcttccctcctgaccttctttccccccacccccctgtctgacgctccgtcaggtgattaaggtggacgggtgagcgagcagacggaacagcgggcggcgcggacacggcacgtcgtgatcgtcggagcgggcatggcgggcgtgcagagcgccgtggccctgcgcgaggcgggcttcaccgggcccgtcaccctgatcggcgccgaaccccaccagccctacgaccgcccgccgttgtccaaggccgtactcctgggcaaggccgaggactccgccttcgacgtcgacttcgaggcgctggacatcaccctgcgcctcggcctggacgtcaccgccctgcgcgccgccggccatgtgctggacaccgccgacggtccggtgccctacgacgccctggtcctcgcgaccggcgcggaacccatgaccctgcccggcgccgagggcgtacccggcgtccatctgctgcgcaccctcgacgacgaccacgtcgtgctgccggtccaggacgggccgcagccgggcggcgtcgtcgagggtgcgcagcagatggacgccgggtacgccctcggcgccgggcagggtcatgggttccgcgccggtcgcgaggaccaggg

SEQ ID NO: 3539 - DNA, 4259 bp, Unknown
  Kingdom: Bacteria, Phylum: Actinobacteria, Class: Actinobacteria, Order: Streptomycetales, Family: Streptomycetaceae, Genus: Streptomyces
cataccggacgcgccgcccggcgtgtgcacgggcggcgcgtccggtatgtcatcggcgacgagcccggccaggtgaacggcatgcgatggcgcgcggggtccgcgctgtaggcgagccccggccgacgtaccgcacgacacaccgctcttctcgtacgtacgaccgcaccgccgtgaccgtatgccggtcgcggtggcgctcgccgctccgcgcatacggtgcatccatccgttgccatgccaaggagcacgtcgcatgtcgtccgacttcttcattccggaccccgagggtctgatccccagcgccgagggctatttcggcgcgtacggcggcaagttcatcccggaggcgctcgtcgccgccgtggacgaggtcgccgtcgagtacgacaaggccaaggccgaccccgccttcgccgccgagctcaacgagctcatggtccactacacggggcggcccagcgccctgaccgaggtcccgcgcttcgccgagcacgccggcggcgcgcggatcttcctcaagcgcgaggacctgaaccacaccggctcgcacaagatcaacaacgtgctgggccaggccctcctcaccaagcgcatgggcaagacccgggtcatcgccgagaccggagccggccagcacggcgtcgccaccgcgaccgcctgcgccctcttcggcctcgaatgcaccatctacatgggtgagatcgacaccgagcgccaggcgctgaacgtggcccggatgcggatgctcggcgccgaggtcgtcgccgtgaagtccggctcgcggacgctgaaggacgccatcaacgaggcgttccgcgactgggtcgccaacgtggaccgcacgcactacctcttcggcacggtcgcgggcccgcaccccttcccggcgatggtccgcgacttccaccgcgtcatcggcgtcgaggcccgccgccagatcctggagcgcgcgggccgcctcccggacgcggcggtcgcctgcgtcggcggcggctccaacgccatcggcctcttccacgccttcatccccgacgccgacgtccgcctggtgggctgcgagcccgccgggcacggcgtcgagaccggcgagcacgcggcgaccctcaccgcgggggagcccggcatcctgcacggttcgcgctcctacgtcctccaggacgacgagggccagatcaccgagccgtactccatctcggcgggactggactaccccggcatcggcccggagcacgcgtacctcaaggacgtcgggcgcggcgagtaccgcgcggtcaccgatgacgcggccatgcaggccctgcgcctgctgtcccgcaccgaggggatcatcccggccatcgagagcgcccacgcgctcgccggtgccctggacctcggcaaggagctcggcaaggacggcctgatcctcatcaacctgtccggccgcggcgacaaggacatggacaccgccgcccgctacttcgggctctacgacaccgacgccgccgtcgaagcggacgccgacagcgaccgcgccgagatcgagggggacgccaagtgagcggcaacatcgagctgttgaacaccaccctggccgccaccagggccgcggaccgggcagcgctcatcgcctacctcccggcgggcttcccgaccgtcgacggcggcatcgaggcggtcaaggccgtcatcgcgggcggcgcggacatcgtcgagatcgggctcccgcacagcgacccggtcctggacgggccggtcatccagaccgccgacgacatcgccctgcgcggcggcgtccggatcgccgacgtgatgcgtacggtccgcgaggcgcacgaggccaccggcgtcccgatcctggtcatgacgtactggaaccccatcgaccgctacggcgtcgagcgcttcaccgccgagctggccgaggcgggcggcgccgggtgcatcctgcccgacctgccggtccaggagtccgcgctgtggcgcgagcacgccgacaagcacggcctcgcgaccgtgttcgtcgtcgctcccagcagccaggacgcccgcctcgccaccatcacggcggccgggagcggcttcgtctacgccgcgtccctgatgggcgtcaccggcacccgcgcctccgtcggcgcccaggcccaggacctggtgggacgtacccgcgccaccaccgacctgccggtctgcgtcggcctcggcgtctccaacgcggcgcaggccgccgaggtcgccgggttcgcggacggcgtgatcgtcggctcggccttcgtcaaggccatgctggacgcccccgacgaggccgccggtctcgccgccgtccgctccctggcgggcgaactggccgagggcgttcgaaagcgctgagccctttaatcacccgaatgggtggattgtggaccggggaggcgcggaggcgcctccccggttcgttccccgagtgtgagcgacaagatccctgagggaaacagaagcgcgcgtgagcgcctggcccagcagcgcgagcgggagaagggacgcgagaagcgccgccggacgctgatcgtcgcctcggcggtggtcggggtgctcgccctggccgccgtggtcggcctgatcgcggccaacgccggcaaggacgacggcggcgacaccgcctccggccccgcggtcgccccttcgggcgcgatcggcgaggacgccctgacggtgccggtcggcgccgccgacgccccgtccaccctcacgatctgggaggacttccgctgccccgtctgcgcccagttcgagaccgccttccgggacaccgtcgcggagctggcggaggacggccaggtcaaggtggagtaccacctggccacgatcatcgacggcaacctcggcggcaccgggtcgctgcgcgccgccaacgccgccgcctgcgcccaggacgccggcaagttcgcggcgtaccacgacgtgctcttcgccaaccagcctccggagccggacgacgcctacggcaagaacagccggctgatcgagctggccggtgaggtcgaggggctcgacacacccggtttccgcagctgtgtggaggacggcgagcacgacagctgggtgaagaagtccgacacggcgttccgcgaaggcggcttccccggcacgccgacggtgctgctcaacggggagtccgtcttcccgagcaagggcgacgagcagatctccccggagaacctgaagaagtgggtcgccgcggccaacaagggcaagaagcccggcgccgccaccccgtccgccccggccgacgggtcctccaccccggccgacccgtcgtcggcccccgcatcctgaacaccccccggagccgcccgtgacgcggtcctcgttacccagacgttgccgggtggcttgccgtacccaccgcccggcaaggtagcgtcgacctcgccatgaatcttgccttcatccccagcccgtcgaccggcgtgatcgagctcggcccgatcccgctccgcggctacgcgttctgcatcatcatcggtgtcttcgtcgccgtctggttcggcaacaagcgctgggtagcccggggcggcaaagccggcaccgtggccgacgtcgccgtctgggcggtgcccttcggcctcgtcggtggccggctctaccacgtgatcaccgactaccagctgtacttcagcgacggtgagaactgggtcgacgccttcaagatctgggagggcggcctcggtatctggggcgccatcgcgttcggcgccgtcggagcctggatcgcctgccgccgccggggcatcccgctgcccgcctgggccgacgcgctcgccccgggcatcgccatcgcccaggccatcggccgctggggcaactggttcaaccaggagctgtacggcaagcccaccgaccttccctgggcgctggagatcagcgagggcccgaaccgggtcgccggcacgtaccacccgaccttcctgtacgagtcgctgtggtgcatcggtgtcgcgctcctggtcatctgggccgaccgccgcttccggctcggccacggacgggcgttcgcgctgtacgtcgccgcctactgcgcgggacgcggctggatcgagtacatgcgggtcgacgaggcccaccacgtcctcggtctccgcctgaacgtgtggaccgcgatcgtcgtcttcgtcctcgccgtcgtctacatcgtgatctccgcgaagatccgtccgggccgcgaggagatcgtcgagcccgaccgggacgccgcccccgcgaagaaggacggacccgccgacgagaacggctccgac

SEQ ID NO: 3540 - DNA, 2121 bp, Unknown
  Kingdom: Bacteria, Phylum: Actinobacteria, Class: Actinobacteria, Order: Streptomycetales, Family: Streptomycetaceae, Genus: Streptomyces
gcgcaggcggccctcggtgtcggcgtgatcgtcgaggacggccgagggcgcgtactgctgggccggcaccacagcggtacgtgggagctgccgggcgggaaggtcgacgcgacgcacgagtcgatcgccgcggcgggcgtccgggagctgcgcgaggagacgggcctggtggtcgacgaggcggccgtggacgtcatcgcgatggtccacgacgtgatcggcgggatcaaccgcgtcagcatggcagccgtcgtacgcctcgcctccggcgtcccggaggtgaccgagccgcacttgatcagcgcctggcggtggaccgctcccgagaagctgccgaccccgctgttcgacccgtcggcacagatcctcgcggcctggcgaccggagctgggcatcacccacccgcccgcacatgtgctgcggatcgctccggacgagcaccgtgcctgacgtacgccctccgctcgcgcacctcttccgcacctcctttcctacagatgcggatgaaacggacccactgtatgaataagggaccatccgtgcgatagggagtaggcccatggacgattacccgctcctggacgtctttctgaccatgctctacctgttcctctgggtcatgtggttcttcctgctgttcaaggtcgtcaccgacctcttccgggaccactcgctgaacggctgggccaaggcgggctggctggtcctcgtcatcctgctgccctacctgggcgtactgatctacctgatcgtccgcggtcgcagcatgcacgaacgcgacgagaagctggccaaggactcggaggcggcgttccgcaactacgtgcgcgaagccgcgacgagccagggcgggtccggcggcagcgaccatgtgaacgatctggcgaaactcgccgaactcaaggacaagggcgcgctgaaccccgaggagtacgagcgggcgaaggcgaagctgctcgcctgaggtcaagctccggcccttccgcccgagcccccaccctcgcccgaagggacggctgtacggggctctcggcggcacaactcggcgaccacgggcggagccctgttcgtggtcaaaccccggctcacccggttgtgggcctcggagcctcggcggcggcgcgaccccgggtcagaggtcgtcgagctgaaccagtccgtcctggatcgcccgggccagaagcgcggccttggtgggcgcctcgcggccactcatcgcgtacttgacccggatgtgttcgaggtgggtgctgacggtacgcggggagatgcccagccgctgccccacgaagtccttggactcggactggaaccactcgaccagcacctcggtctcgcgcgccgagagcgtcggccggccggtggaccggtcaccggccagcgcacccgccagcgccggcggcgtatacgcacggcccgaggccgcggcgacggctgcttcgatcagatgctccgcgccctcggccttcgtcagatagctcaacgctcccaactccagacactgcagggcgatcgcgctgtccgcgcgcattgagtagacgacgacctgccgtcccgcttcggtcagcctgcgcagctcccccatggcgggcgtcggaccacccagatgcaggtcgaggacaaccacgtcggcggtcgcgccgtcccccgtccacgcgacccggacatcgccgcccgacgcgacgacctcgatcggcgggacgccggtgaccagccactgggcgaccccggcacgcacggcggggtggtcgtcgacgatgaccgcgctcagccgcgcctcttgcgccatcgggcctccagccgcagatgctcaccatggacgccgcactcgaccgcgacccggccggtggaggcggtgaccacatcggcgcaggcgtcggcgaccaccgcgatacgcacctccgcatcggtgcgcagcacgcttaccctggcacggccccgcgccgccgacaatgccgtgatcaccggcccggtcagctcgcggcgcacctgcgagggcaccggcatcgccgcgccgctgaccgcgaaccacacgtccacgccccggcgttcggccgcgtcgacgcaggcggcgacctcgtgcaccaacgggtcgggcacctcgtcgttctcggcgaacag

SEQ ID NO: 3541 - DNA, 10650 bp, Unknown
  Kingdom: Bacteria, Phylum: Actinobacteria, Class: Actinobacteria, Order: Streptomycetales, Family: Streptomycetaceae, Genus: Streptomyces
gcggcgcacggggcccggaccctgctggacggcacccaggcggcgggctggttcccgctggaggcgggggcgtacgacttcaccgtcaccggcggcttcaagttcctgctctgtccgcgcggtacgtcgttcctgaccgtcaccgaggaggcgcaggacaccctgcctccccttttcgccggctgggtctccgccggtgctccctggacgagcaactacggcccgctggagcgcctcgcccccaccgcccgcggcttcgacgagccgcccgcctttctctcgtaccacggggccgaacactccctggacctgctcggcgaggtgggggccgacgccctgtacgcgcacgccaccgggctggcggcccggctgcgggcggggttggcgacgctcgggcacgcgacggttcccggggagtcggcgatcgtctccgtgccgggtcttgagagccgtcagcccgagctggtgaaggccggtatcgccgtctcggccccggccgggaatctgcggatctcctgccacctctacaacaccgaggccgatgtggaccgggtgctggaggtcctggcctgatccgtacgggtgtggctcagcaccggtccgggcagtcggcggtctcccggcagaggttctcctcgaccttcgccagcagccggaccagctccgcgcgttcggccggatcgaggcccgcgagcgtgtgctcctccaggctgccccaggcgtcccggaccgccgtgtgcagtgagcagctctcgtccgtcgcctcgacgagcacggcccgccggtcggccgggtcgggtcggcggcgcacatgcccggtctgctccagccgctggagcatcttcgtgaccgtggacgggtccaggtccagggctctgatcagctccgtctgacggaccgcgccccggtcccacaggtgcatcatcagcaactcctgccccgggtagaggtccacgcccctgagcgccttgcccgccgctgtccggtgcagccgggccacccgggacacggcgtggctgacgggcccgctgagcgccgccatggggagcgcgttcgtacaggcgtcttccgcgggggtggcgcggccggtggtcatggcgtgctcctgggggtcctcggggttgcaggcggcggctttcgatgatgcccgacggtttcccgcaactttaccttggtcgaccaatcaatgggttacagtggccgctgtcgccgatgcttggccgaccacatactttcttcgggagccttcatgaccaccgttttcgaccccatcgacctgtccggcacccagctggccaaccgcatcgcgctggccccgatgacccgcagccgagccggtgagggcggcaccgccaccgagctcaccgccacgtactacgcccagcgcgcctcggccggcctcgtgatcaccgagggcatccagccgtccgccgtgggccagggctaccccaccacgccgggtctgcacagcgccgaacaggtcgcctcctggcgcaaggtcaccgacgcggtgcacgccgagggcggccggatcttcgcccagatcatgcacgcgggccgcatcggccacccggtcctgctgccggacggcctcgtccccgtcagcgcctccccggtcaaggccgagggacagatctacacccacgtcgggccgaaggacttcgtcgagccgcgcgagctgacggacgccgagatccacgcgaccgtcgccgacttcgtcaccgcctcccgcaacgccgtggaagccggattcgacggggtcgagctgcacggcgccaacggctatctcatccagcagttcctggcccccaacaccaaccggcgcaccgacgcgtggggcggctccgacgaggcccgcatccgcttcgccgtcgaggtcgtcaaggccgtcgccgccgagatcggcccggagcgcaccgccctgcgcatctcgcccggcaacccgtacaacgacatcgacgagcccgctccggaggccacgtacaccgcgctggtgcaggcgatcgacccgctcggcatcgcctacctgcacatcctggaggccgccccgatccgggagctgaccctcgccctgcgcaaggccttctccgggaccgtggtcctcaacgtgcactccgacggcgccaccggacccggtgaccacacggtgatcgacgacggcatcgccgacctgatctcctacggggcgctcttcctcgccaatcccgacctgcccgcccggctgaaggcgggcggcccgttcaacacccccgacccgtcgaccttcttcggcggcgacgccaagggctacaccgactacccggcgctcgactccgtctgagcgtcctcgcgcggccttccgtcccaccgccacgaggtacggcgcgggtggcccggcagctccgcgcggccggtggcccacagcaggacggtccaccggtcgccgcccgccggggcgtccgggaagagccgggccagcacccggtcgcagagcgcgggggacggcgaccaggccagccccaggccctcggcgaggtcatgcgtgtgcaccagggtctccaccacgcccatcgcggcgaagccctccgggtcggagatcccgtacccgtggtacgagcgcacctcgggcgccgtcgtccgcgccatcgaggccagcagcgctccgctcgcctccagcgtggccagcagcccggcgggaccggcggcacggtcggcgaagaccgcgttgtggggcccgccctgccgctcgggcgcccaccggtagggcacgtcccggtccagcggaggcgtacggggtcccaactgcgcggcgtacgcgaacagatcgtcgctcaggtgctccaccgtctcccagcaggtccagtcaaggcttcccgcggctgcgtcccagcggtccgccggagctccggccagcacgcccaccgcgagccgcaccgccgaggtcacatcgtcggcggtcaccggcagccgggtcccggtgagcgccgcccgctcggcggcggagcactccacacagaactcgttgccctcgggatcggcgagcgtcgcccagccgcgcccgttgggcctgcggtggtcgcccaccagggtcgcgccgagcgcgagcagccgctccacctcctcgtcccgggagcggtcctgcggctggatgtccagatggacgcggttcttggtctgcttcttctcgtccacctggacgaagaggatcgccgcgccgggagcctcgaccagagcctccggatcgccggggaagtcctcgtcggagagcggcgcgccgagcacctgggcccagaagccgccgagcgcgtaggcgtcggcgcagtcgatcgtgatgtgacgtacatgggaagtcatggcggccaccctctccgctgacccggctccggtccagcgagttacccgggaagggccgggacggcgtaccgtcccggccccatctcgcccgtgtggcccgctacttcaccggggtgaagtcccgcgccccgatgaactcggggcggcggatcggagccgcgaagggctcctgcgccgcgttctccacgctgttgaagacgatgaagacgttgctgcgcgcgtacggggtgatgttgtcgcccgagccgtgcatggcgttgcagtcgaaccaggtcgccgaaccggccttgcccgtgaagagcttgatgccgtggcggtcggccatcttcgtcagcgcctcgtcggacggggtgccggcgtcctgcatctggagcgacttcttgtagttgtccttcggcgtctcgcccgcacagccgaggaacgtcttgtgcgaaccgggcatgatcatcagcccgccgttggtgtcgaagttctcggttagcgcgatcgacacggacaccgtccgcatgttcggcagaccgtcctccgcgtgccaggtctcgaagtccgagtgccagtagaagcccgtggccccgaagcccggcttcacattgatccgggactggtggacgtacacgtccgagccgaggatctggcgggcccggcccaccacccgctcgtcgcggaccagaccggcgaagacctcgctgatcttgtggacctcgaagacggaccgtacgttctgcgactgcttctcgacgatcgagcgctcgtcggcgcggaccgccgggtcggtgatcagccggttcagctccgcctggtagacggcgacctcgtccggggagatgagctggtcgacggtgaggaagccgtcgtgctcgtatccctggaggtccttggcggcgaccggacccggtgcgcccggcgcggaccagatgaccgggtcctggcggggagtggtcatctcggcggcgccgcgcgaggggtacagatcggcgcgtacttcggtggtcatggtggttcaggcctcctcggtcagcagtgggtagacaccgttctcgtcatggtcctcccgtcccgtgacgggggggttgaagacacacacgcagcggaagtcggtcttgggccgcatggtgtgccgctcatgcccgtccagcaggtacatggtgccgggcgtgatccagtgcgtctcgccggtctcgtcgttggtgagctcggcctcgccctcggtgcacagcaccgcctcgatgtggttcgcgtaccacatcgaggtctccgtgcccgcgtacagcacggtctcgtggagcgagaagcccaccttctccttggcgagcacgatgcgcttgctctcccaggtgccggatgccgccttcacatgccggtcggtgttctcgatgtcactgaacgatcggacgatcacggtgagcggttgcctttctctctgtacagcgtcccgggcctcgcggcccgggacctctcttctccgcctgccccggcagtgccgggtcaggccgtttcgcggacgcagcgggccagcgtgcgcaggccctcgtccagctcttcgggggtgatggtcagcggcggcagcagcttgacgacctcgctctgcgggcccgaggtctccagcaggagccccagctcgaaggcgcgggcgcagaccgccgaggcgcgcgccgggtcctggaactccatcccccacaccaggccccggccgcggaactgcgcggtcggctcctcggcgcagatggccagcagggtctgctcgacctgttcgccgcgggcgagggtctgcttctccatctggccgtcggcccagtaggcgtccagcgcggcggcggccgtgacgaaggccgggttgttgccgcggaaggtgccgttgtgctcgccgggctcccagatgtccagctccggcttgaacaggcagagcgacatgggcatgccgtagccgctgatggacttggagagcgtgacgatgtccgggacgatgccggcctcctcgaaggagaagaagccgccggtgcggccgcagcccatctggatgtcgtcgacgatcagcagcatgtcctggcggtggcacagctcctgcaacgcgcgcagccactcggcgcgggcgacgttgatgccgccctcgccctggacggtctccacgatcaccgcggcgggcttgttgagcccggagccctggtcctccagcagccgctcgaaccagaggaagtcggggaccgtgccgtcgaagtagttgtcgaacggcatcggcgtgccgtgcaccagcgggataccggccccggcccgcttgaacgcgttcccggtcaccgcgagcgaacccagcgacatgccgtggaaggcgttggtgaacgagacgaccgactcgcggcccttgaccttacgggccagcttcagcgccgcctcgacggcgttggtgccggtcggcccggggaacatcaccttgtacggcagatcgcgcggccgcaggatcacgttctggaacgtctccaggaacgcgcgcttggcggtggtcgccatgtccaggccgtgggtgatgccgtcgcgctcgatgtagtcgatcagcgctcgtttcagcaccgggttgttgtggccgtagttgagcgagccggccccggcgaagaagtccaggtaggagtggccgtcctcgtcggtcagccgggcgccctgcgcgcggtcgaacacggcgggccagccgcggcagtagctccgtacctccgactccagggtctcgaagacgctcagtgcgggcggggtgatggtcacagcgggtctcctgcgtgaggggggtgtgacgggcagtggtcgagtgctccccgccgcacggatgcggcggggagcgcgccgggtggtcggccggcgcgaaaagtcagggggatccggcgtacgggtcgggtacgccggggtgcggtggccggggcggctcaggtggcgaacgggcctatccggtagagcacctcgggcaggtgcgtctcttcggggaacagctcgccgtcgaagagcacttccttctccagcgcgacgtcgtggcgctgggcgtaggacgtgaacagccggtcggaggcggtgttgtccggagtgatcgtcgtctcgacggacgacaggccctggtcggcggcgacccgggcggtcagcgcgtccagcagggtggccgccagtcccttgccgcggtgggcctggtcgacggccacctgccagacgacgagggtctgggggcggtcgggcctgacgtagcccgtcacgaaggcgatgggctcgccgttctcgccacgggcgacggcggaggtcgcggcgaagtcacggcaccacagcaggtagctgtacgaggagttcaggtccaggacctgggagtcgcgggctatgcgccagatcgcggctccgtcctccactcgcggcgcatcgatactgaggaattcgcttcgggcacgggcaaaatctgctggtgcggcggtcatgcgaattgaatttacccagcaaatttcgaaattgcatcgacgtagagggttgggtggagggctcctttgtgttatcaggcgtgcgcgaggtcccctgtgattcgggtgcattttcctgcactttgtcctgaatttttcgggcataatgccgaccgtgtggagtcggtcacagggttgtaactctcgcgagacgtgtccgaatcatgaagttcgcggccagaaaaaactggcccgtttaggtgacgggaaagcgggcagaagaatgtgggaagctgcttttcgataaagcagctttccgcatgaggaatatcagaggctcggccaggtttccgaaacagccctgcgggcagcctcgatatcgacccgcaggcccgcgtcggccagcaccgcgcccagagccgcgagcgaggacagcaccgcgccccgcgtcgcatccgccccgtaatggttgacccggatcatctccttggacagcgccccgccgcccgcgacgagcggcagcgcggggtccgccgccagcgcccccgcgaccagcgcggccgcgtccgtccccgccggggcgcgcagcgtcgtcgccaccggggccgcgtcccgcgcctcgtggacgtacggctccagcccgccgcccagggccaccgcaccggcccgggtcgccgcggcggccgaggcgtggcgggccgtcaccgtgtccaggccctcgtcctcgatccgcgccacgcaggcctccagacccagcatctccaactgcgccggagcgtgcggcagcgccgtacggccgccgtcgatccagcgcaccttccagtccaggagggagaggtaggagcggcgcggcgcggccgggttggcggcgatccgctcccaggcccgcgcgctcaccgacaccgccgacaccccggcgggcccgcccatggccttctgcgcgccgatcacgcacaggtcgacgccccaggcgtccggcagcagcggctcggcgcccaccgaggcgaccgcgtccagcatgaacagcgcgccgtgcgcccggaccacctcgccgatctccgcgaccgggttggtgttgcccgtcgccgcctccgcgtgcaccagcgagacgaagtcgatctccgggtgctcggcgagcgcctcggcgacctggtcggcggtgaccgcggcgtggaagggcaccgtgaggtcgacgacctccgcgccgcagtcccgcagccagttgccgaaggtctgcccgtacggtccggtgaccacgttcagcgcggtcgagccgggccgcgcgccgccgcggatgcagccctccagtggcagcagcgcctcgccctgggtgatgacgacgtcctgctccgtggagaggagccgggccacgcgccgctcgatcgccgcgaagtggtcggcggtgagcgggggcaggtcgaggaaggggtgcgtcacggtggggctctcttcgggttcgttcgcggtccatgggcaggagccggtgaaacgttcccgccttccgggcgggcggtgggaacgccacaggccccagcagcctaccgacggcctcgtacagtgccgcgtatgagtgatcaggaggagcagcgggtgctgcgggtgaagggccgggtgctcgtcggcccggacgaggtgcgggacgaactgtgggccgtgggagggcggatcacctacgagcggccgcccggcgccgaccgcgcggtgacggtcagggggtgggcgctgcccggactggtcgacgcgcactgccatgtgggcctggaccggcacggcccggtcgacgcggcgaccgccgagaagcaggcgctcagcgaccgggaggccggaacgctgttgatccgggacgcgggatcgccctccgacacccggtggatcgacgaccgcgaggacctgccgaagatcatcagggccggccgccacatcgccaggacccgccgctacatccgtaactacgcccatgagatcgagcccggcgatctcgtcgcgtacgtggcccgggaggcccggcgcggggacggctgggtcaagctggtgggggactggatcgaccgcgacgccggggacctgaccgcctgctggccgcgcggcgaggtcgaggcggccatcgccgaggcacaccggctcggcgcccgcgtcaccgcgcactgcttcgccgaggagtcgctcaccgacctggtggaggcgggcatcgactgtgtcgagcacgccaccggcctcaccgaggacaccatcccgctcttcgccgaacggggggtggcgatcgtaccgacgctggtcaacatcgccacgttccccgatctcgcggcgggcggcgaggccaagttcccccgctggtcggcccatatgcggcagctgtacgaccgccgctacgacaccgtgcgcgccgcctacgacgccgggattcccgtctacgtcggcaccgacgcgggcggctccctggcgcacgggctggtcgcgggcgaggtcgccgaactggtcaaggcgggtatcccgcccctggaggccctctccgccaccgcctggggggccaggagctggctggggcggcccgcgctggaggagggcgctccggcggacctggtcgtgtacgacgaggacccgcgcgcggacgtccgggtgctggcggcgcctcgccacatcgtgctgaacgggcgggtgatcggctgagagcagtgcggtgctgtgttgacgagcagtgacggatacggtcccggactcgttgacgcacttctgcgcatgctccggcgcgagcacgctccgtacggctcgcgccgggtgaaacgagtgacatcagcgaacgcacgtgccgaaagattcgaatatgcgcgcggaaacccccctttggggtgaactcacgccaggtatccgccagttcaccctcagtgcgtaaagattcacggagtcgaggccgtcggcgcaggcgatgtcccccattggactgcgccggcggctccattctcttgtgggggttccaccatcttgaacagcaacaccttccgtctcgccgccctggcggtcgccgccggacccgtcgccctgcttgccgccgtccccgcgcacgcagccccggcgacgcccaccaccggcggcgagggcagggcgagcgcggtcgtgctccgtaccgggctcgacgtctcgctcctcaacaagtccgtccaggtgcccctcaaggtcacgctcaacgaggtgcaggccccggccagcgccgagaggaccgcgctcagcgtgaacgtggacggggtggagggcggagccccggtcagcgtcctgcgcgccgacgtggccaccgcgaacgccacggtggacgagcacggggccgagggccgcaccaacctggcgaaggccaggatccatgtgcccggactgccggtgctctcgctcatcgaggtcgagaaggtcacctccaaggcggtctgcgcggtcggcaggaagcccgtcgccgagtcgaacgtgctcggccatgtcgcggtgctcggcaagaaggtggcgctctccgcgggcggcccgacccgggtggcggtgccgggcgtcggcgaggtctccctcgacttgtcgaagacggtcaccaccgagcgcacggcggccgcgacggcgctccggctcaaggtgtccgtcaaccccctgaatctcaacgtcgccgaggtggagggcgaggtcaccctcgccgaggcgacctgcgagaccccgaaggggccgaagacccccgagaagccgaagaccccggaggagccgaagaccccggaggacccgggcaccacggacggcggctccacgggcggcggcggcgacgtgaagacgcagaccggctccgacaccggcacggcccccaccggggccaacctcgccgagaccggcggcagctccaccaccccgtacatcgcgggcggagcggccctgctgc

SEQ ID NO: 3542 - DNA, 2224 bp, Unknown
  Kingdom: Bacteria, Phylum: Actinobacteria, Class: Actinobacteria, Order: Streptomycetales, Family: Streptomycetaceae, Genus: Streptomyces
gccggggacggcgagactgccgcgtcggcagacaggtccggcagtgggcgcgggccgctgatcgcggacgccttgtcggccgctgggcggtcctcgaccggaagccgggcagggcggtgggggcgaagctggacccgctgtggtgacagccgacggctcaaccgcgaatttcggtcaatcgcatgttcagcccagccctcacctccactactcgggcacatcttgcgcacacaattctcctaggggtggcgggtcgatgcggatggcgagggcgtccactcggccaacccttggcggggagacttttcgtcaacttgcgccaacagcgcattcgcccctgttcacctgcgtagacggctctctaggatgacgccgcgccggaccggatagtgacctgctccgtgcttgcgtacatcaactgagctgccgggcagctgattcggcggggggaagaaggcgcgtcgtcgtggcgcggtgtccacactccgtgcagccccttttcggccaggccgcgccgctcctgatgcggtagcggcccgagtggccttctccaccacctcgatcgctgccatcggctgtcgctcttacccaccatcacgcagaggatgcgcacgtgcgttccagaccatgggtgttgcccagatccctgtcacggctgtcacgattgtcagcccgtgctctcccgccgttgctcgccgcggctctcctggccggcgtcggcgtcactccggagctgctcgaccggtacgccgctcccaagaccgtgccggtcagcgactacgactggaaccaggagacccccgccgagcagttgcgtcaggaccagtgcctgatgagcgacgtgctgcggctgggcgggacgtccatggtcgccaccgcgaaggacgggctcaaccagagtccggagcggctccgggagttggcggaccgggactactgggaggacacgccgctcgccgccgcgtaccaggcggacagggatgccgccagtgctgagctggaccggctccacgcgctccacgacagctggaagatcaccgggctcgagacgccgggcggcttcggttctgtcgtcgacttcgagtggccgcccgggaccggtagtgacgatcgtgaggacttccattcccagaccggcctgatggggtggatcgccgaccggttctggaaggacgagggcgacttctacgaggacgcgacgccggctgcggacgcggagaccgttgcggcggtcaaggctctggggcagccgctgtacggcgaaccggacccgtccctgccggactgggaccgtcaggtcgccctgcgggacgcatacgagcatctgacggacgacacctgggagccgaccggcgcggacaacgcccgtctcttcctgagttcgggcggcttcccgacctcggtgccggtgccgggtaccgctgagcacagggtcgcggtcgaggacctcaagtcccgcttcgccgcctgcgcgtggcgtgacccgatggacccggcgaaggtcctgggggaggtctccacgaccgccgcggcggagtggcagcaggagatcggctcgcaggccgccaagcgcaacgacatcctgagcgcgaacacgaacgccgtccaggcgctcaccaaggcctccgagtcgatgggcaagctgctcggccactcctgggtcgccgaccacatcacgcgctggcaggactactggtcctcgggcggcctgggctggatcggcagctccccgatggccgtccagattccgggcgcgaccggcaagtgcctgggcgtgcagggttcgggcaccgcgaacggcacggccgtcgaggtcgtcgcctgctcctcggctgccgcccagcagtggagggtcggcgggggctacggcgagggctacagcctgcagaacgtgaactcgcagaagtgcctcgacgtcgccaccaacgggacgaagatccagatctggacctgcaacggcacgcccatgcaggtgtggaagttcagcgtccgtgcgagcgccaccctgcagaacctgggtgcggacaagtgcctgaacttccccgcgtacaccaccgggcaggacgcgctcgcggccacctgcggcaccgctgccacgcagaaggtgctgttcaaggtatccgagcacaacggcagcgttcccccggcggcggagttcaccaaggcgtcgcagcggctgagcgcggcgcgcacgggggcgaaggccgagctggtcgagctgaag

SEQ ID NO: 3543 - DNA, 3601 bp, Unknown
  Kingdom: Bacteria, Phylum: Actinobacteria, Class: Actinobacteria, Order: Streptomycetales, Family: Streptomycetaceae, Genus: Streptomyces
ggcggggcagccggagacacccgggcagccgggggcgggggccggtggaggaccggtccacgtcgagttcctgctccccttcgacctgctcaaccacgacatggcccgcctggaactgggtaccggagtcccgaggccccggccgatcggcctgcactaccgggtccatctgcgcagcctggaccggatgcgcggcgacgccgggcaactacgccgctggcaggcccgctgggatcagctccggaccgcgaccgccccggccgcccaccgctggaaggccgcggaccgggacggcttcgaacgctggagtgcgcacctcgccggagacgagtcgctcaccgcggtcatcctcgacgcgcccgccgtccaagggcacggcctggaggcgttgcaggccgccgtcgccgagggagtgggtgtcgccgtctgggaccgcagggccgacaactcctcccggtccagcgaactgctcacactgcttctggggcacacgtacacacaactgccggagaaggtccacaggttgagggcgggggcagagatcgaggaggacggccccctgtgggtgggcaggcacatcgcgttcttctgggacgacccgtaccgactggtcgatcgtgaggagttgttgtcggcatgaccggagaggcctcagccgtaccaccgtcgtcgccgcccccgtggtgggtcttccacgcgacgggaagggcgcccgggggcgagccgccggagctgccggagcgcttgggtccgccgccgaagcccgcggcgcggcgctcgccgccgccaccggagtagcggggagcactgccggtgcgggtgcgggaaaatcggtcgttcgagcggggcgtgcgttcgcggttcatctagaacctttcctcgatggggcacgtatcgagggattctttttcgggaagcgaccgtgaacggcacccagaatcgcaagaacgagccgatgaaatgacaaaagaaaacgaagcccggccgccgggaaacagtgcaccggacgcggcttcgtctgggggcgcgcagagcgggccccggaaacgacaacgagccggggcccgcaccccaaggtgcgggccccagctgcgcagtactacctgagtgatcaggcgggggtgatgttctcggcctgcgggcccttctggccctgcgtgacgtcgaagttcaccttctggccctcctgcagctcacggaagccggaggcggcgatgttggagtagtgggcgaagacgtcggcgccgccgccgtcctgctcgatgaagccgaagcccttttccgcgttgaaccacttcacggtgccagtagccatgtcatatctccttaggggcagagcccgcgggcccacactgtgcggaccccacgtcgccgcgatgattaccccgtccggaagaacaccggaaatacaaaagtgtgcccgccgacatctgaccggcaagaacacttgaagtttttgggaaccacaactgcaactgagatcaacactagcacgatgggacggaagaggcgggtgcctaatatcaccggccgcgtcggaacagaccgggaagaaaaaagcctcatcgcgcattgcgcgaaattctgtgctgacgaatgcagatatctccccgccgccacgcggggcccggcgcacggcggcgcggcggccgtcagcgcccggcgggaccgccggagcgggcggaccggccgcgcagctcctcgttgaggcgcagcgcctcctccagctggtcctccaggatgacgatgcggcaggcggcctcgacgggcgtgccggcgtcgaccaggtcgcgggcgcgggcggcgatgcgcaactggtagcgggagtaacggcggtggccgccctcggaccgcagcggagtgatcagccgggcctcgccgatggcccggaggaaccccggcgtcgcaccgatcatctccgcggctcgccccatcgtgtaggcggggtaatcgtcgtcgtcgagccggtcggtggtgtgcgagggggtctcggggggcatctgcacctcttccgtcacgcgcgaccggaggagccgggcaccgtacgcctgtggggtgcgcctctgctgcgtaccactgtttcacgtgactgcacaagaaaccctaatcgccggggaaggccatgtctatcgcggccggaacagattcgggccaccgggaagggcgcggcggagccgccgccgcggatcactgaccgaccggtcagttgtcgtcgggaggaccacggggccataatgcacgcgtagcccttcacgcatcccccgtcgtgaagggctacacccctgtccggagcctgctccggacggtcgcggggcacagggtcattcacgggcaagggactcccctcgtggtcccctgcccgtgttttttcgagttaacagtgacgtagagtgtttacgcaagctcagttccgactccgaggtgatcgtggaggcccggatggccatggacgacggcgacgaacgcggtccgcaacccgtcgaacccccaggtccggacgagcttccccgcctcgactcgctgcgggaaaaggtcgagtacatggtcgagaagaccttccccggccagaagatctcgggccgggtcttcgccgagctggtccgcgaccgcggcggctcgctgtcgcacagctacttctccaacatcctggccggcaaggtcacccagccctccgaggacatcctcaaagccctcggcctggggttcggcgtggactggcgcttcttcaaggaggagtccgaggtcgtcgacgacgtcgtcgccggactccagttcctggccaagcggcgcaccggggagatcagcggcctggccggccggggcctggacgacgacgggctcccgccggaactgctgcggttcgccctgtccctgctggaggacgccacccgggagaaggacggcccggaaggtcaaagcggcggcaacgattccgccgtgcaccaccgcccggcgggaccggcagcgtagcgtcttggtcatgtccctgcggaaactgcggagagagtgcgaggccgggctcgccgacctgcccatcccggttcccttcacgctggacaagctcgtcgcgaacatgcaggaggcgagcgggcgcacgatccggctgcacgagatgccggaccgcctcgcccgcgtcaacgccgcctgcggactgcggctgaaggcgggcggcaccagcctcgtcctctaccgccgcaggccgaccgcgtaccagacccagcacgtgatcctgcacgagctgtgccacgagtggttcgaccacgggacgacgctcgacgcggaacagctccgcacgctcctcccggtcttcgacacctcgctgatcgcccggatgatctccccggccgccgccgcgtccttcgcctccggcggcggcaccgtccaggcccgtgcgcagtacgcgacccatgacgaacgcatggccgaattcggtgcctccctgatcccccggatggcgcgggacctcaccaccgatgacatggtggggcggctggacaactccctgtcccgcccggtggcgcaccgacggcgcggcctcttttccggaagacggcccggcgaggcctgacacgtgccaccgccccgcccgcgggtcccccgc

SEQ ID NO: 3544 - DNA, 5124 bp, Unknown
  Kingdom: Bacteria, Phylum: Actinobacteria, Class: Actinobacteria, Order: Streptomycetales, Family: Streptomycetaceae, Genus: Streptomyces
cgtcgtccccgcccgcgcggtagtcccacaggtggaccgagagcccgaccaccacgacgggaaggccgagcacttcggcggcgagcagggtgccgtggcacagcacggaggtgatgagcaggtcggtccggtccgcgcgggcggggacgacgagccgccgctgggcagaccccggcggaaccggacccgcgagatgcgtcagcagtacgccgaggtgcgggaacaggccgggctgccggcgcgcggctcccggtggggggacgacccgctgccgggcgacgcactgctgctgcgcggcgacccggcgctggagtacccgggcgccgaactgcccgaccgggtccggcacgtgggacccctgcgctgggagccgacgcccggacagggagaggtcgaagcggtcagggaccaggtggcgcggtccgggaagcccgtggtgtacgtccacctcgggcgcgtgttcgagggtggcagccggtggccccacctcaacgagaccttcaccggcggccggttccaggccgtcgtcgagcagggacgctccccgatccccgaacccgcgccgggcgccgacatcctgacggtgcgcaagccgtggatgggtccgctgatcgacctggccggcatggtgctcaccagcggcacctccgcccccgtactggccgccctggtgcgcggccgccccctcgctgcctcacccaacggctccgagcagccgctgctcaccggtgcctgcatgcgagccggtgtgggggtgcacctgccgaaatccgcgccgccggactggccggcgctgctggaatcggcctggcgcgacgacgtcctgcgggaccgcgcccggaccctcggccggaggctggccgcggtggacggcgccgcccgtgcggccgacgtcgtcgaacgggtggccgggcactccgcgatcccgaaggaggaccatgactacgcgaacgtcaggccctgacgcggacggcgggacgaccgccgccgaggagaccgtcgcgaccctggccgcgggtgcggggcggtggctggggctccacgcgggccgtctcgactccccggccggccgcgccgaactacccgtgacaccgcgggtgaaggccctcctgcaactcgcgctgctctgccgctgctggcggaaggccgcgccggacgacctcgccctggatcccgtgctcgcggtcgtggaacacgcctggctgcggccggacttcccgcgcctcctcgcccactcccctgacagcgcgcggccgttcggcctgatctgggccgccctggcaccggccgggcccgtcaccgacgcacagcgcggcgtgctcgaccggctgtccgccgacggctatctgacgccgcgccggaagtctccctacctccacctggggaccaggttctacgccgaactcgcgggcctcgggcatgaactggctccgtacgaggagctgtacgcgtgcagcacgctggcgcgcgccgacggcgtaccggtggccgaactggacgtctgcgaggtgacggacaccgtgttctacctctccgactacggcttccgcgacaccggcctggacgcgggggcccgggagcgggcgctgcgcgtggtggagcggctcgccgaccactgcgtccgcgagggcgcgtgggagtacgcggccaagctgctgctcgcgcagcgctgtctgggctcggacccgttgcggacgcctcgggggacggcggccctcgggatgctcgcgggggcccggtcgccggacggctcgatacccggcaagacagcccgggggcgggccccggcgtccgccgctccccagcagtacttccggtgggcctatcagccgacgctcgtcacggcgctgacgacgctgctcctcacgaacggccgccgcaccccacccgttccgaccacggcaccacccacagctcggaggacgcgatgagcctgcaacaggtccaactcccggacggagcacgcctcctcgaaggcaaacgcaactggtggttcctcggccggggaggcgtcgtccggctcggcggccggcacgtcacccccgagggggcgctgcggcccgacacggagcgccggctgcgcgagcgcggcatgttcgcctcccctccgatccgctcctacgcgctgaccgtcctcaccagcaccaactgcaacctgggctgcggatactgcttccagaacaccgcccaggacaccacgaacggcagccgtccccccaggatcgcccggacccgtctcacctcggagaccatcacctcgatcctcgggttcaccgagcggcagatggcagcggccgaactggacaggctgcggatcctcctgttcggcggggaacccctgctcaacccccgcggctgcctggagctgctggagcgggccgcgcgcatcgggatgacgtcggcctggatgatctccaacaccaccctgctcaccccacggctcgcggggcagctctccgacctcgggctcgactccgtccaggtcaccttcgacggcgaccgctccgaccatgaccgtatccgggtcaacagggcggacaacggcggcacttacgacaagatcgtccgcaacatcgtcgcggcgagcgaggtcacgccgatccagtggaccctgcgggtcaacgtctcccaggagaccttcgacggcgtcgacgcgctcatcgaccggctcgcggcggagctggacccctcccggtgcgccctgtacttcgctcgcgtcggcgacgtgggcatcgggtacgccaacgacctgctgcacacgggcgcgctctcggcccacttcacccggtggcagcgccgggcgctcgaactcggcttcaccgtgagccgtcccggcgcccgccggccctgccgcacctgcggccacaccgaaggccgctacggcgcggtgatcagcgcggacgggaccctggccagctgctgggagaccgcgggcaaacccgactgggaggtcggcacggctgccagcgggtatcggcccgccgacgcgacccgcgaccgctggatctcctgcgaggacctctaccgctacgacgaggacacccgcgtcctcgcgcggttccgcgacgacgtggacgcgaccctgctcgactacctggacgagacggagcgcctgtagccatgacgtcatccctcgaccagctctccgccggcacgctcgactggttgggagcgaacctggaccacttcgacccgtacacggccggcgcggggagggcgacgcaccagcaggcgaaggccgtactggaactggcgctgctctgccactgctcgacacggaccggcggaccccacgacgagcggctggacggggcgacggccctgctgcgcaagctctggcagcgcccggagttcccgcggctcttcgacgcccaccctccttccgctcccacctacggactggtctacgccgctctcgcgcccgacggaatcgacgacacggtgtgccgggccgcgctcgcgcggctcgctcccgacttcctctcaccggccggcaagtcgccgctcaagcgcatggagatccgcttctacgcggacaaggcaggcgccgaccacaccatcgagccgtacgccgaactcgtcggacagagcccgctcgtcaccctgaccgccgcggccacgggggacgcggcgacgggaaacgtggcaccgctcaccaactccgagggatattccctcacccacgccgcgttcttcctcggcgactacggacggaccgcgaccggtctggacggggatgccctggcacacgcgcgggagctggtccgccggatgctggaccactgcgtcggggaggagcggtgggacctggccgccgaactcgtcatcgcgcagttcatcctgggtcttgagccgctgcgcaccccttcggggaccgcggccgtggagtgcctggtgcgggcccagcggtccgacggggcgattcccgggcggtcggccgcgctcgtggcgtccccgtcggccccggtcggggagttcttccggaaggcgtaccacacgacgctggtgaccgctctcatgacactggtcctctccccggggaggccgtcatggcaccgcgactgaccctcatcagccccgacttcacgcggctctggttcggacaggccgtctcctccgtcggggacatggtcttcagcaccaccctgatgctgtgggtggccaccgtactggcgaaggacgagagctgggccccggcggcggtgagcggcgtcctggtggcgggcggcaccgccgtgctggtcgtcggtccgatcgcgggtgtcttcgtcgaccgctgggacaagcgccgcacgatgctcggcaccgaagtgctgcgcggcggtctggtggccctgctgaccgccgtctccttcctgccggccgacgcgctgcctgccggtgcgtggctcgccctcgtctacggcaccgtgctgctgctgcacgccgccgcccggttcttcgcaccggcccgcttcacgatcatcgcggacctggtgaccggggatgccgaccgcgccagggcggccggcatcacccaggcgaccggtcagacagccctgatcgtcggcccgccgctcgccgcgccgctgttcttcacgctgggcgtgcaatgggccatgctcttcaacgcgctctcctacggggtgtcgtacatcgccattcgttcggtccgggtggctccctccgcaacggctccggtcgacgggaagagcacggagaaggccgtcggccgccggtccggcgtgctgcgggagctcgtggcgggcctccgcttcttcgggcgcagcaagttcctggtcgcgctgctggtcttcgccgtgatcggccagttcggggccggcgcgctgaacacgctcaacatcttcttcaccaccgagaacctcggcatgtcggcccggctcttcggctacgtcggcatggccatcggggtgggcggcatcgtcggcgcgctgtgcgccggccgggtggtgcagtggatcggggcacggcggacgacgtgggccggcctgctggtgagcggcgccctgttgatcgcctactcccggcagaccggattcatcggcggcatcaccctgctcgtcctgttcaccattcccctcaccgtgctgaacaccgcgatggccccgctgctgctctcggcgg

SEQ ID NO: 3545 - DNA, 9438 bp, Unknown
  Kingdom: Bacteria, Phylum: Actinobacteria, Class: Actinobacteria, Order: Streptomycetales, Family: Streptomycetaceae, Genus: Streptomyces
cggtcggcgagcgcggcgacctcggcgtcgtgcgtggccagtacgacggtgatgccgtgcgagcgggccgccgtggtgagggtgcgcagcacctgggtacggtccgcgcggtgcagggtcgcggtgggctcgtcggcgaagatcacggtcggctgtgcggccagggcccgcgccacggagattcgctggcgctgcgcctggagcagggcgtgcggccgcttccgggcgaaggcggcgatgtccaggcgctccagccattcggtggcggtcttcctggcggcccggtgcgagaccccgcgcagcagcaggggcagcgcggtgttctcccagacggtcagctccgggaccagctccggatcggaggcgatccagccgaagcgctcccggcgcagctgttcgcggacccggggggtcatggtgtggacggggacgctgttgaaccagacctcgccctgctggggcaccagccggcccgagagacagtgcagcagcgtggtcttcccgctgccgcgcggtccggtcacagcgaggatctcggcgtcccggacaccgatggagacaccgccgagaccgggcgatccgttgtgggagtggtgcagggaacgcgcccagatcacgtcgttgtccggcggggccaccatggcgtacacctcggttcaggtcagatttcccattcccccgtacgggggaacgaagacgcggccgatcggtcactcggcaccgtagatagtcggaccggtgcgggcgcacagcacgcggcccggatacgccccttctcactcgaaggggcgtatccgggccggtgaaccgtatgaaatgaccgccggagggcgatcagccgggggacctggtgtcggtcagagcttggcccaggcctccgtgagcacggtccgcaggatgccctcgatctcgtcgaacgtcgactggtcggagatcagcggcggggcgagctggacgaccgggtcgccgcggtcgtcggcccggcagtacaggccgttctcgtacagcgccttggagaggaagccgtacaggacgcgctcggtctcctcgtcggtgaacgtctccttggtgaccttgtccttcaccagctcgatgccgtagaagtacccgttgccgcggacgtcgccgacgatcggcaggtcgtgcagcttctgcagcgtcgtcaggaacgcgttctcgttgtccaggacgtgctgggtgaggttctcgcgctcgaagatgtcgaggttggcgaggcccaccgcggcggagaccgggtggccgccgaaggtgtagccgtgcaggaaggtgttgccgccctcgtagaacggctccgcgagccggtccgagacgatgcaggcgccgatcggggagtagcccgaggtcatgcccttcgcgcaggtgatcatgtccggcacgtagtcgaacttgtcgcacgcgaagatggtgccgagccggccgaaggcacagatgacctcgtcggagacgagcagcacgtcgtacttgtcgcagatctcgcggacccgctggaagtagccgggcggcggcgggaagcagccgcccgcgttctgcacgggctccaggaagacggccgcgacggtctcggggccctcgaagaggatctcctgctcgatctggtcggcggcccagcggccgaaggccaccgggtcgtcgccgaagagcggggcgcggtagatgttggtgttcggcaccttgtgcgcgccggggaccagcggctcgaagggggccttcagggctgggaggccggtgatggacagcgcgccctgcggggtgccgtggtaggcgacggcacgcgagatgaccttgtacttggtcggctggcccttgagcttgaagtactgcttggccagcttccaggcggtctcgacggcctcgccgccaccggtggtgaagaagaccttgttgaggtcgcccggggcgtagtcggccagacgctcggccagctcgacggccttcgggtgggcgtaggaccacaccgggaagaaggcgagctcctgggcctgcttgtacgccgcctcggcgagctcgtgacgaccgtgaccggcgttgaccacgaacaggccggagagaccgtccaggtagcgcttgcccttgtcgtcgaagatgtacgttccctcgccacgcacgatggtgggaacaggcgcgttctcgtagtccgacatgcgggtgaagtgcatccacaggtggtcgtacgcggttcggctgaggtccttgctcacggctatcgggttccccacatataggtctgcttcttgagcttgaggtaaacaaagctctcggtggagcgcactccgggaagggtccggatgcgtttgttgatcatctccagcaggtggtcgtcgtcctcgcagacgatctccaccatcaggtcgaaggagcccgcggtcatgaccacgtactcgcactcggccatggccgacagggcttcggccaccgggtcgaggtcgccctcgacattgatgccgaccatcgcctggcgccggaatcccacggtgagcgggtccgtgacggcgacgatctgcatcacgccctggtcgagcagcttctggacgcgctggcgcacagccgcctcggagaggccgacggccttgccgatcgcggcgtacggacgcctgccgtcctcctggagctgctcgatgattgcgagggagacggcatcgaccgctggcggtgatccgttcccggtcctggagtctgcgctgcgactggccacacacccaccatgcaccgctcctcgtctgtctcgcaaccccggatcgatgaaattcgttgtctgggtgcctggatctgactgaatccgaagttgggggcgggtgggtatgtcgaaagcgtcaccggaacgattagggtggacatctcacccatcggacagccgacaggaggggtggttgtgaccaccgaggtgcgccgtctgcgcaactacatcaacggagagttccgggacgccgcggacgggcggaccatcgatgtggtcagcccggtgacggaagaggtctacgcaacctcgccgctctccggtcaggccgacgtcgatgccgccatggaggccgccgcggcggccttccccgcttggcgcgacaccacgcccgccgagcgccagaaggccctgctgaagatcgcggacgcgttcgaggagcgggccgaggacctgatcgccgccgagtcggagaacaccggcaagccgctcggtctgacccgcagcgaagagatcccgccgatggtggaccagatccgcttcttcgcgggggccgcacgacttctcgaaggccgctcggccggcgagtacatggagggcctgacctccatcgtccgccgcgagccggtcggcgtctgcgcccaggtcgcgccgtggaactacccgatgatgatggccgtctggaagttcgccccggcgctcgccgcgggcaacacggtcgtcatcaagccgtccgacaccaccccggcgtcgaccgtgctgatggccgagatcatcgggcagatcctccccaagggcgtcttcaacgtcctgtgcggcgaccgggacaccggccgcgccatggtcgagcacccgaccccggcgatggcctccatcaccggttcggtacgggccggcatgcaggtcgccgagtccgcggccaaggacgtcaagcgggtccacctggagctcggcggcaaggcgcccgtcgtggtgttcgaggacgccgacatcgccaggacggtctcgggcgtctccgaggcaggcttcttcaacgcgggccaggactgtacggccgccacccgcgtcctggtccacgagtcgatccacgacgagttcgtcaccgcgctcgccaaggccgccgccgacacgaagaccgggcagccggacgacgaggacgtggcgtacggcccgctcaacaacgccaaccagctcaagcaggtcagcggcttcatcgagcggctccccgcccacgccaaggtcgaggcgggcggccaccgggtcggcgacaagggctacttctacgccccgaccgtcgtctccggcctgaagcaggaagacgagatcatccagaacgaggtcttcggacccgtcatcacggtccagtccttcaccgacgagaagcaggccgtcgcgtacgccaacggcgtcgagtacgcgctcgcctcctcggtgtggacgacgaaccactcccgcgccatgcgcatgtccaagaacctcgacttcggctgcgtgtggatcaacacccacatcccgctggtcgccgagatgccgcacggcgggttcaagaagtccggctacggcaaggacctctccgcgtacggcttcgaggactacacccgcatcaagcacgtcatgacctccatcgaggactgacgcctccgccgctaccgtgcacggccccgggcttcggcccggggccgttcccgtgcaccctctgtacaaggtgtgcggggcgggcccgccccgctggacgcttggtccattgtccgcgcgagcgccgaccggcattctgcgcgggtgccagcgatcaggaagaaccccatgtcccgccgttccctgctgcgcgccctcggggcgggagcggccggcgccacgctggccggctgcggggtgcccgcggccttcgtcgagcccggcgaccgggccggacgcgacagctccgccaccgaccacaccctgcacttcgccaactggccgctctacatcgacaccgacgacgatgacgagtcgaagcggcccaccctggacgccttctcggagcggaccgggatctccgtgacgtacaccgaggagatcaacgacaacgacgagttcttcgggaagatcagccccgcgctgatgaaccaccaggagaccggccgcgacctgatcgtcgtcagcgactggatggcggcccgcttcgtccggctcggctgggtccaggagatggaccgcgccaagcagccgaacgtcgccacgtacctcgacccactgctgcgttctcccgtcttcgacgagggccggcgccacagcgtcccctggcagtccgggatcaccggcatcgcgtacaaccgcaagaagctcggccgcgagatccggtccaccgacgacctgtgggcggccgacctgcgcggccgggtcaccctgctctccgggctcgacgagtcgttcgcgctgctgatgcagggcaacggcgtcgacatcacccgctggacggccgacgacttccacgagatctgcgagcagacccagaagcgggtccgctcgaagcacatccgccgcttcaccggcaacgactacatcaaggacctcgccaccggcgacgtgctcgcctgccaggcgtactccggcgacgtcatccaactccaggccgacaaccccgacatcgagttcgtcgtccccgaggagggcgccgaactgtgggcggagtccctgatgatccccaacctcgcccgccacaagcgcaacgccgagcggctcatcgaccattactacgaccccgaggtcgccgccgaactcgccgcctgggtcaactacgtctgccccgtacccgccgcccgtgacgtcctggcctcctcgaaggacgaggagacggccgcgctcgccgaggatccgctgatcttccccgacgacgcgatgcggaaacggctcgccatcgcgcgggacatcacctccgaggaacggatggacttcgccaagaagtggaactccatcgtcggcttgtgaagcgctgacagggttgccgtaaagagacggtaaacacgggcgtacgctgcggacatgagcgagcgacacgccctcacgcggcgtatacgcaggtggttggtgttcttcatcgtctgtctggtgctgagcgggctcacggctttcccgctcgtcaccgaactccgctgggccgaggatctgctgagcgcctcggcctccccggtccccgagcaccttcccggtctgatggagtggatcacccgggtccgcgaagggctcgacaccgtcgaccgcgagcagcccttcatgctgtacggcaccgactggctggccttcgcccacctggtcatcgcggtcgccttctacggcccctaccgcgacccggtccgcaacatctgggtcatcgagttcggcatgatcgcctgcgccgggatcatcccgctcgccctgatctgcggcccgatccgcgacatcccgttctggtggagcgtgatcgacatgtccttcggggtcttcggcgtcatcccgctgctgatcgtccgccgcatgatcaagcgcctggaggcactggagcaggcggccaccgcgagcccggcgcccgtcccggcgagcgcctgagccaggaacgacacgggctcagggcttccgggccaccaccccgaactgcgcgacctccggctcccgcgggttcgtacgccagcgggaacaggagacgatgcccggctccaggatctccagaccgtccaggaaaccggcgaactcctcccggtcgcgcgcgatgatgggcggtgtggcgttctcgttccagaagcgcatcgccgcctcgttgccctcgccgcccagctccagcgtcgggtgggtcagcaccaggtggctgcccgagggcacggccgccatcagcgtccgcacgatggaccgcgcctcgtccgtgtccagcacgaagttcaggatgccgagcatcatcaccgcgaccggccgccccaggtccagggtgggttcggcggcccgcaggatctgctccgggcggtgcgcgtccgcgtcgacgtactcggtcgcaccctccagcgaactggtcagcagggcgcgggcgtgggccagcacgatcggatcgttgtccacgtacacgatgcgcgcgtgcggcgcggtgtgctgggcgatctcgtgggtgttgttcccggtcggcagcccggtgccgatgtcgaggaactggtcgacgcccacgtcgccggccagatgacgcaccgcccggccgaggaacgcccggtccgcgcgcgccacttcaccgatgctcgggtacatcccggtgacctggtcgcccaccgtccggtccaccgggtagttgtccttgccgcccagccagtagttccacactcgggcgttgtgcgcgacgtcggaacgtatccgggcggtggccgcctgcggtcgggggtccatcacatctgctcctcgatgcccaagggcccggcgccccggggaggcggcgggcggtgcggggttccccatcatgccggaccgatcaagaaccgccgcgaccgggcgagttggccagcagccggtgaagcgtgtcgatccggttggtggtgatcgagtcgaccccccgctcgatcagccggcgcatcgtgcgcttcgtgtcggccgtccacgcggagacgagcagcccgtcccggtgcgcccggtccgtcagctcccggctcaccaggccgaagcggtagttcagccagcgcggcttcaccgcggccagcagctccggacgcggcggggccagcgtggtccaggtcagggcgatctcggcggacggatcggcggcgcgcacccgcagcatcgcgtccgcgctcgcgcagtagtaggcccgctcgccggccccgcactcccggaccgtgccgacgatcttcttcaccgaggcgtccgtggagccgggcaggtccaccatcacccggtgtgtcccgacggcgagcagcgcctcgcggagcgtgggcaccccaccgcccgtcagctccttcagctccgcgtggtccagccggtccagccgccggtcgtggccccacaaccgctccagcgtcgcgtcgtgcagcaggacgggcaccccgtcgcgggtcacccgcacatcgatctcgaccgcgtccgccccccgttcgagggcggagcggatcgagggcagagtgttctcgcgggcgagatacggatcgccgcgatgccccacggcggtgacgctggtgacggtgtcggccatggggccattgtcgaccaccgggtcagcggccggggggccggagccagttcgtcgtgtacgtgtcgatctcctcggccagcttccgcttgcccgccgggtcgaggaacgaggcctccacggcgttcttcgcgagctccgcgatgccacgctcgtcgagctccagcagccgggcggccaccgcgtactcgttgttgaggtcggtgccgaacatcggcgggtcgtcgctgttgacggtcaccagcacgcccgccgccaccatctcccggatcggatgcagctcgatgtccgtgaccgcgcgagtggcgatgttcgacgtcgggcagacctccagcgcgatgcggtgctcggcgaggtgctccagaagtgcgggatcctggacggagctggtgccgtgcccgatgcgctcggcgcgcagcgcggtcagggcgtcccagatcgtctgcggtcctgtggtctccccggcgtgcggcacggagtgcaggcccgcggcgatggcccggtcgaagtagggcttgaactgggggcggtccaccccgatctccggtccgccgaggccgaaggagacgagcccttcgggccggtgctccaccgcgagccggacggtctcctcggccgactggagcccggcctcgcccggaatgtcgaagcaccagcgcaggacgacgcccagctcggcctcggccgccttgcgggcgtcctcgatggcctccatgaacgcggcctcggggatgccccggcgggtcgagctgtacggcgtcacggtcagctccgcgtaccggatgttctgccgggccatgtcccgcgccacctcgaaggtgagcagccggacgtcctcgggggtgcggatcaggtccaccaccgagaggtagacctcgatgaagtgcgcgaagtcggtgaaggtgaagtagtcggccagcgcttccgggtccgtggggaccttggagtccgggtggtgggcggccagctccgcgacgatccggggcgaggccgacccgacatggtggacatggagctcggccttgggcagcccggcgatgaagggatgcggatcggtcatcggaaatctcccgttcggcgtgacgtcggccgggcgtaccggccccaccgatcatcgcaggcggggtccggggcgttgaggcctggccgtagcatgacgggaccacgatgggggaggcccatgtcagacaacacagagcagcccgggggcggggccgcgccgcgcgatccgtgggcaccgccggacagcaaggtggaactgggcaagccgggtgcgcacacgccgccgcccgccccggtccacgaccagccgaccgtgacgtcgatgccgggcgccggaccggccgcgggggacggcaccgggccgataccccagcccggaggcttcgggcccgcaccctcggacgtaccgccgccgccgatcggcccgaacggccccggccacgcggccccgccgccggccgccgcgcactacggctacccggctccgcctccgcagccgtacggcggctacccgggctacggcgcctacggagcgggtccggccggctgggcccccgcgccaaacaac

SEQ ID NO: 3546 - DNA, 2413 bp, Unknown
  Kingdom: Bacteria, Phylum: Actinobacteria, Class: Actinobacteria, Order: Streptomycetales, Family: Streptomycetaceae, Genus: Streptomyces
cgatgaaccggtccgcggtggtggacatggcgttgtgcgaggtgaggtaggcggcttcgtcgtagcgcagttcgcacaggcggctgctgcccaggcactggcggggtgcggacgggccgaacgcgggtggcacgagcaggacgccggccagtgcggcacaggccacgcccgccgccgtcgtgcgcaccgccgtcggggccggggtcagcatccggcccgggagcaccagcagcgcccagcccacccccgtgaggagcacgccgccggcaagagccgtgagggcggcgctcagcccggtggccaccgcctggttcacggcgctgcgccggaggtcgtcgacgagcgcggtgacgctcggggaccaggaggacggtgtggtgaggaggcgccctccggtgaccagccgggccaggagcacggccgcggcggtcaggactcctgcgcaggcgagcgcctgtcccagtcgcatcagccgacgggccggggcagcgggaccggtgaaccagagcgtcgcgagggcggccagtgcgagggcgatggcgagggtctggagcagggtcaggagcctgatggcgtcgcgggcccgttccagggccgtgaggtccgtcccggcagtggtcagggtgccggtgaggtcccacgtaccgtcctggagggtggcacggaggtcggcggcggcgctccgcgagccgtcggagagcgcggcggcggcggtggcggccagcgcggtcgacacgtctccctcccgcagggccacctcgatctcggggcgcagcgctgtccgctcccgcgccgggaccgccgcgaggagggcgtcggcggcacggtcggcctggtcctcggtgagcgggagcgtgggcaggtccggggcgcggccctccttgagggcgtcgagcgccgtcgcgaggtcggcggtgaagcgttcgaagtccggctggtcgcggccctggacatgggccaccaggtcgccgaagtagacgcgtgcgaggtcggcgaggttctccagcaccggggccaggtcgacggtcagccggagttcttcgcggtcgccgcgcagatagccggtcaccgcctcgatctgctggtcggtgagggcccggaccgtggcgggcggcagcacgaccttgatgttcgacgtcaccagcgcctcgggcacgggcaggtgcgcgagcaggtcgcgcgtgacgggcgagatctccgggtcgacgagcacctcgctgtagaggcggtcgtacgccgactcctcgtccagcaccgcctggtagaagccgggcgaggcgaccgtggaccggacggtcgcggtcagggcgacggtcatcacgcacaggacggccagcaggaaggcgagcaccggcacgagacagccgggccggcgcggggacgcggatccccgctccggcccgatcgggttcgcggtcggttcggcgctcacccgcccaggctatgcggaatatcagcttttatgcatgaatgatgagatccaggagctgaggagcccgctgtgcactccgttcatttggccgtgctgatgacgagtcacgaccgccgcgcgcgaacgctgtccgcactgcgcgccctggaggagcagcgtgggctccccgccgggacgacgttcggcgtgcatctcgtggacaccggcagcaccgacggtacgccggaggcggtccggctgcggcatccggcggtggaggtcatgtcggtgggctcggacgtcccccacaaccaggcgctgcgcatcgcgagccgcaacagccgcagcggcggcgggggcggcggtccgctcggcggcacgcccggcggaccgacccactcctggacgcatcagctctggctcgacgaccgggtcgaactgttcccggacgccctcgcgaacctgctgcggacggctgcggcggccgggaccgggatcgtcgtcgtgggcgcggtgcggaacgcgtacggggacacggtgtactccggccggcgcggcaggtccctggttctcgtcgagcccggcaagcaccggcccgagccctgcgacacgtacgacgggcgcgtggtgctggtgccccgtgccgtgcacgacctcgtcggggaccccgacaaggtcttccgccaccggatgggcgactacgaccacggctgccgggcgcggcgggccggggtgaccgcgttcgtcgccccggggcataccggtgagtgcgtgggcgggccggacacccccggatcccgggagccggggatcggcgtccgggaggcgctgcgccgcgtgacctccgcacaggagctgcctctccacccgtggtgggtgtactgcctgcggcacacctggccgtgggcaccgtatctgatgctctccccgtacgcgcgcaccgcggcccgtgccacgctcggccggctgcgggggtgacccggagccggccgcggcggctcc

SEQ ID NO: 3547 - DNA, 1622 bp, Unknown
  Kingdom: Bacteria, Phylum: Actinobacteria, Class: Actinobacteria, Order: Streptomycetales, Family: Streptomycetaceae, Genus: Streptomyces
  misc_feature (1384)..(1416): n is a, c, g, or t
cccgccgccctggcggccctgcgcgaggtcacccaggccgtgaagggccgcggggcgtgcaaacacccggacggttccgcccggttcctgctctcgaccctgtcggcgttcacggacgacctcgccgcacacgtcctggacggcggctgcggccgcgagacggtcggagtgctgccactgcccgcacccggccaccaggatctggaggagtcgattccgagcggcgagaggctcgcggtcgactggacgctctgccagggccacgccctgtgcgcggacatcgtccccgagctcatccggctgggtccggacggctatccggcgctggcggacgccgccgttccgatgcatctgcgcggacgcgcccagcgggccgtacggcgctgtcccgccctggctctccgcatcgagcagccgccggccgagcagcgccccgcactgccggccacgggccggcgtgcgctgggcagtggacgcggctgatccaggccgaagccgatccggacgggcctgatccggacagaaccgatcccgaccggcccgaccggacaaaagaagcgggccacccgatccgggtggcccgcttccttactgtcgatcctgtggagctaaggagaattgaactcctgacctcctgcatgccatgcaggcgctctaccaactgagctatagcccctcgccgcgtgccgcccggtttcccttggcgacatcgagaacattacacggtccccccggtgcttcaccaaatcgtttccggtccgcaccgatacgcccgaatcatcccgaacggtggatcgtcagccgcaggtcaggcggtcgcgaaggagtagaagcgcttgagggtgcagtgctcctccagaagccgcccgtagatcggttccccctccagctcccggtaggtctcgatggggtcgccttttatgatcagcgcccgtgcgcattcctcgcaccagtactggtactccgcgttgaccgggtccatgtccctgacgatgggcgtaccgctgccgcaccagtcgcacttacgcctgtgtgcacccatcagtcagctccagctgtggccgcaggccgtgcacacgtaggagacccctccgttgtcacccagaacctgggccacatgggacgaaccgcaggacggacagccgagacgggatcgatcttcgaacggtacggggtcgggagacggggcggcgacaagaggctggtcggggacgtgttcgcgactcgcagacatcgcgctccctcccgatcggtacgtcgccccctccggcgttccgattctgccatgaccccgcaaggggggcagcccgctcggagcccctatgcagaagatcccgccccctggtggggacgggatcctgattgtggagctaaggagaattgnnnnnnnnnnnnnnnnnnnnnnnnnnnnnnnnngtcgtcgccgaggaccggctccgggagcgtgccggcgttgtgctccagcagacgccagccacgagcaccctcgccgaggacggaccagcagcagttggacagcccgccgagtccttcccagtggtgtgcctccaggccgagcagccggccgatcgtcgtcctgatcgtgccgccgtgactgaccacgaccagcgtgccgttctccg

SEQ ID NO: 3548 - DNA, 528 bp, Unknown
  Kingdom: Bacteria, Phylum: Actinobacteria, Class: Actinobacteria, Order: Streptomycetales, Family: Streptomycetaceae, Genus: Streptomyces
gcccggctcgacgcggacgccgtacccggcgagccggtcgcggaggatctcctccagccgccactgggcgatcagccacccccggtcgtagtgggcgtccggggaaggtgtggagtccgcccacggatcggcctccgcgaccgggtggcggtcgcggtacttgagcatcggcagcggggccgaaccggcggcgagtacctcctccgccactccgagatcgtccaggatctccagcgaccgggggttgggccccttggcccgcgaggtgcgcggcggcgcgggggagcggtccacgatccgtacggccgcgccgcgccgcgccagatcgcaggccagcaccagcccggtgggtcccgctcccacgatgagtacgtcggtcatgcccatgcctctccttcggtcacgcttcccgtccatccaggaacagggaaacgcaaccgagtaagaaaagcaactaggtaaccttttgttgcgcggggtcctgggccgtggccgtcgggtcgggggtcgtggccccggggtccgggg

SEQ ID NO: 3549 - DNA, 2967 bp, Unknown
  Kingdom: Bacteria, Phylum: Actinobacteria, Class: Actinobacteria, Order: Streptomycetales, Family: Streptomycetaceae, Genus: Streptomyces
gcctacgaggcgtacgaggaggtcttctcctccgaccgctgggcccccctggacaaggcgcaggccaacaagcagcgtcccctgtgggcctcgaccggcgtcaaggacccctccctgaaggacaccctgtacgtcgacgacctggtggcgccgaacacggtgaacaccatgccggaggccacgctggaggccgtggccgaccacggcgagatcaccggcaacaccgtcaccggcggctacgaccaggcacgcgccgacctcgacacgatcaagaagctcggcgtctcgtacgacgaggtcgtacaggtgctggaggacgagggcgtcgagaaattcgaggcgtcctggaacgacctgctcaagtcgaccgaggcggagctttcgcgcctcgccccctcggagggctgaccactttgtctgctgttcccggagccaacccgctccgtgacgcacaggaccgacggctcccgcgtatcgcggggccgtcgggcctggtcatctttggcgtcacgggcgatttgtcccgtaaaaagctgatgcccgccgtctacgacctggccaatcgcggcctgctgccgccgggcttctcgctcatcggcttcgcgcgccgcgactgggaggacgaggacttcgcccaggtcgtccacgacgccgtcaaggagcacgcccgtacgccgttccgcgaggaggtctggcagcagctcatccaggggatgcgcttcgtccagggcaacttcgacgacgacgaggcgttcgagacgctgaaggccaccatccaggaactcgacaaggcgcaggggacgggcggcaacttcgccttctacctctccgtgccaccgaagttcttccccaaggtcgtccagcagctgaagaagcacggcctggccgaccagaaggacggctcctggcgccgtgccgtcatcgagaagccgttcggccacgacctggccagcgcgcaggagctcaaccagctcgtgcacgacgtcttcccccccaacgaggtcttccggatcgaccactacctggggaaggagacggtccagaacatcctggcgctgcggttcgccaacacgatgtgggagccgatctggaaccggtcctacgtcgaccacgtacagatcacgatggccgaggacatcggcatcggcggccgggccggctactacgacggcatcggcgccgcccgtgacgtcatccagaaccacctgctccagctgctggcgctgaccgcgatggaggagcccggctccttccacccgaaggccctggtcgccgagaagctcaaggtgctcaccgccgtcgagctgcccgacgacctcggcaagcacaccgtgcgcgcccagtacgagcacgcgtggcagggcggccaggaggtcctcggctactgcgaggaggagggcatcgaccccaagtcgacgaccgacacctacgcggcgatcaagctgacgatcaacaaccgccgctgggcgggcgtgccgttctacctccgcaccgggaagcggctcggccgccgggtcacggagatcgcggtcgtcttcaagcgcgcgccctacctgcccttcgagtccggcgccacggaggagctgggcggcaacgccctggtcatccgggtccagccggacgagggcgtcaccgtgcgcttcggctccaaggtgcccggcacctcgatggaggtccgggacgtcacgatggacttcgcgtacggcgagtcgttcacggagtccagcccggaggcgtacgagcggctcctcctggacgtcctgctcggcgacgccaacctcttcccgcgccaccaggaagtcgagctgtcctggaacatcctcgacccgatcgaggagtactgggacaagcacggcaagcccgcgaagtacgcggccggcacctggggtccgaccgaggccgacgagatgctcgcacgcgacggacggagctggaggcggccatgaagatcgatctcaccgaaaccacgtccagcaagatcaaccaggcgctggtgtcggcccgccgggccatcggcacccccgccatcggcatggtcctcacgctggtcatcgtcaccgacgaggagaacgcgtacgacgcgctcaagtcggccggcgacgcctcccgcgagcacccctcgcggatcatcgcggtgatcaagcgggtcagccgctcgccgcgggcccgccgggacgcccggctcgacgccgaggtccgggtcggttccgacgcgggcaccggcgagaccgtcgtcctgcgcctgcacggcgaactggccaaccacgcccagtcggtggtccttccgctgctgctgccggacgccccggtcgtggtgtggtggcccgagggcgcgccctccgacccggcgaaggacccgctgggggccctcgcccagcgccggatcaccgacacctactcggccgagcgccccatcgaggcactggcggtacgggcggcgacgtacagcccgggcgacaccgacctggcctggacccggatcacaccgtggcgctccatgctggccgcgtcgctggaccagcagcccgccgaggtgatcggcgcgaccgtcgagggtgagagcgacaacccgagctgcgagctgctcgccatgtggctcgcggaccggctcggcgtcccggtggagcgcatggtctccgaaggccccggcctcacggcggtccggatggagacgaagaacggcgtgatcgtcctcgaccgtgccgacggcacgctggccacgctctccatgcacaaccagccggaccgcggtgtggcgctcaagcgacgcgacaccgccgagcttctggcggaggagctgcgccggctcgacccggacaacacctacgcgtccgcggtgaagttcggcgtcgaccggctgcacgcgggcggcgaggtcacggccgcgccggtcgcgagcgccgaggagaaggcggacagggccgccgaggccaaggctcccgccgcgaagaaggccccggccaagaa

SEQ ID NO: 3550 - DNA, 8191 bp, Unknown
  Kingdom: Bacteria, Phylum: Actinobacteria, Class: Actinobacteria, Order: Streptomycetales, Family: Streptomycetaceae, Genus: Streptomyces
gtcgacgccgtcgcggcggcagccgcggctcccgacgcgacggcgtagacagcggcggccaagcgctcgccgtagaccgcccacagccactgctgagcctgccccacatcgtgaatctccgccgtcggcgaacctgttgggccaagcaccggccaggtcaggacagcacccgcgacatcgagaacggcccgggtgaaggcggggccgacggagggtcccgcgatgcgtacggtgccgtcctcgacccgcgtgacgccacagcgccgttgcggcatcacgcgctcctcggctcggcggcggactcggcggtcgccgagagggtgcgcagggccgtacggactcgtgcgcggtggtccatcatcaccgagcgggcgaccccgtcgagcacgccccaggccgatgccgcgtcgggcagtgccgcgtcgcggacgtcgcgcccgtgcagccgtacccagaggcgccgcatgtacgcggtccacggggtgcgcaggtcctgggcgagggcgttcagcacaccgccgtccgggctggggcggagggagacggtcatcctgcgggctcgcaggaccgaagcctcccgctgccagcggctgttgacgatgcggtgtgccgccgtcgaccccgccatggaggtcccggcgcccagtggatcgaggcccaccgcgagtcggccaccgagcacgacagtgacgcgcaggctctcgtcgtacaggcccagcggggcgcagctgcggtcgacctcccgccggacgagctccggcacggtcggcagttgctcgcggtgggccgacgccaggagcacggtgaagagccgttcgaagagcgtgcggtcgaacggcgcggggagggtggcggtcgaggcgctccgcccgacctcgggacgtgggggcgcgcggtgcgcggtcagtccgaggtgcgggggtaggtcggggcggtcccagacgtcggccgggtgggcggcccacagggctcgcccgagcaggctgccgtgctcggcccggaccatggcggcgaaggcctgcgagtcagcttccgccgcaccgcaggcctcgaggacctcggccgccaggcccgtatcggcggcgccgggcaccgcttcgcggccgtcccacgccgctgccagctcggcgtcgagccgcgcgcgccgggcggcgtccgccagatgctccttgagcgcctccaccgtccgtcctccggaagcgtccacgacgtcctcaagtaccgccctggccaccgcgtccgcgccgggtcccggcgccccgtgctcggtcgccagctcgaagcaccgctggaaatacaggtcctgggggttgccggccacgatccccagtgcccggcgggtcctcttcagcagagtgaaccactgtgccgtcgcttccagaaccgcaccggactcccgtatcagcgcgtcgagtcgctccgcctcccgcgcgtcgaggaagtcggcggcgagctccggacgcaacgtgggccggacgaccagcggcagcacgatcaacttgaccgtccgggtcagcggcgcgccaccgggcccactcagcgcccggggacccggcccgaggccgcgccaagccctgtcgatgaccatggcgcgcggacggcgctcgccggtcgacggctggctcggggacggcatgggcagagcgtacgtcctgggggaactggtggtcgaacctgggatcggtaggcgccgcccgcctcctaacgtccacatcaccaggcagaacggaccggaagggcaggcgcagcatgggaatcttcggcaagggcaagggcaagagtcgcgaggagaagaccgccaagatcgtcgagcaggtggccgacggcaagggtttctacggccgtatgacgcgcgcgacgctcggcggcgaggactacgccaagctccagcagtcgctcggcgcgtacaactccggtgccactgtgcaacagttgctcgccatgggcgtaccgacggtccccgccgtcgtcgtgtcgatcagcgacaccggcaggctggtcaacttcgacccggtcgtcgacctggtcctccagctgaccggggtcaccgccgagccggtcacgctccagaccatcgtttcgaaactgcgcatcccccgcgccggtgatcaggtactactgatcgcggacccggccaagcccggcggttacctctacgcgggagacggggtgacgccgtgaagacagcaccgcgcgaagtgccggcgaacgtcaccaccctgctcaccttcgacggacgggtgcagccgggagcgccccgccaccacttctcctccgacccggagcgcctcgacgccccgcgcgccttcgccgtgcaacgggcgcggggcgtggccgagagaccgcggctctgacgtgagcgacggggagaacggccccgcgccgacacaggtgtcgaatgtcggcccctgggcagccgcctggatgtacctctttctcgtggcgctcgggctgttgggaccgttcttgatcgtcctcggcgtcttcatcggccagggcgtggtcgtcaccggcatcgtgtgcacggtggtcctcgttcccgtgggtttcgtcgtggggctcaccgtcgccgccgaacggaggcacaaccgccggctcgacgctttcggggttccggcgaccgcggagatcaccgaactgaccgaatgggacactggggacgacggcggtgccgtggtcgtcctgcgggtcagcgggccgggcttccggacgttcgaggccacctggagacgctcgcagcatcccgccctgcgcgtgggcctccgcctcgacgccgtggtggacccgtccgggaacctgttccgtgtcgtgctgtgaccaagccgccgcagaccacaaggtgtcccgactcctggaggaggccccgcctaccggatggccgacatcctcccggcaaccgccgccgaacgcggcccgggcccggccaccggcggacgcgtcgttgacgcctcgctcgcccgcgccgccgctgggacccaggagaagtccgccccggcacgatcgccgtccagcgtgcttcgcgctccgggctgggagccggcggagcaactgcacccgccatcctgtcggatccggtgcggcgggttcgcgtcggagcggcgtgagcctcgggtccggtgcttctcagctggtggcggggccggtccagtccgcggggacgtggccgaggcggacccgctgcgggtggtcgccgacggggatcgagatgaccttcttgccgctggagaagtcgatggccgtcacctggtcggtgccgctctcggacaccacgcagtgcttgccgtctccgctgacggtggcccagtacggcttggaggcggtgacgagcgggccctcctgaagggactcgcggttcacgacggtgacgtagtcgtccatggttccggcgatgcagagcttgtcgcccccaggactcatggacatgccgtgatggcgggagtcgttgacgtaggtggtgcgttcgtcgctggtgtccgggttcttcggcagcgtcttcactcgggtgattttgtcgttgtgcacgtcgtactcgacgaagccgttgaagaaggagacctggaaatacatcttcgactcgtcaggcgtgaaggccacggggcgcagcgcgtcggacaggtccttgcggccgaagacgtcgagtcgctcgcgcatgtcgatgatcttcttgacctggaaggtcttcgcgtccgcgacggtgatgcgacgatcccccttggtgaagtcctgccagggcgcgtccatgtcggtgttgacctcaccgatggccatgttccagaggtactttccgccgtcggtgtacacgttctcgtgcggcttgtcgcccgtcttgaaattgcctgcctccttgcccgtcgccatgtccaggacgtgcacggtgttggagatggaggaggagacggcgacctgggtgccgccgggggtgaccgccatgtggtcggagcggaaaccggacaccgggaagcgccagttgatcttgccgctgttcacgtcgatggagaccacatcggcgaaactcgggcgggaggcgacgacggacttgccgtcgttcgtggtgtacatgtcgtcgacgtactggtcatgaccctcgcccgggccgagccggataccgaggaagaaggcgagcttgacggggttgaggtagatctcccgcaggcgctccttcttgtcggggatcatgtcgatgcggccgattttggcgtagtcgccacgggagttgatgacgtcggcggttccttcccagttgttgccgacgaagaacacctccttgagctgctcaggggcggcttgtcgcgcctgcctcgggatctcgctcgcgccggccgagccggagatggccggcagggtgcccgcggtcagtcccgcgaggaccagggcggtcgcggcgaaggtgcgtcggcggtgaggacggggggtacaggaacgcatcacggtgaactccggaggcagggaggggcggcgcgccgtcggacaggcccgcatcgcctgttaccagaggtaacgtaaccaggagatacggaacttgaacagagccccatcgaccttccttgacgcgtgaccatcgatcccccgccggttcacgacgtccttgctccgatggcacggaccccaatgatgctgatgctccaacaccttcggcagccacggctcgcggggcgaacgcaccgcggtcgcgtggggcgcgacctcgaacctggagaatcctcatgcaccaacggaccgctgagctgccggaggcgcagtacagccccctgcgcatccgggccacgtggggtggcacgggaagcgtggcaagaagtatcggcaaaccaccgcttgcagcagaggtgaagccacgctcacgcacagctgggggcagatcggcgcgcactccgctcagccccggacgaccccccgactccccttcctgcacagccggcggcccgcgtgcgggcccgggccgacgaagcacccagtcggctgactccatggagcgggcgtggtgagtggcgccaccggaagccgccggcgtctgactcaactccgtcagccaccgacagggcggccacgatgcgctgtgatcactcagcgtgctggtcatacagccgaacgaacacccgcccgcccccgtcacagcgctcgcggcatcagcacccctggggagaatctggggagtattcgaaggctggggagcgtgcggggagaatcggctgcataacgcagcacgaaaccgaaagacactgaaagacacatccacgcaggtcaggggccccgtagaattacacattcgcaggtcagcgccaccgggtagacaacgtcatgacgtagtccaccgggttcggcaaggccggcctgagccgttctcgtgcggagccgacgtccgcgaccaaggtaacgggccatacgcgggccatacggggcaaccagcaggcacgggcaacgttattgctggtctgcggagcatgacctctgtaccaccagcagacgacgtatctgcaactccgacgttgggagcctgggacttcgcagacacctttgcggtggcatcggacacgccgcgttgacatcatcacattggagcaccagaagccgcccctcaagatcgaaaagcgccgtgccagcaaggtgaccatcagtcaggactcagcaagcagtcagcctcagtaccgccgcaaggcgcggcaagccgccacggaccgccaagatccacaactggctacaccctcgctcaccaggaaaaacgcaggtaccgaagccctctgctacgttcaccaggagactggcatgaaaatgctcatcaacgttcccgagaccgtggtcgccgatgctctgcggggcatcggcgccgcgcatcccgagctgaccgtcgatgtggagaaccgggtcgtcacccggcgggacgcgcccgtggcgggaaaggtgggcctcgtctccggaggcggttccgggcacgagccgctgcacgccgggttcgtcggacccgggatgctgtcggccgcctgccccggggaggtgttcacctcccccgtgccggaccagatgctgcgggcggcggcagccgtcgacagcggggcgggggtgctgttcgtcgtgaagaactacaccggtgacgtgctcaacttcgagatggccgccgagctcgccgacgacgaggggatccaggtcgcccaggtgatcgtggacgacgacgtggccgtgagcgacagtacgttcaccgccgggcggcgcggtacgggagccaccctgttcgtcgagaagatcgccggagccctggcggacgagggcgctccgctggagcgggtggccgccgtcgcgcggcaggtgaacggggcgtcgcgcagcttcggggtggcgctcggcgccgtcaccactccggccaagggcagccctaccttcgatctgcccgcaggggaactggagttgggcatcggcatccatggcgagccgggtcgtgagcggcggccgatgatgacgtccggggagatcgccgacttcgccgtgaacgcggtgctggaggacctgcggcccaccggcccggtgctcgcgctggtgaacggcatgggggcgacaccgctgctggagctgtacgggttcaatgccgaggtccatcgggtcctgtccgagcgcggcgtcccggtcgctcgtacgctcgtggggaactacgtgacgtcgctcgacatggcaggctgttcggtgacgctgtgccaggtcgacgaggagttgttgcgactgtgggacgcgcccgtgcggacggccgcgctccgctggggctgctgagcgccgacgggatcccgtgaccgggtgcgcatccggcgcggggccggccgtacagcccgtgccgccgccgggacgacccgttccggggggaccgaggaacaggagatcatgtgctcgacaccgacttcttccgccgctggatgaccgctgtcgcggcgtccgtggagcgtgaggcgaaccatctgaccgagctggactcggcgatcggggacgccgatcacggcagtaacctccagcgcggcttcacggcggtgacggaggtgctggagaaggatgcccccgccactcccggtgcggtgctcaccctggccggacggcagctcatctccaccgtcggcggggcgtccggaccgctgtacgggacgctgctgcgccgcacgggcaaggctctcggggacgacgacggggtgacacaggaccagctcgcccgggcgttcgcggccggggtcgccgcggtgggacagctgggcggcgcccaggccggggacaagacgatgctcgacgcgctgctgcccgcagcggaggccctcgcagcctcgttcgacggcgccgcgaacgcggctcgtgcgggcgccgaggcgacggtgcccttgcaggcgcgcaagggccgggccagctatctcggcgagcgcagcatcgggcatcaggatccgggcgcgacctcctcggcgctgctggtcgaggccctggcggcgacggcggcggacggagcgggcgcgtgagcggcgaacggcaggtgggcatcgtgctggtctcccacagcggtccggtcgccgagtcggtcgccgagctggcacgcggcctcgccgccggaggggtgaccgctccggtcgccccggccggcgggcttcccaacggcgggctcgggacgagcgcggagctgatcggccgggccgccgcctcggtggaccggggtgcgggtgtcgcggtcctggtggacctgggaagcgcggtcctcacggtgaaggccatgctcgccgagggcgacgagctgcccgagggcacgcggctggtggacgcgccgttcgtggagggcgcggtggccgccgtggtgaccgcctcggcgggcggcgacctcgcggcggtggaggccgcggcctcggaggcgtacggctaccgcaagacgtagcgcttccctccggaccgggctggccccgcgtggcgctccgcgcggcgccgcagcagacttgacgacatgtcggcagccaggcgcagtgcgggtcttcttctcttccgggtcacggggggcgtggacgagcgggatgtcgaggtgctgatcgggcacatgggcgggccgttctggacggggcgggaggcggccgcctggtcggtgccgaagggcgagtacggaccggaggaggacgcggaggccgccgcccgccgggagttcgtggaggagctgggggtaccggtcccgccgggcgagtggatcccgctg

SEQ ID NO: 3551 - DNA, 2747 bp, Unknown
  Kingdom: Bacteria, Phylum: Actinobacteria, Class: Actinobacteria, Order: Streptomycetales, Family: Streptomycetaceae, Genus: Streptomyces
cgccctgcagctggccgagcggggcgcgctcggcctggacgacagcctcggccggcggctgccccggctccctgccgcctggcaccgggtgacgctccgccagctcctgaaccacaccagcgggctgcccgactacaccgaggcccctgccttcgtcgccgagctgacggccgacccgcgccggcgcttcgactcgcgccggctgctggactacgtcgccggcgacccgttgcggttcgaaccgggctcggcgtaccactactccaactccgacaacatcgccgtggcgctgatggccgaggctgttacggggcagcggtacgagaagctcctcgccgagctcgtgtaccggccgctcggcctgcgtgacaccagcctcccgcagggctaccgactccctgagccctatctgcacgggtacgcggtggacccgccgaacgcgccggaggacgtcagcacggtgctcggcgcgtcgggcgtgtgggcgtcgggcggcatcgtctccacaccgcgggacctgggggccttcatccgcggctacgccggggggctgggcctcgggcccgaggtccgacgacagcagctgtccttcgtggcgggcagctccgaaccggcaggcccgggccgcaacagggcagggctcgccgtcttctcctacgcgacgcgctgcggcaccgtgtacggccacaccggcaacttcccgggctacacgcagctggccgcggggaccaaggacggcaagcggtctctgaccgtctccctcacctcccaggtgaacagcgcgacgaacccccggctgctggccacgctccgcaaggtccaggaggacttcgtctgccggctgctcgaccgccggaagccgggcggcatgtactaggtcgtgtccgcatggtttcgtccggcccgagggcggacggcgatactctgcggacactccctgggcgtataaggcgggaaggggtacgccggacgtccggcgtaccccttcgcgggtcaggtggggcggcggtcagtccttgtcggtctcctcgcggacgatggtgtcgttcttggcgtccacgtcgaaggtcgtcttcttccagtccgagccgaccacgtcgacctgccagacgacgccgttgtcctcgttgtcgtcgaggccgacggaggtcaccgtccccttcttcttctcggtggcgaccttggccgcctgctgcggggtctgggtggcctgggcgagccggtcggccgtctgcttcttgtcgtcggcgtcctgatccgcgtcgacgcgggcctcgatcaccttgccgtcgaccgcgttgatccggacggtgtggatggtgccgtccttctccgcgacctccgcgacccagaccgggccgtcggcgcccggactcgcgctcgggctggacgtgcccgttccgctcgggctcgcggttccgctcgggctcgcggttccgctggggctggccgaacccgtggggctgccggatcccgtcgggctggggctccggtccttgtcgtcgtcgtccacaccttccaggtccaggtcgaccagcttgcccccggccacctcgccggtggcggtggtggcggcgtcgtcgaaggtgaccttcgtggcgtcgagcaccttcttgcgctcctgctggtcctcggtcagctgggcactggccgagggcgacgtcgtctgcttctgcgggacgaccttcgcggcctcggaggtggccgcgctcgtcgcgctgtccgagctctgaccgcatccggtcatcagaacggccgttgcggcggccatgccgagggcgccgaccgtcttgagggtgcgggaacgggaagaggcactgttcattcgtcgaggctcaagtctcatgcacgcatgcctagccctccgggccatcggtcatgttgtcctatcggggagtcacccgatcgaccgggcgggtccgcccgttggcagtcgctccccgggcggttgacgccggggtgcgaaacaatggcggcagggccgtattctccgcgcccggcccggaggccgtcatggatcacatgatgcacaccgagcgttacgagctcatcttccagatgtccggcgccgcggacgacgtggtccgcgtccggatgaccgaccggctgggggccggcggattcccggtgtacgaggacgagacagggatcgtgcgcgccgagatcagcgaccggggcgaggtccgtatgctcgccagcggcggccaccaggtccccggcgctcccctgctggcccgccccctgaacgaggacgcacccggaacgctgtgacaggaccagcggggtcgggcaccccgtgcgcggggtgcccagccctgtgcacgtacctccccacgcgagcccacccttccgttcatgcccgctcttcgcccgaatgtgtttacattcccgcaccccggacgtaacctgagcgcgaaaccacagactcgggcatgaaacggaaacgaaaccacatgtacgcaccggagcgtcagcaggagatcctccgcatcgcccaggagagcggccgggtcgacgtgctgtccctggccgaggagttccaggtgacggccgagaccgtccggcgcgatctcaaggccctggaccgggcggggctgctgcgccgggtgcacggtggggcgatccccgtcggccggctcgacttcgagcccgacctcgccgaacgcgacgccgtcgccgccgacgagaaggaccgcatcgcgcaggccgccctcgccgaactgcccgccgacggcaatgtgatcgtg

SEQ ID NO: 3552 - DNA, 4220 bp, Unknown
  Kingdom: Bacteria, Phylum: Actinobacteria, Class: Actinobacteria, Order: Streptomycetales, Family: Streptomycetaceae, Genus: Streptomyces
gccgccaaggtcaccgccgaccaggccgtgaccgccgcggcggacttctgctcctcggtggcgtcggtgggcagggcttcgatggcggccttcgcggcggtcacggcctggtcggcggtgaccttggcggctgcggcgtccttcgcggcctgcttggcggcgttggcggcagccacgagggggtggctgtccttggacagttcctcgaaggccttccgaaccgtgacctgggcttcgtcgcgagccttgacggcctcttcgtacgccttctgcgcctgggcggcggccttctccaggtccttgatggtcggcttgctctgcttctcctgcgtctgcgccgccggcttggtgtcggcgaacgcgggggtgacggagagcagcacggcgggggcggtcacggcggcggcgacagcggtggcgagagcgcggcgaatcttcacatgatcccttgggtcgggtccgaacggcggaaaaacgttgaggggcggctgccacggcggaacgatcacgcgggcgacctgtgccgatcgtatggggatcctgtgaggaggccgggggattgttccgggtccgggagcgggacggcgtcgcccggagcggacagacgtcgccaaagcacgcagttgccctcggattccgtcttttcgctgtgacgaacgccatgcggccgtgctgcccgctccccagcgctctgcccggccgacccgggcggaacgcatcattccgtcaggagcgcggggccctggatgtcttcgccgcgccggacggcagggcgaaggacaccgagacgaaatccggttcggggcccgcccggggtcagtgctggttcgcggccagcgagccgcagttggtgccgttcttgccggccacctcaccggagatctcgccgcgccacgtcacgcacagaccgcgtgcgtcgagatagaccggtccggcgtacgtggtgtagtaccccgtgtccgagaccgtcgtggtgggagaggcgaacccgagcgatgccgtcatgtgcacggcggtcccgggcgtggtgcggacggtcaccacgcagttcttgccggtggcggagctgtaggtgaggaaaaccgtgcccttggtgccgatctgcgcggagttcaccacggagtacccgccgccgcaggcgccgttgtacttcgcggctgcggcggccttgggcgccgcggtggcccgctgggccgccggctccgccgcggcggctgccggagcgaaggcgatcgcggcgcaggcggtggcggtgacggcggcgccgatggctgatgcgcgtcggatgatggtcatgtcgttccccgatttctcgaacggtcactgcgcgacgcctggtcgggcgccccggatcctcacacgccggagtggtgtgagtcacacaacgtcagaccggccgggtcgcagtgcagttgtgctcggggtcgcctgttacgaagtcatgacacaggcggacaagatcacctcttccggctgatggcccatggtcggacggcgcacgaggtggccgcccatctggtggacaccgcccgtacgaggaggccggtcgcgggcggcggggtcagccgacgatgtcgtacaggtcgaactgctcccaggagccggtgacatcggcggagcgggcgcgcagcgtgtactggagcgagcccgtgtagctgttctccatcgcgacgaagaggttgttcagggtggaccggagcgcgtagaggttcaggtcctcgttgtggtagacctcgaaccgctcccagccgcccgcggtcgtcgaacgggcccgcagtgtgttctgcgcctggccggtgaagttcttttcgaccgccacatagcggttgttcgcgagggacttgatggcgaaggtctggtcggcctcgtcccactcgaacgcgaagctctcccacgcgccggtgacggcggtggaacgggagcgcagcacaccggtgtcgggtgccgagtaattcacttcggtggccgtgaacttcccgttgcgcatcgacttgatggccagggggccggacgcgtcggccggggcggtggcgattctgccggagccggacaggcgctgctgtctgccggacgcgccggtgatgtgggtcaggtcggtcccggccaccttctcccagcctgcggggacgccggccgggcggtcatggtgcggggcggcaccggccgcgggtgcggccagggcggaggcggtcagcagggcgctcagggaaaggagggtggaggtcaggcgtcgcacaggtcttcctcgcttttcagggcaacggattccggacgccgaaatgttcggcggacggagagaggaaagggtccggtcgtcgctgatgcgcgcgccggaagccgcgaattggcctcagcgtaagggcagttcgcgatttccggcaaaggttttccggacggttcgggaattccggaaacggtcgcgtcgaatatgttcttccgctgttttccgttaaggaaggcgacctgtcccgttgatgtcacggccacttcgcgcacccggcgcggcctgctgcggtggccccgggtgacggcggggccgggggtgcccgccctcttccagaggtgacgtgtgcccgtcagaatccaagggcctgtcccccacggtccttggaggcaccccacatgtccggtcccggtcccgcgcgcacgcccgagcccctgtcccggccctcccgcagaggcttcctggccggcgccctcgccgtctccgccaccgcgatcgtcggcgcggcgcccgccgtggccgccacgcgggaggcggtgcgcggaacacacgactggatggccgccctgcccgacggcaccgcgctccggcggctcacgatcccgggcacgcacgactcgggggcccggttcggaggcccctggtcggagtgccagaacacgacgatcgcccagcagttggccggcggcatccgcttcctcgacgtacggtgccggatcaccggcggctcgttcgcgatccaccacggggcctcgttccagaacctgatgttcggcgacgtgctcgtcgcctgccgggacttcctggcggcgcggccgaccgagaccgtgctgatgcgggtcaagcaggagtactccgaggagagcgacgccgcgttccggtcggtcttcgacgactacctggacgggaggggctggcggtccctgttccgcctcgaccccaccctgcccgacctcggcggcgcccggggcaaggtggtgctgctcgcggacaacggggggctgcccggggtgcggtacggggaccaggctctcttcgacatccaggacgactacatggcggagccgttcgccaagtacccgaagatcgaggcccagttccgcaaggcggcacagcagccgggcaagttcttcatgaactacgtctccaccgccgccctgatgccgccccgctggaacgccgaccggctcaacccgcaggtgcactccttcctcgaccgcgcggagaccgccgggtggacgggtctcggcatcgtcccgctggactacccgaaccagcggtccggcctggtggagtcgctgatccggcacaacccgacagggtgaggggcgctcgccgccgcctcacatccccggcggcggggtcggcgcccccggcagtgtgagcgccgccacggtgccggggccgtcgtccggggccgcgcgcagggcgatcgtgccgcctgcctggtgcaccgtacgggccacgatggacagacccaggcccgagccggggagccggcgggcggacggggagcgccagaagcgttcgaagacgtgcgggagatcctcggccgggatgccgggcccccggtcccggaccgtcagttccccccggtgcagccgtacgtcgaccgtgccgcccggcgggctgaacttcaccgcgttgtccaggacgttgacgatcgcccgctccagggcggccggttccgcgcgtacgtaccagggggccaggtcgtccgtgatcgtcagctcggggccgcgcaggcgggcgcggcgcagggcggtacgggtgatctcgtgcagggacaccacctggagcgggcccggctcggccgcgtcggggcgggccagttcctggaggtcgccgatcagcgcggccagctccgtcatctgggccttcaccgaggccatcagcgccttgcggtcctccggcgggatcatccggcccgtctcgtcgctgcgggccagcagctccacattcgtacggagcgaggtcagcggggtgcgcagctcgt

SEQ ID NO: 3553 - DNA, 1572 bp, Unknown
  Kingdom: Bacteria, Phylum: Actinobacteria, Class: Actinobacteria, Order: Streptomycetales, Family: Streptomycetaceae, Genus: Streptomyces
cctgcacgtacggctgtcggcggccgtggccacggtgaacagcctggcgcggtccgcgcgcgccagcccggcctccgacagccgtacgtgcagggcctcggcgagcagcgggtgcgggccgagcacatcggtcagctcggcctgcgtaccgctgtccatcactgcctgccgtatccgccggatcagcgcgctgtcggggcccgcgagcagcgggaccacgacggcgggcggacccgcgggctcggcgacctcacggccgacggcgacggcctgctcgaagcgcgcgatgcgctcggcggcggtgtgggcgagaacggtggcaagggtcgggtactcggcatcgtcgccgtcgaggtagccgatccgggcgttgaggccgggcaactcggaacgggcgatgctgatcacctcttcggccaggctgcgcgtggccgaggagggggtaccgggaacggcgagaacgagcgcggcagcgccctcgggtgcgaccacgggctccgggcggcggtgccgtccggactggcgaggtcgcggcattcgtacaggcaggccggaagcgggcccagtgggggtgctcatggcgccgcatgctactggttttgcctgcccctctgttcggggagggtccggtcgagcgttaactatccgcttatgtccgatgagtgatgtaccgccggagtgtccctgtctgtcggctcatcgttccgccggcctccgtcctcctccgctccgtcccgtcagccgtcaccccgtcccgggctcgtcgcgcaccgccttttcgccgggctgtccactcccgtgctcctggggtacgaacagcatcgtcgggtggcgtggcaggcgcagatcgccggccgccagggcacgcgcgatccggagtgcgccggtcagcggatcgcccgccgccgaggtcacccgcacccccggcaacagccgtgccagctcctcgcgcagcggcccgatcagcggctcgcccatgtggaacaggccacccgtcagggccacttcgccgagctcgccgacctcgccgtcctcggcatccttcccgacggacgtcgggcacacggctgccgccgcctcggcgatatgaccggcggcctgtcgcagaatgccggcggccaccggatccgctccggcgcacgccgccacctccggggcgaacgaagccagcacggccggccggtccgagcgcggatagagcagccccggcagcgcctcggccggtccgaacacggcccgcagtcggtccagcagggcgggggagccgccacgccgtccgtcatgggcccgcatcgccgcgtccagcccggcacggccgatccacgcaccgccgccgctgtcacccagaagatgaccccacccgtcggccctgtgccactccatcaggtccgtgccgagggcgatcatgcccgtgccgcccgcgacgaccaccccggggcgctgtcccaccgcgcccgcgtaggccgtcacggcgtcggcggccagcgccaaccggcgaacccccagcgcgtccgcgagtgcgccgggcagctccgaacgcaatcgatcgcccagcgtggccatgccggcggc

SEQ ID NO: 3554 - DNA, 3035 bp, Unknown
  Kingdom: Bacteria, Phylum: Actinobacteria, Class: Actinobacteria, Order: Streptomycetales, Family: Streptomycetaceae, Genus: Streptomyces
cgtacgacgacggggtggcgggaggccttgatcgccgcgttgagggcggcgggggtgcggccggtggggttgggcacggtgtggacccgggggtcctcggcgaccagttcggcggcgatctcgtccgtccggtcggcggagggaccgagcgcgatcacgacctccatctcgccggcgtactcctgctccaggatgtgccggaccgagttcctgagatggcgttcctcgttgagcaccggcatgatcacggagacggcggggtactgcgcggcagacatgtggtcctcgggtggtcctcgggggcgccgggggtgccgcgccgcaggaggcgggcggcccgggaggtggcgttattcggccgccacgttaccgcgaatgggggatagcggtgcgcgccgccgggtcgcgggccggggtggagatcgtatgggcctaccgtgcgatggtccccttgcaccgcagaggtgtctcccttgcaccccggaggtgtctcccgtgcccgcaccgcaacgaccgcagcgcccgccgcatccccgcaccactcccccgcgacgccgtccgccccagggcacccggccggtccgcccccgcaagcaggacgagcggccgcgctggggcatgcgggtggccacgggcctgtcggtgctggtgctgggggcgggcgggatcggtcacgccgtggtgagcagcctggagggcgggatcggccgggtcgatccgttcaaggacatgaagaaccgcccccaggggggccacggcacgaatctgctgctcgtcggcaccgacggccgggacacgatcaccaaggccgagaagaagaagtaccggctcggcggcgcgccctgccactgcaccgacacgatcatgctggtccatctgtccgccgaccggcagcgggcgagcgtggtcagcctcccccgggacagttacgccgagatgcccgcccacaccgaccgcaccacgggcaagcgccacgagagccacccggtgaagctgaacgccgcgtacgcggagggcgggcccacgctgaccgtgcggaccgtcgagaacatgaccgaggtcaagatcgaccactatctggaggtcgacttcaccagcttcatgaagacggtcgacgcggtgggcggggtgaagatctgcacggcgcggccgatgaaggactcgtacaccggcctgaacctccccgcgggcacgcatgagctggacggcggacaggcgctccagtacgtgcgctcgcgccatgtggacgtcggctcggacctgggccggatgcagcgccagcagaagttcatggcggcgctgatcaagcaggcgacgagcagcggggtgctgttgaacccggtgaagttccagcaggtctccgcctcggcgctcggctcggtccgggccgacgagggtttcggcacggagcagatgctggcgctcggcaaggcgatgaaggacttcgggccggcctcgtcggagttcgcctccgtaccggtcggcaaccccagcttcccggtcaagggcatcggctcgacggtgcagtgggatgccgcgaaggcgaagaagctgttccgggccctgcgcgaggacaagccgctggccccgtcgaagccggagcccgcggccggtccgaagcagcctgcggccacgctcgtggacgtggctccgaaggaggtccgggtgcaggtctacaacgggaccccgaaggccggtctcggccggacggtggacgcggcgctgcggaccaccgggttcgccaccagcgaggccccgctcaacggggaggtgcgtgatctggaacggacgctcgtggagtacgacccgcgctgggaccggtcggcgaagtccctggccacggccctgcccgggagcgagctgaaggcggtgaagggccagggaccgcagatgaaggtgaccgtgggctcggacttcacgaaggtgcagcgggtgagggcggagaaccggcagacgggcgagttctccacggtgcggggcgacgaggtggtgtgcccgtgacccggtggccgcagggcgcgtgacaagccgctcgcggtgcccgtagcaccctttgggagactctcgcggcctcagtcgtcgatgccgtcggcggcacgcttctcgcgcagttccttgatcgcgcggcggcgggcgagccggtgggtgcgccggatctgcgcctcctggtagcgccggttgtcgcgctcggtctcggggatcaccggcggtacgcggcgcggcttcccgtccccgtcgacggcggcgaacaccagataggcgctgccgacctgctgggcgggggtcgactcgttccagcgttcggccatgacccggacgccgacctccatcgaggagcggccggtccagttgacctgtgcgcgtacgtggacgaggtcaccgaccctgaccggctccaggaagaccatctcgtccatcgaggcggtcaccgcgggcccgccggagtgccggccggccaccgcgccggcggcgtcgtcgaccagtttcatgatcacgccaccgtgcaccgtaccgagaaggttggtgtcgctgccggtcatgatgtggctgagggtggtccgggacgccgcggtcggcttgcccggaatctcgccctccgggcgggtggcctgatctgtcatacagtccaccttatgcgggggcccgcgtcccgcagaatgcatcaggttcgcaacagccctggtgcgatttcccttacaccctgtaatagcggtgggccgggacggcacactggtcggatgaacgattggcccgatcgacggaccggcgaccgcagcgagcgctacgggcggggcagtgccaacccccagcccgagggtgcgcgggcgatgccgcacatccagcgccgccccgccccgcagaggccgcagaggccgccgcagaggccgcaggtgccgccgcagagccagggatacgacgaccgctaccaggacggctacgccaacagccccgaccccgggtacgacagcggctacaacacgggccaggtctacggctcgggcggcggcggatcggacggccggggcggcggtggc

SEQ ID NO: 3555 - DNA, 4259 bp, Unknown
  Kingdom: Bacteria, Phylum: Actinobacteria, Class: Actinobacteria, Order: Streptomycetales, Family: Streptomycetaceae, Genus: Streptomyces
cagaacatgccgtagaggttcgtccgcaccacccggtcgaactgctccgtggtgatgtccccgatgccctcgggctgggacatctgatacgccgcgttgttcaccagcacatcgatgcgcccgaactccgccacagcccgctcgacgagtcgacggcactgctcctcttcccggatgtcgcacgacacggccagaccgcggcgccccgcatcctcgacgaggcgggccgtctccttggcttcctccgcctcctcgggcaggtacgtgaacagcacgtccgcgccctcccgtgcgtaggccagagcgactgcccgcccgataccggagtcaccgccggtcaccaccgctgcgcggttctgcagcaccccgctcccccggtaggagtcctcgccgtggtcaggacggggatccatcggaccggtccagcccggcggctcctggtcctgctgagtgaactccggctgcgggtgcttggtcgtcgggtcctgcggggtctcgcccatcagtgctgttccttcccgtgtccactgtttccagcttgggccacacctgacaaaggcgcgaacgcccaccgcccgcggcgaaagaacggcgtggacgcacgtctccgcggcatcgcgtgtcccgcgatccgcggtttcacacatgcggggcaaggcattccactccgccgattgccctccatgggcctgtcgaaacaaccgtcagcggcgttggagcgaggcaggggcccggaatggggtgccaccctcgcgcagtgggccccgccccgatggtcctcggcgcgccgggcgaagtctcgggcgtacgggctgtgttgcggcgatggaccgggggctgtaggagatcaccgcaccggtcatggggcgcagcggaccgggcagcggaagcgcgcttgcctccaggcgcagcagctccggacagacggctcccagaaggccgggaccatgagtccccggtcccggggacgtcctatcggtgagtagcggttccacgtgtgtggcgtcggtcgcgggcggcccccgctcctgggcaggcatcgacctgcaccgggccgtccggcggggcgtccgtgcatgcggcggtcggacacgggtggcggacacggagctgttatgccgtgaccgtggctggtaacgatgagcggtcgatgcaggaggcaccgggaaagctggccgggaggtacgtatggagacttcggtcgaccgaatcgcgcagccgtggggcggccgtactccttacgaccgcggtcagtcatggccgccgcgtgtgaacacctgtctggcggaaggcgtggagagtgaggatgtggagcggtgggtccaggcagcttcgattctgcactccgacggggacgccatggacattgcggtcagcggtggtcgcatggtcggggtgcgcggccggaaggtggaccgggtcaatcgcggcccgcgcgggtatcggcacgaaccacctcgacgggaacacgcgtctatgtacgtcgacggcggcggaggcgctcaaggagtccttcggctgcgacggccagcctggtagttacgatgacatcgaccacgctgacgtgatcgcgctgttcggtcacaaccttgccgagacccagccggtgcagtggatgcgcgttctcgaccaccatgctcaagaacctgaccccacaaattctcacgagtctgtgaacacggcctgccaccgccggtgccgctcccccacctgcaatggactttccgagcccagctcgttctcaccgcctgtgcactgccgtagctgacgtcacgacggtatttcgaggaaaggtacatagcaaacgaactgatcgtgacggtcggtctcggccgacggctcacagtggcggcgcagcgtagtgcactgcaccatcgtagaggggagaagccagagaagatccggacagaggaggacctatggtgctgcaggccgatcccgaaatcttgcgcgagctggtcaaccgttatgacgaactgcagagtctcgacgagtcctactgggacagcacggtgaagcccgggaccgagggcacgctctacaccctctgcgtgctcaccggcattcgcgacgagtcgcaagccctggctgccgctcgtggcttgtccgtggcgtctacccctcccccgagctagcgcatcggcctgaagagccgggcagccggaccgggcccacaggtaacggcccgcgccttcgtggagtggagtgggctgaaaaccaggtctgggaaacgtcgtgtcaggcgaaggagaagtgcgcggcgacttcggcgggcgtggtcgcctggcgacgtccggggaccttgtgaacgctggttgcgccctcggagcggagctggtcggcactggcgtctcggttcgtggtcgcggcgtaggaacggacgtccgcggcggtgaggtgtcggtgcgtcctcgctcggtgtactgctgctgccaagctccgcgcagttctcgctggactccacggctgctgcgtcgatctgcccccgtgcaaccagtgcctgaacgaagctggtctagcccgaggctgtcgggccgacgagaacgacgagtccagcctgcacctggctggatggttggtgcgagagcgttgaggtagagggcgaagccccgggtgtgcagcgccggtgaagcggaggtggcacagacgcaggctctccccgccgggcaactcggagaccacgtagccgaatcctgcgcggaagcggaccacgatggtgtccctgcgcggccggcgtgcgcgggcgtggcggttcagacgctggcgcaggtggtggcgcatcgattccggtgggtgtacggaaggcgcgacggtcaactcccggacgcgcaccagacccggcataccggatcactgcgcccgcgcatttccgtgtttgacgcgagaattacgtgcgcccgcgtacgccggtggcaaataaccggtcccctcaccttattgttatctactttcgagcatgtacgcccaagagtgaattcaacgaatctttggtgatcgacttgccatacgggtgagccgatcctcgccgccccctgagcgatttttcccgcgcactcactccatcaactcacctcctaccgggcggcgttggcgcaaatatcagcgcatttagcgaaaggtattcggcagttcccttacacctcggagccggttcggtcgagcacgcaaagcagtgattgcattacacaacaacacctccctagcgtggccgcggtgacgtttcacgatgcggacgggaagacgcctaggcacccccggacgtcgattgggccggcggacgcgacaagccgtccgagccgcctcggggaaacgcacaaccaccaatccgcggtcccgccacgagcccgaccgcctccctccttcaggagcggcacaccatgaccgacacaaccaacgccctgaccggctggtctcccgaggctgtcgtcttcgactgcgacggcaccttgatggacaccgaaagccactggcaggacgcgcgcaaccgggtcttccgggacttcggtatccaccccgctccgggtttcgccgagcgggccaagggcgtccattacgtcgactgcggccgactgatggcccaggaggcggacaagcccaagctggcagcggaaatgaccgactcgctgctgcgccacttcatggagcaggtcgccaaggatccggtcaccatgcccggagccgccgacttcgtacgccgcctctccggccagctgccactcgccgtggcgagcaactgccctctggaggtcgtgcagtcgagcctcgaccgagccggtctgctcggccacttcgagcacgttgtggttccgagcgacgaggacccgggagccggaaacggccagcccgtacgcccgaagccctggccggacgtctacgcgacggccgcccgcctctgcggtgcggcacctgagcgggccctcgcggtcgaggactcgatgacgggaatcgagtcggccctgcgggccgggctgcgcgtgctcggggtgggcccccgcccgcggcccgaggatgcggcccgggccgacctgtgggtgccggtcctgaacgctcccgctctgtcggcctgggtggagtcctggtcggcctgcgagacccgggagtaggcaggcagcccttcagtccagccgcgtgctgagatcatccacgactgctcgggcggaggcgaagaacagcccgatgcccaccgcgcccggatcgggaacgccttcggcgcgtcccccgaggtagctggagcgtcccatccgggcgcggtgggcatc

SEQ ID NO: 3556 - DNA, 2099 bp, Unknown
  Kingdom: Bacteria, Phylum: Actinobacteria, Class: Actinobacteria, Order: Streptomycetales, Family: Streptomycetaceae, Genus: Streptomyces
ggcatcgactgcccccgcgacgcctcgctcgccctgctcggcagccacccgccggatctggcggacgggcccgtccccaccggtttcgacgttccccggccccaactgggcgcggccgccgtacggatgctcgccgcactggtggccggggagaaggcgacggaacccctggtggcctgcgccttccggcccggctcgacggccggaccggcccccgtgcgtccctgacgctcccgtatctctccgacccggcccccggaggcggtcgcaccagctccaacgctcaacgttcacacagcacttcaaggagaaccgtgacatccgaacccgacatcctcatcgtgggcgccggactcggcggcgtggccgccgctctcgccgcctgccgggcggggcgcaccgtcgtcctcaccgaggagacggactggatcggcggccagctcacctcgcaggcggttccgccggacgaacacccgtgggtcgaggagttcggcaccaccgcctcgtaccgcacgctgcgcgattccatccgggactactaccgccagtggtacccgatgcgttccgaggccctggccctgcgcaacctcaacccgggcgccgggcgcgtcagcaagctgtgccacgagccgcgcgtcgccctgaccgtgatggaggccatgctcgcgccgcaccgctcctcgggacggctgacgctcctcaccgagcaccggccggtggccgccgaggccggcgaagacgacaccgtacggtccgtcacgctggccgacctgcggggcgacaaccaccgtacgatcagcgcccgttacgtgatcgacgccaccgagaccggtgaactgctcgaactcgccggggtggagcatgtgatcggcgccgaggcgcggagcgagttcgacgaaccgcacgcaccggaggaggcgcagcccctcaaccagcagggcatcacggtgtgcttcgcgctctcccaccacgagggcgaggaccacaccatcgagcgccctgccgactacgacttctggcgctcctaccggccggacttctggccgggcccgctgctcggcttccttgcccccgacccgcgcagcctggaggccgtcccgcggaccttcgtgcccaacccggatctggatccgctggacgtcaacgccgaccagtcggccgacgcgggcgacaaggagctgttcggcttccgccggatcctggcccgcaagctgcaccggcccggcgcgttcgactccgacatcaccctggtcaactggcctctgaacgactactggttgaagccgctgatcggcggtggcgaggagacgtcggccgccgcgctggccgaggcccgccagctgtcgctctccgtcctgtactggctccagaccgaggcaccccgggcggacggcggcacggggttcccgggcctgcggctgcgcccggacgtcaccggcacggcggacggcctggccaaggccccctacgtacgggagtcgcggcggatcaaggccgtcaccacggtcaccgagcacgacgtctcgatcgacatcgtcggtccctacggcggcacccgctaccgggactcggtcggcgtcggcaactaccgcatcgacctgcacccctcgaccggcggcgacaactacgtcgacatcggttcggtgccgttcgagatcccgctcggcgcgctcatcccgcgccgcgtccgcaatctgctgcccgcgggcaagaacatcggcacgacgcacatcaccaacgggtgctaccggctccacccggtggagtggaacatcggcgaggtcgccggagcgctggccgcccactgtgtcgcggagagtgtcgaaccgcaccgggtccaggccgaggacaagcggttcgaggcgttcgccgcgctgctggagcgcgacggcgtgcagcgccactggccggacgtacgcggctactgaccccgtccgcgcacgacggacggcgcggacgacgcatcaccgctccaccgcggtacgcgacacatcaccgcagtacgtgacacacacccgcttcaccgcacggcccccaggggtgagcgcggagcgccgggcgggcgcagctccacctgtacccgcccggcgctccgcgct

SEQ ID NO: 3557 - DNA, 2413 bp, Unknown
  Kingdom: Bacteria, Phylum: Actinobacteria, Class: Actinobacteria, Order: Streptomycetales, Family: Streptomycetaceae, Genus: Streptomyces
gccgtgctgttcgcctcgcagcgccggcgggccaccgcggcgggccgccacagccgctgaccgccgcactcccctctcaacccctgccgcgtccctccggcccggagggacgcggcaggacgtgacgggccggggtccgccgtccgccccatcggacgccgggccccggcccgtcgttgcgcggcgggtcagccgatgaccgaggcgcaggtggtcggggtggcgcgggccgggtcgagggcgttggccacttcgtggaaggcgatgcggtcgatggtcccgatcgccacgtgctcggacagatcgaccgggcacaggtcctggagcagcacgttgcgtacgttcggcccgtccaggtactgcgtccggtacggggtcacgacctggtcgtacttggtcgcgatgacggtgtagcggacgccggggacggtgtcgccgcccgccgtgagcttggtgatgaagggtgaccccgcgacctggtcggcgagtccgggggtgttgtcgctgatgaacttctcgacgccggggaagaacggcagcagcttggtgaggccgagcagcgtggtgccgtggttgtccggggcgataccgacgagggcgttgaccttgtcggcgccgccgaggaacttcaggtagtggttcggcatcatgccgccctgggagtggccgacgaggtcggccttcggggctccggtggcttcgaggacctcgtcgacgaacacgtcgagctgttcggcggacttgtcgatgggtccgaggccgtggaagaacggcaccccggggagctggccgtagtcgagtgagaagacgcagtagccccggttgaccaggtagggggcaaggaccagccagttgtcgatcgagttcccgaaggttccgtggaccaggacgacgggacggggatgggcggcggagggcttgcaggagtagtcgttccagccacgcgaggtggcctcggctgcggccggggtggtcgcggtcgctgtcgccgcgggagcgacgaggacggtgagggagaggagcagggcggcgagcagactgcgcgtgcggggaacgcgcgcagcacggatccagggcagcatcgtgtggtctccttgcggctcaagggaggtgcgatggcggtgcgccctgtggcccggaccacaagctttatgtgctcatgccaaattacgcacgagtaaggtggcgagggaagttacgcgtcggtaaaaactggcggggcgggagtgctcgttctcggccaccggaacggccggccgaaagaccagggccgtccacccccggcactacgccgttcggcccgccccgcctgcgcggacaccaccccgcccggacgctgggggcatgactttcgtcgacgaggtgaagaacgccgtcaccccacgggccgccctgctcgtcatcggtgtgctcggactgcaactgctgttcatcgcgtcctacgtcggagcgctgcacaagcccaagccgacggatgtcgcgttcggggtggtggccccgcagcagatgtcccagcagctcgtcgaccggctggacgagctccccggcgggccgctcgacccccgtacggtgagcagcgcggccgaggcccgcgagcagatcatgaaccgcgacatcgacggtgccctgatcgtctcgccggaaggccgcaccgacaccctgctggtcgcctccggcggcggaacggctctggccacttccctggagcggatcctgaccgaggtcgacgcctcccagcagcggagcgtgcggaccgtggacgtcgccccggcctccggtggggacttcaacgggctctcgtccttctacctggtcgtcggctggtgcgtgggcggttatctctgcgcctcgatcctggcgatcagcgccggcgccaagcccgccaaccggcagcgagcggcgatccggaccggagccatggccctctactcgatcgtgggcggcatcggcggcgcgatcatcatcggcccggtcctcggtgcgctcccgggcagcttctgggggctggccggcctgggctccctggtcgtcttcgcggtcggcatgacgacgctcgcgctacaggccctcaccggcatcgtcggcatcggcctggccgtcctcatcatcgtcatcgcgggcaacccgagcgcgggaggcgccttcccgctgccgatgctcccggacttctggcgggcgatcggcccggccctccctccgggcgcgggcacctgggtggcccgctcgatcgcctacttccggggcaacgcggtcaccgggccactgctggtgctctcggcctgggcggtcgtcggcacggcgctgaccctgctgctgtcgatgcggcaccgggcggatgcggatccgacgggcgccgcggtaacgggcgccacgaccacgggcgccgccccgggaccgggcgccggcgggtcga

SEQ ID NO: 3558 - DNA, 4488 bp, Unknown
  Kingdom: Bacteria, Phylum: Actinobacteria, Class: Actinobacteria, Order: Streptomycetales, Family: Streptomycetaceae, Genus: Streptomyces
tggccctcggcctcggcctggtggcggggttcctgaccccggtcgctctggtcgccgggctcctcctcaacctgctctacctggtcctgatgatccacgactgggccgagcagggacagaacgcgatgatggcgctgatctccctggtggccctgttcgccatggcctggcagacctggtccctggactccgccctcggactgttcccgtgaccccggaacgcacggcgtccccgcgcttcgacctccccgagccggacgccttcacccgcccctactgggacgcggcggcggagggacgcctgctcctgcgccgctgcggcggatgcggccgggcccaccactacccgcgcgagttctgcccgtactgctggagcgaggacgtcgggtgggagcgcgcgagcggggaggcgaccctctacacctggtccgtcgtccaccgcaacgacctgccgcccttcagctcccgcgtcccgtacgtcgctgccgtcgtcgatctcgccgagggtccccggatgatgacggagatcgtggagtgcgcgcacgccggcctccggatcgggatggggctgacggtcgcgttccgcggcggggacgcggaagcggggtgcggcggcgaggccgtggcggtcttccggccccagggctgaacagagctcgggccggcctctgttcgggaggggccggtgcgtggaccgtgcgtgtggaaggctggccagggccatgatccacgggtgcgagggggcggcgtgcgacggtcgggagatgtcacgggctgggcgttcctggcggaggtgggcggagtccggcacgccggtctggcggtcggacaggccgggctcggcccgttcaccggtgccggggcgggtggaagcctgtccgccctcgcccatgtgcgggggctggccacgctctcctcgctggacgccttgccgttctcgggacccgtggacgaccgttggtgcgtccaccgtgacgcggagggcgtcgtcgccgtcttcggtcccggcggcctggagctggcgtacgacctcgacctggacctgccgcccggctggctggagacggtgacccgcacgcgatcgctcgtcctggtggtgtcccatgtgctgccggcctccgacgacatggccgccgtgctgacgtacgagacacaacgggggatggtgtgcgccgggcgggtacggttcggcccgcccggctccgaggccgccggtccgcccacggtcacctacgtcctcgacccggtgtccgtcctggtggagctggtgctccatgtgcgggaccaggtgctgtcgctcggtgcggccaagctgcgggcgcgtgagctggagcgggcgcggcggagcctggagcaggtccacgggctgtccgccggggcgatgctggacctgctgaccggtgaggcgtcccgcagccggggaggggaggccgggctcctgtacgtctactggcggctggtgaccgaggtcgccgaggagagcggggcggacgccgtctgggcggaggcggcgctgcgcaccgtcgagagtgcggcgccggtgctcgcggagcgttgcgaacgctcggtgttcgaggaggccgacgcggtggccggccgcctgatcgagcgctcggagggatccccgggtctgacggcggcactcctggcggcggcccggctgcggctggcggtccggggaccggaggatctgggcggcgactcctacgccggggaggggaggaccgtccgggccgcccagctcgccgcggacctgtaccgctcgccactccaccggccgtggttcggcggagcgtggccgttgctgttcgacgagcggttgaggggtgaggcgcgggaactgctgacccgggccgccgagtcggacgagcgcgggagcgagcagggccgtgcgctgcgccccgcgatcctggtcgcgctggcccaggtgctcgcggaggacgggggtgtggacggggagaccgcccgcgccgcgttcgccgccctgttcgacgcacccgccgccggtccgccggacctggccgtcttcctcctccggtcggtggacgacgcgcccgccaccctcgtcgacgtggtgcgcggacacgtcttcggctccgacgtgtccgccttcctcgccgcacacggcggcgccgtcgccgcccggacggtcggccaaggcgtcaacctcgccagggaacgcgccgaccggccgctgctccgagccgtactggactggtccgaccggtcttccctcgtccggggccccgcacaccgacggcaactggtggaggcccggctgcacgcgcttccccacgaccccaccgactgtcccgcccccggcgacccactcccggagtcccttccggagtcgtttccggcgacctggtccacggcgcagcgctccgccgcgctgctgcacgccgccgcccacgcccgcgaccggcagcggcccgcgctgggcgtcgccctcctgcggcaggcgggaccgggagacggcctgggaatcagactgctgacggcggacctgtaccgcctggctgtggagctgggcgagccggtctccgggagggtcccgttcccctggggccactccacgtacgccgctctctcctacgcctcgctgaaccagcaggacctggcccaggcatgcctgctgcccgtcctccaggagataccgcgactcggcggcgacgacctcaagaacgccgtgtacgcgatcatcgtggacctccccaacttcgacaccagcggcgccccggcgctcggcgaggtgctgcgcgatctcgtccacgccgccgtatggcagctcaccgtccagatcgagacgatgccggtggtgctgatgctcggcctccaccaggcgggcaagggcccggaggcgggtgcgtggcgccggatcggcggcccgctcacccggcccgcgcacatcgagaactacgtcgggaaactgcgcgccctggagagtcccaccgctgtcggcggcgcgacggcgaacctgctcgacgcgctggacgcggatccccgtcccggcggcgaaggggacgggggcggggacggcgacgaccgcgacgagttcacccgtaacctgcgccggcgcatctcctcgttcgtcgacgacgaactccgcggccgctccgcggcgttcgtggacgacgcgcacctgtgggcgaggacgggggacctgctggacgaccgcacggtcctgctcacctggttcctgcccaccgcggtgaacggagcggccgtcctgctcgccgtcacccgtgaggacagcgcgatgacggtgcagctcggcgaccccgccgacggcgggccggagcgggccgcggcgtacgccgaccggcatcccgtcgccgacctggtcgaggcggtccgcacggaggtcgaacgcgacccgctcttcggcgacgtgacaccggagggccaccggctgctgacggggcccgaactcccgctccccaccgccgacctgtgggccgcgtggagcgcccggggcaaggaccgtctcctgctctggccgcacggcgcactgcactacctgccggtcgcgctctgtaccgtcggcggccgcccgatcgccgaggactggaccgtcaccacgatcgtcggcctcgaagcgctcctccccgtcgacggtcccgcacgtcctcgccgcaccgcggtgctcgcctccgcggacggcggcgtcccctacggactgcccgccgaaccggccctggaggagcacgcccgggcggtcgccgcggcggtcggcgcgaacccgctgaccggtccggccgccacccgcgccggactgctcgccgaactcgccacggcggacatggtccacctcgccgtccacggcacgatggaccaggacgccccctggctgcactgcctctacctcaccccggacgaggacgacgacggccgggtcttcgcccacgacttcctcgaactcgacctgagcggtgtccgcctggtcacgctcgccgcgtgcgagtcggcgctgggccggttcgaccgggcggacaacgtccgtggcgtcccggcggcgctgatcaccgccggtgtgcaggccgtcgtcggctgcctgtgggccgtacgccccgaaccggccacgtacttctaccacttcctgcaccgccgggccgggccggccgaggacctggagcgcgcgttccacgaggcgcaggccgccacccgggcccgccacccccagtaccgggactggggagccttcacctatctgctgggccggagcaagggagccgacgcatgaccgaggtccaactgcgcgacatcgccctcgtaccggagcgcacgctcggctccgcggacggcgaaggtccgctgcacggcaggctcaccttcggctgggacctgctgcccgccgaccacgcgagcgcccccgccgactggcaggcccaggtgaacggcacacccgggcgggactaccgccacctgctgctggtgtgctccttccgcccggagaccccgcagtcgccgggggtgttccggcacgcc

SEQ ID NO: 3559 - DNA, 2678 bp, Unknown
  Kingdom: Bacteria, Phylum: Actinobacteria, Class: Actinobacteria, Order: Streptomycetales, Family: Streptomycetaceae, Genus: Streptomyces
cgcggctctccggtgaggcgttcgaaacgttctggaggcgtgttctagaggtgctgcgcgaccgcgggcatgaggtcctggaaggtccgcccgtccgccggcgcgccgatcgcggtcatctgccagcccgagccggaccgctggacctggccatgatctgggcggtgtgccgcccgccgccggtcagggtgtaccgggccagctcctggccgttgctctcgtcgaccagacggcagaaggccgcctcgacctcctcgaaggtctggccggtgaaggagttcaccgtgaagacgatctggtccacatggaccggcacgcgccgcaggtcgacgacgatggactcgtcgtcaccgccctggcccgccccgccgacccggttgtccccggtgtgctggaccgaaccgtcgtcactggtcaggtgctggaagaagaccacgtcctgcggggcctggcccgcgaagagcaccgccgaggcgtccaggtcgatctcgcgggcggtcagccgcgccaggaatcccttacggggagcggacttccagcccagccccatccgtacgacgccgagctcgccgccgccggacttggtgaggctgacctgctggcccttggtgaggttgatcgtcatcgttccgccttcggtgactgggtgcctggggtgacttcggtaggagcgcgcgagtccgggtcccggcggctcagagactgacgccgaagtcggcgacgatgccgctcaggccggatgcgtaaccctgcccgaccgcacggaacttccactcggcgccgtgccggtacagctcgccgaagaccatcgccgtctcggtggacgcgtcctcgctcaggtcgtaacgcgcgatctccgcgccgcccgcctggttcaccacccggatgtacgcgttgcgcacctggccgaagctctgcccccggctctccgcgtcgtggatcgagacggggaacacgatcttcgcgacggtcgcgggcaccgaggcgaggtcgaccttgacgatctcgtcgtcgccctcgccctcacccgtgaggttgtcaccggtgtgctcgaccgacccgtcggggctcttgaggttgttgtagaagatgaagtgctcgttggacagcaccttgcccgcctcgtcgcagagcagcgcgctcgcgtcgaggtcgtagtcggtgccggtggtcgtgcggacgtcccagccgagaccgacgaggatcgcggtcagtcccggggcctccttgctcagcgagacatttccgcccttggcgaggctcacgcccatgatgttctcccttgtgcggtgacgggtgttcacgtggtggcggccacgccacgggtgacggcgcggacacgctgcgactacgggaaaatctacagcactgtagattttcggtgccaggaggcggcggcccggcccccggtcggtggccgggccctccgtcggctggatacgatttcccgacaccccggcaggcgaagcgccacggccgggcggccgaacggagaaagccgggcggacggacggagagaggggtcgggccgtggacggcgaaggagccggtggcgagggggaatcgcctgtccgcaggcgtggccagggtgagctggaggcccaggtgctgtcggtgctgggcggggcgagcgagccggtgaccgccgcctgggtgctggagcggctcggcgcgggcctgtcgtacagcaccgtcatcacgatcctgacccgtctgcacgccaagcaggcggtcacccgcaccgggcggggacgccccgtcctgtgggagcccgtggcgaacgaggcggggctcgccgccctgcggatgcgccggctcctcgacaagcagagcgaccgcgacgcggtgctctccagcttcgtctccgtcctctcctcgcacgacgaggacctgctgcgtgccctgctcgccgagagcggtcccgacggcaccgacgcgccctcggaccggccggagcgctgacgatgggcgtcttcgtctacctgcccctcgtgctgcccctgaccgcgttgccgatcgcgcgcctggccgaacagcacctgcacccccgcagggcggcccggctgctgaccaccgtcgccgtgatcctcgcctcctgctccctggtgtgcctcgggctgctggtggtggtgggcacggcccagctgcccggcaacccgctgcccgacggctggtccgacgccgaggtccgcgaggccgtgccgcacgacgcgttcgcgggcaaggcgtccatcctcgcgctcgtcgtcgtgacggcggcctgcggattcaccgtccaccgccactaccgcttccgggcgcgggcccaccgggcgctcgcgggcctgccgggcggcgacgtcgccgtactgcccgacgacgtcccgtacgcctacgcgctccccggctccccgggccgggtgatggtctccacggcgctgctcgcctccctcgaaccggccgagcaccgggcgctgttcgcccatgagcgggcccatctggcgggacgccaccaccggttgctgctcgcgacccggctggccggctgcgtcaacccgctgctgtggccgctgctcggggccctggtctacagcacggagcgctgggcggacgaggaggcggcccgggtcaccggcgaccggcggctgaccgcacgcgcggtcggcaaggcggcgctcgtctcccgcccggtgcccggc

SEQ ID NO: 3560 - DNA, 2210 bp, Unknown
  Kingdom: Bacteria, Phylum: Actinobacteria, Class: Actinobacteria, Order: Streptomycetales, Family: Streptomycetaceae, Genus: Streptomyces
  misc_feature (1887)..(1888): n is a, c, g, or t
cgcccagcccgctcaccgccgccagcgtgggatgcccgtcctccgtggcccggcaccggtgcgcctccagggcacggagctcgtccgcgcggtcggtgatccggaccgagggcggtaactgccacggcggcggcacctcctcccgtgccccggcccccgacacgtggatgccgccgtgcacgcttcccgcctgcaccacgaagccgtgcaccgtgccgctcagttcgttggcgttggtgctgtgttcgtgcccccgcatgcgtccccctccggacagccgagtaccagctcccgcagacatcctttccgtacaggcgctcgatacccgggcccacggcgatcggctgcggttggccgattccactccgaggagcgccaggcgttctgcatatgccaaaggaatatgcgctccctgtcgacgaccctacgcaccgcgcacgccaacccggccttttcacacgttctccgccttcggcaccgcacggtgtggcaccgtgggtcaactgacgactcgggtgtcggggcgtccgcggagggggatcttcatgcgatttcgcaccgtcgcggtctcggccgcactcgccctgtgcgccacggtgggcgtcgcggcctgttcgtccccggcggacacggccgacgccacccggcccgagggtcccgccgccttgacgacgcctgttcccgtggacggcatggcgggccgcatcgacacgggcgagcgtcgggccggtccgcccgagacggacggacgggtcggggcgggccccgcggagtgcgagacgtccgccgcggcgatcccggcggagtgcgccctcgaccttgcgttccacgacatcgccgagggggagccggccgtagggcctcccgtgcggtgacttcggtacgcaggaggggtgggcgcacgaaggtgcgcccacccctcctgctgtgcccgcggcgtgcctgtcacgtgtgcaccatccgcaccatggagcccctgcgtcacagaagccccttccatccgtcacgacgatctcttagtctcacactctgttcacatattgatatttgatgatcttgcaacagaggtcaggcgcgggggtagtgaagcatgcgtgaaaactggcgctcgaagttgagcgttctcgccggtgcgtcagcacttgcgctctcggcggtcaccgcgacgccggcgctggccgacgacgcgccggtgagcccccaggaagtgcagatgccgctggacgtgaggatcgtcgaaggcggggccgcgggtcccggagaggcggttcccttcccggcggaccaggaggaccaggttggaccggcggaaaccgcgacgccggggggccaggcggaagctgtcggagctgtcaacgccgctccgtcgtcgagcacgtgcctcggttcgaccgccgcctacggcgccagggggtgcttccagcacaacggcgacatcgtctgggcgggcgacacggagaaggacggcatgtccgcggccgtcggggtctacaccgactacgggcgcgccgaggaggtctgcgtcaacaagctcggcgtggacacctgggcgacgtgcaacaaggactaccgcgaggacggggacgtacgcctccgcgtcctgcgctacgacggcgacaccggcaagttctaccagcccgagacctggtccggctggatcccggtcgacgggaagtactgagtcgacggagagcactgacccgcgctctcgtgggggcgagccgggccacgctccgctcgcccccacgggggccggcgcacccgcggcacacgaaaaaaccggaccagcctctgctggtccggttcttcaatccggaagtgcccccggcaggattcgaacctgcgcacccggctccggaggccgatgctctatcccctgagctacgnnagctacgggggcgtatcgcggtgttgctctgcgacgggtgaaacactaccagctcccacggggtgtccgtgaacaggtattccgccgtgcctccgcgcctcttcatcccggccgggaggcccgtgcgggcggtggccacccgtccggggcggaagtggacaaaacccggacaccgcccctccggccgacctactctcgaagagtgtcaggggcgtacggccgcgtgcttgttgtcgacgacaacaaggtcatccggcagctgatcagggtcaatctcgagctggagggcttcgaggtcgtgaccgcggccgatggcgtcgag

SEQ ID NO: 3561 - DNA, 3652 bp, Unknown
  Kingdom: Bacteria, Phylum: Actinobacteria, Class: Actinobacteria, Order: Streptomycetales, Family: Streptomycetaceae, Genus: Streptomyces
gcggtccgctcctcgacgacccggcccgcgtacatcacgtacacgcggtcgcagtaggcggcggccaggtgcaggtcgtgggtgatgaacagcaggccgaggccgcgttcggcgcgcagggtgcgcaggagggcgaggatctccgcctgggtggtgacgtccagggcgctggtcgcctcgtcggccagcagcagccggggctcggcggccagcgccccggcgatgacgacgcgttggagcatcccgccggagagttcgtgcgggcgctggcggacccggcgctccggttcgtcgagcccgacggcgtccagcagctcgaccgcgcggtcccgggccgccgctccggtcaccccggtcccggctgcggcgagccgctcgacgaggaagtcgccgatgcggcggacggggttgagggcggcgcgcgggtcctggtggaccagggccacggtccgggcccggtgcgcgcgcagttcctcgccgcgcagggcgaggacgtcgcgtcccgccacccgtacggaaccgtcgagggccgttccttcggggagcgtgcggagggccgccttggcggtcgtggacttgccggagccggactcgccgaccaggccgacgacttcgccgctcgcgacccgcagggacacctggtccaggacgggccgggcggtgccggggaggcggagggtgaggtggtcgatgtcgaggagcacggtgtcacttcccgctgcgtcgtatggcatgggccctacctcccgttggcgagtcggtcggcggcccggaccccgacgacgttgaaggagacgaccaccagggcgatggcgatgccgggcaccagggcgggcagcagcgcgccctggacgacggcggcctgtccctcctgcaccatcaacccccagtcggagctgggcggctgggcgccgaagccgaggtaggagagcgtggccagggacatcagggcctcgccgaagaggaccaccagatagccgatgacggagcggccgaggttggggacgaggtggaacgcgcagatccgcaggcctcccatgccctggacgcggtaggcgtcgatgtagggcttgcgccgctctccgatggccaccgagcgggtgtacttggcgacggtcggcgtgtacgcgaggccgagcgccagcacggaggtggtcattccggcgccgaacaccgcgatgatcagcacggtgaacagcagccccgggaaggcgtacatgacgtcggtgagccgggagacgacggtgtcggcccagccgccgcgccaggccgccagggtgccgagcgcgatgccgagcacggcggcgatggcgagcaggagcgccggggcgacgaggctggtgcgggccccgtacagcacccgcgacagcaggtcttggccggaggagtcggtgcccaggaggtggtcgccggtggtcccggccagcgaggcggagaggtcgatggcgtcgggggcgtacggggcgatcagcggggcgagaagggcggcgagcaccaccaggccgaggaccgcgcccgcgaggaacgctccgtagggacgccgcgcggccgggatctccaccggggccggggtcgaggccggggccagggtcggggcggtcatacggcggcctccttcacacgcgggtcgagcagcgggtggacgaggtcgacgagggtggtgaccacgatgtagccggtgaccatgagcagcaggaccgcctgggccacggggaagtcgtgggtgttgatcgcgccgacgagcagcgagccgatgccgctgatgccgaacgcggtctccacgacgaccgtgccggcgagcatcccggccatgaccagaccgcacatggtgacgatcgggccgagcgcgttgcgcaggatgtggcggcggacgatctcgcgctccgggatgccggaggatcgtgcggcctccacgtggtcggcggccccggcgtcggccatcgcctgccgggtgacccggctgatgatggcgagcgcgccgagcgccagcgccagggcgggcagggtcagatggtgcagggtgccggtgaacccctcgcctcccccggtgacggggaaccagccgagctggacgccgaagacggcggcgagcgcgatggcggagacgaacgaggggaccgaggccgccagtgtcgtaccgccgacgacggccgagtcgacccaggtcccccgccggacggccgcgaggatgcccgcgccgacgccgaggacgacgaagaggacggtcgcgtacgccaccagggccagggtggtcgggaagcgggcgacgatcaggtcggccacctggtcgctgtatttgaaggagcggccgaggtcgaagtggaggcagtcgccgagccagcggccgtactgcacgacgaggggttcgtcgaggtggtactgcgcccggaccagctccagcttctcgggggtgagtttgtcgcggccgccggccaggaagacggcggggtcgccgggggccgcgtacacggcggcgaagatgacgaaggaggcggcgaggagggtggccagcagtccggccaaccgccgggagatccgggcgagcatcgcgggtcagcccttcttggcgccgaggtcggcggcccaggggtagtagaggtacgccatggaggcgggcggtccggtcagcttctcgtcgaggacgaggacggaggggacctgggcgacggagatccagacggcggcgtcggtgaacttcttctggacctcggaggcgagcttcgcgcgctcggcgtcgtcgagggtggcgagggccttcttgaccgtggcgtcgtaggcggggtccgcgaagccgacccagttgttggaggagccggtgagcgcgttgtcgtagaagcccatcgggtcggccttggagatgtaccagtcgccgaccagcacgtcgatgccgctccgggcctcggggtcgctgtagaactgctcgaactgggcggtgggcacggtcttgatctgaccggtgagcccgatccgctggagggcggaccggacggcgttggcgacgacggtgcggccctggctggcgtcggtgccgatgacgatcggagtggcggcgtcggcgccggagtccttcaccagcttcttcgcggcggcgatgtcctcggcgtcgggactcgcgggggcgacccggtcggcggcacgctgagcggcctcgaagaccggcttctcgtaaccccaggcgccggagccgaccggggtggaccagggctggaccatcccgccgtagccggaggcggcgatgcccttgcggtcgagcgcgagggagagcgcgcggcgcacggccgggtccttcagtccgccgcgtgcggtggggatgaggacgagggaggaggtggagggaccgtagtgctgggtgaggcccttcttgccggcgagggcggaggcggtgttgggcgattcggcgtacgcgccgtcggcggctccggtggtgagcgcgttgaccagagcgctgtcggtggcccagcggaaggtgacgcgcttcgtcagcggcgcctcgccccagtagccgtcgtagcgctcgatggtgatggagtcgccggacttccagctcgccagccggtaggggccggtgcaggcgtcgggctgtccgggggtgccgaagtcccggcccgccttctcgacctgctccttgttccagacgatgcccgcgtccccg

SEQ ID NO: 3562 - DNA, 3672 bp, Unknown
  Kingdom: Bacteria, Phylum: Actinobacteria, Class: Actinobacteria, Order: Streptomycetales, Family: Streptomycetaceae, Genus: Streptomyces
gtcctcctcccgctccaggaccatgatggccgcgccctcgcccatgacgattccggcccggtccgccgcgaaggggcgacagaggcgggcggggtcgccgtcccgcagcgctgccgcgccggagcgggcgaagccggtcatggcgaccgggaacacgatcgattcggtggcgccggcgatggcgatgtcgcactggcccagcgtcagcatgtcccgggccaccgacagcgcggtcaccccggacgaacaggccgtgcacggggccaggctggggccggtggccctcatccggatggcgatctcggccgcgggcatgctcgggatggtcagcaggatgcccgcgggcgaggtggccccggggccccggcgctccagggcgacggcctgttcggtgagcccggcggatcctccgctgctggtgccgacgacgacggcgacccgggcgccgtcccagtgcgccgggtcgagcccggcgtcggcgaccgcttcccgagcggccaggagcgcgaacttgacgtaccggcccatccggaacgcggtccggccgccgaccgcatcgtcgaggtcgatgccggagaccgtacaggcgaagtcgacttcgcagcccagcagttcgggaacggtacgagcgggcgacacgcccgcgcagactccgtcccaggtggtgtcggtggtgtggccgaccggagtgatcattcccagcccggtgacggcgatggcgggtcgcttcatcgggtgttgctcaccagcaccgtggcctcggccgccgcggtgccgacggccgcgtcgatgtacgcggagatgtcggccagcgtggcgtccttgtacagcttctccgagtccgcgtcgacgcccagggtctccttgatgacgacggcgaactcggcgaccgcgagggagtccatctccaggctgtccatggtggactccggcaggatctcggcggcgggcaccttgaacgtcccggtcagcacctcggtgatcttggggtggatggtcttcatggtggttcctctcatcggcgtctcatcggcttggcttcgtgctgcgcggcgggtgcgtgaacgcgatgacccaccgcccgatgtaactggatgacgatcttccggttacgccttcgggcgaaccgattcgtctacgctcacctgcggcttctcgaaccatcgggagagcatggaggtggtcccccagtacgccagcaggaccccgcgggtaccgagcgccgccaccttctcgcggagcgggcgcctcctgctgccgcagacgggccgccggaactccgcagcgcgaccccggattcccgccctccggccccggtgccaggacccctcggggtcgtcgtacacgtccgcgtaaccgggtccggcgatcggccagtccgacatcaggcgctcgggcagcgcgaaggactccaccagggcgggggtgtgtccggccacgacggcgaccgcgtcctccaccgcgtcgggcagaagggtgacctgatcggccgtcagccgtccggacgcgagcagggcgccgctgttgcgggcgatccaccggagcgcgaagagcctgcgcagctcgctcagccgttgacgcgccgcgccctcgggaagggaggcgacggcctcggcatacgcttcgtccgcctgccggtaggcgtgtgcctcgacgccgcgcagcgcggccgaggaggcggcgttccaccggccgagcgggtcgccgggcggggcggcgcccatccgctcgcgggcgcgggcgaaccagaggtcctccacggccgcgaacagccgcccgaggaaagcggggtcgtcgatatcgccggggccttccggggccggttcccgggcggtggcgctgaacagcatctctgcggcggccttggcgtgcacggcgaggttgtcgccctcggccgtgatcgcgccctcgatgccggtgaacagctcggccatgccgttgttctccaggagcccctgggcgccgcaccgttcgcggcactcgacgatgacggcgcgcgcctgccaggtgatccaccccttggcgacggccaccaggcgttccgcctcgtcccggtcggcgtccggggccgactcccagcggtccagagccctgcggtgcagcaggctcatcgcgtagacggtggccatcgcccccgccagcggcccgtggtgggtgcggtgcgcgtacaccgggatccgccgcccgacacgcgaaccggagatcatccggtgtccggcgtaacggacggcgatcgccagggcgacccgggcggagccgaccgcgcaggcgctcatggagagcttgccgggggtcacccggccgatggagacgaggaacctccttcttcggttggggacttcactgcggaatcgcccgtcgtcgccgatccgcccctgctggccggcgagcagcgcgtcgcgcgggacgaagcggcggtcgaaagaggtcaggcagtggtcgaccggggaacccatccgggcgggcagccgccgcacccggacgccgggcagggcgcgatgggcgtcggtgagcgggacgaggaagaggaagaccccgtggtcggcgccgtcgacgagcagccgggccgccacgacaccggacttgggaccgcccgcgggactggtgttgggcatgaacttctgcgccccggcgtgcggggtgtgcagcacgaagccgtcgcgttcacggtcgtacgccgcggtcgtctcgatggccgccgcgtcgttgccgtgcgccacctccgtacagaggaaggtgcccacgcgccgcagggcgaggaagtccgacaagtcgcggagtgtgcccgcgtcgtggtccagcaggctgccgaggaagaggttgtagtggatgcccgccacggtggtcagcgcggggtcgacggggccgagccattcgtgcagggcggccagagcccgggggtcggcggccagcctcgcaccgcagtcgagcgcgttgttgaggatccgcagccggtgataggagagagcgagtcgttcgtcgggggtgccgccaccgggacggcgaaacggctccgttgtgagcagcctgcgccagaacccgtgttcccggcggaagttcggtccgaagagcaccgcggtgagcaggtcgttcgtggagggcggggccgcgtcgttcatgattactgtcacaacacagtaacgatcaaggaacggcgaggacaccctcgccgtcccgaaatgcccctgtgaatcaggcgcgttggaaggcgagggcgacattgtggccgccgaagccgaaggagtggctcacggccgtctcgacccgctggtgacgtggctccttggtcacgcagtcgagcgggaaggcgtcggggagcgcgtccaggttggcgatcggcggaatgacggaacgttccagcgtcaggacggtggccactgcctcgatcgcacccgccgccgccagggtgtgcccgacgacacccttgggcgcggtcaccggcggccggtgcgggaagagccgggagatgagcgtggtctccatggcgtcgttgaggggcgtggaggtgccgtgggcattgatgtggtcgacgtcggacggcgtccagcccgcctggtccagcgccgcccggaccgcacgctgggcgccgtacccgtccggggccggggcggtggggtggtgggcgtccgtgctggaccccgcgccggtgagcagggcgcgcgggcggccacc

SEQ ID NO: 3563 - DNA, 720 bp, Unknown
  Kingdom: Bacteria, Phylum: Actinobacteria, Class: Actinobacteria, Order: Streptomycetales, Family: Streptomycetaceae, Genus: Streptomyces
gactcgacggccggaacggccctcgcctccggttacgacgagccggggacccggctgcgggtcgcctccgggcgctcgggcgacgcacgctggctggagatcgactaccaggtccaggagaccggctactggtgcggtcccgccgcgacgcgcatcgcgctctccgcccggaccgccgcgccgagccagggcgagctggccgcgcagctcggcacgaccgaggcgggcaccgatcacatcggacaggtcaccggcgtgctcaacgcacgcctcggcggcggctggtacgagaccaaggagatgccgaacgacccgcccacccagggacagcgggacctcctgtggcacgacgtcgtgtacgacatcgaccgcaactatccgctggtcgccaacatcgtcgccccgccgggcaaccagccgcccggctacccgccggaccagacgatctaccactacttcaccgtcttcggctacgacgcggtcgaccggaccgtcctcatcgcggaccccgcgtccttcggcggcaaccagatctactggatctccttcgaccagctggccaccctgatcccgccgaagggctactccgcctgactccgcccgatgccgcggggcgggcacgaccgccccgcgacccgaacccgttccccctgaccaggaggtcacgttgagcacgcaacggcccacccgcagaggcgtcatgaaagccgccgccggact

SEQ ID NO: 3564 - DNA, 2792 bp, Unknown
  Kingdom: Bacteria, Phylum: Actinobacteria, Class: Actinobacteria, Order: Streptomycetales, Family: Streptomycetaceae, Genus: Streptomyces
gcagcagcccggcgaccaggggacgacggtgtccacgcacggccagtggctgtgcgcggcgacggcgggcgcgggtatcggaccgctgccggcgcccgcctcgaagggcgcggtctcgctgcgccaccagggaacccgggcgactcgtgagtcctccggccagcgggaggaacacctgcgggcaggcccggaaccgggccggcccggtgacgaacggaccggggcgggtcgctgtcggccgcggcggaaacggccggggcgaccgcacgactcccgatcgtccggaagggtggcatgtgcggggcacgccgggcgggtcgccggacgcggtcggacgggacggtgtcgcactccgtcaccccggcgtcggcatgacccggtggatcagaaggcgaagacggcgttgtcgttcatgctgcccgccatctcgcaggcgttgccgtacgtcgtgctgaactggacctgcttgccctgccagacgccgtgggcggtcaccacgaccgggtcccactggcgggtacaggtccggttcgacgggccggcggtcagttcggagaacttccctcgaaccgcggccagttccttgcaggccgcagcgggatcggggtgcgtcccctcggcggtgggggcacaggtgagcgtcacggcccgctcgacggtggcggtcagcgggtcctcgccgcgggccacggtgaggacgagcgccgagggcgcgtagaggctctccgccttcgccggtgcggcctgggcggtggcggtcgcgataccgccgaacagaagcgtgctcgccgtgaggcttgcgaagatcacgtgagggttgcgtcgcattggtgaagactccttggtcgtgtgcctgattgcggtcaggagtcttacgcatgcggaaagtaggcgcacttcgacggccagcttccggccgcagacgggcgttcgagccgaccgaatggtcattcgggcagctcagacacctcgcatggaccgtccagtatatggacggactccggcagttcaacgcagaactactgcctgacctgcggatatacgggaatccttcgatgcgacaaaccgccacttcggccggaaagcgccgccgcacgggacgctcgcacccgatcacgcctccgccaccccctccggcacggagcgagccggcagccgatcacgcggggggtcacacggaggacacaattccggatccctcttgaccagggcaatttaggttaggctaacctcacggtcgtgatcgttcctgccctcgaccgagaagacccaccgccgcgtcggcgctccgcgcccgctgccggtgccaccgccgtgcccacgaccgccgagccaggcccggccgcctccttcgcggcccccggacccgacgtcggcctcgacgcccgcgacatgacgatcgcgtacgaccgtaccgacgtcgtgcacggagccgatctccggctgccgcgcggtcgcgtcaccgctctcatcgggccgaacggcagtgggaagtcgaccctgttgcgtgccgtggcccggctgcacaaggcccgcaccggcagcgtgaccgtggcggccggagccgaggacgccgcgcctgtcgacgccctcgccctgtcgcgctccgacttcgcccgccgggtcaccctgctcgcgcagagccggaacgcgccggccggcctcagtgtgcgcgacgtggtcggattcggccggcatccctatcggggccggctccggggcaccgatccggacggcgcccggatggtcgagcacgcgctggccgtcacgaacctcgccgagttcgccgaccgcggggtggagagcctgtccggcgggcagtcgcaacgcgtctggttcgcctgctgcctggcccaggacaccgacgtcctgctcctcgacgagccgaccacctatctcgacctgcgctaccaggtggagatcctcgacctcgtccgcgatctcgccgacacccacggcgtcaccgtcggggtcgtgctgcacgacctggaccaggccgccgccgtggccgaccaggtcgtcctcctctcgtccgggcggatcgtcgccgcgggcacacccgcggaggtgtacgcccccgagcggctcagcgacgcgtacggcatccgcatcgacgtcgaacccgactccgccaccggcatcccacgtacccgtgcggtcggccgccaccaccttcgttccgaaaggccctgaacaccctcatgaagaaccagcacctgacgtggcccgccctcgccgccgcggccgcgctcgccctcacggcctgcggcaccaccgaggcgccgaagaaggaggccgccggggacagcgcggtgacgatcaccgactcccgcggcaagaagatcacgctcgacgggccggccgagcgcgtcgtcggcaccgagtggaacgtcgtcgagtcgctcgtgaccctcggcgtccagccggtcggcgtggccgacgtcaagggctacaccgcgtacaacacggccgcgccgctcaccaagggcgtcaaggacataggcacccggggcgagcccagcgtcgccaccgtcgccggtctcaagcccgacctcatcatcgccaccaccgacctgtccgactccgccatcgcgcagctgtccaaggccgccccggtcgccgtggtgcgttcggccgacgcgagtcggcagatcgaccagatggtcgacaccgtcgagctcatcggcaaggccaccggcaacgaggagaaggccgagtccgaggtcgactccttccgcaaggcggtcgccgacgggaagaagaagctcgcggacgccggtctcgacggcgag

SEQ ID NO: 3565 - DNA, 7445 bp, Unknown
  Kingdom: Bacteria, Phylum: Actinobacteria, Class: Actinobacteria, Order: Streptomycetales, Family: Streptomycetaceae, Genus: Streptomyces
ccgtacgtacccctcgaaggctccgtcgacgccgaaacgggggcccgacggcacccggacgccgacccgttcgcccgccacggccagccgcgatccggagaggcccccggtgcgcacccacagcgtcagaccgccgcgcggcacggcgaactcccagtccggcagctcccgccgcaccgccgcgaccagggcgtcccggttctcccgcgcctggcttcgccggacctcgacggcctgttcccagccgcccgtacccatgagccagttgatggcgagctgttccaggacgggtgtgcccatgtcggcgtaggcgcgggcggcgaccaggctgcggatgacgtcgggggccgcgcgcacccagccgatgcgcattccggcccagaaggccttgctggccgatccgacggtcaggaccgtgctgcccgccggatcgaaggcgcagacccggcggggcatgtcgatgtcggcgtccaggcgcagctcgttcatggtctcgtcgacgaccaggaccgttccggcagacctggccgcgtcgaccaggtcccggcgttgctgctcgtcggcgagcgcgccggtggggttgtggaagtcggccaccacataggcgagccggggcgcggcgtcccgcagcacctggcgccagcggttcatgtcccagccgccgagcccttcctccatcgccaccgggacgagacgggctcccgtctcgcgcatcagctggaggatgttggcgtaactgggggactcgaccgcgatccgttcgccgcggcccgcgaagaggtgacagatcgcgtcgatggcgcccatcgcgccggtggtgaccatgatctgttcgggcatggtcgggatgccgagcgcggtgtagcggtcggcgatcatctgccgcagggcaggcagtccggccgggtagtcgccgtgcgtgtgggcgtacggcggcagctcctccagcgccccctggacggcacgggtcagccagggctcgggcgcgggcagggccgcacagcccaggtcgatcatcgagccgagcgactccggcggcagcggttcgaggccgcgggcgggcagcgggttgcctgccgggacggcggtccagctgcccgcgccgcgccgggactccaggaagccttcggcgcgcagcgcctcgtaggcagccgcgacggtcgtacggctgacggcgagggcgagggccagttcgcgctcggcggggaggcgggcggcgaccgggacccggccctccaggacgagcagccgcacaccgtcggcgagcgcacggtaggcgggcggcttgcgaccgcccggtccggtgggccgcgcctgttgcgaccggagctgccgggcgagctgggccgctcccaccgtcgatgtccactgcgccatcgaaatcagtccaccttcctcgaattggccatagttggtgaccgatcccctgccacagagtgacatgaagcagtccactaccactacagcagggggcacaacgtggccaggaccaccggccggagcaccacccatctcacccggcggctggtccagctgtacgtcggcctcacgttgtacggggcgagctccgcgctcctggtgcgggccgaactgggcctggagccgtggggtgtgctgcatcagggcctcgcggagctgaccgggatatccatcggcgtggtgtcgatcgtcatcggcgcggtggtgctgctgctgtggatcccgctgcgccagcggccggggctcggcacggtctcgaacgtcttcgtggtcgggctggcgatggacgggacgctcgccgtggtcggcgacctggacgggttcgggttccgggttcccgtgatggtcctgggcatcgtgctcaacggggtggcgaccgggctgtacatcgcggcccggttcgggccggggccgcgcgacgggctgatgaccgggctgaaccgggtcaccgggcgctccatccggctggtccgcacggcgatcgaggtggcggtcgtggtgaccggcttcctgctgggcggctcgctgggagcgggcacggtgctgtacgcgctggccatcggcccgctggcccagttcttcctgcggatgttcgcgctccccgagcccgcgggcccgggtgccgtcgtcgctccggacgagccgtccaccaccgcgtcgcccgccggttccggccccgttgccgacccggcatccgggcaggccatactgccgcagtgaatccgagccacccctatctcgaccacccggcgccgatcgccttcgcccatcgcggcggggcggcggacggcgtggagaacaccgcgaccgccttccgccgggcgtccgaagccggctaccgctatttcgagaccgatgtgcacaccacggcggacggccgtctcgtcgccttccacgacgcgaccctggaccgggtcaccgatgcccggggccggatctccgcgctgccctggagcgaggtgcgcctggcccgggtcgggggcagcgagccgctcccgctcttcgaggaactgctggaggaattcccgaaggcccgctggaacgtggacctcaaggccgaatcggcactggagccgctgctcggtctgatccgtcgcaccgatgcctgggaccgggtctgcgtcggctcgttctcggaggcccgggtggcccgcgcccatcgcctggcgggcccccgcctggccacgtcgtacggggtgcgcggcgtcctggggctgcgtctgcggtcgtacggcatccgggcggcgctgcgcgcgggcgcggtctgcgcccaggtcccggagcggcagggcggtatcccggtggtggacgcccgcttcgtccgcacggcgcacgcgctcgggctccaggtgcacgtctggacggtgaacgagccggagaggatggcggcgctcctggacctcggagtggatggcatcatgaccgatcacatcgagacgctgcgtacggtgctgagcgagcggggggcatggtcctgacgcccggtccgtccacgtccacaggggacgaccgagggggcgcggcttgagcaccgggaccacagggaagaccgatccgtccgggcagccgccggacgacgggacggcggccgcccgcaaacgggagcagcacggctggtatttctacgacttcgcgtgctccgtctactccaccagcgtgctgaccgtcttcctcggtccgtatctgacgtcgatcgccaaggcggcggcggatcccgacgggttcgtgcacccgctgggcatacccgtgcgcgcgggctcactgttcgcgtactccgtctcggcgtccatcgtggtggccgtcgtgctgatgccgatcgtgggcgcggcggcggaccgtacggggcgcaagaagccgctgttggcggcagccgcctacacgggggccgcggcgacggcggggatgttcttcctggacggccaccgctatctgctgggcgcgttcctgctgatcgtggcgaacgcctccatctccgtgtcgacggtcctgtacaacgcctacctgccgcagatcgccgagccggaggagcgcgacgcggtctcctcgcgcggctgggccttcggctacacctcgggcgccatcgtcctggtcctcaacctgatcctgtacaccggccacgagtccttcgggctcacggagtccgacgcggtgcggatctgcctcgcctcggccggtctgtggtggggcgcgttcactctcgtaccgctgcgccggctgcgcgaccgccgggtcccgccgggcggcgagggagcggtgggatccggatggcagcagctcagatcgaccctgcgcgacatgcggcgccacccgctgacgctctccttcctgctcgcctatctcgtctacaacgacgggatccagacggtgatctcgcaggcctcgctgtacggctccgaggagctgggcctggatcagacgacgctgatcgtcgccgtgctgctggtgcagatcctggcggtggcgggggcgctcggcatgggtcggctcgcccggacgcacggcgcgaagcgcacgattctggggtcgctggtgatctggaccctgatcctgatctccgcctatctgctgcccgccgacgctccggcgttcttcttcgtcctggcggcggcgatcggcctggtgctgggcgggagccaggccctctcacggtcgctgttctctcatctggtgccgcgcggcaaggaggcggagtacttctccgcctacgagttgagcgaccgcggactgagctggctggggcccctggtgttcggtctggcgtaccagctgaccggcagctatcgggacgcgatcatctcgctgatcgtgttcttcgcgctcggcgcggtgctgctcgcgcgggttccggtgaggcgtgcggtggaggccgcaggcaaccccgtgccggaacggatttagacgttgaagtcaaagggcggtagtatacgtctttggcctgcccggaggaccgttactgccagtggaagcggtccaaccgttgagtgacaacattcaccagaggtgacaaaccgggcatgggcgggtactcaacccagataaagcagcggcacgacgggcgacgcatgaccggcaacgggaatctttaccgccgaccggacgttgaccggatgacgacgacagcgacattttgtcctgtgggcgacaagcccgggaggcacgattcatgagtgagcgagctctccgcggcacgcgacttgtggttaccagctacgagacggaccgcggcatcgatctggccccgcgccaggcggtggagtacgcatgccagaacggacatcgatttgagatgccgttctcggtagaggcagagattccgccggagtgggagtgcaaggcgtgcggcgcccaggcactcctggtggacggggacggccccgaagagaagaagggcaagccggcgcgcacgcactgggacatgctcatggagcggcgcacccgcgaggagctggaggaggtgctggccgagaggctggcggttctgcgctccggagccatgaacatcgccgtgcacccgcgggacagcaggaagtctgcctgaccgcgttaccgcacagcagcacagcaccaagagccgcgggccgtgacacagaaggtgtgtcacggcccgcggctcttcggcatgtccgacggcatgtcccacatgacccgatggaacggctccccgttcacgccctgacggggagcctcccgtcagggcgtgaggggcgggcggggcccccgggggtcgtcgtcgggcccggaggacgcctgggagccgtcctcgcggatgacctcgccctgaacgacctttccgtccggccggtgcatcctggcctgctggaaggcgtccgagagaccccccggcgtcgcggcccgcatacggcgctccagcgagcgctccgcgtaccggccgaccatggcgcgcaccggcggcaccagcaggatcagtccggccgcgtccgagatcaggccggggatcaggagcagcagcccgcccagcatcagcaggccgttgccccgggaacccttgccggccgcgggagcggccggcggcgtggccggagcgccgggctgccccggcatctgctggagggtctcggtcaggttcttgaaggcgcgtcggccggcgctcttgatgaccacggcgccgagcgctgccccggccaccaggatcagcaggacgacgaggccgcccgcggccgaggcgaccagggtcagcagccagatctccaggaccagccaggcggccagggccggcggcaggaatctacgggcgcgcgagcgccggggacgggtcgggagcggagtgccggtcgtcatgtccccagtgtgcctgtacgggcgtgcaagcggcgtaagggggtgatcatgaagccggtcgggggcggcgcccccgtccgccgctcaggagcgtcagagggtcttgcggcccaggaccttgttcgcgcgggaggtgatgccccagccggtgacccgccacagagcctcgacgaggatgtcccggctcatcttggagtcgccgatctcccggtcgacgaaggtgatggggacctcgaccacgtgatagcccgcctcgaccgcgcggcgggcgagatccacctggaagcagtagccctgcgaggcgacctcgcccagtccgagaccgtcgagcgtcccggtgcggaaggcgcggtagccgccggtgacgtcccggacggagagaccgagggcgagccgcgagtagaggctgccgcctcgcgagatcacctcgcggctcttgggccagttgaccacgcgaccgcccggcacccagcgggatccgaggaccagatcggcgcccttgagcgcggtgagcagccggggcagttcctcgggctggtgggagccgtcggcgtccatctcgacgagcacgccgtagccgtgctcggagccccaggcgaagcccgcgaggtaggcggcgccgagcccttccttgcccttgcggtgcaggacgtggacctggtcgtcggccgcggcgatctcgtcggccgccttgccggtgccgtcggggctgttgtcgtcggccaccaggatgtcgacatccgggacggcggtgcgcacccggtcgacgatcggcccgatgttctcgacctcgttgtaggtcgggatgatcaccagaaccttgccgagcgggccgaactgcctctgaccgccgtcgttcactactgccccttaaagtccgtacacagggggacaccatatccagcgcatcgccgccgggctccgacgcggtcgcgcgggcgtgcggcgcggcgcggacagacccgtggaactgcggacagaacacggatccacgacacggcgacccctgggagaaaacgtcggaacttcggatcggggcccggcgcccttcgggccgacctgggacccgctggctgcgggtcgaccgaaagccgttgtctactgaacgtccgggccccacccgggtcccaccctccgtccggctgaaaccttccctcgcccccgaggcgcgggcgctgaacctggctgtcagcggtggtgggccggtgcggcacaccacctcatgacccagcggcgttcgacgactgcgtggaggtttaaccggtcggacgtcctgtggtggacccggccgaacctaccggcccgtgggcgctttctgtcaacagccgtgcgacctgcgactttttccgaaattgcctggtcagtgccgaggggccgcaggtcgcggaccagcgatcgggtcatcgatcggcggtacgaaatgtcccgacgtcactcgttcggtcgtacgtagacagtttgtccgaagaccacggtccgcaggcagacgggaaggtcggcaccggggtcgaggtccggcaggccgggcgtcccggaccgggggtcggtggaccatcgggcgacccggtcgtcgggtgcctggaccaggagttcggcggtgcgccagacggcgtagtcggccggggcgccgggcaccaggaggcccgcgtcgtcgcggccgactacgc

SEQ ID NO: 3566 - DNA, 4049 bp, Unknown
  Kingdom: Bacteria, Phylum: Actinobacteria, Class: Actinobacteria, Order: Streptomycetales, Family: Streptomycetaceae, Genus: Streptomyces
gcaggtcggaggccacgatggcgtccggcttcagcgaggcgagcagccgggcggcgcggcgggcctgcccgacgccggtctcggtgagctcgatgtccgtggagccctggaaacggcgctccaggttccacgccgtctggccgtgccgccagaggacgatcctgcggcccgtgccgctgctgctgccgttcagttctggtcaccttccgtgccgccgttgagctgtgcgtgctcctcggccttgccgcgggtcttgatcgcgtcctcggggagggcgatctccgggcagtccttccacaggcgctccagcgcgtagaagacgcgctcctcgctgtgctggacgtggatgacgatgtcgacgtagtcgaggaggatccagcgggcgtcgcggtcgccctcgcggcgcaccggcttgacgccgagctccttctggagccgctcctcgatctcgtcgacaatcgacttgacctgacggtcgttgggggccgaggccagcaggaaggcgtcggtgatcgacagcacatcgctgacgtcgtaggcgatgatgtcgtgcgcgagccggtcggcggccgcctgagcggcggcgttgatgagctcgatggagcggtccgtggcggtcacatgcaggctttcgtcggcggtcggatgcaacctctagggtctcacggaccaccgacagagccttactgcgtttcatggccgggcttcgggcgcggataccggccggacccgacggcggataccggccgggctttcacgcgacggccaccggccggaccgggctctccggccgacgccggagcgccggccggtgagcccgaacgggctactggacctcgtagtcctgaccgaggaccgcggacacgtcggcgttggcagccggctcgcccttcttcacgtcacctgcggaaagccccagggtcttggccacctcgacggccttctccttgtcctcggcggaccggtagagcacgacggacgacgcctcggcccctgccttgccgctgtccacgaaggcgtaaccgccgttgaccagctggacccgggcggcctccgcggccttctcgttccccgtggcgttacggacggcgacccggagcggagcacctgcctcgggagccttcaccgtgccgccgagaatgtccttgacgacgccgcgggtgtccgcctcggtgagcgtgccgtcctcctggacaggcagcagggccgtcttgtagtcgccgaccttggcacgcgaggccagcttggcgagcgaggccccgaggtccttctcgggcagcgacgggtccagcacctggagcagggtctcgatggtgacggtcgcggccttggggtcctcggagatcttgcgcagcgtggcccgcatgacctcgccgaaacgcgtcagctgcttggcctcgggctcccccggcgcacggtacgtggcgtacgcgacggccatcggaccgctgagcgtctgcccctcgcccttgttcaccaggggggattcgcccttcttcgcgccgggcacatcggtgtcggtgtcgacctcgatgttgccgaccagctcgacgaggttctccaggtacggggtgtccagccgccaggtgccggtgatccgggtgcccaggagggtgtcgatggattcccgggtgccggtcctgccgtcgtcctcgacggacttgccgagtgtggtggtcgtcccgtcgtcgcccgcgacggcgagggagttgggcagcaggacggtggtgccctgctcggtggtggcgttgtcgacgagcagcgccgtggaggtgccgcccttcttcgtgtcgtgcaggtgcaccacgatcatgtcgcgctgctgggcaccggcggcgacggacttcttctcgtccgatcctgagaggcccgggatcatgtcggcggaccagagatagccgaccccgccgacgacgacgaggacggcgacgactatcagggcgaccatccggttgcggcccttgcgtcgtgcttcctcgcgccgctcgctgcggctctcggtgaacttcagccagtcgatgacgtcttcggagtcctcgtcgggctcctcgatgaacgagaactgctcggtgcggtagtcgggggcgggcttgcgctgccccggaagcgcgggctccgcctccatctccgccgctcccggcgactgctgcggctgctgtgcgggagcctgctgcggggcctgttccggtgcgggggccacactctgctgcgggacggtccagtgccggccggtgtcgaccgcggcgggctgctgcccggtggcgtagccgtagtcggtgtaggtgccgtagccgtatccctggtcggccccctggccctgctgcgtctggggcggctgttccgggtgctggtcggcgtagcggtcgtaactccggggctgctgctgggggttgccgtacgcgtcgtagccgtagccggcgtcctgggtctggtgcccctgacccggctgggcggcgtacgggtcgtaaccctggccctgctggccctgctggccctgctggtcgtactgctggtggccctgctgctggtagaccggctggccgtacgcgtcgtagccgacgatctgcggctcttggtagtacgggtcgtacgggttctgtcggtcgttcaccggtgcccctctccgtggctcattcgccgcggtacagctggcgcttgtcgatgtagcggaccacgccgtccggcaccaggtaccagaccggctccccctgcgcgaccctctcacggcagtccgtggacgagatcgccagcgcgggcacctccacgagggagacaccgccctcgggcagaccgtcgtccgtgagcacgtgacccgggcgggtcacaccgatgaagtgggagagcgagaacagctcctccgcgtcgcgccaggtgaggatctgggacaacgcgtcggcgccggtgatgaagaagaggtccgcctcgccgtggacctcgcgcagatcccgcagcgtatcgatggtgtacgtcggtccgccacggtcgatgtcactgcggcttaccgagaactgcgggttggacgcggtggcgatgaccgtcatcagatagcggtcctcggccggggagaccttcttgtggctcttctgccacggctgcccggtcgggacgaagacgacctcgtcgagatggaactgggcggccacttcactggccgccaccaggtgtccatggtggatcgggtcgaatgtcccgcccatcacgccgatacggcgcttgccggggccggtaggcacttcctgctctcccatgcgtgcagagcctactggcacagctgtacgcccccgactcagcggtcgcggttgaagcgggtggtgacccacagcaggaacatcagcgcgaggaacgccccggcgccgacgaagtaggggttgaggctttcgtggttgccgccctcgccgccttcggaggcgagagtgaccagctggtgtgcggtgctcgtgaggctcatcttcggcaggacctatcgatcgtgaatcggaaggaagacgtcggtcacatcgtatgcgggacccccgggcacgctcacggcgactcagtcgttgttgtcgtcgttgcggtatccacgcagcaggaaccaggcgagcagaaccgctccgaggatcgagacgagcaacacgatccggagggtgtcacccggtccctgctcctgggacgcggcggcgagcagtacggcggtgtgcggcatttcgggcgctcctcacagttatccacagccccccgcacaccgtagcgccagcgcatacgctgggttttgtccgggggacgagcaacgtctcgtacgaacagggggccatccatgaccgacaacagtcacgagaacgtgccgagcaggcagcgccggcgattccccgggatctcctcccgggcctacgagcaccccgccgaccgctcggccctggtggccctgcgcaagctgaccgggttcgacaccgtcttcaaggcgctcagcgggctgctcccggagcgcagcctgcggctgctcttcctctccgactccgtccgggtgagcgacgcgcagttcgcccacctcaacgacatgctgcgggacg

SEQ ID NO: 3567 - DNA, 2453 bp, Unknown
  Kingdom: Bacteria, Phylum: Actinobacteria, Class: Actinobacteria, Order: Streptomycetales, Family: Streptomycetaceae, Genus: Streptomyces
gtctcgcgcaccgtccccgtgcgcgagacggcgtccgggtcggtgaagccgagcaccgtctcgccgggggcggtgacgaagcgctgggcggcgatcgtcgtggggagcgcgtccagcacggacatgacgagacggttggcctcctcgtcccagtcgaagtggtactcgcggccccggccggacttggtgtggagcaactgctcgatccgggagcgggccgctgcctcgccgtccgtgaagtacgcggggtaggagacccgcaggcgggtgagccgcccgtcggcgtcgaaggcgtacccgtcgaaggccttcccccagtcgccgccgtgggcgaacagcggatcggggtcgtcggccgtggagaagtacggcacgagcgcctcgtacagcgacttcaggcgcgcggtctccgacgcgtcgggcccggttctcgccggggtccgctcccgccccttccacgcggcagcgcccatcaccgtgaccagggtcaggatcggcccgtaggggacgagcgccaccaccagcacgcaggccgcgccgaggaacagcttgggaccacgccgctccttgggcgtcgcgatccacttctgccggccggacacggccagcagccgtagcccgcggaccaccgtgatcagcggatggaggacatcggtggcactgtcggcggccgtgcgcgcgatctctctgctgcgagtgatcgaagcgctgccgctgctcagaatgcgggggagtggtcgccgggccacatcggtctcctgaaggggtgggagcggttgcggagcgtcagaacttgatcccgcccagcaggccggcgaggctcgccccgcccgccgtgatgctcggtgcgatggcggtgccggccaggtagaagccgaacagggcacagacgatggcgtgggaggccttgagtccgtccttcttgaagaacaggaagacgacgatggcgagcagtaccacgcccgagatggaaaggatcatgagcggttctctcctggttgaaggggacagtcaccatgagtccttccaggatcacgggaagtatctatacgacaaaaggtgcaatcgagtgaatatccagcgctttcacttgactggcccacagaagtcggcccccggagagcggcatcacctcgtccgtgccgggcaggatcagccgcggtgatcccttgccggatccgggccgggtcatgtcggcccgggagcagtaccctgtcgattcactcgtacggctccgtgccgtactccccaccaggtcaaccgcggcggtgacacccgcggcagcggtcaaggaaggcggcccgtccgatgagcgaaacccccgatcccgaggtggtcgagctggcgaccaaggtcttcgacctggcccgcgccggcgacaccgaggcgctcacggcgtacgtcgaggccggagtccccgccaacctcaccaacgaccggggcgacacgctgctcatgctcgccgcctaccacgggcacgccgggacggtcgccgccctcgtcgcccgtgaggcagacccggaccgcgccaacgaccggggccagaccccgctggccggagccgtcttcaagggcgaggacgccgtcatcgacgccctgctcgccgccggcgccgacccggccgccggaacgccgtccgcgctggagacggcccggatgttcggcaagtccgacctgctggaacgcttcggtgcccggtaggacgccggcgggctcgcccctgggcgcgtccgccgtgggctccgctgaccggtccgtcgtaaatgtggtcgcggtggcgaaatggctgggtcatcatgacgtcgcgggtccgctcagggccaccgacgagaggcagaggaagatgctcttcaccaggcgaaagacggcggtcggccgatcatgtcactgcgcggcgtaatggtgtccccccggacacccccgcgtgccgagaggcgcggggcactgcacagtcccggttgcgtcgacagcttgatgtgaggctttctcccatgttcgatccgttcatagcgccgagcggcaccctgctcggcctgttgcagaggggccgcggcgacggcacgctccacgcgctcgccgcaccacgccccgaggccctcgcggctctcaaccactgcgtcgtgagcgacccccgtcacgactggcaggtggagaaccgctccctctactacgcgcgcctctacctcgacctcgacggcggtatcgaggagatcgagcggcacctcgccgatcccgacgaccacatcgataccgacgactcccggaccggtctggcgctgtccgtcctcggccacctcgcctcctacggacgcgacgacgccctggccctgctccgccgctacgcggcgaccggcgccaactgggcctgggccctggacgaactcgccctgcgcgacgacgacgccggcctgcgctccctcgcgctgcccgtcctcgcccgcttcccggacacc

SEQ ID NO: 3568 - DNA, 4361 bp, Unknown
  Kingdom: Bacteria, Phylum: Actinobacteria, Class: Actinobacteria, Order: Streptomycetales, Family: Streptomycetaceae, Genus: Streptomyces
agcagggtggtcttgccggcgccgttgggaccgatgacggcgtgccgggcgcccgccgggagccgcaggctgacgtcgtcgacggcggtgagagtgccgtaccggcgagtgagccgggtgaggtccagtacgggaggcgccggcgtggcgccggtcggtgctggtgtcatggggagaccttcccggcggggttcggtgcgggtgctgacggggaccggtcctcggccacgggaacctcggacggccgcccgttcccgccgcgcagaccggccaggccgcgcggcagcacgtacacggtggcgacgaagagcacgccgagcagcagtggcccgtggccgggccaggaaccggcgacccagtcccgggtggcgacgatgagcccggcgcccagcagggcgccgaccacggacgtcgtaccgccgatgaccaccgccagcagggcgaacgcggcgatctcgaacccgacgtcggcgggggagaggtactgctggacggtcaccatcagcgaaccgcccaccccggccagggcacccgcgcagatgtgggccaccagcaggtagcgccccaccgggtgcccggatgcgcgcatccgggcttcggcgccccgggtgccggtcagcagcttccccgccggggagcgcaggacgagcagggtgacggagacggcgacgacggcgacgacgagcgcgtagttgtacagctcgctctcctccagcatcccctccccgccccacagcgcccgcgtggccgggaagccgacgaggccgtcggcgccgccggtgacggacttgagctggttgacgaccgcgccggtcagctccccgatggcgagcgtgatcatcagcacggtggtgccacgggcccggatcaccgcgggtcccaccaccgcggagaagacggcggcggcgagcgccgagaggacgatctggacggggcccacggtccaccccgcgtccgccaggttcgcggtggcgtacgcgcccaccgcgaacggcgcggtctgcccgagggtgggcagtccggcgtagccggtcaggatggtgacactgaccgcgagcagccccagggccagggcggaacccgccagcgagatgctgtacgcgtcgagcagggccggcagggagatcagcaccacgagcaggacgagcagcggagccgcctgccgccacgcggcgccgcccggcagccggccgatccaccccggcacgcggctcccgtacccgcgaggcgctgtcccggcccggtccgcctccgccgcccggtccgcgcccgacgcttctgctgtgcccggcacctctgccgcttccgccgtccgcggcgtctcgcggggccgtcgtcgcagccggcccgccaggtgaccccggagccgggcgaccgggtccggcgcagggccctcggggccgtgcgccgtcgccggttcggcgaagcgggagcgcagtaccagcaccgccgccatcgcggcgaagagcagatacggcgccaggtccggcgccagcgagacgcccagcgtctgcacctcgcccaccgcgaccgccgcgaagaaggtcgcccacagcgagcgcagcccgccgagcacgaccaccacgagggacagcatgagcacgttctcggacgtaccggggccggggccgatgatcggcgccccgagcacgcccgccgcaccggccagcgcacccgccgccgcgaggacgccggtgtgcaccgcccgggggttgtgaccggtggccgcgagcatctgcggatcgtcggcggcggcccgtaccgcggcgcccatacgggtccgggtcagcacccaggtcccgaacgccgcgagcagcacggccatcacgatgaagcagagccggtaggcggggtagcggtgtcccagcagcatcaccgaggagtcgagcgcctcgggaacgcgtacggggagttcgtccgctccgaagagctggatgagcagatcacccccgatcagggcgagcccgaacgtcagcagtgcctgcgcgagatgcccacgccgggcgagcggagccgtcgcggcggacagcccggccccggcgacgcacgccgccgcggttccggcggccaggccgagagcgagaccgccccaggtcccgtcgctcagctcggcccccgtgtaggcgccgatcgcgtacagcgtgccgtgcgacagattcagcacacccgccgtgccgaaggcgaggctcaggccggcggcgaccacgaacagcagcagtccgaaggccactccgtccaccgccgggatgaggtgggcatcgaggagatccatgtcagctgccgagcgtcgccaggtcctggaccatgacgttggccaactgggcgccgtccggccgcacctggcgcaggtaccacgtctgcaccggcgagtgggccttgtcgccgaactcccaggagccgcggggactgtcgatctgtcccaggcccgcgatggccttgttgatggtctgcggcgtcacgtcgccgtccttcgccgcgtcggcgatcgccttgtccagtacggcggccgcgtcgtacgacgccatcgcgtaggtggtgggctgggtgtcgtgctccgccgtccagtcggcggcgaacgtgcggttcgcctcgttgtcgaggtcggccgcgtagttcaggacggagtagatgtccttcgccgcggcgccctgggcctggagaacgctgccctcggtgacgaaggccgtgtacagcggcagatcggcgatgtccgactgggcgtactgcttggcgaagtcgatcgcggccttgccggcgtagaagcagtacaccgccttggcgtccgtcttggcgatctccgcgaagtacggcatgaagttggtcgtcttcgggaacggcgtccaggtggtcttgccgtccgggttggcgagcttccccttgacccgctcgaactcgtcggtgaagccgcgcagttcgtcgtagccgccctggtagtcggggccgatcgcgtagaccggtccgtcgaccttgtccttgatgtacggggcgatggccctgcccggttcgtcggacaggaagctcgtcgtccacacgtactcgatgtccttgaccggcggccgggcgttcgaccccaggaaggggatcttggcctgctggaccaacggcagcaccgcgttgaccgagccgccgccgacgaggcccgtcaacacgtcgaccttgtccttcttgaccagcttggtggccgccggcacggcggtcggcgggccgtctccctcgtccgccacgatgagctcgacctttcggccgcccagcttgttgccatgggtctccagatacagcttgaagccgtcccgcagctccgtgccgaccggctcgtaggtgcccgagagggaggccaccaggccgaccttcacggtctcgtcgtcggcgccgctgtcgccgctgcagccggtgacggccgccaggccgagggcgagggcggctgcaccggccggccggaatctgcggcggtggggacgggtcagggtggagaagaacatgggggctctcatcactgtgtcggaggcgggggcatcgggagccggtcgggacgggtgcggcgggtgaccgccgcacccgtgggagtccggaccggcgagcagtacgggggcgggaggtggcccgacgggcgatcagcgatgggtcgggaagctcggatcgcggacctggggggacagcgagtcgcccacctggttgatcagttcggacatcatgtagctgacctcgccgatgtccgcgtccctggtggtggtgacgaggagcgaggcgccgctggagacggccatcgagaacatatagccgccctccatcgcggtgaggctgtgctccacggggtcggtgttcgtcaactgggccgctgcggacagcaggttgacgacgccggacgcgatggcggccagccgctcggcgtcgtcgcgttccacaccggtgtacgccagcgcgagtccgtccacggacacggctatcgcctgggtgacttccgggagacgcccggcgaaatcgctcaggatccagctcaggtcggaggaggtggtcatttctcggtccgttcggtgttgtcgtccggggcggaacgcccccggtggttcgtgctccggttgatcccctgggcgtaggccgccagcacgtcggagacctgtcgggagtcccggcgccggggcgacggccgcggagcgccggtgccggggcgctgttcggcgccttcccgcttgcccccggcgggccactgctgaggcgctcggcgctgccgcacgggcagccccgaggagctgacgccggcgacacgtgacaccggctcgtcgtgcacgggatgcggcgcgggcgcggtgccgtgctcccgctcaggtgtgccgccgccaggcccgccatcgcgggggcgcgcg

SEQ ID NO: 3569 - DNA, 3962 bp, Unknown
  Kingdom: Bacteria, Phylum: Actinobacteria, Class: Actinobacteria, Order: Streptomycetales, Family: Streptomycetaceae, Genus: Streptomyces
gatgtcgagcaccatcaggtcgaacccgccggtcagcgcgtggcccagcgccaggtccccgtcctcggcgacgaccgtggtgaagccgttggcgcgcagccccttctggacgaacgaggcgatgcgctcctcgtcctcggcgatcaggatgcggttcatgagtcggtctccagcgtgagtacgaaggtggctccgccgccttcggtccggcgtagttcgatgcggccgtggtggccctccgcgatggccttgacgatggcgaggccgagccccgcgccgctggtgcgggtcccgcgccgggacgtcccccggcggaacctctcgaagatcacctcggcgtcctccggcggaatcccgggcccgtggtcggcgacgtacagctcgacgcggtccgcctcgacccgcgaaccgatccggatgcgcccgccgggcacggtgtgctggacggcgttctgcgcgagctgcaccatcgcctgcgtcatccgctgcgggtccaggcgcacttcgaggtccgcgacgccgtcgagctgccactcccggtccccgagggtccgcaccttcacgaacacgtcggcggtcagctccgcgagctggacgggttcgggggtgacgaagtcggggcgctcggcccccgcgagcagcagcaggtcctcgacgatgcggctcatccggtccagctcgtccgtgaccagccgcaccgtctcctcccggtccgccgggtcgtcacccatcagctccaggtggccccggacgatggtgatgggggtgcgcagctcgtgcccggcgtcgtcgacgaagacccgctgcgcggcgaacgcccgctccagccggtcgagcatcgcgttgaacgtctccgcgagggccgcgatgtcgtcgcggccctccacggggatgcgccgggtgaggtcctgctcggtcagttccgccgccgtcgtccggacgagacggacgggcgcgaggatgcgtccggcgacggcccagccgatcccggtcgtcatcagcagcgccacaccggacagggcgagcagcgtccagaacgtcttgtcggcgacggcccgttcgcgttccgggtggaaggcgacgacgaacgcgccgggctgttcgcccgtggaaggcccgatgtcgaccttggcccagcgcacctcgccctgcgggcggtccagggtcccgaaggagtccttggaggcgtggatccgggtgagcgaggcgcggtcccgccacagggcggtgtccgggggcagttcgcggcgctgccggatgacgtcgggcttgtcgccgggccggccggtcaggcccagcagctcctcgtcggggtccgcgtactgccgttgcagatagacgcggaggagcttgtccgcgctgtcgaaccggccgccggtggcggggtccaccccctgcggcacgaagttcgcgaactcgccggtctcctgggtgagcagctggctgatgcggtggtccacgtcccgctggaggatcgaacgcacggtgacggcgaccgcgcccagcgcgaccgccatcacgaccagcaaccacagcaggatccgtacccgggcggaaatcctcggaaggctaaccgtcatcaccgaagtcgtcgtcatcgtcgtcgtcggccgccgaggggcccgggacgacggagctgtccggtgtacgggtcggggaggaggagccgctcggcgccggggagtcggtcggcgacgtgacaccgctgggcggcggtgtgccgcgcggactctcctccaactggacggtgggaggcaccttcggtgcttccgaggtgtcggtcatggcatagctggtggccgctatgccgaggggcacggcgacgacggctgccagggccgccagacgaggtgagaaagccatgtattcaccctgactgccccggagggtccgaacatgaagcgaagatgaacaatccttcatcttcgatgtgcttcccgtccgtctgtgggagagcgcggcccgggaagacctgccgttcccgcttgcttcgagtgcactccaaggatttagcgtgggggcatgacggtgatcgacggaacctcccggagcactcccgcgacaagcgcgcacccgcggtcctcgccggcggtggacgtctgcgcggccgcaccgaagccgcacccccgccccgcgggcaaggacagctacacgatcagcgaggtcgtcgccttcaccgggctcaccgcgcacaccctgcgctggtacgagcgcatcgggctcatgccccacgtcgaccgctcgcacaccggccagcgccgcttcagcaaccgtgacctcgactggctggcgttcgtcggcaagctgcggctgacggggatgccggtcgccgacatggtgcggtacgcggagctgctgcgcgagggcgcgtccaccttcgaggaacggcaggaactgctggaggcgacccgccgcgatgtgatcacgcggatcgcggagctccatgacaccctcgccgtcctcgaccacaagatcgagttctacgcgggcgcccgcagggtgccggaaaggcacagcgcctgatgaacgacaacgacaggaacacgatcgccaccgtcgggatgggcggcgacggcggaccgcgggtcggcgtccagggcctcggctgcatgggcatgagcgagttctacggcgacaccgatgagcgctccgcccgggacaccctggacgcggcgctggaagcaggcgtcacgctcttcgacaccgccgacgtctacgggcgcggggccaacgaggagttcctcgcgccgttcgtcggggcccaccgggacgagatcaccctcgccaccaagttcgcgctggtgcgctccgacaaccccgggtaccggggtgtgagcaacgaccccgcgtacatccgcaccgccgtcgaagcgagcctccgccggctgaacacggacgtcatcgacctctactacatgcaccgccgcgacccggccgtcccgttcgccgaatcgatcggcgcgatggcggagctgatccagcagggcaagatcaagcagatcgggctgagcgaggtgaccggtcccgagctgcgcgaggcgtacgcggtgcacccgatcgccgccctccagtcggaatggtccctcttcagccgggacgtggagaagagcgcgctcggtgcggcggtggagctgggcgtcaccctcgtgccgtactcgccgctcggccggggcttcctcaccggggccttcaccgacgcgggcaaggacctgggcgagggcgatttccgcaagcagcagccgcgcttcaccggcgacaacgcccggacgaacgccgccctgctggagcccgtccacaagatcgccgccgcgcacggggccaccgccgcgcaggtggctctcgcctgggtccagcagcgggcccgggtgcacggactgaccgtggtcccgatccccggcacccgtaagcggagtcgcctgctggagaacgtggcggcgaccggactgacgctgacggccgaggaactggccctgctggagccgatcgcgggccgggtggcgggggaccggtacccggacatgagcctgacgtcggaggcgcgggagaagtagtccggaggcgtacgaggtgatcgcctggttcatgaaggtcacgacggccgggcgacgccccggaccccgtacgccggaaggccgccccctcacgccagccccagcgcgaacaccgcgaaccccgccgcgagcagtcccgccagcgcacggcgggcgttcgcggcgcgggtgcccgcctgccacggagcctcgaagcggcgcgcgtaccgggcgatcagcacgagcagcccggcgaacaccggcagccaggcgatccgggcgaggatccagcccaccgtgtccggcgcggtcgtcagccccgccaccgccgtccccacccccgcgagcgaggccggtacggcggcggccagcatcgcggtctggtgccagcacaggatcgtcatcgcggagaggttgatcaccacgaccggc

SEQ ID NO: 3570 - DNA, 4519 bp, Unknown
  Kingdom: Bacteria, Phylum: Actinobacteria, Class: Actinobacteria, Order: Streptomycetales, Family: Streptomycetaceae, Genus: Streptomyces
cggccccggtggacgcggcagcagtacgggagtggcgcgaggcgctggacgcctgagccgccgagtcggcggggcgggaaccgcaagggtcccgcccccgcgcggtaccgctacgccagcgcctccggcaacggcgccgcgtgcagcaccgtgagcccggagaccgcacgggtcagcgccacgtacagccgccgcagcccggtccgctcgtccggctcgccgtcgaccacggccgccggttcgtcgaggaccacgtagtcgtactccaggcccttggcgagcgacgcgggcaccagcgtcagccgggacgcggcggtcgtctcctcaccgggggagagatacgcgtggcccgccgccgtcagggccgcgcccagcgccgggatccgggcgtcggcggcgatcagcccgatcgacccctcgtggcgcaacgactcctcgcaggcggcgacgacggcagcctccagcacctccgccgacgggacctcccgcacgaccagcgaaccgggcgactcacgcaccgactccaccgccgccagccccggcgagatcacgggcagcagccgggaggcgtacgcgatgacctcgcgcggcacgcggaaaccggcggtcagctcctccaccaccgcgtccgccttgcccaggtggaacagcgcctcgtcccagctctccgtggaccacggggtcgtcccctgggcgagatcgccgagcacggtggccgaacccgtcgagcaccgccgccccaccgcccggtactgcatgggggagaggtcctgcgcctcgtcgagcacgacatggccgagcgagtgcgtacgggcgatgaggtcccccgcctcgtcgatcagcacggcgtcggccgccgaccacttcgcggacttcacaccacgggcgggcttcgcccacagcagccgcttctgctcgtcctcggtcagcaggccctccgcgtgcgcggccaggaactccgcgtcggagagcagccgcagcaccagcttcgccggatccacggccggccagaccgccttgacggcggccttcaccgcggggttccgggccaccgcgttctgcacccggtcgtcgggcgcctcaccggcctcctccatccgtacgaggacggcgtgcgcgatccgctgcggcagcgcctcgtgcgcggccccgtaccgcatgtcgcgggccagcagttcgtcgaccatctcctggacctcgtacgcgggcacgcgccagcgccgggacccgcgcaccacgacgacgggctcgacgggggcggtcacatgcgagcggatggcccggcgcagcacctcggccatacgggcgtcgcccttgacgacggccgtggccgcgtcgtcctcgccccggacctcgacgccggtgcgcaccaggtcgtcgacggtggcctgcttcaccgccagctcgccgagggcgggaaggacctgctcgatgtagtgcaggaaggaacggttcggcccgatgacgagggtgccggtgcgggcgagccgctcgcggtgcgcgtacaggaggtacgccacccggtgcaggccgacggcggtcttgccggtgccggggccgccctgtacgcagacggtgccgccgaggtcgctgcggacgatctcgtcctgctccggctggatggtggcgacgatgtcgcgcatcgggccgacgcgaggccgctcgatctccgcctggaggagccggctggtgtgctcggcctcggcggggtcggtgaggcgctcgtcctcgtacgcggtcagctcgccggcggtgtagccgaagcggcggcggagccccacgtcctgagggttcttgcgggacgcctggtagtacggctgggagaccggcgcacgccagtcgatgaccatggggtccccgacggcgtcgtggacgtgccggcgcccgatgtagaaccgctcgccctccgcgccttcggccagctcgccgccgacggcgtggagatagtcgaggcggccgaagaacagcggggtgtgcgagaggtcggcgagcgccttgatgcggtcgtcgatctgggcctggagcacggcggcgttgacccagttcgcggtgacgtcgcggatatcgagggcctggacgtcctcgcgcatcccgcgcagcgcggcgcgggacgcggcgagatgggcgcgttcgtgcgccaaggggtcggtggcgccggtgggatcgggggtggaatcgctctctgctacgtgcgcgggcacggtgttgcctccggctcttcaacgcaggacggcggaccggacgcgcttcggtgacatggcggcactcggagcggcggggtccgctggaaaagtacgtatccgttgggtgtcggccggtttccgtccggtcggcggcgctcccggggccgggaagacggcgcgggaggcgggcagacccgcgattgtagccacggagcgggtcggcggcgaaccggaatacggaccgcgcgggccgccgggcctcccccgggggcggagacgccagggatacccgtaggggacgcgcccgccgggagcggtaccggagggctacccgcccggctccggggttccgtctgcgggccgacgcgcccgaacgggtgacgggagcaccatggatacatgagcacagccaccctgaacccacgcaggaccggccccgcgcacggcgcgaccgcggccaccggtcaccaccgaccccaccgcgtcggcgacgcggtgcgcgccgtgaaggtgttcgtgacggcggcgttcggcgtcgtcgtcctgggggagtacgcggaggaggcgggcgtcgtcggccggggccgctgaccgcccgcccctgacgggagcctcagttgccggcgagcagctcgtccgcgtcgacgatgcggtacgcgtacccctgctcggccaggaaccgctggcggtgcgccgcgaagtcctggtcgatggtgtcgcgggcgacgaccgagtagaaccgggcctcgtgcccgtcggccttcggccgcaggacccgacccagccgctgggcctcctcctgccgcgacccgaaggtcccggagacctggatggcgacggtcgcctcgggcaggtcgatggagaagttggcgaccttggacacgaccaggacactgatctcgccctggcggaacgcctcgaagagcttctcccgctgggcgttgctggtctcgcccttgatcacgggggcgtccagatgctcgcccagctcgtcgagctggtcgatgtactggccgatgacgagggtctgctcgccctggtgcttgcgtaccagcgcctcggtcaccttccgcttggtcgcggtggtggcgcagaaccggtacttctcctccgtctcggcggtcgcgtaggcgagccgctcggagtcggtgagattgacccggacctcgacgcagtcggcgggcgcgatgtaaccctgcgcctcgatctccttccacggagcgtcgaaccgcttcggcccgatgagcgagaacacatccgactcccgcccgtcctcgcgcaccagcgtcgccgtgagacccagccgccgccgggcctggaggtcggcggtgaacttgaagacgggcgcgggcagcaggtggacctcgtcgtagacgaccagaccccagtcgcgggagtcgaacagctccaggtgcgggtagacgcccttccgccgggtggtcagcacctggtaggtggcgatggtgaccggccggatctccttcctcgtcccgctgtactcgccgatctcgtcctcggtcagcgaggtccgcttcaccagctcgtgcttccactgccgggcggagacggtgttggtgacgaggatcagggtggtggccttggcctcggccatggcgccggccccgacgagcgtcttccccgccccacaaggcagtacgacgacccccgacccgccgtgccagaacccctcgacggcctgcttctggtacggccgcagcgaccagccgtcctcggccagctcgatcggatgggcctcgccgtccacgtaccccgcgaggtcctccgcgggccaccccagcttgagcagggtctgcttgacctgcccccgctcggaggggtgcacggccacggtgtccgggtcgatccgcgccccgaccagcggctgcaccttcttcgaccggaggatctcctccagcacgggccggtcggtactggtgagcacgagcccgtgcacggggtgcttggacagggtgagccgcccgtaccgcgccatcgtctcggcgatgtcgaccaggagcgcgtgcggcacggggtagcgggagtgctcgaccagggcgtcgacgacctgctcggcgtcgtgcccggcggcacgggcgttccacagcccgagcggggtgacccggtacgtgtggatgtgctcgggcgcacgctccagctccgcgaacggcgcgatggcacgacggcaggcgtccgcctggtcgtggtcgacttcgaggagcagcgtcttgtcgctctggacgatgaggggtccggtcacgcgcttcggccctttctgcggggtgcggccacggatgcggccaaacgtccagtgtgccgcatcggggggcggggtgggg

SEQ ID NO: 3571 - DNA, 6633 bp, Unknown
  Kingdom: Bacteria, Phylum: Actinobacteria, Class: Actinobacteria, Order: Streptomycetales, Family: Streptomycetaceae, Genus: Streptomyces
gcccgtgcgctgctcgcgggcttccccgtgctcgtcctggacgagccggccgaacacctcgacctgccgaccgccgacgccctcaccgccgacctgctggacgcgacccggggctgtgcgacggtactgatcacccaccggctgaccggcctcgactcggtcgacgaggtgctggtgctggacgcgggcagggtcgtgcagcgcggaccgtacgccgaactggccgcagaggacgggccgctgcgccgcatgctggagcgggaacgggagacggtcggggcgagggtccgctagcggcgacggcacggaccggccccggacgaccggcgatccttcaggcgtcgagcgcattctcgactttcgccccctatcggtactaactaggctcgggccatggcagagcccgacccgaaggactccctcgacgccgccacccgggccactcgcagcctccagggtctgtccaccgagctgaccgcgcgggtgccgcagctcctggaggcgatgcgctccgtcggcacgggactggagctgcactccaccctggaccggatctgcgagacggcggccgagctcgcccacgcccggtacgccgccatcggcgtcgtcgacgagcagggcgagggactgtcggacttcgtcacgtacggcgttccgcaggaggtggccgaggcgatcgggcgacgccccgacggccaccggggtctgctcggcgcgctgatccacgaccccgccccggtccgtctggccgacctgtccaccgatccgcggtctgcgggtttcccgccggggcacccccggatgcggaccttcctgggggtgcccattcgggtccagggggagatcttcggcaacctctacctcaccgagaagcaacacggtgcggagttcagcgactacgacctccacatggtccgggtgctcgccacggaggccgggatcgccatcggcaacgcccggctgtacgaggcggcgcggcagcgggagcactggatcgacggttcggtcgcggtcaccacggcgctgctgtcgggcggggacgcggacgaggccctgtccgtggtcgccgaacacgcccgccggctcgccgactccgccgccgggatcgtgctgctgcccgccggggagggcggcctggagatcgtcgccgtatcgtccgacgacccctcgtcctcgctcggcgtgatcatcccgccccggagcaccgtggtggcgaaactcctggcgggcgaggcggtgttcatcgacgactcggccaccgacagccggatgatcaccaggctggccgaccggttcggccccagcatgatgctgccgctccacagcggcggccgggtgctcggtgcgctggccaccccccgggcgcggggcgcgcgcccgttcacggagacggagcggacgctcgccacccagttcgcctcccaggcggcgctcgcactgatgatggccgaggcgcagcgggaccgggagcgcctcgcggtgtacgaggaccgcgaccggatcgcccgcgacctccacgacctggtcatccagcggctgttcgccaccgggatgatgctggagagcgcccagcgcaggtcggtggtgcccgaggtgcggaccggtgtcggccgggcggtcgacgagctggacgtgacgatccaggagatccgcacggccatcttcgcgctccagcaggaaccggccgaggctccctcggggctgcgcacccgtgtgctgcgggagatcaacatggcggccgttccgctcggcttcaagccctcgcaccgcttcctgggcccggtggactcgctcgtcggcgagttgaccggcaagaacctggtcgccgcgttgcgcgaggccctctccaacgcgttccggcacgcgcgggcgtcgctgatcgatgtggtcgtcgacgccacggcgaccctgccggacgggcggggagcggtgcggctctcggtcgccgacgacggggtgggtatcccggagggcggccgccgcagcggtctgcgcaacctggcccggcgggccgagtccctgggcgggtcgagccggatcgagccggggatcggggaggacggcggcggtacgacggtggtgtgggaggcgccgctgtgagggaggcccgagggcgaccctgccggacggactgggcggaccccgacgggcccgcgagcgtctgccggtctgccggtctgccggtctgccggtctgccggcgtgcgtgctggcgtgctggcgtgccgaaaggtttcagcaggtctctgcgcgggcggcgaggatccgctcgatgacgaccgccactccgtcctcctcgttggtcgcggtccggcccgaggcggcggccaccgcgtccgggtgggcgttgcccatcgcgaaggaggcgccggcccagctcagcatctcgatgtcgttgggcatgtcgccgaaggcgaccacctcggcgggcgagatgccgcgctcggcacaacaggcggcgagcgtggtggccttggagacgccgtgcccgctgacctccaggagcgcggaggggctggagcgggtgaaggcggcccggtcgccggccgccgtacgggccagggtgaggaaggcgtcgggggccagctcggtgtggtgggccagcagcttgagcacgggcgcgccgacgcccggggtctcctcgtacagcagcttctcggcgaccgccaccgtggctcccgggtccagatggaagggcgggtaggccggttcgtagttgatgccggtggtcatctcgacggcgaaggaggtgccgggggccgcctcgcgcagggtgcgtacgacgtgcagggcggctgtgcgctccagcggtcgtacggagagcagctcgccgtccgtccgcaggtcggtgaccacggcgccgttggcgcagatcgccgtaccgtggctctggacgtggtcccgcacgacgtccatccagcgggccggcctgccggtgacgaagaagacctcgatcccggcctcctcggccgccgcgagggccgcgaccgtgcgcgcggacagcgtcttgtcgtcgcgcagcagggtgccgtcgaggtcggtggcgatcagccgggtcacggcgggaagaggcgtatcggtcactgaggtcaccgggccattctcgcccacagaggtgcacgtgcgtgcggaggggcgcacatttgagtgaataacgcgctgatcagcagaaacttcctctggcatatgccagcgccatcgactggtcgccggacccgcgcacggtcgtaggctcaggggcatgagtccccgcctgagcaccgtgatccttcccgtccatcgctggcacgagggcggtcgcgaccgctggcagcacgcggaggagctgggcttccacaccgcctacacctacgaccacctgtcctggcgaaccttccgggacggcccgtggttcggggcgctgcccacgctcaccgccgcggcggcggccaccgagcgcctgcggctgggcactctcgtgacctcgccgaacttccgccacccggtcacgctggccaaggagctgatgtccctggacgacatctcgggcggccgggtcacgctcggcatcggcgccggcggcagcggattcgacgccaccgccctgggccaggaggcctggaccccgcgcgaacgagccgaccgcttcgccgagttcgtcccgctcctggaccggctgctcaccgaggacgcggtgaccgagcacgggaagcactacaccgcggaggaggcccgcaacatccccggctgcgtccagcgcccccggctgcccttcgcggtcgccgcgaccgggccgcggggactgaagctcgccgcacgccacggacaggcctgggtcaccaccggcgaccccaagctgtacgagaacggcaccccggaggagtcgctggccgcgctgcgggcgcagaacgagaagctgacggccgcctgcgcggagatcggccgggacgcctccgccctggaccggatcctgctcaccggcttcaccccggaccgtaacggcccgctggagtccgtggacgccttcgtcgacttcgcggggcgccacgcggcgctgggcttcaccgagatcgtcatccacgccccgatcccggactcggtcttcgacgtcgacccgaaggtcttcgagcgcatcgcgaccgaggcgcccgcgcagctggtgtaagtccctggtgcccccgggctgcgccctctcagccgcgcaggcgcaggaaatgcggaggtacggcgtcggcgagccagacgccgttggcgctgacccggaagacatggccggcgcggtgcatcgcgcccgcgtccacggggaggacgaggggccggccgcgacgggcgccgacccgggtggccgtctcccggtcgggggacaggtggacgtggtggcgggccatggggcgcaggccctcggcccggatcgcgtccatcacccgggcgaccgtgccgtggtagaggtgcgcgggcggttcggccggcggcaggtccaggtcgacggcgacggtgtggccctgattggcgcggatgcggtccccctcgatggtgaagcggcgcttgtcgttggaggcgacgacgtggtcgagttcggcgcgggagaaggcgaatccgtgccgggccgcggcgcacagcagctcctcgaccgccacccagccgttctcgtcgagggtgagcccgatgtgttccggctggtgccgcagatgcttcgagaggtacttggacaccttgacggtgcgacgttcgtccatgggtgccagagtgccggtggcggcctggtccgtgcatccgcatttcggctcgtcggctagtcgcctcttcgcctcatcgcttcttcgttcttcttcggttcttcggctcttttcctccatcgggtttgatccacagtcaacttgggttatccacagggtatttggcaattctgtggaaaacccgcgtgcgatttaaggagtttcgtcaactttgacctccttggtatgagttgctgcgaggtcgtccaaggtgcgtgcctgtacctcccgttcggtggccgccgccacgaaggccgccactcgatccgcaccaaccagctcctgcacggcctgggttgtccgggccgggagcagcacggggcgggtcgcgtcatcggcgatcgccgtctcctcagcgccgaggtggtgatgcagatggcgcgtcgcgaacgtccgcatggctcgggccagttcggcgtccaccgtctgctgtgcgagcggccgcagacgacgtacgagcgacgccgcctcggccgcgtcggagtcggtggggggccgatggccgagatagcgggcgaagacgtgctcggtggtgaactccaggaaacgggaggcgatgtgctccacctgaccgcgaagttccctgagatggcccgagatcgcgggcagcgggacccccgccccgtacaactcggccgccaccgccagctcctgcggactgggcacgagaaattcgtcgtcgcggccgggcacccgttccagcacgccgagctccaccgcctcggcgatggcctcgtcgtcctgccggccgccgaacctcgcgtccagctcccggcggctgatccggtcggcctcctcgtccgtccacgggccgtgcacctccgcgaccagaccgagcaccccgccgagcccccgtcccgcgtcccacgcctccagcaactccttgatgctggccagggtgtaaccccggtcgagcaggtccgcgatctgccgcagccgggccagatgggtctcccggtacacattggcccgaccgcgccgctcgggcgtcgggagcagcccccggtcctggtaggcgcggatcgtgcgcaccgtggccccgctggcgtgggccaggtcctcgatccggtactcggccgcctgctccccggccccggtcacagcgggggcttcagccgggcgacggagcgcagggccccggggctcagccgggacagcagccgcgcgccacgcgcctccggggtcaccggcaccaccgcctggttgcgcacgaccgcccgcaggatcgcgtcggcgaccttctccggcgggtagttgcgccgtccgtagagccggctcgtccgcttctgcagccgctcctcctccgccgcgtcggcccccgcgaaacgcgtggtggcggtgatgttggtgttgacgatgccgggacatatcgcgctcaccccgatcgacttctccgccagctcggcccgcaggcattcgctgagcatgagcacggccgccttcgacgtgctgtaggcgggcagcgcacgggagggctggaaggccgcggccgacgccgtgttgacgatgtggccgccctggccccggtccgccatctgcttgccgaagatccggcagccgtggatgactccccacagattgacgtcgaggaccttcttccactcctcgctcgtggtctccaggaaggagccggacagtccgatcccggcgttgttgaccaggatgtcgacgatgccgtactcggcggcgacccggtcggcgagcttctccatcgcggcctcgtcgctgacgtcgaccacctcgccccaggccgcgggcgccccgatcagccgcgccatctccgcggtccgggctgccccttccgcgtcccggtccacggccacgacccgggcgcccgcctcggcgaacgcgaacgccgtggcccgcccgatcccggcggc

SEQ ID NO: 3572 - DNA, 6548 bp, Unknown
  Kingdom: Bacteria, Phylum: Actinobacteria, Class: Actinobacteria, Order: Streptomycetales, Family: Streptomycetaceae, Genus: Streptomyces
cctccaccccgacctctcgccgcgccgcctcgccctgctcgccgaacaggcgaaggccctgcgcacccacggcttcctccccgatgccgtcgacatcgactcctgggccgaccccgcaccgctccgccgtgccgccgcgctgaacggcacgccggtactcccgccacccgccactccctgaccccgaggaccaccgccatgcatgtcacccgaccactccgtaccactgctccggccgccctgctgacggccaccgcactcctcgcgctgagcgcctgcggcacctccgcggcggacggtaccggcgccaccggccccggttccgggaagatcgtcgaggtgcgcatcccggaccccggcaactccggcgtgctcgccctcggcaagaaggacggcagcctggacaaggcgctgggcaaggtcggcgcgaaggtgaagtggaccggcagcgccgggcccttcgccccggcggcccaggcgatgaacgccgaccagctggacatcgccaccggctccatcacctccggcatcacctccctcgcacagcgccccggcttcaggttcttcaccgccgtcgacccggacgcggccggcgagggcatcctcgtccgcgacggatccggcatcgactccgtcaccgacctcgtcgggaagaaggtcgccgtcaaccagggcggcaccggtgagtacctgctgctcaaggcgctggccaaggcgaagatcccggcggagaaggtggagcgggtctacctcaggcccgaccagaccgccgccgtcctcaacgccggacaggtcgacgcctgggccgtctgggccacctacgcggtcgcggagatcggtggcggcaaggcgcacttcgtcgccgacggcggggccatcggctccgacaactacagcctcaacgccgtgcgtacgggcttcgccgagcagcatcccgaggtcgtccgggcgctctacgactacctccacgaagccagcgcccaggagaagaaggacccggccgcctacctcaacgtcttcacggacgtcggcccgaccgcagtcaccggcaaggcgaaggaggtccagaccgagatcaccgcacagggcggcaccgtcgacccgatcggccccgaggacatcgcccgcttcgaggcggtcgccgccttctacgccgagcagaaggtcaccagggcgaaggtcgacgtggcggcccacctcctcgacgtggagaagctgacatgagcgtgatcccggcggcgggcccggacagccctccccgcacggacacctccggcaccggcgacgctccgccccccggactcgtcgccccgcgcccgcagctgcgcagaccccggagccgtccctacgccgtcaccgtccgggcgctcggcccggtggtcctgctctccctgtggtgggcggcctccgcgacgggactcctgaccgccgacgtcctggcctcaccggccgaggtgttccgcgcggtgggagagctctggggcaacgggcaactgcccgacgccctcaccacctcgctgacccggtccggcctcggcctgatcatcggcctcgccgccggactcacgctcggcgtcgtcaccggattcacccggctcggcgacgaactcctcgactcctccctccagaccctgcgcaccatccccttcctctccctcgtcccgctgttcatggtctggttcggcatcaacgagaccgcgaaggtcctcctcatcgccgtcgccaccaccttccccatgtacgtctccacctccagcggcgtccgcaccaccgacccgaagctgatcgaggcgatgcgcgccttcggaatgagccggctcggcatcgtccgcgaagtggtcctgcccggtgcgctgccctcgctcctcgccggactgcggctctccatgacgctcagcgtcatcgccctcatcgccgccgaggagatcaacgccaccgcgggcatcggctatctgatgtcccaggcccagagctacgcccgcaccgacatcctcgccgtctgcatcctcgtgtacggactcctcggcctcaccgccgacatcctcgtccgcctcctggaacgcgtcctgatgccgtggcgcaccccgcaaggagcccgccgatgaccggggacaggaaacaggccacagccgtacgggtacggggcctccgccgggtattcggcagccgtgccgtgctcgacggtctcgaactcgacatcgcccggggagagttcgtcgccctccttggtgccagtggcagcggcaagacgacgctgctgcgcatcctcggggcgctggacggtgccgacgggggagaggtgctggtgccggagagccgcacggtcgtcttccaggaaccccgcctcgtgccgtccaagaaggtcctcgccaacgtgaccgtagccctgcccgggtcccggacgccggacggactgagggcgctcgccgaagtgggcctggaaaggcacgccgaggcctggcccgccacgctctccggcggcgaggcccagcgggtcgcgctcgcacgcgccctggtgcgggagcccgaactgctgctgctggacgagccgttcgcctccctggacgcgctgacccggctgaagatgcacgacctggtcgacgaactgtgccgcaagcaccgcccagccgtgctcctggtcacccatgacgtcgaggaggccgtacggctcgccgaccgggtggccgtcctgcgggacggtcggctcgtcaccgacgagcgcgtcgccgtcgaccgcccccgcgaccccggagacccggccttcgccgcactgcgccgccgcctcctggacgatctcggcgtccccgccgctccgggagccgccaccgggtccaccacaggccctgccaccacgcccgccccgctctccgtcggagtgatctgaatgaccatcaccatcggtgtccacgccagcaatccgtccctctaccacctctaccacctgacccggcacggcttcgcccagcaggagctggagcccctcggcgagagcgtcgccttccacccgtacagcaacggcgtccgcaccggcgagctgctcagccggggcgtcatcgacttcggcggcaccggctccaccccgcccgtcaccgcccaggctgcgggccacgacctcgtctacaccgcggtctccgccccgcgtcccgagcacggcgccctgctggtccgcgaggacagccccctgcggacggccgccgacctcaagggcgagaccgtccacctggcgatcggctcctggcagacgcacctgatcgccaaggcgctcgacgacgcgggactctcctatgccgacgacatcaccgccgaacgctccaccgaggacagcgaacagctcctgcgcaccggagccgtcgccgcctgggtcgcgcagggaccgcagctcgccgcagcccgccgcaccggcgggctgcgcaccctgatccgcaccggcgacgtcatcaccgaccgctcggtgttcttcacccggcgcgcactcgccgagcagcggcccgagatcatcgacgccctcacccgcgcgctccggcgggccgacgactgggccgccgctcatccccgcgacgccgcgcggatcgcctccgccgacctcggcggcacggtcgaggactgggagagcgcgctgaccgcactgccgtggcggatcgaggaggtcggcgacgccttcctcgccgaacagcaggaggccgccgacatcttccaccgcaccggcttcatcgagcgcccggtcaccgtggcgcacgccgtcgcccacgcacccgcgaaggcgatctgagggcatggccaccgaagtcctctggtacatcatcccgcgcgaaggcgcctacccctgggagccgtccggccggcgccccgtcgacctcggctatctcagcagactcgccggaaccgtcgaacagctcggctacagcggcgcgttgctcgccaccgacctctacgacgtatggccgctcggcagtgcgctggccgcgtccaccagcacccggttcaagccgctgctcgccgtccatccgggactgatctcgccgaccctgctcgccaagatggccctcagcttcgacaccctcttcggagggcgactgcgcttcaacgtcgtcaacggatccaccacgtccctccaggagtacgggctccacgtggaacacgacgagcggtacgagctgagcgccgagtactggtcgatcgtgaagcggctcaccgccggcgaggtgttcgaccaccggggccgcttctacgacctgagggacgcgggcgcgtccttccgcgagctgaagcccgtccaggacccgcacatccccctctggttcggcggctcctccgaccccggcatcgagatggccgccgaacacgtcgacgtcttcctcacctggggcgagccaccgcacctgctcaaggagaagctggagcgggtacgggcgcgggccgccgcccacggacgcaccctgcgcatcgggctgcggctgcacctcatcgtccgcgacaccgaggacgcggcctgggcggcggccgaccggctgctggacgtcaccagcgaggccacgtacgcccggcagctcggagaccgggcgggggaggacggcgtcggctggcaacggcagttccgtcagcacggcggcagggtccccgcccgtgcgcgggagctggaggtccaccccaacatgtggccgggcatgagcctcttccggcccggtcccggtacggcggtcgtcggctccacggcccaggtcgtcgaaaggctccgggaattccaggacttgggcgtcgacaccttcatcctgtccggtaaccccctgctggaggaggcctaccgcgtcgccgagaccgtgctcccgtccctcggcgtacggcgctgagcgaccaccgtccgacggccgggacgacgcgccggtccaacgcttcgccccggcctcccggcgctgtctactctgagccgcatgaccgcagcgatcaccgccggacccggctcccaccgggccggagccgggccgcacggctccggcggtgtatcgcaccacggtcggacccgcgcggactgcggtcatcggcacccggtgcaagactcggaacgagaggaatcacccggcagcacaggacgagcaggatcacccggaccgactgaggagcacgccatgatcagccccaccttcctcgacggagcgcccgactgggtcgatctcggcacccccgatctcgatgcggccaccgccttctaccgggagctgttcgggtgggacctggtccccggcggccccgaggtcggcggctacgggatgctcaccctggacggccggtacgtcggcggtgtgatgacggtgtcggaggaggaatcgccgagcgcctggtcggtctccttccagtcgcccgacatcgccgccaccgccgcggcggtggagcgggcgggcggcagcgccgcgttcgagccgatggacgtcctggacctgggcagcatgggcggcttcacggacccggccggagcgtatttcgccgcctggcagcccaagaagcaccccggcttcggcgtcgtccaggagtccggctcgttcctctgggccgagctgtacacctccgacgtcccggcggcggccgcgttcttcaacaacgtcttcggctgggggaccgatcagttgaaggtggagggcaccgactacacctacaccaccgtccacccggccggcgccggtccggaggcgtcgttcggcggcctggtccggatgggcgacgtcccctccgaggccgcccgcggcccccactggctgccgtatttcgccgtggccgacgtcgacgccacggtggcgacggcgaagcggctcggcggcacggagaccctggcggccatggacgtgcccggcgtcggcaagatggccaacgtcgccgatccgttcggggcggtcttcgcggtcatgaggcccgagcccaggcagtagccacgagcggagaccgcggttccggcggctttggcgagcactcctgggccactcaggagcgggattgatgaatcgttgatcagttgtttatcggcaccgggcaccgtgtgcaccatgctgatcaacaccgtgaccgacgacgcgctcgcctggcaggagtccgcgttgtgcgcgcaggccgggcccgagttcttcttcccggccccgggcagttcgacccgcgaggccaagcagttgtgcaacgcctgcgaaggccgtctggcctgcctggagtacgcactcgccaacgacgagcggttcggcgtctggggcgggctctcggagaaggagcgcgagcggctgcgcagagaaggacgcgaccggggctgaacgccgcgaaaggtcctcgccgcactcacgcaccgtaaacccctggggtgttcgggtccggcccggcacaatcgggccatgaccgacgcaccgcccctcgtcctcgccgcagccctgctcgacgcgctcgaaccgctgtcccatggggggcgcatgagcgaactggcggtcagagcgggccggctggccgaccaggggtcgctgcgcgccgtcctcgacgaactggaggacggcgcgcagcgacccctggtcggccagccg

SEQ ID NO: 3573 - DNA, 1400 bp, Unknown
  Kingdom: Bacteria, Phylum: Actinobacteria, Class: Actinobacteria, Order: Streptomycetales, Family: Streptomycetaceae, Genus: Streptomyces
gggcgtccagcgcgcgcagccgctccaccagctccggggtgacggcgtcggcggacaggaaggggctggcgcccgccgcccgggacccggccggaataccgtcgaggtagcggtcggtgaggatgccctgctccagcggcgagtaggcgatggacccggcgcccagctcgtcgaggacgtccggcagtccgtcgtcctcgatccggcggtcgagcatcgagtagcggggctggtggatgaggagcggagtaccgagatcctggaggatcgcggcggcctcgcgggtctgcgcggcggagtagttggagagaccgacgtacaacgccttgccctgccgtacggcggagtcgagcgcgcccatcgtctcttcgaggggggtctccgggtccggccggtgggagtagaagatgtcgacgtactcgataccgaggcgcttcaggctctggtcgagggaggagcgcaggtacttgcgcgagccccactccccgtacggcccttcccacatgtggtagccggccttggtggagatgacgatctcgtcgcgcaggtgggcgaagtcggtcgccagggcgcggcccagggtgagttcggcggatccgggcggcgggccgtagttgttggccagatcgaagtgggtgatgccgaggtcgaaggcgcggcgcaggatggcgccctgcgcctcgggggtccggtctcccccgaagttgtgccagaggccgagggagagcgcgggcagcagcagaccgctgcggccggtgcgccggtagggcatggcggagtagcggtcggcggacggcaggtacatacgggactccgcgggaggggtacggggtggcgcgccgggaccggcgcgcatccggtccaggcttccgcagatggatccagcagtccaacaggagattccgctcggattcatcgcctagattgctcaatcatggaattgcgtcagctggagcacttcgtcgccgtcgccgaggagcagcacttcacccgcgccgccgagcgcctcgccgtgtcgcagtccgggctctccgcctccgtacgggcgctggagcaggagctgcggaccccgttgttcagccggaccacgcgcacggtccggctcaccgaggccgggcgggcgctgctggtggaggcggagcgcacgctggcggacgcgcgggcggcgcgggacgcggtcgacgccgtacgggggctgctgcgcgggacgctgacggtgggggtcgagcagtgcgtggcgggggtgagcccggcgcggctgctggcggcgttccaccgggagcatccgcagatggagctgaggctgcggcaggagggcaccagcagcctgctggacggggtggcgggagggcgtctcgacctggcgttcgccgcgcacagcagcaccatcggctcccggg

SEQ ID NO: 3574 - DNA, 4962 bp, Unknown
  Kingdom: Bacteria, Phylum: Actinobacteria, Class: Actinobacteria, Order: Streptomycetales, Family: Streptomycetaceae, Genus: Streptomyces
gactatgtccgcccatgttgaggttttctcaacacatggttacggtggctgaccatgcagcaggacgaggtggccgcacgggtccggcaggtgatcgacgccacgggtgtcagcgcgcgcgagttcgcgcggcggatcgtcatcgatccgtcgaagctgtcacgctccctgaactgcacacggcgcttcaccgccgccgatgtccgcgatccgggccagctcggcggcggtgaagcgccgtgtgccgttcagggagcgtgacagcttcgacggatcgatgacgatccgccgcgcgaactcgcgcgcgctgacacccgtggcgtcgatcacctgccggacccgtgcggccacctcgtcctgctgcatggtcagccaccgtaaccatgtgttgagaaaacctcaacatgggcggacatagtccttgaactggaaaggcgttgtggttctgactgatgcatcagtcagaaccacaacgccttctcacccgctgcccgcccgcccggcggggtggctcgggatgctcactcctggacgagcatcccgctccgcagtttgcccagcatccggctcagcagccgggacacatgcatctgcgatatcccgagctccgcgccgatctgcgcctgggtcatctcctggccgaagcgcatgtcgatgatccggcgctcccgctcgtccagttcgcccagcaggggtgcgagggcatggagattctccacggtctccatggcggggtccggctcgcccagcacatcggcgaaggtccgcccggcggcctggcggggtccggtctccgcggtgtcggtcggcatgtccagggaacccgcggtgtagccgttggaggcgacgatcccctccgtgacctcggactcctcgattcccaggctctctgccagctcctgcaccgtggggtcccggtcgaggtcgcccgccagggactccttcgccttggcgaggtcgacccgcagctcctggaggcgccgcggcacgtgcaccgcccagctcgtgtcacggaagaaccgcttgatctccccgacgatgtacggcaccgcgaacgaggtgaactcgacctcccgcgagaggtcgaagcggtcgatcgccttgatcagcccgatggtgccgacctggacgatgtcctccatgtcgccactgccccggttgcggaagcggttggcggcgaagcggacgagggacaggttcatctcgataagggtgttgcgcgcgtactggtactcgggcgtgccctcctccaagacctggaggcggtcgaagaagaggcgcgagagccgacgcgcgtccatcggggcgatcttcccggcatcctcgatccacggaagttcctcggtggtgcccgcctgctccgtaccggccgtctgtgcggtctgtgcggtctgcgcggtcatgtcgcttcacgctccctggttcgtaggccctgaggtctgttcgccttcccaggggtacggctctcatgcgtagcggagggagttgatccggtcatccggatcgagttggccggaaacagaccctgttcggctctgaggcgccgtcaccgcgaggcgagcggcgcgaggcgaacggcgcgagcaatgaatgcgcaaacaaccgccccaccggtacgggggagcccggtggggcggtcgccaccagagtgccacagccgggcggtcgttgggaccggaccggcgcgtattggcctacggatgagtcgatttcgccgctcgggggctcgggcgtacgccggggcatcggggtgccgcagagagacgggttcccgtggtgcggggtcgcgcccgatggtgcggggccggtgtcccatcggcggaggcctggcggccgacgtcccggtggtgcggggcaggacggcccacacttcgatgattgcggcgccgtgaacagattcgtcacgcggaataccggccgtacccaccggcttttcctgcctggcgggtgcgccgctcgaacccccgagcacccgccgccgagaaccgcgtgacggatggaacgagaacgaggaagaccatgacccagaaccacccccggccccggaccgatgccccttccccgctccacccgctggacaatcccgcccggtcctcgctcaccggtccgcacgcccgcttcgccgagaggcgcggccggatcctgcgctatcccgccgacgtcactccctggctcgcgctccccgacaccccgaaggcccaggactgggccgatgtcgcggcgctcgccggaccgggcggctccgtcaccctggccgcgttccaggtgccgccgccgcaggactgggagatcgtcttccgggccgagggcgtccaactggtcgacgcgtcggtggacgccgcgcccgatccggaggcggtcccgctgggcccccgggacgtgccggagatgctggacctggtggcgcgcacccgtcccggccccttcctgccgcgcacggtcgagctgggcacgtacctgggcatccgcaggggtggcgcactggtggcgatggcgggggagcggctgcacccgcccggctggaccgagatcagcggcgtctgcacggacgagtccgtacgggggcagggcctggcgagccgactggtcctggcggtcgcgcacggtatccgggagcgcggcgagacgccgttcctgcatgcctccgcctccaacaccggggccgtccggctctacgagtccctcggcttccggcttcgccggcgtacggaattcctctccgccctcgtccccgccacgctcccgtcggccgacgggagccgcaggccctcgctgcgctgacccggcgcgccgcaccgatccgcccccgacggcccgttaccggcggtccggccggtacgggtaccggacaccggtacccgtacggcgggaccgggacctgaggcacccccgctacgggaccacggtcccgggccggaagccccgggcgggaccttcggcagccgctcggggccctaagccctcctgcgcggacgcccgccacccggtccactggaagggaccggtcgaaactgcgggcggcgccgagagatcagcgggaggacaggccgtgcccatgaggttgctggacatggcacagaagtggaacggggtagggcaccggggtggtggcgcgcccggtgcggacgcgggcgtcgcgacggtgtcccagggccggatcggcaactgggcactggtcggcggtctcgcgctgctgaccgtactcgtcgtgttcctcgacgtcagcacgggcaacgacctgcgggtcgtgccgctgctcgtggtcgtccccgcactggcctccgtctactgcagcctccgtcagaccatctggatcgcggtgtggatcaccacggtcgtcgtcgggttccgggtgggcgccgacggcaccttctgggacttcgtcttcggcatcggattcgccgttctggcctgtgccctcggggtcgccgcctgcgcggcgcgcatccggcacgccaccgagatggcgcggctgcggtccgccgccgtcaccctgcagcgccagatcctgcggccgcttccggtcgtgaccgagcatctcttcgcgcacgggctctacgagccgatcgaggaggaccgcttcgtcggcggagacatctacgaggtcgtcgaatcgccctacgggacccgggtgatcatcggggacgtccagggcaaggggctcgcggccatcggcgccggattcgcggccatcgccgcgttccgcgaggcggccatccgcgaacccacgctcacgggtgtggtggacgcgctggaggacgccgtcgtccggcacaacgtgttctccgcccagaccggtgaggccgaacgcttcgtgaccgcgctcgtgctcgggttcgacggaggcggccgggtgcaggccgtgaactgcgggcacctgccgccgcgcctgctgcacgacggccggtcctcggccgtcacgctccaccggacgtacgtccccctcggcctcgccggactcagccgggagacccgtacgaccgagcccttcgacctcccgccgggcgcgacgctcctcgtcgtcaccgacggggtgaccgaggcccgcgacgccgccggcgcgttctatccgctggacgagcggatcggggcctgggccgggcacgggccgcgcgaactgctcgacgcgctccacgtcgatctggaggacttctccggaggcgtccggcgcgacgacatcgccgcgctcgccctgctgcgcacccccgccgacggcgggcggcggcccccggtttccggcgacgccgctccccgcgttgccgctcccggcgctgtgcttcccggcgttcgcgctcccggcgatgacgccggcgcgggggagagcgagcggcggaccgcggcggtctgagcgcgcgccgcgcacctgcggtcggcatccccgatgtccccacgcgacgaatgtcgcgtagggacattttcgggtgtacggtacacatatgactccggaacggaagatcccggaacggcgcagccgcaagacgcgccgtacccgcgacaccctggcgcaggccgcgttcgagctggtgctcgaccgggggctgcggaacgtgacggtcgaggagatcgcggaagccgcggacgtcgaccgccgtacgttcagccggtacttcacgagcaaggaggccgccgccctcgactccctgcggggcgacggcgaccgcatcaacgcggccctgcgcgcccgcccggccccggaacccccgctcctcgcctaccggcgggccgtcctggactggctcgccgatcccggggcggagccctggcaccgccgcccccggatcttcgacctgctggtcgtcgccgaggaggagccgacgctctacgccgtcttccaccacatccgtgtggacgcccagcaggactcggtcgccatcgtcgcggaccggctcggggtcgacccgcggcaggacatccggcccgccgtgaccgtcgccgcgggagcgggcgcgctgctcgccgccc

SEQ ID NO: 3575 - DNA, 1735 bp, Unknown
  Kingdom: Bacteria, Phylum: Actinobacteria, Class: Actinobacteria, Order: Streptomycetales, Family: Streptomycetaceae, Genus: Streptomyces
aattcgccgtcggcgacggccgtgtccgcggcggcccgcgggagcgcctgcgtacggtcgccgacgtgcggcagcatccgcgtacggtcggcgtcggctccgaagcccgtgcccggcgggacgcggagcatccgggtccgcgcgtcgccgaggtccagcaactgcgtccggtcggtgtcgaccggcttcagcagctgcgtgctctcggtgtccgggaccacctccgggaccgcgcccgggtcgaccgtgggcagcaccgtggtggcgtcctcggccggttccgggtcgggccgccgggcggcgcctctgtgcccggcgggcgtcgtctccttggtgcgcaccgtcacctggcggccctccgggtgggtcacctggaccgtcacctcgcggatctgctcgccggtgcggcggaagaagtgctggaagaccgagccgccgcaggtggcgacgacgctcatcacccccgctccggcgatcgtgccgtacacgcccaactgcgaggccagcacggccgccgcgacggctgccacggcactcccggcgacctgcgggaggctcagatctatgcgcctttccttcagttctgtgtcactttccggcttctgaaccattaccagcccctgcttgacatctctcccaccatgcaacaggaagggacaaatgagcgaagtggatagttccgtttccggcgattgtgtgaaggacaacacgcatcaggggcatttcacggagaaccgggtatctcaactcccgcgcctctcgagaacttcggcggcgcgccggtccaccccggtggcccgaatggagtactgtgacgagccctgggggcggactccgacgtgggaatccgcagccaccggagggggccgacggcggcgctcgacccggcggtgtcaaggcatcacacgagtgcctgctgcacagagcggccaaatcggtcactttgtgtcgcaatgggtaaccgtgtcatggtgacgcaccaggacgggagcccgacacgccgggcaacttggcaaggttgtggcaggctgcacccgggcaggtcacactcgactagcggaagcagcgacgcacgtgacgtcggcaggcaccacccgggaggtccccatgcccgaactgcgtgtcgtggccgtctccaacgacggcacacgactggtgctcaaggctgcggacagcacggagtacacgcttccgatcgatgagcggctgcgcgccgccgtgcgcaacgaccgcgcccggctcggccagatcgagatcgaggtggagagccacctccgtccccgcgacatccaggcccgcatacgggccggtgcctccgctgaggaggtcgcccagttcgcgggcatccccgtcgaccgtgtacgccgcttcgagggccccgtgctcgcggagcgcgccttcatggccgagcgggcccggaagactcctgtgcgccgtcccggcgagaacaccggccctcaactcggcgaagcggtgcaggagcgtctcctgctgcgcggcgccgacaaggaaaccgtccaatgggactcgtggcgccgtgacgacggcacctgggaagtcctgctcgtctaccgggtcgcgggtgagccgcactcggcgagctggacgtacgacccgcccaggcggctggtccaggccgtggacgacgaggcgcgctcgctgatcggcgagaccgacgacgtcgccgcacccgagcccagcttcccgttcgtgccccggatcgcccggctgccgc

SEQ ID NO: 3576 - DNA, 3383 bp, Unknown
  Kingdom: Bacteria, Phylum: Actinobacteria, Class: Actinobacteria, Order: Streptomycetales, Family: Streptomycetaceae, Genus: Streptomyces
ctcactccggtcgccgccgcactctccgccgcggcggcgaccggagtgaggagcatcgagggcgtcgaggccacggcggtggcggcggcgagtgcaccgagcacgcggcgccggctccagaaaactgtctgcataagagagtcgtcctcgtgtgagctgttgacaggtcatgccgattcgcaccggcagcggtattccgacgtgcccgcgggatgaaatgcccctggatacgaagtagcgcgcaggcagcgcttgttgccgtgccggaccatatcaactgttcatacggagggtgccgattaatgaatcgacttcgtcaactcacgtcgatttcagcccacttgctctcctatcaatcagcattcacactcccctcacaatctcctgtgcaacctttacaagatgtggcggaaatcacgaatgacgcgcgtggattggcgcgctttgcgtgattttcctgcactcgacctgcggcgcgcttcatgctgatatggcgaatcggatgacggtcgccggggcaggagtcctctcactccgaaaggcacgaggctcatttcccaagggagttgggacatgcggcgggccgccgcggaaatcgctccgccgtatgcccgaatgtgagcccggtgatgaacatccggtcgtcagcgacgaacttggggaggcggatgcgatgaaggaatacatcagaatggccgtgaagccgcagcacaagcggctcgcgcggcgcgcaccgggtagggccgtggtcgacatgaccgtcggcgccgaggagaagtcgttcgacatcaacaaggacgcctggaccccggcgggtgagaccgcggacccggagggccgcgatcacctgctcgtcgaggtcgggtcctccaagtagccactcgacgaactcggtgggttcgccggcggcgggggtgccgcactggtcgccatgtccgtgaccgcccaccgccggcccgaacaccgctgctgccgacgtcctcgacggatcagccgtccgccgccacctccgacgtatgcctcaggtggtgtcccgtcggcccaggtgcaccgtgcgggcggtgagcaggtggacgtcggggcggtggtgaagaccttcgcggtcctcggggtccagcagccggtccagtaccgcgctgtcctcggccgtcagcagctcgccgagcacctcccgttcgcgggtgatgctcgcgacgacatggtcgcgggcgggacgggagagcggggcgggcaggtcgaggaggaagctccgggtgccctgcgggaccaggccgaccgcggtgaagagcgcactccagtcctcggtctcccgcttcgcgcccgggagttcggaccgcatgtgctcgaagcgcgtggcggcggccgcgcccatacgggcctccaggccgggctgtccgatgccgatgtcgcggggcagtcgccgggtgggcaggccgccctcgacgagcgcgaccgtgccgccgggccgtaggagcccggcgaagccggccagagcggcgcgctggtcgcccaggtggtgcagggagttgcccgcccagatcagatcggcctcgcccaagcttccgaagtcttcgggcagttcggcctccagggtctggaagcggtcgatcactccgaggcgtcgcgcgcggttcttcgcgcgttccaggagagcgggcgtggcgtccaccgccaccacctcggcctccgggaagacctcggccagcaggcaggagacgacgccggggccgctgccgacgtccaggacccggcggaccctcggcgcggtgggcagggcggcgatccagcgggccgcctcctcgtactgtgcggcgttgagttcggcctcctgctccagcagggggcccaggacgtcccagtcgatgtccgccgccggatcgccgcccgctccgtgcacatgggcatgcgcacgggcgtgtacgggcgtggcgggggcgggcgcgtcgtggtggccgtgaccggcgtggctgctcatgggaccagcctctccgaaggaggatcgctcggcaatctttgttgccgatccggcaaatcgaggtggtcccccgacgggctgccgcggtattcctgcgggctgacgcccctgaccctcttgaacgcggcgctgaaggcgaagggggtgctgtagccgaccttccgggccaccgcctccaccgtggcgtcgctctcgcgcagcaggtcggccgcgacgtcgagccgccagccggtcaggtacgccatcggcggctccccgaccagctcggtgaaccgcttcgccagggtcgtccgggagacccccgcccggaccgccagctccgccgtcgtccaggggtgcgccggatccccgtgcatcgcccgcagggccggccccgccacctggtcgccgagcgctccgtaccaccccggagggtccgcctcgggccggtcgaaccagtcgcgcagcgtgcacaccagcaaccagtccagcagccggtcgagcacgatctgttcgcccggccgcccgccgctgatctgtccctccaagtagtcgcgcagcggtgcgcagtcctgctcgtcgggcaccacgagggcgggcgggagcgcccgcaggagccgctggggcacctgcgcctgtacgtcataggtggcggccaacagcacggtgggaaacccggacccggacccggcttccggtgcgggggcggtgtccggggccgcgcccctgcccacctcgcgcacaccgccggccgagcccgtccccgtagcgttcgccgggtcgtcggtgaagacgaacggggccgggccgcgcacgatcgccgcctcgccgaccttcacccgcagcggctcgccgtcctccggcacgatccaccccccgcctcgcagcggcagacacagggtcagatacgccccgtcggtgaaccgcaccgaccacggcgcgcgcagcaccgaacggtcgaacaccgcaccactgccccgcacgccccgcaacagctcgtcgaacacgtccatgacgcaactgtaggcagagtcgcgcccgctccggacgatcgcctctgcgcggcggacggacacccatgggccgggcggggaccgccgcgacggactggtcccatgacgacgaagagcacgcaccgcgttccgtccgggacccttgccctcggagcccggcaaggccggccgccgggtcgtggcccggctgcgcgcgaccggaaccaccacggtcctccccgcctcccgctccggcgaggtccccttcgactggaccctccccgacaccggggagcccgccctcgccggggtcgacaccctctacctggtcgcccccgaggacccgtcccccgtaaaggagttcgtgacccgcgccgaggcctccggggtccgccgcttcgccacgcgggccggacagttcgtaggtgcggcccgcg

SEQ ID NO: 3577 - DNA, 3112 bp, Unknown
  Kingdom: Bacteria, Phylum: Actinobacteria, Class: Actinobacteria, Order: Streptomycetales, Family: Streptomycetaceae, Genus: Streptomyces
cgaactccggcgcgaggcgggcctgaccggcagcgagctcgcgcgtcgctgcggctggcacccgtcgaagtcctcccgcatcgagaacgcccgtaccgcgccgacggccgaggacgtcacggcgtggtgcggtgcgtgcggagcacgggacagagcgggcgacctgatcgcttcgctccgagccgcggaaggcatgtggaccgaatggcggcgcatggagcgctcaggtctccgtcaagcgcagctgaaccgctaccccctgtacgagcgcacgcaacgcttccgctcctactcctcctggctcgtaccgggcctcctccaaacgcgctcctacaccacggcggtcctcgaagccgtccagaagaggcgcggtctcgtggacgacgtcgccgaggccgtggacgcacgcatggatcgtcggcgcgtactgcaccagggcaaccgccacttcgccttcctggtggaggaatccgtgctgcgggcgggtgtgggcggaacgcaggtcatgaccgaccaattggcggcactgatcgccgctggttcactgcccaacgtgagcatcggcatcgtcccgtccactccggaccgggagcgctggccggtggaaggcttctggatctacgacgccgcacaggtcaacgtcgaactggtttcgggctacctgaccgttacggctccgagcgaggtggcttcctacgctgcggccttctccgaactggcggaatgtgccgtgcacggcacgggtgcccgcagattgatcacggccgcgctcaacgcgctcgaccaccccgactatcgctgagacaggttcgcactgccctgctggaaccaagcctcccggagtgaaccctctgtcactgtccggtagtccggtgctcggcggtgcgacccgagacaggaggtcaggcttccgcatcgccccactcctcgacggccacctcatcgcccacggacagctttcccggccgcaccacggagaacttcgcgccgaacaccaccccgccgcccgccggtagtccgcagcggctccgggccccgggtcccggcctgctggtcgaccagggtgaccgcgcagcgcacggcgagcctggcgtaacccaggtcggccgcgccgatggtcatgcggcggatccggtcctcggcgtgggcgccgccgcccagtcgcaacccttgacggggtaggtgaacagatcgacgacggtcgccatccggccgctccttcgtgaggtccccggccccggaacttccgccgtcgggccgtacggccagggtgccaggccgggcggatcctgctcgacggctttacgccataccgcgacgcgccacccgcgacgcgccaccgacgggagtgtgcgcgttccgcgccgcctcgaaggtgccaggagctgatcgagccgcggcttgtcaggctgctgcgggggtggggcggaaagtgcggcggtatgcctggggtgtgaccccgatggcggcatgaaggtgctggcgcagggagacaccggtgccgagtccggcgcggtcggcgaccaggtcgacgggccagtcagtggtctccagcaggtgtcgggccaggtcgacgcgctggcggacgagccactggccggggctggtgccgacctcgtcgcggaagcggcgggtgaaggtacgcacgctgacgttggcgtgggcggccatgtcggccagggtgacgggttcagcgaggtgttccatgatccatgcctgtgtggaggcggtgcccggggcggcggggtcggggacgggtcgctggatgtactgggcctggccgccgtcgcgccaggggggtacgacgcaggagcgggcgacctcgttggcgatctcgctgccgtggtcgcggcgaacgatgtgcaggcacaggtcgatgccggcggcgaccccggcagaggtgaggatctcgccgtcgtcgatgaagaggacgtcggggttgatgcgcgcggtggtgaacatgcgctgcaggcggtcggcttcgcgccagtgggtggtggcgggccggccgtcgagcagtcccgcggcggccagcacgtaggttccggtgcagatcgccacgatccgggttccggggcggatggccgccatggcctcgcgcagcgtgtccggcagacggccctcctcgcggatggcgcccagcgcgtgggagggcggaatgacgacggtgtcgacggcggccagcagggaggcgtcgtgggagacggtgagctggtagtcggcctcggtgcggacgggactgccgtccaggctgcacgtggtcacggagtagagccggtcgcccgtgccgtcgcgagcggcgccgaaaatccgcgcggggatgccgagctcgaagggaacgacgccttccagggccagaacgccaacgtggtgcatgacccgattctttcattccatggccatcgggccactactggggacctttccgcccaggcactctgaggacgtgcccaggagaaacggcacgaacgacacgaagcgcactgctgaaaagagcacgtcatcatggaccaggccaccagcccctcgaccatgcgcgccgtctcccagaacgccgccggacccccgggggtcctcaaggtcgtcgaggtgcggcggcccgtcccgggcctgggcgagatcctggtccgggtgcacgcggcaggcgtgaaccctaccgactggaagacccgcgagcgcggcgtgttcgccaccggggccaggccgccgttcatcctgggctacgacgtcgccggggtggtcgaggctgtcggcggcggggtgaccctcttcgaggccggcgacgcggtgttcgggatgccgcgcttcccgcacccggcgggtgcctacgccgagtacgtcgccgccccggcccggcacttcgccccgcgcccccagggcctggaccacatcgaggccggcgccctgccgctggcctcgctgaccgcctggcaggccctggtggacaccgcgaacgtccggcccagcgagcgcagcaacccgtgcttggcggcgctggcggtgccgatgacgtgggcgccgcgggccttggcgatctgcacggccaggtggccgacgcctccggcggcggcgtggatcaggacgcgctcgccgggccggacgttcgcggtgt

SEQ ID NO: 3578 - DNA, 4671 bp, Unknown
  Kingdom: Bacteria, Phylum: Actinobacteria, Class: Actinobacteria, Order: Streptomycetales, Family: Streptomycetaceae, Genus: Streptomyces
acccgcagggcggcgccgttgccgaggctgccgccgtcgaagagctcgggggccagcgtgcgccagtcggccggggactccagcagccggggcagcaggaggtgcatgccgtggccgtagccgcgggcctggtcggcgtcgaaggccagggcgtaacagagcgccaggtggtcctggtcgacgtggccgtgctcgtcgagggagcggtgcagcgcgagcgccagggccgtgtcgtcggtccagtgccagcggggctccggcggggtgcggcggtcccggatctcgttcacggcctgccgtggctcgcggaagagcgggaaccagcgctccccgaacgcgtcgccgagcgcgagggcttcgaggctgcggcgggcggcggcgcgtccggcggcggtggctgctggcgggttcgtcgtcatgcccgcatcgtgaccgccgggacccggtggcgtacatccattatcggacccggggcccgtacggtgagctgtccgctgctgccggtccggtcccggagcgacccgcaccgccccgcctcaggcggcggccgcgccctccccgatcgcctccgcgacctccgccacccgggcctcctcctcggcggcgaagcgttcgcggtccagttcctcggctatctcctcgtcctgagacatcagcaggtcgaggttggagtcgccgagttcgaggacccccatgtcgacgtacgccttctggagccgcgggccccacaggccgatgtccttgacgcacgggacgatccggctgaacaggagcttgcggaagagctggagaaactcggagtgctccgaaaggtccttcgcctcctgcttgccgatgccgaagttctccaggacctcgacgccgctgagccggtcgcgcatcaggtagcagccctcgatgacgaactcctcgcgctcgcggagttcggcgtcgctcagctgcttgtagtagtcacgcagcgccatccgcccgaaggcgacgtgccgggcctcgtcctgcatgacgtacgccaggatctgcttgggcagcgccttggtcgtggtgtcgcggatcatcccgaaggcggccagcgccaggccttctatgaggacctgcatcccgaggtagggcatgtcccagcgggagtcgcgcagggtgtcgcccagcagcccctggaggttgtcgttgaccgggtagagcatgccgatcttctcgtgcaggaagcggccgtagatctcggcgtgccgggcctcgtccatggtctgcgtggcggagtagaacttggcgtccaggtcggggacggactccacgatgcgcgccgcgcacaccatcgcgccctgctcgccgtgcaggaactggctgaactgccaggaggtgtagtgcttgcgcagctcgccccggtccttttccgtcatcttcgcccagtgcggggtgccgtacagggtgagcgcctcgtcgggggtgccgagcgggtcggcggggtcgacctccagcgaccagtcgatgcgcttgttgccgtcccactgcttgtccttgcccttctggtagagggcgaggaggcgttcgcggccgtcgtcgtagtcccagctgaaccgggcggctccggtggcggggacctgccagatcggttcggcgggcggggtggtgtagaggtcatgtgtggacacggacggctccttcgcctcgcatggctcgacctgatcgacaagttccgtgacgccgaaggcagttgagcgcgctcgtcggccgcctccctggcaggttcacacgttggtagacagcgggtcaacaagtcgtaccgagtcgcgtcccagggattgacggccttgctgacaggcagtctcataagagataaccgccggtaactcctgttcccggcaccccccgtgtgaggtgctcccgccatgacgcccgtcaccgctcgcgatgccaccgtgctccgtgacgcactcggcccgctccgcgaccgcgagcaggtcgccctgcggctgctcgaatcctcggccaagcactccttcgaccccgacaccgagctcgactgggacgcggccgtcgagcagggcaagtggttctggccgccggaactgctctcgctgtacgggaccccgatgtgggagcgcatgtccgaggagcagcgcctggacctctcccggcacgaggccgccgcgctggcctcgctcggcatctggttcgagatcatcctgatgcagctgctggtccggcacgtctacgacaagccggtgaccagcaaccacgtccgctacgcgctcacggagatagccgacgagtgccggcactcgatgatgttcggccgcatgatcgactggggcggatccccgacgtacccggtgccgcgcgtctaccacaatctggcgcgggtcctgaagacggtctccaccacccccggttcgttcgccgcgaccctgctcggcgaggagatcctcgactggatgcagcgcctgaccttcccggacgaccgcgtgcagaccctggtgcgcggtgtgacccggatccatgtgatcgaggaggcccggcacgtccggtacgcccgggaggagctgcgtcgccagctggtgaccgccccgcgctgggagcgggaactcaccaaggtcagctgcggcgaggcggcccgggtcttctccgtctgcttcgtgaacccgcaggtgtacgagaacgtcggcctggaccgccgcgaggccgtcgcccaggtgaaggccagcggccaccgcgcggaggtgatgcagtccggcgcgaaacggctcaccgacttcttcgacgacatcggcctgctgaacggcgtcggccgccggctgtggcgcagctccggtctgctggcctgaaagccgtacggacgggaggcgcgggccccggcggcctcaggcccaccggcgatcggggggtgggagaaggagcggggtcgggggcgtgcacctgcgagtcggaggattgaggcagatggggtctcccctgctcgggcggagccgagagctcggggacggagccatggtgattgacgacgacgcggcggatgcgcgttcccagccccgcgacgccgccccccgattgccggtgggccttaaggtcggtggcatgacctccaccgccgcagtcccgccgccccgggcgacgtaccgcaggctcagcgtcgaggagcgccgctcccagctgctgctcgccgcgctcggcctcttcgcccaccgggcgcccgacgaggtctcgctcgacgaggtggcggtggcggccggagtgtcccggccgctcgtgtaccgctacttcccgggcgggcggcagcagttgtacgaggccgcgctcggctcggcggccgacgagctgacgctgtgcttcaccgaaccgccggtgggcccccccaccgagcgggtcgcccgggtgctggaccgctatctgcgcttcgtcgacgagcacgacaccggtttcagcgccctgctgcgcggcggcagcgtcgtggagacctcccgtacgacgacgatcgtggacggcgtgcgacgggcggcggccgacgagatcctgcgccacctcgggcggatgggcgggtccggggaccagcccgccggaccgagactgcggatgatggtgcgcagttggatcgccgccgtcgaggcggcctcgctgatctggctggacgacgggaagcggccggccgcttccgagctgcgcggctggctggtcgaccacctgatcgccctgctcgccgcgaccgccgccaccgacccggagaccgcggcggtggtgaacgacctgctggccctggagacctccgacggcccggccggacagctggcggaacgggtgattccggtcgtcgcggaggcggcgcacctgctgcccgccgccgctgcgtcagactgaccgggtgaagagcgagaacacccctttccgaggcggccccctggacggccgggtcctgccgatcctgctcggcccgaccggccatccgccgaagtggtacgaggtcccggtgccctcccccgacggcggccccgccaccgtgtacgcctaccagcgggttccggccggctacaccaagcggctcgggctccagcgcggctgggtgtacgagtacgcccccgggggccgcgagcaccgcaccctcaagtggccctggtccaggactcccccgagctccccgggccgcgactgagcggccggcgaccgtccgtggaccacaggccctaagatcgacggtcaggcgccgaaggacggctcgctcggtcgccgaaagacggtcactaggggggtgcgccatggaggcgctgcgtcaggacgatccacgccgcttcggccgcttcaccgcgctggcccgcttccacgaaggcgcgagcgccgtgcggtacgtggcgcgggacaccgcatccggcgaggtggccctcatcaccgccgcgcgccccgagctggccgccctaccggcgtaccgtcgccgcttccaggccgaggcgcgcaccgccgaacgcctcgcgggcggctgggtggccccgcccctggacaccggtgaggagccggagaccccggcggacgggccggaacccctgtggacggcggcgggttacgtccccgcgctgccgctggccgaggcgatcgggatcgccggtccgctggacgagcgggccctgcggatactgggcgcgggcatcgccgagatcctctcccgggtgcacgccgccggggccgtgctcc

SEQ ID NO: 3579 - DNA, 4587 bp, Unknown
  Kingdom: Bacteria, Phylum: Actinobacteria, Class: Actinobacteria, Order: Streptomycetales, Family: Streptomycetaceae, Genus: Streptomyces
ccagcggagtgggcgtcggcgggcatacccctgctccgaagtccccgggaggtcgtcagcggactgcactcccggcaccggccgacgcccactccgctggttcgagcatccgggcaaggcggttgacggagtctgcggaaaccgaggacgccgctgtcgaagtggctgtggacggggcgaatccgaaggtcacggtcctcccttcgctacgcgcccacgatgcgggcagggtcgagtgagggcgcgccgcgacacagcccttccgggcccgatgaggaactgtgcgggggcagctccaattctccctggcccaccggcaggcggcaacgagcaattgctatggctgacgggaatcagccggaatgacactgatatccctgcccatccccgcccgggatgactccctccgtcacccctgaatcgcgaggaccagcagaaacaccgctgtcacggtgggtggattcgctgattgtcagtcccatcgggttgcatggggggcatggacaccctggagctccgcaccgaagccgacgccatcctcgctgagctggtcggtgcccccggggggtcggcgcgcctgcgggaggaccagtggcaggcggtggcggccctggtggaggagcgtcgccgtgcgctggtggtccagcgcacggggtggggcaagtcggcggtgtatttcgtggccaccgcgctgctgcgtcggcggggcgccggcccgacggtgatcatttcgccgctgttggcgctgatgcgcaaccaggtcgagtcggcggcacgggcaggcatccgggcacgcacgatcaactcggccaatcctgaggaatgggaaacgatctacggagaggtggagcgcggggagaccgacgttctcctggtgagcccggagcgcctcaattccgtggatttccgtgatcaggtgctgccgaagctcgcggcgacgaccggcctgctggtggtcgacgaggcgcactgcatctccgactggggtcacgacttccggcccgactaccgtcggctgcgcacgatgctcgcggagctgccgacgggggtgccggtgctcgccaccaccgccacggccaacgcgcgggtgaccgcggatgtggcggagcagttgggcaccgggggcggggacgcgctggttctgcggggaccgctggaccgcgaaagcctgcggctgggtgtgctggagctgccgaacgcggcgcaccggctcgcgtggctgggggagcggctcggggatctgcagggctcggggatcatctacacgctgacggtcgcggcggcggaggaggtggccgcgttcctgcggcagcgcggatatccggtggcctcgtacacggggaagacggagaacgccgaccggttgcaggcggaggaggatctgctggcgaatcgggtgaaggccctggtggcgacctccgcgctggggatgggtttcgacaagccggacctcggcttcgtggtgcacctgggatcgccctcgtcgccgatcgcctactaccagcaggtggggcgtgcggggcgcggcgtggaccatgccgatgtcctgctgcttccgggcaaggaggacgaggcgatctgggcgtatttcgcttcggtgggtttcccgccggaggagcaggtgcggcgcaccctggatgtcctggggcaggcgggccgtccgttgtcgctgccggcgctggagccgttggtggatcttcggcgctcgcgtctggagacgatgctgaaggttctggacgtggacggagcggtcaagcgtgtgaagggcggctggaccgcgacggggcagccgtgggcgtacgacgcggagcggtatgcgtgggtcgcgaagcagcgggcggcggagcagcaggcgatgcgggactacgtggcggccgacggatgccgcatggagttcctgcagcgacagctcgacgacgagaaggcggtgccgtgcggccgctgcgacaactgcgccggtccctggctcgatccggccgtctcctccgcggccctctcggcggcgacgggtgagctggaccggccgggcatcgaggtcgagccccgcaagatgtggccgaccggcctggcctcggtcggcatggatctcaagggccgtatccccgcggggcagcaggcgatgacggggcgtgcgctggggaggctgtcggacatcggctggggcaaccgcctccgcccgctcctgtcggcgcagtcggcggacgggccggtcccggacgacgtactgaacgccgtggtgacggtgctggcggactgggcccgctcaccgggcggctgggccgacaggtctcccgatgcggtggcgcggcccgtggggatcgtcgtcgtgccgtcacgcacccacccccagttggtcacctccctggccgagggcgtggcccgggtcgggagactcccgctcctgggcagcctggcccacaccccgcatgccgacgagcacgccgcgcaccgcagcaactccgcccagcggctgcgcgccctggccgactcgttcacggtgcccgacgaactcgccgaagcgctggccgccgcccacggcccggttctgctcgtcgacgactacaccgaatccggctggaccctcgccgtcggcgcgcgcctgctccgacaggccggctccgaccaggtgctcccgctcgtgctggccgtggccggataggccgcgaggtgttgcccagtaggtgagggggccgctcagagcgtgtgggtcctgcccccacgcagctcggtgggaccgtccggtccccggttgcgtcagggcatctgccagagcaggacggcgtccttgtgacctccgagcgggtctcggtgttccacaggacgacgtggccgtcgcctcctccgaaggcgaggaggctcccgtccgggctgaacacggcgacgttgtcgctgtccctgaccgtgccggtggacttgccatcgggggtcagggtctccagggcgttcccgccgctgaccagcatgtcaccgtcgccgcggagcgccacagggacgccgggttcgctcagggtgacggccgtgtgcttgccggacggcagctcccagaggtgcagatcccccccggtgctcgcgcgacgtcgtcgatgccgtcgagcgcggacggttcgtccaggatccgctggacgatctcgatcagcgtgggcgcgtcgaacggcccgcgaccggtcgccgctccgatttttgcgtcggctgccgctgccaccacgagagcggaacgtttctcctggtgggtcagtcgaagaaggtatccgcatggtgcgagcggaccggatggcgccggtcgcttgaacggtcatccgaagaagtgctgggtgaagtccagatggcctccagcccgagcggacggtagccgtcctccggtgtccaggccgacgagctggaacgttcccgcgcatgagggtgcgtcaggggtgccgccagcgccttgcgttcgatgccaccgaggcgtcgctcgaagtcggcctgcagccggttcaaggtgtcgaggaagtcctcgagcggaatgcttccttcgtacatctgctcctcgttctctgcgccgttcccggcatcccgcgccggatccggaacgtacggatgttcgccgaagccgcgtcagccatgcgtgggcggcctcgaaagtcgtcaaaatgtgaaacggaacatgctttctcctgctgcactccgcacaacgagccctttcgccggagggagtgcggcattcgggtgacgcggtgagaaggtgccatgttcgccccggattgtccggtagcccctcgggccttgcgggcgcatggcgggagacggccgctcagtcgcgccaccacggctcacgcacgtagagactctcctcgcccgtgcaccccgcgccgttggagatttcctccgtgtccaggttccagcccacgacgccgtttcccttgcggccgagctcgatcaggcggttgttctcggtccgtgtgccgtcggtgacctggcagcggacgatcgaggtccacgcctgcccgtccagcgcggcgacgaaggccagcgccgggagtgcgagggtcgtcaggcccagggccgcccactgctccagggccgccgcccggcgcagcccccgcgacggccgatagccgccgtcgcgttgtgatccggcagtcgcccgtcggccgacgcggtgtccgtgtgcgcgccgtctgccggtgcggtactccaccacgacacccttgcgcagcgcgtaggcggcgagcccggtgcccagtccccaccagggcccgaagaagcacgcgtccaccacccccaccgcgagagggttgacgacggtcagcgccgcccgctggagcgcccgtagggcgccgctccccaccggaacggcgccgcgcgcagcgaacagggcgaagacgacgcgggagacgaccacggccagcacggaggcgaggagcgggtcggtgagcaccatgccgatcaggacgtcgggccagttcgcgggttccatgccgatgaacacgtcacgggccgcggcaccgcccccgaccgtgtacgcgaccttcgtcaccggcaccgcgagcgccaccgccaacagcaccgtgtgcccgggaccgcccttgcggtcccgggcacacggtg

SEQ ID NO: 3580 - DNA, 489 bp, Unknown
  Kingdom: Bacteria, Phylum: Actinobacteria, Class: Actinobacteria, Order: Streptomycetales, Family: Streptomycetaceae, Genus: Streptomyces
gggggtgcgacgcgggggtgcgcccggaaggcgccggagccggggcgggtgacgacgagcccttcggcggcgagctgggcgatggcgcgggagacggtgacgggactgacccggaaccgttcgacgagtgcacgactggacggcagctttccaccgggtgagtagcggttgagatcggcccgcagggaagtgaccagttcggcgacgctgctacgctcttgcatgagagcagagaatagcgctaccccaccttcatcgatagcagttgccccgccggtcggcaccttgcggaccgccccggcgagcagttcggcaacggctgcgaccgaggctgcggacgggccgggaagcaggcccgcgccggggtcatcggccggccggagcggcaccgtgctcgccggtctcggcgtggtggcgttctcgctcacctttccggccacggcctggggcctggagagcttcggcccctggtccctggtcgctctgcgc

SEQ ID NO: 3581 - DNA, 555 bp, Unknown
  Kingdom: Bacteria, Phylum: Actinobacteria, Class: Actinobacteria, Order: Streptomycetales, Family: Streptomycetaceae, Genus: Streptomyces
gctcctcggcggtgggctcggctcccgaccggaactgctcgcgcaactgggcgcgttcgccgagcacttcggcgcgcagcacgatgcggcggtcctccaggtcgtcgtggacctcgtcggtgccggtgatctggtggctgcggtaggccatggccagcaggaaggcggtggtcgccagggtgatgacgatggcggtcagcgcgatggcctggggaagcgggtcggtgacccggctcagggacaccccgtagagcagcggctcggctccggcccggccggtcgaggagaggaccagcaggttgatgccgttgccgaggatgacggcgccgagcaggatgcgggtcagcggacgggtgagcatcaggatgccgccgacggcgcagagtacgacggcggtggcgaggagcgaggcgctgacgatcatcgcagggaccctcccgcctcggggccgccctcgggggtgaggacgcccgccgcccgttcgacctgccggtcgatcttggcgccgagagcccgcacgatgtccaggacgacgccgaggaccagcaggtagac

SEQ ID NO: 3582 - DNA, 2125 bp, Unknown
  Kingdom: Bacteria, Phylum: Actinobacteria, Class: Actinobacteria, Order: Streptomycetales, Family: Streptomycetaceae, Genus: Streptomyces
gtccgggtcgaggtcgagggtcgcgagcgctcccccgtccgcgacgttcgcgaaggtcagccgcgctccgagcacctcggactggccctgggcgaccgtcaggccgaggccgtgtccccggccgcgttcgctcgcgccggtgcggaagcgctgcgggccccgctccagcaggtcgggcgggaaaccgggcccgtggtcgcgtacggcgatccgcgccccggtcacggtcacctcgacgggtgccgcgccgtgccggtgggcgttggtgacgaggttgaccacgatccgctccacccggcgcgggtcggtctccaccacctcggcggctccgacggcgacccgggtgtccgtgcccgtccgccgcaccacgtcggcgaccagttcgcccagcggcaccgggtcgaggcgggcccgctcggcgcccgcgtcgaggcgggagatctccaacaggtcctccaccagcgcgttcagagcccgcagccggtcccgtacgagaccggtcgcctcgtcgtcgtcgggcagcaggccggcggcggtgaccaggcccatgagcggggtgcgcagttcgtgcgccacgtcggcggtgaagcgccgctcgttctccagcttgcgctggagggcgcctgccatgtcgtcgacggccgccgacatctcggtgatctcgtcgcgggcccgcccggcggggccgatgcgggcgtccaggtcgccgtcggcgatacggcgggcggtacgggctccgtggcgcagccgccggttgatcggttcggtggcgagggcggcgagcgggacgacgaagacgagggcggcgagaacggatttcacgatgctgcggtccaggagctggaggctccggacctcggcgctcatgtcgtcccggacgacgaggatctgatcgtcgccgacggccaccgcgccccacatccagtaccagttgggcggatcgacgtcgtaccaggtggcgtatccgccgtcggtctccggacggcggtcggcgaggtcgcgcgccagcggttcgggcagctcggccctggtccgtacgtcgatgtcggccggcaccttccccgtacggtcgaactcccgctcggcggcgatcagccgggtgagggtccggtcgtggccgacgcgcaacccgcgctcccgggtcgcgtcgtgcaccaggaagcccaccacggccgcgaccgcacagcatgcggcggcggcgagggcggcgatcttccagcgcagggcgcgggggttgaggaagtccacggagtccgccggccgctcagccgcggacgagcttgtagccgaagccgcggaccgtctcgatccggccgctgccgatcttcttgcgcagccggagcacacacaggtcgaccacccgggtgtcaccctcccagccgtagtcccacacgtcgcgcagcagccggcggcggtcgagcaccgagccgggcgcggcggcgaactccagcagcagacggagctcggtcggcgtcagcgaaacggtctcgccggcccggcgcacctccataccgagggtgtccacactgaggtccccgaagaccacgatgtggtcggtccggccgggcttctccgccgcggccccctccgcgtccgggcggaaggtggcgcggcgcagcagtgcgcggatccgggcgaccatgacggcggtgtcgacgggcttgatcacgtagtcgtcggcacccgcctccaggcccgcgaccacgtccagggcgtcgccgcgcgcggacatcatcaggaccggtacggagctctcctcgcggatccggtggcacaggccgatgccgtccagttcgggcagcatcacgtcgaggatcagcaggtcgtgcgcgcccgcgcggaacgcctccaggccgctgagcccgtcggcggccaccgcgacccggtatccgtagcgttccagggccagttggacggcacggcggatggtggcgtcgtcctcgaccacgagcacgctgacgggggccgggccccgggcttcggacacgctgcctacctgggcgttcgaggtcatcggtcgctcgcatcgtagtcgggggagggcggcgggccgggtcaccggctcagcgtggccgcggtggggaggtcaccggatcggcgtcgcggcacagggaacgtcaccggc

SEQ ID NO: 3583 - DNA, 4048 bp, Unknown
  Kingdom: Bacteria, Phylum: Actinobacteria, Class: Actinobacteria, Order: Streptomycetales, Family: Streptomycetaceae, Genus: Streptomyces
aagagcggggtccggccccggtcgcggttgcgacgggactggttcgtgcgctggcgcggggccggaccccgctcttcgaccagtacgacgacgaggaccggccgcgtgcggccaacgagtgacacgacgggtgggagctggaaaccccggcaccgctgaccagcggaggaacggatttccaagcacccccgtgagggtgctagagtttcacacgtcgcaagggcctgtggcgcagtctggtagcgcacctcgttcgcatcgagggggtctggggttcaaatccccacaggtccacagcgagccgtatacgggtaacaccgcaggcggttgacgaatcccgtccgatcatttcgatcggacgggatttcgtcgtttccgggagcgtcggtcgtccgcttcgccgtgagcgccgatagcgcatgggcgcagccgttgacggggaccgtgcaggtccggccgggtgccggccggtgaatgatctccgccttctctacagttctcggccagttctgtagaaaagagccccatctccgcttcttgtcgcggcagttccgactgcgccagagttcgaggcgcggcgacagggacatgtcatcgccgccgggcagtgtccatggaacacatcgcgcttccccaggcgcggtgtggccaccccccccattgtctggacgctcgcctgcgtagcggaaggaatcgcgtgaagcacagcaggaagaagaacgcgcgcagatacatcgtggccgcctcgatcggcgcccttctgtcggccggagtcgccacaggggcctacgccggtacgacggaggagccctcggcgcccgcagcggctccggcctaccagccggagatggtcaaggcgctcgccacgaccctgggtgtcagcgagaaggccgccgtggagcggctggaccgcgaggcggagcagcaggaccggttcgccgggttgcgggaggaccgggtcagcacgctcggggccttcttcaccaaggacggttcgctggtcgtcaacgccgccgacgccggtgcggcgaaggaggtcagggccgcgggtctcaaggcccgggtccccgagcgcggcgagagcgagctggaccggatcaaggcgcagctcgacgccaaggcgctcaggagcgccccggccggggtgtccgcgtggtccgtcgacctcgcgtcggacaccgtgaccgtcgaggtcaacggcgactccgacgccgcgacccgcagcttcctcaaggccgcgaagagcaacggcgacgccgtacgcgtggttcggggccaggagaagctggagacccaggccgtcgttccgcccggcagccggatgaccttcaacggctacctgtgctccgtcggttacggcgccaaggaccgtaacggcaagcaggtgctcgtgaccgccgggcactgcatcgaggacctgccggaactggcctacaacgggacccggttcgccaagggcacccacacccggttcgcgctgggcacccgcagtgtcgacatgggcatcgcggccgtcgacgccggccactcgatcggcctcgacgtcaccacgtacggcagggccggcaccgtcccggtcaggggcagcaagcgggctccctccggtgcggcgctctgcaagtccggccagaccaccaactggacctgcggcaaggtcggctcgtacaacgtcagcgtcacctacaccgaccagaacggcggcccggacaccgtcgtgaccggactggcgagctccagcgtctgcacccagggaggggacagcggaggcgcgtacatctccggtgaccaggcccagggcatgacgtccggcggtcccagcaaccagcgctgcaacggccaggtcaactcgcccggctcctcctacttccagccgctcgacgacgccctcgcctactacgggctgacgctcaacaccaagtaaccgcagcacagatcaggaccggccaaggccaccccccagacgcgggagaccgtccactcatcctgggcggtctcccgttccactcgttcccggtccgcccttcgccgtcaggtctgttcccgtcccgtagtcccacgccaccccgtggacgccgggcttgcaccgggaggtgagcacatggacgtcgtgcgaatcgctcagcgggatgcgccgccgggcgcggggcggggcgccgaccttctcccggacgtagcggtggcagtccgccggcagggcgccggggtggaagaagacctgctggaggtactcgtggaggttcgtccgcgaccagcgctcgtagtgcgtagcaggcgtttcggacgggctcacctcgaccgcgtaactcaccaccgtggtgtccagtttggccagctcccggccgaagtggatctccagcaccagggatttgagccctttcaggtacgtggcctcgacgaggcgtccgcagctgaccctgatgtcgacgggttcggccgcctcgtcgtcgaagctgagcacgaagatcgcccggtcggctcccgcccggctggcccgcagcacgttcgtggtggaaatcgcgctcagcgtgccgctctcaccgaccttcacgacgtcgtggaccatcagcgagctggactcctggttgaagtggcggaatcgcgcgccgagcgccttctccaccaccgagtcctccccgaggatctggagcgccgccccctccgcgccgggcggggtgatccggccgcgcgggcggcgcggaccgagcagcgagcgcagggctccggcgggcagttccaggatctcctccagcacctccaccgctcggagggaccgtgcccgttcgggctggctgcggccgcgctgccagctgctgagggtggcctggctgatggtgatgccgcgcaccctgagccgttcgctcacccgctccagggacaggccgcggcggttcagcgcctcccgcagtgccccggggaaggtgtcggcgccggtcgccgccgcgtgcagggccgaggtggtgatggcctcgcccgtccgcgccgcggtggcgtgtgcctcgtccggtcctatcgcgatcgcgggtggccccgtggagtccggatcggtggcacgcgcctcgtcggtgtccgctctgctcgacatgtccctcccgtttcccggcactctccctgcgggacggcctacgggcccccgcatactggttgaccaccggacaggggacggataacaaaacccgcaggcgtgacctgtcccacatacccggtggcgaaccgaacgaagggcgtgaacggcgtggacagcaccgctctggtcatcgcggcgaggaagggcgaccgggccgccggggagcggctggccgcccagtacctcccgctggtctacaacgtcgtcgggcgtgccctcaacggccatccggacgtggacgacgtggtgcaggagaccatgctccgggcgctgtccggactgccctcgctgcgcgatccgtcccgctttcggtcctggctcgtcgccatcgccatgaaccaggtccgcacccgctggtccggtctcggccaccgcccggcgccgctggaggcgaccgaggaccccgccgaccccgccgccgacttcgtcgacctgacgatcctgcgcctcgaactctccggtcagcggcgcgagacggccgaggccacccgctggctggacggatccgagcgcgacgtgctgtccctgtggtggttggagacgaccggcgacctcacccggtccgaactcgccgaggcgctcggtctttccccgcagcacgccgccgtacgcgtccagcgggtcaagaaccagctcgacatcgggcgcgcggtcgtccgggccctggcgtccgacccgcgctgcccggccctggaggacctgctgagcgactgggacggtacgccgacgcctctgtggcgcaagcggatcgcccgccatgtacggggctgcgcctcctgctccgacggcagtacgggactggttccgccggagggcctgctctccgggctcgccctcgtggtgccgctctacgacagcgggcagcaggcggcggccgtcgcctcctcggccgcaccggtcgccgcctgctgcccgctgtcgtag

SEQ ID NO: 3584 - DNA, 3188 bp, Unknown
  Kingdom: Bacteria, Phylum: Actinobacteria, Class: Actinobacteria, Order: Streptomycetales, Family: Streptomycetaceae, Genus: Streptomyces
cgcgggccgcggctggagaagtcggcgaggcgctcctcaccgtccacggcgcccacggtcagcgccttgtccgcggcgccgggggtgcccacggtgtactcgccgggaccgctgttgccggccgaggcgacgaagagcgttccggtggtatcggtcagctcgtcgaggccgaggctgagcgggtccgtaccgtcccccgccgtatcgctgcccaggctcatgttgacgacgtcggcgcccgaggaagcggcccactccatgccgtcgagtacggaggacagggagccgatgccgttgtcgccgaggaccttgccgaccagcagcttcgcgccgggcgcgacacccttgcgggagccctgcgaggcggcgccggtgccggcgatggtggaggcgacgtgggtgccgtgaccgaaggcgtcccgggtggtggggctgtcggtgaagttgcgggccccggcgatccggccggcgaggtcggggtgggtgtcgtcgatgccggtgtccaggacggcgacggtgacgcccgtcccgtcgtaacccgcgctccaggcctccggggcgccgatctgcggaacgctcctgtcgagggaggcgcggaccttcgcgtcgagccagaggcggtcgatgccggcgccgagctgcggcgtcttcggagtcttcatcgtcgtgggtgcatcggtgccgagggtttcccagaagcggcgggcctgtcgcttctcggccgtcagcgcgcgcccccggacgctgccgagcgtgcgtactgtctcggaaccggcgggctcctcggccgagttgagccggacgccggagcggtaccgggcgatcagcggaatgctcctggtccgggcgtcgtcgtagccctgctccaccagcccggtgatgttgaacaactggcggtcgagagcgcccccggccagatacggcatggcctcccgggggagtacgtagagatcaccgtcgatctccacctggtcgtagctgccccccgagccttccgcgcccggctcgacggaaacggcctggcggccgtcggggaagcgctccaggtgtacccggtctccggtcacgagggtgacggtggaggtccgggaggcgggagccgccggtcggccggtggcggcggccggggagacgggggccagaactggggccagagcggcgatgagggcaccagccgctatgagcgcggcggggcgtagccgtgggtgcataggggcctcttcgaagtacgggagtggagcgcgcggttcggatcaacactccgtcctgcgaggcccgtgtgtcacgtggtgcgggtgccgtgatcgcgacatgtcgtctctacgacagggggagagccggttgatgtgccgtgtaccggtggggctggcagacgggggactgtaccgtgcatcggataaccccctggtatacaggggcagttgaagactgacgtgacgatggacaccgggaatgacggcttcggtgtggatgatgtccccgtggctcagctggtggccggggctcaggtcggcgggttgcggctggccggtgagggtggggtgccgcagcagctgacgaagcggctggagtcggctctcgatggggagctgaccgatcaccgttccccgcgagcgggccggcacgttcgagccggtcctggccaggaaggcagcggtgtccgggcggcatcgacgagatgggcctgtcactgttcgcgggggactgaccgctctgcccgaggcggtgaatacggactggcccgcgacgatcgtggtgcctagtacggtggcagccgcagcatcccggtgccctcgcgtacgtcgtgcacgagccggttcctccccaccggactgccgtgctcgtccgtggtcaccagggccgcgtcgtcgctgttgaggcaccgcccgcgcgcgtccggctcggggcagaacagaacgtagccggtctgccggtcgacgcggcccggctccagtcgccagatcccctggtaggtgctcatcaccacccgggggtaggtggcgcgcaattgctccttcaccgcgttctgcacggtgtcgccgaccttctggctctcccggaacgggcggacggcccgggcactgcccgtcgtgtcgacccggcccgcctcgatcccgtaactcgccgagaagtaggtctgcttggtgagcgaggccagaaggtccggccgggtcagccgcatcacggcaggccaggactccgtgccccggtcgcgccggtcggcgacggacggggagaccacgttcacgtacgacccctgagccctcgacaccgtgctgtcggtcccgctcgcattgacccagcgctgtacgcacgcgccgatctcgccgagcaccttcgtcacggtggcgttcgtcagctcggccacgacgtagggctgggtgccggtcgggcccagggcgatgacttcgtaaccgcaggcgtcgaaggagcccttgagcgttcggaagtcctcggcctgctgccgcccgcgcttcacggcctcggccagaacggccgcgcagtccttgcggtcgcacgaccccttctccgcccggtccgtgtcgatgcggagccggaccacggcgtcgcggtcgtcggtcaccgcgaacgtgacctccgagccgccggagcccgggaagagggtgcgtgctccgatcgccttgagctgcccgggaaagcgcttctcggccagttcctccgccgcccggcggtcgtcatcggtgtcgaccactccgcacgcgcccaggagcacgaccagcgatcccgtcagcgcgccggtcagtgcggctttccaccctctacggcgtggtccggtcatgatctgctcctccacctggccccgtcccctgttcctgtgacagtaggacgagcgcctgcgggccggatgagtacgcctactcaacccggtgcgcggcgtcctcgcgcatctctccccgacccgtcgccgccattggcatggacctgactatcgaactccgctacagtccgggacggcacatctgagagcgctctcacgcggcacgatcggcatgcgctcccggacgcctcccgttccacccccacgtcgctggaacaacaggaagggtcactcccttgagacacgcaaccgtgctgcggaccggtctgtccgcactcctgctcctcggtgcctgggccgccgccggcccctcgaccgcctccgccgcccccaccgactccgcggaggc

SEQ ID NO: 3585 - DNA, 3906 bp, Unknown
  Kingdom: Bacteria, Phylum: Actinobacteria, Class: Actinobacteria, Order: Streptomycetales, Family: Streptomycetaceae, Genus: Streptomyces
  misc_feature (3516)..(3545): n is a, c, g, or t
gcgcgggcctgtcggtcagcggtacgacgccttcgggcatgtcggactcctctcccagcggtgccgcggcaggatccttcgccccgcggtacctccaccgtggcagcgggagggcgggcgccgcgtctgcctcaggtcgtgcgcggatgtgacctgcggatgatgtcggagggccgggggtgctccgtagggtctttgccggtagcggcaacacgtccggacccggcctccgtcgtcactagcgtgcggagctcgacctcacgcggcttgcgggctcttcggagccgatggcggccacggcccatcagtgtcaaggagccgatccatgtcccgaccgaccgatcaggccgatgcggcccccgacggcaacggcgcctacgcggccccggcgcacgaccccgtcgccgagcggttcatggcgatggccgacgtcatcacccccaacgccgtccgggtcgccgcgaccctcggcatcgccgacctcgtgcgcgagggggtggaccggctggacgacctggcggcccgcacctccaccgaccgggaggcgctcggcgagatgatgcgccacctgaccgtccaggggctgttcgcgcagcccgagcccggcgtctacgcacccaccgagctgtcgcgctggatcgagagcgaccacccggtggggatgcgcgagttcctcgacctggactccccgatgggacggccccagcgcgccttcgccggcctgctccacagcatccgcaccggcggccccgcctacgccgaggtgtacggcaggacgtactgggaggacctggacgcccgtcccgaactgagccgggccttcaacgcgaagatggccgagcaggtctcggagatcgccgcggacgtcgccaagacctacgactggggacgcgtcggccatgtggtggacgtcggcggcggcaccggcaccctgctggccgaggtgctcgccgcccatccgtcgctgcgcgcgacgctcgtggacctgcccgccgcctccggtggcgccggacggcttctggccggtgccggtgtcgccgaccggtgcgagatcgtggcaggcagcttcttcgaggctctcccggcgggcgcggacgtctacgtcctgtcgacgatcctgcacgactggagcgacgaggcgtcccgggcgattctgcgccggtgcgccgaggccgcgggcgagcatgggcgggtgctggtcgtcgagcatctgatccagccggagatccggcagggcatcgcgaccctgaacctgatcctgctgacgacgctcggcgggagggaacgctccctggaggagtacgccgagctcgccgacgccgcggacctgcgggtcctgcggacgctgccgctcccgtccggccgttcggcggtggagctcgggcgccgcccatgaacgatctcgtgttcgccctggccggaaccatgggggtcgtgaccctggccgtcggcatggccgtcggcgcccggcgcctgctggggctgcgggtcgggaccctgcgcatggtgctggcctccctggtcggcttcgccaccgccgtgttcttcggcaaccaggtgcagctgcccctggagcgcggggcgctcgccaccgtcatggtcggcatctccgtgctggtgacgatggcgttcctggtcctggcggacgtcgtgatgtcggaccggtcgcgcccggtggcctggagccgccggctgcgccgccgcgtcatgcgggtccaccggtacgcccagatcggcgtgatcctggcccggcacggcctcgcgcccttcctgcgccgcaaggaccgcagcggtgtggccggccggacgggctcgccccgcctcgcccggtccctgcggctggccatcgaggagggcggcgtcaccttcgtcaagctcggccagctgatgtccacccgaccggacgcgataccgagcgagttcaccgaggagctgagcaagctccagtgcaaggtggcgcccgcgccctggccggaggtccgccaggtgctggaggacgagctgggcgtcctggtggacagcgagttcgccgagttcgacccggagccgctggccgccggctcggtggcccaggtgcaccgggcccggctgcgctccggggcccgggtggtgatcaagatccagcgtccgggcatccgccacatcgtggaacgcgacctggacatcatgggccggatcgccgtcatgctggaggaacgggcggactgggcccggtcgatcggagcgatcgcgctggccgaggggttcgccaccgcgctccgcgaggagctggacttccaggtcgagctgcgcaacatgagcgcgatcgggaccgccgcggccgaggccggcacgacggtgtgcgtcccgaagcagttcgacgcgctgtgcaccaagcgggtgctggtgctggagcacctggagggcacgccgatcggtgaggccgggccgctcgtcgagcgcgccggtctcgaccgggaggagctcgcgggcgtcctgctggactgcatgatgcgccaggtcatgatgcacggcgtctttcactgcgacccccaccccggcaacatcctgctgctggacgacggccgcctcgcgctgctcgacttcggggtggtgggccggctggacgccaaggccaggtccgcgctgcgcgccctgctgctggcggtcaagcggggagaccgggcggcgctgtgcgacgcgctgctggacctcgtcatccgccacgacgacctggacgaacaagcgctggaacgcgaactcggcgatttcgtctcgctgttcctcaccgcgggcaccacacccgacctggagatgttcgccggactcttccgggtggtcgccgggcatggtctctccgtgccgccgcaggtggccggtctgttccggatgctcgccaccctgcacggcacgctgatgggcctggcgccctccttcgacatcgtgacggagtcgcgcgagctggtggccggctactacaccgagcggttccggcccgccgcgctgcgggccaccgccggggagaacgccctcagcatgatggcgatgctgagcaaggtgccccgccgcctggaccggatcaccggggccctggaggagggccgcctcggtgtgaccgtacggctgggagcacgcgagcgggaccgcaggctggtcaccggactggtgcacctgtcgctgatcacggtgctgtccgccgccttcgggatcatgggggtgctgctcctcggcacggacagtggccccctgatcacgcccaccctgggcctgctcgacgtattcgggtacaacctgctggtcgtcagctcggtgctgggcctgcgcgtactcgtccgggtgttccggggcgaaccctgaggaaccccggcggaaaccggaagcgattcactgaaccgactggaggcgtgtcatgaaggcgaagtcggcctaccgcaagcgctggggagtccccggcggccccgatctgctcgaccaggtgcccgacctgctcgaccaggtgcccgacctgctggaccaggtgcccgacctgctggaccnnnnnnnnnnnnnnnnnnnnnnnnnnnnnnaccgcgcagcgggtccgagctgatcgaggagatcggcaccctcccgggccgcccgcacgtcaccgccgagcagctgtacccgctgctgcaccagctcaccgacgagaacctggtgacggccggcacgaaggaccggccgcgggcctacgcgctgaccgaggagggccgggagaccgtccggcggcgtgggagctccacaccagggaaaggcgcgggggaggcccaccggatcctgggagacgtgctgatggccgccggacgactggagtggtcgggcgacgcccgccggcgggagcaggcagccgcggtgctggccgagacccggcgcgagctgtaccggctgctcgccgacgaggagtcc

SEQ ID NO: 3586 - DNA, 654 bp, Unknown
  Kingdom: Bacteria, Phylum: Actinobacteria, Class: Actinobacteria, Order: Streptomycetales, Family: Streptomycetaceae, Genus: Streptomyces
tggcggccgccgtcgccgccctcgtggcgcatgcgtcggcacaggacgacgtggtcatcggagccccggtctcccgccgggacgacgaggatctggcgccgatgatcgcctgcctgtccgacgtcatgccgctgcgtcagcgcgtttccccgcaggactccttcgccgacctggtggctcgggccaaggcggaggtctggggtgccgtggcgcaccgcgacgccccctactcccatctgatccgcgatctgaacgtggagcgctcgcccggccgttttcccttgttccaggtggtcttcggcctggacgacgcccctgccccggccctggatctgccgggggtggcagccgagcggatgtatgtgcacgcgggcacggccaagtacgacgtcttcctgcacctgatccccgaggctgggggcttccgcggctacgcggagttctccaccgacctgttcgaccgttccacggtcgagcgtctcgcccagcggctcgcggtactgctgcgggccggtgcggccgagccccgccggcccttggccgagctcgatctcctgccgccgtccgagcacgcgctcctcgacgcatgggcgcgcggcgccacgctcgcgtccgacgcacccctggcgcacgaggcggtagccgcccaggccc

SEQ ID NO: 3587 - DNA, 2458 bp, Unknown
  Kingdom: Bacteria, Phylum: Actinobacteria, Class: Actinobacteria, Order: Streptomycetales, Family: Streptomycetaceae, Genus: Streptomyces
ccctcttccgtacgtacggggtgctcagagcgccgggcgcgctccggaaccggaacggcgcaccgagtacgtgacgaagcccgcgccgaggcccaacagggcggtgccgccgatgagatacggggtcgtgtccgggcccggcccggtgtcggcgaggagcgcgccggaggcgtcgtcggggctccccgcagactgcccggcggtccggtcggaggtggccgccggggcgccctgggcgccgttctcaccggtcgcgttggccgaggggacgaaccagagagcggccagcagcgtgcctgcggcggtggcggtcaggagagtgcgacgagcgacggacacagattcgatccccttgcgacaaacatgagttagccccgtgggccgatgctaagcaaagcagcgggtcggtggaaagtcgcggcctcgccgggccttacgctccggcctatgagcacagaagagacatccaggtttgttcggcttcgcgtggagatggtgctggaggtcaccgacctcgacgccctgaccggcaccgccctcgaatccatcgccgccgagtacggagagcccgtcgccgcggtcgccgggagcgacaccgccgaggagcggatgcatgccgaggccacggtccgggcagacggagcagaggccctcgcctcgctggtcgaccccttcgacctggtcagcgaggtgcccggggtcgaactggcccaggcctcctggagcagcgagagcatcgagtacgaccccgacgcggagggctgggacgacgcggacgacggcgacgaggacctcttcctgccgccggacggggacgacgaggaggggtacggcgacacggtcgcgcacaatgggaagaacgacggcgaggacggtgaccccgcgcagcgggtgtgacgtgtgagaacaccggccccggccccgctcaccggcggaccggggccgcgccgggcgccggcggaaagaggggccgggacgcgggaaccaccgctgccgggaccgcgtcgatgagtggtgttccccacatctgtcgtggatgtggaacggagcaccctttccgggtgttcttggaacattgacggggaatagcggcctgacggccccgtccggggatttcggggaatcggcaacgatggagaagcgtgtgatgacggacagcaagcggcgcaggggcctcatggccatgtccgcactgctcggcggcgtgctggtgctttcggcctgtaacgacgacggcgacaagggcggcacgaacgccgggagctcggagtcgtcgcagcaggaggtggacaaggcggcagccgcggacgcctccgaggcgcagatagcgatcaagccgaagaacggcgcgaccaacgccagcatcaacaacgcggcccaggtcaccgtcgccaagggcaagctgaccaaggtcgtcatgacgacggcggcgggcgacccggtcgagggcacgctggcggccgacggatccagctggaagcccgcgggccagctggagcggtccaccacgtacaagatcgacgccacggcggccgactcgaagggccgcgaggcccacgagaacagctccttcaccaccgtctcgcccgacaacagcttcatcgggaacttcacccccgaggacggctccacggtcggcgtcgggatgcccgtctcgatcaacttcaacaaggcgatcacggacaagaaggccgtccagaacggcatcaccgtgacctccagcagcggccaggaagtcgtcggccactggttcaactcccagcgcctggacctgcgcccggaggactactggcagggcggctccaccgtcaccctgaagctggccctcgatggcgtcgagggtgcggacggcgtcttcggcgtccagcagaagaccgtgaccttcaaggtcggccgtaaccaggtctccaccgtcgacgcgaagaccaagcagatgacggtcacccgcgacggcaagacgatcaagacgatcccgatctccgcgggctcccccgagaaccccacgtacaacggtcagatggtgatctccgagaagcacaaggagacccggatgaacggcgccaccgtcggcttcaccgatgacgacggcaagggcgagtacgacatcaaggacgtgccgcacgccatgcgcctgtccacgtcgggcaccttcatccacggcaactactggggcaagggcatcttcggcaacgccaacaccagccacggctgcgtgggcctcgccgacgtgaagggtgcgaacgactccagtgcgcccggcgcctggttctacgacaactccatcgtcggcgacgtggtcatcgtcaagaactccccggacaagaccatcaccccggacaacggtctcaacggctggaacatgagctgggccgagtggacggccggctcccaggcctgatccaaccgccgttccccctcggcaccgcccccgtccccgcccgaaggcggcggccccgga

SEQ ID NO: 3588 - DNA, 1465 bp, Unknown
  Kingdom: Bacteria, Phylum: Actinobacteria, Class: Actinobacteria, Order: Streptomycetales, Family: Streptomycetaceae, Genus: Streptomyces
  misc_feature (539)..(540): n is a, c, g, or t
  misc_feature (1030)..(1033): n is a, c, g, or t
tacggtccccttaaagcaaatgcattgcgtttacggaggagtcccatgcctggcgtcatctccgacgcacaagcggcggccgacgcacccccggtctccgacgcacccgcgtgctcgtctccaccctgctcgtccgcttcggccccgcccccaccgtcaccgtctacgtactgccggcggcagtgttcctcgcccaggcggccgtggcggcactcatcgcttcacgacgcggggtggcacgctccgaatccgacccctcccactgaagagaacaaccgaccgcttccgttgaagagaacaaaggaaacgacacaccatgcacacctcccccgccgccactcccctcccctcctggaccgtgggcggcgtcaccgtccaccgcatcgacgaagtcaccctgccgcccgcgaccggaccctggctgctgcccgacgccactcctgaagtggtgaccgcccaggactggctgcacccccacttcgccgaccaggacgggattttgcacatcgacagccacagcttcgcgttcgtcgtgaacnncacgccgatcacgtcggctggaacacacggcaggtgaacggggaatgggtccccacctttcccaacgcccgctacctcacctcccacgccgagagagaattctgggccacgtacgacatggaggaggcacgcgaacagatgttccgcgactccgtgatcccggtcgaacaggcgggtctgctgagcacgatcgacgtcccgtacacgggggccgaaatctccccggggctgcgcctgattccgacacccggccacacccccggccacatcgccgtggaattgaccgaccggaccgagacggcgctgatctccggcgactgcgtccaccaccccgtccagttcgcccaccccgccatcggcgcctgcgtcgacatcgacccgcggcagtccgaggccacccgccgcgagctcctcgactccctcgccgacacggacaccctcctcctcggcacccacttcgcaccgcccaccgccggccgcgtggtcaccnnnngccggcgggaaagggctaaatcagcatgctcagggggccagtgccggtgtccagtggcgcggtgccctctcgcgtcttgagcaccgattgaacttgccgttgcatgacaaaatgcaagttgtcagcccggcttgggtgttcaggcgggaggtacgggcgcgcagaccgtgcgaccgcctccgacgccgatcctccggccacgtaaacccggccagtggatcacccgccggttgcctctatcgtctcggtcgtgacagagacgagcggggagctggtcggcggggcagtatcgcctggtcgaaccgatcgggcagggcggaatgggccgggcctggaggggaggggacgggacgggacgggaccctgcaccgttacgcggcccacagcccacagccgttccgccacgccggaccgctggcggacgtcctgacc

SEQ ID NO: 3589 - DNA, 5747 bp, Unknown
  Kingdom: Bacteria, Phylum: Actinobacteria, Class: Actinobacteria, Order: Streptomycetales, Family: Streptomycetaceae, Genus: Streptomyces
ggccgcccccttccccgtacgcgtgacgccgcgggtcagcccttcagctcggccgccaccagctccgcgatctgcacggcgttcagcgccgcgcccttgcggaggttgtcgctggagacgaacagcgcgagaccgtgctcgaccgtctcgtcgacccggatacggcccacgaaggaggcgtccttgccggccgcctggagcggggtcgggatctccgagagctcgacgccctcggcgtccttcagcagctcgtaggcgcgctcgacgccgatcggacgggcgaagcgggcgttgatctggagcgagtggccggagaagaccgggacccggacgcaggtgccggacaccttcagctccgggatctccaggatcttgcgggactcgttgcggagcttctgctcctcgtccgtctcgaacgagccgtcgtccacgatcgagcccgccagcggcagcacgttgaaggcgatcggacgcttgtagacggtcggttcggggaagtccacggcctcgccgtcgtgggccagcttgtcggcctcggcgacgaccttgaccgcctggccgtgcagctcggcgaccccggcgaccccggagccggacacggcctggtaggaggcgacggtcagcgcttcgagaccggcctcgtcgtgcagcgggcgcagcacgggcatcgcggccatcgtcgtgcagttcgggttggcgatgatccccttcgggcggacccgggccgcgtgcgggttgacctcggagacgacgagcgggacctcggggtccttgcgccaggcggaggagttgtcgatcaccacggcgccctgggcggcgaccttctcggccagcgccttcgaggtcgcgccgccggcggagaacagcacgatgtccaggcccgtgtagtcggccgaggaggcgtcctcgacggtgacgccggagcccttgaagtcgatcgtggagcccgcggaccgggcggaggcgaacagccgcagctcgtcgaccgggaagtcccggtcggccaggatcctgagcatgactgtgccgacctgaccggtggcgccgacgattccgaccttcacgaggactcctctgttctgcacgtccggcgtctgcccgcccgtgcgtctgtgcggcccgtttgccgctccatgatgcgtatgtcctggcccgccttgtccaatccattgtccgacctgcggactcttcgtgcgaggaccgcagattctgcgacgtccgtgcgtacggggacaaacatctgcggcgggcggccaggggtgtgaccaggaacacgcacggcggggcgggtgcccgtgagagcacccgccccgccgccgtaccgatgggacctgtcacggtcccggggaatccgttacggcgtgaccttctcgatcacgacgctgccggtgcccgcggcggtgccgcgcgcgttgaccagcttgacctcgccgaagaactgacggcccgcgggggccgccccggcgaccacgacctcggcgccgacctgggccgacgcgccgttggccaggttcaccgccttggtggagtcgaccttgatcgtgccgagcgacgccgagtagtacacgtcgcggtagtcgtacgtggtcgacccggtcgggaccgagtaaccgtcgatgacgacggtgtacgtgcccgcggcgggcttcaccaggctgaccgcctcctcggaaccggcggtggtcgcactgccgacctgcgtggcgccccggaagacgtacaggtcgaggtcggcgttggcgtccgacgtgccgccgatggcgatgtcgagcttctcgacaccggcgccgatggtgaccgtggtctcacgggtctggcccgtcgagatcgacggcttgtccaccttggccgaccccagcgaaccgccctggagcttgccctggaggtcggcggcgccgttggtgaccgtccagttcaccgcggcgggagcgccgatcttcgcctcggcgatggtctgcaccgccgggtcgaaggtcgcgccgagcagcgagacgtccagcttgtacgggttgtccagcagcggcgacgtacggcgcgcctcgacctcgatctcccacacgccgggctgcgggtccttgtaggaacgcgcgtccggacggcaggtgttggccgggttctcgtagttcgggtagcagaacgtcgtcgtggtcgggtcgaccggcgtcccgtacgggtgcagggagacgaaccgcgtctggctgcccgagcgcagtgcgctgagggcgacctcaagggtcttcgcgccctccggcacgttgacgaagtacgacgtggtgccgttgcgctggaccgagccggacgccttgtaggcgtaaccgggctgctgcagctcgtgggcgacgacgaccgtggccatgatctggtggtccacgccggaggtcttcttgtcgtcgacctggaggatggcgctgtgcaccccggcggtcttcgccttggccttgaccttgaccttgaccggcgtgtcgagcggcagcgagacgtactgggggctgctcagctcgaaggtgccgtcgttgttcttccaggacagcttgtgctggacgttgcggtccgggcccgtggtgcgggtgacgacgacgtcgtagaccttggtctcgccggccttcaggccaccctcgcggtcgtagaggccggtgccgaagcccgggtccttgagcgcgaagtcgatcgcggtgtcgaccggggccttcaccgagaactcgtgcgcgggcttgccctgcttggcgatctgcttccacgccttgacgatgttgatcagaccggagccctgggcgtgcgcgggcacgtcctcgatgtggctcgcggtgctggtcagcgcggtgcgcaggtcggccgggggaagctcgatgcccttctgcttcgccgccgacagcagcagcgcggcggcgcccgccgcctgcggggaggccatcgaggtgccctggagcatggagtagccggccggcaggtcgtaacccgcctccttgaccggaccgcccggcgcccaggtctgggtggtgttgatggacgcgcccggcgccgcgatgaccggcgtgaagccgccgtcctcacgcggaccgcgcgaggagaagggctgcatgtcgtacttcttggtgacggtggagccgtagttggccgcccacgtctccttggagatcgacgcgccgaccgagatcacgtggtcggcgaccgacgggtcgccgatggtgttgagacccgggccgctgttgccggccgagatgaccagctgcacgccgtagatgtcgatgagccgcttgtacagctcggcgcgcgcgttgttgccgtcgttcagcggcggcaggccgccgatcgacatgttgacgatgtcgacgccgcggttgacgacgaggtcgatcatgccctcggtcagcgcgatgttggtgcagccgccggaccaggtgcaggcacgggaggagacgatcttggcgccgggggcggcgccgttcatctcgccgccgaacagcccgttggccgccgtgatgcccgcgacgtgcgtgccgtgcgcgccctcgatgacgccgatgttgacgaagtccgccttcgcgcccgaggcgtcgaggaccacgttcttacgggtctcgacgacgaacgggatgcgctcgacgacctgggtgcgcgggtcgtcctcaccgaagtaggagacctggaacttctccttgtacggcttgaggaccttgtcgtcggagaagtccgcgtcgttgttcaggtccacccgcgtggtgccggtgaccgggtcgtacagcacgccccagacgtcggtggtgtcaccgtcgcggttgaggtcgcccgccatctcgccaccggtggtggccgcctcggcgaacgtggcgaacttgtagctgcccgccggcgccgagtaggtcttccccccggatgtgaacgtcgggccggcgaccgactgggacatttccagccaggtgccgtcgccgtcgctcaccgggtcggtcgcggtcacccagtcgacgatcttgcgctcgccggtggtggtcttcttcagggccgggtgaccgaggtcgacgccggagtccaggacgccgatggtgatcccgcggccgtcggcctccgggtgcttctcgacgaactcgaccgcacccgtctcgaacgacgggttgtacgggttcttcgccggggtcttcttgtccggcgccgcgtaactgcccgtggccttcggctgcttcgctccggcggcccggtcgcccttgggcgtcgggtcgtccagcttgatctcctgcttgagatcgatgccgaggacggaggagagcttggaggccgccttgatggtggactcggcgcggctggtcgggaccgtcgcccggacgtagccgagcttgtcgtaggtccggccgagcacggagccctcgacggcgtccagctgcttgctgacctgctcggtcgccccgggggtggtggcgaccatcatggtgacgctcttctcgcccttggcctcggccttcgccaggacatcggcgtcggccttgccgagcttgtcaccccggtcgctcgtggcggccggtttgacgggtgccggtgccgggtcctcggcggcgaacgccggagcggcgccggaggcggcgagtgcggccgccagcccggcagcggccgcgatacgagccgcgcgtctggccccgggtatggagctgggggattccttggtcatcagcatccctgtaattgaaagagagagtccggaattcggtaccggatgaccgctcagcctgtcgtaaatgacaggggtttgtggagagttggcggaggcgagtcagggacatggcatagatccgccacggggcgcgatatgccacgcgggatgaatgaggtcaaacggtatgtccgtgacgcgtgcggcggcggccgtggtccggaccagccgcagcaccgttccgggcggcctcccgccccgccgtcccgctcggcggccacccggcctccgctcagcgcggcagcaccatcacgtacgcggccggctcgcggtcggccgccgccatcagcgccgtccgcaccaccgtcgcctgctggtccgccgcctcgcgcagcttcctcggcgagagatggacgaccgtgatcccgagccgttccagatgctcccgcttcgcggcgtgcgcggaccactgcgggtcctcctccgcccggcccctccgtccgggcgcaccgtaccggggtgcccggacgtccagctccaccgccacggcctggtcgggccagtaggcgtcgaccccgccgagccggggcccgcccggcagcctcagctccacgttccacagcggctccggcaacccgtgcccgcgcaccatcgcgtacagccgcgcctccgccatcgaccgcccctcggccagcagcgcgtcgaccgcgcccaccacggcgggtcgcccgagcagcttcgcctcgctcaactcccgtaccacggcggctggttcgcagtgcccgtcacgtacggcctcggtcagcagccgccgcacgcacgccgcgtccaccgtgctcgccaccgcatccgccagggcccgctcgaccggggcgacgggcagctcgcccacacgcgccgcgcgcggcaccgaggcggtccgcagcacctccacgaaccgggtggaccgcagccgccgggtgcgcgggaccagcacgtcgatccggtgcagcgcctccacgtccccggccgcggcgaagccgtacagcgcgagcgcggcgaggccggtgaccatcgcctcgccgtatcccgcgtccgctggacccgccggagcgcgccgcgcggaggc

SEQ ID NO: 3590 - DNA, 633 bp, Unknown
  Kingdom: Bacteria, Phylum: Actinobacteria, Class: Actinobacteria, Order: Streptomycetales, Family: Streptomycetaceae, Genus: Streptomyces
ctcgcgggccccggcgggccgctcgtcggcgccggcggacgaacactcgctgcgccgctgagccggcgacggccgaaggacggccgtccgctagcgggcggccaccacgaccgtcttggccgccttgtcctgcaacccctgccggtagggcttgtccgtgaacatcagcacgatgttgatcagccaccacaggcacgggcagcacagcagcgccggggcccacagcacgacggcccgcatcagcgcggccccggtgtcgggcacccgcccgtcgttgagcatcgcgacgcgcagcttcagcagccgcttgcccagcgtgcggccgtccttgtgggtgaagtacgtgtcgtaggcgacgtagaccaccaggccgatgatcgaccacagcaactggtgcccgctgtacccactggcgaccgcgtcgccgaacccgtcgtcgccgtccccgttgacgtcgaccgcgccgccccagggcagcgagatcaggtacagcgggatcgagatgatcaggaagtcgatgagccgcgccaggatccgcttccccggctcggcgagcggcggcattccggccagcggatcgggcgccccgaaaccgccgccgctgccgtacggatcgttcggcgggggcggagg

SEQ ID NO: 3591 - DNA, 1550 bp, Unknown
  Kingdom: Bacteria, Phylum: Actinobacteria, Class: Actinobacteria, Order: Streptomycetales, Family: Streptomycetaceae, Genus: Streptomyces
cgcggtgtcgttccactcctccagcacccggcggcgctcccgctccccgagtacgtcgatggcgcccagggaccggccggggtcgtcggccaccgcgtgcagcacccgcaggagccgctcgttgatcagccgtgcggtcgcctcgtcgaagaggtcggcgctgtagtccagcgctccccccaggccgtcgggactgccgtcctcggtgaaccgctcggtgaggtcgaaggagaggtcgaagcggaccgctccgccgccgaccgcctcgggacggacgtcgaggccgggcaggtccagctccgccgtctcgttgttctggagggtcagcatcacctggaacagcggatgccgcgacatcgaccgggccgggttcaactcctccaccagccgctcgaacggcacgtcctgatgcgcgtacgccgccagatcaccttcccgcacccgctccaccagctcacggaacgacggatcacccgacgtgtccgtccgcagcaccaacgtgttgacgaagcacccgaccaaggagtccagggcctcgtcggtgcgtcccgcgaccggtgtgccgagggggatgtcggtaccggcgccgagccgggtgaggagcgtcgccagggcggcctggacgaccatgaacaggctgctcccctgctcccgggcgagacgggccagccgcccgtgcagggcgggttcgatgtccaggggaacgcgtccgccgcggaaggcggcggtcgcgggccgggtccggtcggtgggcaggtccagctggtccggcagcccggccagcgccgtccgccagtagtccagctgaccggccaggacgctgtccgggcggtcctcgtcgccgaggatgccgcgctgccacagcgtgtagtcggcgtactgcaccggcagcggctcccagcggggggcgtcgccggacagccgcgccgtgtaggcggcggccaggtcacggccgagcggggccagcgaccagccgtccccggcgatgtggtgcagccccaggagcagcacccgggtcgtggcgtccagctcgaacagggatgcgcgcagcggcggttcgacgctcaggtcgaagccccgggccgcgtcccgggcgagtgcctcggggagcgtggcggcgtccacgggtacgcggacgagttccgggctccagcggtccaggacctgctgcgagggcgctccgtccgtctccgggaacaccgtgcgcagcgtctcgtgccgggccacgacgtcggccagggcggagtgcagggccgcgatgtccagctctccggtcagccggacggcgagcgccaggttgtagcgggcgtcctgcgggtcgagccggttgatgaaccagagccggcgctgcgcgaaggacaggggtatgcgctcgggccgctccatcggggtgagggcgcggcgagcggtgccggcgctgccgagccgctccgccagccgttccacggtgggtgcttcgaagagggcgcggaccggcagttcgacgccgaggaccgtacggatacggctcaccaaccgtgtcgccagcaacgagtgaccacccagctcga

SEQ ID NO: 3592 - DNA, 2656 bp, Unknown
  Kingdom: Bacteria, Phylum: Actinobacteria, Class: Actinobacteria, Order: Streptomycetales, Family: Streptomycetaceae, Genus: Streptomyces
  misc_feature (290)..(305): n is a, c, g, or t
  misc_feature (2480)..(2492): n is a, c, g, or t
tcgcgcacgcggtgagcgatcccttcgggcagggcccgctgccctggctgcgcggcagcgagaactacttcgacgacaccggccaggtggtcccctggtacgccgacccggagctcggccggagcaccggcggcggcacccgcacggccgacgacgtgcaccgccagatcaagggtttcgtctctcccggcgcggcggcccccggcgaggccatcgacttccacatcaccgtggacccgccccagcagttctccgtcgacgtctaccggatcggtcattacggcggcgannnnnnnnnnnnnnnngcccccgccgctcgccgccgaccggaccgtctcctgccaccactggtggatgtcctggcggctccagatcccgagttactggtccgtcggcgcgtacgtggccgtcctgaccaccgccgacggctaccgctcgcacatccctttcaccgtgcgccacgaccaccccgccgacctgctgctcctgctgcccgacatcacctggcaggcgtacaacctctatccggaggacggccgcaccggcgccagcctctaccacgcgtgggacgagcgggggcggctgctcggcgaggaggacgccgccgtcacgatctccttcgaccgcccgtacgccggggccggcctgcccctgcacgtgggtcacgcgtacgacttcatccgctgggccgagcgctacggttacgacctcgcctacgccgacgcccgcgacctgcacgcgggccgcgtcgacccgagccgctaccggggcctggtcttccccggccacgacgagtactggacgctgccgatgcgccgggccgccgagcgcgcccgggactccggcacctcgctcgtcttcctctccgccaacaccatgtactggcaggtgggtctcgcgccgtcggcctccggcgaggcggaccggctgctgacctgccgcaagcgccgggggcccgggaagtccgccctgtggcgcgaggtggaccggcccgagcagcagctcctgggcatccagtacgcgggccgggtgcccgatccccgtccgctggtcgtgcgcaacgccgagcactggctctgggactccacgggtgcggtcgagggcgacgagatcccgggcctggtcgcgggtgaggccgaccgctacttcccgcgcaccagcctgcccgagcacgacaaccggatcctgctggcccattccccgtacgaggactccgagggcgccacccggcaccaggagacctcgctctaccaggccccctccggggcgctcgtcttcgcctccggcaccttcgcctggtccccggccctggaccgtcccgggcacaccgacccccggatccagcgggccacggccaaccttctcgaccggatctgcaagcgcgactgaccgtgttcctcgaaacccgcgacaggccgccgggccccgggcgagaaccgggccgcggatacgggacaatcggaaccgctcctggatcaatctacgcggaggaaccgtgtccggttttgtagaaaagcccgagcccgtacaggttccgggcctcacccacctgcacaccggcaaggtgcgtgacctgtaccggaacgaggcgggcgacctcgtcatggtcgccagcgaccgtatctccgcgtacgactgggtcctgcccaccgagatccccgacaagggccgcgtcctcacccggctctcgctctggtggttcgaccagctcgccgacctggtccccaaccacgtcatctccaccgagctgcctccgggcgccccggccgactgggcgggccgcaccctcatctgcacgtcgctgcggatggtcgaggtcgagtgcgtggcccgcggctatctgaccggctccgggctcgtcgagtacgacgccacccgtacggtctgcggcatcggtctccccgagggcctggtcaacggatccgagctgcccggcccgctcttcaccccggccaccaaggcggccgtcggcgaccacgacgagaacgtcagctacgaggaggtcgcccgcgaggtcggcgtggagacggccgccaacctgcggcgtacgacgctcgacgtctaccggcgggcccgggacatcgcgcgggagcgcgggatcatcctggccgacaccaagttcgagttcggcttcgagaccaccgaggacgggaccgagcggctgatcatcgccgacgaggtgctgaccccggactcctcgcgcttctggcccgccgccacctgggagcccggccgggcgcagcccagctacgacaagcagttcgtgcgcgactggctgacctcgccggcctccggctgggaccgcgcgagcgagcagccgcccccggcgctgccgcaggagatcgtggcggcgacccgcgccaagtacatcgaggcgtacgaggtgctgaccggcaccaactggtcctaggaaaacgaaggaagccccggtccgagaggaccggggcttcccacatccggagcggacgaccaggttcgannnnnnnnnnnnngatcttggtggcggccgacgacaggtagttgcgtacggtcccctgcgacagggaggcccgctccgcgatctccgcgaccggcgccccgtccgccgccagttcgagcacctcggcctccctggccgtcagtggggagtccccggcggagatggcgtcggccgcca

SEQ ID NO: 3593 - DNA, 8721 bp, Unknown
  Kingdom: Bacteria, Phylum: Actinobacteria, Class: Actinobacteria, Order: Streptomycetales, Family: Streptomycetaceae, Genus: Streptomyces
ctgtcccggcggctgctggaggtcgttgacgcccaggtgcaccagcactgtacgcagccccggcagcccgagtacgtcgcggtcgaagcgcgcctggccgccgggcccgaagcggacgtcgtcgagcagcagccgattgccgcgcacggaacaggcggccaccacgacgttcaccgccggtccgccgcccggcccccggtcctccggaccgccgctcgtgccccgtgccgccggacggcgggccgcctcctccctgaccacgtggtcgagacggaccgcctcgcgctcgtccgcggccagtccccgttcgctgcgggccagcacgagcagtccctcgatgagccgctcgctgcgccggttggtgtccagcagggtctcccgagtgcgtacgaggtcctcgggggacggatcgtccaggccgatctggatcgcggcgcgctgggtggccagcggggttctcagctcgtgcgaggcgttcgcgatgaatctctgctggctgtcgaacgccttctccagccgggccagcagggcgtccagcgtctcgcccagttccttgagctcgtcgtcgggcccggtcggcgccatgcgttcgtgcagggtgtgcgcggaaagccgacgggccttctcggtcatgtcgtggatgggccgcagcacccgcccggcggtccaccagcccaccgcgaccgcacagcccgtcatcacgagcagagcggcgatcgaccagtacaggagctgctgccccgccgcgttgctgacgttgtcggtgaggtcgtagacggtgggcggccccaggtgccgtcgggagatcagcggaccgttcaccgcgtagcccggctgggcgaccgcggcggacgaggcgatggagcgcgcctcggtctccgtaccggcgcgggaggccaggttgacggtggccagcagggcggtgccgagcaccaggaagacaccgccgtacacgagggcgatccgggtccggatcgtcgagtgcggcagcttcgaggcatccaccagccgccgcagcggggacggccgcttcacagggcgtacccgacgccctgcacggtgcggatcagcgcgggctcgccgagcttggcgcggagcttgctcatgcagacgcgcacggcccccgtgaacgggtcggcgttggcgtcccaggcccgctccagcagctcttccgcgctgaccgtgccgccgtcggcctccaggagcagttgcagcacggtgaactccttcggcgagaggtccagatcccgcccgtcgcggagcgcggagcgccgtacggtgtcgagccggatgccgtggcgctccagctggggcggtacgggtctggcgcttctccggcgcagggcgcgcacccgggagaccagctcggggaactcgaacggcttggacacgtagtcgtcggcccccagatcgagcccggcgacccggtcctccatggtcccggaggcggtgagcatcaggatccgggtgcgggagccggaggcgaccagccgacgggccacgtcgtcgccgtgcacccgggggaggtcgcggtcgagcacaacgacgtcgtagtcgtgcagaccgaggtaggcgagggcagcgtcgccgctgtacaccgtgtcgaccgcgaaaccggcccggcgcagtccggtggcgaccagttccgcgaggatctcctcgtcctcggcgaccagtacccgcatggtgatgtcccctgcctcgtgcacgcttgtccgctccctcccaggatgcgactttcctacgggaaccattacgggaacggatgtttcgcaaagctctccaccggaggccgccgctccggccgcacggggcccatgtttatcgatgtgagtggatcttgatctggccgttaggatttcgaccatggcggccactggatccgagaagcagggggcgacggcgtactacgtctcgacccccatctactacgtcaacgacgctcctcacctgggccacgcctacacgaccgtcgcaggcgacgtgctcacgcgctggcatcgccagcgcggcgagaaggtgtggtacctcaccggcacggacgagcacggtcagaagatcatgcgcacggccgaggcgaacaacgtcacgccgcaggcctggtgcgacaagctcgtcgaggaggcgtggaagcccctctgggagcatctgaacatcgcgaacgacgacttcatccggacgacggagaagcggcacaccgaccgtgtgcaggagttcgtgcaggacctgtacgacaagggcgagatctacaagggcgggtacgaaggcccgtactgcgtgggttgcgaggagtacaagctccccggcgatctgatcgacggcgagggcgagttcgccggacagaagctctgcccgatccacaagaagccggtggagctcctcaaggaggagaactacttcttcaagctgagcgagtacggcccgaagctgctggagttctacgcggcgaaccccggcttcatccagcccgagtcggcgcgcaacgaggtcgtgaacttcgtcgagcagggtctccaggacctgtcgatctcgcgctcgacgttcgactggggcgtcccggtgccctgggacgacaagcacgtcatctacgtgtgggtcgacgcgctgctcaactacgcgacggccgtgggctacggcgcgaaccaggagaagttcgacggtacgttcccggcgaacgtgcacctgatcggcaaggacatcctccgcttccactcggtgatctggcccgcgatgctgatggcgcagggcctgccgctgcccggcaaggtcgttgccaacggctggctgatggtcggcggcgagaagatgtccaagtccaacctgaccggcatcaagccgcaggacctgacctcgcacttcggcgtggacgcgtaccgctggtacttcctgcgggccatcgcgtacggcagcgacgggtcgttctcctgggaggacttctccgcccgctacacctccgagctggccaacgactacggcaacctcgcctcgcgcgtcgcggcgatggtcggcaagtacttcggcggtgcgctgccggaggcgacggccgccggtgacgccgagcgagcggtgcaggagggcctggcgaaggccgtggcgaccgccgaccggaagatcggggaggaactggacttccagtccggcatcctggcggtcttcgacttcgtgaagcaggtcaacggctacatcacggagcaggagccgtggaaggtggccaaggacaccagcccggagggtcaggcccgcctggcgaccgtcctgtacacggccgccgagtccctgcgcggggtcgcggtcctgctcaacccggtgatgccggagacctcgcagaagctctgggagtccctgggcgccgaggagtccctgggcgcgctggccggccagaaggtccaggacgcgggcgcctggggcgtcctgcccgcaggctcgacggtgacgaagggcgcggtgctgttcccgcgcctggaggagaagccggcgtaacgcgtccgtacgcacgaggagcccgggaccgtgaacagcggtcccgggttcctcgcgttccggcttgggttcggcgcatcctgctgcccggtcggcgactcggcgacgacccgtctcatcgcctcagcgtctgggcgtcgcccatgacgatcaccgggttcatggccgggtccagggtgcgcagcagttctttcatgtgttcctcgggcacggagacgcagccctgggtggggccgccgtggtcgacgtggatccagatgccgccgccgcgtgcgaggccgagcgggcgggtgcggtccagggggctgacgccctccgtgcggttgtagttgatcgcgacgacgtagtcgaaggagccctccagcggctctccgtagaagccctcaccgtccaccgcgaaccgggggtgctcgtcgtagggcagcagcgctcccgggtcggggagccggccgcccgcgtcggtgagcgggtagacgcccgtcggggacctcaggtcgcccgccacgtggtggtccgtccagccctccatgccgttgtgcgccggccagggtcccgcgaccggctgccagcccgtcgccgggtcctcgcggctgtacaggacggcgctggaccggttggagtcggccttctcgccggtcacgacgaacacttgccgggcctcggcgggaatctccgctcgggtttccggccccaggtccgggatttcggcggggctgcgggtgggtgccgcggcaggtgaggaccggagcgcggacgcggcgtcggactgcgggcccgcggcgcccttccccgggacgcccacgggggtcttcgcgggagccccgtcggaggagcagccgctgagcagcagagccaggacgaggagcggtgtggcgaacagggcgggcgggcggcgcgggacggacacggtggcaggctcctcgggtggcggcggacggcgcggcgcggcaaggcgggatgcgagaggggtgtctcggtgccagtccttgccgggcccgccccggccgaacccgatccggggccatccggctgtaccgcgtagccctgaccgcgtaggcctgccgtcaccggctctccgtcacctgcaacgaaacagcccccgatcgggtgatcgggggctgtttcacgtgaaacatccgtggagcgggaccgtgcgggctacttctccgcggtcttctccgacgcgcccttggcggcgaccggcttgcgcagctggatgttcagctcgcgcaggcgggtctcgtccagctcggtcggcgcgcccatcatcaggtcctgggcgttgccgttgagcgggaaggcgatcgtctcgcggatgttcggctcgtcggcgagcagcatcacgatgcggtcgacgcccggggcgatgccgccgtgcggcggggcgccgagacggaacgcgcgcagcatgcccgcgaactcgtgctcgacggtctcgcggtcgtaaccggcgatctcgaaggccttgagcatcagctcgggctcgtggttacggatggcgcccgaggacagctcgatgccgttgcagacgatgtcgtactgccaggcgaggatgtcgagcgggtccttctcctccaggtccgcgaggccgccctggggcatcgagaagggattgtgcgagaagtcgatcttcccggtctccgcgtccttctcgtacatcgggaagtcgacgatccagcagaaccggaacacgccctcctcgaagtgaccggcacgcttggccgcctcgacccggaccgccgacatgatcttggagacctcgtcgaactcgcccgcgccgaagaagacggcgtggcccggggccagcgagaggcgctcggtgagcgtcttgacgtcggtctcggtgaggaacttggcgatcggtccggccagcgtcccgtcctcgccgacgcgcacccaggccaggcccttggcgccgtgctcgacggcgtactcgccgaggccgtcgaagaacttccgggactggcccgcggtgtccgggaccggcagcgcgcggacgtgcttgccggcgaacgccttgaacccggagtcggcgaagacgtccgagatgtcgacgagctccagcttggcgcgcaggtccggcttgtcgttgccgtacttcagcatcgactcgcggaacgggatgcgcgggaacggcgaggtgacctcacggccgttgccgaactcggtgaagagctcggtcatcagcttctcgatcggctggaagacgtcctcctgctcgacgaaggacatctcgacgtcgagctggtagaactcgcccggggagcggtccgcgcgggcgtcctcgtcccggaagcagggcgcgatctggaagtagcggtcgaagcccgagatcatcagcagctgcttgaactgctgcggggcctgcggcagcgcgtagaacttgccggggttcagccgggacgggacgacgaagtcacgggcgccctcgggggaggtcgcggtgaggatcggggtcgccatctcgttgaagccgagggccaccatcttggagcggatggaggcgatcacggccgagcgcagcatgatgttgcggtgcatgcgctcgcggcgcaggtcgaggaagcggtactccaggcgccgctcctcgttgacgccgtcctcggtgttgatcgtgaagggcagcgggccggcctcgccgagcacctcgacctcggtgacctcgatctcgatctcgccggtcggcagctccgggttgacgttgtcggcgccgcgcgcggagaccttgccgtcgatccggacgacggtctccttggtgagcttcgccagggcctcgttgccgggggtgccggggcgggcgacgagctgcaccagaccgtagtggtcgcgcagatcgatgaagaggatgccacccaggtctcggcgattgtgcagccagccgctcagccggacgtcggtgccgacgtcagaggcgcggagctcgccgcaggtgtgggacctgtaccgatgcatcgtcgttcatccagtcttcgcggttcgggggtgcccggcggatcagggcccctgggggtggatcgagcttgcctaggctaccgcccggggacgggacggttcatttccctttacgtcgccgtacccgccggcccccggggcaggtggcggcccctcggtggcgtccgccgagcacatcttcctaaagtggggcaatgcgcaccgaggaagtcctggccgcgatcgcgacgggcctgtggcgctgggacaacgcagccggcacggtcacgctcgacgcggaggcggcccggctgctggggctgcccgccgagcccggcagttaccgggaatccgaggtgcgctcctgtttccacccggtcgactggaacgagatctacgcggtggtgaacctcgcggtcgccgagggcacccttgccgaggcgcggctgcggatcgtggacgagcgcggccgggtcctgcgtaccgtccgcagccgctccaagccggtcgtgccgccggaccgggacgccgggagctacgtcctcctcggcacgctccaggaggtcgccgagccgcagcccggctccaccgacgccgcccacacaccgatcaccggggactggcggcggtcccgggaggcgttcctgctggacgccgggcgggcgctggccgaggcacggtccaccgcggaggtgctgcgggtcgccggatcgctctccatgcccggcttctccccggacggactcgcggtcttcggctccgccggggagcggctgacgatcatcgggcaccacggccacagcgcgggcgacgaggaaccgttcactgacatgcccctggagaccgactacccggccgccgaggtcgtccgcaccggccgcgcgatctacctcccctcgcccgacgagtaccgccgccgctacccggccacctggccgctcgccagccgcttcggacggcagtcctgggcctttctgcccctggtgtcctccggccgcacgatgggcgcgtggatggcggggttccggaatccggtggcgttctccccggacgagcgcgcggtgctctcgacggtcgcccgcatgctcgcccaggccctggcccgggccggggtggccgagacggaaagggagctgtcgctcgggctgcagcgctcgatgatgccgaccctcggcccggagatccccggcatgacggtggccgcgcggtacgtgccgaccggcggcgggctccaggtgggcggcgactggtacgacatgatcccgctgcccaacggccgcatcgccctggtcatcggcgacgtccagggccatgacgtgcgcgccgccgggctgatgggccagctccgtatcgccctgcgcgcctacgcctccgaggggcaccgcccggacgccgtgctctcccgggcctcgcgcttcctgtccgggctcaccgacgcgtacgagagcgtcgaggagcccgcgacgccgcgcttcgcgacctgcctgtacgcggaggtggacccggaggccgggaccctggacatcgcccgtgcgggccaccccgacccggtggtgatcagcgccgacgggaccgcggtgatccggcagacggccggcggtctgccgctcgggatcgagacggactccgactaccccaccacacgggtggtcctggagcccggcgagacgatcatgctgtgcacggacggcctcatcgagaccggcgggcacgacatggccaccggctggacccggctgcgcccggtactggaggagcccaccgaggacctggagcagctggccgacgccctggtccaggccgtgcacgggccgacctcgcactacacgacggggccgctcgcggaccggcgggaggacgacatcgcggtcctggtgctgcggcgcgagagcgtctccgcccgggagacgccgccgcgccgcagcgtcatgaccatcgcgcaggccgagcccgagcggatctcggtcggccggcagctcgtgcgcgaactgctgcacgactggggcgatcccgagcaggtcgactcggcggtcctgatggtctccgagatggccaccaacgtgctcgtccacaccgacggggacgcgctgatggtggcggagatctccggcgaacggggggaacggcggctgcgcgtcgaggtcgccgacacgagcgacgaactgccgcacaagaggcggcctggcgagatggcgtccagcgggcggggactcgtgctgatggagatgctggcggacgcgtggggggtggatccgcgcggggaggggaagtcgatctggttcgagctgtacgagtcggacgaaccggggg

SEQ ID NO: 3594 - DNA, 3686 bp, Unknown
  Kingdom: Bacteria, Phylum: Actinobacteria, Class: Actinobacteria, Order: Streptomycetales, Family: Streptomycetaceae, Genus: Streptomyces
cggaacggaggccggaaccgggaggaacgcggttccggcctccgttccgctgccaccctccttcgtcgtcggtcagtgggccgtgtggtcctggcgccgtccgcgctgcctcggagtgtcgggcaggtcagcagcgcggacggcgcgggtgcgggtcgtgggccgttacgagggggagccgacgacccggccgcctcttgcgagggagctcattcaaccgagcccgggacccgcgcggcagagcgcacagcaggagggttcgggcattccgttcacaccccgtgtgaatcgtgctccactaggctcatcgcgacacgcacctggggggacgatggagcccaatgtcctgctcgaagccctgatcgaggaggccggtgtgtcccgtgccggcctcgccggtcacgtcaaccgggcgggcctgtcccgcgggctgagcctgcggtacgaacacacggcggtctcccgctggctcaagggtcagcgcccgcgcgggcaggtgcccgacctgatctgcgaggtgctggccggccggctggggcggcccgtcgcgctcgacgacgtcgggatgggcgcctgcgccgggccgggggcggaccccggcgccgagggtgcctccctctccgggttcgtcgagcgggccaccgccctgtggcgctccgacgaacagcggcgcccgcacctggccaccgtgcccgccgtcaccggcacccaggcggtgatgccggtctggcagtgggagaaccccccggaggacaccgacgtatcgcggccgggaccgggccgggtcggcgcggccgacatagcgatgctcaaggcggcccgcgaccactacgagcagatgtaccgcaagacgggcggcatcgcgaccaggtcccggatcgtccgctttctcaacgcggaggccgcgccgctgctgcgcggcggctacagcgacgccctgggccggggcctgcaccgggcgacggcgggactggtggcggtggcgggcatctgcgcctacgactccaacgcccacggactcgcccagcgctacttccaccaggccttgcggctcgccaagtccagcggcgaccggggactcggcggctatgtcatcgccctgctggttacccagtcgctcttcctcggcgactaccgccgctccatcgccttcgccgaggccgcgctgcgggccgccggcggtcacatcacccccgccctcgccgccgatctgcacgccatgcaggccaaggcgtacgcccggctcggcgacgcggcgagcgcccgggcctgcatcgggcgggccgaggcccaggcgggccggatccacgccggccgggagccggacgagacggggtacgtccagccgggcctggtcgacgtccaggtggcggaggcgctgctcggtctcggggacctgcccgccgcccgggagcacgcggcctccgctgtgcgcgccccggcgcacgaccgggggcgcgtgcaccgtctcgcgatgttgagtcatatcgagctgcttcagggcgagcccgaccgcgcggccggtacagctgccgaaatggcgatgggggcccggggaatggagtcccagcggctgcgcgaccgcctgcggcaggtccggcgggaactggccgcgagcggttgctccgacgcggtggtgaccaccgacctgatcgacgaggcgctccgcgtgcctctgtgagctctgccgacgccccgtcgttcgttccctctggcagtcgagcctgctggcatgttgaccccaacatgtcgaaaggcggcagaaccgtgcagtggacgaacttaagcgaacagaatgtgtatcagaatccgtggttccgggtgaatctggcggacgtccagctccccgacggcagccacctcgaccacttcgtcatccggttgcgacccgtcgcggccgccaccgtcgtcaacgaggcgaacgaggtgctgctgctctggcggcaccggttcatcaccgacagctgggggtgggaactggccgcgggcgtcgtcgaggacggtgaggacatcgccgcggccgccgcccgcgagatggaggaggagaccggctggcgccccggcgagctgcgccccctgctcaccgtggaaccgtcgaacggcctcaccgacgcgcgccatcacctgtactggtccgacgaggcgcactggaccggccccccgcaggacggcttcgagtcctcacgccgcgagtggataccgctcaaggtggtcccggacatgatcgcccggggtgaggtgcccgcggcgaacatggcggcggccctgctgatgctgcaccacctgagactgggctgacccggccccgtaccggcgtgctgtacgcgcgaggagccggccccggggtgaccgggaccggctcctgacagcgaaacgaagggggaggctcaggcgtacgggtagaagcccgagccggtcttgcggccgaggcggcccgcgtcgaccatccgctggagcagcgggggagcggcgtacagcggctccttgtactcggcgtacatcgagtccgcgaccgaggccacggtgtccaggccgatcagatcggccagcttgagcggacccatcgggtgggcgcagcccatctccatgccgttgtcgatgtcctcgcggctggcgattcccgactcgaacatccggatcgcggagagcagatacgggatcaggagcgcgttcacgacgaacccggaccggtcctgggcgcggatcgggtgcttgccgagcacgtcctgcacgacggcctcggcgcgggcgatcgtctcgtccgaggtggtcagcgccgggatcagctcgacgagcttctgcaccggggccgggttgaagaagtggatgccgatgacccggtccgggcgtgaggtggcgacggccagcttcaccagcgggatcgaggaggtgttggaggccaggatcgcgtcctgtcgggtcaccacctggtcgagcacctggaagatctcggtcttgacctgctcgttctccacgacggcctcgatgacgagatcgcggtcggcgaactccccgaggtcggtcgtgaagctcagacggccgagggtctcgtcccgttcctccgcgctgatcttgccgcgctcggcggccttcgagagggagttgtgcagacgggtgcggccgatctccagcgcttcgccggtggtctcggcgaccttcacttcgaggccgctgcgcgcgcacacctccgcgatacctgcgcccatctggccacagcccaccactccgacgcgtgcaatgtcggccatagagtccgtcacctcgtgcctttcgctgttctccgtatcgcagggtcccgtgtgattccggtgcccgcctcgaccccacgacgttactccgaatgccgacgcggacgtcccgcgggtcattgcggccacggatgggcatgatgcggttacgtagagctatcggagtcgggtgcgggacgtggtggagagaggtgggccaggatgcggcgaccgggagtggcgagaagggcgttcgtgctgggcgcggccggactggtggcggcgatgacgtcggccggtgacgcggtcgcctccccggtggcacggagaggcggcggcgggcggcccggggcggcgcccggccaggtgcgcggcatgtgggtcgccacggtcgccaacatcgactggccgtccaagccgggtctcacggcggcgcggcaggaggccgagctgttcgcc

SEQ ID NO: 3595 - DNA, 1985 bp, Unknown
  Kingdom: Bacteria, Phylum: Actinobacteria, Class: Actinobacteria, Order: Streptomycetales, Family: Streptomycetaceae, Genus: Streptomyces
ccacagcaccgcccccgcccgccgacaccaccgaaccagcgcctctcacccggatcatccgcggcgccctggaccgcctccgtgccttcgaccggcgtcggccgcgggtctgggacgcggcggtgaccgcgttctggaccgtggcggcggtgctcgactacacctccggcggctggcggaccgtcgcacgcgacgacgtgacggcgcccgaaccgctggtgctcctgatgagcctctgcttctcgctgccgctgctctggcgccgaacgcaccccatggccgtactgctgctgatggcaccggcgtccctggtgaacgtctggacgggtgccgtggtccaggccgcactcctccagctgatcccggtgttccagatcgtcctgcgctcctccttacctacggtcgggaccgcggcggcgctgttcgtcaccccggtcctggccgtaggcgtgcgcatcccctccgcctggggccaggaagtggtctcgtacgtctggggactggtgttcgtcgtgcttctggggatcgcggtacgcacgcgccgcgagtacaccgaggccctggtcgagcgcgcccaccggctggaacacgaacgcgaccagcaggcccggctcgcggctgccgccgaacggacccgtatcgcacgggagatgcacgacatcatcggccacaatctgtccgtcatcacgggtctggcggacggcggcgcgtacgcggcccggaagaacccggaacgcgcgggccaggcgctggaagccatcggcgccaccagcaggcaggccctgtccgaactccgccgcctcctgggcgtcctgcgcgacgaccaccccgaggccgaacgcgccccgcagccgacgctcgacgaactggtccctctcatcgaacgcgtacgccgggcaggcctgcccgtccacctggagctccacggcgaaccccgcgcgcggtcgctcaccccgggccgccaactcaccgtgtaccgggtggtccaggaagccctgaccaacaccctcaagcacgccaccggtcccacgtccgcgacggtcaccctcacgtacacgcacgcgcacctggaggcccgcatcaccgacacgggcaccggagccggcgcgaccgcggacgtggaggaagccccgctaccggcccagggcatcatgggcatgcgggaacgcgccgcactgtacgacggcaccctcgacgcggggccgctgccgaaccacggcggatggcagatacggctccgccttcccctggaggacacgcgcccgtgacgaccgtactcatcgtcgacgaccagccgatgcagcgcttcggcttccgcatgctgctggagagccaggacgacatgacggtcgtcggcgaggccggcaacggcaacgaggccgtccacctggtcgcccgccaccacccggacgtcgtgctgatggacatccgcatgccgggcctggacggcatcgaggcgacccggcgcgtcatcgctgcgggagcccgcacccgcattctgatcgtcacgacgttcgacctcgacgcatacgcctacgacggtctgcgcgccggcgccagcggcttcctggtcaaggacgccctgcccgaagagctcctcgccggcatccgcgcggtcgccgccggagacgccgtggtcgccccgaccctgacccgccgcctcctggacgcctacgtccaccacctcccggccgcacccggcgcacctgccgcgtcggacccgcgcatcaccgcgctcacggaacgggaacgggagatcctcaccgtgatcggccagggctggtcgaacacggagattgccgcccgcctccatctcgccgagtccaccgtgaagacgcacgtgacccgcatcctcgccaagaccggcgcaagggaccgcgtccaggcggtcatcctggcctacgacacccgcctggtcaccccgatgtaggcagtgcctggacggtacgggggacaatcggtcctggaacgcagaaaagccccgc

SEQ ID NO: 3596 - DNA, 3355 bp, Unknown
  Kingdom: Bacteria, Phylum: Actinobacteria, Class: Actinobacteria, Order: Streptomycetales, Family: Streptomycetaceae, Genus: Streptomyces
cgcaaggtcgtgctggccggggccggccacaccccgcccctggtgctcggcgagcggcgctgcgagttcgtcgagaccacgctctccgccccgctggggatgctcgcctgctgggaggcgccgagcgtggagttcagcccggcaccaggcgaaacggtgctgctctacacggacgggctgctgcgccgcaccggggacgcgatggaccgcgccttcgcccggctgcactccgccgccgcctccgtaccgaagtcggaccggcacgacccggcggccgtcgccgaccacatcctgtgcacgatgctccccgacggcctcgaccagagcgattccgccgaggacgtcgtgatcctcgccgcccacttcgactgacctcccgcgccggcccgccgccccttcgaccgatccggcggcggcgtctccggtaagaggcccttcggccctgggcccccttccgtacgcccgtacgatgggttgtggtccagtgtcgtactcaaggagaaacacatcgtgtctgaggagctcatcccggagaacccggagcaggagaccgaggagaacgaggcagaggaagcggtcaagcagcggaagaacggcctgtacccgggcgtctccgacgagctcgccgacaacatgaagtcgggctgggccgacacggaactgcacgacctccagccgatcgcccaggccgagcacaccgccgcccggcgcgccgcgctctccgcccgcttccccggcgagcgcctggtcatccccgcggggaacctgaagacccgctccaacgacaccgagtacgccttccgcgcctccaccgagtacgcgtacctcaccggtgaccagacccaggacggcgtgctcgtcctggagccgaagggcaccggccacgaggcgaccctgtacctgctgccgcgctccaaccgggagaacggcgagttctggctcgacggccagggcgagctgtgggtcggccgccggaactccctctccgaggccgagcagctgctgaacatccccgcgaaggacgtccgcgagctcgccgccgtactggcggaggccaccggcccggtccgcaatgtgcgcgggcacgacgcgtccgtcgaggccgccctcaccgacaaggtcaccgcggagcgtgacgaggagctgcgcgtctacctctccgaggcccggctggtgaaggacgccttcgagatcgccgagctgcagaaggcgtgcgacgccaccgcgcgcggcttcgaggacgtcgtgaagagcctggacaaggccgaggcgaccagcgagcgcttcatcgagggcacgttcttcctgcgtgcccgcatcgagggcaacgacatcggctacgcctcgatctgtgccgccggtccgcacgccaccaccctgcactgggtccgcaacgacggcgacgtccgcgccggcgagctgctgctcctggacgccggcgtggagaccaacgacctctacaccgccgacgtgacgcgcaccctgccgatcaacggcacgttctcgccgctccagcgcaagatctacgacgcggtgtacgaggctcaggaggcgggcatcgccgccgtgaagcccggcgccaccttccgcgacttccacgacgcctcgcagcgcgtgctggccgagaagctcgtcgcgtggggcctgttcggcgacctggacgtggaaaaggtcctggagctgggcctccagcgccgctggaccctccacggcaccggccacatgctcggcatggacgtccacgactgcgccgtcgcgcgcaccgaggcgtacgtcgacggtgtcctggagccgggtgtctgcctgacggtggagccgggtctgtacttccaggccgacgacctgaccgtgcccgaggagtaccggggcatcggcgtccggatcgaggacgacatcctcgtcaccgaggacggcaaccggaacctctccgacacgctgccccgccaggcggacgaggtcgaggcctggatggcgcggctgaagggctgacccatcgccgtacctctcgcgagggcgcgccgctcactacaccgtgagcagcgcgccctcgcgccatttcaggaccttgtcgaagcgcaccacggcgccgtggcccggccggttgccgaactggacgtggtccgagagctgctggatgaggtcgagaccccggccgctctcggcttcggcttcccgcgcgggaagcgggggccgggtgtgctgctgttcggaaggggcggctgggcgaagcgcgcgccgggcgggaaagcccggccccgagtcgctgacctcgatacggcatttctcgccgtccagataggccgtgacccggtactgcccggagtccgcggcagggtgtccgtacccggaatcccccggctccccgagagccgtgcggtcgccgccgtgttcgacggcgttcgcacaggcctcgctgagcgcgaccgacaggtcgaaggagatgtccggatccacccctgcggtttccatggtgccgagcagaaaacgacgggcgagcgggacactcgcagcttcgcgccgcaaatggagagaccaccagatgctcatctttcagcctcctggctgcggctcgacgtatcgatacgtattgccgccctcggcacttcgtaagcacggatcgggtgggagagccctcgttcggcggatgtggatattcggccgcccggtgtatggatccgcccggcaccaggtcaccgggcgtccgtccggtgacccgggtgcgcgcgcccggtccgtacatcccccgcgaacgggctcaacaagcacggttggggacggagcctgatcttccggacctgccgtacggcacaggggggtgcagtgcgatgatgtcccggccatgtccacgcctctcgcacacgccggagccggtctgcggctcatgagggccgcggtgttcaccgcggcctgcgtcgtgctgtccgcggccggacacgcgctcgccgccggagcgcccgtccccgcgtggaccctgctcgccggattcctcggcgtcctcggcgtcgccacggtcctcgccggacgggaacgttccctgccgtcgatcgtgggcgcgctggccggcgggcagatcctcctgcacgtgctcttcgcgtacggcagccacggcagtgccccggccgccgctgcgccctcgggtgacgacaacccgctcatccggttcgccgccggcctcgtctgcggtgccggaccggcgcagctgaacgcgaccgacgcccaccgcatcgtctcctccgccggcatcgacccgtcgacgctcgcgggggcgcacggtcatctcgcggacggcggggccggagcggtcgggagcgccgcgtcggcggccccggacagcgcctccggcatcgcgcaggtc

SEQ ID NO: 3597 - DNA, 807 bp, Unknown
  Kingdom: Bacteria, Phylum: Actinobacteria, Class: Actinobacteria, Order: Streptomycetales, Family: Streptomycetaceae, Genus: Streptomyces
agcagcccggttcccagccgtccggctgggtctcgcccggttttcagcccgccgcgccgcggcccaagcggacgggtctgatcgtcgccgcctcggtcttcggcgcgctggtcgtcctcggtgtcatcggcgccctgctgccggaggaccccgacacgtccgccaagggcgaccggtccgaggcgtcctccaacggcggcccgagcggcagtggttccggggacgaggcccgggagaagccggccgatccccggcccgtctcgtacaagggcatcgacgtgacggagaactacgccctgcagctcgccgacaacccgccccggccgctggaggacgaggacagcggcgtgatgtacggcaagaaggacttctacttctaccgggactccctcttcggggacgagcaggtgggcagtgccaacggaaagctcgtcgtgctgaagaactcgcagaagggctcgctgaaggtctgccgcgaggagacccgctacaccgagaagatcgggctcgaccagctcacgtccggatcgcagatctgtgtgctcagcaaggccgggcacatcgccgtggtgacctatcgcggcaagtcgggtgcgaacgaccccagccactacatctccatcgacctgacggtctggcgcaacgccgaagaggcgcaggagagctgacgtaacgccaggccgtccgcccgcctccgtcacctgccgcccgtcggcgacggaggcgggggcggccccgggcggtcagtgaccgacgagctcgccgtcccgggcgacgacgcgcccgccgcgcaccaccatctcgcgc

SEQ ID NO: 3598 - DNA, 1834 bp, Unknown
  Kingdom: Bacteria, Phylum: Actinobacteria, Class: Actinobacteria, Order: Streptomycetales, Family: Streptomycetaceae, Genus: Streptomyces
ccggtccgactccagctcggcgatgcgccgctccagctcgtccgagggtgagagcagcccgcgcgccatcgcccggtccaccgtcgtcagtccccgcgtgatgaacggcagcaccggccacaggacgaacagactcgccagcgtcaccgcgaacgtcagcaccccccacggcagtcggatgaacccgtacagcaacgcccgccagcccaccgggtccttgagccccgcccacagccggacgaagaacccctgcccctggtggccgcgtgccagcggactcggctcctcgacccgcacgccgagcatccgccgcgcccgccaccgctccagccggcccagcagccgcgagccctggagcccgccgaccagcagcggcagcccgatcacggtgacggagagcccggcgccgacggcgaccacgaccaccgtgtagacgaagccgacgacggccaacggcagattggcgagcagatacgcgacctcccgccaggtccaccggtcgagggcgaagcgggcgggcggcggcaggtcgggatccggcacggaagggctcatggtcatacccacagcctgccgggccgcacccccgcacaccatggggctcatgggtggggtgaagtagggataaccccacctgatgcccgacgcggctgcttacgctccgtttagcaggccctagactcccgtgcgtacggaacaggtacacgggacagttgcggacgacgagggagcgaggggcggacgtggccgacgttacggacgtgaccggcgtggcggacgcggtgggcctgaccggcgtgtccggcgttccggcggacggacccaccgcactcgccgcggagtatttccagagctattcggtgatcggcctgctcgccctgatcggcgtcctgttcgtcgccgtggcgttcggggccggacgactgctgcgccccgtcgtccccaccccggagaagcttctcacctacgaatgcggcgtcgacccggtcggcgagggctgggcgcacacccaggtccgctactacgtctacgcgttcctgtacgtgatcttcgccgtcgactccatcttcctgttcccgtgggccacggtgttcgcggcgcccggatacggcgcgacgaccctggtcgaaatgttcatcttcctcggcttcctggccgtgggactgctctacgcatggaagaagggcgtcctcgcatgggcctgacgagccggccgacccccgcatcgcagcagcccgcgcccccgtccgacccggtgctccttcccgagcccaagcgtctcggcgtgctctcccggctcgcaccggagccgatgaaggtcgtcctcaactggggccgccgctacagcctctgggtcttcaacttcggactcgcctgctgcgccatcgagttcatcgccgcgtccatggcgcgccacgacttcatccggctcggcgtgatcccgttcgcccccggtccgcgtcaggccgacctcatgatcgtgtccggcacggtgacggacaagatggcaccggccgtgaagcggctgtacgagcagatgcccgaaccgaagtacgtcatctccttcggcgcctgctccaactgcggcggcccctactgggactcgtactccgtcaccaagggcgtcgaccagatcatccccgtcgatgtgtacgtacccggctgcccgccccggcccgaggcgctgctccagggcattctcaaactccaggagaagatcgcgcgcgaatccctcgccgagcggtacgccaccggggccacgggcgggggcccgtcccccgaggccctgcgcagcggtctggtggccgcgccgacgccgccggccccgacggag

SEQ ID NO: 3599 - DNA, 2255 bp, Unknown
  Kingdom: Bacteria, Phylum: Actinobacteria, Class: Actinobacteria, Order: Streptomycetales, Family: Streptomycetaceae, Genus: Streptomyces
gtcggggccggctcggggtccggcttcggggtcggccccggttcgggggccggctccgggccgggcctgggtcccggcgtcggttcgggggtcggcctgggttcgggcttcggttccggggtcggactgtccggcttcggagtcgggctgtccgggcccggcttcggggtaggggtcgggttgtcgagcttcaggtcggggccgggatcgggcttgtccttgaagaaggggccgtccttcaggaagttggtgtcgtagctcttgacgatgttcttcgcccagttctcgaagaggctggtgaagaaccccgccgccgcaccgaaggcggccgccttgccgatgtcgccccagtcgatcccgtccggacgccgaccgtcgggagcgaagttcatcatcgccagccggacggcgaaggtggtgaacgcctccgccagtgcctcgctcagagcgggcatcaggtgaagtcgcttgagcagatggctgaagagggtcagaagcacgaaccggctgcgcagcttcgccacgaggatctggctggcggaggcgccaccggtgaagaaggacagcgcgagatagatcgcgatctcgatgagcagccggacgatctcggcgatgacctgccacttggactccatgacgtccatgccggtcttccggcggccccggccgatctcgtcgagctgcttggtgaactccaggaggtagttcttgccctgatcgtcgatgagggtgcccatcgcctgcttgtacgagctcgacagctcgtccggcatcgcctgtgcgatgtcgtgcaccgacttctcgatcagcgcggagagctgctcgatcttgcgggccatgccggtgaagttgtactggctctggtccgcgaggtcctcgtcgatggtggtgaggaactccccggtcagcgcgaagatcatcccgttgatctccggcgtgggcatgatgctcaactgcggccgcccccggtggtgcgcgggcaggccggagcggccgctcccccggttctgcgggagcggccctcggcgcggggatcagcggcggccatgcccgcccgtgtcgtcaccgaacacgccgttggcctcggcccggctgctgtacttgctgatgccttcgaggttggtgtcgcgggtcgaacgcaccaggtggatctggtccttcatcgcggcggtgctggcgctgagcgcgtcccggaagccggtcatggtctccgtgaccttctgggtctcctcgcggtcccgctcggtggccttctgactcatctcgtcggtgctcgccgccgttccgacccagccggccgtcccgtacacgtcgtcccggaactccgtcaggatcgacatggccaggtccgcgatctggtcctgctgctcggtcagcgaagccacccggtgcgggtcgaagtagtagcgtccggccatctcagtcctcaccgtcctcgtcgagcgcgtcccgccaggcgggcttgtccccgtccggccgcgaccgctcctcgtcgtcctcgcggagaacctcggggccgaagatccgctcccagtccacctcgaagcccggcagttccggaatcgcgctgctgggctcggtgaacggcatcatcgccttcatcacatgccggttcatcgcgacccgggcctcgctcgccgcctccatgacgctggcggccaaggcctggggcgacatgtcgcggtacttgtcctcaaggaactccaggctggtcagctccccctgcgggcccaccgtgcagcgcaccgcccgatcggaggagacgcgggcgaacgaggcctgccgcagttcgcgttcggtccgcgcgatggcttcctgggcctgctggagttcggccatcgccgtctccaggcgcttctccagaggttccggcacgccttggtcccttctccgttccgtgtcgcccatcgtgcgggccggccgggccggcccgcacgatgatcaactctgatgattctgctcgtggccgcccggcaggggaagccggtccggctcacgattcctatgggatacgtctcttccgcgccgtggcgcgcggcgtcctcgcggtcaccgtccgatcaccgcggggctgccgccctcctcggtcccccagacgtcctcgtcctcctccagataggcggaggaactggtggtccggcggccactgtcctgctcctcctcgccccgcgtctcaccgccgctgctggtggtcgtgggccggggggcgggggccaggaaggtgtcttcgccctcctgccggttccaggcgccgc

SEQ ID NO: 3600 - DNA, 2586 bp, Unknown
  Kingdom: Bacteria, Phylum: Actinobacteria, Class: Actinobacteria, Order: Streptomycetales, Family: Streptomycetaceae, Genus: Streptomyces
  misc_feature (2342)..(2343): n is a, c, g, or t
gtggggggtaggggggcgcggcgtgtgccggggaaccggctagcgcgcggcggtcgcgttcacgtcggcgacgatgcggtgcgcgaggcgctcggaggacggcgggttctgccccgtgtacaggttgcggtccacgaccacgtacggccgcagcggcagacgagccttggagtactccgccccgctctcccgcaaacggtcctccagcagccagatcgccttgcggccgaagctgttgaacttctcctccaggttcgacagccccgtcatccggtaccccgtgaacggccacgacccgtcctcgcccttcgcggcgaacgccgccgccggcgcgtggcacagcagtgcgagcggcttgcccgaggcaaggacgcgggtcagcagcgcgccggagaccgggtcgaccggcagatcctccatcggaccgtgcccgccggggtagaacaccacatcgaactcgtcgggatcgatctcggccagcacccgcggctgcttcaaccgcgcgtcgatcgcgtccagatacgcggccacctcacgcagcttcttcggccaccctgccgtcttcgacatgctcagccggtcgagcgtggggatctttccgcccggcgtggcgatggtgatgccccaccccgcctccgtaaagatcttgtgcggcatcgcgagttcctcgccccagaaccccgagggatggacctcgccgtcccgcagcgtccaatgatcggccgccgacacgacgaacagcaccttcgtcacaacaaccccttctccgggggacacgggtccatcgcgaccctggtggcgacacaaagacctatcaaccggtattcatcggaaaatctctcctcatcatctgccccgagcgacacacgggcgaccggccacccgagcgattccgccgtacgcccggcctgcgcgcgagctacctcgaaaagcacctgacctgggctgacgccctcacccccgagatcacgcgccggatcgaccccgacggccccaagggcgaactcaaggcacagacgatgatccacaccgcgctgagctgcttcgacgtcgccatgacgcgctggacggacgacggcgcggaccagcccctcaccgatctcgtcgacgaagtgttcgggttcgtacacatcccgcacgcctgacgggaagaccgcctcgcgcctcaagctcccgaaatcccgacgaccgggacgctccccggctcccctgctcgaccccggggagcgtccggccgcgcggcgcgacgctgccgcagcgccgccgcatggtgacgacgactccggcactcgcccgggccgacagcaccagcagcacagaggccatggcgctgccgtcgaagcaggagatcgttttcctcatcgggcagggcgcgcgggtccagcggtgatccgggcagctcgtcccggccgttcatcgtccgccaggcctgcgctcgcggggccggcgctcccccgcagacgggaggcgcccgaacggcgagcggcaccttcacctcgcccggtgcgacgcaccccacactctccaatgtttacgctgattacattcatgggctaatgtgagtggtgtacacatcgtaggcgatcaacagggaagagatgatcgacatgaccagcgagctgttctcaccgctgcacctgcgctcggggcgggtgctgaagaaccggatcgccaaggcggcgatggaggagaacatggccggtgacggccaggcacccgacgagcagctgttcacgctgtaccgacgatgggcggccggcggtaccggtctgctgatcaccggcaacgtcatggtccacgccgaggcactgaccgggcccgccggtgttgtcctcgaccggaacgcgccgctcaagccgttcgccgagtgggccgaagcgggcaagtccagcggcggcgcgatatggatgcagatcaaccaccccggccggcagatcgccgccgacatgcccggcgtcgtatggggtccgtccgacatcggcgtcagcctgggcaggcacagcagccggttcggccggcccgccgccatgaccgcgcgacagatcgaggagaccgtgacccggtacgcggtgactgcgcaccgcgccgagaaggccggtttcgacggtgtcgagatccatgccgcacacggctacctgctgtcgcagttcctctcccccctggtcaacaagcggaccgaccagtggggcgggcccctggagaaccgcgcgcggatgctgctcgacatcgtcctcgccgtacgggccgccgtctcgccgtccttcgcggtcgcggtgaagctcaactccgccgacttccagcgcggcggattcgacgccgaggacgcccgccaggtcatcganncctggtcgaactctccggcggcagctacgagagcccggccatgaccggccgggccgccgacacgcggacccaggcccgcgaggcgtacttcctggacctggccacggacctggtgaagtccagcccgatccccctcatgctcaccggcggcatcacccggcgcaggaccgcggagcgggtcctcgacagcggcgtggcggtcatcggcatgggcacagcgctcgccgtcacccccgacctgcc

SEQ ID NO: 3601 - DNA, 3848 bp, Unknown
  Kingdom: Bacteria, Phylum: Actinobacteria, Class: Actinobacteria, Order: Streptomycetales, Family: Streptomycetaceae, Genus: Streptomyces
ccgaaggacacccgccatgcaccgcgcattgatcgtcgtggacgttcagaacgacttctgcgagggcggcagcctcgcggtggcgggcggtgccgatgtcgccgccgccatcaccgacctgatcggcgccgcccagcccggctaccgccatgtggtggccacccgcgaccaccacgtcgacccgggcgaccacttctcgcccagccccgacttcgagcactcctggccggtgcactgcgtcgccggtacggagggcgtcggcttccacccgaacttcgcgcccgccgtcgcctccggcgcgatcgacacggtgttcgacaagggggcgtacgcggcggcgtacagcgggttcgagggctccgacgagaacgggaccggcctcgcccagtggctgcgcgaccgcgaggtcaccgaggtcgacgtggtcggcatcgccaccgaccactgcgtacgggccaccgcgctggacgcggcccgcgagggcttcgtcacgcacgtgctgctcgacctgaccgcgggcgtgtccggagcgaccacggagcgggccctggccgagatgcgtacggcgggcgtgaagctctccggcacaccggtcgtcgcacaggcgtaggcgcgcacctcgtcgcacaggctcaggcacgcacctcgtcgtgcgggcgccgcagccccctacgcggccgggcgggccggtccggcgtacccggcggggcccagcagggccctgatcgggtgccacagctcctggggagactggggagactggggagcgaggcccgacaggccggaagggcccgcctgcggtgcggcccgccacagcagaccgtccggatgatgcagcaccgccgtgacctcgtccggcgtgggcggccggtcgttgccgcgcaggtagaccgcccgcaggcccagattgcgcagcctggtcagggcgcgcgcccggttcgccgcgtgcaccagcacccgtaccggggctccgggctccgctcccgtaccgccgcaggggcctgttccgtcggccggtctggtcagggtcagtgcgaccaccaccgtgccgttcggcaacctgcagaaacctccgcctgccatgctccgcgctcccccgtgagacgtcgtgtcaataaggatgtgaacaagacgcacctaaacacgatcggccgccgcccgctagagggcgacggccgatcatggtttgacctgcggttttacttgatcagcgacccgaggggctgaccagcacgctcatcgtcgagccgttgcggggctcgtggacgatggagatgcgggtgttcgtgtcagggaccttgacactgcccgtggggttctcctcgtaccagtaggtgcccttgcggtcgtcgaagaccgggttgcccagggcgggcttgatgtactgcgggacgtccgcgttgtgcagcgtgaagcccttgttcgggtaccagctgaacggcgcgtcgaacggctggatcttgttgcgcaggagcgagccgtccttccacttcagcggcttcgcgtgcgcgtcgatcggcaggatcagaccctggcccgggtggacagaggtgttgttgtccttctgggaggtgtcccagagccagaccagcagaccgttctggtacgcgtagtgctcgacccagtccggacgggtgccggagaagccgaagttgtacgggccgaccttcaacgtctcgtcgtaggagacgtactggcggttctccgcgatgtagtactgcgggtagtcctgggtgaaggactcaccgatccgcgagaagcccttcgcggtccagccgttgtcgtcgccctcggcgttgtccgagaacagcgcggcgccgtcggcggtgacggtgatggcgtcgcccgcgaagcccttgccgcccgcgccgccgtccgtctggtagcggaagcggaggtcgaccttcttgcccgcgtaggcgtccagggagaaggacagcttcttgtacgcgcccgagacgtcggtcagggccggcttgtcactggcgtcgcgcgggatggccttgccgtcggcggtgccgtcgagcgcggtccagctggtgccgccgttgtcggacacctcggtgtagaggtagtcgtagtcggcctcgatgtcgtaccagcccgaaaggtccagcgtggccttggacttgccggtcaggtcgaccgagcgggtcagggtgttcgacaggtcgtcgcccatgtcgctccaccactgcttcgcaccctcggcgggcttgacgacggtggtggtgacggccttcttcggcagctcgacgacgagcgcctgcgggttctcggtgttgtactccgagacccccagcttgtgcagcgaggtcttgccggccttggccttgtcgtagtcgagccagcccagctggagcttgtcccacgaggtcatgtcgcccggcaggttgccgatctcgcccttgccggtgccgagccaggagcccgccgacatcagggaccagaagccgaccgagttctcgccgtcgccggaggtgtcgtacaggtccgggaggccgaggtcgtgggcgtactcgtgggcgaagacgcccaggccgccgttctcgggctggacggtgtagtcgccgacccagatgcccgtgtcgccgatctgggcgccaccggccttgttgtccgcgggaccggtcgcgccggcgttggtgccgtacgcgtaccagcggtgcgcccagatggcgttggtgccctcggcgccgccgccggccgactcgtcctcgccggcgtggaccagctggaagtggtcgatgtagccgtcgggctcgttgaagttgccgtcaccgtcgaagtcgtagcggtcccactcgtcgtactccgcgaggttcgccttgatctccgcgtcggtgcggcccttggccttctggtcggcgacccaggcgttcacgccgtcgcgcaccgcgtcccatacgttggcgcagttggactggccgcagtagttggagccgtaacgggcctcgttgtaggggaccttgacccagtcggagacctctccctcgaccgagtagcggcccgaggaggtcttctcgtagtaggtcttgagcgagttgacgcccttgccctcgccgaagtagagctcctggaagtgctcctggttgtagtcggccttccaggcggtgctgttgtccttcttcgggtccggctcggcgatcttgttgtgcgccgggcccgggttgcccccgaacttcttgacgggcggcttggggccgtcgccgtccgggtcgatcatggtggtgtcgtcgacctggtcgccgaactccagcagaatggtgaagatcttgtcggtcttctcccggccgagctcgacgtacttcttgtcgccgagcttgacgaccttggagccgctccggttcgccaccttcttgtcgccggacagcaccagctccagcgcggcctcgcgctgggcggcctgctcctcgctgaaggggccctccaggttgtgctccacgtgccccttggccggtgccgggtcacggcggtcgacgctggagacaccggaacctgatgagctgtcatgcgcctgggcggtggcgaaggtcgacgccgtcgcagcggtcgcagccatggccacgacaacggcggcgccacgaagcgcccgtctctgattggtcacttgatgcagtcctccccgggcgtccgcgccgcggccaggggggtatgaaacgggccgcgcgcgtaaacgcgtcacaagtgacgacattcgatcggagttgcgagagaaaagacagaccttgacttgaacagaccaagtgcactatgcggagtgctcttccggtatgcggacggtatgtgaagggcatgggaacggtaaaggaacgtcgacggcccggaccgggccgtcgacgttcctt

SEQ ID NO: 3602 - DNA, 4765 bp, Unknown
  Kingdom: Bacteria, Phylum: Actinobacteria, Class: Actinobacteria, Order: Streptomycetales, Family: Streptomycetaceae, Genus: Streptomyces
gaatcaccgtgcagcgggcgctggagctgccggggctgcgcgccgggctcccggaggtggtggccggcgccgaccggctgaaccgtacggtgcgctgggtgcacgcgggcgaggtcccgaacatcgcctccctcctcaagggcggcgagctgctcctgaccaccggtctgggcctgggcgcccgctgcacggtgattccgctgtggctctccacgtaccggcccgcttcccttgtgccccgcccgtcgatcgggcggtcgtcctgttcaggacgctaccgcccggggtgcggggcgcgcatcgcaggggaggagcgcggaggcgcagccgcgcggggcccgccggtcagggcttcgtcagcaaccccgcgagcgtgccccggctgcgccgcagcgcctcgatccggtcgtccatcagcgccagctccccgccgaggatctcccgcagctccgcgcaccagtcgaacacgggccccgcaccccgggcacacggcagcacctgggcgatcacctcggtggacagacccgcccgcagcagcgcgcggatctgcgtgacggtcatcacggcctcctcggcgtagtcgcggtagccgttcgccccccgcccggccgacagcagcccctgcgcctcgtagtaccgcagcgaccgcgcgctgacgcccgtgcgccgggacaactccccgatcagcatgtatccgtgccccgttccctcttgaccttgtcaccggtgtcaggccctaacgtccgggccatgaaccaggattccccgtacatcgtgcaggtgaacggccggacggccaccaccgacgacctcgcgccgctcgccttcgcgggccatgcccacttcaccgccgtacaggtctcgggcggccgggtccgcggcctcgacctccacctggagcggctgagatccgcgtcggcggagctgttcgaccgtgctctgccggaggacctggtgcgctcgcgtctgcgcacggcgctccgcgacggaccggccgatctctcgctgacggtcacggtgttctccccggcgggggagttcacctcggcagacgccgatcccgcgctcctcgtgcgcaccggcccggcctcgtccggccccggagggccgctcgccctggcggcggtccggcacgaccggttcctgccgcacatcaagcacgtcggcgaggcggccaagacgcacctgctccggaaggccgtcgcggacggcttcgacgatgccgtgttcctggacggggagggccggttcagcgaggcgacgatctggaacctggccttctgggacggcgagtcggtgctgtggccccgggccggcctgctgaccgggacgaccatgggcatcgtccgccgacagctggaccggctcggcgtggggcagcggaccgtcgcggtcacccccgacgacctgcccgccctcgccggcgcggtcgtcatgaactcgtggacgccgggcgtgcctgtccaccggatcggcgcggccgagctgccggccgccccggcattcctggagctcctgcaccgggcgtacgcggccgaaccgctcaccgccccctgacacgcgcgacggccgccccggagagcccggggcggccgtcttcaccgtcggcggctcagccgacgtacgcgccgctcgcggtcagccgcagagccgtgtcgatcagcgggacgtgactgaacgcctgcgggaagttccccacctggcgctggaggttggagtcccactcctcggccagcagacccaggtcgttgcggagcgacagcagcttctcgaacagctggcgcgcctcgtcgacccggccgatcatcgcgaggtcgtcggccatccagaacgagcaggccaggaacgcgccctcgtcgcccgccagaccgtcgacgccggcttcctcgccctccgtgggatagcgcaggatgaagccgtcctccgtggacagctcccgctggatcgcctcgatcgtgccgatgacccgcttgtcgtccggcggcaggaagcccatctgcgggatgagcagcagggaggcgtccagctccttcgacccgtaggactgggtgaaggtgttgcgctcctggtcgtagccgcgctcgcagacgtcccggtggatgtcgtcacggagctggtaccaccgctccagcgggccttcgacgtccccggactcgaccagcttgatcgtccggtcgaccgcgacccacgccatcaccttcgagtgcacgaagtgccggcgcggtccgcgcacctcccagatgccctcgtcgggctcctcccagtgcttctccagatactcgatcagcttgagctggaggcccatggcgtagtcgttgcgggtcagacccgtcatgtgcgccaggtgcagcgcctcggtgacctcgccgtacacatcgagctggagctggttggccgcgccgttgccgacccggaccgggccggagttctcgtaaccgggcagccagtccagctccgcctcgccgagctcgcgctcgccggcgatgccgtacatgatctggaggttctccgggtcgccggccaccgcgcgcagcagccactcgcgccaggcgcgggcctcctcccggtagccggtgcgcagcagcgaggagagggtgatcgcggcgtcccgcagccaggtgtagcggtagtcccagttccgtacgcctccgatctcctcgggcagcgacgtggtcggggccgcgacgatgccgccggtcggcgcgtacgtgagggccttcagcgtgatcagggagcggacgaccgcctcccgatagggcccgtggtacgtacactgatcgacccattcgcgccagaacagctcggtcgcctccagggaaccctcgggttcggggagggcgggcggcccgtggtgcgagggctgccagctgatcgtgaaggccacccgttcgccggggccgacggtgaagtcggagtaggtggtcaggttcttgccgtaggtctccgcctcggtgtccagccagacggagtccggaccggcgacggcgaccgtgcggttgtcgaccttgtgcacccagggcgtcacccggccgtagctgaaccgcatccgcagttccgagcgcatcggcacccggccgctgacaccctccacgatccggatgagttgcggcgcgccgtcacgcggcggcatgaaatcggtcacccgtacggtgccgcgtggtgtgtcccactccgattccaggacgagggagtcaccgcggtagcgacgccggtcggcgaaggctggttctgttccttccgctctcgcggggcccaggcgccagaagccgtgttcctcggtgcccagaagccccgcgaacacggcgtgcgagtcgaagcggggcaggcacagccagtcggctgtgccgtcccggcagaccagggcggcggtctgcatgtctccgatgagtgcgtaatcctcgatgcgcccggccacgtgcgtctccagtcgaacggccatgtcgccccgtcaaagggcgcttactgctggtcaagggggtcgtagggtctttcacccgggaagatccgacgagtcctgtaccggtgggcgacctgggtggtgccgccgcccggccgtctcggcagcgagtgtttgagcaggatacgacgcaccacgaagatccgcgcgacggtcttcgcaacatctctgatgctgatcaggttgggacgtggagcggctggggtgaaggtgtgacgtccctgtgcagggtgtggccggaagcagcctcccgccgtcgctgttaccctggtagcccgtggaccggtggtcgttcgcgacagcgcacgaggcccccgaaccgcagcgacggcacccccggaatctccggttcggcggccggtacgcacctcagaatcgcgaccacgggagccccctttggctatgcagcccacatccacgacgaccaagcacatcttcgtcaccgggggtgtcgcctcctccctcggcaagggtctgactgcctccagcctgggtgccctgctcaaggcgcggggcctgcgggtcaccatgcagaagctcgacccctacctcaacgtcgacccgggcacgatgaaccccttccagcacggtgaggtgttcgtcacgaacgacggcgccgagaccgacctggacatcggccactacgagcgcttcctcgacgtcgacctcgacggctccgccaacgtgacgaccggccaggtctactcgcaggtcatcgccaaggagcggcgcggcgaatatctgggcgacaccgtccaggtcatcccgcacatcaccaacgagatcaagcaccgcatccgccgcatggccaccgacgacgtggacgtcgtcatcacggaggtcggcggcacggtcggcgacatcgagtcgctgccgttcctggagaccgtccgccaggtccgccacgaggtcggccgggacaacgtcttcgtcgtccacatctcgctgctgccctacatcggcccctccggcgagctgaagaccaagcccacccagcactcggtggccgccctgcgcaacatcggcatccagccggacgccatcgtgctgcgcgccgaccgcgaggtccccaccgccatcaagcgcaagatctcgctgatgtgcgacgtcgacgagaccgccgtggtggcctgcccggacgcccggtcgatctacgacatccccaaggtgctgcacaccgaaggtctggacgcctacgtcgtgcgcaagctcgacctgccgttccgggacgtcgactggaccacctgggacgacctgctggaccgggtccacaaccccgaccacgaggtcaccgtcgcgctggtcggc

SEQ ID NO: 3603 - DNA, 983 bp, Unknown
  Kingdom: Bacteria, Phylum: Actinobacteria, Class: Actinobacteria, Order: Streptomycetales, Family: Streptomycetaceae, Genus: Streptomyces
ccgtctgcgcgccgaccaccgaccggacctcgcgccagccgatgcccgcgtccgcgagggcggcgtgcgcggcgatccgcccgtacgtgacgaaactgcgcccccacttgccccacgggtgcatcccggcaccgaggacggccacgtcgccggtcatgagccggcctccgccgccacgggacgccagtgccaggtcgtgtgcacgacgcccgtcgcccggtcctcgtccagaacgcccggtacgacctccaccaccgagccgacggggagatcggccacgcccaccccgggagcggcctgccccagcaccaccatgcgctcggcggccagttcgacggcgaccagcgtgtacggagtccagggcgcctcggggtcgctgacgtacgggggagggggccggtagcgtccgtcggtgcaggaccacaccgttccccgcttcgacagcggagcctcctccagctcgccgccggggcagcccgggttgcggcagtggccgtcctcccgggggaagtgcaccgaccggcagccggagcacctggtgcccagcagccggaaatcctcctccgcggcgtcctcggtgaaccaaccggccaccacgggtatgcgcgtgcgcgacaaagtccctcccggcactggatctgacggaacgtcagaagtgtgccacggacaccttggtccggcgagggggccggcccgccggtcccggtccctggtcgcgcccggccccgaccgtgcggcctcagccgcgcggctcaccctcgtcgcgctcgcccccggagtgctcagccagccacttcgccgcggtctccgccagctccgcgtcccggcccgcgagcatcgtccggatcatctgcgcgtccccgcgcagcgaccacaccggatgcccgaacgtggccgggttgttcctctcgatcaggaagtgcgcgggccacgccgtgccgtacccgatcagcggcagggccgccagatagcgtttccggccc

SEQ ID NO: 3604 - DNA, 2187 bp, Unknown
  Kingdom: Bacteria, Phylum: Actinobacteria, Class: Actinobacteria, Order: Streptomycetales, Family: Streptomycetaceae, Genus: Streptomyces
  misc_feature (252)..(253): n is a, c, g, or t
ccgccacccgctccacggcgcgacccaccccctcgccgtaaaccgttttggcgatagctccacccatcccatatgcttctcacgtccccgacgcgctgcaaagcgaacaggcgggccaatagccctcatcgtctagtggcccaggacgccgccctttcaaggcggtagcacgggttcgaatcccgttgggggcacgtttcaccgtgtgcgagacttgtttcgcacattgcttggtcctgtggagcagtttgnntcaaatcccgtcaggaccgctgcagccccagcggctgcgtggctgggtagctcagttggtacgagcgatcgcctgaaaagcgataggtcgccggttcgatcccggccccagccacttctcgaaggccccgtccgatggacggggccttcgccgtgtcacaccttctcggtctccccggcctcctcggtcatctccgtctcctccgcgggtgcgtccttgtcgcgccgccgccaggcccgggcgcccaggaccagcagcgccacgagcaccaccgctcccagcagcaccccgtccggcacctgttcgcccaggttctgtgcccactgctcgaccgcgaacgagtcgtcgacccccagcagaccgggcagcgcggtcgtcccgtcgtacacgaggaacagcgcgccgagcccgatgaagaacagtcccgacagcagcgacgtggtgtgcagctcgaaccggccgagccggacggcacggccgcgcaaccaggcccggcggccgaggtcgaagcgttcccagagcagggcgagcacgaagagcggtacggccatcccgagcgcgtacaccgccagcagcagcccgccgtagaccgggctgccgctgaccgccgcgacggtcaggacgctgccgaggatcgggccggcgcagaatccggccaggccgtagaccgcgcccagggcgtagacggagaacgccgtggtggggcggatccggccgctgagggccgcgatccgccgggacgcgaagccgaggccgacgatctgcgcgacgccgagcacgatgatcagccagcccgcgcccgtgacgagggcgtcgcggtggccgtagaacagccgtcccgcgtaactgccggccgcgccgagcgggacgagggtcgtggcgagcccggcgtagaagatgccggtgcgggccagcagccgggaggtggagtcgatggagtacgcgaagaaggccggcagcagcagcgcgctgcacgggctgaccagggcgagcagcccgccgaggaaggccgcgaaatagccgatgtccgccgtcacttggcggattcctctgcgtcgttccccgcgtggccggtgtccttgccggtggccttcgcctgctcggcggcggcctcgatggcctgcgtgaacgtctcgtccggctgcgctcccgcgatcgggcggccgttgatcaggaacgacggggtggacgtcgcgccgatcccgtacgcctgctcctggtccttcgccacggcgtcccgggcgggcttgccttcgaggtcctccatgaaccggttcaggtccttcaccccggcctcttcggcgagcgccttgacccggtccttgccgaatcccttctccttcgccccttcggcgtaggcggcgcggtggaactcccagaagcggtcctgctgcccggcggcccaggcgccgcgcgcggcgttctcggactcctcgccgaagatcgggaagttgcgccactcgatgcgcagcgtgccgtccttcacgtacttctcgatcagcttcggttcggtgtcccgggcgaacttgccgcagtagccgcacttgaagtcggcgtactcgatcagcaccaccggtgcgtcggcgcggccggcggccagcttgtcgtccgcgtcccgccgggccagcttcgccagttccgggtagacgccctcgttcgggtcggcggagacctcggcggccggggcggaggaggtgtccggggcggtgtcgtcgggggcggtggcccggtaggaggcgaagccgaggagaccggcggccacgacgatcacggcgccgtagaccaaaggcttgcgggaggaggacttctggcccgtggagacgggcttcttgggcgtgggcatgcggcactccgtgctgatgatccggaaggagagggagaagggcgcgggtcgggcgggtgcccgcctacacccgcagcacggagagttctac

SEQ ID NO: 3605 - DNA, 635 bp, Unknown
  Kingdom: Bacteria, Phylum: Actinobacteria, Class: Actinobacteria, Order: Streptomycetales, Family: Streptomycetaceae, Genus: Streptomyces
ccctcctggtcctcgacgtcgtcggcctcaccccgcagctcctggcccacatgccgaacctccgggccatggcggagcagggcgcgaaggcaccgctctccaccgtcctgccggccgtcacctgcgccgcccagtcgaccttcctcaccggcacgatgcccgccgagcacggcatcgtcgccaacggctggtacttccgcgagctcggcgacgtcctgctgtggcgccagcacaacgggctcgtcgagggcgacaaactgtgggacgcggcccgccgcgcccaccccggctacaccgtcgccaacatctgctggtggtacgcgatgggcgccgacaccgactggacggtcaccccgcgccccgtctactacgcggacggccgcaaggaacccgactgctacaccaggccccccgccctgcacgacgaactgaccgaccgactcggcacgttccccctcttccacttctgggggcccggcgccgacctcgtctcctcccagtggatcatcgacgccacccggcacatcatcgccacccgcactcccgacctcgccctctgctacctgccgcacctcgactacgacctccagcgcttcggccccgacgacccccgctcccaccgggccgccgccgac

SEQ ID NO: 3606 - DNA, 3873 bp, Unknown
  Kingdom: Bacteria, Phylum: Actinobacteria, Class: Actinobacteria, Order: Streptomycetales, Family: Streptomycetaceae, Genus: Streptomyces
tcgagctgggtggtcactcgctgctggcgacgcggttggtgagccgtatccgtacggtcctcggcgtcgaactgccggtccgcgccctcttcgaagcacccaccgtcgccgggctcgccgcccacgtcgacacgggagaggcctcccggcccgcccctgccgtcgtcgcggaacgccccgagcgcatacccctgtccttcgcgcagcgccggctctggttcatcaaccggttcgacgagcggagcagcacctacaacatgcccttcgccgtgcggctgcgcggtgcgctggacccggtggcactgcgcagggccctggccgacgtcgtcgagcggcaccagagtctgcggacggtcttccccgaggtggacggggtggcctgccagcacgtcctggccaccgaggacgcggccccgccgatgcccgtcgtgctcacgaccgaggagagcctgcccggacagctggccgccgaggcgggccgcggcttcgatctggccgccgaaccgccgctgcgcgccacgctgttcgccctcgcacccgaggagcatgtactgctgctgctggtgcaccacatcgccggcgaccggtggtcgctggccccgctcgccgaggacctggccgccgcgtacaccgccagggcggacggccggacgccgcggctccccgcccttccgctccagtacgtcgactacaccctctggcagcacgcggtgctcggctccgacgaggaccccggcagcctgctgcaccggcagctggagttctggaccgaggaggtgcgggatctccccgaggagctggacctgccgaccgaccggccgcgcccggcccgctcggacttccggggcgacgagatcaccttcgacctggacccccggctgcacagcgacctggccgcgctggcgctcacccaccgggccagcctctacatggtcctccaggcgggactggcggctctgctgacccgtctcggcgcaggcaccgacctgccgatcggctgcgccgtggccgggcgggacgacgaggcgctggagggcctggtcgggttcttcgtcaacaccctcgtcctgcgtacggacacctcgggcgaccccggattcgcggagctgctggagcgcgtgcgcagcaccgacctggcggccttcgcccaccaggacctgccgttcgagctgctggtggagaagctcaacccggagcgtgtggccggccgccacccgctcttccagatcgccctcggcctgcagaacgcgacccccgaaccccggggcctgaccggactcgacacccgggccgagccgctgggcaacaggacgtcccggttcgacctgctgatcaacctcgtcgagcggcacgacgcggagggccgtcccgcgggtctgggcggcgtcgccgagtacagcaccgacctgttcgacgcggagaccgtgcaccgcctgaccgctcagctggagcggctgctgcgggcggcggtcgccgacccggaacgtccgatcggcgacctggacgtgctgacgccccaggaccgcaggcggctgctggtcgagtggaacgacacccaccgcgaggtgcccgccctgccggtaccggacctgttcgaggcgcaggccgcctcgtcgccggaccgcaccgcgctggtccacggtgatcgcgccctcgactacgcggagctgaacgaggccgccaaccggctcgcccgggtgctggtggaccggggggtggggccggagcggaccgtggccctggcgctgccccggggagtcgaccaggtggtctccgtgctcgccgtgctcaaggcgggcggcgcctatctgcccgtcgaccccgactatccggccgagcgcatcgcgtacatgctgaccgacgcccgtccggccctgctgatcagccacacggggatcgccgccggcctgcccgagcaggccggagccgcactgctgctggacgagccggagaccgtacgggacatcggagcacgctccgcggggaacgtcaccgacgccgaacgctccgccgtcctgcgtcgggagcaccccgcctacgtgatctacacctcgggttcgacgggtcgtcccaagggcgtcgtcgtctcgcacgcgggcccggccagcctggccttcggccagatcgaccggttcgcggtcggccccgacgcgcgggtgctgcagttcgcgtcgccgagcttcgacgcggcgttctccgagctgtgcatggccctgctctcgggcgccgccctggtgctcgccgaccgtgaccggatgctgcccggcgaacccctggcggaactgctggagacggagcggatcacccatgtgacgctgccgccggtggccctggcggtgctgccgccgcacgcgctcgaccgggtcaccacgctggtcgtcgcgggggacgccgtctcccgggagaccgtcgcccggtggtccggcggccgccggatgatcaacgcctacgggcccaccgagacgaccgtgtgcgccaccatgagccggccgctgacgcccggtgacggcgcgccgccgatcggcaggcccatcgacaacgcccgcgtctacgtcctggacggccggctcgctccggtcgccgtgggtgcggtcggcgagctgtacgtggcgggctccggactggcccgcggatacctgggccgtccggggctgaccgccggccggttcgtcgccgacccgttcgacccgctgggcggccggatgtaccgcaccggggacctggtgcggtggaactccgacggggagctgagcttcgtcgggcgcgccgaccaccaggtcaaggtgcgcggcttccggatcgagccgggcgaggtcgaagcgctgctgaccgaccgtcccgaggtcgcccaggcggcggtcatcgtcagggaggaccggccgggcgaccgtcagctggtcgggtacgtggtgcccaccgcccggcccgcggccggcgacggcggggacgacggcgtcggcgccgagcaggtcgacgagtggcgtgaggtctacgacgcccactaccggcgcgaggccgaggagggcgagttcggcgagaacttctccggctggttcagcagttacgacggcgagcccatcgccctggagcagatgcggcggtggcgggccgagaccgtggaccgcatcctcgccctggaaccggcgcgggtcctggaactcggtgtcggcaacggcctgatcctggcgaaggtcgccccgcacgtgcggacgtatctcgggaccgacttctccgccgaggcgatcgaggccctgcgcgcccaggtggcgcgggagccggagctcgccgggcgggtggaactgcggaccggggccgcccacgagacggacggcctgccgcagggcttcttcgatctcgtggtggtcaactccgtcgcccagtacttccccgacgccgcctatctggaggacgtggtgcgccgggccgccgccctggtggccccgggcggcaccgtgttcgtcggcgacctgcgcaatctgcggacgtcgcgtgccttcggcaccggggtctcgctgcaccggtggtccccggacgaggggaccgccgccctgcgccgcacggtggagcagagcgtggtgatggagaaggagctcctggtcgacccggccttcttcaccgcgctggcggccaccgtgcccggcctggagcccgacgtccggatcaagcggtccggcgcggacaacgagctggcccggcaccgctacgacgtggtcctgcgcaccggccgtacggcgcgatccgagccggccgcgaggacccttccgtgggcgtcggtggccggtggactcgacggcctgacacgggagttgaccgacacgcccacagcgctccgcgtcaccggggtacccaacgcccggctcgccggtgagctgg

SEQ ID NO: 3607 - DNA, 2593 bp, Unknown
  Kingdom: Bacteria, Phylum: Actinobacteria, Class: Actinobacteria, Order: Streptomycetales, Family: Streptomycetaceae, Genus: Streptomyces
gtggccgcgcggccacgggtgctgttgacggtgcgcccccggacgatcccgatgaactcctccaccaggtcgggggtgacctccgcctcgggccaggacagggcgacgcgtgactcgggggcgtccgggaccggacggtaggtgaggtccttgcggtggtggaggcgggccagggactgcgggacgaggaggacgcccacgcccgccgccaccagctcgatcgcgtccgccgtggtcgccgggcgctcgacggcgggacggccgggcagggtctcccagtcgaggaggtcgtccagcgggtgcagcacgatctcgtcggacagttcggcgagcgacacctcctccgcggcggtcgcgacgtggtccttggggaccacgacgacggtcgtctcggtgtagagggggatcgcgctcaggacgctccggtcgaccgggagccggacgagaccggcgtcggcgccgccgcccgccagcaggcccggagcctcgctggcggtggcctggaccagttccagagaggtgtggggcagccgctcgcgccagaccctcacccacttggtgggcgtcacgccgggaacgtacgcgagcctgaaggatgaggggatgtccgagcctgtcacggaaccaggctaccggcaggtggtcggaggtatgtcccatggtcgataccctggacccatgacgtcgcacaagaccgcccagaccatgaagcccgccacggcggcgaagaagctgggtgtgtacctccaggccacccccgccgagttccaggagggtgccgtctcccgcaccgagctgaacgccctccagaccgacccgcccgcgtggctggtggagctgcgccgcaccggcccgcacccgcgcccggtcgtcgccgcgaagctcggcatctccatcgcgggtctcgcccgcggcggggtcaccgagccgctcaccaccgagcagatcgacgcgctgaaggacgagatgcccgagtggctcgagaaggagcgcgccacgcaggccgaggtgcgcaaggagaccgctcggatcaaggagcgcaacgccgagcgggccgcgcagtccggcgatcagtagtccggcgaccggcgcgcgtgaacgacgcgcgcgcctggggcgtgtccggcggatcagggccggcggccacggccctgagggaactggcccatgctgaccgcgcggtgaatcgtcgcggccagttcccgcgcgtcctcggtgaacgtgtcgacccggatcttccgtgcgtcgcgcagttcgatggcgaaaccgaagcccgtcccccgggcctcggccagcgggcggccgtcctcggccgaggcggagccgatccgctcgatgtccgtccagggaatcagggtggcgttgcccgcgacccggtgcgtcagcccccgctcgtggacgtcgaagcactgttcccgcgtgcggcgggcctgcgtcaggcgccataccccgaggcccagtccgaccagtcccactccgagcagcagacccgccagctcgggtgcgccgtcggtggtgccgatggaggcgatggtcacgggcactccgaaggcgaggccgacgacaccggtgaccagcagggcaccggccagccgtagacgtctgctcccgtcagtgcggtgctcgcggacgaatccgcccagctcccgtgcggcatcggtgcgtcgcatcacgtctcccccgtcgtgtacacatcagattctgcccgagtgcgtggggagtgtcagggaaaccggcgggcgcatgccacgggcccgcggccggtccgccccgccgacgcgtacgtcggtggaacggccctgccgcgggcccgtcgggttaccggaccggtcagagaacgccggactcggcgatggtgaccttggcgctggtgcggccgctggaggagccgagcgcctcgatcttgcggaccagagccatgctgtcgtcgtcggcgacctcgccgaagaccacgtgcttgccgtccagccacggggtgagcaccgtggtgatgaagaactgcgaaccgttggtgttctttccggcgttggccatcgagagcaggccaacgcggtcgtgcttgagcttgaagttctcgtcggcgaacttctcgccgtagatgctcttgccgccggtgccgtcaccgcgggtgaagtcgccgccctggagcatgaagtccgtgatgacgcggtggaaggacgagccggcgtagccgaagcccttctcgccggtggcgagcgcgcggaagttctccgccgtcttggggacgacgtcgtcgaacaggttgaacgtgatacgccctgcgggcgcgtcgtcgatggtgatgtcgaagtagaccttggttgtcatggtgacatcctcacattcctggcaaccgcaggtgaaacccgggttgggtcggcacgtcggatgtcctgttccgctcacctcccggcggtctccccgcgggccgcatagacggcgttcaccagggccgtcttgcgcgggtcgtcggcgagccgggagcccatccggttcatgacgtacccgagggcgattccggcatccgggtcggccaggccacaggagccgcccgcgccgtcgtggccgagcgcgcgcgggctggggccgtagg

SEQ ID NO: 3608 - DNA, 2440 bp, Unknown
  Kingdom: Bacteria, Phylum: Actinobacteria, Class: Actinobacteria, Order: Streptomycetales, Family: Streptomycetaceae, Genus: Streptomyces
gagccagccgccgtgcaccccgcagcactgcccggcaacggggcacgcgtcgtggcgcgcccggtccaggagcgccccggtgggcgtgcggacagcggcgtacagaaatccgaccaggaggacaccactcgtgggtactgaccgccgtccgggcggccaagggcgggcggtgcggatgtccgcgctgctgggctgcggcatcgtcgtgctggccggctgcggctcgatgccggtgaccggggacgtcaaggcggtcgacgcctcgcagcccggggactcccaggtgcaggtgtacgcggtggcaccccgggaaggcgcgccgcccagcgagatcgtcgacggcttcctggagtcgatgaccagtgatgatcccgcgttcgcgaccacgcggaagtatctgagcgccgacgcccggcgtacctggcggccggacggaggcaccacggtgctcgcccaggcccccacccgcagcggtcccctgctccacgacggggacgaccgggccacccgggacaaggcgacgacttacacgctcaccggcgagaaggtggccgcggtcgatgcccagagctcctaccgtccgctcgcgcccaccgactactcccagaccctgcacctggtgctggagaagggggcggacgggaagcaggaatggcgcatcgacgtcgtgccggacggcctcgtactcgggcagtccgacttcaagcggctctaccgctccgtgaacaagtactacttcgccaccggacgcacgaacgggcggtcgacgctcgtcgcggaccccgtctacgtacgcaaccgtacggacccggtcacgcgtatggacaccgccacgcagaccgtccggacgctgctcgccgggccgacgaactggctgcggcccgtggtcgactcccggttcccgacggggaccgccctgcgcaagggcgttgtcgcgctgccgccggacgaccagaacgttctgaaggtgccgctcaacgacaaggccgacaaggcgagccccagtgcctgccggatgatggccgcacaggtgctgttcaccctcggggacctgacctcggcgcgggtcgagcgggtggagttggagggcggcgagggtcagctctgtgcgctggacgccgacgacgcaccggagttctccgccgaccaaggctccgacggggacgacagccagtacttcatcaacgacaagggccaggtggagcagatccccggtgccaccgacggcaccggaacacccgagcccgtgaccggcccgctcggttcgggcgccgtcccgatgggtgccgtcggggtggcccgggacgaacagcgggccgccgcggtctcctcccacgggcagcacctctacgtggcctccctggagacggagggcgaactgaccgaccccctcgtcagcagcaaggcgaagaaggccgccgaccggctgtcgtcgccgagctgggacggccgcggcgacctgtgggtcgccgaccgcgatccggccggtcccagactgctgcggctcaccgggggtacgggcgagccgcaggaggtccgggtgccgggtctcgacggcgcccggatcgaggagctgcggatgtccgcggacggggtgcggatcgctctgctgctgaggaaggacggccgtacgacgctgaacatcgggcgggtcgagcgtcgggggtcctccgtggagcccgagatctcggtcgaggacctgcgtcaggccgcaccgcagctcacggacgtgacggccatctcctggtccggacgcagccggctggtggtcgtcggcaaggaggagggcggtgtccagcaggtgcgttacgtgcaggcggacggttccacgtcggcctcggggtcgttgccgggggtgaaccaggtccagtcggtcgccgcggcggacgacgagctgcttccgctgatggcggagaccgtcggcgacggcatagtgaagctctcgccgggggacaactggcagacggttctcaaacagggcacgtcgttggtctaccccggctgatccggcagccgggcggtgttccgccggacacccgggtctatccacaggggtggtccggttccggcggtcccggcactgtggggtcatgcggaacgtgtggcaggaactgtccggcctgcttctgccggtggcctgcgccggctgcggcaggccgcgcaccgagctgtgcacggcctgcggggccgcgttgcacggtgcgcccgctcgcctggtccgaccctcgccccggcccccggggcttccggcggtgtacgcggccgcgccgtacgagaacgccgtacgcgcggtgctgctggcccacaaggagcgaggggcactggggctggccggggcgctcggacgggctctggcgggttgtgtacgggccggggcggggcggccgggaggtgcgggtcccctgctgttggtccccgtgccctccgcgcgctcctcgac

SEQ ID NO: 3609 - DNA, 5247 bp, Unknown
  Kingdom: Bacteria, Phylum: Actinobacteria, Class: Actinobacteria, Order: Streptomycetales, Family: Streptomycetaceae, Genus: Streptomyces
ccaggagtacgagcggatcgcccggctcgcgggcctggcggcgggcacctccgccgacaacgagcgcaagatgcgcctggaggcgtacgtcctggccgcccgcctcgaacaggtggccgccgccgccaccgcacggctgcggcggatgtcctccggccgctacaccctcgtccactccgacgcccgcaccggcggccgcagggccgggctcggactgcatgtggtggacgcctggaccggcagcgaacgggacaccgcgacgctgtccggcggggagacgttcttcgcctcgctggctctcgcgctgggcctcgccgacgtcgtgaccgaggaggccggcggcgtacggctggacaccctcttcatcgacgaggggttcggcagcctggacgaccagaccctggacgaggtgctcgacgtgctggactccctgcgggagcgggaccgcagcgtgggcatcgtcagccatgtggccgacctgcgccgccggatcccggtccggctggaggtggtgaaggagcgtcagggctcctccgtccgccaccgcctgtgaccggcacgcccccgcggacactttgtcgggtcagtggccgatcgcccggcgcgggagcggcgaggagtacacgacgctggtggtgacggagcccagtgcgccgatccgcccggtggtctcctccagatgtttcatcgaacgggccgtgaccttgaggacgaagcagtcgtcgccggtgacgtggtgggcctcgatgatctccggagtggtctccaggagatcgtggaagggcttgtagttcccgttggggtagcgcaggcgcaccagggcgagaaggggcaacccgagccgctcggcgtcgaccaccgccgcgtacccgctgatcacccccagctcctccagccggcgcacccgctccgtcacggcgctcggggacatggccacggcgcgtgcgagctcggcgaaagtggcgcggccgtcgcgctggaggacgtcgagaatgcgccagtcggtggcgtccggggaatagtcggtcactcatcgagagaacagggaaatacccggcgaatcaagaggagtgccggggaatctcacttcccggtcccgttccgcggtcatagattcacggtcatgacctcgcacatcacggccacggccgaccatcccgtcctgcgcgtcgcgcccgcttctcccgccgccgcggcggcccacttcggcgcctcgctcgccttccacgccgacgtctccgacgtcgcctccacgctcgccgccgacggggatcccgggttcgtcgtcctggacagccgctccaccgcgtcctgggaccagggacgtgtgcccggggcggtgcacctgcccaccgcgctgatccccgggcgggcggcggcgctgctggacccggccgtccccgtcatcacgtactgctggggcccgggctgcaacggggcgacccgcgcggccctggccctcgcccaactgggctaccgggtcaaggagatgctcggcggtttcgagtactgggtgcgcgagggattcgccttcgagacctcccggggcgtcgagcggcgcggagccgacccgctcaccgcgccgggcgacgacgccgcctgcggctgctgagaccaggggccgggcggaggtcagtgcggttcgaagcccgccagcgcggcgaacaggcctccggcctccgacccggcggggagtccgctgacctggccgtcgccgacctccaccacccgccacaccccgtcctcgcgcaacgccacgtcggtggtgacccagcgcagtccgaggcggcccaccgcctcccgcaggaaggccggctcggggacgggcgccgagccgggggtgtcgggatgggcggtgacgagcaccgcctccccgtccacccaccacactcgcgcctcgccgcccgcgacgaacggctcgaaggaccgcagcaccaggccgcccgagaggaacgcgccctgcagctccatgaaccggccgaccacggaggccaggtgctccccgtccgccagctccggcacgtaacacgcttcgtgccactcgtgcttgcgggacttcacgaagtccttcacgatgccgggccccggccccaggggtgcggcgagcccggtcagctcgtccgcggtgggtgacggagcccccggagtcatggcgcaccacacgctgcgcggcgtgagcgcgtcgaactccgcgtaccaaccggggagttcatgcgcccgccggtagccggcggcgccggtgagcagggcgcagccccggtcgccgagcgccgcctccagttccgcgtaccgggcggaggggatcatccagccccggtaccagtacggtccggagtcccgcgcgacccgggccaccgctccggccgcgtcacccgcgagcagcgcgtcatgatcgagcagcgcgatccgcccgccggccgcacgcgcctccgcgacctcgccggcgaactgcgggtcgggccgggagagccgcaacgggtcggcgcagaacaggaatccgttccgctcgctcatgacaggctgcctcactctcacggacaggggctccggaccgtacacatcacgcggatcagagccgcgacaactcgtccaccagatcgtccaggcccagcgacccctgcgagagcgccgccatgtgccaggccttcaggtcgaacgcgtcgccatgtgcggcgcgcgcgttctcccggccgagcagccaggcgcgctccccgagcttgtagccgatggcctggcccggcatcgacagatagcgggtcagctcgctctccacgaagtcggcgggacggccgctgtggttgccgaagaactcctgggccagatcaggtgtccagcgttcgcccgggtggaagggggagtccgccggaatctccagctccaggtgcatgccgatgtcgacgatcacccggcaggcgcgcatcatctgggcgtccagatagccgagccgccgttccgcgtcgggcaggaagcccagctcgtccatcagccgctccgcgtacagcgcccagccctcggcgttcgcgctgaccatgccgaccgacgcctggtagcgggagaggctgtcggcgacgtgcgtccactgcgcgatctgcaggtggtggccgggaacgccctcgtggtaccaggtcgagaccaggtcgtacaccgggaaacgggtctcgcccatggtgggcagccaggtccgcccgggacgggagaagtcctcggagggaccggtgtagtacggcgcggcggccccaccgggcggtgcgatgcgggactccaccttccgtacccgctcggcgaggtcgaagtgtgtgccgtccagcgcctcgatcgcctcgtccatcagaccctgcagccactcgcggacctcgtccacgccctcgatgtgcttgccgtgcacgtcgaggtgggcgagcgcctcccaggggccggcgccgggcaggatcttctcggcctcggtcctcatctcggcgagcagccggtggtattcggaccagccgtacgcgtacgcctcgtcgagatccaggtcggtgccgttgtacagccgcgaccagagggcgtagcgctcccggccgaccgggtccggcgctccctcgatgcccggggcgtacacgtcgcgcacccagtcccgcagggagagcaccgaggcggtcgccagcccggcggcctcgtccagctccgcccgcagggacgcggggccgggagcgacgaactccgcgaagaacgccgtgccttcgccttccccgccccactccgtgagctgcccgacgaaggtggcggtcgcgcggggaccgccgtacagcttgcgctccagaccgagcgcgagcgaggcgcggtacccctcgtgcgcggcgggtaccgcgcgcagccgttccacgaccgccgcccagtcctcgtccgtcgcggtcggcgtgagcgtgaagacctcggtgatgctgtgggccggcgactgcaggttggagacggtccgcagtccctcctcggcctcgtgcacggcgagttccgccgtcagacgttcccgcaggaggcgtccgcagcgccgctcggcatcgctgtccgcaccgggacgccgctcggcggcgtccagcttccgcaacgtcgcgcggatgaggtcggcgaccgcggcctggcccgccggtgagaagtcgggcagccgacgcgagctttcggacacacccagataggtgcccgtgatggggtcgagttcgatgattgcgtcgacgtaggcgtcggcgacctgacggggcagcgcgctgctcgaagtgtctgacatgcggacatcctcgtacggcggtggcctcctcgtcatcaccagggtccccgggcgtccgaaagacgatcacttccagcacgtccgggtcttccggcgggcgtcgccggtgcgcgtctccggcatgttcgtggactcagctcgcggcgggaggaagcagcggcccgcagtcccactgctggaagatcaaccgggtgtccacccgggccacctcccggcgcgaggtgaactcgtccagcaccagccgctgcagatccgccgcgtcggccacggcgacctgcaccagatagtcgtcggggccggtgaggtggaagagcgcacgcgactccggcagggacctgacgcggtcgacgaacggcccgatgagctcccggcggtgcggccggacctgcaccaggagcagggcctggagaccccggccgatcttcgccggatcgaggcgcagctggtccccgaggatcaccccggaccggcgcagccgggccacccggtccaggcaggtcgaagcggccacgccgacctcggccgcgagctcgcggtacgtggtccgggcatcgttctgcagcagccgcagaatctgcagatccaccggatcgagagcgacggaatcggacatgcggcgaacgtagcacggggttcggccgctacgaaccggtagctgttcagagtgatggcatggacaacgaagtctcgatgacgccccctgcccccaccccgtccagggctctcgccaccgaagccgtgcacgccggacgcgacgacctcgcctccctcggcctgcacgccccgccgatcgacctgtccaccacctacccctcctacgactcgcgcggcgaggcgatgcggatcgacgccttcgccaccaccggcgcccgccccgacgggccgcccgtctacgcccggctggacaaccccaccacgggtcgcttcgagacggcgctcgcccggctggagggcgccgagagcgcggtcgccttcgccagcgggatggc

SEQ ID NO: 3610 - DNA, 3159 bp, Unknown
  Kingdom: Bacteria, Phylum: Actinobacteria, Class: Actinobacteria, Order: Streptomycetales, Family: Streptomycetaceae, Genus: Streptomyces
cgcccgaggcccgagccgcccgcttgcgccgccgacgccggtccccgcgcgcccggatctgctcggcggccagcggcacggcgccctgccgtccgtcggcggcgaggtcggcgagccgctcgtccaaaccggtgtcctcaaccacgctccacctccgaaacccggcccgcccgcggatccagctcagtatcggccagaatcctcgccagcgcggtacgtccccggctcagctgcgccttgaccgtaccgacgggagagccggtctcctcggcgacctgcttcacttcgagatcgcacaggtggtggagcacgacgacccgtcgctgcgctgcggggatctgcttcaacgccgccaccagcagcacatgatgatcgtccggcggcggtacgtccgggggtggaccctggcgcttcgcgaaggtgagggaggtgcgtacccgacgccaccggctgaccgccagccggtaggccacggtacgcacccacgcctccggcgcaccgtccttgtccagtgcggcccggcgctcccaggcccgtacgaaggcttcctggaccacgtcctgcgcctcggcgcggtcaccgatcatggcgtacagctggccgatgagccgccccacacttccggcgtaaaaggcgtcgaacgcctgctcgtccatccccacctggtctttggaggtcgcacccacttgaggcggcacacatattcggccgtgcgaacactgccacccggcactcgtgccgggcaaggaccgagtgtgtcaccggtaccgggtgctggccccaccctcgatcatccggacagccggatggccgggagggcgcctcgtcggggaacgtgagggtctcccggcaagtcgtcgacagagaaggcaagatcgtgcgcattgttacggccgccgccgtcgccctggccctcgccggtggagccgctccggccgccaccgcccaccagccgaccacccacggaacctggcgcatggacggctacggcaccgtgctctccatccggaacggcaccttccaggagtaccagaccaccgccgtcagttgcgtcgagggcgactcggcgcagcgcaccgggcccggcgtctacaccatgcccgacggcaccgacctcaccgtgcgtaccgacggagggcccgaccgcgcgtccgtgcgggcggacggctccgtcggcgaccggaagctgagccggatcccggagttgcccggcgcctgcacgagtgcggcccccgagggagcgctcgccgccttcgacgtcttctggcagtccttcgaggagaactaccccttcttctccgccaagggcgtcgactggcacgcccaacgcgaccgctaccggcctacggtggacgccaggacgacccaggacgagctgttcgccgtcttcagcgagatggtcgagccgctccacgacgcccatgtcgccgtccaggacggcgaccgcgtcttcgcccggccccgtcccggcaccgtcgtgcccaacgggaagctggacgccaggatcaagaagttcatcgtggagcgcgacctcgcgaacgcccggaatcttcaggacttcgccgacggccggatcacctacgccgaccttcccggcggtcagggctatctgcggatctccggcttcggcgggtttgcgggcgacgacacgtcccacgccgcccaactggccgagctcgaccgggcgctggacgcggtcctcggcggggaacgctcccggcgcccgaagagcctgatcatcgacctgcggatcaacggcggcggctccgacgccctgggaatccacatcgccgagcgcctcaccgacttcccttacgtcgcctactccaagcgggcccgcaacgacctcgccgacccctcggggcacacgcacccccaacccgtgcacgtcacccccgcccagggaccccgtcacaccggaccggtcgccctgctgaccggcggctccaccttcagcgcgggggagaccttcgtccaggccctcatggaccggcccggcaggacggtccggatcgggcagcccacacagggggtcttctcggacgtcatgacgcgcaagctgccgggtggcatggcggcctggctgccgaacgaggagttcctgacccgctcgggcaggaccttcgacggcacaggcgttccgccgcacctcaccgagccggtcttcacgaaggaggagttcgacgggaagagggactcggccttcgacagggccgtgaacgtgctgcggcaccgcggcggtgccacgggatgaggcgggaaacggcggagcttccggccggccgggctcacgccgccgtatcggcccaggagacggcgaagtacttgacgcgttcgtcctccccgaccggacgcattcccgccgccgtcatcacgtggtgcgacgcgatgttgtcgtggtcggcgtcgcccttcaccgaggcgacgccgttggcccgggcgaacgacagcagcgcgcggagagcttcggaggcgtagcccctgccctgggccgatgggacgacgccgtagccgatcgtgacgtggccgtgctcgtccggaggggtgtggaaatccacgccgccgatcacccgccggtccgagcggcggcgtatcacgtacgggccgaacggctggggatcgccggtggtcgcgcagcgttccaggaggcgcttggccacggacacgtcgtcctcggtcgggaatcccgcctcccaggccgcgtcggcggccggctcgcccgccaccatccgttcggcctcgtccacggatatcgggtgcagtacgagccgctcggtcaccaggtcagtcatggcagggaggtctaccacgcggcacggacgggccgcgcgtggatttccggccgagggacacccgccgggctgcctcagggacacccttctcggtgctgcctcagggacttctgcggcgggacgaccaccccgtacaggtcgccggtggtggccagggcggcgtggtgcacctgccgggcgtcgaggtcgtcctggccgccgggtccatggaccccgtcaccacctgcgccggggtacgcgtccttccggaccgccccttccgggaggccgtcggcggagccgacgggtcgcctccgtctgcgtcggagcgcatctgccggccgccgccgggctggccgccggcagatgcgctccgacgcagacggag

SEQ ID NO: 3611 - DNA, 2945 bp, Unknown
  Kingdom: Bacteria, Phylum: Actinobacteria, Class: Actinobacteria, Order: Streptomycetales, Family: Streptomycetaceae, Genus: Streptomyces
gcggtgaaccgctccagcgtgtccgccgcgtgccgacgggagtacgcgcgacgctcccgcgcgatccactcgtcgaggcgtgcggtgtccgagccggccgctcgtcccccgtgctccgtctcgacgacgagcgccgcgagatggccgggcagcgccgcgcggacggaatgccgttcccgcgcgtcgcccaccaacacgaccaggcgggcgccggtcgtgccggcggcgtcctcgactgccgcggccacggtacgggcgttctcctcccacgtgttctcgacgctcagctggaagtggcgctcggaccagtcggcggaggccgtgcggtgcacgggccagtcgcggccccgcaccgcaccgagcgggctgcgtgcggacgatgtccgcagctcgatgtcggcaccgaggcgatcgatgtgcacgaccagggtgtccggctcatcaggagtcagctcgaccagtggtgctacgtgtgggagaggcgcccagacgctggaggactcgccgggcggtggaacgctcaggacgggatccagtacgacctcgccgtgggcggcgaacagggccctgcccggggtgtgctcgccgaagtcgtacgagccgatcgtccggcgcacggcccggcaggtctcctgatccgccccttgcgcggccagttcctcgctgatctgccgtcctttgagctcccggcggctcagcgtggcctcgtcggcgatcgaggtgtcgagataggccgtggcccatgggcccgggagctcgtacaggggtgccagttgcgcgagatccatggtttcctcccggtctgtcggggtgggctcgacgcggtcgggtaccccaatcagccgcggttacacacacgccgggtcgcacgccgccgcgctctcggactggatgttgatcccgtttggggtccttgcgaaagggaactcggctcggcggccgagcggtggcccgtggggtcgggtcgcggagcgcgggatcaggggttctgctccgcggcccgtccctggccccggacccgtcggcggcctcgcggccaggtcgggcggtgagtttccactttccgcagctcccccgaattttgcacgtttagtcagcattcgtacgggtatgcgagtaatgcgcttcggacatgaggcgcgcccgtgggagttccgggcggcatgtgtccgactccgcgcactcctacggcggctcaacgtaaccgtcgtcgaggagtgaactcgcatgcaggctgcatctggccacgagcgacgtgcggacggggacgactcagctgcacacgaggcattccggaggctgagagcgttgcctccgggccgggagcgggacaagctgcgcagcgatctggtctgtgcgtggctgccgatggctcaccggatagcgtcgcggttccgcgaccggggggaggcgatggacgaccttcggcaagtggccgccatgggcctcgtcaaggccgtggaccgttacgacccgctccgcggcaaggcgttcgagacgtacgcggttccgaccatcacgggcgagctgaagcggcacttccgcgatcacacctgggacgtccacgtgccgcgccgcgtccaggatctgcgcaaccaggtcaggacggtccggcgtgagctgagccagaccgcgggtgggcgcgcgccgacctgcgctcagatcgcctccgcggccgggctcagcgaggaggacgtactgctgggcctggaggcgctggagagctacagcgccctctccctggacgccgaaccggcaggcgcggaaggcggcagcccgctgtccgagcgactggggaccaccgatcgggccctggacgtcgccgtcgaccgggaagcagtgaagccgggcctgcgcaagctgccggagcgggagcgcaccatcctctacctccgcttcttccgcgacatgacgcaggtgagcatcgccgaacgcctcggcatctcccagatgcacgtctcacgcctgctcagccagtcctgcgagcggctgcgcgacgacgccctccagggagcggcatgacagcccccacgccgcttccacgccgatcgggcgaccggcggccggtaccctcgctcacgccccccgtgcgggtcagcaggccatgaggacggcgctcgcccgcgtaaccccgcgcatgcaccggcccgacacgtaccaggtgacacagtccctgaaggcggccgccgcggccatcgtcgcgtggtcgctgaccggctggtggctgacggcgcccatggcgctgatggctccctgggcggctgtggcactggtgcaggggaccgtctaccggtccgtgcgcaccgcgtcccagctcctcctgatgatcacggccggaaccctgatcgccgccggtgccgccgccctcacgggaaacacgatgaccgccatggtcatcgccctccccctcaccgtgttgctcggcaacctggcgccggtcggcggccagggcctgtacgcaccgaccaccgccctcttcgtgctggcctacggctcgtactcgttgccggccgtcgggcaccgtctgctggagacggccgtgggagccgccgtgggcatcgcggtgaacgccgcgatcctgccgcgcatgctcgccaccgccgatctggtcgacgcctccatcaccaaggcgggcgtgagcgcaccgctgatggtgatgcgctgcgacggcggggtgatgtcgctggacgagatgcggcgcagaccgctgctgacggtgctgtccggaccggcggccggcgtcgccggcgcgctgatgcaggagcgcatcagcgagggtctgttcctggagaccggcggcacgtccacggacatcagcgtcgtgcggcggggcaaggtcgccgtccggcacgccaccatgctcggccggacgtcgtacctctcggcgctggacgtgcggaccgtcgatccgccgccgaccccgacggtccgcacgtccagcgccg

SEQ ID NO: 3612 - DNA, 1949 bp, Unknown
  Kingdom: Bacteria, Phylum: Actinobacteria, Class: Actinobacteria, Order: Streptomycetales, Family: Streptomycetaceae, Genus: Streptomyces
gcccgctgctcggccgtgccctcggcggcgacggtcggcccggcgtgcagcagcccgacgaagttcgccccgacgtagggagcgccggccttctccgtctcctccaggtagatcaggtgctgggtcggggtcgcgccccgcccgcccgcgtccaccggccagtgcaggcccgcgtacccggcgtcgtacagcatccgctgccaggtggtgtcgtacgcccggcgcgcgggccagtcgccggacgagggcttcgggggcaggcccgggagcacgccggtcagccactcccgcagccgccgccggaactcctcctcggcctccgtgtacgcgagatccacgactccgccgcctacttgtcgaggtccaggccgagcatccggatcgcgtttccgcgcatcagtttgtggacggtctcctcgtccagtcccttgacgtggtcgagagcaacctccttggtgtgcgggaaggtcgagtccacgtgcgggtagtcggtctcgaaggtggcgttgtcgcggccgacgacgtccagcgcggagatgccgtgcttgtcgcggaagaagcagcagaacatctgccggtagtagtacgtggacggcggctcggggatcagatcgcgcaccccgccccaggcccggtgctcctcccagacgtcgtcggcgcgctccagggcgtacgggatccatcccatctggccctcgctgtacgccagtttcagcgtcgggaacttcaccagcaccccgctgaagaggaagtccatcatcgaggccatcgcgttgttgaaggagagcgaggcctgcacggccgggggtgcgtccggggaggcggcgggcatctgggagctggagccgatgtgcatgttgacgaccgtgccggtctcctggcagacggcgaagaacgggtcccagtagccggtgtggatggacggcaggccgaggtacgtggggatctccgagaaggtgaccgcgcgcacgccccgggccgcgttgcggcggatctcggcgacggcgaggccgatgtcccagagcgggatgacacagagcgggatcagccggccgccgctgtcgccgcaccactcctcgaccatccagtcgttgtaggcgcgcacacaggcgagggcgacctccttgtcgtgcgcctcggcgaacgtctgcccgcagaagcgcgggaaggtcgggaagcagagggaggcctcgacgtggttgaggtccatgtccttgaggcgttctgcggggtcccagcagccgggccgcatctcggcgcgggtgatgccctccagggtcatgtcgtcgcggtcgaagccgacggcggcgatgttccgcttgtacgggaacttcaggtcctcgtagatccaccagtccgtcggcggcccgtccgggtccatcgtgatgacgtacttcccgcccgtgtacgccagctccccgatgcccgcggtgagcggctggggaccgcgctcgcggtacttcgccggcagccaggtggagaagaggtgcgcgggctcgatcacatggtcgtcgacgctgacgatccgaggcagttccgtcatggtgtcgtcccctccggcgcacccggcgaggtcccgggtgcgggcgtttcctgatgacccgtcagattcgcttgcggcactcaggctagctccgcacccctggaccgacaaggcgcggagccctacgctctccgcattatctgactggccgtcagttcggagggaccgctgtgaccgccgtgaacgacgtgaccgcatccgcccacgccctgggcgcctcccgcaccttctgggagctgaccgaacgccgcgccgccctcagccccgaccgcccggtcctgctccaggaggaccggagcctgaccttcggcgagctgcgggaccgcgccgagcgggtcgccgccgggctgtacgggatgggcgtgcgcgcgggcagcgtggtggcctggcagctgccgacccggct

SEQ ID NO: 3613 - DNA, 2900 bp, Unknown
  Kingdom: Bacteria, Phylum: Actinobacteria, Class: Actinobacteria, Order: Streptomycetales, Family: Streptomycetaceae, Genus: Streptomyces
  misc_feature (390)..(391): n is a, c, g, or t
aacgccgacccctgcgccgccgggtccgccgccagctccgccgagctcaccggctccagcagcgccgccagatacgactgcgccacgaacaggacaccggccagcaccagacagaacaacaccgcccgcgccaccttctgcgagccgcccgtcacctcctcggcgaacgaggcgatggcgtcgaagcccagataggagagcacggcgatcgacacggcccccagcacggccgccatggagaacccggtgtcccccgtcagcggcgtcagccagccgcgctgcgccccgtcccgtacgaggacgaccacggccgagaccgcgaagaccagcagcaccacgatctccatggccagcaccgcgaagcccacccgggcggccgcccgtacgccnnggcgtacgggcggccgcccgtacgccccacaggttgagcagggtggtcacgaggaccgcgatcgcggtccacacccaccgcgagacctccgggaccagcgcgttcatcgcgatcccggagaagaggtaggcgacggccgggatcagcaggtagtcgagcatggccatccacccggcgatgaaccccggcccttccccgagccccttgcgggcatacgtgaagaccgaaccggcgaagggggcgacccgcaccatctgggcgtaactgaaggcggtgaagcccatcaccaccgtggccaccacatagacgagcgcgaccgcgccgtcggacttcgcgtccagggtgccgaacaccccgacgggggccatcggggcgatgaagaggagcccgtagacgaccagatcccggaaccccagcgtccgccgcagcctgcccggttccgtactgctccccgcaccgctgcccgtcccgctgcccggaccgctctccggcaccgacgtcatagcccctccatcaccatccgtcatgactcacgaacgcaccgcgcccagtctcccgacccggccgtcctcgcgcctgttcgccacggccttacgatgggacgcatgactgcaactcctgcccgccgtgtcctgctcgccgcaccccgtggctactgcgcgggcgtggaccgtgccgtgatcgccgtcgagaaggccctggagcagtacggggccccgatctacgtgcgccacgagatcgtgcacaacaagtacgtcgtgcagaccctggagaagaagggtgcgatcttcgtggacgtcaccgcggaggtgcccgagggctccatcgtgatgttctccgcgcacggagtcgcgcccaccgtccacgcggaggccgccgagcgcaagctcgccaccatcgacgcgacctgcccgctggtcaccaaggtccacaaggaagccgtccggtacgccaaggaggactacgacatcctcctgatcggccatgagggtcacgaggaggtcatcggcacctccggtgaggcccccgaccacatcacgctggtcgacggccccgaggacgtcgcgaacgtcgaggtccgcgacgagtcgaaggtcgtctggctctcccagaccaccctgtccgtcgacgagacgatggaaacggtcgacgccatcaaggcgaagttccccaacctcctctcgccgcccagcgacgacatctgctacgccacgcagaaccgccagatcgcggtgaagaagctcgccgaggacgccgagctggtcatcgtggtcggctccaagaactcctcgaactccattcgcatggtcgaggtcgccctggacgccggagcccccgccgcccacctggtcgacttcgccgacgagatcgacgaggcctggctggagggcgtgaccacggtcggcctgacctcgggcgcctccgtccccgacgtcctcgtcgacggcgtcctggaatggctcggcgagcgtggttacgcggacgtggagacggtgaagacggccgacgagtcgatcacgttctccctccccaaggagctgcgacgcgacctgcgcgccgaggccgccgccctttccgccgagtagccgcgcaaggggcccggcctgcccgtaccgtgggttccatggagatcttcggcgtggacatcggcggatccgggatcaagggcgctcccgtggacctggaccgcggagacctggcgcaggagcgccacaaagtgctgacaccgcacccggccacgcccaagggcgtggccgacggcgtggccgaggtcgtaggtcatttcaactggacgggccccgtcggcatcaccttccccggggtcgtcacggacggcatcacgcgcaccgcggccaatgtcgacaagggctggatcgacacggacgcccgcaccctgctgggcgagcggatcggccagcccgtcaccatcctgaacgacgccgacgcggccggggtcgccgagatgaccttcggcgcgggcaagggccgcacgggcacggtcatcctgctgaccttcggcacgggcatcggcagcgcggtcttcaccggcggccggctcgtccccaacaccgagctgggccacctggaactgcacggccacgaggcggagaagcacgcctccacgaaggccaaggaggacgaggacctgagctggcagcactgggcgcaccgggtccagaagtacctgctgcacgtggagatgctgttctcgcccgagctgttcatcatcgggggtggcgtgagccgcaaggcggagaagttcctgcctctgatcgagaaggtccgggccgagatggtcccggcgcagcttcagaacaacgcgggcatcgtgggagcggcgatggcggcggcgggccaggcacaccacgagagctgaacgggacagacggcgtcacgggcccgcgtaccggtggcggcaccggcgagggcaccggcggtgacagcggcgacgggtcgagacccgctcagggccgctgaggacgacgggcaactgcctctgcccctaccc

SEQ ID NO: 3614 - DNA, 1541 bp, Unknown
  Kingdom: Bacteria, Phylum: Actinobacteria, Class: Actinobacteria, Order: Streptomycetales, Family: Streptomycetaceae, Genus: Streptomyces
cgccggactccaggaccgttacggcggcggcctggccgggcggggcggcgcgccagaaggccaggttccagaccttggcgaccacgtacagcgtcagcaggctggtggccgccgagccggcgaccagcagccaggcccagccgccgccgtcggcgacgccggcgcgcatcagcccgagcttgccgatgaagccggagagcggggggattccggcgaggttcatcgcggggacgaagaacagcacggcgagcatcggcgcggccctggccagaccgccgagccgggtcagctccgtggtgccgccccggcgttcgatgagcccggcgacgaggaacagggtcgtctggacggtgatgtggtgggcgacgtacacgatggccccgccgtacgcctcgcgggtggcgaggccgatgccgaagaccatgtagccgatgtggctgatcagggtgaaggagagcagccgcttcaggtcggtctgggcgaccgcgccgaggatgccgatgaccatcgaggccagtgcgatggccatcaggaggtcgccgatgcggttgccggggaagagcagggtctcggtgcgcagcatgcagtagacgccgaccttggtgagcagtccggcgaagacggcggtcacgggggccggggcggtcgggtaggagtcggggagccaggcggccagcgggaagacggcggccttgatcgcgaagacggtcagcagcagcgcctggatcagggtctgtacgccgatggggaggtcggccagccgtcccgcgagctgggcgaagttcgcggtgccggtggccgcgtacgtcatggcgatggcggtgaggaagagcatcgaggagaacagcgagatgatcacgtaggtggagcccgcccgcatccggggtccggtgccgccgagggtcagcaggacgaagctggcgaccagcatgatctcgaagccgacgtagaggttgacgaggtcgccggcgaggaaggtgcaggagaccccggcgacgaggatcaggtaggcggggtggaagacggcgaggggggtctccttgtcccggtcggtcatgccctggccgagggagtagacgagtacgcagagcgtgatggccgaggagaccgtgagcatcagcccggacagccggtcggcgaccagggtgatgccgagcggcggggcgaagtcgccgaggtggacggagagcgggccctgccggtcggcggcgatcatgaggatcaccgagagcgcgagtacggcggacagcacggcgacgctgatgaagcgctggaagcgccccaggcgggtgccgaaggcgaggctgagtccggtggcgcacaggggcagcagcacgggcagcgggacgagcgcgttcatccgtcggctcctcggtcgcgggggtagcggtcgtccgccttggcgtcgccgtcgcgttcgtagtcctccgggtccgcacccagcacgtcgttccacaggttgccggaggcgtcgcggccccgggcctggcgggcgcggtcggcgcggagccggtcgcggagccggcggcgctcctcgcggt

SEQ ID NO: 3615 - DNA, 2098 bp, Unknown
  Kingdom: Bacteria, Phylum: Actinobacteria, Class: Actinobacteria, Order: Streptomycetales, Family: Streptomycetaceae, Genus: Streptomyces
cccgacatgatccgaacgagaggccctggcccccgcacaacgaacggcccgggcccccaccgaaggagacccgggccgaacgaacagcacaccgcacacagcgctacgggaacaccggcgccccatcacgcgtcagccgccaccccaccgaagcgaacaccgccggatccaccgaacccttcgcccgcacccacccgatgatcgtgttccggatctcgtccgaatccgcccacaactgctgcgcacccggcacatgcgggaagttccccccaccactcgcccggtagttgttcaccgcgaacacgaaccgcgccgccggatcgatcgccttcccctcgaaggacaacccgacgatccgcgaaccgaccggccgcgcgatgtcgatctcgtacgtcacccccgacaccgcgtcgtagttgtagtccggaatcccgtccgcattcgtcaacttcgccgtgtccaccggaccccccgccgccgtccgcacgaaataccgcgccgaatactccagatactccttcaactgcgcacccgtgagcagccgcgcctccagcgtgttctcgaacggatacaaccccgccgcatccttgatcgtcacctcaccggccggaatccccgccgtacgcgagaagcacgaagcctgcgacaacaccggcaacgccgcgtactccccacccgccagcgccgccttcaccgtctccgcctgcacctggttgatcagatcgatgatcggctcgtccttccacggcgcgtccgccgtcgacatcgccaccaccgacgtaccgatgacctggttgacgtactccacgaccttgcggtgctccgaccgcaacaacgacgtcaccttccggtcctccgccacggtattggagttcaacacccgcgaaccggccttctccaccgtccagcgacccttctcccacaccagatcgaaatcgaacagcgtcagccgctgcccccacttcgccggctccgagagcacgacccgcttcccggtctccttgttcgtcacgaaatgctcggcgatctccacatgcgcgtgccccaccagaatcgcgtcgatccccggcacctgctccgcgaccagcgccgccgcgttctccacatacggcaactgatccccccacgacgaagtccccgacgaacccgaatgcgcggagaccagaaccacgtccgcacccatcgaccgcagcttcggcacccacttcgccgcctgctcctccagacccgggaacaccatcttcccgcccacattcgccttgtcccagatcgcgacacccggattcgtcagccccagcaccgccacccgcacatcacgcccgtacggtgtgcgcatccgcttgatgacatacggggcgaacgccggccgcaacgtcttcgcatccagcgcattcgccccgagcaacggaaagtcgcactgctcctcgaatttccgcagcaccggaatgccgtaattgaactcgtgattcccgagcgcagccgcgtcgtaaccgatcgcgttcatcgcctgcgccatcggatgcaccggaccacgacgggccgtgatcggatcgaccttcgcgtagtagtacgacaactgtgtgccctggatcgtgtcacccgcgtcgatcagcaacgtgttccggcggcccttctcccggcgcacctggtccaccaacgtcgagatcttcgccagaccgacatcgttgtgcgcggagtcgtcgtactccctgtccgtgaagtagtcccagttgaagacgttcccgtgcagatcggtcgtgcccatcaccgtgaacgagtaccgcttcaccggacgcccgtgaccgtgaccgtgccccttcgcctccgcggcgccggccgaacccacgaccgcaccgcccgccatcgccacacccgcaccggcggcagccgaacggcccagaaacgtcctacggttcaacggcatctcttctactcctcgttcagaagggcaacgcgcgtagattctggcccagcggccaccacgcacaacaccccaagcaggtttcgatctgatgaccacgcgacacacaccacgacacacccacccccgtgccacagtgaacgcatgaccgaaatccccacacccccccccacaccc

SEQ ID NO: 3616 - DNA, 1350 bp, Unknown
  Kingdom: Bacteria, Phylum: Actinobacteria, Class: Actinobacteria, Order: Streptomycetales, Family: Streptomycetaceae, Genus: Streptomyces
ctacggaccggtagagtgggcaggtcgtcatcatgcccgtacagggggaagccggtgcgaatccggcgcagtgccccagccgtgacccgtccgcccgacggcagccggaccgccctccgcggagcgtgaccggctcgggccaccggaaccccggtggccggcaccgtcgaggcatacggggccggagcccggggccctcgtgcgcccggggagtccggccctcgcaggagaggcccagcccgccatgaccgtacgccgcagcgcagccgcgctcgcgaccaccgccgtgctcctgggcgcggccgcacctgtagcggtcgccgcgccgagtccctccccgtcggcggagctgccggccgggctctacggcaccacggaccccacgtacgacggggtgtggcggcagtcgctggccttcctcgcgcagaagatcgagtacgtcactccggccaccgccgccgtcgactggctggtgggccagcagtgcgacagcggggcgttcacctcgtaccgggacgccgccgagccctgtgacgcgtcgacggtgatggacaccaacgccaccgccgtcgccgtgcaggccctcgtcgaggtgaaccagcaccgcgacgccgcgaacaacggcgcggactggctgaagtccgtgcagaacgaggacggcggctggggctacaaccccggcagcccgagcgacgcgaactccacgtccatcgtggtcggcgcgctcgcccggaccggggtcccgatcaatgaggtcaccaccgccgacggaaagactccgtacaccgcgctccagtccctggccgtcccctgcgaggacaaggacggcggcgcgttcgcctatcagccgggcaagaagggcgagctgaccgccaacctggacgccaccgcggcctcggtgctcggtctgatgggcaagggcatcgcctccggcacgtccaacgcggtcaaggacccctcctgcacgaagggcgacgacctcagcccggagcagagcgcccagaacggcgccttcttcctcgcggacaccctgaagaaatcgccgtacctgaagcaggccccgatgccgggggccgaggactccgagccgcagcccgactacggcaacaccgcggacgcggtcgtcgcgctcgccgcctccgggcacacggacaaggccagggcctcggtcgcctggctgcagaagaacgccacgggctgggcgaagcagggcggcccggccgccaccgcgcagctgatcctcgcggcacacgccaccggcgcggacgcccgcagcttcggcggggtcgacctcgtcaagcagctcaacacgatgggccactccccggccgccaccgctctcccctcgcc

SEQ ID NO: 3617 - DNA, 1464 bp, Unknown
  Kingdom: Bacteria, Phylum: Actinobacteria, Class: Actinobacteria, Order: Streptomycetales, Family: Streptomycetaceae, Genus: Streptomyces
cagcacgacgacggcgacctgacgggccccgtccgccgcccgtacctccgcgccctcggcatgctcgccgtcgacgtgctgggggcatggctggggctgctcgccgtgggcagcgtccgtactccggtcggccccatggacaccaatatgacgctgcgcccctccctgaccggcggcagcaagatcaacgtgtccccgctcggcgccctggagctggactcgcacagcgcgccgctccggctcgacgtggacgtggaccgcctcgaccccgaacgctcccaggcgctggtcgaccagccggaacggttctccagcctccaggacgaggtcacccgggacgtcgccgccggcacccgggagctggccgtacgctcctgtgtcgccgtcgtctccggcgcgacggcgctcggcctcgtcgtctaccggcgcccgcgccgcgccctggcggccggcgggctcgccctcaccctgctggccgcgtccggcgtcagcgcgtacgccacctggaacccgaagtccgtcctggagccgaagttctccgggctgctctccagcgccccgtccctggtcggcgacgcccgctccatcgtcaccgagttcgacatctaccagcaggagctggcccgcctggtcaccaacgtcaccaagctgtacgacgcgacctccacgctccccgtctaccagcccgaccccggcaccatccgggtcctgcacgtctccgacatccacctcaacccggcggcctggcacatcatcgcctcgctcgtggagcagtacgagatcgacgtcatcgtcgactccggcgacacgatggaccacggctccgcccccgagaacggcttcctcgacccggtccgcgacctcggcgcgccctacgtctgggtgcgcggcaaccacgactcccccatcacccaggcctatctgaagaagttcaagaacgtgagcgtcctggacgacggcagcgcggtgaacgtcggcggactgcggatcgcgggcaccggcgacgcctccttcaccccggaccggaccgccccggtcggcggcaaggaggccgcgcagctcgaaggcgcgcgcctggcctccgcgctgcgcgaccaggaacgcgcgggcaccccggtcgacatcgccgtcgcccacgacccgaacaccgcccgggagaccgacggcacggtcccgctggtgctgtcgggacacctccaccgccggatcaacgagcagctgaagctcggcacgcggctgaaggtcgagggctccacgggcggcggcgggctgcgcgccgtgcagaacgacaagccggagaaggtgcacgcctcggtgctctacatggaccgctccacccgccggctccaggcctgggacgagatcacgctgggcggtctcggactgacgaccgccgaggtcagccgccatcttccggaggagaacctgaagaaggacacccctgtctcccccaccccgtcgccg

SEQ ID NO: 3618 - DNA, 3150 bp, Unknown
  Kingdom: Bacteria, Phylum: Actinobacteria, Class: Actinobacteria, Order: Streptomycetales, Family: Streptomycetaceae, Genus: Streptomyces
ggtgaggcggggcagcgtctcgtggctggaggctccggcgaagccgatggtcacccggccgtactcgccccggcccgccgagcgggcggcccggacggcggtgtcgaggtcgtcgagggcggtccgtacggggtcgaggaaggcctcccccgcgccggtgagccggacggagcgcgtgttgcggcggaacagctggacgccgagttccttctccagctgccggatccgctggctcaggggcggctgtgccatctggaggcgtttggcggcccggccgaagtgcagttcctcggccacggcgaggaaggccttcaggtggcgcagttccatggcgacacccctcgcgtcattgatatgccccgtgtctggatccgaccttaattcggtattggacagccatcaatgggtgctgacaccgtgggggccgcggatgcggacgatgaggagaaccgtggaccggacggccggcaaggtcatgtcgatgagggaggccgtcgccgccttcgtcggggacggggacaccgtgagcctcgaagggttcacccatctcatcccgaccgccgccggtcacgagatcatccggcagggccgccggaatctcacggtcgtccggatgacggcggacatcgtggtggaccagatgctggcggccgggtgcgtgacgcggctggtctcgtccttcgtggggaactcctccgccggttcgctcggggagctgcggcggcggatcgagcacgccgacccggagccgctggagttcgaggagtacagccactacgggatggtgtgccgctatctcgcggggtcgcagcggttgccgttccacccgctgcgctcgtacgcgggcagcgacctgccgtccgtcaatcccggtatccgcaaggtcgcctcgccctacccggccgccgacggctccaccgagcagatctacgtcgtaccgcccgtcaacccggacgtgacgatcgtccacgcgcagcgcgccgaccgccggggcaacacccagatctgggggctgaccggcatccaggccgaggcggtgtacgcggcggagaaggcggtcgtggtggtggaggagctggtggcggacgaggtggtccgctcggacccgaaccgcacgctgatcccggcgcacgcggtcgacgcggtagtgatctgcccgcgcggggcgcacccctcgttcgcgcagggctactacgaccgggacaacgccttctaccgctcctggtcggcgatcagcaaggacccggcgcggctgcgggagtggctggaggagtgggtgtacggcaccgccgaccacgcggagtacgtggcgaagctcggcgaggagttctgggcggggctggcggtcggcgaggcgatgagcgaaccggtgaactacgggaggcggctgtgaacgagcgggacccggataccacgcgacccgtcacctcctccgagctgctgtccgtcgtcgcctcgcgtgaactggccggacgccgcacggtgttcgcgggcatcgggctgccgacgctggccgccgagctggcgcggctgaccgtcgcgccggacatcgaggtggtgtacgagtccggggtctgcggggcgcacccctcccatctgccggagaccatcgcggacgccgtcctgatcaccggggccgaagcggtggtgtccatgcccaccctgttcggctcggtgctccagggcgggcacatcgacgtgggtttcctcggggcggcgcagatcgaccggtggggcagcctcaacacctcggtcatcggggactgggaccgcccgtcggtgcggctgccgggttccggtggcgcggtcgaggtgatggcgaacgcccgggaggtgttcgtggtgatgcgccgccacacaccgcgttccttcgccgaggcactcgacttctgcaccacaccgggaccggaccgggcgctggcggacggcatccgcccgctgggcgtcggcgtcacccgggtcgtcaccgaactgggcgtcctcgccagggagggcgtcggcgacgaactgcggctggtcgccgtgcatcccggggtcaccgtcgaacaggtgcgggccgagaccggctgggacctgaaaacggccgccgcggtggcgacgacggcgccgcccacccccgccgagctgcggctcctgcgggacgatgtcgaccccgaccgtgtctacctccgctgaaagggcttccaccgccatgcgtatcaggatcgtcggagccggggccatgggccgcggcatcgcccagtgggcggcgagcgccggacacaccgtcgagctcggggacgtacggcccgaggcggtgacggacgccctggacttcgtcgcctcgatgctggaccgggccgtcgccaagggccggatgtcgtccgccgagcgggacggggccgtggcccggctggtgccgctcgccgagccgtgggcggcgggcccggaggtggagctggtgatcgaggccgtacgggaggacctggcgaccaaggccgaggtgttcgggaagctggagcgggcgctgccgtcgtccgccgtcttcgcgaccaacacctcctccctgtcggtgacccggatcgccgcgacgctccaggacccctcgcgcctggccgggctgcacttcttcaacccggtgccgctgatgaggatcgtcgaggtggtgccgggagcggccacccgtccggagatcccggccctgctgaccgggctggtggagggctgcgggcaccgtgcggtgaccgtcgccgacacccccggtttcctggtcaaccacgccgggcgggggttggtgaccgaggcgctcgcgctgctggaggagtcggtggcggaccctgcggagatcgaccggatcggccgggacgtgctggggctgcggatgggacccttcgagctgatggacctgaccggtctcgacgtgacggccgcggtgatcgactcgatctgggagggcttccggtacgaggcccggctgcgcccgtccttcctgaccccgaaccgggtggtggcggggctgcacggccgtaagacgggccggggctggtacgcgtacggcgacggggtccccggtcccgcgccggagagcgcggtcaccggggacgcggagcgcccggtgttcctggtcccgggcgggcgtccggagaccgccgcgtacgaggaggcgctggc

SEQ ID NO: 3619 - DNA, 2951 bp, Unknown
  Kingdom: Bacteria, Phylum: Actinobacteria, Class: Actinobacteria, Order: Streptomycetales, Family: Streptomycetaceae, Genus: Streptomyces
gcacgcaccggcgacaccgaaggtgtgcgcaccgcgatcgagggccttcatgggtactccgttccctgtgcctgtgcggatggtgactaccgggcgagggccgcgacgcccgcctgggcgaacttctcgtcgaggtcgccgctgggcgcgccggccacgccgatgccggcgaccggggcacccttgacctgcaccggagcaccgccaccgaggaacagggtgccagggatgtccttcaggttcggggcctgctccaggcgcttgaccagctcggaggtgggggcgttccaggagacggcggtgtacgccttcttcaccgcggactcgggggactgcgggcccgcgccgtcgccgcgcagggagacgatggtgttgccgttgcggtcgacgaccgcgacggagacccgctggttctccttcttcgccgcgtccagcgtggcctgcgcggccttggtggcggcggccacggtcaggtgcgtcgtctgctggaggttccggttgctcgtgtcggccttgacggcggcagcgggggcggcggccggggaggaggcgctcgcggacatcgcgccgaacgtgccggccccgagggcggcgacgacgacggcgccggtgacggcacgggtgcgcagcgacagcttcttcatggtggctccttggtgatccgggggcggcccggtgggtcggtgtgcggtgcggcccggaagtggtccgggcgattcgctctggtatcgatcctcccggcggatccggccccgtacggtcgccgtaccggctggaagcggcgcgcgggtcggccgacgcccccatcagccgatcggttgatgcgggggtggccggatcgggtcaccatggaagatccgcgcaggtcagcagggtcggacgagacggaacacgaggtacgaggtggaccaccggagcgatccccaggccccggagggaggcggacccgccgacgccgcccccggtccgggacggggtgctgaccccggctcgggttccggctcgggtctggacgccgacggtccggacctcggcccgtcctccggcgccgaccccgacgcccgctggctcgcgctcctcatgcacgccgcgttcttcctgctgctcggcgcctcgctgacccggttcctgatgcggcaccccggtgaggcccgcaccccgtggatcatcgccctgtcgatcaccctggcggtgctgtacctcctggggcccgtcctgggttcgcgccccaccccgcgccggctcgtctggctgggggtgctcgtcctcgtctggatggtgctggtcgtcctcgcgccgagcttcgcctggtgcgcggtgccgttgttctacaccgggctgcgcatcctgccgccgcgcgcggccctcgccctggtcgccctgctcaccgcgttcgtcgtggccgcgcaactgcgcctggccgaagggttcgacccgaacctggtcctcgccccgcccgctgtcgccgccgtggcgaccgccgtcttcgtccatatgcggcgtcaggcggtacgccagcgggaactggccggacgccagcgcgaactgatcgacgacctgctgcgcacccggcgcgaactggccgccaccgagcggcgcgagggaaccctcgccgagcgccagcggctctccatggagatccacgacaccctggcacagggcctgtccagccagcagatgctgctccaggcggccgaccgcacctggacggccgatccggacgccgcccgccgccatgtccgtacggccaccggcatcgcggaacgcaatctcgccgaggcccgccgcttcgtgcacgacctggccccggccgacctggccgagggcggcggtctggaggcggccctggacgcgctggcggcccgcgagagcgcccaggcggagggcgcgctcaccgtccactgccatgtggagggcaccccgcacgccccgctgccggaccgggtgcagtccgccctgctgcgcatcgcccagggagccctggccaacgtgcgggagcactccggggccaccgccgccgggctgaccctgacccacctcgacgaccgggtggtcctcgacatcggcgacaacggccgcggcttcaccgtggagcccgccggagtccgcagccccgacaccgtgcgcggccacgggctccccgcgatccgggcccgggtgcaccagctcggcggaacgctcaccatcgagtcggccccgggcgagggcacggtgctctcggccgggatcccgctcgcgcccgcacctctcaccgtcccggaggaccccgcatgaccggccgaggccagcagacgccccctgtacgcatcctgctctgcgacgaccatgcggtcgtccgcgccgggctgctcgcccttctcggcagcgaaccggacatcgaggtcgtcggcgaggccggcagcggcgaggaggccgtggtgctcgccgcccggctcaccccggacgtcgtcctcatggacctccagctcggcgagggcatcgacggggtcgaggcgacccgccgcatcgcggccgacggcacggtccacgtcctggtgctgaccacgtacgacaccgacgccgacatcacccgggccatcgaggcgggggcgaccggctacctgctgaaggcggagcgccccgaggagctgttcgccgcgatccggtccgccgcccagggccgcaccacgctctcggcccccgtcgccagccgggtcatggcccggatgcgcagcccccgccccagcctcaccgaccgtgaacgcgacatcctgggccagctctcccagggcctcggtaaccgcgacatcgctcgcgccctgtttatcagcgaggccacggtcaagacccacctgggccggatctacgacaagctcggcgtcgacacccgtgcgggcgcggtggcggtggcgaaggagcagcgcctgctgccgtagggctcggtggcggtggcgaaggagcagcgcctgctg

SEQ ID NO: 3620 - DNA, 5668 bp, Unknown
  Kingdom: Bacteria, Phylum: Actinobacteria, Class: Actinobacteria, Order: Streptomycetales, Family: Streptomycetaceae, Genus: Streptomyces
cggctgctgcggctgcccgtacccctgcgcctgcgccgggtgcggttccccgtccggacggatcgtcggctggtactgcgtgtcccaggtcggcgcctgccacgtctgcgtcgcgccctggtcgaaggcggccggctcctgggacgcggcggactgcccggacgtcccgtcgggccagtgcggcgacgccggctgctgctgccggtcggggtcgtacggatacgggtactgctgatcgctgctgctcatggcctgcggttcaccctcctgcgaacggcgggagcacctcgaccgtgccgccctcggcaaggcgtacggtctcatgcccgcgggtcccgacggggttcccgtcgatgaggaacgagcaccgccggagcacctggctcagctcgccgggatgcctctcgcgcgccgcgtcgagcgcctcggcgagggtcgccgccgcgtacggctcctccgcggtgcccgcggcggccttggccgcagcccagtagcggatcgtccccgctgccatggcgccactccttcgggtcggttcgtcggacgcctcgtgcgtcagctctccatgatgggtcacgcgggcggtgcggccgtcgcccagtcggcgatgcgggccagcagggcgtcgtccgccgcgttctcggcatggcccatcccccgctccagccacagctccgcgccgcccggaccggccgcctccgccagcatcctggggtggtccagcgggaagtacgggtcccggtcgccgtgcacgagcagcagcggggccggggcgatgagcgggaccgcggcgaccggggagagcgggacggggtcccagtcctcggtggcgatgcgggtacggaatccgtagcgcccgacgaggcggcccgagggtcgggtgaccacccagtgcagccgccgcatcggggccgtcccccggtagtaccagcgggcgggagcactgacggagaccacggcgtccgagtgcgcccccacactccctgtgcgcccctcgcgcgccggtacgcgaacggccgtatggcccgccgcggattccgccgtatacagagcgccgtgccggagcaccaccgagccgcccatcgagaacccgaccgtcaccacccgggagtggcccagttcccgcgcccaggtcaccgccgcggccaggtccagcacctcgcggtcgcccaccgtggagcgcccgccggaccgcccatggccccggaacgagaacgtgatcacggccgcacgctgggcgaagacccgcgcggcacgccgtacggcgggacggtcggccgagccggtgaaaccgtgcgcgacgacgatcgcgggggtcgccgcggactcctcggccgccgcgtcccccggcgtcccggcaaccgccgtacacggttcgtacaccgcctcgaccggtacgccgtcatcggtcagcaaggtggcgcaccgcggaggaggcgtgagcaagggaacagaagaactcgggaatcgaccctcggacgcggaactcatgtgggctattctgctgcgaagaggatccgggcaatgcagcccccgggtccttttgtgctttaccggcgttgttacgacgacgtttccacaagctcagcggtcccaggggcgcgggaccgcaccgtaaaaccgcatgacgcatgacgtacgaagcagtgccgcatactcccccgggtccgacccgggagtgcccctctcgcagggaacgaggaggaccgacgtaatgggcgagcgaaccgtgcaacacgatcgaccgaaccaggcaggtgggcggcgatgagttcactgctgcttctgacgaacgcactccagccgtcgacggaggtgctccccgccctcgggcttctgctccacagtgtgcgggtggcccccgccgagggcccggccctcgtggacaccccgggcgccgacgtgatcctcgtcgacgggcggcgcgaccttccacaggtccgctcgctctgtcagctgctgcggtccacgggacccggctgtccgctgatcctcgtcgtcaccgagggcggtctcgcggccgtcaccgccgactggggcgtcgacgacgtcctgctggacacggcgggaccggccgaggtcgaggcccggctgcgcctcgccatgggccgccagcagatcacctccgacgactccccgatggagatccgcaacggtgatctctccgtcgacgaggcgacgtacagcgcgaaactcaagggccgggtcctggatctgaccttcaaggaattcgaactgctgaaatacctcgcccagcacccgggccgggtattcacccgcgcccagctcctccaggaggtctggggctacgactacttcggcggtacgcggacggtcgacgtccatgtgcggcggctgcgcgccaagctcggccccgagcacgagtcgctgatcggcaccgtgcgcaacgtcggttaccgcttcgtcacgccggagaaggtcgagcgcgcggcggaggaggcgaaggaccgggccgccgcccagcgggagcgccggtcgagggaaacggaagccgtcgcccgttcggagcagtccccggccgccgaggtgacggaagaagccccggtggaggctgccaagaggtaggtccatccgcgtagactgcggcgcgtggccaaggtgacgcgggacgatgtggcgagactggcggggacgtcgacagcggtcgtcagttacgtcatcaacaacggaccccggccggtcgccccggccacgcgcgagcgggtgctcgccgcgatcaagcagctgggctaccggcccgaccgggtcgcccaggccatggcctcgcgccgcacggacctgataggcatgatcgtgccggacgcccggcagccgttcttcgcggagatggcgcacgcggtcgaacaggccgccgccgagcgcgggaaaatggtgctcgtcggcaactccgactaccgcgacgagcgcgaggtccactatctgcgcgccttcctcggtatgcgcgtctccgggctgatcctggtcagccagggtcccagcgagcgcgccgccgccgagatcgaggcctgggacgcccgggtcgtcctgctgcacgagcggcccgaggcgatcgacgacgtcgccgtcgtcaccgacgacgtgggcggcgcccagctcgccacccggcatctgctggagcacggcaacgcgtacgtggcctgcctcggcggcacggaggagaccccggcggtcggcgacccggtcgccgaccacgtcgagggctggcgacgggcgatgcacgagtcgggccgctccaccgagggccggctcttccaggccccgtacaaccgttacgacgcctaccaggtggccctcgggctgctggcgggcccggaccggcccccggcgatcttctgcgccacggacgaccaggccttcggcgtgctgcgggccgcccgtgagctgcgcatcgacgtgccgggcgagctggcggtggcgggcttcgacgacgtgaaggaagccggcctcaccgatccgccgctgaccacggtccactccgaccgcccggcgatggcgcgggcggcggtggacctggtgctggacgactcgctccgggtctcggggtcgcggcgcgagcgactgaagcagttcccctccgccctggtggtgcgacgctcgtgcggctgcggggagcccacgtccccggcctgacccgaccggcctttacagcgggcatacgcggttcttccgggcttctcaggacgtactcaggcccttctcatcttcgctgaccagcctggtgcacatgacggagaaccttcgcccgagcggcgcgcactcgacggaccaggacccgaccccgtacgcctccccgtacgcgtacgacggcacggcgcacaccggtacgccgtacgacggcaccgcgtacgccggtacggccggtggttacccgccgccgcccccgtacgcccccaccaacaggcgccgggcgaagcggccggtcgcgctgctggcggcggtggcgctcgccgcgggtgtgatcggcggcggcaccgccaccctcgtcggacagctgaacggcgagggttccggagccaccggatcgggtggcgcggtcaacggcaccaccgtctcgcagagcagcaagggcaccgtctcggccgtcgcggaggcggtctcgcccgcgatcgtggagatcggcgccgcctcgtcggcgggcaactccaccgggtcgggggtggtgatcaccggggacggcgagatcgtcaccaacaaccacgtcatctcgggcgcgcagcagatccaggtcaccctctccaccggaaagacctacacggccgacgtcgtgggcaccgaccccgacaaggacctcgcactcatcaagctccggaacgcgagcggcctgaagacggccacgctcggcgactcctcgcaggtcgaggtcggcgaccaggtcgtggcgatcggctcgccggagggcctgaccggcaccgtcaccagcggtatcgtctccgcgctcgaccgggacgtcacggtcgccaaggacgactccggcagctccggccagggccaggaccggcagggtggcggtcagcagtggccgttcgagttcggggggcagcagttcaacggcgacacgggcgaggagaccaccacctacaaggcgctccagaccgacgcgtcgctcaaccccggcaactccggcggtgcgctgatcaacatggacggcgagatcatcggcatcaactcggcgatgtacgcgcccagttcctcggcatcggacagcggctccgcggcgggcagcgtgggcctcggcttcgcgatcccggtgaacaccctcaaggccgacctggacaccctgcgcgcgggcgacggctcctgatcccgcgcggccgccccggccgtgcaaggctgagacaccccccgcagaccgggtcgacacgagaagaggaccagtagcgatgagccccgccgaagacgatccccagcgcatcctgatcgtcgacgacgagccggccgtgcgcgaggcgcttcagcgcagcctcgccttcgagggatacgggacccaggtcgcggtcgacgggtacgacgccctggcgatggccgaggcctacgcacccgacctcatcgtcctggacatccagatgccccggatggacggcctcaccgccgcccgccgcatccgggccaccggctcgaccacgcccatcctcatgctgaccgcccgcgacaccgtgggggaccgggtcaccggcctcgacgccggcgccgacgactacctggtcaagccgttcgagctggacgagctgttcgcccgtatccgggccctgctgcgccgcagctcctacgcgtcggctgcgggcacggacgcccccgacgacgatgtgctctccttcgccgacctgcggatggacctggcgacccgcgaggtcacccggggccagcggcgggtggagctgacccgcaccgagttcaccctgctggagatgttcctgtcccacccgcgccaggtgctgacccgggagcagatcctcaaggccgtctggggcttcgacttcgagccgagctccaactccctggacgtgtacgtgatgtatctgcgccgcaagacggaggcgggcggcgagccgcgcctcgtccacaccgtgcgcggggtgggctacgcgctgcgtgccggcgggagcggggaggcgtgagcacggcgcggccccccgcgcacggtgtggac

SEQ ID NO: 3621 - DNA, 717 bp, Unknown
  Kingdom: Bacteria, Phylum: Actinobacteria, Class: Actinobacteria, Order: Streptomycetales, Family: Streptomycetaceae, Genus: Streptomyces
  misc_feature (357)..(400): n is a, c, g, or t
gccggaggtggtccgcggtggtgatcaggacgcccagggcggcgaagaggaggccgagggcgagggcctgggtgagggctccggcgtagccgtacgtgtcgacgtcgaggaacgggtaggggtagcgggccggagcgccgggggagagcagggctccgcggatcagggtgaggcccaggtaggccgcgggtgcggacagccagagtgggatgtgcgccaggcgcagggtccggggggcggtcagcaggagccagtccgcggcgacggccaggggggtcaccgtgtggagcaggaggctcacggcggtggaccagccggcccccgtgccggggtcgccccggagggcgctcgccgggnnnnnnnnnnnnnnnnnnnnnnnnnnnnnnnnnnnnnnnnnnnnagccgccgtggttcaccagcaccaggtggtacatcagcccggtgaccgctgcgagcaggagcaccccgcccgacagcctcggcgacagtggcgggccaccccgccaggaacgtacggccgaccacccgagagcacccgcgaccaggaggttcgccaggaccgtgaagtggatcagcgtcggtggtgcgtagccggtcgccagggcgaggaccgggcccgcgaccgctcccccgcacgcggtcgcgcgcagggccgcggcccaggggcggcggggcccggcgaggtccgggagcacctctgccgcccgggggcggggg

SEQ ID NO: 3622 - DNA, 7316 bp, Unknown
  Kingdom: Bacteria, Phylum: Actinobacteria, Class: Actinobacteria, Order: Streptomycetales, Family: Streptomycetaceae, Genus: Streptomyces
acagcagcagcccgccgaaccgcaggcgccggccgctccggactcctccggtgtgccggtcccgcccatgcctcagcgtggtgcggccgacccctcggtcaccagctcgtggcgggcctcgcccaacgacgaactcgtacgccaggccgaacgggtcaagaagcccgccgccggcggggtcaccacttccgggctgcctcgccgtgttccccgcgccaatttggttccggggaccgcacagcagcagaatcaccagtccggaccacaggtttcgcgcgcgcccgatgacgtgcgcggtcgtctgaccaatctccgccggggcatccagcagggtcggcaggccaacaacggcccgcagaccggcagtatccatctcggccccactcaccagcaggagcgttagttgagccccatgagtcaggccgcgcagaatctgaactggctgatcaccaacttcgtggacaacaccccaggggtgtcccacacggtggtggtctccgcggatggcctgctgctggcgatgtccgaaggattcccgcgcgaccgcgccgaccagctcgccgccgtcgcgtccggcctcacctcgctgaccgcgggtgcgtcccggatcttcgagggcggtgccgtcagtcagacggttgtggagatggaacggggttttctcttcctcatgtccatctccgacggttcgtcactggccgttctggcccacccggacgccgacatcggtctggtcgggtacgaaatggccctcctggtcgaccgtgcgggcactgtcctcacgcccgacctccgcgccgaactccaaggaagtctgctccactaggcggccatccagcggattcacgacacgatccccccaggtaatgcccacaaccctcacccgtcaggccgctttagtcccctcgccggccccttgcagacggcaagccgagaacctgctgtcacgcccggaggattcatgaccccgccacccgcctcacccgatccgtacggcgcactgcaccacgcgtcgtacgacggggaaggcgaccagccgctggttcgtccttatgccatgaccggcggccggacccggccgcgctaccagctcgcgatagaggcactggtcagcacgacggcagaccccgcgcatctggggaccctgctccccgagcaccagcggatctgccacctctgccgtgaggtcaagtcggtggcggaggtgtcggcgctgctgtcgatgccgctcggcgtcgcccggatcctggtagcggacctggcggaagccggcatggtggccatccaccagccgggcaatggagaggccggcggcgcgccggatgtgacactgctcgaaagggtgctcagtggacttcgcaagctctagtggcggcacgggccgcgccaccacctcggcgaagatcgtggtggcgggcggcttcggcgtgggtaagaccacgtttgtcggtgccgtttcggagatcaacccgctgcgcaccgaagccgtgatgacgtccgcctccgcgggcatcgacgacctgacccacaccggggacaagaccaccacgacggtggccatggacttcggacgcatcaccctggaccaggacctgatcctgtacctcttcggtacacccggccaggaccgcttctggttcatgtgggacgacctggtccgcggcgccatcggcgccgtcgtcctcgtcgacacccgccgcctcgccgactgcttccccgccgtcgactacttcgagaacagcggactccccttcgtcatcgccctcaacggcttcgacggacaccagccctacacccccgacgaagtacgcgaggcactccagatcggtcccgacgcacccatcatcacgacggacgcccgtcaccgcgcggacgccaagagcggcctgatcaccctggtcgagcacgcattgatggcacgcctgaagtagttcttccaccaggcgtaagtcgatatcggcatacggaagttgcagtagtcacgcgggggcggcctgtgtcgtttgacacgatccgcccccgtgttcataacgtttcgacagagaattgactccacgccgccacccgacgcatccacttggtgccactgcgctcacatgagccccgccttttgacggggctcgctctttatgcccgttttatctgaggtctgggccactcggaatcgccgactccgactgtttggaatgggacccacccccgtgctgcaattcgacgaactccccagtagtacggccctgaacgaataatccggcacagcgtaggtgccgacgccgagaggttgttggtcgagtgaggcgaagcaacgagggctccgcggcgcagcccgagcggggcaacttcaccccgccgtcgcacgctgtggcgtcccctgcgaatgtgcccggcacggagcccggcggtggtggcagcaccagccggatgtccccgcgcaactggcgggtggccacccggctgaacgcgatcctcctgatcccggtgctggtcggcctcgtcatgggcggcttccaggtgaaaggttccatcgacacctggagccaggcacaggaggccgagaagatcgcggtcgtcgtgcgcgccgcgtccgactacgggcaggcgctgctgaacgagcgggacctcaccgccgagccgttgctctcgggcgaccgtgacgccgatgtggtcgagcagacccgggccaccacggacgaggcggcacggaagttcgacgccgcggtgaaggacatgcccgcgaagccgggcctggagcgccgtctgaagctcttcaagggcgaggagcccaagcttcccgagctgcgcaaggccgcctactcccaggccctggacccggtgaagaccgaagagggctacacccaggtccagcactcgctgatggagttctccaacgagctcggcctcggcaccggcaacatcaccagctacggccgtacggtctacgcgatcgagctgtccaaggctgcagaatcgcttcagcgctcgatcggcacgcaccttctggtccgcccgagcaagaagccggggacgtacaacgaccaggtcaaggccttcggctcgtacaactacctggagcagatcgcgctgggcgagttcaactccggtggcacccaggccgacgtcgaccgcctcaagcaggtcatggccggcaaggccgccgagggcgccaagcagctcaaggccgccaaggagcaggccgaggccgcgggcaaacccttcgtggccccgccgagcatcgacggttcggtcttcgacggcatggcccagcagatcggccaggggcaggaccccaaggacctggcggccaagggcatcacgccggagacctggatggcggcggcgaccgcgaagttcgaggggtacgccaccgtcgaggacgagctggtcaccaaggcggtggacgaggccgcgagcatctcctccgacgccaagaccgacgccatcgtcaacggcctcatcgtcgtcatcgcgctgttggccgccttcctcctggccgggctcatggcccgccagatgagccgttccatgcgccagctgcgtaccgccgccttctccatcgccgagcagcggctgccctccctcgtcgaccagctctcgcgcaccgacccgggccgggtcgacacccgggtgcagccgatcccgatcaccacgcaggacgagatcggcgaggtcgcccgcgccttcgaccaggtgcaccgcgaggccgtccggctcgccgccgagcaggccatgctccggggcaacgtcaacgcgatcttcacgaacctctcgcgccgcaaccagtcgctcatcgagggccagctgaccctcatcaccgacctggagaacaacgaggccgacccggaccagctggagagcctcttcaagctggaccacctggccacccgtatgcgccgcaacggcgagaacctcctcgtcctcgcgggcgaggagcccggccgccgctggaaccagccggttccgctggtcgacgtcctgcgggccgcctcctccgaggtggagtcctacgagcgcatccagctgaccggtgtgccggagagcgagatccacggccaggccgtcaccgacctcgtgcacctgctggccgagctgctggagaacgccaccacgttctcctcgccgcagaccaaggtcagggtcaccgcgacccggctgcccgacggccgggtgatggtcgagatccacgacaagggcatcggcctcaccgccgaggacttcgccgacatcaaccacaagctggccaacccgccgaccgtggacgccgcggtgtcccagcgcatgggcctgttcgtggtcggccgactggccgaccggcacgggatccgggtccagctgcgcccctcgggcgagcaggcggggaccacctcgctggtcatgctgccggacgccatcacccacggtggcggtggcgaaccgggctccggccaggacgacttcacggtctcctcgatcatccccgagcagcagcaggccttcgagccggcaccgcagcaggccccgatgcgcacggcagcggagctcggcttcgacgactcgcgctacgaggccccggacccgtcacagctggaccccgtcgggcgctcgctgatgcgcgaggagcgcagggcggccctggaggcccagaccggcacgggcggcgcgttcggggacgactcccagcaacagcagggctacgcaccggacgcgtacgcgggcgacccgtacggcgggcagcagcaacagggttacgccgacgatcgcttcggccaggacccgtacgggcagcagcagtcgcagcagccgtaccagggggcgtacgagcagcagcagtacggcgtcggggacggttacacgcagcagcgggaccagcaggcgcagcagcacccgggagacggttatccggaatcggcatatgccgatcggaatgcccagcagagtcagtacgccgacccgtacacggcttcgccggaccagtcgcaccaggatgactggcctgttcagagcgacttctcccacgcttatgagccgattgctccggccgaatcggaatctgttccgagcacgcccgcagagccttcggagcgcgtaggcttcgaccgtccggggcccaccccgaacgtcggccacgagctgaccgaagccggtctgccgcgccgcggcggtcagcagcactggcagcccggccccggcggccgcggcaacgaccagcccgatccgaccccggggacccagccgcagcaggaacagcggcaggacccgcagacggacggggacggctccgacgactggcgctcgacgaacgacgagcgctgggagcgggccgagaagctccgtgagccgaaggcgggcggaatcaccccctccggcctcccccggcgcgtacccaaggccaacttggtcgagggcacggcggagcagacccagcagggcggcccacaggtctcccgcgcgcccgaggacgtccgcggcaggctgagcaacctgcggcggggggtccagcggggacgcagcgagggttcggacaccagtaccacctacaaccaggagcgttagtgtgagcccgatgagccaggcggcgcagaatctcaactggttgatcaccaatttcgtggacaacacccccggggtgtcgcacacggtggtggtctccgccgacggactcctgctggcgatgtccgagggtttcccgcgcgaccgcgccgaccagctggcggccgtcgcctccggtctgacgtcgctgaccgcgggggcttcgcggatcttcgagggcggcgccgtgaatcagaccgttgtggagatggagcgtggattcctcttcatcatgtccatttccgacggatcctcactcgccgttctggcccacccggacgccgatatcggtctggttgggtacgaaatggcccttttggtggaccgcgcgggcagtgtcctgactccggatctccgcgccgaacttcagggaagtcttcttaactagtagacagacagtgcgtttctcgccaccgcgccataaagtgcggtggcgcggccccacggggatcggtgaccggcagtcggaggaggaaacgtggcagcacccacaggcgggcacccctacaacggtgaccagagggttccgggtgagcacggtgacaaccgtttcggcttccctgccgcacctggcgggcagggctccggtcagtaccagccatatccggagccgcagcaccaacagcagcagggtgctcacggcgcgcaggggtccgagtggcccccgcagcagccggagatggggtggccgcagcaaccgcagcagccccagcggtacgacacgcctcagcagccgcacagtcagccggtgcagcagcggtgggctcccgagcccgccaagcccgccgcgcacaacccgctggtccgtccgtacgccatgaccggtggccggacccgaccgcgttaccagctcgccatcgaggcgctggtcagcaccacggccgatctgtcccggctgcaagggcagttgcccgagcaccagcggatctgccggctctgcatcgagatcaagtcggtcgccgagatctcggcccttctctcgatccccctcggcgttgcccggatcctcgtcgccgacctggccgaggccggactcgtcgctatccatcagcccggcggcgacgaggccgccggcggccagccagatgtgacactgctcgaaagggtgctcagtggacttcgcaagctctagcggcggagcggcccgctccactacctcggcgaagatcgtggtggcagggggcttcggcgtgggtaagaccacgtttgtcggtgccgtttcggagatcaacccgctgcgcaccgaagccgtgatgacgtccgcctccgcgggcatcgacgacctgacccacaccggggacaagaccaccacgacggtggccatggacttcggacgcatcaccctggaccaggacctaatcctgtacctcttcggtacacccggccaggaccgcttctggttcatgtgggacgacctggtccgcggcgccatcggcgccgtcgtcctcgtcgacacccgccgcctcgccgactgcttccccgccgtcgactacttcgagaacagcggactccccttcgtcatcgccctcaacggcttcgacggacaccagccctacacccccgacgaagtacgcgaggcactccagatcgggccggacacccccatcctgacgacggacgcccgtcaccgcgcggacgccaagagcgcgctcatcacactcgtcgagcacgccctgatggcgcggctgcgctaggacacaggtcgtacgcagaagggccccgcactcccgaggagtgcggggcccttctgc

SEQ ID NO: 3623 - DNA, 2086 bp, Unknown
  Kingdom: Bacteria, Phylum: Actinobacteria, Class: Actinobacteria, Order: Streptomycetales, Family: Streptomycetaceae, Genus: Streptomyces
cccgaccccagcttcttcccccctcacccagcagaccgacgcacctcaggaggcacggtgtcattcgcccgacgacgaacatcggcaggtcgacttctcctgttcgcggtggcccttgccaccatcgtgagcatcaacctcatcggatccccccgggccgaggcggaacccggcccctccttcaccaatcccgtggtgggcgcgccgaacagtgccgacccgaccttggtgtaccacgagggcttctactactacgtcgccaccacgtggtcgtccgacatcgtcatgcgccggtcgccgacgctggcaggcctgcgtgacgccccggagcggctggtcttccgtaccggcgggaccgctatgtgggcgccgcacctggagatggtgggtgaccgctggtatctgtactactcgatcgagcagagtggcgggccccggaggacacacgtcctggagagttccgggcgtgatccgctcgggccgtacaccgatcgcggcatcatcgacctcatgcccgacaacggctgggccatcgacgcgagcctgctgaagctcaacggcggtctctacatgacgttctccgcattcgccccgcaggacaacctgcagtcgatctacatcgcgcccatggtgaatccatggaccgccggtgcgaccgggacgcggatatcggccccgaccctggcgtgggagcggcaggacggagcggtcaacgaggggtcgttcgccctgcagcgtgacgggcgtaccttcctcacgtactcggccagccactgcaacggtcccaactacaaactgggcatgctggagtaccggggcggcagccctcttgccgccgcgtcatggaccaagcacgccgaccccctgttccagcgcgacgacgccgcaggcgtcttcgggccgggacatcactcgttcttctcctcccccgacggcagcgagacctggatcgcctaccacgcgaactcctcggccgggcagggctgcggcacatcgcgtacgacccgtgtgcagaagatctcctggaacgcggacggcactcccgatctcggcaccccggtgtccacctcgaccgtcgtccaggggccgtccggcgaggcgggcggcgccgcaccggtcgcactccgcaacaggcacagccgcctgtgcctggacgaccgtgactgggcgaccgcgcccggttcggccgtacagcagtggacctgcaacggggcggcggtacaggactgggccatgacgccggtgagcggtggccactaccaggtccgtaaccggcacagtggtctgtgcctggacaactacggctggggtaccgagccgggtgccgaggtccggcagtggacctgcaacggaaacaacgctcagcagtggcgcgtcagtgcggtgggggagggcttctccactctcaccaaccggcagagtggtctgtgcctggacaactacggctgggggacggcgcccggtgccgaggtccggcagtggacctgcaacggaaacaacgctcagcagtggagcatcggctgatcataggctcccgggcggaagcgcccacgcgccgaatgcctgatgcggcatgaccgcgcccgatggctgccatatcgtcccggcagccatcgggcgcggccatcgacgggggcacagtggagcgggccggctccgcgtcctacatctgacgtgccggagtctccgagggggcgaggcgcgaaagctccgcctcggtcgacttgagcaggtcgttccaggacgcctcgaacttctcgacgccctcgtcctccagtacctgtacgacctcgtcgtacgagacgccgagcttcttgatcgtgtcgaggtcggcgcgtgcctggtcgtagccgccggtgacggtgttgccggtgatctcgccgtggtcggccacggcctccagcgtggtctccggcatggtgttcaccgtgttcggcgccaccaggtcgtcgacgtacagggtgtccttcagggaggggtccttgacgccggtcgaggcccacaggggacgctgcttgttggcctgcgtcttgtccaggggggcccagcggtcggaggagaagacttcctcgtacgcctcgtaggc

SEQ ID NO: 3624 - DNA, 1236 bp, Unknown
  Kingdom: Bacteria, Phylum: Actinobacteria, Class: Actinobacteria, Order: Streptomycetales, Family: Streptomycetaceae, Genus: Streptomyces
cgccgcgcccgcgagctcggggaagatcaacctggacaagggacgggtcaccctccagaagaaccagaccgtctccctcgtcaaggggggcgccccgctgctctcgcgggtcaggatgggcctgggatgggagcccgcgttccgcggcaaggacatcgacctggacgcgtcggtgatcgcctacggccccaaccgcaaccacctggacagctgctacttcggcaagctgaccatcctgaacggagcgatcaagcactccggcgacaacctcaccggtgagggcgcgggcgacgacgaggtgatcatggtggaactcggccggatccccgccgaggcgacgggcctggtcttcacggtgaactcgttcaccggccagaagttcaacgaggtggccaaggcctactgccggctgatcgacgacgcgtccggcgaggagctggtccgcttcgacctcaccggcgccgagccgcagaccggcgtgatgatggccaagctcatcaagcagttcaccggcgagtgggagatgaccgcgatgggcgagttcgtgaagtcgcgcaccgtgcggggcatggtgaagcccgccgccaagtccctgtagccgccgtgggccctcgccggagggccgcaacggagtccggggcgcctgaagtgattcaggcgccccggttccggagaagacggacgctgctcgtgctcgtctcgcgactcagagcttggtcaacttggagtacgggctcaggatccttccctgtcgccccgagaagtcgatgaggaccgcatcgttgtcgccctcgacagcaagaatcctgccgagcccgaactggtcgtgcgacaccctgtcgcccacatcgaagcattcgaccggtggggcctcctgggccgggcggttgaagggactggaaggcaggtgacgccgggctgactgtttcattaagtcgagtatgcgccctgtgaaggccctacgccatgcccgtcggcgcccaaggccccagacgtgccggattcgtaatcagcgctcaccacggccagtcagcgcttcctcccgcctccagcagcggaaccatgcggaacgccgcgtcggaaagacccccgaacgtgtggcggttcccgtcgccggacggggtgtggccgagccggtatccggccagattccaggtgtagacgggcaccgtgtccggaacgctccgggtcgcgtcgccacggcgggtgtacgcgacctgctcgtcggtgacgatg

SEQ ID NO: 3625 - DNA, 5250 bp, Unknown
  Kingdom: Bacteria, Phylum: Actinobacteria, Class: Actinobacteria, Order: Streptomycetales, Family: Streptomycetaceae, Genus: Streptomyces
gccaccggcgcgcgccttccccgcggtggcggcggaggcggacgcagcggctccgggggtggacagcgcggcggccgtgcggccgaccttgctgcggctgccgaggacccactccgcgatgtgcgcgaagaaggccagggtgtagacggccatcgacgaatagatcagcacattgctggtgttcgccaggctctcgttggttgcggcggcgagattcacttctcagccccttcggcaggtgcttcggcaggatgtacgggccggctcccggcctcgttcgtggcgtcggtcgtgccgggcccgtccggcgcgtccggtttctccggcgtgtccggggcctccgcggcggcgggggcgacgggcgccgtggtgaccagagcggccgacaggtcgcccagttcttcggggagtttcgcggactcgctgcggcccaggcccgccatttccacgaccgtgacgccgtcggcaccccggaccgcccgcacccacacccggcgccgctggatgaacagcgagccggcgagaccggcgatggcggcgacggatccgccgagcgcccagccgttgcccggctgctgcgagacctggaagctcgcccactcctcgacgccgtcgaaagtgatggatccggcgccgtcgggcaggtccagcttctcgccgggcatcatcatcttcttgaggagttcgccgtcctcgcccttgaactccttcatcttggaggtgtcgagctggtagacgttctgcgcgagcccggagtcgacgccgagggagccctggtaggcgctgagcgccagcacggggaagtccaggccggggaactgcgagaacatctggcccttgccctcgccggcgaaggtcggcacgaagaacgccttgaagcccagctgggtcttctcgccgttcttgtccttgtagccgtccatcaccttgatggcgccggacgaggtgatgttgtcgtcgatcggcagcagcgggacggcggaccgggagacgaccttccccttgccgtcccggacggtgacgacgggggcgtagccgtgggcgatcagatagaccttggtgccgtccacgacgagcggttcgttgaccttgatgacgcccttgcgctccgcgccgtcggctccctcggtgtacgtcacccgggcctcgaaggtccgcggggtgccgcgctgcgggccgctcttctcgtacgtaccgacgaagtcgtcgagcacgaaactgaacggggccagcgagtcggggtcgtagagcgagcccgaggtgaagtcgtcgtactgggtgagcgtgttggagaagccgtcgccctcgacgatcagcttgccgccctcggacttgaagagctgcccggaggcgaaggccaccagcatcacgatcagggcgatgtggaagaccaggttcccggcctcgcggaggtagcccttctcggcggcgaccgcgtcgcccacctcgtgcgcacggaagcgccgcccgcgcaggaccccgagggccgcctcgcggacctcctcgggctcggcctccgtgcgccaggtggtgtacgcgggcagccgcgtcagccgcttcggcgcgcccggcggccggctgcgcagctggccgacgaactggccggtgcgcggcacgatgcagccgatgagcgagacgaacagcaggatgtagatcgcggagaaccacaccgagctgtagacgtcgaagagctggagcttctcgtagatcggggtgagggtggtgtgctggtccttgaaggcctgcaccttcatgtcgtcgacgctgctctgcgggatcagcgaacccgggatcgcgccgagggagagcaggaagagcaggatgagggccacccgcatcgaggtgagctgacgccagaaccagcgcacccagccgaccacgctcatcgcgggcacgccgaccccggtgtcgggtcggtcctcgcggggcgcggtggagagccgttcgcccgccgcgccgtggacggagccctggccgcgctcgtcctcgcgctgccgcgtctccgtgctgttcgacttgctcatgaactcagatccctacaacgaagccgctggaccagctctgcatgtgctgcatgagcgtggcccacgcaccggtcagcagcaggattccggtcacgatcatcatgccgccgccgatccgcatcacccatgcgtagtggcgcttgacccagccgaacgcaccgagcgccttgcggaaggcgaccgcggcgaggacgaacgggacaccgagaccgagacagtacgcgacggtcagtatcgcgccgcgtccggcggtggcgctctcggcggacaggaacagcaccgaggagagcgtcggtccgatgcacggcgtccagccgatcccgaagagggcaccgagcagcggtgcgccggccagaccggccaccggccgcttgtggaggcggaactcgcgctgtgtcacgcccggcaggagccccatgaagaagacgcccatgaggatcatcaggccgccgagcaccttgttgagcacctcggagtgcatctggagctcgttgccgaagtagccgaacagcgcaccggtggaggcgaacacgacggtgaagccgaggacgaagagcgacgcacccgcgatcacccggccccgccgcgcctcggcgaggtcggtaccgctgaccccggtgacgtaactcagatagccggggacgagcggcagcacgcagggagagaagaacgagatgagaccggccagcagcgcaatgggcacggccagcagcagggccccgctcatgacggtgtcgttgtacgcggcgagcgtgatcaccgggtcacttctccgcgataatcgggtcgatcatcttgcgcagctcgtccgcgtcgagcgcctggagcgtgcgggccgcgatcttcccgtcccggtcgatgaccacggtggacgggatggcctgcgggttcagggtgcccttggggaagcggaggatgagcttgccgatcgggtcgtagaagctcgggtactcgaccccgtagtccttctcgaagttgaccgccgcgtcccgctgggcgtcgcgggtgtttatcccgacgaactggacgccccggtccgccgtctcctcggagacctgagcgaagtacttcgcctccaggcggcaggggccgcaccaggagccccagacgttgaggacgacgaccttgcccttgtagtcggcgaggtcgagcggcttgccgtccagaccgttgccgtcgagcttcggcgccgccacccggtcgctcttggcgacggtggagatgccgccgccgccggtgacgaagttggtgttgcctccgcctccggccttgttgcccccgccgcacgcggacagcgtcagggcaccggccacagcggtggcggcgagcagggtgaagcggcgtcgggacgcgcggccaaagctcatgtgaaaagtttcgcatggcggattccgggcttccccgcgcccccctcggtgcccgtaaagccccttgtcaagcctgtttaaagaaggagttccagccaccggcgggcgcctgcccgacgtccagcgtccggagcttggcgagcacggcgggatcctgtacgtcgagccagtcgacgtactgccggaacgagacgagacgcacgtcgtccttgtcggccaccttcttgatcacttcttccacggcgtccatatagatgccgccgttccactcctcgaagtggttgccgatgtagaacggcgcacgattcgactcgtacgcgcgctggaaaccggcgagatacgccccggtcgcctgggtgcgccagcccggataacgcgagggcatgcccttcgtcgaattctgcgactgattggcgaggatgttgtagtccatcgagagcacctcgaaggagtgcccggggaacggcatcgcctgcagcggcagatcccagacgccgccgcgcttcacgggccaggtctggcggccgccgggcgaactggcgtcgtagcgccagcccagcttgctcgcggtcggcaggagattgtcctggccgagcaggcagggggtccggccgccgatcagttccttgcgatagtcgaacggaagcgggtcctcgttctcccagccggtgttcgtccgccattccgtgacgaacgacacagcctgattgatctcgctgtgccattgggcgggggtccagcgctccacggaaccggaaccgccgcagaaatgcccgttgaagtgggtgccgatctcgtggccgtccagccatgcctggcgcacgtacttcagcgtgtccttgacgtgatcgtcggtgagatagccgatgtcggaggcgccgcgggggttgttcggcggacggtagagggatttcttcgactcggggagcagatagatcccggagaggaagaaggtcatcgccgcgtcgtgttccttggcgagttcgagaaagcgcgggaagagcccgttgccgacctcgcccgcaccgtcccaggaaaagatcacgaactgcggcggcttctggccgggttcgaggggaacaggcgcctgcggctggttgggctgtttgccggtgtcggcggtcgaaccgtcaccgatcagccggaccttgttcttcggcgcgccgtttccgctgccgttgccgccgtttccggtgtcgcctttgccgccccggacggaccctccgtcgccggaggagcccgagtcgccacacccggcgagtccgatcgcggctgcggcgccgagccccgccccgagcaggccccttcgattgatgtcgcgcatgccgtccccatctgcggtcgttttatctcaagcccatacaaactgctgaagagttagatggggcacgtaacacgtcggttccgtgcatttggggactttctttaccctttaccttgcaggcccaccggctgcccgcccgaccatgacacgacgtccgtacgacgctcgcacacctttgcggacggtcctggtgggggacgcaggagtggccttcgcagttctgccgtcgaccgacggatcgccggccggcttcgggtccaccggacggtgccgacggatcggcttccccggatcgtcgaactcatgcgcgagcacggaggcgcccatcggcctccctaccggaaggtctccaccagggcgtcggtcaggagtccctgccagcaggcgtggtcgcggccgccgttgtggacggtgcggacgacccggtgcccccgggcgcgcagcgccggaacgagggcctcgccgtgctcgaccgaagcggccccgtcgtgcaggccgagggcgaggtggacgacgggcgcggaggcccggcccc

SEQ ID NO: 3626 - DNA, 4016 bp, Unknown
  Kingdom: Bacteria, Phylum: Actinobacteria, Class: Actinobacteria, Order: Streptomycetales, Family: Streptomycetaceae, Genus: Streptomyces
gggcgggacgacgctcgtccactcctgcgccccggaggtgccgttcgcgctgctgcgccgagccggggccgacggcatctcgttcgacttctccttgctcaccgagcgtgaggaagaggcgatcggggaagccgtcgagggcggtacccagctcttcctcggcgtcgtgccctccacggacgcggcttcggagggattgtcggacccgggcggtagcgtcatgggagtcaggacgctgtggagcaggctggggctgaatccggggactctcgccgagtccgtcgcgatcaccccgtcgtgcggcctcgcgggtgcgtcgcccgcgtacgcccgcaccgcgctcgcccacagcgccagagcggcgcggtcgctcgcggacaaccctgagtgacggggacgacgggcaaacgggaggacgggacgatggccggcgaacagcgggtggagcaggagagctcggttccggcggacgtgcgggagaagcacgcgctgctggccgagcagatcgaggagcaccgcttccgctactacgtgaaggaccagccggtcgtcagcgacggcgagttcgaccggcagctgcgctccctggaggccctggaggaggagcacccggcgctgcgcaccccggactccccgacccagaaggtcgcgggcccctaccgcacggagttcacctccgtggagcaccgcgaacgcatgctctccctggacaacgccttcgacgacgaggagctggccgcctgggcggaccgggtcgccaaggacgtcggcacgcccgaccaccacttcctgtgcgagctcaaggtcgacggcctcgccgtcaacctcacctacgagcacggccgcctgacccgggcggcgacccgtggcgacggccgcaccggcgaggacatcacccccaacgtgcgtacgatcgccgagatcccgcaccggctgaagggggagaacatccccgccctcgtcgagatccgcggcgaggtcttcttccccatggaggacttcgaggagctgaacgcccggctggtcgccgccgacgacaagcccttcgccaacccgcgcaacgcggcggccggatcactgcgccagaaggaccccaaggtcaccgccacccgtccgctgcacatggtggtgcacggcatcggcgcgcacgagggcctgagcatcgaccgcctctccgcggcctacgagctgctccacgcctggggcctgcccaccgcgcagcacaacaaggtcgtcgaatccctcgccggcgtacgggagttcatcgcgtactacggcgagaaccggcactccgtggagcacgagatcgacggcgtcgtcgtcaagctcgacgaggtcccgctccagggacggctgggatccacctcgcgcgccccgcgctgggccatcgcctggaagtacgctcccgaagaggtcaacaccaagctggtcaacatccgcgtcggcgtcggacgcaccggccgcgtcaccccgtacgcccaggtcgagccggtcgaagtggccggttccgaggtcgagttcgccaccctgcacaaccagaacgtggtcaaggccaaaggcgtcctcatcggcgacaccgtggtcatccgcaaggcgggcgaggtcatccccgagatcctcggacccgtcgtcgacctgcgcgacggcaccgagaaggccttcgagatgccgacccactgccccgagtgcgggacggaactgcgcccgatgaaggaggccgacatcgacctccgctgccccaacgcccgtacgtgcccggcccagttgcgcgaacgcgtcttctacctcgccggccgcaaggccctggacatcgaccacttcggctatgtggccgccgccgcactgacccggcccctggagcccgccgagcccgtcctgcgcgacgagagcgatctgttctccctcaccgtcgaccaactgctgccgatccgggcatacgtcctggaccaggacagcgggctgcccaagcgcgaccccaagaccggtgaggagaagatcgcgacggtcttcgccaaccagcagggcgaaccgaagaagaacgcggtggccatgctggaaggcatcgccgccgccaaggaagccccgctcgcccggatcctcaccgggctctccatccggcacgtgggaccggtcgccgcccaggagctggcccgtcagttccgttccatcgaccggatcgacgaggcgagcgaggaggagctggccgccgccgacggcgtggggccgaccatcgccgcctcggtcaagcagtggttcgccgaggactggcaccgcgagatcgtgcgcaagtggcgcgaggccggggtgcggatggcggacgagggctccgacgaggacgagggtccccgccccctcgaaggactcaccgtcgtcgtcaccggcaccctcacgggtcacacccgcgacggtgcgaaggaggcgctccaggccctgggcgcgaaggtcgccggatcggtgtcgaagaagaccgcgttcgtggtcgtcggcgacaaccccggctccaagtacgacaaggcgatgcagttgaaggtgcccgtcctcgacgaggacggattcgcgatcctgctcgaacagggacccgaacgtgcgaaggaggcggccctgcccgccccggaagccacgcccggagccgacccggagaacagcggggagtaaccggccgccggacctccgttcgcccactgttccccggatcgagacgccttcgagacgctcccccggcgtggcgcggcccgtacggggaaggaaacggggcagaggggtgaagaaggggccgccgttccccgaatggccctgccgcgccacccgttcgggtcaatagcagatggtgacgggtggtcggttcgcattcgggcaagagctgtagagcgctgcccctggaagcctttcgcggcctactgttgagaggtacgcccgccgtgcacggctgctcgaccgggccgtggtgccaccggagcgggcgccaccgagggacatcggcaccgccggctgtgagagggacggaatgaaaccgaccgagagcgccgccccggtgtcgcggctgcaaggtttcgtcggcctcacgccccccgtgggcgccgccgtcgtgggcatcgccgcggtgctgctggcggtcgggtcctaccggaccgttcaacagggacacgcgctcttcccggacggtgcggtgggctggtccctcgccgtgctcaccgggatcatcgtcggccatctggtggcgctcggccgcgaccggtggtggggcggcaccggctccggggccgccctcaccctcgcggtgctgctgctgttcggctggctccctgccgtgctggtcagcctcgccgtcgtggtgctcgtcgggaccgcccgcagacaccgctggtggcagggtctcctgcacggcggggtcgacatgctgggcatcggcgcggcggccctcgtgctggccgccttcggcgaggtccccaccgtcgaggacccctggcggccactcgactggggcatcgcggccgtcccggaactgctcctgacggcatcgacgtatctgctcgtcacccgggtcctgctgtggtacgcccaggccccgcacaacggcgggctgcccaccatcgcccgtaccgcgatgctgcggcaggggctcgtcgccgtcgcgctcctcgggctcgccccgctgatctgcgccgtcgcgatgtccatgcccgtcctgctgccactgttcgcggtaccgctgatcgccctcgactccacgctctggatcgcccgcgcccgcgccgaggagcagctgcgcgacccgctgaccgggctgcccaaccggcagtggctgctggagcggacctggtcggcgctggaggacgcggagtccatcggcacccgctccgccctggtcctcatcgacctggaccgcttccgcgccgtcaacgacaccctgggccacctggccggcgaccggctgctgctgcagatagcggagcgcctgcggctcgccctgccgcgcggcgcggaggccgcccggctcggcggcgacgagttcgccg

SEQ ID NO: 3627 - DNA, 796 bp, Unknown
  Kingdom: Bacteria, Phylum: Actinobacteria, Class: Actinobacteria, Order: Streptomycetales, Family: Streptomycetaceae, Genus: Streptomyces
gcccaggccctcctgcgccttcaacgcccgcaggatcctggtgtaccgccagtccgcgtcggccgccgtccgtacggcctgcgccacccggtccgcgatgtcctgggccttcccggcgttcgggttgggcgcgacgagtcccgaaggcgtgaccatgcccgggttcggaaccccggacgccgtcccgcccgacagcggcttcccgtcgaccaggccctcgcccgccgccggatacgtcaccgacccatccgcgtgcaccgtgaacctcagcgccgccgcatcgtccagcgccccctccagcacacgctgctgggccttgatctcatgggccaggctgttcagcgtggtccgcagcagcccgcactcggtatagatgtactggaagttcgcccccagcctgcgcagacggcccacggccgcgccgaccgcctcccccgtctgcgtatcgtgcaggccgggcaggagctgaccttcgatacggtcccgggccgcgtcggcacggttgctcacccgtccccagccgtccgccgcatcctccagttcggcacacttcacctcacgtaacgcggcccaggtcagagcggaacccacaccgccgctccatccgctcaccacgcgccgccaacgcccggcgtcttcaccccgtcgaagccgctcttcaccgcctcgttgacttgcgcctgcccccggacgaccgccctcagcttcccggcgaggctcccgcactcgccgcgcgcgtcctcgatccggcgctcccacgaggcacgcacggcgctcagttcggccagcgaggcca

SEQ ID NO: 3628 - DNA, 4859 bp, Unknown
  Kingdom: Bacteria, Phylum: Actinobacteria, Class: Actinobacteria, Order: Streptomycetales, Family: Streptomycetaceae, Genus: Streptomyces
cctcaccgacaccaccgtcagacacgcgctctccggcaaggtcatcgagctcaccgacaccttcccggtccccgacgccacggcgttcgcggtcggtcagtggtgggccgtgcaggtggacccggtcgccggcggcggcggtgacgaacgggaactgcagaagctggtcgagatcaccgagatcgtcgacgccggacacatccggatcggctacctcaacggctgggaactcgccgcgggccgcaacctcacctggacccgcgtcgagccggtccgcgacacccacgtccgcaacctggtcttcgagggagcggggaccgacgagtacaccggctcccacccggtcagcttcgagtacgcggtgggctgcgacgtctccgggatccacgccaccggcaccttctggccggtcatcatgcgccgctggtgcacccgcttccgtaccgaggactgctccctgaagaacccgcccacggtggagtacggcggcgcgggctacctcacccagcagatctactgcctgtacggacgggtcgcggactgcacgaccagcaatgtgcgccacctcaacgacctcaccgcctccgcctactgcaccgtcgtgaactgccacggcgacggcgacgacgcgggcggcaaccccttcacgacgcacggacagtacgagcacgatctgatcttcgacggcaactccggactgatggacatcgccaactccggatccccgtggggaatgtccgcgaagcggatcaccgtacgcagacatgtctgctcctggttcaccgccaacaccaagatcaccgatctgaccctcgaagacatcacggtgatcgcgcgccccaccttcgaccaggccggcaccctcaccgtcaacgccgacggcgcccaggtgcgcggctgcaccgcgaagaccttcgccgtcggcgagcgttccgcccgctccgccaggccgaccaccgtcagcgactgctccttcgagccgcccgccggtgccgtcctcgtccagaccccggtcacggcgaccgtgcacttcgtgcgctgcacgttcaagggagtcgacggcgcgatcctgcgcggcgcggggcccgtccacctcaccgactgcaccgtcaccggcgccgagaacgcggccccgttctcggtcggctcggcggatctgcggatcgacggcggcagttacgacaacaccggcatcgaactcagcgccgtgcgcgaccagcggatcaccgtcaccggcggcgtccgcctcaccggcagcaacaaggccaaggcgctgctcggccgcgcggccggctccggaaaggtcatctgggacatcagcggactcagcagcgccgcctccggaccggacaccgcccacgtccgcatcgccgacggatccaaccactacgcggcaaccgggaaccgcttcaccggcggcacgctccacctcgctcccgccgcactggactccgtcctgcacgcctcgtgcgtggaggacggaacgaagcgcaccgccatgcccgcgaacagcgacacggtgcgcacggacgggaacctgaccctgtgaccgcggtccgcaccaccacgacggccgacgaaccagccctggccgacctgtgggagcggtgtttcggcccctcggacatcgccgccctgcacgctctcgaccccgaccgccaccagcacaccttcgttgcgccgaacagcgtgggggacgggatcgacgcggtcgtcgtctacgtaccgaggctgatccgcgacgcggccggtaccccgcggcgggtcggcggcatcggcagcgtcgccacccggcccgaggcccggggcagggggctggtgcggcggctgctgacggcggcggagaacgccatgacggccgaacagtgcgcctggtcgctgctgttcaccggaacaccgggcgtctaccggagctcgggatggcgggagttcaccagcacgtacaccgaggggacgctcgcgccctcttcctccgccggggggttccggatccgcgccgccaccgcgcaggacaccgcggagattgccgctctgcaccacgcgtacaacgcggaccggccgctcagctcgctgcgggcgcccgaggactgggccgtgcgcgtccccgcctggtacggaccgtttgaccggtcgctcgtggcgcaggaccccgtttccggtgcgctcgtcggctgggtggcggccggctacgaaggggagtgcctggaggtgcgtgagttcgcgggtgcggccgaatgcctggattcgctgttcgccgccgtcggctcccggggcagggcagcggggctgacgcgggtcagggtcaggatccccgacgcccgggccgcgcttcccgccctgctgacggacgccacgcaggtgacggaacaggtggggatggcacggccgttgcatgccacggccgagtccgtactggctacggtcacggcgcccggcgctgtccactggtacggcgactgcttctgaaactcagccgtgcgggatgcgttccgacagcgcgtgaggacctgccggccggccggttccggcagccacaggcccaccgggccgtccggtcgcagtccgcacctgtccagcagcctcgaccgcagtgcggtggctcgcgggaagctccttctcgcgcatgcgccgtccggaccgctcgacgacgtggccgtgagcgggcggggacgatccggtccggttcacctccgtcaccgccggtgggtcggatcaagcggctgggccaggacttcacctgtgccaccgccgacccattggtcgagaagggagcatcatcgtcgtcaccggcaagacccgcgcagtggaggctttcgccgaacgcagctgagaccgagcgagctggtcagccgcttacgggcgattgctcacgggcgatagatcatttcgatcaggccggcagcgatcagagcccagacgccgaagccgatcagccagatcatgtcagtgagcgcacccacgagcagcagagcgacagcggccagcaggagagcagccacgacacgacgcagctcagggatcgctttcatgtcagggcctccgggacgatgaccgctcggccatcggccggcaccccggtcgatgggttcccgcccggtcggccgggggccgatcctgggcacgcgcagcctgtggccacgtcatcagtatgagccgccgctcagccctgcggaggctcctgacgcggctcctgacgcgtccctgatgcacctctgacgcggtgccgacgcggacacggcccgggcagggcgagatgaaggtgcgcggggacggcaccccgagtgggtcccgccgggggccggggatcctcgctcggcctcgccgacctgtgcctcaggtcgatgaccgggtgcggcaccatgttccggaccttctgccggtcatacgcccggggactcaagcggagcccgtcgtacgcgcggagattcccacagggctgctcgacaccccacccgttcccctcgtgaaccgaccgggaagcggaaggcctgggggatggacccatggcctgacctcccgtcaggggggacgctcacggagcggaccccgccgggatctcccacagtcgtacgccgttgttcgcctcggggtcgtccggggggccgtactggtccgggctgtcggaatcctcgtcgggttcgtcgacgcccccgagggtgttgcccgcgaggaaccgtccgtccgggctgaaggccagttcccggatctcgtcgtcaccgtagccggtgtcgtcgtcggccaggagggcgctcggcctgcggtcggccaggttccacagcagcaccccgccgtcggcggtgacggcgagactccggccgtcggggccgaacgccaggtcccgggcctcgacgcggcggtcggcgagggtggccttgaggcggccggtggccacgtcccacagccgcacgtcgccgccaggcccgccggtggcgagggtcgtgccgtcggggctgaacgcgacggcgtaggtgacgtcctcgagggcgagattgcggcgggggtcgccctggccgtagggctccggatcgatccgggtcaggtcccacagcttggccggctcgttgttcgagtagctgcgcttgtcggacgcgtcgccgacggaggcgagggtcttgccgtcagggctgaacgccatgtccatcacgcgcacctcctgcgtgaagtgggcgcgcgtgtcctcactacggctgttgacgtcccacaggttggccccgacggtgctgccgagggtgatccgcttgccgtcggggctgagggcgatggaataggcgttttcctcgatgcggcggatctcccgtcgccccgccacgtcccagacgccgaccaggttgttgtaggtcctcgtggccagggtcttcccgtcggcgctgaacaccacgttgaggaccctcatgggtctccccgcccagtccttctcgacgagcgtggcgcgcaccttgcgcgtggcgacgtcccacagcctgaccttgccgtgctcgccgccggtggcgagcgtcctgccgtcccggccgaacgcgatgccgctggaccccttggcgaagatcgcggtcgccgcgaccacggggtacggctgcttgttcttcgggggcttcttcgacgagggaagcaggaccgcgaccaggacggcggccagggcgaggacaccgacgacgccgagcagggcgacgtacggcggggtggacgaggtcgcggtcctgcttccctcgtcgaagaagcccccgaagaacaagcagccgtaccccgtggtcgcggcgaccgcgatcttcgccaaggggtccagcggcatcgcgttcggccgggacggcaggacgctcgccaccggcggcgagcacggcaaggtcaggctgtgggacgtcgcc

SEQ ID NO: 3629 - DNA, 970 bp, Unknown
  Kingdom: Bacteria, Phylum: Actinobacteria, Class: Actinobacteria, Order: Streptomycetales, Family: Streptomycetaceae, Genus: Streptomyces
cggccggggtgtggacggcggccgggcggccgttcggtcccctgccgtcctggtcgcccctggcgcttcaggaggcgaccgcgcggacgctcttccgggaccgggccgaggccgcgtgccggtcggcggcggcgggggtgacggtgctcctcgggggcggtgccctgctggtcgcggtcgcgctcggccggaacgcgggggcggcgcaggacgcgttcctggggctcgcgggcgactggtcgggacggttcgccgtgctcctgctggctgcctcgctcgtgcccaacgccgcactgtggggagcggcgtacgggctcggacccggcttctcgctcggtacgggagccaccgccaccccgtggggcctcgacgggaccccggcggtgccccacttccccctgctggcggccgtgccggaccagggtccgggctccctgctgaacggggcggccctggcggtgccggtggcggccgcgctcgcggtcgcctggttcaccgtccgcagggccgcgcccgccgacgcgcccccagctcaggcgtggagccggcgcgagacggtacgggtgaccctgctcgccgcgctggggtgcgccaccggaacggcactgctcacggcggtggccggtgggccgctcggcaccggggcgctgagggagttcggcccggtgtggtggctggccggtccggcggcgctggtgtggaccgcggtgatcggcgtaccggcggcgctgctgctgcgcctgtggcgattgcgtaccccgggctgggcctggcgcagggacgtaccggaagcggaagagccccaggcggcagcgacggcggtcgaggcggaggccgaggagaaggcggaggcggaggccgtcatcggacgtccgcgccgctggtgggcgccgtggcgtgggcggggcgggaaggcgggcgcgtccgccgatgcggcgccgggcggtaccgcggctccggcggcttcctc

SEQ ID NO: 3630 - DNA, 6024 bp, Unknown
  Kingdom: Bacteria, Phylum: Actinobacteria, Class: Actinobacteria, Order: Streptomycetales, Family: Streptomycetaceae, Genus: Streptomyces
tcgccgaacggggcgggggcgagcgtggggggtctgcgccatggcgagggatcacgccgcccgtcacggtcgacccccgtgtggcctcgggtccgccatcgggtcatgatcaatcccggcgtccgggacggtgcgatcggcccccaggccgtccctggagccggcgctgctagcctgaatctgacgtcaacgtgaggtatgagcgggaagggagtgacctgcgtcatgcgcatcggacagcttgccaggcggtcaggggtcagcgtgcgagccctgcgctactacgaggaacagcggctcctggaatcggcgcggacgcccggtgggcagcgtgactaccccgacgaagccctggagcgggtccagctcatccaggacctcttcgcggccggcctctccagccgtaccgtcgtcgaactcctgccgtgcgtgagcaccggcgtcgcgacccccgccatgctcgaccagctcgtcatcgaacgcgaccgcatcgccgcacgcatccaggacctgacccgggcccagaccaaactcggccgcgtgatcgagaatgtgaccgcggcgaacgtggcgcaggactgatcactcgccgcctcggacaggcgccgggcggcgggtggtcggccgccagaggagcagttgccccgtcgggcggaaaacgggccatccgcgcggttcagggccgaagcgtcagacgggcggcaccaggtcgctgtcgctgacggtgtaggtcagcggggggtagacgaagtccgtttccttgttctcgcggcgtcgcagccggtagaactcgctcctctgctcctcgtcggccggcgtcagccgctcaccttgcgagaagtatgcctgtccgtcgcggtaccggacgaaggtcttcgacgttcgaaacgttacgcccatccataggttgtcggccgccccggagggattctccagcacgattctgtgcctgagtcgccggttcgagtcgacggagagcgcgacgacactgttgtgggtcagcgggatctcgaccttcccggcaccggagtccttcgattcgacaatcagcttcctcggccggcccgcttcgggatgctggtagcaggagaagacggcgatgaacgaatcgtcggccagatcgagagcctggtcggaatggctgcccattttcgtgtaggcgttcgtgtagctctcgatgagagcgttgttgaagccggccgaaagcgccgcacgttcctggatctgccgcgccagccgttcgtgcacgggcctgaagtgctgtgccgggccgctgtattgcgtggtcgtgcgtacgagcggcacgccgttggcctcgtccgcccgggtgagcacggcgcctcgccggccctttcccaggtgttccaggtgcgccgacgaggccagctctgcgaagagattcgcctcggccggcacagcgaacgtgaggatctcctccgaaatcctagactcgcggggcaacgtagtctcccgtgttcatgctgaagagaaacctgtcgccgtagtcgatgaaggacgaggttctgttctcctcggcgtagagcttgcgcagatcgtccatgccggatgctgtggggggttccagcctcaccaggtctccggccacatcgaggaacgtgtggccgttcttgtgcacggcttcggtgctcgaacagcgcaccacgtaccccaggcgggtcgggagcaaagcggcgtccagcgtcgagggccggatctcgtgcgtatacaggcggttggtggacagcggcatgaaaaacacggagccgggatagagggtcacgctgaactgtgaggggagtgccaccccgtcgtgttctccggtcggatccttgaggcgaaaacggagactggtcagcccgctggcgcccttcacgccgtagtcgaaggcgtcctcggtcagggggtgcagacggtcgagccggtcgtagaacgtgcagaaggccatgatgccgttgacgggcatgtccttggtcttgtcggcatgggccgagatcttggccttggactgcttgcgttcggccgtggcaagggtgttgtggtagatctgggcgaggacgtgattcagcggcgcctggtcccggaagacggtggcggcctcacggttcagggtctcgacgatgtgcgtgtcggtcgggcggaaactctcggtcggtcccgagaggttggtggagcaccgaagcaggcggaaacgcagttcgtcaccgtcctgtgtgacaggcgtcagatagattccgctgcgatgcgccgttccgggcttggtggactccgtcagggactggaacgtgtgctccgcgcggatcctttcgaagtgaccggcgtcgggtccgaagaagcggcggtagtacacgccggcaccgtgtacgcggacggggacgcgtccgaggtcgatgagggtccacggttcctcgatgtcctcgtggtagccgtgcgacagctcaccgacaacgaacacccgggccgcggagagcagttggtgacggtcgatcgcggatatgtcaccacacagatagacagtccgctgtgcggggtcgggcgaaccggaagcaagatcctcaggtgtgatgacggaaccgaagaagtccttgatcgcctcgttgtcgcgcgacgccgaaggcgcgaccaagaggttgctcgtatcctcgatgcgggcctctgcgagctctgttgtgtgcatcaaccggtacctgtcctcttcgcggaactcgatgggtgctcaaagcgggagacatggcaacgatccggccgacctaggaggcggcggcgtcgtccgagcgggcgcggagggtggcttcgaagtcctcggcccgagcgagctggacgcggagcttttcgacctgctcggcggctgcctgctgataggcgcgcacccgggccagcaactcctcgcgcttgccggagtcgagctggtcgtcggcgtcgagccggtcggtggcatcgagcagttcgcgcatctggtccagggtgaagccgagcggcttcatcctccggatgaccatgaggcgggcgacgtcggtctcggtgtagaggcggaagccgccctgggagcgggcggagggggcgacgaggccggtctcctcgtaatggcggatggtgcgcagggagagctcggtccgtgcggcgacctcgccgatctgcatgtgcttgccgtccatgcccgtgcctctggcctctctcgtttccggagcgttcccggatcgtccccaccggtgccgcccctgggcgggcacccctccgtcgatctctaccctaacgttagggtagagatcgacggaggggaggccgccttccgctgttcgtgttgccgtgtcggggccgatgaagcctccggcgaaggtccgattgtcgcaggagaagagcgtgcgcgagcccatgacgcccggcgtcggcttctgcccgccgtgactccccgcctcgggacgtgactccggccgcgccgaagcgcggctgcgcgtccgttgccggccggactccaccgcacggtcggtggcccccgtcgaaccggttcgcggtcccggccgggggaagggatgcggagcgcgcgtcaccccgtgcgcccgatcgtccacgacccgggaggaacccgttatgagcatgccgcaccgtctgatcggttccggcgaccaccaagtgctggtactccacgactggttcggtaccagttccggctggggccccgtcctggactgtctggacggcggcactttcagctacgccttgctcgactaccggggctacggcgatcgcaaggccgtcggcggagcgtacacgctcgccgagatcgccgacgacgcgctcgccctggccggtgaactcggctgggagagcttctccctcgtcggccactccatgggcgccaaggcggctcaacaggtgctggcccaggcgccggggagggtgcgcaagctggtcggcctggcgcccgttcccgccggtgtctatccgctggaccgcgacggggaggcactgttctacggcgccgcgcaggaccgcgacaagcgacgggccatcgtggacctggtcaccggtcgacgcgctccccgggtctggctcgacctgatggtcgaccgctcgctggagtggtcgacccgcgaggcgttcggcggctacgtgaaggactgggtcaccgccgacctcacggaacggatcaccggcaaccccgttccggtcaaggtcatcgtcggcgagcacgatctcgccctgacggccgatgtcatgcgcgccacgtggctcagccactatccgaacgccgaactggaagagatcgccaacagcggccactaccccatgtacgagactccgctggctctggcgaccagcgtcgagacgttcctgcgcgcctgagcgaccgccgcgcaggggccggcccggccgggccggcccctgcgggtccgggcagcgcccgcctagacgggctgcttctcgctgggggcggaatcctgcgagggggctccgcgcagggtgagcagtgatgcgaccgcgccgacggcggcgagggccgccgctccgatgaaggcggcggagaacccgttggtgagagcttcgggattgccgagttcacgggcgccgtacgccgcggacacggccgtcatcgcggccaggccgagagcggagccgacctggtagctggtgttgacgatgccggaggccaggccgccttcctcggggcgcgcactggacagcgcggtgccgagggaggggatgaacgccagcgacatgccggctgctgccagcagggacgcgggcaggacgtcgacccagaaggtgccgtccgcccgggcgaaggacagccacagcatgcctgccgcgagggccagcaggccggtgacgatcagcggcttgctcccgaagcgggccatcaggcggggcgccagaacgatcatcatgatcatgatggcgaccgtcatgggcagcagggccgcgcccgaggcgaacgctcccagccccaggacctgctggaggtacaggttgaggaagaaccacatggggatccacgcggcggccatcagcagctgcgcgatgttcgctccggccaggttgggggccttccagatgcccagccgcatcagcggctcgcggcgcttggactggatggcgacgaacgcgccgatcagtgccaggcctgccagcaggacgagccaggtctcggccgagccccagccggtttccggggcgcggacgatggcgtagacggcggtggccagtcccacggtgaccgtggccgctccggcgaagtcgacggatccgcggcggacgggggaggagggcatgacccccggggtgatggccagcacgatcagggcgatcgggatgttgatgtagaacacccagggccagctggcgtactcggtgatcacgccgccgaggaagacaccggcggtaccgcccgccggagccgcggcgccgtacagcgccagcgccttggtcaactccttggggcgggcgccgaagagcatcatcaggagcgtcagggcggacggggcgatcagcgcagcgccgacgccctgcagggcgcgcccggtcagttcgacccagacctccggggcgagaccggcgaccagggaacccccggccatcacggtccagcccgcgacgaagatccgcttggcgccgaacaggtcggagagccgcccgccgagcaggagaagcccgccgaaggcgacgacgtaggcgttgaagacccaggacagaccctcgggggagaagcccaggtccacctgcatcttggggagggccacgccaatgatggacgtgtccatgatgaccgtgaactgggccagggctatgaggacgagtgccgtccagcggcgtggactgggaggagcggacggggatgacataactgtctcctatacgggaggggggtatctcgcttcgcgtgagcaatataccccctaggggtatgtcgagctgtggtcggggccgatcgggcaggtctgtcggggtgctgggttcgccaccgcgctcgcgcgacgtctgccgacaagggcgtcctacgcggccttggacagggcggaccggtccgcc

SEQ ID NO: 3631 - DNA, 1570 bp, Unknown
  Kingdom: Bacteria, Phylum: Actinobacteria, Class: Actinobacteria, Order: Streptomycetales, Family: Streptomycetaceae, Genus: Streptomyces
cacccacaccaccaccgggcggatcggcaggacccgccaccggctcctcgccccgctcgtcgaggacagcggccatggcttcgaccgtcttcagccggaacacgtcccggggacggagtgacaggccggccctgcgggcccggcccgcgacctggatggacatgatgctgtcgccgccgaggtcgaagaagctcgcgtcggccgccacctcgtccagacccagcacctgcgcgaacagaccgcacagcaccacctcacgcggcgtccgcgccgcccggccacgcgccgaacccgcgaaatccggtgccggcagagcacgccggtccagcttcccgttcggactcaacggcaacgcgtccagcaccacgaacgccgacggcaccatgtactccggcaacacccccgccacagccacccgcagcgccgcgacatccacaccatccacggcaccgttctccggcaccacatacgcgacgacggcgcgcacaccgggacggtcctcgcgcaccaccacggcggcgctgccgacaccggggtggctcgccacggccgactcgatctcgcccagttccatccggaagccgcggaccttgacctggtcgtccgaccggcccagatactccaggtcaccgccggccgaccaccgcaccacatcacccgtgcgatacatccgcgcaccgtcggcgccgaacggatccgccacgaaacgcgaagccgtcaggcccgggcgtttcccgtagccgcgggccaggccgggacccgcgagatagagctctccccggacacccgggggaaccggtcgcagacccgtgtcgaggacgtacacccgccggttgctgatcggacggccgatcggcggcgaggacggggtgggcccgtccccggcgtaccagccggtcgagtagacggtggcctccgtcgggccgtagaggttggcgatcctggcatccggcatggtgcggcggatccggtcgaccagccgtgcgggcagagcctcgcccgccagcaccaccaggccggcccgggccgccaggccggagtgggtcaggagctggtcgaaggcggacgggaccgcgctgacgagggagccggaccaggtgtcgtacggctcgtcggcgagcgcgagcacatcgcgcaccacctcggcgcagccacccgacaggagcgggccgaagatctccaggacggacacgtcgaagttgagggaggtcgagaagagcacccgcgacagcgcgtcggggcccagctcccgggcggcccaggaggcgaagccgaccacactctcgtggctgacgacgacgcccttgggacggccggtggagccggaggtgtagatgacgtacgccgggttcgcgggccgcagcacgagggtccggtccgcgtcggtcagcggggttccggacgcggcgcgcagagcggcggccgtcggctccgcgtcgagcagcagacggggtgtgccggtgtccgggagacccgcggccaccccggagttggtcagcgtcagcaccgggtccgcgtcctggagcaggaaagcgatccggtccgccggataccccgggtccaccggcag

SEQ ID NO: 3632 - DNA, 3287 bp, Unknown
  Kingdom: Bacteria, Phylum: Actinobacteria, Class: Actinobacteria, Order: Streptomycetales, Family: Streptomycetaceae, Genus: Streptomyces
ggcctcctccgcctgcgccgacgcggcggcggcatcctcctgccgcacctcgtactccgcgcccgctccccgcgcctcgtcgccggcgcccgtcccacggtcctcgtaactcatgcccgacccaccgttctcgccgtgcggtccgctcagctcatcgggcctctacgggcccgcccgcgcgaggattcactgcggtgcgtagcagcctagttacacggtggtgccatcggtcggcgtatgggagaaccggcccgaccggtacgtccctgcttgcccccgcccgtacttccccggcgtacgcgaaagccccggtacgccgaccttcggcataccggggcttcccggacctctacggctctacggcagcgccagcatccgctccagcgcgagcttcgcgtacttctccgtctccgggtcgacctcgatccggttgaccagcttgccctcggccagcgactccagggtccagaccaggtgcggcaggtcgatgcggttcatcgtcgagcagaagcagaccgtcttgtcgaggaagacgatctccttgtcctccgcggcgaaacggttcgccaggcggcggaccaggttcagctccgtaccgatggcccacttcgagccggccggggccgcttccagggccttgatgatgtactccgtcgagcccacgtagtccgcggcggcgacgacctcgtgcttgcactccgggtgcaccagcacgttgaccccggggatccgggcccggacgtcctcgaccgactcgaccgagaagcggccgtggaccgagcagtgcccgcgccacaggatcatcttcgcgtcgcgcagctgctcggcggtgaggccgccgttcggcttgtgcgggttgtagaggacgcagtcgtccagcctcagccccatgtcccgcacggccgtgttgcggcccaggtgctggtcggggaggaagaggatcttctcgccctgctcgaaggcccactccagggcccgcttcgcgttcgaggacgtacagatcgtgccgccgtgcttgccggtgaaagccttgatgtcggcggaggagttcatgtacgagacgggcaccacctgatcggcgaccccggcctccgtcagcacgtcccagcactcggcgacctgctcggcggtggccatgtcggccatcgagcagccggccgccaggtcgggcaggacgaccgcctgggcgtccgtggtcaggatgtccgcggactccgccatgaagtggacgccgcagaagacgatgtactcggcctccgggcgcgcggccgcgtcgcgggccagcttgaacgagtcgccggtgacgtccgcgaactggatgacctcgtcgcgctggtagtggtggccgaggacgaacaccttgtccccgagcttctccttcgcgacgcgggcgcgttccaccaggtccgggtcggacggggagggcaggtcgccggggcattcgacgccgcgctcgctcctcgggtcggcctcgcggccgagcagcagcagcgcgagcggtgtcggctgtacgtccaggggctgggccgtggtcacgtcacgcaccctttctagtctgcgaactctgtgaaccccgcgagcttccgcggagaacttcggcgaactcgccttttcgtctatttgacgttatctatcatagccgcttcgtgtcactttgacgatgccgatagcgtcgatgtgacgcatcccccgggcggcccggtgtgcgagcatgaaaaggaacagacaagcgcttggcccggaatgtttccgaggctgagacggttgaaccgtcggcaagcagtccgtacaacccgggagagaagcagatgtccgtatcggacgagaccaccaccgtgagcgacggcatcctcctgtccgacgccgccgccgccaaggtcaagggcctgctggagcaggaaggccgcgaggacctggcgctgcgcgtcgccgttcagcccggcggctgctcgggcctgcgctaccagctcttcttcgacgagcgttcgctcgacggcgatgtcgtgaaggacttcgacggcgtcaaggtcgtcaccgaccggatgagcgccccgtacctgggcggcgcctccatcgacttcgtcgacaccatcgagaagcagggcttcacgatcgacaacccgaacgccagcggctcctgcgcctgcggcgactcgttcaactaagcgctgcgcgtacagcacagggaggcggccccgggatcggtcccggggccgcctccgtatgtccgtcgtactgtccgtgagtccgccgtcggcgtccgtgcgtccgccgtcagccgcgcggcaccgcaccgcccgacgccgcgtcgatcaccgtacggtcgcccagcggcttctccagcgtcaccgtccgcgtcagttccttggcgatcatgatgcaggccttcttgccctcctgcggcttctccgtgaccgagatccgcacctggcccgcgctctccttcgcactcgccgtgtacgtactgcacacgccgccccagaacgtcacctcaagagtccgtccgtccgcgccgtacgacgtcaccttccggtccccggtgggcgtcggcctatccggcttctcgatgaacttcgggtccaccgcgacctgagtgacggtgtgctccgggccgcccggggcctggcggaccgtgaacagccaggacggcaccagcgtctgccggccgtccacgtagttcagcgcgagaccgaacaccgcgtcctcgaccgtctgctccaccggcgcccgcttgccgttcgacggcacacactggggggccgagggcttcggctcaccctccagcggtacgggagtggcgcagccgccgatgtcccggtcggcgtcgcccttgcccctgctcgccgcgttcagctgcttcagcgcctcgtccgcgccgaccgccggataggtgtcgcccttctccagcgccttcaggtgtccgctgccgccggccacctcgccgtccggtcccacctggacaccggtcgaccagccgtacgtcgggagcccgtcgatccgcgggtcggcgttcaccacgcggacgtcgcccatcagttggccggcgttcagtgccgcgtcgtcctgcccggccgccttgagcaccgggaccgcggccgccttcgccgccttctcgctcaccgggtcgccgcccggctccgaggtcccgttcgcgcacatcgtccccgactcgcagggtttgggcggggtggcgcgggtgaacgtccaggtgcccggggcctgcttcgtcaccttcaggagcgcaccggggccgtcgtcgtcgccgaccacccaggacgtgccctcgg

SEQ ID NO: 3633 - DNA, 2740 bp, Unknown
  Kingdom: Bacteria, Phylum: Actinobacteria, Class: Actinobacteria, Order: Streptomycetales, Family: Streptomycetaceae, Genus: Streptomyces
  misc_feature (375)..(376): n is a, c, g, or t
gcgcgggcgcgcgggtcgggggcctgcggctgggggtaccgggggtcgaagctcatgtcgtcgagtccttctgcgaaggggccgggaggggtgaggacggtccgtgaaccgatgcgcgcggagggccggaaggccgggcgggaagccgggtggaaagccggccgctgctcggctgccgcccccgtgcgccacggtcgccgatcgtagtgggtggccgagtgctctctctcacaccgtgtgcgtaatctgggggaaatcccgggtcgcgatactgaagtgtccccctaccccgggcggtggtgcacggaccgtctgaactgcaaggatgtggcaatggacaagcagcaggaattcgtcctcaggacccttgagganncgagctggagcaggccttcgacgagggcatcggcttcgacggctcggcgatcgagggcttcgcccgagtgtacgaatcggacatgatcgccaagccggacccgggcaccttccagatcctgccctggcgcgcggaggcccccggcaccgcgcggatgttctgcgacatcctgatgccggacggctccccgtccttcgccgacccccgctacgtactgaagcggatcctcgcgaagacgtccgacctcggcttcaccttctacacccaccccgagatcgagttcttcctgctgaagaacaagccggtcgacggcacccgcccgaccccggcggacagctcgggctacttcgaccacaccccccagaacgtcggcatggacttccgccgccaggcgatcaccatgctcgaatcgatgggcatctcggtcgagttcagccaccacgagggcgcccccggccagcaggagatcgacctgcggtacgcggacgcgctctccacggcggacaacatcatgacgttccgtctggtgatgaagcaggtggcgctggagcagggcgtgcaggccacgttcatgccgaagccgttctcggagtacccgggttcgggcatgcacacccacctctccctcttcgagggcgaccgcaacgccttctacgagtcgggcgcggagtaccagctctccaaggtcggccgctccttcatcgcgggcctgctgacgcacgcggcggagatctcggccgtcaccaaccagtgggtcaactcctacaagcgcatctggggcggctcctcccgcgcggccggcgcgggcggcgaggccccctcgtacatctgctggggccacaacaaccgctccgccctcatccgcgtcccgatgtacaagcccggcaagaccggctcggcccgcgtcgaggtccgctccatcgactccggcgccaacccctacctcacctacgcggtcctgctcgccgcgggtctcaagggcatcgaggagggttacgaactcccggccggcgcggacgacgacgtctgggccctctccgacgcggagcgccgcgcgatgggcatcgagccgctcccgcagaacctgggcgaggcgatctcgctgatggagaagagcgaactggtcgccgagacgctgggcgagcacgtcttcgacttcttcctgcgcaacaagaagcaggagtgggaggagtaccgcagcgaggtcacggccttcgagctgaagaacctgctgccggtgctgtagtcactgatcggcgagcggggagcccgcgtgcgcgacttcgggccgacggtgtcacaccgccggcccgaagccgtcgcaggtcgaaagtgcgggcgggaagaggaggccggaagcgcaggccggttcttcggtgtcagtagcggtggcccggccagtgcgggtcctcccagcgggccgggccggtgaggccgatcaggcgtacgcggtgcagcagtgccgcggagcccttccggaggtgcagccgcctcggcacgtggcggaccagccaggcggacagctcgccgcgcatgccgctctcgtcctcgtagtcccacgcgtcccaggggagttggtcgcccaggaggtcgtactcccacgcggcggccgcttcggccaggtgacggtcggacatctcgtggtcgagggcctcccagacggtgagccacgggccgagcgtggcggaggcctcggcgcacagagccaggatctcgtgaacgcgcacggcggggtccgggtccacgaggctccgggcccaccaggcgtgcaggaactcccacaccgccgcgtcctggtccgcgggccattgccgccagtgcccgcgggcgaacgagcggccgacctcgtacataccgaacatgggctccacgcggccgctcaccagcgcccgggcgaactggggcaggatccggcgcaacaccgccccgtggtcggcccagtcgggggcgtcccaggtccggcggaggaggtcgggggagaggccgacgtccggggtcttcagcagcgccagctcctccgggctgccccagtggcagacgcactggacctcgtcggcgcgcgcggtcatcccgcggaaggtgtcgtccaggctctccagggcgcggtcgagccggagccgggcgggggtggtgggattcatcgtgatcggcacagcctcagggactccagcaggtctccgcctgccgaagatcgccaccttacgcagtggggccggccgtgtcgccggggttgttccaagcggcccgcgacctggcccccgcccgtacaccccgtacgcgacgggcacgggccaggcgtgaccggacgcgctacaccggcggcgtccccggcggtgacggtgcggggggcgggttgggcagtgg

SEQ ID NO: 3634 - DNA, 5028 bp, Unknown
  Kingdom: Bacteria, Phylum: Actinobacteria, Class: Actinobacteria, Order: Streptomycetales, Family: Streptomycetaceae, Genus: Streptomyces
gcccagctcggccgccgctgcgcggggtagtcgccctcgctccgatcgcggacttcaaggcggcggccgagctgggcgtgtgcggcggtgcggtcgctcaactcctgggcggggacgccgacgtcgaggcccgggcggcacaggccgaccccggggtgctgctgccgaccgggatcgccaccgcgatcgttcagggcgtcgaggacatcgtcgtcccgcaggccgtctccgaggcgtacgtcgacgcggcggccaggtccggcgagatggtgggcctgacgctgctcggcggcgtcggccacttcccgctgatcgatccggccgccgacgcctgcgccgtcgtggccgaggagatcacccagctcgcctggtgaattccctcgggcccccgccctgattgcggacggaaggtgtccgcaagggtctctacgttggtcctgttgccgctcggacggaggcggaaccgacgtaaggagacctcatgacgatcctggtgaccggagccacgggaacggtcggccgccgcgtggtcgagcagctgctggagcgcggcgagcacgtccgggccctgacccgcgacccggcgcgggcggagttcccggacggggtcgacgtcgtccgcggcgacctcacggacccggcgtcgctggcccccgcgctggtcggggcgagcgggctgcacctcatcaccttcggcggcgagttcttcgccccgctggagaccggtgaggagatcctcgccctggcccggaacgcgggcgtgcgccgggtgaccgtgctgcacggcggcggggagaccccgatggaggcggcggtgcgcgcgagcggcctcgcctggaccgtcgtgatgccggtggagttcatggcgaacgccctggagtgggcgcccggcatcaggagcgagggtgtggtgcgcgagcccttcgtcggccggctgagcgcgatggtccacgaggcggacatcggggcggtggcggcggcggctctcacggaggacggtcacagcggtcaggtgtacgtggtcaccggaccgcaggcgctgaccgtcggcgacaagacggcggtcatcgcggcggcgcggggcgcggacgtggagctggtcgagctgaccgaggagcaggcgctggagagctggcgggaccagggcatgccggaggacgtgatcgctttcctgatcgacgtctaccgggacaccccgccggagggccggaccgtgatcgacacggtggagaaggtcaccgggcggccggcgcggaccttcgcgcagtgggcggaggagcacgcggaccacttccgcgcgggggcctgagaaggctgtcaccaggggttttccggtcctcgggacggtacggcggaggcgggtagtccttgagggggacggcccggaatccgtagcgatgctgacgacccgccgtccgccgccgcctaccgtggaagcgtgaccgagacccagacaaagaccagcagcccggagttccgggcggccgcaggggcgatggacggcctgcggaacgacctcctgcgcaaggtgttcgactaccgtcccctgccgccgctcaaccccgacggacgggtggtccggcggctgcccgaggggatgcgcaggctcgtcgtctggaccccgcacgccctggtgctgttcgccgccttcctggtgatgatggccgggttcgcggagtgggactaccgcttcctgatgggcgtggtgcccgcgatccctgtcgcgatgaccctgatccggccggtcgccgcgttctggggatcgatgctggcgaccgtcttctgcggggtcctgggcggcgatctgtggaatccgagctccttcatggcccaggtggtggtcatggtggtcgtggccgcccggacccggccccgtacgggcgcctggatgtggctcctgaccttgctgttcggggtgctggtggaggccggagacccgtcgatcaccgcacccctggcgacgctctccgccttcgcgctgctcgtcgtcgccgtggtccagatccggcgcgacgccgagcgcgaggtcaccgtgcagcgcaccgtcaccgctgtcgagcgggaccggcgcaccctgctggaggagcgcaccaccatcgcccgggagctgcacgacgtggtggcccaccacatgtcggtcgtcgcgatccaggccgaggccgccccctaccgggtcgagaacccgccgcccgagctggagcaggccttcgtcaccatccgggagaacgcggtggccgccctcaccgagctgcgccgcgtcctcggggtcgtccgggcggaggactacgaggcccccgacgctccgcagcccaccctcgccgcgctcgacggactcctggacaacgtccgcgagacgggtctggagaccgagaaggtgatcaccggggccgtccgcgaactgccgcagggcgtcgagctgtcggcgtaccggatcgtccaggaggccctgagcaacaccctgcggcacgcgccgggcgcctccgcccgggtcgagctcggctatgtcctcggcgggctcgggctgcgggtggtcaacggaccgccgcgcggcctggtcaagccctcgccgggagccgggcacgggatcaccgggatgcgggagcgggtcgcgatgctgaacggcgagatgacggccgggacgaccggggacggcgggtacgagatcgccgtgttcctccccgtaccgctgtcggacggtccggagccacgggagacggccggcggcacggcggacgcgacgggcgacgcggacacggtcgtcgtcgaacggggaggcggcgcatgagcgacaccgacatccgggtcctgatcgtcgacgaccagatgatggtccgcgagggtttctcggtcctgctcaacgcgatgccggggatcaccgtcgtgggcgaggcggtggacgggcgtcaggcgctcgcccaggtcgccgccctgcgccccgacgtcgtcctgatggacatccgtatgccggagatggacggactcaccgcgaccgagcgactgcgccgccggcccggggctcccgaagtcgtcgtcctcaccacgttccacgcggacgaacaggtgctcagggccatccgggccggggcagccggattcgtcctgaaggacaccccgccggcccggatcgtcgattcggtccgccgggtcgccgccggggatccggtgctctcacccgccgtcacccgccagttgatggcccgcgccgcgggcggcggacacgacgaccgggccggccgcgccgaccgcgcacgcaggcgtttcgatcaactcgccgagcgggagaaggaagtcgccgtcgccgtcggacgcggcgggtccaacgcggagatcgcgggatccctctacctcagcgtcgcgaccgtcaagacccacgtctcgcggatactcgccaaactcgaactcaacaaccgtgtccagatcgcgctgttggtccatgacgcgggactcctcgacgcggacggggaggacgggggcggcctacgctgagcggagtggaccggagcggaacggagcggaacggaagaggggctgaccgccatggcgctggaacgctgtcccgccctcgcccgcgacccgtccggcggcgagccggaccggctgcccggtcgctgacgcgcgggtgcgggctgccggtccgctggtggggccaggcccgcaccccctcctgccgcacagcgcatctccttgaagggaaccgagttgagcaccgaacccctggtcgatctcgccgcgctcggcgatgagttcacccgcgacccctatcccgcctacgccgcactgcgcgcgaagggtccggtccaccgggtgcggatccccgagggcgcggacgcctggctcgtcgtcggatacgaggcgggccgcgccctcctcgccgaccagcggctctccaagcactggagccgggcctcgccgtcgctcggcgtcagcaaggtgtccgcgggctcctcgatgctcggctccgacgcccccgaccacacccggatgcgcaagctggtcgcccgcgagttcaccccgcgtcgcatggagcaactggccccgcgtgtccaggagatgaccgacggactgctggactcgatgctcgcggccccggcccgtgcggcggacctggtcgaggcgctctccttcccgctgcccatctcggtgatctgcgagctgctcggcgtcccgtccctggaccgcgaggccttccgtacctggtccggccaggcggtctcctccgtcgacccgtccctgcgcgcctcctccacgcaggcgatgaccgcgtacatcgccgggctgctcgccgacaagcgcgagaaaccgggcgaggacctgctgagcgcgctgatccacacctccgacgaggacggagaccggctgtccggcgacgaactgatcggcatggcctggctgttgctggtcgccggacacgagaccaccgtcaacctcatcaccaacggcgtgcacaaccttctcgcccaccccgatcaactggcggctctgcgagccgacttcacgctgatcgacaacgcggtcgaggagatcctgcgcttcgaggggccggtggagacccccacctaccgcttcacgaccgatccgatcgaggtcggcggggtggtgatccccggcggcggcgagctggtcctcgtcgcgatgtcggacgccaacagggacccggcccgctaccccgacgggtcccgcttcgacatcacccgcgacgcccggggtcacatcgccttcgggcacggcatccactactgcctgggcgcgccgctggcccgcatcgaggccaggatcgccatccggtcgctgctgcagcgctgtccggacctgcggccggccgccgacccggcgacgctccgctggcgcaccgggatgctgatgcgggggccgctgagcctcccggtcgcctggtagcggccggtccggcaggcccggggaccggttcagccaccggggatctcggccatcgccaccggccggcgttcgcggcgggagacctcgcacgcctcggcgatccgcagggcgtgcagggcctcccgtccgtcg

SEQ ID NO: 3635 - DNA, 3958 bp, Unknown
  Kingdom: Bacteria, Phylum: Actinobacteria, Class: Actinobacteria, Order: Streptomycetales, Family: Streptomycetaceae, Genus: Streptomyces
tcccgcccgtcccggccgtcacgcccgtcctgttcgtgcggctcgtccgccgcccggccggaggcggggtcggccggactcgtaccagcacccatggggttccctccggatccggccgtcagcccgttgcggcggcgtcggcggcctcggtggcggcccgctcggcggcctcgaccacgttgaccagcaactgcgcgcgggtcatcgggccgacgcccccggggttcggggcgacccaggcggccacctcgcggacccccgggtgcacatcgccgacgatcttgccgtcggcgtcccggctgacgccgacgtcgagcacggccgcgcccggcttcacgtcctccggcttgatcaggtgctgcacaccggcggcggcgacgatgatgtcggcctgccgcaggtgggaggagaggtcacgggtgcctgtgtggcactgggtcaccgtggcgttctccgacttgcgggtcagcagcagggggatcgaccggccgatggtgacgccgcgtccgacgaccacgacgtgcgccccgttgatctccacgccgtgcgcgcgcagcagctggacgacgccctgcggggtgcagggcagcgggccggtctcgttgaggacgaggcggccgaggctcatcgggtgcagcccgtcggcgtccttcgccggatccatcagctccaggatccggttggtgtcgatgcccttgggcagcggcagctggacgatgtaaccggtgcactcggggttggcgttgagctcccggacgacgtcctcgatctcctcctgcgtggcggtgtcgggaagttcgcgctggatggagccgatgccgacctgggcgcagtcacggtgcttgccgttgacgtaccaccggctgcccgggtcgtccccgacgagcagggttccgaggccgggagtgatcccctgggccttgagggccgccacacggacggtcagatcggatttgatcgcggcagcggtggccttgccatcgagaatctgggcagtcatggtcccatcctcgcggatgaccccgcccgcataccaattgccggcgccgcccccgtaccggacattgcacttgcacaacgtcgagggtcccggactggacaaacgagggtcccgcttataacgatgaaggccgcggttgtacggggggtgggccgctgatcgatgtccttcctccgtgtggccatctcgtccccacacgtctgttgaaggaaacaccccatatgagcttcggcgacccgaacaacccgtacgggcagcagcccggccagccgccgcagggcccgccgcagggacagcccggttacggctacccgcagcaggctccgcagggtgtcccgccgcagggctacggctacccgcagcagcagccggggtaccagcagcccggctacccgcagcagcccggccagccctacggcggcggctacccacagcagcccggccagggcggcatgccggagctggcgcactggggtctgcgcttcggcgggctgatcgtcgacgggctcgtcctgatggtcccgtacatcctggtcatcatcggcagtggaatcggcgactcgttcggcgcgatcctcggcgtcatcggcttcatcggcctcatcggcctggccatctggcagctgtaccaggagggcaccaccggccagacgatcggcaagaaggccgtgggcatccgcctgctgcgcgaggccgacggccgtccgctgggcttcggcatggccttcgtgcgccgcctggcccacttcctggacagcatcgcctgctacatcggctggctgtggccgctgtgggacgcgaagaagcagacgttcgcggacaaggtctgctcgtcggtggtcgtcaaggccaactgatccgccgcagcacctcgcacgtacgaaggccgcccccggtgaacgggtgcggccttcgcgcgcgtacgggcccgggaccgcggtcggtcgtcccgggacccggtcagtcgccccgcgcgcccgggatctccgccggctccggtgacgtgcgctccatcaccacgaagctgccgccccggtgcttgagccggtaggacgcctcggggtgcagctgctgggcgtacgccaccgggtcctggatcgggcgggaccagccgaagtccaggttgatggcgacgatgtcgggtgcggttcccggggctccgccgacccagtagacggtgcggtcggaggtgaggtgggccatcagcgtgatgtccgtctcgacccgcgccccggccgggatggcgtcgagcgccgcccgggccgcctggctgcgggcgtcgtcggtgcggtaggtctccgggcgcaggagatcgcgcagcggcaggtgctgggtcagcgcgacggcgatcgcggcggcgacgggcacggcgaccttcgcgtacgaggcgagccagggccggtgggagtcgcggctgcggcggacgccgtcggccagcgcgaggaagagcaccggcatgaggatcgcgctgtagtgccagaccatgccccagtggttgctgtcctgcgagagcagccgccagccgagggtgggaacgatcagcagcgtcagcggtgaacgcagcgccatgaacgcggtgatgccgatcaggaagaccagcatctcgatcttgacggaggagttgaggacgcccaggacggagtccagcatcgagacgtcctgctcgccgttcttgtcgatcttcgtccagtagtcgtaggtgcccgcgctgctggccgcggggatgaggaccatgagcgtgacgacgaaggcggcgaccccgaaggcggcgagcagcgcgccctggaggcggcggccgtacacgaagagcaggaagccgacgaccgccacggtggcgcccaggtcctccttgaccaggaccagggggagcgaccacaggagcgcggccgtgtaccgcttcaggagcagcgcccggcagacgagggcgagcaggggcaccgcgaaggcgatctcgtggaagtcggacttcaccgcttcctggattccccaggagagtccgtacgcgacggtgacacagagtccggagcgcccaccgaggagctgctgggtggtgcggccgacgacgaccgctcccagcgcgaacagcgcggcctgggcgaacagcagggcctcggccgacggccagagccagtacagcggggccagcagcgccacgatcggggagaagtggtcgccgaggatcagatagccggggcccttgatgtcgacgaccggggcgtcgaacccggcgtacgcccggacctcctgctcgaagatgccgaggtcccaggagggcgagccgaagcggctgtactggaagtacgcgtagaggaagtagagcgcgcacaggatcgcgccggcgatgaggtacgggcgcaggggtacgcgttcggcggcggcgtcgcccgtacgcggcgcgtcgccggccggacgggcgtccggccccgggccctgggcgggcaggcgtcccggtcccggccggtccgttccactcttgttcagctcaagcacggtgactgcccccgccagtgatttccacggccgttcattagaccagagcggcgagccggttccgcacgacggacaaggccgaggccgcacccgtgtcgggtgcggcctcgggtccggtcggtggaagagggaccggccagtggaattcggtggaagaggtaccggtcagtggaagaagtggcgcgtgcccgtgaagtacatggtcacgccggccttcttcgcggcctcgatcaccagttcgtcgcggacggacccgccgggctgggcgacggccttgacgccggcggccgtgaggatctccaggccgtcggggaacgggaagaaggcgtcggaggcggcgtacgccccgcgcgcccgctcctcgccggcccgctcgacggcgagcttcgcggagtcgacccggttgacctggcccatgccgacgccgaccgacgcgccgtccttggcgagcaggatcgcgttggactt

SEQ ID NO: 3636 - DNA, 6927 bp, Unknown
  Kingdom: Bacteria, Phylum: Actinobacteria, Class: Actinobacteria, Order: Streptomycetales, Family: Streptomycetaceae, Genus: Streptomyces
aacggtcctggagtccggcgacgacagcgacgacgacgcggacgcgggccccgaccggatccgcggcaccggcgacgagggcatcgcaccggcccaccgcccggcgggacaggccgtggccgcgaccctgcacggacgggccgtcatcaccaccagccgactgccccacccgatgatcgcggccaccgcggcgaccatcgcgatcggcctcgccttcacggtgttcgccgacccgctcaccgccttcaccgaccgcacggccgccgagcttctccagcggaccccctacgtccaggaggtgctgggccggtgaaacgcatcctgcgtctctccttccgcaacgccgatctgccgccgctgagctgcgagttcggtacccgccgccgacgcgtgctggacctgccgctgatcgcctggctcaccgtcatctgggtgctgctctggtcgaccctcacctgggccaacgtcctcaccggcctggtcgtctcggtggccgtctgcctcgccttcccgctgccccgggtcgacctcggactccggctccacctctggggcatcctgcgcctggtcggctatctcttccacgacatgtacacctcgggggtgaaggtcacccggcagatcttcttcggcctgccgcaccgggccgccgtgatcggggtgcccctgcgctgccgcagcgacctgatgctcgcggccaccgccgtcgccgtctccaacgtccccggcggctccatcatcgaggtgcgccgggccaccgccaccgtcttcctgcacgtcctggacgccgaccgtcccgaggagctcgaagccgcccggcgccaggtgtggcggatcgaggaactgaccgtacgggccttcggcacccccgacgagatcgcccgggtcgccgaacccccgccaccgccccagctcgccgcagggagacccgcaccatgaccgcgcccgaacaggtcgaccacatcctgctgaccgctgccgtcgtcctgatcctgctcgccggagccctgctgctggcccggatctggcggggtccctccatgctggaccgggcgatctcgctggacgtctgcgccgccctgatcatcgccggactcgccgccaaatcggcgttcgcccgggacccgttctacttcccgatcatgctggtactggccttcctcgggttcaccggctcggtgggcatcgcccgcttcatcgccgtacgcgaccggccccgccgccagcactccgacgacacccaggaggggccgcggtgagtctctggctccagatcgccgacacggccggtgccgcactgctcctcgtcggcgccgcgatctgtctgctcggggtgatcggcatgatccggctgcccgacgtgctctcccgcagccacgcggcgaccaagccgcagaccctcggcatgatcctggtgctggccggggtcgcgctgcggctgcgcggcggcatggagctcgccaccctcggcctcatcgccttcttccagatgctcaccggcccggtggcctcgcacctggtggcccgttccgcgtaccgcaccggccagatcgaccacggcgagctgctcttcgacgaactcgacgagcagctcaccgagggcaactgagcgacggccgaagcgcgttcacgcccccggcacgcggtcgaggaacccgctcaccgaactgatccggccgtcctcggcgagccggaccacatcgaacccggccaccggcgcggagccgtccaccggggagaccagctcccaggcgaaccggaccaggtcgtggtgtccgtcggccgtcccggcgggccggaagcggaagccggggaactgctcgtgcacgccggcgatcacggccgccagcccctcgtgtccctgtacgtcggccagcgggtcggtgtagcgggcgtcggcggtgaacgcggcggcgacggccttcgcccgctcctcggtcccggtggtgttccaggcggcgaagtagcgctggacggcctcgtcgtacgtggtcatggtgtgccctctccttgtgcgccccggtggtccggggcggtgacaccaccttggcccgggggtccgggcaccgtcgattaccccggaggtaagggggctccgggtgccggtccgccgccgggcgtagggtcgaaggagatcgcgcatcgcgcatgtcgagcgggggcaggaaaccatggcgtacggaacggtcacgacggtcagcaccagcggcgggcacactttcagcaaggagaaccgggacagtgtgacgctgctcgccggcctcggggtcgagggggacgcccacgcgggcgagagggtcaagcaccgttcccgggtcgcgcaggaccccacccagcccaatctgcggcaggtccacctgatccacgaggagctgttcacggagctgtccgacgccggtttcaccgtggcccccggagagctgggcgagaacctcaccactcggggcatcgacctgctcgccctccccaccggcaccctgctgaggatcggcgacgacgcggtcgtcgaggtcaccggcctgcgtaacccgtgcctccagatcgaggccttccaggaagggctgctgaagcaggtcgtcggccgggacgcgacgggcgcggtcgtgcgcaaggcgggtgtcatgagcgtggtccggcagggcggtgtgatccgccccggtgacacggtcgccgccgaactccccgagggcccgcaccgtccgctggaacgcgtctgaatcccctcgcttccctgtccccgccaaagcacccacgggccggtgtccgcatgccatgatgcgggcaatgccggacgctggggggcgtatgggaagcacgggcacagcgctgcgcgaattgcgcggcgcacagaagagcgccaagggcgtctcgctctattcgaggtacgtgaaccggcccgccggccgggtgctcgcggccggagcgtaccgagcgagtatgacgcccaatcaagtgacggtcaccagtgcgttgttcacctacggcgcactggcgtcggtcgcgctcgtcgagccgtcctggacgctcggcgtcctggtctgggcggccctcgcggtcggcttcgccttcgactccgccgacggacagctcgcccggctcaccggccggggaggtcccgacggggagtggctggaccatgtcgtggactgcgggaagctggtgctcgtccacgccgccgtcctgatctccttctaccgcttcggtgaacttccttcagaagcctggctgttgcttccgctgggcttccagctggcggcggtggtgaccttctgcgcgggtctgctgcgcgaacagctcggcaaggcggcggcgagtgcccggggtccgtcatgggcggcgccggcgtcggcggcacctgtctcgcgggtgcgggccgtggcgctgctgcccgccgactacggagtgttctgcctggtgttcctgctgctcggcgcacccggagccttccgcgccgggtacgccgtgctcgcggtggtgcacacgctgttcctggcgctcttcctcggcaagtggttcagggagctgaaagcgctccgggccggctgacgagcacgtccagcgcccggcgcagctgggtgctggacgtgtgcacggtgtacgggaagtagacgacctccacccccacttcggcgaagtcgcgttccagcttctcccccttctccgtgccccgccagtcgtctcccttgaagatcacgtcgaaccggacctgctgccaggtctcgaccttgtccggcacggtctccacgaacgcggcgtccacgaagcgcacgctgcggacgatctccagtcgttcgcggagcgggatcaccggcgtgtggcccttggcgagggcggccatctcgtccgacacgacccccgcgaccaggtagtcgcactggctgcgggcgtgccgcaggatgttgaggtgcccgacgtggaacaggtcgtacaccccgggtgcgtaacccaccctgtgctgcaccatccgtatctctccccccacggtgaacgtgatccggtgatgttccaacgaccttactgtgaagaacacttgtgcaagccgtgaacggataagctggacaggggctgctccccggtggggacagtggctgtcgtggggggaaggcgatcgtccgatgtccgaagcgtcaaggcccggtccgctgcgggaccgccgacttctggtggtttcgaccaactacgcaccggagctcacgggcatcggcccgtacgccacccaactggccgagcactgggccgagtccggagcccgggtccgggcgctcaccggaatgccgcactacccctcctggcggctggaggaggggtaccggggtgtctggcggacggtggagatacgcggcggcgtcggcgtgcaccggcgcagacactatgtgccgcagcgtcagactgccctgagacgcgccgcgttcgaggcgagcgtcctcgcgaccggactgttcgctccaccgcccggacgtcccgacgccgtgatctcccagatgcccagcctcgccggcggcgtcatcggggcccgcctcgcccggcgccaccgcgtcccccatctgcccgttgtccaggacctgatgggcgcggccgccgcgcagagcggcatccggggaggcggcagggccgccgccgtcgccgcggccgccgagcggtacgcactgcgcggagccgccctcgtcggcgtcatccacgaaagcttcgtccctggcgtcaccgctctcggcgtcgaccccggccgcatccgcatcgtccccaactggacccatgtgcagggtcccaccgccgaccgggccgcgacccgggcccggctcggctggcccgagagcaccccggtcgtcctgcactccggcaacatgggcctcaagcagggcctggacgtcctggtggacaccgcccgcatcgccccggacgtccgcgtcgtcctgatgggcgacggcaaccagcgcgacgccctgcgcgcccgcgccgagggactggccaacgtggacttcctggagcccgcggcggccgaggagttcaccgacgtccttgccgccgccgacgtcctcgcggtcacccagcgcgcctcggtcctcgacatgagcgtcccctccaagctcacctcctacttcacctcgggacgccccgtgatcgcctccgtcgccgacgagggcggcaccgccgacgaggtccgccgctcgggagccggcgtcctcgtggatcccgaggatccggccgccctgctcgaagcgctgcggaagctgtccgccgacccggccgccgctgacgccctcggggccgagggcccgcgctacgtcgcccgccgtctgagccgggaggcaggcctcgcccggttcgacaccctgctcgccgaggttctgccggacgcacaagggagaccccgccgatgacatcccatctccgcaccccggacgaccaggacgagccggcgctcctgcgcgaccagttccgccaactcctgcgctaccgctccctgctggcctgcggagtcgtcgtcggcctgctcggcggcggctatctcgccctcggcggcgaggacgcctacaccgccaccggcgaggtgctcgtgcgttccgcgatctccgaccccttcgccgccggatcgaccgcggacaagggcatcaacatcggctccgagcgccagaccgccgtcagcgacacggtgggcaccctggccgccgggaccctcctcaaggcgggcgacgacgtcaccgcccgcaagctgctcgccgggctccaggtcaccaacccgcccaacaccctcaccctccgcttctcctacacggccgccacctccgagcaggcccgcgcccgcgccgaagccctcgccggggcctatctggcccaccgcaaggcgcgcaccgaggagagcatccagaacatgtccgacggctaccgggcccagctcggcccgctggaggagaagcgcgacctcctggaggaccagacaggggtgggtgcggaggacgacgtcagcagcgcccgcgccaacatcatcgtctccatctccgagctgagccggaagatctccgaactgaaggccctggacaccacccccggctacctcaacaagaagcccgtcgcccccaccgcgcccaccggagcgggactgcccctcctgctcgggctcggcggcgtcgtcggcctcgcgctgggactgctgctctcctgggtgcgcctcgtcttcgaccccgccgtacgctccacccgcgaactcgtccactcgctcggcgcacccctgctcggcaccctgccccgggaacgcgccgccgcgggcagcctgctcgccatcggccgcggcggctcccggctggccgaggagtaccgcgccgtcgccttccggctcgcctacgacccgtcgttcgccgagagccgccgcctgctggtcaccgccccgcgcggcgacagctcggcggccgccgccgctgccgccaacctggccgccgccttcgccgagatgggccgcgacgtcctgctcgtcgaggccgacctgcgcaccccctcgctcgcccgcgacctgggctcggccgcccacgggacacgcccgccgcgctgggcggccggggagggggacggcagctggcccaccggcggccgcacccatgtggaggtgcccggatccggggccttcgccctgatccccgggaccaccgtcgacaacgtcccgcgcgccctgacctccccacccgtcggccgcatcgtcgccgaggccgaccggcccggcaacgtcgtcatcgtcctcgccccgcccgtcctgtcctacgcggacgcggtcgccctcgtcgaccgggtggagggcgtcatgatcgtctgcgacccgcgcgaggtgcaccgcagcgacctggaacgcatccgcgagatcatcggagcctccggaggatccgttctcggcgcgctgctccaccccggccggggccgactgcgccgcgcgcggcgcag

SEQ ID NO: 3637 - DNA, 9430 bp, Unknown
  Kingdom: Bacteria, Phylum: Actinobacteria, Class: Actinobacteria, Order: Streptomycetales, Family: Streptomycetaceae, Genus: Streptomyces
gtgtgccggtgcgcttccgcgtccccccgttcgcgtgcggagcgtgacgcgggcggcccgcccccttgaccggaagttattttccctataagcgtactcacttgaaagtttctttcaccccaggaaggagctcaagtgccccaccgcacctcaagacgcacccttctcaccgccaccgcggccgccacggcggcggcggccaccggcgtcctcgccgtcccctccgccgcctcggcggactccggagacgcctccaccgaccgccgcctgcgacggatcatcgccgggatgagcctggaggagaaggtcggccagctcttcgtgatgcgggtctacgggcactccgccaccgaccccgaccaggccgacatcgacgcgaacctcaaggagatcggggtccgtacggccgccgagttgatctccacgtaccacgtcggcggcatcatctacttcacctgggcgcacaacacccgcgacccgcaccagatcgccgacctctccaacggcctccagcgcgcggccctcgccgggcgttcccggctgccgctgctcgtctccaccgaccaggagcacggcatcgtctgccgggtcggcgaacccgccacgctgctcccgggcgcgatggccctgggtgcgggcggctcacgctccgacacccgccgggcggcctggatcgcgggcgccgaactggccgcgctcggcatcaaccagaactacgcgccggacgccgacgtcaacgtcaacccggccaacccggtcatcggcgtacggtccttcggctccgatccctcttcggtcgccgccctggtcgcggagcaggtgaagggctatcagggcgcgggcatcgcgtcgaccgccaagcacttccccggccacggcgacaccagcaccgacagccacaccgggctgcccgtcatcaaccacacccgcgcgcagtgggaggagctggacgccccgccgttccgcgccgcgatccgggcccgtatcgactcgatcatgaccgcgcacatcgtggtccccgcgctcgacccgtccgaggacccggccacgctctcccggccgatcctcaccggcatcctccgcgaggagctgggctacgacggggtggtggtcaccgactcgctcggcatggagggcgtgcgcacgaagtacggcgacgaccgcgtgccggtcctcgcgctgctggcgggcgtggaccagctgctgaacccgccgaacctctccgtcgcctggaacgccgtactggaggcggtgcggcgcggcgagatcagcgaggcgagagtcgatgagtcgatcctgcggatcctgcggctgaagagccgtctgggcctgttccgggacccgttcgtcagccggcggggcgtcgagcgcacggtcggcagccgcgcccaccgggccgccgccgaccggatcgccgagcgcacgacgaccctgctggccgacccgggcacgctgctgccgctctcccgccgcagccaccgcaacctgctggtggtgggagccgatccggcctccccctccgggacgacgggcccgccgaccagcaccctcgcgaacgcgttcggtgaactgggcttcaccgcgagggcgttgtccaccggtacggctccgaacccggcgaagatcgccgaagcggtggccgccgccgagggcagggacgcggtggtcgtggcgacgtacaacgtcacggcgaccagctcgcagcgcaccctggtcacggccctcgtggcgaccggcgtcccggtggtcaccgtcgccgtccgcaacccctacgacgtcgcccacctcaccgggaccggagtcgccgcgagcctcgccgcgtactcctggaccgacgtcgaactgcgcgccgccgcccgggtgatcgcgggccacgccgatccggagggcaccctcccggtcccggtgcagcgcgcggacgacccgacgcaggtgctgtatccggtgggccacggactgtcgtactagccctacggcggccggacggccccgccctccggccggggacgcaaagcaccccgcgcacctggcgtggccccgctcctgcgggccacgccgggtgtacgtctgtacggacgtatcgggggtttcttcatggatgagcacgcttccccgtggggccgggcccggcgtcgacggccggttccactgcgggtccgggtcagggtcgcggtccaggccgcggtcctgaccctggccgcgctcctgctgacggcctgccggatcccggacgggacggccaccgacgaccgggggcccgcacccgcacccgccgcgcccggcccgtcaccgtacggggtggtgttcctcggtcccggcgactgcagttcgcgggggccggagatccgggaggtgttctgccgcagcgagaaggccgcggccaccgtgctcgcccggcacctgggcaccccgtcgtcgggaccgccctgcccggacgccacggacttcgtcctgcatgtctcggagacgggcaccggggcccgttcccggctcaccaccggctacgcctgcatgcggaacctggaacccccgcatccgggcgacccggggcggggcggcggcccgctgaccgtggtcggggactgtgtcacggcctcccgcgcgggcgaggtcacggagaccgcctgcgaggacacggccggccgcgccccgcgctaccgggtggagtcggcggtgcagcggcgggcgcagtgccccggcaccacggacctgttcgtcgccctgggcggggacaggccggtgggctgcgcccgccggtcacctggagagtgaccggaggacgcagcccacggggaatgccgcgaggagaaccgcttggccgctacgggcgcagcgtggcctcgtcgcgctcgatctcaccgttgcgctggtccagcctggtgtcgaacttcgccagcggcttcgccttgcccgggtccgcctcgacggccgccggggcgacgcccgcccagcgcaggatcgcggcggtggccttcgccttctcgtcggcgacgagaccggagaccttcgagccgtggttgccgccggggacggtgtagacgtagctgtccttcgcgccgcgtccgaggcggaacggctccgcgctccacgggtcgttctcgccgttgacgtacatcatctgccgggcgttgcgcctgacccagcggtcgacgtcccgcatcgcaccccggtcgaacttcatcgggatggagcggggcacgaagttgcgcgggggctggtagccgtagcggctcaggttgccgagccagggctgcttgatgtccggcgacccgagctgggtgcccgcctggtagtagtacggcgtgtacgtctccaggccctggtcgatgtaggcggagaagccggcgatggcgtcgacggagttccagatgtcgtcgtcggtggccttcttggcgtcggccgggatgtccgcgcagtcggcgagcaggctgtactgccagaacgcccacgtgtagtccatgaccgtggcctcgtaggcgcggtcgagggagcccacggtgttgaaggtccagccgttggcggcggccagctccttgtacttcttctggagcggggcccggcggatcagcgcctcgcgctgcacgccggccagcctgtcgcggcactcctcggtcccgacgttgtcgaagaaccggtcgtacgccgagtcctcgtcgttcacgacgtcgttgggcgcgacgtaggcgacgacgccgtccatgtccttcgggtagaagcgctcgaagtacgtggcggtcatgccgcccttggacccgccggtggccagccacttcttgtcgtagatcttcttcagcgccgtgaacacccggtgctggtcgctggcggcctgccagatgtccagcttggaccagtcggccggggccggccgggacggggtgaagtagcggtactccagcgagacctggttgccgtcgatgatctgcgtcggctcgctgcggctggggttcgtggagacgttgtagccgctggtgaagaagaccgtcggacggctcacgtccttgtgcagcagcgtcaggcgctgctggaacgtgcccttggacgggcgccggtggtcgaccggctgggtgtagttgaggacgaagtagcggtagcccgcgtacggcttctcctggatcaggctcatgcccgggatggccaggatgcggtccttgatgtcctcgttgctcgcttcgctgcctccggcgacgccgctgctccgctccacggccggctccgcggcggtggccgcaccggccgaggcccccgtggctccgaccgtgcctatgagcacggcgagcgagagaacccctgtgagtgacttgcgcatgcacgctccccttgattcacaacagtcgccgtgaacttatccgggcaacacacgccacgccagacccggttgcccgtgtcagtgaagaagtcggcggagaaggggaggagtcggcggaaaagtcagcagagaatccatccggtggaggcggatttcttgccgatcgcgccggtggcccgtacgcagcggttgagcgcgttgaccgtgaccgggccggccatcttcgtgtacttgcccttgtcggagacggcgcgtccgccgcgcgcctggagcgagacgctcatcgtccgccgtttgccgggcttcttcgcgacggtcaccgcgcagacatgggcgcggctcttgtagacgcgcagctctcccgtggagaacccgaccgtcttcgccgggcggccggagcagccggaggcggcccgggcgacgccgggggtgccgaacaggggcacgagtccggccagcaggaacaggacgaggacgcggacgagcaacggccgtccccccggccccgtccggccggccggtccggctgccgccgcccgtcccgctgtctccgccggtcctgtcggtcctgtcggcctcatgggtctcaccggctccgcagctctgccgaacacattcgcccccacctgacatctgtacgcacctgtgcgtccctggctacgacgcagcagacccgtgggaggttgcaccgccgggtccgatggacccggtggacccaccgtccccggcagccgatcagacgcctgccggctcgtcctcccctatgccctcgccgatgaaggtgcgccacagccgggcgtactgcccgccccgggcgagcagctcgtcgtgcgtgccgtcctcgacgacgcgcccgtggtccatgaccacgacgcggtcggcgcgggcggccgtggtcagccggtgggccaccaccagcgtggtgcggcggccggtgaggcggtcggtggcctggttgaccagagcctccgtggcgaggtccagggcggcggtggcctcgtccaggagcaggacgtccgggtcgacgagctcggcgcgggccagcgcgatgagctggcgctgtccggcggagaggttgcggccgcgctcggcgacctcgtggagatagccgtcctccagcgtggcgatcatctcgtgcgcgccgaccgcgcgggcggcggcctccacccgggcgtcggtggcgtcgggcagcccgtaggcgatggcgtcgcggaccgtgccggcgaagaggtacgcctcctgcgggacgacgccgaggcggtgccggtaggcggtcatgtcgagggtgcgcagatcggctccgtcggcggtgacccggccgcccgtggggtcgtagtaccgggcgacgagcttgacgagggtcgacttgcccgcccccgtctccccgacgaacgccaccgtctggccggccgggatgcgcaggtcgacaccggtcagggcctcctcgtcggtgccgtacgcgaaggagacgtcctcgaacgcgatctcgccgcgcagcgagagcacgtcgagcggctcgtccgggtcggcggtcgaggtgggctcgcgcagcagctcctggatgcggccgagggagacggtcgcctgctggtaaccgtcgaagacctgggagagctgctggacgggggcgaagaacagctcgatgtagaggaggtaggccaccagggctccagtggtcagcgtgccgttgtcgatccggcccgcgccgacgatcatgacggcggcggcggcgaccgaggccagcagctggacgaacgggaagtagacggagatgagccactggccgcgcacccgggcctggcggtagtggtcgctgtgctcggcgtagcgtgcggccccgtcgtcctcgcggccgaaggcctggacgatgcggaggccggagacggactcctggaggtcggcgttgacggcgctgatgcgtgtccgggccagttcgtacgccttgacgctgctgcgccggaagaagaaggtgccgatgatcagcacgggcagggtggcgaagacgaccagggcgagctggacgtccaggacgagcaacgcgaccatgatgccgaagaaggtgaccacggagacgaaggcggtgacgagcccggtctggaggaacgtggcgagcgcgtccacgtccgtcgtcatccgggtcatgatccggccggtcagttcccgctcgtagtagtcgaggccgagccgctggagctgggcgaagatcttcaggcggagcgcgtagaggacccgttcgccggtccggccggtcatccggatctcgccggtctgggccacccactggacgagcacgacgacgagcgcgatcgcggaggcggcccacacggcgccgatggagagctgggtgacgccctcgtcgatcccgtgccggatcaggaccggcagcagcaggcccatgccggcgtcgacggcgacgagcccgaggctgatcagcagcaccgcgccgaagccgtgcagcagccggcgcagcccgtaggagtcctcgggacgcacggcggcggcctcgtccacgtcgggggtgtccgtggcgggcggcagggcctcgacctgggcgagcagttcgggtgtcgcgggcataccggcgaccgtggtgtcccgctcctcctccttgcggatccacagctcgggggtgatgccgcgctccgcgtcgaactcggcgtccagctcctcctggagggcgcggtcgtcctcggggtcggcctcggtgcgcggcggccggtggccgggtgaggtgccgcccagctcgtcggggtcggtgaggaggcggcggtagagcgcggaggtgcgctccagctccgcgtgggtgccgaccgcggcgagcttcccgccgtccaggacggcgatgcggtcggcgagctggagggtggagcgacggtgggcgatgaggagcgtcgtacggccggccatcacctgcttgagggcctcgtggatctcgtgctcgacgcgggcgtcgacggcggaggtcgcgtcgtcgaggaggaggagccgggggtcggtgaggatggcgcgggcgagcgcgacgcgctggcgctggccgccggagagggtgaggccgtgctcgccgacggtggtgtcgtagccgttcggcaggtcggagatgaacccgtgggcctgggcggcgcgggcggcctgttcgatctgctccggggtggcgtcggggaggccgtaggcgatgttggcgcggatggtgtcggagaacaggaagctgtcctcggggacgagcccgatggcggagcgcagggacgcctgggtgagttcgcggacgtcgtggccgccgatgaggacggccccgtgggacacgtcgtagaagcggggcaccaggagggagacggtggacttgccgctgccggacgcgccgacgacggcgacggtctcgccgggttcgacggtgagcgagaagccgtcgaggacggggcgctcgtcgtcgtacccgaagcggacgtcgtcgaactcgatcccggccggggcgtcggccggcagctccttcgtaccgtcctgcatggagggctcggtgtcgatgagctccagaacgcgttccacaccggcgcgggcctgctggccgacggtgaggaccatggcgagcatccggaccgggccgacgagctgggcgaggtaggtggagaaggcgacgaacgtgccgagggtgatctcgccccgggtggccagccagccgccgagcgcgagcatggcgacctggccgagcgcgggcaccgcctggagggcaggggtgtagcgggagttcaggcggatggtgcgcagccgcccggcgaacagccggcggccgacctcgcggagcttgccggtctcctggtcctcctggccgaagcccttgacgacccggaccccggagacggccccgtcgacgactccggcgacggcggcggcctggctctgggcgtaccaggtggcggggaagaggcgggtacgggagcggcgggcgatgaaccagagggcgggggcgacggcgagggccacgagggtcagggggagcgagagccacgccatgatcaccagggagatgaggaagagcagcacgttcccgatggtcatcgggagcatgaagagcagcccctggatcagctggaggtcgctggtggcgcggccgacgacctgcccggtggacagctcgtcctgacgtctcccgtcgagccgggtgatcgtcgtgtacatgtccgtacgcaggtcgtgctggacgtccagcgcgagccggccgccgtagtaccggcggatgtaggtggctatgtagacgaggacggccgcgccgatgagcagcccggtccagacggcgagggagcgggtgtggtcggtgaccacgtcgtcgatgatcaccttggtgatgagcggcacgagggccatcacggccatgccggcgagcgacgagccgagagcgagcacgacgttgcgccggtaccgccacgcgtacccggtcagccgccggccccacccctgttgctctgcgcccgtcacgcgttgcctcccgtttcggcctgtccgccggcctgtccgctgatccagctgtgccacctggtctaccggaaggcaccaacgcccggggctgcgtatttcatcccgccgcaacaaagggggcggcaaacggggccgatggtcggggtcgtgcggtaccggggtcctaggaccggttcagggtcccggccgggcgggtagtaacccgcggcggacccggctgacgcagggccggcccggggccggagggcatctcgaaggggcaggaaccatggcgaacgaccggctcaccgaggcttaccgctgcggacagctctacgcggcgctcgccgctctggagcgcctcagcgagggcgcgcaccactccttggggaagcccgggacgcggcggcagctgtccaccgaaccgcgcaagcacctcaccgtgcacctgtggcaggcgggccggtatctggccggcgccaccaaccgggaccagggacccgccgccgcggtgatattccggcagttgccggaccttctgccgcgccgccgggagctgcccggggagatccgggacccggcggagcgggcccggttccaggagggcgtccaggcgcaggaggccgcgatcgagaaggcgctcgcggagctgtgagcggccccccggcccggcgtacg

SEQ ID NO: 3638 - DNA, 2990 bp, Unknown
  Kingdom: Bacteria, Phylum: Actinobacteria, Class: Actinobacteria, Order: Streptomycetales, Family: Streptomycetaceae, Genus: Streptomyces
ccggggcgggtgatgttgtgcaggtcacgtacacctggaggccttgtgcccgttaggcggggagaacgaccggcacgagcgaggagcagcgcatgacggcatggatggtacggacggaacgcggtacggcgcacccgaattcggggcggcgggcgacggcgggacgtgaggacgacgcaatgtcgggaggccgtggggtcgcacgggtgccgggcgtgctggcgggcacggcagccctgctgacgctggcctgcggtgtcggcgtcgcgcacggagcggacggcggcgcgtccgacgcccctggcggccagggccacggcgcgcacggggcgcctgcggcgggtgtctcggcacaggaggcgggcggcggtggagacccgagccgcacggatgacgtcgccgcggcgggcggcagctcgtggatgcgggccgcgggggtgttctccccgcccggctcgttcgtcccgtccgaggcgctgacgtacgacacccggctggtgccggcgggcgcgcggatcgaggtcacacagttcgcggacccgtccggcacccgggtcgcggcccggctgcggggcctcatgcccggccgtgcgtacgggatgcacgtacacacctcgccctgcggcgccgatcccgccgccgctgggtcccactaccagcaccggccggcggcgaccgcggacccggtcaacgaggtgtggctggacttccggacggacggggagggcgacggccgggcggaggccctgcacggctggggcttccgggagaacggggcgcggtcggtgatcatccatgaccggcagggcggcgcgggggagcgggcggcctgcttcacggtcccgttcgggcctcacgggcaggactgacgggggtaccgcaccctcggcggacgacggcgtacggcggtgtcccgctcctccgcgcgccactgggggatcggggcaccgccgtacatccccgccgctccgtgcgagggggctgcgggacaatgccgagtcgaacggtcagaccgacccgaacggtcgggcggagacgaacggtcaggccgacttgaacggtcaggccggaggcggtcgttcagaccgagacggccggggtcttgtcgcgccggggcgtgtcctcggcggtagccgccgtgttccgcgaaccgaagaagcggtccagagcgacggttcccgggccggtgaagaccagcagcaggaacgcccagcagaacatcgccgcgctctcgccgccgttctggagcggcaggaacgcctcgggctggtgcaccttgaagtacgcgtaggccatcgaccccgaggcgaggaaggccgcggcgcgggtgccgagaccgagggcgaccagggacccgcagaccagttggatcagggcggcgtaccagtcgggccaggcggcggtctccgcctgggtgccgccgatcactccgaagagcgtggcggcaccgtgaaaggcgaagagcaggccgacgacgaagcggaagaggctgagcacgtaaggctgggcctggttcaggcggatgagcatggggggggctccttcggttgtggtggggacgtgaaccgatcgggcgcctcaggttcgggcgcctcaggttagggagacctcatcgatgcttgcaacttcaacattctgtcgagtggccgaaaatcgcctcgctctcaggggtgagtgaacgctcaagaaccgattcgagctgggccccctgcttgctcgccctggcctggaccaatgtcagcgcagacttccggccacgcaacgtgagcgtcatgagctggttaccgaaccaggggccgcccgccctgtgccaggtcaccggtgacgctcccgtacggccgtggcgggccagcagtcggccgatccgtcggcccgcccggctccagccgaagcggaaacccgtccggatcgaccgggggatcgagttgtgcacgggtgagcaggtcagctggaggacgcgagaggccggcgcgcccccggagccgggaccggaatcgctcccggggccggagccgagtacgggatcggacttcggccactgtggctcggcgatgtaggcgtggtgcacatcgcccgagaggacgcataccgtcgccggggcgtccggaccactccccgcttcccgcagcagctccgtgaaccggtcgaaggactccgggaaggcggcccaatgctccaggtcggccgcgcggcgcagcttgtcgccgaagcgcgcccagcgttgcccgcgtacgcccgcgcacagtgcggcgttccagcgctccgcgtcgtggacgagcggaggcaacagccacggcagggagctgccgatgaggagatgatcgtatgaagaagcgtcgttcaggaccgcattccgcagccagtcggcctcctcggcgtcgagcatcgcccgctctccctcggccaggacgcgggccgcgcgggtgtcgaccatcaccagccgtactcggccgaaaacacgctggtagctccaccgggtacgggcgggatccgcgtcggtctcggcggcgaagcggcgcagcacctcggtgccgtcgggcgaggctctgaccgccgcgtacaccgggtcggcggccagctcggcaggggagagatttcccaggtgctggtggacccagtacgacatcagcccgctgacgatccgttcgtgccaccagggcgtggcgcgcatgtcgcgctgccaggcggcgctggtgttccagtcgtcgatgacgtcgtgatcgtcgaagatcatgcaactggggaccgtggagagcagccagcggacctccggatcgcgccacgattcgtcgtagaggtaggtgtactcctcgtagtccgcgatctccgcgcccggcggctcgctcaggtcccggcgggcggccagtctgcgccgggtctccccggaggtctcgtccgcatacacctggtcgccgaggagcagcaggacgtcgggccgctcggccgccggatccgcggcgaggcgggcggccagggtcaccagggcgtcc

SEQ ID NO: 3639 - DNA, 2290 bp, Unknown
  Kingdom: Bacteria, Phylum: Actinobacteria, Class: Actinobacteria, Order: Streptomycetales, Family: Streptomycetaceae, Genus: Streptomyces
cgacgccctcaccggcgaacggctcgaagcgctcgacggcgaggacccgggcagctgcccgatcgagatcccgcccgagtgggtgatgaccaccgccgagacgtacgcggccggctatgccaacgccgccaagctggacggcgcggcggcgctggggcccgcgttcatgaaggtggtgctgaacaagcgctacatcaacgactcctgcgcctcgaccgtcgacgtcagctcggaggtgaacttcgactaccaggggcgtcggcaactccccccgaccagggccacgttcctcagctacggcttcatgccgacgaccgcgaccatgacgctggagcaggtggggcccccggccgcgatccatacgcacacggtcaccaacacgccgacctacccggaggagacgacggtcacggcgcagctcgtgatgcgtctctccgacgtccaggtgaacggagttcccctggacgtgggccccgactgccgcacggagcgccccttcgagcaggtgctgagggggtacggccagagctatccgccggccggttacctcgtggcgaccggcggcagcctgaccgggtacgcccacatcccgccgttcgagggatgcggcgtgagcgaggacctcgacccgatcttcacctcggccatctccagcccgggcaagaaggccgacaactacaccaagatgacgcaggcgcccctgtgcgtggccacgaacccggaagggccggactgcccgccgaaggtgccggcgcccgaacggtgaacgcgcacggcccgtcggccgccgacagatgagcgtgcacggccgccggccgccgacacgtgaacacgaacgagcccttccggttccacgggaccggaagggctctctttttctgcccgcgaggacaccccgccggtcgtgtggttcctcatcatccgacaggtttgatccgcggattactcacccgtgaacaatcctccgcccggcgtgaattctcgccgaggaaaatctgtacccagtattgcgaagtcaggttaccggcccgtagcgtcccagacgtgccgatcgaaatcgcctgcgtacctgctcggcgggcacacccgggcccggttcgctccgctccggcccaggggcaccccggatcgaacgccccgtgcttgcgcagatttcgacaaggacgggaaccggccttgtcaccgaatgacaagtgatccaatctcagccccgcgttcgtcgatctccgctgttcaacggcttgccctggcggtttcggcggacataacgtgcgccccctggtgcatgtgtgacgagccgccatcgcttttctcagagccggagcgctaaacgatgaacacgttcaccgccacctcgagggagggccgatgggaatcgaagtagtcgtcgagggcctgacgaagtccttcggcaagcagaacatctggcaggacgtcagcctcaccctgcccgccggtgaagtgagcgtcatgctcggtccttccggaaccggaaagaccgtattcctgaaatccatcatcgggctgctcaagcccgaacagggacgcgtcctcatcaacggcgtcgacatggtgaacagctccgagcgcgacatcatggagacccggaagctcttcggcctcatgttccaggacggggctcttttcggctcgatgtcgctcttcgacaacatcgccttcccgttgcgcgagcacacccgcaagaaggaatcagagatccgccgcatcgtcatggagcgcatcgacatcgtcgggctcctcggcgcggagggaaagctgccgggcgagatatccggcggcatgcgcaagcgcgccggcctcgcccgcgccctggtcctggacccgcagatcatcctctgcgacgagccggactccggactcgacccggtccgcaccgcctacctgtcgcagctcctcatcgacctcaacgcgcagatcgacgcgacgatgctcatcgtcacccacaacctcgacatcgcggcgaccgtccccgacaacatgggcatgctgttctgccgcaacctcgtcaccttcggcccgcgcgaggtgctgctcaccagcgacaccccggtcgtctcccagttcctcgccgggcgccgcgaagggcccatcggtatgtccgaggagaaggacgccgccaccctcgccgccgagcagctggtcgacaccgcgtcgccgcgcaccggaccccgcaccgtcgtcccccagctggagccctcccccgggatgcccgtacgccaaggcgcgctgcgccgccgggagcgggtcatgtcgatgatgggccagctgc

SEQ ID NO: 3640 - DNA, 5607 bp, Unknown
  Kingdom: Bacteria, Phylum: Actinobacteria, Class: Actinobacteria, Order: Streptomycetales, Family: Streptomycetaceae, Genus: Streptomyces
ctcgggccccgcgctcaacctccgcagccccgcccaccgcaccgaacgcgagctgctcaagctcgccctccagaagcccgccctggtctccccggccttcgacgcctacggcctggacgagttcaccgccccgccctacgccgccgtgcgccagtgcatcgcggaggcgggcggcaccgaacagggcctcgccgacaaccgcgagtatctggtcgccgtcatggacgccgcccccgacaacaccgtccgcagcctcgtcaccgagctcgccgtcgaggtcttcatcggcaagaccatcgacgagacctacgccggcatgcagctcgtccacgtccggctgcgcgccgtggaccgccgcatcaacgacgtccagggcagcctcgcccgcctcggcagccatgtggcgccccaggacctggccgccgcgcagaacgaggtctgggtgctccagcagtacgcccagtccctgcgcgcccacggcgccgccgcgctctgagtccacccgtcaccggccgcggtaatcggccggtgacggaccggaaccagaaagtccccgcacgcccctcgtgacagtcgtgtgtcgtaccccacactggggaatgtctgagtcatcggagcacgccggtccgcaggggagcatctcggggccggaccgacctccaccccccgtcatccggcagcgatcacctggaggtcgcccccgtgcagacccggaccgtgacgaccacgaccgagcccatcgcggccatcccggcgcagaacaggtcgctgcaccacccggagaccacagccggcccgccgggatacgcacccgaggcagtcatggtggaagcgacgcacctccccgaccctccggagccgaggaaccgggcggactccggcggccccacctccgacctgttccggcagtatctgcgcgagatcggccgcatcacgctgctcaccgccgccgaggaggtcgaactcgcccgccgtgtcgaggccgggctcttcgccgaggaacgcctcgcgggcacccccgacctcgactcccgcctcgccggggacctggaccggctggtggtgatgggccgcacggccaaacgccgcctcatcgaggccaacctccgcctcgtcgtctccgtcgccaagcgctacgtgggccgcgggctgaccatgctcgacctggtccaggaggggaacctcggactgatccgggccgtggagaagttcgactacgcccggggctacaagttctccacgtacgcgacctggtggatccggcaggccatgtcccgcgcgctggccgaccaggcccgcaccatccgcgtcccggtccatgtcgtggaactgatcaaccgtgtggtgcgggtccagcgccggatgctccaggaacgcggcgtcgagcccagcgccgaggacgtcgccggcgagctcgacctgatgcccgagcgggtcaccgaagtcctccgcctggcccaggagcccgtctccctgcacgcccccgtcggcgaggaggacgacgtctccttcggtgacctcatcgaggacggcgacgccgcctcacccgtcgagtccgccgccttcctcctgctgcgcgaacacctggaggcggtgctctccaccctcggcgagcgcgaacgcaaggtcgtccaactgcggtacggcctggaggacggacggccccgcaccctggaggagataggcaggatcttcggtgtgacgcgcgaacgcatccgccagatcgagtccaagaccctcagcaggctgcgggaccacgccttcgccgaccaactccgcggctacctcgactgatccacccggccggtccgctcagtccacctcggccagcgcctgggcgaactgggccgcgtacagccgcgcataggcgcccttggccgtcaacagcgcctcgtgcgtgccctgttcgacgatcgagccgttctccatcaccaggatcacgtccgcgtcccggatcgtggagagccggtgcgcgatcacgaacgacgtacgcccgtgggccaggcgcgccatcgccttctggatcagcacctcggtccgggtgtccaccgagctggtcgcctcgtcgaggaccaggatcaccgggtcggacaggaaggcccgcgcgatggtgatcagctgcttctcgccggcgctgaccccggcgccgtcgtcgtcgatcaccgagtcgtacccgtcgggcagcgtccggatgaaccggtccgcgtgcgccgcccgggccgcctcctcgatctcctcccgggtgacctcgcgcgaagcgccgtacgcgatgttctccgcgatcgtcccgccgaacagccaggtgtcctggagcaccatgcctatggaggagcgcagatcgtcccgggacatcttcgccacgtcgaccccgtcgagcgcgatccgcccgccggtcacctcgtagaaccgcatcaggaggttgaccagcgtggtcttgccggcgccggtcggaccgacgatcgcgacggtctgccccggctccacgctcagcgacagattctcgatcagcggcttctccgggtcgtagcggaaggccaccttctccagcgagacccggccctccaaccgctcagggcgctcgccgtgctccggatccgcgtcctgctcctcggcgtccagcagttcgaagacccgctccgccgaagcgatgccggactgcaccaggttggccatcgaggcgacctgcgtcagcggcatcgagaactgccgcgagtactggatgaacgcctgcacgtcaccgatcgacagcgtgcccgaggcgacccggagcccgccgaccaccgcgaccagcacgtagttgatgttcgagatgaagaacatcagcggctgcatgaccccgctggcgaactgcgccttgaaccccgcctcgtacagcgcgtcgttctgctcggcgaagtcccgcgcggactcctcctgccggccgaagaccttcaccagggtgtgaccggtgtacatctcctcgacgtgggcgttgagcttccccgtcacccgccactgctgcacgaactgcggctgcgaccgcttgccgacctgcgtcgccacgaccaccgacaacgggaccgtcaccagcgcgaccagggccagcagcggcgagatccagaacatcacgaccagcacgccgacgatcgtcagcagggagttgatcagctgccccatcgtctgctggagcgtctgcgagatgttgtcgatgtcgttcgtcgcccggctcagcacctcaccgcgcttggcccggtcgaagtacgacagcggcagccgcgccagcttcgtctggaggtcctcgcgcagctggaacacgatccgattgatgatccggatcgacacccgcgtcgccaccagcatcagcagcccggcgccgacgtagatcaccagggccaccagcaggacgttccccaccgcgccgaagtcgatgccctcgcccggggtgaagtccacccccgagagcatgtcggccatggaaccgcggccgtcctcacgcagtgcctcgatcgcctgcgccttcgtcgtgccctcgggcatcccgcgcccgacgacaccgccgaagatcaggtcggtcgccccaccgaggatcttcggcccggccaccgacagcgcgacgctcaccgtcacggcggccagcatcagccacagagaggtcttctcccggccgaaccgcttcagcagccgcttgctcgaccccttgaagtccatcgaccggtcggtgggcgcacccccggccatcatccgtccgcccggaccggccattacgcggcctccgcttccgtcagctgggagagcacgatctcccggtatgtttcattgccgtccatcagctcgtgatgggtgccggaccccacgacccggccctcgtccagcaccaggatccggtccgcgtcacggatggtggacacccgctgcgccacgatcaccacggtcgccccggccgtctcccgccccagcgccgcccgcagcgcggagtcggtcgcgtagtccagcgcggagaacgagtcgtcgaacagatagatctccgggcgctgcaccagcgtcctggcgatggcgagccgctgccgctgaccgccggacacattggtgccgccctgcgtgatcggcgcgtcgagcccgtgttccagcgcctcgacgaactccttggcctgcgccacctccagcgcgtgccacagctcctcgtcggtggcgtccggattcccgtaccgcaggttcgtcgcgaccgtccccgagaagaggtacggcttctgcggcaccaggctcaccgtcttcgccagcagcgccggatccagcgtccgcacgtcctcgccgtcgaccagcacctcgccgtccgtcacgtcgaacagccggggtacgagtccgagcagcgtggacttcccgctgcccgtcgacccgatgaccgcggtggtctccccgggccgggccaccagctccacggcccgcagcaccggctcctccgcgcccgggtagcggaactcggcgccccgcacctccagatgcccgtgccgccgcaactcggtcaccggcgcgacgggaggcacgacactcgactcggtcccgaggacctcctcgacgcgctcggcgcacacctcggcgcgcggcaccatcatgaacatgaaggtggccatcatcacggccatcacgatctgcatcagataggcgaggaacgcggtcagcgcgccgatctgcatcccgccgctgtcgatacggtgcgcaccgaaccacaccaccgcgaccgacgacaggttgaccaccgtcatcacggtcgggaacatcagcgccatcagccgcccggtcgccaccgacacgtcggtcagctcggtgttcgcaccccggaaccgcttctcctcgtacccgtcccggacgaaggcgcggatgacccggttgccggtgatctgctcgcgcagcacccggttcaccccgtccagccgctcctgcatggagcggaacagcggccgcatcctcttcacgatgaggccgaccgagacaccgagcaccggcacgaccgccagcagcacagcggagagcggcacgtcctggccgagcgccatgatgatgccgccgacgcacatgatcggagccgacaccatcagcgtgaacgccagcagcaccagcatctggatctgctggacgtcgttggtggtccgggtgatcagcgagggcgctccgaagctccccagctcacgggccgagaaggactgcacccggtcgaagacggcggcccgcacatcgcgcccgagagcggaggcggtccgggccccgtagtacacggcgcccacattgcagagcacctgaacgacgctgacggcgatcatgagaccgccgaactccaggatgtagccggtgtcgcccgagacgaccccgttgtcgatgatgtcggcgttcaggctgggcagatacagcgtggcgcaggtctggagcagctggaggaacaccagcagcgcgatgggtttcttgtacgggcccagatgggcccgcaggagttttatgagcacgcgggtctctcggaatcggcggaaggcagaggccgccccagtttcgcgtacgccgtactccgagggcgaacccttttccgccaagcccgggtcaaacctggagcgcgcgggggagccccacgcgctccaggtt

SEQ ID NO: 3641 - DNA, 1801 bp, Unknown
  Kingdom: Bacteria, Phylum: Actinobacteria, Class: Actinobacteria, Order: Streptomycetales, Family: Streptomycetaceae, Genus: Streptomyces
cggggcgcgggtcgtcgccgtcggcgcggaccgcgacgggaccggtggtgtggagcgcgcggagcgggccggaatccccacgttcgtgtgcaagctcaaggaccacgcgacccgcgccgcctgggacgaggcgctcgccgcacaggtcgccgcgcaccgcccggacctcgtcgtctccgccggtttcatgaagatcgtcggcccggcgttcctcgccgcgttcggcggccggaccgtcaacacccaccccgccctgctgcccagctttcccggtgctcacggagtgcgtgacgcactcgcgtacggcgtgaaggtcaccggctgcaccgtccacttcgtcgacgacggcgtcgacaccggtccgatcatcgcgcagggcgtggtcgaggtgaccgaggaggacaccccggagggtgaagccgccctccatgaacggatcaaggaagtcgagcgctcgctgctcgtcgaggccgtggggcggatcgcccgtgacggccatcgcattgagggacgaaaggttcatctcggtcatgtcggtgaataagcccatccgccgcgccctggtcagtgtctacgacaagacggggctcgaagacctcgcccgcggtctgcacgaggcgggcgtcgaactcgtctccaccggctccaccgccggaaggatcgccgccgccggagtgccggtcaccaaggtcgaggagctcaccggcttccccgagtgcctggacggccgcgtcaagacgctgcacccccgcgtccacgccggcatcctcgccgacctccgtctcgacgcgcaccgcgagcagctcgccgagctcggcgtcgagcccttcgacctggtcgtggtgaacctctacccgttcaaggagacggtcgcctcgggcgcctccgacgacgagtgcgtcgagcagatcgacatcggcggcccctcgatggtccgcgccgccgccaagaaccacccgtcggtcgccgtcgtcaccagtcccgagcggtacgccgacgtcctcgccgcggtcaaggccggcggcttcgacctcaccgcccgcaagcggctcgcagccgaggccttccagcacaccgccgcctacgacgtggccgtcgcctcctggttcgcggacgactacgccgccgccggcgactcgggcctccccgagttcctcggcgacaccttcacgcgcaagaacgtcctgcgctacggcgagaacccgcaccaggccgccgcgctctacacctccggcgagggcggtctcgccgaggccgagcagctgcacggcaaggagatgtcctacaacaactacacggacaccgacgccgcccgccgcgccgcgtacgaccacgccgagccctgcgtcgcgatcatcaagcacgccaacccgtgcggcatcgccatcgccgacgacgtcgcgaccgcgcaccgcaacgcgcacgcctgcgacccgctctccgcgttcggcggcgtcatcgccgtcaaccgcccggtgaccgtcgagatggccgagcaggtcgcggagatcttcaccgaggtcatcgtcgctccggcgtacgaggacggcgccgtcgaggtgctggcccgcaagaagaacatccgcgtgctgcgcgccccggaggccccggcctccgcgttcgaggtcaagccgatcgacggcggtgcgctgctccaggtcgccgaccgtctccaggccgagggcgacgacccggccaactggacgctcgccaccggcgaggcgctctccgaggccgaactgaaggagctggccttcgcctggaaggcgagccgcgccgtcaagtccaacgcgatcctgct

SEQ ID NO: 3642 - DNA, 1366 bp, Unknown
  Kingdom: Bacteria, Phylum: Actinobacteria, Class: Actinobacteria, Order: Streptomycetales, Family: Streptomycetaceae, Genus: Streptomyces
cgagcgtgctcatcagtagaccccttcgatgatggccacgtcgtcgaggctgcggtaggtctgcacatcggcgaggccgtccacggcggagccgtcgctcggctcgacgcgtatcgcggtgtcccgttccaggacgttcggcaggaacatctcctccgagaccaggtggagccggacccggccgcgttcgccgtaggccaccggttcgccgtcctcgtccacgaggtggaggcgcgtggtctcggggaacggctcgaagacgcacgggtggacgtcgtcgggccgggccggccgctgcggcgccacccccatcaggctgttgccgtagacgccgaccacgtgcgccgccgggaagaagacgtcgccgagctgcttcaggctctcccggctgatggacgtcccggcccagatgatcgcgcggacctcggtgcgcaccagctcgtacaggcgcggcctggcgcagatcgcctccaggagcggcggagtggtgttgagcacggcgacgggctggctctccaggatggtctccgcctggtccagcaggtgctggacgtacgcgtcggcctcctcgccgcgtccctgcgacaggagccgcttgacccaccgcgggtcgaggtcgacggtgtagaagacgccgccgccgagcgcggcgtagcgggccgtgtcgaatccgatgacatgcgggccgccgggtcccaggtgcagccagttgccgtgcgcggggacgccgctcgcgatcaggcgttcccgcgcccatccggtcaccagcgaccggtaggcgctgtcgacgatgcgcttgggtgatccggtggtgccgcccgagtcgtagacccggaagggacggtcggacagtcctcgcgggatcaggtcctgggccgggacggagcggagttcggcgctgacgtccgggaagcgggtcaggtcggccaggccccgcacctcggagacgggatcgaacccgagcccgtccagcttcttcagccagaacggcgagccggtctgcgcaccgaagtgccatgccatcaacttgactacgtgactgtcgaattcgggatcaacgatgtggctcatgacggacttccgctctcctgatcacggggcaagggcggtacggcacccatcgtgctggcgaggcctatcggtcccgtatcgcctgtgtgtcgtggaacgcgtccgcccgcacggcaccgttcggacggtgctgtgcgggcggacggttcggtacgggcgagcggccctgcggcggttcagggcgtgcgccggcccggggtgaaggcgaccagtgcggcgatcagcgggaagagcgccaccacgccgagcgccgtcgagagcggcatcgacttcgccagcgcgcccgcggtggcgc

SEQ ID NO: 3643 - DNA, 8409 bp, Unknown
  Kingdom: Bacteria, Phylum: Actinobacteria, Class: Actinobacteria, Order: Streptomycetales, Family: Streptomycetaceae, Genus: Streptomyces
gcccggcgcaccgccccgcagccccgccccgcacggccacagagccgagcggccgtcccccaccgagcccggcctgcggcactggcggccgggccgagagcaggagccgcaccgatgcccctgaaccgcagacagctcatcacgaccgcggtggcgaccgccgtcgccacgggcgcgacgagccggtgggcggccggcgcgaggagttcttcggtatgaccaggaaagggatgtcgaaccatgcgaccagcacccgcaccccgtcaccgcacctggtggcggagactgacggccaccaccggcctgctcgccctggtggccaccgccctcgtggggaccggcatgtccccggccgccgcggcgcccccggcctgggagccgaagccggcgcccatgacgacgccgtggacgaaccaggtcccggtggacaagccgctgccggagtatccgcgcccgcagctgacccgcccggactggacgaacctcaacggcatctgggacttcgcggtcaccggccgtgacgccggacagcccgcgacgttcccggagcggatccgggtcccgttcgtcgccgagtccgcgctctccggcatccagcgccggatcaccgagatggacaagctctggtacaagcggaccttcaccgtccccgcgaactgggacggccgccgggtcacgctgcacttcggggcctccgactggcagaccacggtccgggtcaacggcaccgaggtcggggtgcacaagggcggcttcgactcgttcgcgtacgacatcaccccgcagctcaacgggggtacgaacaccgtcgtggtctccgtgtacgacccgagccagaccggcggccaggcggtcggcaagcagcgcgtcaacgaggtgaagccgcacccgggcggcgggatcttctacaccgcggcctccggcatctggcagacggtctggctggagccggtggccgccgcgcacatcacccgcctcgacatgacccccaacctgggcgacaacacgctgcgggtgaaggtgcggacggcgggcgcggcaggccggaacgcccggatcaccgtctccagcggcggtacggtggtgggcacggctaccggcgcggtgggcggggagatctccgtacccgttcggaatccgcggctgtggacccccgaggatccgttcctgtacgacgtgagggcggacctgctcgacggttcggccgtcatcgacaccgtgggcagctacaccggcatgcggtccgtgggcctggccgaggtggacggcatcccgcggccggtgctcaacgggacgttcgtgttccagaccggcaccctggaccaggggtactggccggacggcatctacaccgcgccgagcgacgaggccctgaagtacgacctacaggcgcacaaggatctcggcttcaacatggtccgcaagcacatcaaggtggagccgcagcggtggttctactgggcggacaggctgggtctcctggtgtggcaggacatgccgtcgatggacaccggcaaggtgccggacgggcccgcgcgcacccagtgggaggcggagtaccgcaccatcatcgaccagcaccgcagttcgccttcggtggtgatgtgggtcaaccagaacgagggctgggggcagtacgaccaggccaggatcgccgacgaggtcaaggcccaggacccctcgcgcctggtcaacaacatgagcggggtcaactgctgcggctcggtcgacggcggcaacggcgacgtggtcgaccaccacatctacgtcggacccgggaacaccacgccgagcgccacccgggccgccgtgctgggcgagttcggcgggctcggccacaaggtgccgggccacgagtggtatccgggcggcggcttcagctacgaggaccagccgagcgtcgcggccctgaacaatcgcttcgtcgggctcctcgacagtatccggatcggccaactgcctgccgggctctccgcttcggtctacacggagatcacggacgtcgagaacgaggcgaacgggctgctgacgtacgaccgccaggtggtgaaggtcgacaccgcccgggtgagggccgccaaccaggccctgatccaggcgtcccgcacacccgctcccccggtggacctccccaccgggcagtacacgtcactgcgggtcaccacgcccgggcacacgacgaagcacctgcgccaccacgactcactggccttcaccgaggtggtggacggagggagtccggccgtgctgaaggctgatgtcacctggaagctcgtccccgggctcgccaacggcaactgctactcgttcgagtcccggaactaccccggcgagttcctccgccaccgggagttccgggtacgccgcgacgccgacgacaactccgcgctgttcagggcggatgccacctggtgcgcggtcgcgggcagtggcggggtgcggttcaccagcgcgaacctgcccggcagctatctgcgccacatcgactccgaggtgtggctcgccacccccggcggcgggcgggccttcgacaacccggcgttcttcgccgaggacaccacctgggcggtcgacgcgccgtgggccccgtgatccccgggggccggtgaaggggtgaccgaccggcccggccgcgacggagaggctcttccgtcgcggccgggccggctgcgggcggggtgagatgtgcggccgggtcagaagcggtcaggcgcgcggtccgggagcggagccccggggaacacgtcctccttctggttctgccgtgccttcgcgttcgactcggcggtcgccttgcaggtcacgtccttcgccgggagcttgccggtcagcagatagcggttgaccgcgccgtccgtgcacgcgttgccgctggggtagacgccgtgtccctcgccgccgaggacggtgaccatcttcgacccctccagctgccggtgcagggcctgaccgctgggcagcggcgtctgcgagtcccactcgttctggaccaccagggacgcgacctcgttcttcacctcggtcgcccgctccacggacctgtcccagaacgcacagggcttgatgctggacgcgaagtcgccgaagatcgggtaacgccccttgtccgcgatggcgtcccgccggtagctctcggggtcgcgggaccaggcggccgagttgtcaccgcacaccacggcccagaaactcgcggtcccgttgtcggccggcgtctcgacggccgcgcctgccgttccgcgttcctcggatccggtgaacgcggtgagcttctccgtcgcgacgggcttgccgtcggccgccttcttcagctcgacgaaggcctcggtggcggactgcgggctgaagaccgccgcccgcataccgctgcggatgtcgtcgccggtgaccaactgcccgtccaggtcgatggggtcctcgccggcctgcgcgaccaggtcccagaaggtcccttcgaccttcttcggggtgtcgccgaggccgtatcgctcggcacgctcggcggcccacccggtccaccggtcgaacgcgggctcggcgccctccgcccaccactggatcatcccccgccaggcgcgttccgggtcgaccgcgctgtccagcacgaaccggtcggcgcgtcgcgggaagagctgggtgtagacggcccccaggtaggtgccgtacgagtagcccacgtaactgatcttcttctcgccgaggacctcccggagcaggtccatgtcgcgtgcggtgttgcgcgtggagatgtgcgggagcacgtcgcccgccttcttctcgcacttgtcggcgacggtccgcgcccaggcgacgtcggcgtcgaacgtctccttcttgtacggccgcagccagttctcctcctccggctccaggccgcaggagaccggggtgctgcgtccgacgccgcgcgggtcgaagccgatgaggtcgtacttctgccgcgcggacgcggggagcgactcggccatcgacagcggcatgtacaggccttcgccgcccgggccgccggggttggagagcaggacaccctgccgcttgccgggtgcggtggccttgatccgggatatggccaggtcgatccgcttgccgccgggcttgcggtagtccagcgggacctcgatcgtggcgcaccggaactccgcgggagcggcggccgcacaccgcctccactgcggcttctgcttcgcgtaccggtccagcgcccccttgccggcggacggggacgcgctcgacggggaggccgacgacgaggaggcggacggagcggcggtggccgtgggggtgaccagtgcggggacgagcgttgccgtgatgcttaccgctaacagaggtacgagacgtcgactgttgcgcacgatatcgatccttccggtcacatgttcggacagaaaagatcattcaggaaccggccgtgcgtgcggatcccccgccgggctgcacctcgcctccaccctgggaatgacgcaaccggcgggggtggtccgcgagttgtagaaacggagtacgaggtcggggcccgctccctcgcgccgggaggcccggcgcggggaaagcggaccccggtcttctccccgctacggctgctgacgtccgtggagcgcggacacctcctcggcggtcagggccttgtcgtacaccccgacctgatcgacggagccgttccagaagtcggccctggcgccgtcgtaccgggcccgtcctacggacagcgggccggtgctcacatcggccggaccggcctcggtggtggcggcggccttcccgtcgacgtacagcgtgatcgtgtcgcccttgcggacgccgaccaggtggtaccacttacccgtctccggggtgatctccaggcgggcgcgcttgccgcccggggtggagaaggcgaacgcgccctgtccgtactggaggtagaagggattctcggtgcggcgtccgtcctggctgacgacggtggcgtagttgcccggcaccgcgtccagtgcggcccacgcggagaccgtgtagtccttcgtggtgtccacgaccgggccggcgctctgggcgtactgtccctcgccgtcgaacttcagcgccgagccggtcacgcccggggcccaggacgtgccgccctccagggcgaggtgggccttgttggggccgctgtcgcgggcggtcgtgcccgcgttctcgtcgagcgaccaggagccgccgcccttcagctcgacacgctcaccggccttcgcacccgcggcgatcacctgacggttgatctcccggaccttcttcgggtcgaccttgatctcacgccggtcgtacgtccacagaccgttcagctcgttctccaggtcgctgacctgggtgtagacggagccggacagttcggccccggcggcggcgaggtaatacgtacgggtgttgtcgacgtacttggcggtgagcgcggccttgtccgcgaccccgctgtagatgttggcgggggcgccgggccacatgtgccccggggtgcgaagcgtgaagcctccgtgctcgccgtccatcgcggcgcgacggtcgtccgggaaggccgggtcgttgttcacgtagtcgtggtggtcgatgatctcacccttgccggaatcacccttggaggcgcagcagttgacgccgctgtgcgcgttgaccacgcgggacgggtccagtgccttgacgtcctcggcgatcttgccggtctcggtcctgtcccactcgccccagccttcgttgaagacgatccagccgctgatggaggggtggttgtggaactgcttcatcatctccttcccttgggtgaggaaggcgttcttgccggtgtcgttgtcgatgtcggcgttgacgaagtcctgccacacgagcagtccgagccggtcggcgtggtagtaccagcgcggcgattccaccttgatgtgcttgcgtacggcgttgaagccgaggtccttctgggccttcaggtcgaaggtgagggcggcgtcgctgggctgggtgtacagaccgtcgggccagaagccctggtcgagcatggcgagggagaagaagggcttcccgttgagaacgagcttctggtagccgccgacttctgcgatcttcagctggcgcatcccgaagtagctctcgacgctgtccttcgagcggccgtcggcgagggagacgtcgaggtcgtacaggtaggggtcgtccggcgaccagaggtgctggtccttgagctggaggctgagcctgcggttggccgggccggtgaccgtgccgacgaccttgcccttgcggtcgcgggcgacggcggtgatccgggcgtcggcggaggcggcggcgttgacggtgaccgcgaggcggccggtgtcgatgtccggtgtggtggtcagggagtcgatcgcgacgggggcgaccggctccatccacacggtctgccagataccggaggacggggtgtagacgatgccgccggggttggtggactgcttgcccttgggctggttgggaccggtctcgtcggtgacggcgacgacgatctcctggggtccgctgcccagaagcgcgtcggtgatgtcggcggtgaacccggtgtagccgccggtgtgttcggcgaccttggtgccgttgacccagacggtggaccggtagtcgacggcgtcgaagttgagcttcagccgcttgtccttgccggacgcgcccttgccgcccttgccgcccttgccgaccgaccagttcttcgggacggtgacgagcttgcggtagaacatgtggtcctcgtcgcgctccaggccggagagctgggactcgaccgggaacggcacgatgatcttctcgtcgagcttcttgccgaagaccggctgctcgccctcggtggccccggcgaactcccaggggccgttgaggttcttccactggtcgcggacctgctgcggccgggggtactcgggcagcgggttgttcgtgtccagccggtcgccccaggtggtggtgaggcggtgcgtggagaggttcttggcggtgcggccgatctccggaacggtctcggcgccggacttcagaccgccctggccgtcgtagacgaccttgacgcgctggtccttcaggacgggcgcggcgagatcgatgatcagcgccctcgggttgtccgatgcccggttcaccgacttcaccggcatcggggaggtgtcgacctcgatcttgaggtggtccttcaccttccggtagtccgagacgcggtccctgaaggtggcctggaggcgcttgccgttccccgcgacgctcagggcgaccgggtagacctcgaagtcggcgggcggggtgaacgcggactcgggcacgatctgcttctcgagggtgtcgctcccccagcgcaggaacatgctggcgccgccgacgtcttggaacatctccagcttgaagtcgtgcttctccccggccttcagggcgatcggagcgctgtgctgctccttgtcccagtcgggctcccagtggtcgatgacaacgtttccgtcgaggaagagccggaagccgttgtcgccgatggcggagaaggtgtactccccggtctcgggagcttccaactgccccgtccaacgggccgtcgtgtgctcggtcttgccggtggccgactcgaacgcccccgtgaggccggggaagtcgatctcggggtccagggaggtggcgccgagttcggcgaagtcacgggcgcccggggcggacatgctgaagtactcgcccttcagcccgtggacatcggtgaccgggtcgtcggccgtgaaggccttcgcggtggctccggccggtacggcgggagcggcggccgcctgggggaccagggtggcaccgaccggtatgagcagcgccgcagcgcaggccagggacctgaacagggcgcgggggcgcgggtgttgtcgtctcaaggcgtcgtcctcgtcgaagagccgggggtgcctcgaaccagcgaggcactgcacatagtcgaacattgagccacaacaccaaacactgcacaacggtcgtgcacgcagaattttcaacgatagaaatctggccgtcatcgggacgtccaccgcggcccccacgggtcggccggagtcacggagccacggggagcacccccgccggggcacccacccccggcccgcgcggcggggacagagccgttcggcgtaccgcgcgtgattcacccggccgttttccatgaaatgccgtttcgggggtacccgaactccagccagaaagctcacgcgacggggtggaaaccatgaacgaccgcattctgatgacgttttcaccggacggcgagacccgcaccgactacgtctgccgaccggagaaggccgccgacgcgcgggacgcggtcagcaccttcgtcgcacggctgcaccccgcgccgacctcgcacacggtccagaacctcctgatcctcgtgtcggagctggtcaccaacgccgt

SEQ ID NO: 3644 - DNA, 2124 bp, Unknown
  Kingdom: Bacteria, Phylum: Actinobacteria, Class: Actinobacteria, Order: Streptomycetales, Family: Streptomycetaceae, Genus: Streptomyces
tctcagccctcggcgggcgatgcccccgccgaggccgacggggcttcgcccgccgagggctgagagcctgtcgggtgacgtccgctttccgatcggaggtcacccgacaggttctgagccgggcccttcgcggttccgttcggatcggcgggtccgccgggcaccccataggatcgtggtgtggccgtcttccggatcgagcgtttctcccctctccccgcagccgaggcctggcgccgggtgaccgactgggaacggcacgccgcgcaggtgccgttgaccgcgatctcggtcccgaccgggtttccctcgcagctcgggacggtgttcgtggcgcgtacggggctgggcccgctggcgttcgacgatccgatggaagtggtgcggtggacgccgcccgccgggggccgggccggggtctgccgactggagaagcggggggcggtggtgctgggccgggcctcgatcgacgtgcttcccacggattccggttctcatgtggtctgggtcgaggaactgcgggtgcggctggtaccccggtggggtgatccgctgctcgcctccaccggacggcggatgttcggcaaggtcctggacgcgctgctcgcctcccccggcgacgtgcgcgggtgaggtgcccgtaccggggggtcctgtccgcgcacgccagcgtccagcgggccctggccgccgccgggagccgcgcaagcgtcgctgcgcgggggcgaaacgatcgcggcggtgcgctgagccggcacggccccgggggacggcaccgtaccgatggcgtcgatgccgccgttcggagcgcccgaccggccgcaccggccgtacggtgcgagactcggaaaggtgacggatcttgacgactcctccgacggcggctcccacggcctgagtctccccgacggcccggacggccccgacagctcacgtccgcgctgtctggtgaccggggcgaccggctacatcggcggccggctggtgcccgcgctgctcgatgcggggtaccgggtgcgcgctctggccagaacgccgcagaaactgcgcgactacccctgggcggaccgggtcgaggtggtgcgcggcgatgtcaccgacgccgcgtccctggcggaggcgatgcgggacgtcgacgtcgcgtactacctggtgcacgcgctcggttccggctcggacttcgaggagaccgaccgcagggcggcccggaccttcggcgagcaggcgcgggcggccggggtgcgccggatcgtgtatctgggcgggctgaccccggccggggtgccggagaggaacctgtcgccgcatctgcgctcgcgggccgaggtggggcacctcctgctggactccggggtgccgacggcggtgctgcgtgcggcgatcgtgatcggctcggggtccgcctcgttcgagatgctgcggtatctcaccgagcggctgccgctgatgatcactccgagctgggtgcggacccggatccagccggtggccgtacgggacgtcgtccggtatctggtggggagcgcgaagctgcccgaggacgtgaaccgggccttcgacatcggaggcccggacgtcatgacgtaccgggacatgatgcagcgctacgcccgggtggcggggttgcggcggcggctgatcctgccggtgccggtgctcaccccgacgctctccagccgctgggtcggactggtcacaccggtgcccagctccatcgcccggccgctcacggaatcgctgcgccacgaggtggtgtgccgggagcacgacatcaaggagtacgttcccgatccgccggacggacccatcgggttcgaccgggcgttgcgcctggccctgcagcggatccaggaggcacgggtcgacacccgctggtccaacgcctcggtgcccggcgcgccgagcgatccgctgccgaccgacccggactgggcgggcggcagcctctaccgcgacgagcgggagctgaccgtgccggtcgggccggacgcgctgtggcgggtgatcgagggcatcggcggggagaacggctggtactccttcccgcgggcctgggcggtacgcggctggctcgaccggctcgtcggcggggtggggctgcggcgcggccgccgggacgcccag

SEQ ID NO: 3645 - DNA, 3050 bp, Unknown
  Kingdom: Bacteria, Phylum: Actinobacteria, Class: Actinobacteria, Order: Streptomycetales, Family: Streptomycetaceae, Genus: Streptomyces
ccgccgccgggcagggtgaggctctgcaggcggcggcgcttgaagtagtgctgggtcgtggggtcgagccgctcccgcagccatgcctcggcctcggggcgcagcccggggtggagcttggcctgcatgcagtagccgacggtccgcaccaggggggcgagggtctccggcgcggtgcgcggcagcagcgggacggccccggagccctgcgcgtccagatcgggcacgaggtggtcggtgatcgtcagcgggacgcggttgctgttctcgtacggggtgatgcggtcgaggaccaggcgggtgccgacgcgggcgacggggatgccgtagtaggcggcggcggtgaacatcgcggtggagaagcagccgacgaccagggtgggcgcgcaccgctcgtacagcgtctccgcgagcagcgggccgtccagggtggtgagccgtacgccggcctcggcggcggcctcgtccagggcgcgggagtagccggccggcgccgtggggtgcggcttgaagaggatggaggtgtgcccggcgcgcacggctccgcgcaacatccgcacgtgcaggtcctcttcctcctccggggtgaggatgttgagggcggcgaggtactggccgagcagcatcgcggtgggagcggccgcttcggcggcggcgagcttcttgtccccgtcggccgcggcggcgatctcggagaggacggcgcggaaggcgtcgtccgggacgagttcgggctcgacgccggcctcggcgaggaggagcgggcgcagcccggtgaccaggtcgaggtggaggacgcgccggatgcggcaggcgatggactggggcagccggttgcgggtggggccgtagctcatcaggccgtcggcgtacacgtgcacggcgctctcggagaagatcgcggccagcgcgcgggccggattgacctggatggactccacggccaggtcgacgggggcgtcgggggcgatgtcccaggccaggcggaaggcccgctgccacaggacggtctcctcggagcggggaccccagccgctggggtggtgcgggctgatcgcctcgttccagtcgacgacggcgtcgaagcgggcggcgagggagccgtaaccgcgcatctcctccaggcgcagggccgtctcggggacggccgcgttgttggagaccagcaggatgcggtggctgtcggtggcccggccgaactgtccggcgtcgagcgcggcggcgagggtggccgccccgtacagggtggacacctggaagatctgggtgcgcgggggcgtacgtacggacgtgggtacgggcgtgggtagggacatcggtcaggcggccttctgcttggtgcgcagacggctgagcagcgtgccgcgcttgtcgtcgatcatcgtcagggtgcggtcgagcacgtcctgcggcatccggtgcagcgcggcggccgactcggagcgcagccgccgggcggtggcgggctcgtagtcgtcggccttctcgttgtggaaggcgatcatcgcgcagtacgtgcggacggccttgggcagcagggtcttcgcgtcccggtccgtgcgcagttgatcgagcagcgtgtcgtaggcggggaagaagtcgagctggcgggagtccttgatctgggtcagggaggtggtgaccccgcgccggtagaagatgccgtacagcccgagcgacgcgtaggtgcgggcgcgcagatggagctgccagatccacagccggtcctcggcggtgcgcagttcggtggcgaagcgctgggcgccgtcggcgaagagccgccggtggtagatcccggcccagacgaacgggtagtcgaccatggtctcgcgctcgggagccccgatcccttcgcgggggtcgagcagggtgtcccggagaggcgcgggggcgcgccgcacgacgcgggtggtgccggtggactggacgtggtcggtgcgggcgaagtcgcagtcgaggtcctgggcggcgcgcaccagccggtccagatggccgggggcgtaccagtcgtcgccgtcgaggaaggtgaggtagtcgccctcggcggcgtcgatgccgctgttgcgggcggccgcgatgccgacgttcgtaccgtgtctgaccacccgggcgcgcggcagccgctcggcccagtggtcgacgatgtcctgcgtgccgtcggtggacgcgtcatcgaccagcaggaactcgatgtccgggtccgcgttgcgggccaggctgcccagcgtggtcggagcgtagggcgcgacattgtggagcggtacgacaacggacagtttcggcacgcgtgccctcgccttcgatcatggtcccgacaacctagtgagacggcggaaggatcgggtgacgcccgccacgacaacgggtgaactctgcgcgtccgccgcatgaccgggcgcgcgccggagaacgtcccacgacggagcttgacctcgacttcgcttgaggttctacgttccgttgcatggactactcacacgacgacgcgggactcgcccgccagccgatcggttactggagctgggccgcgcacgaggcgacggtcacccacatccggtccgcgctggccgagcacggactcacccagcctccctggtgggtgctcaaccaactggacggcgcggacgaggagggacggggccgggccgagctggtggcgatgctcagcggctacctcgacaccgggaccgccggcatggaggaggccgtcgagagcctcctcgaacggggcctggtcaccgaggacgccggagcacggctgcggacgacccccgagggacgggcgctgcgcgagaaggcgtacgcccgggtcgcgcgggcgagcgcggagatccacgagggcatccccgaggcggagttcgtcgccgcgctcaagatgctgcagcggatgatccacaacgtcgggggaaaggcctggcaccactgaggccggagctacacgctgctcagcgagagcttggccgcgaacccgaggaacaggacgcccgccgccttccgacgccgtaagcgactgtcggcgggggccacttcggcggcgggcgtcctgttcc

SEQ ID NO: 3646 - DNA, 579 bp, Unknown
  Kingdom: Bacteria, Phylum: Actinobacteria, Class: Actinobacteria, Order: Streptomycetales, Family: Streptomycetaceae, Genus: Streptomyces
  misc_feature (341)..(391): n is a, c, g, or t
ggcggcggccaggcgggtgccgccgaagatcagcaccgagaggtacgcgaagctggcgagctggagcagcgtccccagcagcaggaacgacagcgccggataggcgtagcccgggtcgacgaactggacgaagaaggagatcaggaacaggatcgccttcgggttgatcaggctgaccaccagcgcccggcggtagggcctctccacgggggcggtcgctccggacgcctcggcggtctcgaccgtctccacgagctcggcggtacgccggtgccgctcgcgccacagggacacggccgcccgcagcatcccgatggccatccaggtcagataggccgcgnnnnnnnnnnnnnnnnnnnnnnnnnnnnnnnnnnnnnnnnnnnnnnnnnnncgccgcgccgggcggcgacggagagcacgtacagcgagttcggccccggcagaagaacgatcagcgccagaccggcgagataagtcggaagatcggtgacacccagcatggacggagtctcgcacgcccgtacggggtgtcgtccagggggtttcaccaggcgatatcgacgccccggtggcgcccgg

SEQ ID NO: 3647 - DNA, 6945 bp, Unknown
  Kingdom: Bacteria, Phylum: Actinobacteria, Class: Actinobacteria, Order: Streptomycetales, Family: Streptomycetaceae, Genus: Streptomyces
gtcggcgaccgcaccgcgcaccccgcgcagcggaagccgctcggcggccggagcggcgggggccgcggaagcgggggaaggtccggtcggtgccgcagccgcctggaccgtccgtgtcttctccgccgcggtctcctccgcctgccggatcgcgcggtcgacgtcggcgcgcaggatcagcccgtcgggacccgaacccgccagccgccgcagatcgatctcgtgctgccgggccagccggcgcaccagcggagagaccaccggcaccgggccctgccggtccgtcacgagaacggtcgccggggcgggaacggtgacggcggccgtcgcccgagcggccacgacgacgtcggccgtctctcggtcgagccggtccggacggatgcgccgccggcgtgcggccggtgcgccggtcccgtaccccacgagcacgttccccgacccgtccgaggactccgggtcagagacggaggaggcggcggaagaggtgctgataggggtaccggaatcggaggacgacggggacgcaccggagagacccagctcctccgtggctccgaccgcgaccgtcagcagcggtgcgccgacgggaagttccgtaccctcctcgccgaaccgcgcggtcaccactcccccgtagggacagggcacctccaccatggccttggccgtctcgacctcgacgacgggctggtcgatggcgacgacgtcgccgacctccaccagccagcggacgatctccgcctcggtcagtccctctccgaggtccggcagcttgaattcgagcacctgggccatcagctgtccgcctcccactgcaaccgggccaccgcgtcgagcacccggtccactcccggcagatggtgccgctccagcatgggcggcgggtaagggatgtcgaacccggccacccgcagcaccggagcctccagatggtggaagcaccgctcggtgatccgagccgcgatctcaccgccgggcccgccgaatccgggggattcatggacgacgaccgcccgcccggtgcgccgcaccgacgcggtcaccgtctcgtcgtcgaacggcaccagcgagcgcaggtccaccacttcgaggtcccagccctcggcgaccgccgcctcggcggcctccatgcagaccggcagggagggcccgtacgtgatcagggtggcgctgcgcccggaacggcgcaccacggccctgccgatcggctcgaccgcggcaggcgcctcgggcgaccagtcggccttggaccagtagagccgcttgggctccaggaagatcaccgggtcgtccgaggcgatcgactcccgcaacagcccgtacgcgtcctcgaccgtggccggtgtgacgacgtgcagacccggggtggccatgtagtacgcctcggaggagtcgctgtggtgctcgaccccgccgatcccgccgccgtacggcacccgcacggtgatgggcagcggcatggccccgccggtgcggttgcgcatcttggcgacatggctcatcagctgctcgaacgccgggtaggcgaacgcgtcgaactgcatctccaccacgggtcgcagcccgtacatcgccatgccgacggccgcgccgaggatgcccgcctcggccaggggggtatcggtgcagcggtcgtcgccgaactccttcgccagcccgtcggtgatccggaagaccccgccgagcgtgcccacgtcctcaccgagcacgtgaacggtggggtcctcggccatcgagtcgcggagcgcgcgcccgagtgcctgcgccatcgtggccggtttcgccttcgccggacgtccgtcggccgtcactgccgcggtggtcatcgtcccgcctccgcgccgtgctcgtcgtggtcctgctcggcgtccagctcggcgcgcagggcggctgcctgctcccggagctggccggtctgctcggagtagacatgggtgaacagatccatcggggccagctccggatccgcgttcatccggtcacgcagggcggcggccatgcgttccgcggcctccttcgcccgcgcgatgcccgcgtcgtccagcagcccgcgccccgtcagctcacgctccagcagccgcaccgggtcgtgcgccttccaggcctcgacctcgctgtcgacccggtaacgggtggcgtcgtcggcgttggtgtgggcttccatgcggtaggtgaccgcctcgaccagggtcgggccctcgccgcgccgggcccgtgccacggcctcgctcagcacctggtgcacggctgcggcgtcgttgccgtcgacgagacggcccggcatcccgtatccgacggccttgtgggcgagggagggggcggcggtctgcttggccagcggcacggagatcgcgaagccgttgttctggacgaagaagacgaccggggccttccagacggccgcgaagttcagcgcctcgtggaagtcgccctcgctggtgccgccgtcgccgaccatggcgagcgccaccacgtcgtcacccttgagccgggcggcgtgcgccagccccacggcgtgcggaagctgggtggccaggggggtgcacagcggggcgatgcggtgctcgcgcgggtcgtagccggtgtgccggtcaccccgcagcagggtcagcgcctcgaccgggtccaggccgcgcgcgacagcggccagcgtgtcgcggtagctggggaagagccagtcgcgctcctccaggaccagggcggcggcgatctcgcacgcctcctggccggtgctcgacgggtagaccgccagcctgccctgcttcgtcagcgcggtggcctgggcgttgtagcggcgtccgcggaccagctcggcgtggagtcggagcaacagctcggggtcgacatcggcgaccgcgtccgtaccgagcacccggtagggctccgggtccgggagcagcggggcggggtcggtgatcggcttccaggccgggggcggcgtgggccggtaggcggccgcgccgggcagctcttggaccgtcatgagaagcacctcctggcatcgagggagatcgaggggtagtcgatcggagtgtcgacagggagcgagatgtcgaggcgtgggccgggcacggatgtggtgtgcctcacctaccgattgttcggtcgcgggggcattttggctacaggcgccgccagcctgtggacaaacggttctccacagcctgggataggcacaggtcgtccacaacagggaggcgcgggccgatggcagctgaacgaatggccgacaagggcgaggagccgtaccgggccgcgcccgccgccgggccgtcggccgcacccgtcggcccggcggcggagcccccggttccgcccgcgcggccgctggactccatcgaccgcgacatcctgcgcatcctccagacggacggccgcgcctcgatacggtccgtggccgaacgggtccacgtctcgcgcgccaacgcctacgcccgtatcaaccggctcgtcgaggacggcgtgatccgcggcttcggcgcccgggtcgaccacgagcgggcgggccagggggcgtccgcgtacatcacgctcaagatcgtgcagaactcctggcgcacggtgcgcgagcagcttcaggcgctgcccggggccacgcacatcgccctggtcagcggcgacttcgacgtactgctcctggtgcacacgccggacaaccgggcgctgcgggagctggtcctcacccggatccagtccatcccggaggtgctttcgacacgcaccctgctggtgttcgaggagacggacctcggcccgcgcccggaccggccggccgaactcgcctgagcgcgccggcggccaggaggatgatccggcgggctcagcggccgttcgcccgcatgccctcgaaggccagctggacgaccgtgtccgcgagctgctcctcccccgggaaaccgcccggctgcggccgataccactcgaccagcgagttcaccatgccgaacagcagccgggtcgccagccgtatgtccacgtccgcccggaggtcgccctcggcgaccgcggcctggagcagctccgacacccgctggtcgaactcgcgccgccgctccagcgcccagcgctccgtcttcgtgttgccgcgcacgcgcagcagcagcgtgacgtaggggacctcggccatcaacacgtcgacggtccggcgcgtgacgtactcgacccgctcgaccgcgcgtccgcgcagcgcccccggctcgtcgaggatggcgaaaagcccgtcgagcgcccggctcacggcccggcgcagcagttcctccttgcccgccacatggtggtagatggaggatttcgagatgcccgccgcccgggagaggtgctccatggacgtgccgtcgtagccgcgctcgttgaagacacgcacggcgacggtgagcagggtctccggtgtgtacgtgtcccgcttggccgtggtcatgtccgcgatcctcccccatgagttgtccacaggttccctggggccccttgtcccgaccgatcgttcggttactctaactccgtccgtacgtccccgcccggctcgatgaggagttggtccgccatggccgccgcgctcaccccccagcagctgtccgagacccaccggcccacgctcgaccaggccctcgacgtgatcagtacccgcgcgtactggtcgccgcaccccgagcacccgaaggcctacggcgagggcggtgccccggacagtctcggcgcggccgagggcaaggccgctttcgacgccctcctgaacacccgtctcgacctgggacagcccggcaccgacggctggaccggcggcgaggtctcgccgtacggaccggagctcggcgtcgagtatccgcacgccgacccggacgtcctgcttccggcgatgaaggccggcacggccgcctggcgggcggcaggaccggagatccgggccctggtctgtctggagatcctgtcgcggatcagcgcccgcacccacgagctggcgcacgccgtgatgcacacgagcggccaggccttcatgatggcgttccaggcgggcggcccgcacgcccaggaccgcggcctggaggccgtcgcgtacgcctaccgggagcaggtccgcaccccggacaccgccgactggtccaagccgcagggcaagcgcgatccgctgaagctgcacaagtcgttcatcacgtccggtcgcggcatctcactcctcatcggctgcaacacgttccccacgtggaacggctatcccggcctcttcgcctccctcgccaccggcaacccggtgctggtcaagccgcacccgcgcgccgtgcttccgctggccctcacggtgtccatcgcccgcgaggtgctgggcgaggcgggcttcgacccgaatctggtcgcgctggccgccgagcggaccggcgagggcatcgccaagaccctcgcggtccgccccgagatccggatcatcgactacaccggctccaccgccttcggcgactggctggaggagaacgcccgccaggcccaggtctacacggagaaggccggcgtcaacacgatcgtcgtcgactccaccgacgactaccggggcatgctcgccaacctggcgttctcgctctcgctgtacagcggccagatgtgcaccaccccgcagaacctgctgattccccgggacggcatcgccaccgacgacggcgccaagtcctacgacgacgtggtcgccgacatcgccgccgccgtcaccggactgctcggcgacgacgcccgcgcgtccgccctgctcggcgcgctggtcaacccggacgtcaaggcccgggtggaggcggccggggagctcggcgaggtggccctggactcgcggacggtcgcgaacgccgaattccccgacgccgtcgtccgtacgccggtcgtcgtgaagctcgacggcaccaagtccgacgacggcgcggcctacctctcggagtgcttcgggccggtgtccttcgcggtcgccgtcgagtcgacgaccgccgccctggacctgctccgccgcacgatccgcgacaagggagcgatgtcggtcggcgcctacaccacgtcccccgaggtggaacgcgccattgaggacgtctgcctggacgagtcggcccagctctcgctgaacctgaccggtggggtctacgtcaaccagaccgcggccttctccgacttccacggctccggtggcaaccccgccgcgaacgcggcgctctgcgacggtgccttcgtcgccaaccgcttccgcgtggtggaggtgcgccgccaggcgtgactagagcgtctctcgcgggtccgggacgtcggcgtggcgctgcacccacgcgtgcatcgcgatagcggcggcggcgccggcgttgatggaccgggtcgatccgaactgcgcgatcgagcacaccatggaggcgtgctcacgcgcttcctcggtcagtcccggcccctcctggccgaagagcaggacgcagcggcgcggcagttcggtgcgttccagcggtacggcgccggggaggttgtcgatcccgatgatcggcagcccctcggccgccgcccacgcggtcaggtccgccgtgtcggggtggtggcgcacatgctggtagcggtcggtgaccatggcgccgcgccggttccagcgccgtcggcccacgatgtggatctccttggccagaaaggcgttggcggtccgtaccaccgagccgatgttgaagtcgtggccccagttctccacagccacgtggaagtcgtgccgtcgcagatcgagatcggcgacgatcgcctcccgcgtccagtagcggtacgcgtcaccgacgttgcgccggtcgccctgggccagcagttcggggtcgtagcgctcgccctcgggccagggcagcgggtgcggcccgacaccgaccggctggccgtagccgtcgtcgtactggaggggttccgccgcctgggactccgtcgggtcggccccctccggggcggccgtcggcc

SEQ ID NO: 3648 - DNA, 2817 bp, Unknown
  Kingdom: Bacteria, Phylum: Actinobacteria, Class: Actinobacteria, Order: Streptomycetales, Family: Streptomycetaceae, Genus: Streptomyces
ggtgaccatcccggtggacggccgggtcgccgatctccagctcaagttcttcgccaacaccggggcgcccggcgcgcagatcgccgaggtccaggtcctggggacggccgcgcccaacccggacctgaccgtgagcaccctgtcctggaacccctcgtccccgtccgagacggacgacatcaccgtcgaggggaccgtccgcaacgccggttcggccgcctcccccgcgacgaccgtcaacgtgagcctgggcggcgcggtcgtgggcagcgcgccggtcggcccgctcgccgcgggagcctcggccccggtctcggtcgaggtcggcaagcggccgcagggctcgtacgccgtatcggcgctggtggacccgaccgacacggtcgtcgagtcggacaacgccaacaacagccggaccaccgccaccccgctggtggtcgggcagagccccggccccgacctggaggtccgctccatctcctccagcccggccaacccggccgtcggcgcggcggtcaccttcaccgtggcggtgcacaaccgcggcaccagcgcggtgagcgcgggcacgatcacccgcctgaccgccggttccacgacgctcaacggcaccacaccggccaccgcggcgggagcgaccgcgagcgtcacggtcgccggcagttggacggcggcgagcggcggcgcgacgctgaccgccaccgcggacgccacgaaccaggtcacggagaccagcgagaccaacaacacgttcgcccgctccatcgtcgtgggacgtggcgcagccgtgccgtacaccgaactggaggcggagaaggccgactacgcgggcaccctgctgcggtccgacgcggaacgcaccttcgggcacaccaacttcgccaccgagtcctccggccgcgagtcggtacggctcgactccaccggtgagttcgtggagttcacctcgaccgccccgtcgaactccgtcgtcgtgcgcaactccgtcccggacgcgccgggcggaggcggccgcgagacgaccatcagcctgtacgccgacggcgagttcgtccgcaagctcgacctctcctcgaagcacagctggctgtacgggaacaccgacagccccgaaggactcaccaacacccccggcggcgacgcacgtcggctgttcgacgagtcgcacgccctgctcgcgcagacctatccggcgggcacgaagttccgtctgcagcgggacgcgagcgacaacgcctccttctacatcatcgacctgatcgacctggagcaggtggcggcgccctcggcccagccctcgggctgcgtgtccgtcacggcgtacggcgcggtggcgaacgacgggatcgacgacacggcggcgatccagcgcgcggtgacggcgaaccagaacggcgagatcgactgtgtgtggatcccggcgggccagtggcgccaggagcagaagatcctcaccgacgacccgctcgaccggggtcaggtcaaccaggtcggcatccgtgatgtgaccgtccggggtgcgggcatgtggcactcccagctctacaccctcaccccgccgcacgaggcggggggcatcaaccacccgcacgagggcaacttcggtttcgacatcgacgagaacacgcaaatctccgacatcgccatcttcggctccggcaccattcgcggcggcgacggcaaccacgagggcggcgtcgcgctgaacggccggttcggcaaggacacgaagatcagcaacgtctggatcgagcacgccaacgtgggtgtctgggcaggtcgcgacttcaccaatctcccggagctgtggaacccgggcgacggcgtcgagttcaccgggatgcggatccgcaacacgtacgcggacggcatcaacttcgccaatggcacccgcaactccacggtctacaactcgtcgttccgcaacaccggcgacgacgccctcgcggtctggtccagcaagtacgtcaaggaccagtccgtcgacatcggccacgacaacagcttccgcaacaacaccatccagctcccgtggcgtgccaacggcatcgcgatctacgggggttacggcaacaggatcgagaacaacctgatctccgacacgatgaactacccggccatcatgctggcgaccgaccacgacccgctgcccttctccgggcagacgctgatcgccaacaacggcttgtaccgcaccggcggagccttctggaacgaggaccaggagttcggcgcgatcaccctgttcccgcagaacctgccgatccccggagtcacgatccgcgacacggacatcgtcgactccacctatgacggcatccagttcaagacgggcggcggactgatgccggacgtcacgatcgagaacgtccggatcgacaggtccaccaacggatccggcatcctggcgatgggcggcgcgcgcggcaacgcgacgctcacggacgtgacgatcaccgactcgcgcgacggtcacgtactgatcgagcccggttcgcagttcacggtctccggcagcccgaacggcgcacgggccaagcggtagccgcttgtacgctcccgggccggcggatcgtcgtcggcccggaaacacccttttcccaccagggaattgggtcctgcaaggctctgggaagtgcagggtcccggggctaccctccgcgcatgattcccacggttgtctggggcaccggcaacgtcggccgcgcggcgatccgcgccgtcgaggcccatccggcgctgacactcgccgccgtcctcgtgcacgatcccgccaaggtcggccgcgacgcgggcgacctcggcgggatcgtgcac

SEQ ID NO: 3649 - DNA, 583 bp, Unknown
  Kingdom: Bacteria, Phylum: Actinobacteria, Class: Actinobacteria, Order: Streptomycetales, Family: Streptomycetaceae, Genus: Streptomyces
tacctggagggccggggtggacccaccccggccctccaggtaggccagcaccgcgaggacgcggcggtggacggcgccgtcgtccggttccaggccgagcttggcgaagatcgatccgatgtgcttgctgaccgcccgttcggagacggtgagttcggcggcgatggtggcgttggccttgccctgcgccatgtgttccaggacttcgcgctcccgggcggtgaggctctggagcgggcccgccgaggatctgcgggtgaggagctgggtgacgacctccgggtcgagcgcggtaccgcccgccgccacccggtccagggcctccaggaactgctcgacccggcccacccggtccttgagcaggtagccgatgccccgggcgccttgggcgagcagctcggcggcgtacgtctcctcgacgtactgcgagaggaccaggatcggcagatcgggcagttcggcgcgggcggcgagcgcggcccgcaggccctcgtcgcggaaggtgggcggcagccgtacgtccaggacggcgacgtccgggcggtgttcgagcagggcgggcaggatctccgggccggccgcc

SEQ ID NO: 3650 - DNA, 2228 bp, Unknown
  Kingdom: Bacteria, Phylum: Actinobacteria, Class: Actinobacteria, Order: Streptomycetales, Family: Streptomycetaceae, Genus: Streptomyces
gttggcgggcttgatgtcgcggtgcaccaccccttcggcgtgcaccgtggagagaccggagagcagttggtccagcagcaggcagacgaagcgcgggggcaacgggccgtagtcgccgatgacatgggcgagcgagccgccgctcaccaggtccatggtgaacaggaccttgtcgtcgtcggcggcccagctggccggggccagcacgtgcgggtgctcgatgcgcagggcctgctcgcggacgaagcgcagcagcgtgtgcgcgtcgctctgctggagcaccttggccgcgacgtacctgcggcggcggtggtcccaggcgcgccagacggcgccgaccccaccccgtccgatcggatcgatcagctcgtaccgaccagcgaagacctcacccattgtgctgcgcccgctccccgttcccgtggtgccgcggcgtccgccgcggcccgtgtccggcccccgtgtcctgtcggcaccagggcgccgcacggtgcgcgcgtgccctggctcctcgtccgtcgtggtccggagccgctagctctggtgcccctcgtagtgcgcgaccgcgtccgcggtgcgtcccgctccgtacaccttgaggaactctgccagctccgggtgggtcggggcgagggcgtccgaggcatcgatgatgtcgccagccgccgcgaccgaccgcagcagggactggatctcgcgcaccacacgacgcacggtgggagcgccgcccgtggaggtggtctggccggtggcggtcaggaccgacccgccctgcgacttcttgatctcctccatgcggtcggtggcctcgcccgcgctgacgctgccgtcggccacctggctcgccagctcctggagggcctggacgcgctggaccaccgcgggattcccgatcttggcccgctggccgctcatcagctgggagagcatcggggcggagagcccgagaacggcggccagccgggcctggttcaggccgaggtcatcgatcagccgacggaagagcgcccccaacggctccccgtaccaactgcgttgaagttctctggctcttgccgtcgcctcttgttgcgctgcgtccatggcgtctccccatcgctgcggcttcgctgctgcgaaccttgcgagcatcttacggagcgtggtcgtccaccgggagcccctatgcttttgcaggatcacgggggtcacccggtactctggtctgcgacggtagccctggcacggacgtgctcggcgttgccttcgttcgttgtggcccggggccttagctcagttggtagagcgctgcctttgcaaggcagatgtcaggagttcgaatctcctaggctccacattcagaagacccccctgaactgcggtaacgcggctcaggggggtctttctcgtcctgggcccgcatcggtgggccgccgggcgcccgccagcccgccgggccgcgatctcgtacgatccggaaccggcgcgcttcctccggggaccgagagccggaggcaccaggcacacttcatacgtaaacagtcgagccacaaaaggactcaggcatgatcacgttgacgaaggaagacggcccggccgacctgggtggggtgacccatctgtccatcggggcgtcctgggaccccaccgtcgggagcagcggcggcctgatggggaagctccggcagaaggccggcacggacctcgacctgatcgccatcgcgctgcagggcggggacccggtgcggctggcaggcctggactcgctggacccgctgggcaacggctcgctggtgcacagcggggacaaccagaccggacacggtgacggtgacgacgagacggtgaccgtcgagttcgccaagattccttcgaacatcacgtccatcgtcttcatcgccgccgcgtacaagaagcggagcgcgttcagcaacgcgcgcaacatcagcttcaaggtgtacgacgcgacgggcgggagcacgcagcaggtcgccgacatctggccgagcatgctcacccaggacaacggcgtcgccgtggccaaggcgatccgcgagggcgcgggctggaagctccaggtgatcaacgagaccgggaagatcaagcagggtgacgagcaggccctgatgcgcttcgccgtgagccggtagtcgccggtgggcggcgctccgccaccgtcctgcggtggagcggggcgagagaacgaacgcggctgcggtaaccgcccgagcggttaccgcagccgcgtt

SEQ ID NO: 3651 - DNA, 1316 bp, Unknown
  Kingdom: Bacteria, Phylum: Actinobacteria, Class: Actinobacteria, Order: Streptomycetales, Family: Streptomycetaceae, Genus: Streptomyces
tagacacgtgtgcccccgccggacgggcgggggcacacgtgtctaccgggccggcgtcaggaacccacgctcaccgtgaagcgacgcgggttcccgtcgtgcgccgcgcccgagacgtccggctggccgtcggggcggacgtcgtcgtacgggaacgcgtagccgatcgggctgttcgcgtggaccacccgggaccagtggttggtgaccgttcccttgtagtagtccgccgtggacgtgccgttcggctggctcgggtggctcagcatgatcgagcggttgaagcccgccgccagccgggccaggatcgccttcttgtcgtcggagtcgcccgggttgttggtgaacgggccgtggttgcaggtgaagatgtccttcgtctccggcttgacgaaggtgtgaccgccctcgaaggtcagggtgtccccgctgacccggccggccagcgtgccccggccgccctggaggtcgatgcgcaggtcctcggagcggtacttctcccagacctcgtcgatctgcgcggtgaacaggtcccggaacggcatctcggcgggccggtcgaagtacggggccatgatgttctgcggcgagacgacccgcaggacgctgccgtcgtcactccgggtgatcagcttgtcccacggctgcccgtcggcggcggcctgggcggtgaggtcgtccgcgatccgctgcaccgcgccctccgggtgcggcgcgacgacgtgggtcccgtcgccctccagcgtgatcccgatcggaagagcggtgatcaggtcgacgtagctgatgttggagtacaactgctccgtgttgaaggtgaactcgcagaacgaccaggtgcgcccgtagttggggtccgtgggcgtcgcgaaggcgggctccaccagcgaagggcccgggttgaggtagaagtccagcttgtcgtcgcggacgaagtagacccgcgccccgtacatctgcggcagggtcagcacgaccggacccgcgcccgcgcccttgagcgggatcgcgcagtcgaccggcagcggggtctgcggggcgccgggggagtcggggcggtagacgccgccgtccggcttgagcagcacccagcggtcggtgcccagctcgtggccggtcacatacgcgtgcaccgtgcccggcaacgacttgttctccagagccagttcgcaggtcgcgggggccgccgagacgcggggactcagagccgtgccccaggcggggtacgtgagcgccgcggccgaggcggcggcgccggtcaggaacattcggcgtgaaatcacgaaggaactcccgaggtggtggggggccgcagg

SEQ ID NO: 3652 - DNA, 6704 bp, Unknown
  Kingdom: Bacteria, Phylum: Actinobacteria, Class: Actinobacteria, Order: Streptomycetales, Family: Streptomycetaceae, Genus: Streptomyces
ggcggggcgagagacatcatgtctctcgccccgcccgccgttctgctgggcgtcgcgtcagacgcggcggtggcggccgtagtactcgccggtcgtgcggtggaattccgtgtcgccgatgtgcttgtccttgtcgaattccggagagtccttgacctggtccttggtgaggtcgaggtagaccttcttctcgtcgctgtcgatgcggctcaccgtgcccgccgggagcagaacgtgcttgccgaaaatccatacgccggtgtcgaccaccagatatgaggacgtgacatcgtcggagtgcttgtcgaccttgccgatgccgccgtccgtcgcctcgaccttgtagccgatcaggtcggtaccggcagtgtggccgatattcggctggtaaccccacaggttgtcactcatgggaaattccttcgttcgtagggataaggaatgaacgtattcggagcggccgtcagggcggcgccgacactggttcgctctctcgctcccaccctggcgatccgccctttgcctcagcaaccttgatcagcctcgtgccccggaccatccggcatacgcccacggaatctgttgttttccggcccgattccagggaagccgggcaacctgcacgcaggtcggttcacgggcctccttgatcgactccggcgctgagggcttttccgcatcgaggcttacctttcccggtgccgggcacacggacgacacgactcgaaggagtaactcccatgctgggtatagcagccgcagtactgttcttcatcgcgttcctcatcaacgccgccgatatttccaccaacgacgtgttcgcgtcgggcaacgtgatgctgctcggcctcgtgctcctcgccctgcacgtcgcgggcgtgggcgccggaagccggatgggcggctcgcgcaggcgctgaggcacccgcaggcgccaccggccccaggagaacgcaaaccgatggagaaggcacaccgatgaaggacgcatcgcaggacaacacgggcacgcccacccctgaggaactgcgcgaacaggtggagcgaacgcgcgacaagctcgggcagaccgtcgaggcgctcgcggcgaaggccgacctcagggagcagacgaaggacaaggtcgccgcggtgaaggagcgggccgccgggaaggccgggacggcatccggccgcatgcgccacctgacggagcaggccgcgcggcgggtgaaggacaggacacccgacgccgtgctggaagagaccgcgcgggtcaccgcgcagctgcgtgagcgtacggtgcgcgccggccagtacgcggcggtgaaggctcccgatcctctgcgggaaagggcggagcgagccgccaaggctgtccgcgccaaccgcgccccgctcctcacgggcagtgccctgctggtcgccttcctgctggtacgccgcagccgcggacgcaaccgatgaagggaaccaagatcgcctacaagccggtcggcctggtcctgggtgctgtcagcgggatgatcgcgggcgccgccttcaagcagacgtggaaactcatcgagggcgagggggacgcgcccgacgctctcgacgagggccgcccgtggcggcagatcctcctcgcggccgccgtacaaggggcgatcttctccgtggtcaaggccgccgtcgaacgctcgggcgcccaggtgaccaggcgcgtcacgggcacctggccggcgtgacccccggggctgaccgccgcccgcgccccgtcagtcggtctgcggcggctggtacgcggcctgccgggcggccaacgacccgttgaaacgggtcagcagggcgcagaacgtgtcccgctcctcctgcgaccagccgtccgtcacctgggacatcagctcacgccgcgaggcccggacctcttccagccgggcctgaccccgcggcgagagctggagcaccacggcccggccgtcctccgggtgcgacgtgcgcttcaccagaccggtgtcgacgagcggcgccacctgccgcgtcaccgtcgaggagtcgatgcccatcccggccgccagcgccttgacgcccatcggaccttcccggtccagccggttcagcagcagatacgccgcccggtccatcgagttgcggacctggccgacaccgccgaggcgggtctgctcggcacggcgggcgaagaccgccacctggtgctggagcgagtccagcaggtggtcggggcccgggtgttcggggacggcgcccccggaaggagacgcagcagtcgtcatgtcctgagggggcatggccgggggctctcttcgtgcggtgtcggatgggtgggggacagagtacgcggccccggggcaacgcgtaccagtgccgcacaaacctgcggacaccaccgcaggccgccgtgagacacatctgccgggccgtgtccgagctgcaagacttgcggacatgagcttccgcacgaccgcctcccaccccgccctgatcctcgacgacgtccggggcgcacagaagatgctgtccggggtggcgagggtgaccgccctggagggaagccgtcacctgaccgagctggtcggctccccggtccacctcaagtgcgagaacctccagcgcaccggctccttcaaactgcgtggcgcctacgtccggatctccggcctcaccccggtggaacgggccgccggggtggtcgccgccagcgccgggaaccacgcccagggcgtcgcgctcgcctcgtccctcctcggcgtgcgctccacggtcttcatgcccgtcggggcgcccctgcccaaggtcgccgcgacccgggagtacggggccgaggtgcggctgcacggccaggtcgtcgacgagaccctcgccgcggcccagcggtacgcggaggagaccggcgcggtcttcatccaccccttcgaccaccccgacatcatcgcgggccagggcaccgtcgggctggagatcctggagcagtgccccgaggtccgcacgatcgtcctcggcatcggcggcggcgggttcgccgcgggcgtcgccgtcgcggtgaaggccctgcgccccgacgtccggatcgtcggcgtccaggccgagggcgccgcctgctacccgccctccctggccgccgggcacccggtctcgctcgactccccggccacgatggccgacggcatcaaggtgggccggcccggcgacgtaccgttcgccctgatcgaggagctggtcgacgaggtccgcacggtcaccgaggacgagctgtccagcgcgctgctgctctgcctggagcgcgccaaactggtcgtggagccggccggggccagcccggtggccgcgctgctcagcgacccgaaggcgttccgggggccggtggtggccgtgctgtccggcgggaacgtcgaccccctgctgatgcagcgcatcctgcgccacgggatgtcggccgcgggccgctacctgagcctgcggctgcgcctcaccgaccgcccgggagcgctggccgccctgctggccgcgctgaccgtggccgacgccaacgtcctcgacatcagccatgtgcgcaccgacccgcgcctcggtctgaccgaggcggaggtcgacctgcacctggagacgaaggggccgcagcactgcgcggaggtcgaggcggcgctgcgggcggcgggcttccgggtgatgggctgaggaacccggccgcaaggggtggctgccgcgccggggtgtgcccgttcaccgggcggcagaggcccgccgatcctaggatcggaccggaaagccgccacgacaccatccgcgagtgacgggggagcctcttcatgccaggtgcgatccatgccgaaggtctggtgaagaccttcggcgacgtacgagccctcgacggcgtcgacttcgatgtccccgagggcacggtcctcggactgctcgggcccaatggtgcgggcaagaccaccgccgtacgcgtgctgaccacgttgctgcgcccggacagcggcacggcgttcgtggccgggatcgacgtactgaagaagcccaacgaggtacggcgctcgatcgggctctccggacagttcgccgcggtcgacgagtatctgaccggccgggagaacctccagatggtcggccggctctaccagctgagcgcccgggacgcgaaggcccgggcaggtgtcctgctggaccggttcaacctcggcgacgccgccgaccgcaccgccaagacgtactccggcggtatgcgccggcgcctcgacctcgcggcggcgctcgtcgtgtcgccgcccgtgatgttcatggacgagccgacgaccggcctcgacccgcgcaaccggcagcagctctgggacgtgatcgaggatctggtggcgggcggtacgaccctcctgctgaccacgcagtatctggaggaggccgaccgcctcgcccacgacatctgcgtcatcgaccacggcaaggtcatcgcccgcgggacctccgaccagctcaaggcgcgcaccggcggcgagcgcgtcgaggtcgtcgtgcaccgtccggacgagatcgagcgcgcccggtccgtgctgaccgccctcggcaagggcgaggtcaccgtcgtcccgctctcccgcaagctgaccgtaccggtcagcggcggggccaagctgctggccgagatcatccgcgacctggacgccgagggcgtggagatcgacgacatcgccctgcgcaggcccaccctcgacgacgtcttcctctccctcaccggccatgcggccgaggtgcacgagaacggggacgaggagtccggcagggcgcgagcggaacgttcccccgactcccggagcaaggaggacacccggtgagcgcgatccccaaggacgcccccgcactggttccccgccccgccgggggcgtcgcgcagtccgtgaaggactccctcgtcgtcgccaagcggaatctgatccggatgacccggatccccgagatggtgatcttcgggctgatccagccgatcatgttcgtggtgctcttcacctacgtcttcggcggctccatcagcatcggcggctccaccgacccgcagctgtacaaggagttcctgatggcgggcatcttcgcccagacggtcaccttcgccacggcgggcgccggcgccggcatcgccgacgacatgcacaaggggctcatcgaccgcttccggtcgctgcccatggcccgaggtgcggtcctcaccggacggacgctcgccgacctcgtccagaccacgctcaccctcgtcgtgctcgcgggagtcgccctgatcgtcggctggcgcacccacgagaacctcttcaaggtgatctgcggtttcctgctgctgctcctgctcggctacgcgttctcctggatcggcgccctgatcggcctgtccgtgcgcaccccggaggcggcgacctccggcggcctgatctggctgttcccgctgacgttcatctcgaacgccttcgtcccggtcaccggcatgccgacgttcctccagcatgtcgccgagtggaacccgttcagcgccacggtggcgggggcccgcgagctcttcgggaacacaatgccgggcgtgccgaagtccgtcaccggggcctggccgatggagcacccgatcctcgcctcggtcatctggtccgtgctgatcatcgtggtcttccgcaccctcgcggtccgcaagtaccgctcggccgccgtctgacacccgacccgggcgtcgcgatgagttccggcggcgccgcgagtctctactggtggacgccgccgggcgtcccgcgcgcccccgtgaccccggctcgcgacaccagggaggacaccatgaccaccgcaccggacgacccggccaccgaactgcccggggccccgcccgtcgtcgacttcgccacctggcaggccgcccgggacgagctcctggtccgcgagaaggcccacacccgccagggcgacgcgctcgccgcggcccgccgccgactgccgatggtggaggtcgacgggacggccgaggtcgtcggacccgagggcccggtcccgttcctggacctcttccagggccgccgggagctcgtcgtctaccagcacatgtggtacgacggcgcaccgcaccagggtcagtgcgagggctgcaccgacgcggtctggcacatgaaggacgccgtctacctcaacgcccggggagtctcgtacgccgtcctgaccacgggtccctgggaagaggtggccgcctacaccgcgttcatgggctacacccagccctggtactcggtgcggggcctggacgcgccgatcggtggcgagatgggacacctcgcctgcttcctgagggacggcggacgggtgttcctcacctactccacgacgggccgcggaatcgagccggccaacggctccttcggcctgctcgacctgacgccctacggccgcggcgaggcgtgggaggacctccccgaggggcggccggtgctcggcagcgtccgggaggggtatccgggcgagggcggccaggcctgctggtactggcgcacggacgcggacgggaccgcgagctggggcgctgccagccgccccacgtcccggagcgaagcccgagaagaccctcggccgcagcggcgactgctcctgacccgggccgcgggaacgccccgggtacgggcgacgacgcacgggagccccggccgtccgtggccggggctcccgcctcgttccgtcgtgaccggccggatcagccggagtagggc

SEQ ID NO: 3653 - DNA, 4568 bp, Unknown
  Kingdom: Bacteria, Phylum: Actinobacteria, Class: Actinobacteria, Order: Streptomycetales, Family: Streptomycetaceae, Genus: Streptomyces
ctaccggggccgggccaccgtggtgcgcgtcggtggaccggccccgggagggagcggcggggccgtacggtccggcctcagccgatcacgttgtccacgcccttcttcgccgtctgccacgccttgtccgacgacgtccccttgcgctcgacctcgctcagcgcgttcgtgatctgctgcatcacgttctggtcgtgcacacccagcacctggaccggggacgccttggccgcctcaccgaagatccggccgatcggggctcccgagaagtacgcgtccttcgcgcccgcgatcgtctcgatggcgcccgtcgaggacgggaagttgccctgcttctggaagaccttcgcctgctgctcgggggcggtcagccactcgatcagcttgtacgcctcctccttgtgcttggccgcacgcgggatggagaggtacgagccgccccagttgcccgcgccgccggggagcttggcgatgtcccacttgcccttgcccgcgtcgccggcctggcccttgacgtagccgagcatccaggccgggcacgggatcgtcgcgaacgaaccggccgcgaacgcctggttccactgcggggaccactggtcgagcttggcgctcaggccggcctcggccgcctccacggaggtgtcccaggcttccttgaccgccgggttcttctcgtagatcagctcgccggaggcgtcgtagtaccgctccttctcctggccgatcatgatcccgtagagcgagccgacgctgtccagccaggcgctcttggcgggggccttcttcttgtactgcttgcccagctccaggtagccgtcccacgtggcccacttcttcgcgagctcctcacggtccgtgggcagtccggcctgctcgaagaggtcggtgcggtagcacatcgcctccgggccgacgtccgtgccgaggccgaggatcttgccgtccttcgtggtcgccgccgaccacttggcctcggcgaactcgcccttgagcttgtcggccccgaactccttcaggtcctggaacttgtcggcctgctgctgggtgaccgacgcgatccggcccacctcgacgccctgcacgtccgcgagaccgccgccgcccgcgagccgggtctggagcgacttccagtagtccgcctcgtcctgggtgtcgctctgcttgatcgtcacgtccgggttgagcttctggtactcctcgtacagcccggcctccttgaagccgaaggaaccgaagaggtcgacgttgagcgtgacctttccgcccgcgctgtcggaggagtccgacgagtcgccggatccacaggcggcgaggagggccccggcgaggacgaccgcgccgaggcggacggtggctctcttggcggctcgggctatgggcatgggaagcctcccttggcttcgggatgaaccgagcgccttgagagcgctctcaaaacctgcgcttggagcgtcccccaccacctctgccccgtcaagactcgaacgcataacagcttggggttacacccgatgcccatccaactgccgtctgtgtgcgttctcttgacacttacgtttcaggagttttacgttccttggcacttgagagcgctctcgaacgcgctcttcgccccccatgatcgaggtgctgctcgtgcgaacctccctctccagactggcccccggactcgcctccagacccgccgcggcgacgctcctcgccatcgccgtggccgccgtgggcctgggccccgccgcatcgcccgctgccgccgccaccatccccgccggcgccggcagctactccgactcccgtcccgccggtacctcgggcccgaccaccaacaccggtgcgcccgtcacccccaagctcaccaccgccgcgcgggacaagccggtcccgaccaacgactggtggtcctcgctcgcctaccagcgctacggcgacaacccgtacagcacgcccatgtacggccacccgctcacctaccaggccaaggcctccggactggaggtcggctatccgaccacgcccgcgatcgtcggcgacggccgccagtacgagtacgcccacaaggccgacctcaccgtcggcctctccggcctgaactcgcccgacaccaaggccgacgcctggtccgactggacggtgacgccctactgggccgacggctcccgcaccttccgggccaccatcggccacggcatgcccttcgtgtacgccaagggatccggcggcgacgcccgcatcaccaccgcctccacgcccaccgtcttctccgaccagggcaacgtcctcggcatcaccgtcgccgggcaccactacgccctgttcgccccgaccggcagcgactggaacgtctccggcaccgcgatcaccgcgggcctcggcgggaaggactacttctcgctcgccgtgctgccctccacggacgcgctcgcgacgtacaagaagtacgccttcagcttcgtcaccggctcccaggtggcctggcagtccaccggcggcaacgtgcgggcgacctacagcctgacgaccgaggccaaggagggaaccgaacgcggcacgctccaggccctctaccgccaccagtggctgcacaccaccgacgcgctgaccccgtacacgtacgtgtcgccgcgcggcacgatgaaggtgcgcgagtccgcctccttcaccaccagccagaagaacaacggcgtcgtgcccgcgctgcccgcgtccagcggcgtcgacaaggcccggctggccggctatctcaacgaggtcgcgaacgcctccgaccccttctcgggagccgcggacacctactggaccggcaaggcgctcggccgtctcgcccaactggtgcccgtcgccgaccagatcggccagaccgccacccgggacaagctcctcgggctgatgaagggccggctccaggagtggttcacggcgggcggggccggcgagttcagctacgacaaggactggaagaccctcacgggctacccggcctcgtacggcagcgacaccgagctcaacgaccaccacttccactacagctactacgtctacgcggcggcgatcatcgcccagtacgaccaggcctgggccgccgactccgcctggggcacgatgatcaagcacctgatccgtgacaccgccaaccccagccgcaccgactccgcctacccgttcctgcgcggcttcgacgtgtacgcgggccacagctgggcctccggccaccagggcttcgcggcgggcaacaaccaggagtcctcatcggagtccatcaacctcagcgcgggactcgtcctgtggggcgcggccaccggtgacaacaacctccgcgacctcggcagcttcctgctgaccaccgagtcggaggcgatcacccagtactggttcgacgcctcgcagcaggtcttccccgcctccttcggccacgacacggtcggcatggtctggggcagcggcggcgcgtactccacctggtggacggccaacccggaggagatccacggcatcaacgtcctcccggtgaccggtggttcactgcacctggcccgcgagaaggcagccatcaagcggaacatcgccgagatggagcgcgagaacggcggacccgcccaggagtggcgcgacctgctctggcagttcgagtcgctgtcggacccggcggcggcgaaggccaagtgggacggggtgaacgggaactacgagccggagcagggtgagtccaaggcgcacacctaccactggatcaacaccctgaacacggtcggcgcgcccgacatgacggtcagcggcgacctgcccacctccgccgtcttctcgaaggacggcacccgcacctacaccgcccacaaccacggctccaccgcccggacggtcaccttctccgacggcaagaccctctccgtaccggcccgttcgacggcgacgagcacgggtcccggtggcagcaaccccgacccggaggaaccgggtccgtccaccgggaacaccttccgcctcaagtccggcggggtcctcaccaccgccaccaccgacccggcgggcgcggacaccatcgcctcggccgacggcgtcaaccgggacggcaccccgtaccggccgaccgtctacgaggtgaagaaggtcaacggcaaggtcgcctccggcgcggccaccgcgttccgcctccgggtggacgcgggcacgaaggtcgggctcgctccgcaggtccgggtcagctacgacctcaccggcgacggcacgttcgaccgggccgagaccttccgctacttcgcgaccgacccggtcaacgggtgggaggagtacacgcaggggtccggcccgcaggcgaccaccgggagcctgggcgaactcaggaacggcacggtccgcctggaggtctggaacgcgctcggcaacggcacgtcccaggtgcagaccggcacggacgcggccgtcctgaagatcccgtacgtgtaggtcgcgcgtgatcccgtacggatatgtggcgggatccgcacgtgtaggacgtgaccgtacgggaacgattcgtgcggcgggtctccggctcctcagggcggaggcccgccgcgctcccgcgctcccgc

SEQ ID NO: 3654 - DNA, 1796 bp, Unknown
  Kingdom: Bacteria, Phylum: Actinobacteria, Class: Actinobacteria, Order: Streptomycetales, Family: Streptomycetaceae, Genus: Streptomyces
ccggggcgcccacccttttcttctccgctccgcgtgctcagccggcgaggagcttcttcaccgcgccggcgacccggccgccctcggcgagtccggcgaccttcgggttgacgatcttcatgacggcacccatcgcacgcggcccctcggccccggcggccttcgcctcctcgacggcggacgccacgatcgcgttcagctcgtcgtcggagagctgcttgggcaggtagccgtcgagcagctcgccctccgccttctcccgctcggcctgctcggtccggccgccctgggcgaaggcctcggccgcctcacggcgcttcttcgcctccttggcgatcaccttctgcacctcgtcgtcggagagctcgcgcgccgacttgccgctgacctcttccttggtgatcgcggtgagggtgagccgaagggtggacgaggtcagctcgtcacgcgccttcatggccgtgtggaggtcttccttgagcttggacttgagcgtggtcatgccgcgattgtgacaggtgcggggcccgagccgcccgtcggttttccggccgcccggaggtttccggtcgtcccgtgcggtctgcgacgatgggcgcatgcgcgcacgctacggagtacccctgaaagtcacggcagtcggcgcggcggtcggcgccgccggactcgcctacgccgccgggttcgaggcccgctcgttccgcctgcgacgggtcaccgttcccgtactcccgcacggggcacgcccgttgcgtgtgctccaggtctccgacatccacatggtgagcggtcagcgcaagaagcgcgcctggctccagtcgctcgcaggactgcgccccgacttcgtcgtgaacaccggcgacaacctctccgacccggaggccgtgcccgaggtgctcgacgcgctcggcccgctgatggagttccccggggtgtacgtcttcggctccaacgactactacggccccaagctccgcaaccccgcgcgctacctcctggagaaggcccggggcaagcacggcctcaacggcaacgctcccgcggtcggcgtcgtccacaacccgtgggagccgatgcgcgacgccttcgacgaggcgggctggctgaacctgtcgaacacgcggggccggctcaagctcgacggcctggagctggcgttcaccggtctggacgacccgcacatcaagcgggaccgttacgccgaggtccagggcggccctccgagcggcgccgacctctccatcggcgtggtccacgccccgtacctgcgctccctggacgccttcacggccgacggctaccccttgatcctggcgggccacacgcacggcggacagttgtgcatcccgttctacggggcgctggtcaccaactgcgacctggacaccgaccgcgtcaagggcctgtccacccacacggtcggcgaccggcgcgcctacctccacgtctccgcgggctgcggcaccaaccgctacaccccggtccgcttcgcctgcccgcccgaggtcaccctgctgacactgacgccgaaggcctgagcgggcgcacgcggggcgggaccacagcgcgcgacggacgcgggattgtttcgccttcacgcccgccagacagacgcggcggacgcgggacggttcaccttcacgcacggagtgggcgcggcggtcgcggggcggcccacttcacgcacggcgagtgggcgcggggtcgtccacttcacgctcggtgggcggacaaatcgcggagggcttcccacccgcttacggtacgaatcatgaccgcgccacggaccacccgag

SEQ ID NO: 3655 - DNA, 3584 bp, Unknown
  Kingdom: Bacteria, Phylum: Actinobacteria, Class: Actinobacteria, Order: Streptomycetales, Family: Streptomycetaceae, Genus: Streptomyces
cgagcaggtcgacgccgccctccaggccctgttcccggcgcaggtcggtgagcagttcccgggattcggcggcggcctggagggcggcgtcgacctgctcgcggaactggcggcccacgcagaggacttcacccgccgccacccggtcacggccaccttccgccgcctcgccgaggagaccccggtaccgcccgtaccgcaggcggtcgcccggcaactcctcaccgtcgcctccgaggccctggagaacgcccaccgtcacgccggcccctcgtatctgatcgtcctcgcgggggtgcagggcgacatgctccgcatcagcgtgtacgacgacgggcgcggcctgcccgccggaacgacgctcgacaccctgcgccgggccggccacttcggcctcgtcggcatggtcgagcgggcggcctccatcggggcccgcatccggatcggccgggggagcgcggagaagggcaccgaggtgcgggtggagctccccctggcggcgctgacgagcccggccgccggggagaacgacccgtcggcctccccgcccgtccccgcgcggccgttcgcaccgtcgcccacaccaccgtcctcggcgtcgctcgtacccgagaacgtcacgaccccccacccatgaccccgaccctgagaggaggtcgcagcatgccggacgatgtctcccccgcgccgaaccgcaacggggcggcggctcaccaccacgcccccccgtacacgtcgtcgcacatcccgctcgcccaggcccgcggccccgccggacagcccggacaccagcactctgcgatccagccgccggccgcgccgacgccgtcccccgcgttcggaggacccgccgcgtcccccttcccaccggctcccgcggttcccggaccggcccggctccgggtggtggtcgcggacgacaacccggtggtccgggcgggcctgggcgtcctgctctcgggccgcgccgacatccaggtcgtggcagaggcggcggacggccgcgaggcctacgagaagacgctccagcaccgccccgacgtggtcctgctcgacgtccggatgcccggggtggacggcatctcggccctgccgcacctggtcggcatcgctcccgtgctcatgctgacgtacagccgcgagagcgagatcgtccacgaggcgctgcgcctgggcgcgggcggctacctggtgcacggggagttcacggcggaccagttggtccgggcggtgcgcgacacgagggacggccgcgcgaacttcaccgccacggcggccgacgccctgctggcccacatgcgcctggggtcggccccgccccggggccccctgcccgaggggctcggatcggcgctgacgacagcacccgtacccgtgcacccggcgccacgccccctcgaaacttcggaaagtctttcgcaactgcaaccttctgtgggacagtcttctgtgtccgggggatcggtttccacccccaacaggcagcagtacaagctgagttcgcgggaggtggaggtcatggacctgattgcgtccggaatgagtaatcagcagatcgccgccacctgcttcatcagtgagaagacggtcaagaaccacatcaaccgcatcttcacgaagctccacagcgccacccgcagcgaggcgatcgcccactggctcggcaccgcgccccggaaccccggacggcagccatgaccgagcgatcgcgcgacgagagggcccaggaagccttttgggcccgggaatgggcccacgggccctctggggcagcggcggtctccccctatgtttctcacgtcgccaacggcaccggccgggaggaagccggtaccgagggcgacaccgcaggaacgtgcgagtcggccggcaaacggtcggccgaacccggaggggaacaccatgtcgaacatcaccctgaagaccgccgtccgcgtcaacggctgggccaacaccgccgtcagcagcatccagaagcgctacgaggcgaaggaccgcggacagacggcgttcgagtacctgggcatcatcctggtggtcgtggcgatcatcggtgcgatcgcggcgtccgggatcggcgggaacatctccagccgtatcgacggactggtgacctccatcgtctcgggctgatgcgcgagcgccaacacggcgacgcagggcaggccttccccatctacatgatgatggtggcgggcctgctcttccttgcgttggccttcttcgctgtcggcaaggccgcggccttgcgcaatgattcccagggtgccgcggacgccgccgcgctggccgccgcccagcaggcgcgtgacgacttcgggaccgggttctacgcctcgctccccggcaacaccctggacatcttcctgggcgcgcccttcgccccgccctgctacgaggcggaacggctggccaacgccaacgaagccgacatgaccctctgcgtgccgaggtacggctacctccgggacacgatcaaggtcgaggtcaagggccgtgatccggtggactcgccggtgatccccggttcggacgacaagaaggccgaggccgaggccaccgcgctcatcgagttccgctgccccaacccgaaggccatcgacttcaacagcgacggcgtccaggacctcttcatcttcacgtgccggaacggcaagatcatcgagatcgcgcccggcagcccgccaccgtggaagagcgtgagcacgacgctcttcgacgtgcggttggtcgaccagtgacagcgaagcgaacgacgagtagaggaatcggaccatgagcatgcggcggaccacgacgaccagaagggcgatggcggctgtctccatgacggctgccctggccctcgcgctcgccggctgtggcgacgacggaggcgaggagcccggcaccgagggctccggcgcgccgtccgccccggccagcccctccgcggaggacaagggcgagacgcagcaggaggacacggctgcgggtgagaacgtggacccggacgtgaagctcgcggagacgcgcgggcagggtggcctggttctggtcgtcaacgaggtcaagcgggactccggcggcttcctcaccgtccagggtgcgatcaccaacgagggggaccaggcacggaccacctcgggctgggccgggtcggaggtgaacatcgtcaacaagaaccccaactcggtggccggcgcgacgctggtggacaagatggggaagaagcgctattacgtgctccgggacacggactcccgctgtctgtgcaccacggcgatcacgtctctggccccgggcaagacggcgccgatcttcatgcagttccccgccccgccgcagggcacgaccgaggtcgacttcagccttccgaccttcgccaccacctcgctgaagatttctgggtgagtgcggccatgaagaccaccaagcgcccccgggcgacccgcaccatggggcaggccgtcgcggtcgccgtgctgctcgccggcaccacgctgctcggagcctcaccctcgtacgccgacgacggaccgagcgtcccgcccgggacggaggcgacgtcggagccgcccgttcccgtcgacccggccgacccg

SEQ ID NO: 3656 - DNA, 3593 bp, Unknown
  Kingdom: Bacteria, Phylum: Actinobacteria, Class: Actinobacteria, Order: Streptomycetales, Family: Streptomycetaceae, Genus: Streptomyces
ccgcgcggcacgcctgaccgctctcaccgaccgggccggacggctggcggaccgcttcctcccgcgcacgccggccgaacggatcctggacctgaccctcggcaccgccctgctcgtcctgaccgcccccgccgtcgccgtcgcggccctcgccctgtgcgcgcggcgcactccgggcggcgcctgggaccgccggccccggaccggcctgggaggccgggtcttcgagctgcggacgctgcgcacccggaggctccgcctggacctgttctcccgcctgccccacgtcgtgcgcggcgacctctccctggtcggcccggcccccctggcaccgggcgacccacgggccgcgggacccggcgcccggcagtggcggcaggaactgcggccgggactgaccggccttgcacaggtgcgcgcccgctccggcatgccgtgggacgaccccgctctgctggaccagcactacgcagagcaccatggagtggtgctcgacctggcgatcctcgccgaagccgcacgcgatcccctgcgggcgcggctccggaaggcccgtcgaaccaaggcacacctgagcgacgcagatcaccggcaacccggctacagccccgttgaataagtggatagtgtcagcacagactgattaagttactgcttagtagtagcgggcagtgtcaactggaccccgctctcgcaggcccgaggagccccgaaatgcaactcgccgcgatcattgtgtcgctggtgctgacggtcgtcggcgttgcgctcatcacccgagccgtcgcgcagatctaccgcttcgtccgtctgggacagccggtccccgcaggcagccgcaccgacgaccccaagcagcggacgatcaccctggtcaaggagttcgtcggccacacccgcatgaaccgctgggcggtcgtgggcgtcgcccactggttcgtcgcagtcggctttctgaccctgggcctgacgatcgtcacggcgtacggccagctgttcaaggccgactgggtgctcccgtacatcggcaccttcctgccgtacgaggtctacatcgagttcatcgcgctcggcacgaccctcggcatcctggtcctgatcgcgatccgtcagctgaacctgccctcccgggcgggccgcaagtcgcgcttcaccggttcgaagatgggccaggcgtacttcgtcgaggcgatcatcctgatcatcggcgccgcgatcatgctgctccgcggcctcgagggcgcgctgcaccacgtggacagctacggacccgcgtacttcgcctcgtaccccctggtgctggccttcaaggggctgagcgtcgaaacgctgcagaacctggtctacctgttcgcgatgatcaagctcggcacgacgatgatctgggcgatcacggtcgggctgaacaccaacatgggtgtcgcctggcaccgcttcctcggcttcccgaacatctggttcaagcggaactccgacggcgacgtcgcgctcggcgcgctccagccgatgacgtcgggcggcaaggagatcgactgggaggacccggccgaggacgcggtcttcggcgtctcgcaggtcgagcagttctcctggaagggcatcctcgacttctccacctgcaccgagtgcggccggtgccagtcccagtgccccgcctggaacaccggcaagcccctctcccccaagctcctgatcatgtcgctgcgcgaccacgcgcacgccaaggccccctacctcctggcgggtggcggcaaggacatggagggcaacgagaaggccaccgaggagcagctcaaggacgtccccgcggccgccctcgccgaggccgagcgccccctcatcggcaccgccgaggagaacggcgtcatcgacccggacgtcctgtggtcctgcaccacctgcggcgcctgcgtcgagcagtgcccggtcgacatcgagcacatcgaccacatcgtcgacatgcgccgctaccaggtgatgatcgagtcctcgttcccgtccgaggcgggcacgatgctcaagaacctggagaagaagggcaacccctgggggctggccaagaaggcgcgcgtcgagtggaccaaggaggtcgacttcgaggtcccgatcgtcgggaaggacgtcgaggacctcaccgaggtcgactacctgtactgggtcggctgcgcgggcgccctggaggaccgggccaagaagaccacgaaggccttcgcggagctgctgcacatcgcgggcgtcaagttcgcgatcatgggcggcgacgagaagtgcaccggtgactccgcccgccgcctgggcaacgagccgctgttccagcagctcggccaggagaacgtggccatgctgaacatggcgtacggcgaggacgacgacacggcgacgaagaagcccaagtcgtcgaagaagatcgtcgcgacctgcccgcactgcttcaacacgatcgcgaacgagtacccgcagctcggcggcgagtacgaggtcatccaccacacgcagctgctccagcacctcatcgacgagggcaagctgatcccggtgaccccggtcgagggcctgatcacgtaccacgacccgtgctacctgggccgtcacaacaagatctacaccccgccgcgcgagatcatcgcgaaggtcccggggctgcggaacgaggagatgcaccgccacaaggagcgcggcttctgctgcggcgccggcggcgcccggatgtggatggaggagcggatcggcaagcgcgtgaacaacgagcgcgtcgaggaagccctctccctcaacccggacatcgtctccaccgcctgtccgttctgcctcgtcatgctgaccgactcggtcaacggcaagaagaacgacggccaggccaaggagtccatccaggtcgtggacgtctcgcagctcctcctggagtcggtgaagacccctgccgatccggcgggcgagccggagcaggtggacgcaccggagcccgaaccggcaaagtgacctgacgcatcaacgcgatgagcggccggacctgcctcgggggcaggaccggccgcttttccgtgcccggccccgtgcccgggctccccggcccggcagtgacgacggccgcatgtgagccgggacatgtacgcgacggcgtatctggagcatcatgtgccccggagaaacccggtacggatcaggaaccctctcgccggcagacggcagacggcagagctcagcacccgacggacaacgaacgagcgacgaacgaggcccccgtgcgcccacgcatcacgcacccgaaggcagcggtcaccaccagggtgacggccgtcctcgccgcgggctgcgccggcctgctgctcgtgctcaccggctgcggaagcccctcggccgccggcacaccgccctccgccgcatccgggtccggcgacaagaacggcgacaccccgccgaaggcgcagaccctggcgggctcggcacgcgtccccgtaccgcgcggcaccggcagccgtgtcccgtacgacttcaacggcgacggccaccgggacctggtcatcgacgacctggtgaaggcccccgaggacagccacggcgacgacgcggggatcggcatcgtctacggctcc

SEQ ID NO: 3657 - DNA, 719 bp, Unknown
  Kingdom: Bacteria, Phylum: Actinobacteria, Class: Actinobacteria, Order: Streptomycetales, Family: Streptomycetaceae, Genus: Streptomyces
cgtcgtcggcgaactgccgcgcccggtcccgagccgcccagcgcagcgactccgccgagtgcgtgatccgctgcgtgcgttccctgagcttgggcagcaggcccgcgaccgtcgcccggtccggctcgcgctccagccgcttcagctcgtcgtccagttcgaggccgtgctcgctcagcctccggaacagcgccaccgactccgccagggacgcgtcctcggcggctccggcgtgcagggcgtcctgcgtggcccgcatcgaggtgcgcagggcgagccggagctgcgccagctcaccggcgacacccggctgcccgaagctcttggcccggagcgtggtgtcctccacggtgcgccgggcctgcgtgatcgtgcggtccacgccgcgcttggccgcgccgacggccttcacggtcgcgtagacgcccagcgcgacgaacgcgaccaagaacagcgccaggatcgtgatcgcggcttccatgaatgcccctcgatatctcgatgcggccgccgataccggtcgccccctccaccgtaaacggaacgggcaggccgagggttccttcggaacccccaacctgcccgtaggggatggccctcaccacacgcagggaccgtcacacggctgcctcatccggctttccggctgctgtcatccggccccgtcacgcagccccgtcactcagccgtcgtcacgcggggacgatgttcaccagctt

SEQ ID NO: 3658 - DNA, 2879 bp, Unknown
  Kingdom: Bacteria, Phylum: Actinobacteria, Class: Actinobacteria, Order: Streptomycetales, Family: Streptomycetaceae, Genus: Streptomyces
cccggcggccggtcgtgcggccggtggcggcggacgagtcgccggacggtccgccctgcccggcctgcggcacgccgaacctcccggggcggcagttctgccggcggtgcgccgctccgctccgggcccgggaacagccctccgccctgccgtggtggcgcacggtgtggccgttccgccgccgggtgcgcggcggttcgggccgggcgctgcggcggacgctgctggtcctggtcgtggccgggctgctggtcgcgggcttcctgttcttccccctcgggcgctacgtcttcgaggacgtccgggacaagctcggcggcacggcggagatcagccccaccggggtgaccgccagcgcctcggctcccggtcacccggcgagcgcggcgatcgacggcctgacgaacaagtactggggcgctcccgcgctcggcgcgtcgctgacctcctcgttcgggacgccgttccggctggtcggcgtcgtggtgcacaccggtgtgtcgaaggagccgcaggagttccggcggggtgcgcgaccgacccgggcggacctgctcgtcaccacgaaggacaacaaggtgcacaagaaggcggtgaccttcaacgacaagcccggcaagcagacggtgcggacgggcatcagcgatgtcgtctccgtccgactggtgttgcgggaggcgaccggccagggcgaaggccggccgatcgcggtcggcgagatcgagttcttcaagcgcacctgagccggaatccgccactcccccagtcacccgacacacccgtcacagccacgccgacggcctcatgagttcaccaactacccagtaacgatcagggagttcttgacgatcaaacaatttcggtcacaaatggcttccctccgcgcccccacccggggttgactgggcattacccatggtgacgcgcccgcccaccggctcgccgaccctgccccggccgccccggctcccggcggaggaaggaggacagcgatggccctcccacctcgcacgtcgccccgtcgtccggcctgcgggctctcggccgccgcctcccggcgggcccgtccattgcccgatcacccggaatacgtcgttcatatcgtccgcctgtattcatcagacgaggggcagcaatgagccagatcacgttaccggcgtttcacatgccgttccagagtgctggatgccatccaggcctggcggaaacccgcgaggccgcctgggaatgggccgaatccgaaggactggatctgtccgtaccggcccggaagaagatgatccggacccgcccggaactatggatttccctcatcttcccgcaggccacgcaggatcatctcgacctcttctgtcaatggctcttctgggccttcctggtggacgacgagttcgacgacggaccggccggacgcgatccgctgatgtgcgagacggcgatcacccgtctggtggacgtcttcgacggggccgcgccgaacgggccgatggaacgggcgctcgccggactgcgggaccgtacctgccgcgggcggtcgccgcagtggaaccggcagttccggcgggacacggcggcctggctgtggacgtactacgccgaggccgtcgagcgcgccgccggacaggtgccgagcagggccgaattcgccaagcaccggcgtgattcggtcgccatgcagccctttctctgcctgcacgagatcacggcgggaatcgacctcccggattccgcgcggagcctgcccgcgtatatcgccctgcggaacgcggtcaccgatcattccgggctctgcaacgacatctgctccttcgagaaggaagccgctctcgggtacgagcacaacgccgtacggctgattcagcgcgaccggggttgcaccctccaggaagcggtcgacgaggccggtatccaactggcccggattgccgaacgggtgcagcgggcggagagggaactgatcgacgaaatcgaggcggcgggcatcggcggcccgacccgggcggccctggaacgctgcgtccaggactaccggggactcgtacggggcgacttcgactaccacgcgcgcgccgagcgctacacccgcccggatctggtggagctggacgaacgggactcgctgtcccagcacttcgccgcctgaacgacccgcccggcgacggcctcctcctccccggcgcggtccgggaatcgcctcccggaccccgtgccgggaggcgattcccgggccgccgtgaccacccgaacgtttcccgccggaccgggacggggtggggcggggtccggtccggcagcatggaagactggggcccgcaagcatgtcccgggtcgccccaccgaccgggccgacggagacgtcgtgcccccggtcagcgactgaccggccggaatgtcctgccttccagccagcgtcgtccccggggaatcacacgtgagagcacagcgaagaatgtggaccacggccgccgtcaccacggcggccgtggcgggtgtcctggtgttccagggcgtgaccggcacctccgaccccgaccgcgacgggcgggcggcggacgccaagtccgcgccggtgaagtccgatgtgcacaggaccgctctgaagacctcgcccgacggcgactccgcgtcgctcgcgcggcgcgacaccgaaccgttcagcctgctcggcgtcacctggaccgatcccgccgctcgggtgacggggagcgtcgaggcccgtacccggtccgccgcgaccggcgaatggaccggctggctgcccctggacaccgagatcgacgggcgcaccgagaccggccggtccggggtccgcggcaccaccgaaccccgctgggtcggcccctccgacggcgtcgaggtccgcgtcctggccggggacg

SEQ ID NO: 3659 - DNA, 5056 bp, Unknown
  Kingdom: Bacteria, Phylum: Actinobacteria, Class: Actinobacteria, Order: Streptomycetales, Family: Streptomycetaceae, Genus: Streptomyces
gccgaggtcgccaagttcgccgagctgacctgcgcccacatcgacgagctctccgccgcgagcgccgcgggccacgccgacgaactggccgcccggggcagggcccacgagcgccatctggaacatctggcccgcgacctcctctccgccgcgagcccggaggtgctgctggcttcctgtcaacgggccgggtggccgcctccggtttcgctgaccgcggtcctgctgccggccgcccaggcccggcccgtctaccgcgcgctcgacgcgaacaccctggtcctcgatgacctgccggatgccactggtgtgctgctcgtccccgatgccgaccgatcacgcctcttgcggcaactggccgaccgcaccgctgtgatcggcccggcccggccatggacgcgtgcttccgcctcgtacgcacgagccgtacgcgcgcgctccctctcctccgatattcgcgacaccgaggaccacctgcccgagctggtgctgagcgccgacgtggacgcgttcgcagacctgcgtgcccgagccctcgcaccgttgtggaccttgcccgtggcgaccgcacggcggctggaggagacgttgcgtgcgtggctgctgcaccagggcaggcgggaggaggtggcggcggcattgttcgtccatccccagacagtccggtaccggatgtcgcagctgcgggagctgtttccggatctcgcgtcgccacaccgggtccttgaactgactctggcggtcggtctccggggcagctgacgcttatcccgtcccgaccgtcgacgacggcgtccgcgccggcggagacagagggggtgaagtgaagaccggacaaggtcagccggacgaacgaccgggccgaaccggcaccactgcgcgagggatgatgggacggaacgacggaacacgaggtcaggagcttccatggcaaagcgggttcaccgcccccgtgaggatgcggagttcgatttcatcctcgggatgagcagcgttccggtcctcgcatacttcaccgggacctggcccaaggcaatcgagccctgccgggtgatggacctcgtcgtgggtgacatcgccgacgactacacgggccgcctgacgatcgtccgcaccgacatcacgcggtgtccggcggcaaccgagcgatacggggtcaccggagccccgtcctgcctcttgctgaaggcgggagaggcggtggcgcacggcacggggcccatgaccatcgccgaggtacggacgttcctggacgaccacctctgagcggccgctgcggcacccggtcgcgacgcccgtcacggtctcggccatgggagctgcgctgcgccgcctgagaccccctacaggccacataaccccgttcggcgcggtcgcgtccggcagttgcgcggcaccagcgcacgtcggggaaggaccaggatgggcgtccacgccgacccagcaccgtgaatcggccgggtgagggctgatggcgtcaacgccgggcgtggcgggggaagggtcggtcggtcgacctgatggtggccggcggcccggatctgctgaacgagcgcgtcggaaacccgagctccggccgggccctgtcgatgcctgtcagccggcttttcccgacgaggctcggaccacgtcaggggccggggtggtgctcgcgacgtcggtgaccgcggccttcaccggtaccccgattccgagcttctccaggatcttcttctcgatctcgttggcgaggtcggggttgtccttgaggaagttgcgggcgttctccttgccctggccgagctgatcgccctcgtacgtgtaccaggcgccggccttgcggacgaagccgtggtccacacccatgtcgatcaggccgccctcgcggctgatgccctggccgtagaggatgtcgaactccgcctgcttgaacggcggggcgaccttgttcttgacgaccttgacgcgggtgcggttaccgacggcgtcggtgccgtccttgagcgtctcgatccggcggatgtcgaggcgcaccgaggcgtagaacttcagcgcccggccaccggtggtggtctccggggagccgaacatcacgccgatcttctcgcgcagctggttgatgaagatcgccgtcgtcctcgtctggttgagcgcactggtgatcttgcggagtgcctggctcatcagacgggcctggagacccatgtgggagtcacccatctcgccctcgatctccgcacggggcaccagggccgccacggagtcgatgacgatcaggtcgatcgcgccggatcggatcaggatgtcgacgatctccagcgcctgctcaccgttgtccggctgggacaggatgaggttgtcgatgtcgacgccgagcttcttcgcgtactccgggtccagcgcgtgctcggcgtcgatgaacgccaccgagccgccgagcttctgcgcgttcgccaccgcgtgcagcgtcagcgtcgtcttaccggaggactccggcccgtacacctccaccacacggccgcgcggcagaccaccgacacccagcgccacgtccagcgcggtcgaccccgtgggaatcacctcgatgggctcattcggccgctcgcccaggcgcatcaccgcacccttgccgaactgccgttcaatctgtgcgagtgcggcgtccagcgccttctcgcggtcgttacctgccatgggttccacccgatttgcttgagtcgatcgcttcacgtctcagacgctaacccctgccactgacaatgggcctcgacgtcctccctgcctgtggacaactccacggccgggcccgggaaaacccggccagaacttcatcagaatggatgttcgattttcgtgtcaagcgcaccacgcggccccgcagccacccctgaccgaacgcgaccgagcctgcacccctgagcgtatcgccctatattcgatcgttatgggagcgattgcggagcccggagcatccgacggagggcaggcccccgggtccgatctggccggccgcgtggccctcgtcgccggaggaacccgtggggccgggagaggcatcgccgtccagctgggcgccgccggggcgatcgtgtacgtgaccggccgcacgagcggttccgagcgctccgagatggaccgtcccgaaacgatcgaggagaccgcggcgctggtcgacgcggcgggcggacggggcatcgccgtccaggtcgaccacctggtccccgaccgggtcagggcgctcgtggcccgcatcgcgtgcgagcagggcgccctgcacatcctggtgaacgacatctggggcgccgagatcgagtgggacaagccggtgtgggagtcgtcgctcgacaccgggctgcacaccctgcggctggccgtcgacacccacgccatcaccagtcacttcgcgctgccgctgctgatcgagacaccgggcgggttggtcgtcgagatgaccgacggtacggacgagtacaacgcgtcccactaccgcgtctcgttcttctacgacctggccaaggccgcggtgaaccggatggccttcgccctcggccatgaactcgcaccgcaccacgcgacggccgtggcactcacaccgggctggctccggtccgaggccatgctccaggcccacggagtgaccgaggccacctggcgggacgccgtcgcacacgcgccccacttcgccatctccgagtcccccgcgtacgtcggccgcgctgtgtccgccctcgccggcgaccccgaggtggcccgctggaacggcagggcactctccagcgggcagctcgcccaggtgtacggcttcaccgatgtggacgggagccggcccgacgcctggcgctatctgaccgaggtacaggacccgggcctgccggccgacgtgacgggctaccgctgaggcggcccgtccggtgtgctccccggtcccccgcgtccgacggcccgggggccgttcaccagacggcgcatccgtgacgacaacggcctcccgggcgctcggctgctccccccgtgcacgcgtgggtcatcggtgacgtcgtaccgcttcacataggcgccgaggaacgcctggagcgtggcgatggcgggaatcgcgaccagcgcgccgaccgcgccgagcagggccgtgccggcgatgaccgacccgaaggcgaccgcggggtggatgtcgacggtcttcgcggtcagcttgggctggagcacgtagttctcgaactgttggtagatcacgacgaacccgagcacccacaacgcgtaccaggggtcgaccgtgaaggcgatcagcatgggcagcgcgcccgcgagatacgtgccgatggtggggatgaactgggagacgagtccgacccagacggccagtgccggggcgtagggcaccccgagaatcaccagcaggacgtagtgcgcgacaccggagatcaacgccatcagaccgcgcgagtagatgtatccgccggtcttgtcgaccgcgatctcccaggcccgcagcacctcggtctgccgggccggcggcaggacggagcacagggcgcggcggagccgggggccgtcggccgcgaagtagaaggagaacaggaagatcgtcaacagccggaacagcccgccgaggaccgttgtggagacgtcgagcacgccggtggcgctgttctggacgtacttctgcagccagtcggagtgcagcaggctgtcctggacctcgacccgggagagttcggtgcggaaggtctggttgacccagttgatcaccgagtcgatgtacttggggaactcgtcgaccatgtcgacgatctggcccgcgagcatcgaccccaacagcaccacgaatccgacgccgaagatcatcaggccgaggaagacgaggaacgtggccagcccgcggcgcatgccgcgatccgccatccggccgaccgcgggctcgatggcgagcgcgaggaagaacgcgatcagcacgttcgtcagcagcccgatgagctggtcgaacgcccaactgccgagctggaagcaggcgtagagcgccagggccagcgccatcgcgcgcggcagccagccgggcatgcggaccccaccggcgccggag

SEQ ID NO: 3660 - DNA, 1563 bp, Unknown
  Kingdom: Bacteria, Phylum: Actinobacteria, Class: Actinobacteria, Order: Streptomycetales, Family: Streptomycetaceae, Genus: Streptomyces
ggagcgcggcaccgccccggcaacaccggaggacgacgcgctgtcactgcccgcaagtagggtgtgagacatggcagacccctccagctaccgccccaagccgggacagatccccgactccccgggggtctacaaattccgcgacgagcaccgccgggtgatctacgtcgggaaggccaagaacctgcgccaacgcgtggccaactacttccaggacctcgccggcctccatccgcgtacgcgcacgatggtcaccaccgccgcctccgtcgagtggacggtcgtctccaccgaggtcgaggcactccagctggagtattcctggatcaaggagttcgacccccggttcaacgtcaagtaccgggacgacaagagctatccgtatctcgcggtcacgctcaacgaggagttcccccgcgtccaggtcatgcgcggagccaagaagaagggcgtgcgctacttcggtccgtacggccacgcctgggcgatccgcgagacggtcgacctgatgctccgcgtcttccccgtccgcacctgctccgccggcgtcttcaagaacgccgcgcgcaccggccgcccctgcctgctggggtacatcggcaagtgctcggccccctgcgtcggccgggtcacccccgaggaacaccgggagctggccgaggacttctgcgacttcatggccggccgcaccggcacctacatccgccgcctggagaaggacatgatgcaggcggccgaggagatggagtacgagcgggcggcccgcctccgcgacgacgccgaggccctcaagcgggccatggagaagagcgccgtcgtcctcgccgacgccaccgacgccgacctgatcgcggtcgccgaggacgagctggaggccgccctccagatcttccacgtgcgcggcggccgggtgcgcggccagcgtggctgggtcaccgacaaggtcgaggcggtcgacacctccggcctcgtcgagcacgccctccagcagttgtacggggaggagcgcggcgacgccgtccccaaggaggtcctggtccccgcgctgcccgaggacaccgaagcggtctcccagtggctcgccgagcgccgcggctcccaggtcagcctgcgcattccacagcgcggcgacaagaaggacctcatggtcaccgtgcagcgcaacgcccagcaggcgctcgggctgcacaagaccaagcgcgcctccgacctgaccacccgctcccgcgccctggaggagatcgccgaggcgctgggcctggacaccgccccgctgcgcatcgagtgctacgacatctcccacctccagggcgacgacgtggtggcctccatggtcgtcttcgaggacggcctcgcccgcaagagcgaataccgccgcttccagatcaagggcttcgagggccaggacgacgtccgatcgatgcacgaggtgatcggccgccgcttcaagcgctacctccaggacaaggagcgcacgggggagtgggaggagacgccggagaccgcctccgacaccaccggccctgccctcaccgccaccggacctgctccggtccccgccgc

SEQ ID NO: 3661 - DNA, 4277 bp, Unknown
  Kingdom: Bacteria, Phylum: Actinobacteria, Class: Actinobacteria, Order: Streptomycetales, Family: Streptomycetaceae, Genus: Streptomyces
actgtgcgtaccgccgccgcgccatgcgtcccacgaccagccggcggccggcctcgacgcctgcggcggcggtacgcacagttggaccgggagtgggccgaggcgggcccggactggggcagggccggaacgggcggctgaccacggtctcccccggccggaggcggcggcgggcgacgtcgctcggcggggccgatcgtcaactcccgcccctcacgcgcgctacggtggtccgaccccgtccgcctccccggcgacggacggacccgaggcatcgcacagcacgaggtgggggcacagcaacgccatggcacagggcacggtccaggtgacgcacaccggcacatcgcgatggcgccgccgcacgggcgagtacgcctccctctccgcggccctggaggcggcagccgacggcgacgtcctcaccgtcgcgcccgggacctaccgggagaatctcgtcgtccaccgcgcggtgacgctgcgcggccccgagggttcggtcggttccgtgcggatcgccccggtcgacggcgtaccgctgaccgtgcgcgcctccgcggtcatccaggacctccatgtcgagggtcaggactcggcggcaccggccctgctggtcgaggacggcacggcggagctgacggatctgcggatcgtgacgcggtccgccgcgggcatcgaggtgcgcggcgcggcgcggcccaccgtgcggcgctgcacggtcgacaatcctgccggggtcggcatcgccgtgctggacggtgcgggcggcgtgttcgaggagtgcgaggtcgtctcggccggccagtccggggtctcggtccgcgacggcggacaccctcgactggaccgctgccggatccaccacgcgtccggggcgggcatcggcgtcaccggcgagggcagcggtctggaggcgttcggctgcgaggtgtacgagatcaagggcagtggcattcaggtcaccgcccgcggctcggcccacctgaccgactgcaccgtgcaccgcacctcggcggacggtgtcacgctggacaccgacgcggtgctcaccctcgccgactgcgacatccacgacatcccggagaacgccgtcgacctgcggtcgcgttcggtgctcacgctgacccgctccacggttcgccgtttcggccgcaacgggctctcggtctgggatccggggacccgggtcgacgccaaccagtgcgagatccacgacagtacgggcgactatccggcggtctgggtcagcgacggcgcgacggtgatactggacgcctgccgggtccacgacgtgcccgacgcgctgttcgtcctcgaccggggatcgcgcgccgacgtcgtggacagcgacctctcccagatccgcaacaccgccgtctccgtgagcgacggggcgaccgcccagctggacgactgccggatccgggaggcgtccacgggcgcctggttccgcgaccacggcagcggcggcacgctgaacaactgcaccatcgacgcggcgcagaccggggtcatcgtcaccaagggcgcggaccccaccatcgagcgctgcacggtcacctctccggccgaggcggggttctacgtctcggccgagggccggggcaccttcgacaactgccgggtgacgggcagcgagggctacggcttccacatcatggacggctgccgcaccaccctcacccgctgccgtaccgagcggtgcgcccggggcggttacgaattccccgagggcgacaacggcgccgcgaccgggccggtggccaaggactgcacgagcgacgagagcggtctgcgtacggcgtcggccccgtcgcccgcggtgctgacggagacccggtcgacgcccggtctgctgggcgcgctgcccgggcagcggccggtcgagcccgctccggagccggtcgccccggcggagccggcccgggactcctcggcggtcctgggcgaactggacgcgctggtgggtctggacagcgtcaagcgcgaggtgcgcgcgctcaccgacatgatcgaggtgggccgccgccgtcaggaggccgggctcaaggccgcatccgtccgccggcacctcgtcttcaccggctcccccggcacgggcaagaccacggtcgcccggctgtacggggagatcctggcctcgctcggggtgctggagcgcggtcatctggtcgaggtgtcccgggtggacctggtcggggagcacatcggctcgacggcgatccggacccaggaggcgttcgaccgggcgcgcggcggggtgctgttcgtcgacgaggcgtacgccctctcccccgaggactccggccgggacttcgggcgggaggccatcgacacactggtgaagctgatggaggaccaccgggacgcggtggtcgtgatcgtcgcgggctacacccgcgagatggagcggttcctcaccgtcaaccccggggtggcctcgcggttctcccggaccatcaccttcagcgactatctccccgaggagctgctgcggatcgtcgagcagcaggccgaggagcatgagtacagcctggcggagggcaccggggaggtgctcctgaagtacttcacggcgctccccaagggccccgccttcggcaacggccgcaccgcccgccagaccttcgagtcgatggtggagcggcacgcgggccgggtcgcccagctcgccgagacgagcacggacgacctgaccctgctctacccggaggacctccccgagctgcccctctgaacgtctccctccggctcctgccgaccgcctccggcctgcctcggcaccagcggccccagttcgtcgaggagggcggcccgctcctcggcgaaggccgggtcggcctggtagtcggagtgcccgaggatcggttcgggcagcgggagcttcgtggtccgcccgtaggccagcgggtccttcaaggggccccggtcgacccccgggtcggggtcggcgcagatgcggacggggccgccgatcgggtcggtggcccgccacagattgcgccagcagtgcaccgagcggtgcagcccgagcagcggctcggggccgaagtaggcagggaaccaccggccgtacagccgctccaggggggagccgtaggtgagcagcgcgacccggcggcgggtcacgtcgggcagttgccagacggcggacgcggcgagcacgctgccctgcgagtggcccgagatgacgagccggccgcggggtgtggtcgccgtccaggcggacatccgggaggcgaggtcggggacggcgcgctcggcgtagcacgggggtgcgaaggggtgggcggcgcgcggccagaaggtgcctacgtcccagaggatgccgatggtgcggcgggccgaggcgtccttgtacgcgcggcggccgccggcgacgaacaggacgaagccgaagccgatcagccaggagccggtcgactgcgcggcctcggcgaacgattcgacgagcggccagctcccgtcggcggcccggcccggcacctcgtcactgcgccaggagccggcgatcgcgcccgccccgagcagcagggtggccccggagaccacgccgacgatccagggcgccgagtcggtgagggcggcggtcgcgcggatccgggcgatgcggcgggtacggccctcgtcgggcggttcgggggcgtactcctcctcgatgaccgggcccaggcggcgggcggtgcgtgtggtgcggacgatcagcaccaggaccgggacgagcaggagcagcaggagcaccgggatgacggaggcctgccagctgagcaggaccggcggcccggcgatgtcggtgccgtggcccatgcccgggctgccgggtccgtcgagccagtcggcgacgcgctgggccaccccgccggtcatcacaccgccgagggcgcaggcgagcatcgcgaccgcggggccgccgagtccgtacaggatggtgcgcggctcgggggtgctccggtagaggccccgggcgaccagggcgagggcgacgacgaggattccctggccgagggcgaggaggcggaaggcggtctcgccgggcaggctgcccgaggagagccagtccgggcgcgaccaggaggcgtgcacgacggcgagggcgagcagggcgagcgcggaaccgggcagataggtgatgagcgcggcgtccagccgggtgtcgcgggtccgttcgctgcggccccggcggcacacgacccagatgacgacgagcgtgcacagggcgatgccgccctcgacggccgcgccgaggaactggggcaccgggccgtcgagggcggcat

SEQ ID NO: 3662 - DNA, 3879 bp, Unknown
  Kingdom: Bacteria, Phylum: Actinobacteria, Class: Actinobacteria, Order: Streptomycetales, Family: Streptomycetaceae, Genus: Streptomyces
ccgtcctcaccgcggcgccctcggccgcgggcgccgcggtgaggacggggtggaaggagccgcgggcgacggcccgctccaggtcggcgatcagcgtcgcgacgtcgatgtcctcgccgtcgagatagcggtccatcagggactcgtcctcgctctcggcgatgatcccctcgatcagccggtcccgggccgcccgcaggggctcctcctggtcgggcgcgggcggccgctcggcgcgttcccccgaggagtagtcgaggatccgccgactcagcagtccggtgagcccggtcagcggggcgtgtccgtcggcgccctcggggcccagcacgggcaggtacagcggcaggacggcgtcggggtcctcgcccccgaaggcctcggcgcagatccggatcatgtcgtcgaaggaggtgcgggcggtgtccaggtgcgtgacgacgatcgcgcggggcgtgccggccagcgcgcactcctcccaggcggcccgggtggtcgcggccacggacgccgcgtcctgggccgccgagacgacgaagagggccgcgtccgccgcgcgcagaccggcccgcagctccccgacgaagtccgcgtagccgggggtgtccagcagattgatcttgcagccgtcccaggccaccgggaccagcgagagctgtacggaacggcctcggcgctgctcgatctcgtcgtagtcggagacggtcgccccgtcctcgacccgtccggcccggttcacggctcccgccgtcagggccagggcctcgacgagggtggtcttgcccgatccgctggggccgaccagcaccacgttccgtacggcggaggggtggccggccgccggtactcctccggcggctccggggtgtgcgtgtgccttgtcgcccatgatgcgtgcctcccggtcgatggcgcggtgcgggggagggcgaccgcgcgcggagcagcggtggtcacgggcacggggaggccgccgcggcggcttcggcgacgcccgcggtccttcgagcttggcaccgcgacggggcctcgtccatacgtcgcgcgcggcacggtccgtacgccgcgctccggctcggcccccgcgccgcgcacgggcgcggtccggtccgggcggggagagcgcgtgacacccggcggcgggtgcccgtccggtggaaggcaccggcggtgactacgatgggccagccggtggccgaaggggccgctcggcgaaccgaaccctcgggaaggccatgctgaacaagtacgcgcgtgcattcttcacgcgtgtcctcacaccgttcgccgctctgctgctccgtctcggggtcagccccgacgcggtcactctcgtcggcacggccggagtgatggcaggtgcgctggtctttttccccatgggggagttcttctggggcacgatcgtcatcacgatcttcgtcttctccgacctcgtcgacggcaacatggcgcggcaggccgggatctccagccggtggggcgcgttcctcgactcgaccctggaccgggtcgccgacggggcgatcttcgccggattcgctctctggtacgcgggcagcggcgacgacaacatcctgtgcgccgtcgcgatcttctgcctggccagcggccaggtggtctcgtacaccaaggcgcgcggcgagtcgatcggcctgccggtcgcggtcaacggcctcgtggagcgcgccgagcggctggtgatctcgctggtcgccgcgggcctcgccggactgcacacgttcggcgtccccggtatcgacatcctgctgccgatcgcgctgtggatcgtcgccgcgggcagcctcgtgacgctgatccagcgtgtggtgaccgtacgccgtgaatccgccgaggcggacgccgcggaggccgccgtgggacgggccgccgctgacccgtccgccgccgctcgggggagcgagggcgaccggtgagcgccggcacgtccgacctgaagggccggctcaccgacgggctgtacggactgggctggggcgccgtcaagagactgcccgagcccgccgccgcccgactcttccgcaccatcgccgaccaggtgtggaagcggcgcggcaagagcgtgctgcgcctggagtcgaacctggcccgggtcgtccccgacgcctccccggagcgactggcggagctgtcgcgggccggtatgcgctcctacatgcgctactggatggagtcgttccggctgccgacctggagccccgagcgcatcaaggccggcatagacgtcgccgacgtccaccacctgaccgagggcctggacgccgggaacggcgtgatcgtcgccctgccgcacctggccaactgggacctcgcgggagcctgggtcaccaccgacctgaaggtccccttcaccaccgtcgccgaacgcctggagcccgcgacgctctacgaccggttcgtcgcctaccgcgagggcctgggaatggaggtcctgccgcacagcggtggggccgccttcggaaccctggcccgccgactgcgcgcgggcggcctgatctgcctggtcgcggaccgggacctgtccgcgtccggcgtcgaggtgtcgttcttcggcgccaccgcccggatgccggcgggtccggcgctcctcgcccagcagaccggcgcgctgctgatgccggtgacgctctggtacgacggcacgcaggtgatgcgcgggcgcatccatccggcgatcgagatgccgcaggaaggcacccgcgccgagaggacctccgccatgacccaggccctggccgacgccttcgccgacggcatcgccgagcacccggaggactggcacatgctccagcggctctggctggacgacctggacccccggggggaacccacgtgaagatcggcatcgtctgcccgtactcctgggacgtaccgggcggtgtgcagttccacatccgggacctggccgagcacttgatccggctcggccacgaggtctcggtcctggcacccgccgacgacgagacgccgctgcctcgttacgtcgtctcggcgggccgggccgtccccgttccgtacaacggctccgtcgcccggctgaacttcggcttcctgtcggcggcccgggtacggcgctggctccacgacggcacgttcgacgtcatccacatccacgagccgacctccccgtcgctgggcctgctggcctgctgggcggcgcaggggccgatcgtggccaccttccacacctccaacccgcgctcccgggcgatgatcgccgcgtacccgatcctccagcccgcgctggagaagatcagcgcccggatcgccgtcagcgagtacgcccggcgcaccctggtcgagcacctcggcggggacgccgtcgtcatccccaacggcgtcgacgtcggcttcttcgccaaggccgagccgaaggccgaatggcagggccagaccctcggcttcatcggccgcatcgacgaaccccgcaagggcctccccgtcctgatgaaggcgctgcccgcgatcctcgccgcccggcccggggcccggctgctggtcgccgggcgcggcgacgaggaggaggcggtggagaccctgccgaaggaactgcgcgagcgcgtcgagttcctcggcatggtcagcgacgaggacaaggcccggctgctgcgcagcgtcgatgtgtacgtggccccgaacaccggcggggagagcttcggcatcatcctggtcgaggcgctgtcggccggtgcgccggtgctggcgagcgacctggacgccttcgcgcaggtactggaccagggcgcggcggcgacctgttcgccaacgaggacgccgccgcgccctggtccagtacccgcccgaaggcggccaggccgctcgccagccccggcgcaccggccgacagcgcctcgacca

SEQ ID NO: 3663 - DNA, 3080 bp, Unknown
  Kingdom: Bacteria, Phylum: Actinobacteria, Class: Actinobacteria, Order: Streptomycetales, Family: Streptomycetaceae, Genus: Streptomyces
cgcggtgcgcaccgcgaccatgtcggtggcctcgctgaccacctcgaaggtctcgccgaggtcgttgacctcctcggcgcccgcgtcgaggaccgcaccgaggacgtcgtcctcggccagctcacccttgggcacgatcacgacgcccttgcggttgaacaggtacgagacggagcccgggtcggccatggagccgccgttccgggtcatcgcgacacgtacgtcggacgcggcacggttgcggttgtcggtgaggcactcgatgagcaccgcgacaccgttggggccgtaaccttcgtacatgatcgtctcgtagtcggcgccgcccgcttcgagaccgccaccgcgcttgaccgcggagtcgatgttcttgttcgggacggagctcttcttcgccttctggatggcgtcgacgagcgtggggttgccgtcggggtccacgccgccggagcgcgccgcgacctcgatgttcttgatcagcttcgcgaagagcttgccgcgcttggcgtcaatcacggccttcttgtgcttcgtcgtagcccatttagagtggccggacatctgccttctccttcgcgtcaccaaaatcgagtcgaacccgagagatcctaccggggtccgctcagttcaccgcgcgcaccatgtccacgaacagagcgtgtacgcgatggtcgccggtcagttcgggatggaacgaggtggcgagggcgtttttctgccggacggccacgatatgaccgccgtgttcggcgatgacctcggtctcggccccgacggactcgacccacggcgcgcggatgaacacgccgtccaccgggccgccttcgacgccgccgacctcgaccgcggcctcgaacgactcgttctgccggccgaaggcgttgcgccgcacgatcatgtcgatgccgccgacggtctcctggcccgagcgcgggtcgaggatcttctcggccagcaggatcattccggcacaggtgccgtagaccggcatcccggccccgacccgctcgcggagcgggtccatcatgccgaagagcacggccagtttggacatggtggtggactcgccgcccggtatgaccaggccgtcgacctcggcgagttcctcgggacgccggaccggcctggccagggcgtccgccgaggccagggcgatcaggtgctcccgtacgtcgccctggagagccagaacgccgatcaggggggtgtcgctcatcagtggttaccagccgcggttggcgtagcgctcggactcgggcagggtgtcgcagttgatgccgaccatggcctcgcccaggttgcgggaggcgtccgcgatgaccttcgggtcgtcgtagaaggtggtggccttcacgatggcggcggcgcgcttggccgggtcgccggacttgaagatgccggagccgacgaagacgccctcggcgccgagctgacgcatcagcgcggcgtcggccggggtggcgacgccacccgcggagaacagcacgacgggcagcttgccgagctccgcgacctccttgaccagctcgtagggggcgcggaggtccttggcggcggcgtacagctcgttgttgtcgaagccgcgcagccgggcgatctcgttcttgatctgacgcaggtgacggaccgcctcgacgacgttgccggtgccggcctcacccttcgagcggatcatggccgcgccctcggcgatgcggcgcagggcctcgcccaggttggtggcgccgcagacgaagggggtggtgaaggcgaacttgtcgctgtggttgacctcgtcggccggggtgaggacctcggactcgtcgatgtagtcgacaccgagggactggagcacctgggcctcgacgaagtggccgatgcgggacttggccatgacggggatggagacggccccgatgatctcctcgatcatgttggggtcggacatccgggccacgccgccgtccttgcggatgtcggccgggacccgctccagggccatgacggccacggcccccgcgtcctcggcgatcttcgcctgttcggcgtcgacgacgtccatgatcacgccgcccttgagctgttcggccatgccgcgcttgacgcgggcggtgccggtggcggggtactcggcggactgcggggtgctgggaagcgtggacacgggacctcactcggtgaaagacgctggatactgcaacgccgagcaaacgccccgggaccagtccacagcaagggccaatggacaggccgtggatcgttttggacctgaatcgttctccggctcaggtgccgggacggtccgcgagggccaccggcggagcgtcgtccatctcgaaggcgagcgggaacggcgcgtgcccggccagtcggaagagccggacggtacggtgccggcgcagcgcgcgggcggcgcgcacggagtcgttgtggaaacgccgggccatggggacgcggcgtacggcggcggccagttcgccggccgcgtcctcgccgccagggatctccttcaccgcgtcgacctgggccggttcgccgaagacggcgcgcagggcggtgctcagttcgctctcggcgacctcgcggtggtcctcctcggcctgccgggcggcgtgcgcggcctcgtacaggacgatcgaggcggccgggtccaggacgccggaggtggccagctcctgggtgaccgaggcgcggcgcagcagttgggcgtcgagggcggcgcgggcggcgtcgatccgggagtgcaggcggtcgagccggccggcggtccagctgaggtacacgccgaccgcgatgagggcgacgacgatccagacgatgagggttacggtcacgggcccacacgctaccgtcgccgagggccccggcccgcacccgtgtcaggtgcgggccccggggctcagtcccgtgcgagtccgaaccgggcccgcagcccggagcgttcgtccgccgcgaccgacgcggccccgtcggtcacggtctcgtacaccgcgaggatgtcggcccccaccgtcgcccagtcgaagcgccgtacgtgggcctcgccgcgttcgcgcagtccggcgcggcgctccgggtcgcccagcagccggatcgcggcg

SEQ ID NO: 3664 - DNA, 1069 bp, Unknown
  Kingdom: Bacteria, Phylum: Actinobacteria, Class: Actinobacteria, Order: Streptomycetales, Family: Streptomycetaceae, Genus: Streptomyces
  misc_feature (389)..(390): n is a, c, g, or t
aggacaagcagcccgggggagccgccggagcgtacgcccccgtcggcaccgccgccccggcgccggccgcggccaagggacagctaggcaaggacggcaaggcgctgaccctgcgcttcgtgctcccctccgggcccggctcccagtcgctgcgcagcgtcggcgacaagatcgcggtgatgctggagaagatcggcatcggcacggagatcaccaaggtccccgacgagagctacttcaaggaccacgtcgcctccggcgcgtacgacctggcgctctactcgtggcccgccaccgcctacccggccaccgacggacgcccgatctacgccaagccggaacccgccaccgacgggtcgctcctcgtggagcagaactacacccgggtnnccgcagctggtcgcggtcgacaagaagctcgcgaacgtcggggcgttcggtttcgcggccccccggtaccaggacatcgggttcaagaaccggcaagcggcaggttcccccgcagaccgcaagaagtagcggccaaataccacaccctcgcgccgccaagctcagatgcacctcaaaacccttgcccgccggttccaccggcgggcagtgtggtgtctgcccttgacccgggccgttccatcgcttcaccgctcctcaccccccacagctccgcccgtattccggccatccgaatggcccggcagcaccttgacagcggctgaatatcgcctgaatcacacgggaagaccgcgtccgcggatcggtccgggaagcccggtgggccccgggcccgtacgatgggacgagccgtggcgtgccgcccggcgggcgtacgaggactcgaagaccgactgagacgcctgatcccacgatccgagagaagcgcaagccacccatgcccacgcgccacgacatccgtaacgtagccatcgtcgcccacgtcgaccacggcaagaccacgctggtcgacgccatgctcaagcaggccggagcgttcgccgcccacgccgccgagcacctcgacgaccgcatgatggactcgaacgacctggagcgtgagaagggcatcacgatcctc

SEQ ID NO: 3665 - DNA, 1361 bp, Unknown
  Kingdom: Bacteria, Phylum: Actinobacteria, Class: Actinobacteria, Order: Streptomycetales, Family: Streptomycetaceae, Genus: Streptomyces
ccggagcgcaccaccacccggcaccggctggagggccaccgggaggcgctgcgcgcggccggcctggaccccgccccgggcgagggcgacgggggccgcggctccgacgatcaggaccggctcaccgtgcacgggccctacgaccggcgctccggctacgaggccaccctcgaactcctgcgcagagcaccggacgtgaccgcgatcgtggccgccaacgacaccgtggcgctgggcgcgtgcgcggccgtacgggaccaggggatgcggatcccccaggacatctcggtcgcgggcttcgacgacctgccgttctcggtggacgcggtgccggccctcacgacggtgcggctgccgctcttcgaggcgggcgcccgggccggacggctcgcgatgggcaaggagaacccgccacccggcgggatcgcgaccatcgcggccgagctgatgatccgggggtccacggcggcgccgcgcgggtgagcccggccggggatgcttccgggcccgtcgacccgaacgataggccctagcccagcagtccgagcaaccgtcccagcgcgtccgcgacgggctgggccaccgggccgaccgcggtggtgagttgcccgagccgcgccagggtgaggccgcgctcggtcatggcctcgcggtccagggcgagcacgggcagggtctcctcgaccgtgcgggcctggtccggggtgagatgagcggtgaggctgcggagctgggtcttcaactgctcaacggctttgcggagttcagggtcctgtacggcgcccacgtagccgttgttgatgccgatgttctgggcgccggtctggttgaagacggggccgttgtaggtcgagtggtgcgtcggttcggtcatagcctgatccccgtgttctgaccgccgttctggttgaagacggggccgttgtagttgttcagctggtgcacgtaggccgtgaactcggcctccgggtggtcgatcgcgtggactatccgcccggcgatggtccgcagctcgtccacgctcggcagcgtcacgagcactcgggagccgccggccgtctccacgaccaggaccggcttctccggtgcgaccagcgccttgacgaaatagacgaccagaacgatcagcaggacgaaaaccggtagccagtcggtcaccgagtagacgaaggccaccaacgccaggcccagcaggaagcggaggacgttccgttccggcttgatcttgatggcctcgacccgggtgaggttgtgcagcggcagggccgccgctaccgccgctgccgcctccgggaggcgtcctggagatctcggtcaagcgccggatgctctggatcggctcggcggccctgccgctgcac

SEQ ID NO: 3666 - DNA, 1674 bp, Unknown
  Kingdom: Bacteria, Phylum: Actinobacteria, Class: Actinobacteria, Order: Streptomycetales, Family: Streptomycetaceae, Genus: Streptomyces
ggccactccgccctgcccggaccgctctgccacggggtcatcgccaaggacgggtccgtccacctcgtggggaacggccgggccaaccatgccgggctcggcgacgacgacgtcctgcgcgccgtcgtcgcggagaaggcgctgcccccggacaacgaggccaacaccgacggcaaccggcacttctacggcttcgagtgcgtcaacctcggtgacggcaaggacccctggccggcggcccagttgctggcgatcgagcgggccgccgccgccgtctgccgggcgcacggctggtcgcagcggtcggtgatcgggcacctggagtggcagccgggcaaggtcgatccgcgcgggttcaccatgaacgcgatgcgcgcgcggatcggcaagcggctcggcggatccccggacgggccagccgatccgccgccgaagccgacgtacgagccgttcccgggggccgcgttcttcaaggtcggccgcaacagcgcggtcatcacggcgatgggcaagcggctggtgtccgagggctgcggccggtacacggtgggtcccggacccgcctggtccgaggccgaccggaagtcgtacgccgcctggcagcgcaagctgggctacacgggcgacgacgcggacggcattcccggcaagagcagttgggaccggctcaaggtgcccaacgtgtgaccgccgcgcctccggctcctccccttctttgcctgaggtgaggagccggacgatcggcggacggttgaccggagccgcccggtcgcgcgggtcagcagctggagcggcaccggtcagcggttgaagccactgcccagttccgcctgcgcggccaccgtgccgagcgtcccgtggccgaagctgaacgagcccttggccacgaggccggtgccagtggcggtggccgggaacacccacagggagccctcgtccgcgttctctccgggtgctcccacggccagttcggtgcggccgtcgccgttgaggtcgcgcagggatgccgcgccgccgaagcggtcgttcttctccacggcccccacgacgtccggcgtgccctggttgaagccgtaactgccctgtcccgtggggccggcagcggtgccggggaggacgacgaggccgcccgccgaggcgatcgtgccctggtcctcgccggggacgcccaccgcgatctcgccgtagccgtcgccgtcggtgtccccgatggccacggacgcgccgaagttgtcgctgtgctcggcggcgccggggacaccgggtgagtcctggttgaggacgacggcctcggtgccccgcgggccgctcgcgccgcccggtacgtaggtgagcatgccgcccttggcgagcggcaggtccaggtcgctgtcgtacccgtcgacggcgcgcccgacggcgaggtcggcgtaccggtcgttgttcacgttgccgacggcgatgtgctcaccgccctgcaggttgtagccgttcctccccttgacggcggtgaggtccgggccgagtccggccgggccaccgagaccgatcatgatgcgccgcgcgtcgtactcgtcaccgtcgttggcgacgacggcgagatcgtcgcggccgtcgccgttcaggtcccccgcggccaccgagatcccgaacgccgacgacgggcggaacctcggtggccgcgggggacctgaa

SEQ ID NO: 3667 - DNA, 5915 bp, Unknown
  Kingdom: Bacteria, Phylum: Actinobacteria, Class: Actinobacteria, Order: Streptomycetales, Family: Streptomycetaceae, Genus: Streptomyces
tacccacgccgtccgcggaccgcgccacccgcccctccaccctgctgcccggcgcgacgcaccggacggtcgacgtccccggcggccgcatccactgcgtcgaacagggcacgggccccctcgtgctcctcgtccacggtttccccgagtcctggtactcctggcgccaccagctccccgccctggccgcctccggacaccgggccgtcgccatcgacgtacgcggctacgggcgctcctccgcacccgccgccaccgacgcctaccgcatgctcgcccacgtcgccgacaacaccgcagtcgtccacgccctcggcgaggagaccgccaccgtcgtcggacacgactggggttcgcccatcgccgcgaacagcgccctgctccgcccggacgtcttcaccgcggtcgcgctgctgagcgtcccgtacgcaccgaggggaggcccccgccccaccgacggcttcgcgagcatcggaggcgaggaggagttctatgtcagctacttccagacccccggccgcgccgaggcggagatcgaaccggacgttcgcggctggctcgccggcttctacgcgggcctatccggcgacacccacgcccccgcggaccaccccggcctcttcttcgtaccgccgggcgcgcgcatggccgaccggttccccgccggccggctccccggctggctcgacgagcgggacctcgacgtctacagcgaggagttcgagcgcaccggtctcaccggcgcgctcaaccgctatcgcaacgtcgaccgggactgggaggacctcgccgcctgggacggagcacccgtcacccagccctcgatcttcatcggcggcgccctggacgcctccaccacctggatgtccgacgccatcgacgcctatccgcggaccctccccggcctgtccgccgcccatatcctcgaaggctgcggccactggatccagcaggaacgtcccgacgaggtcaaccgcctgctgaccgactggctgcgcggcctgcgttgagggacgcccggcccgcgacgcccgcgtcagcaagccgtgccgcggttcgccgccgtcgcccgcagcaggtcgcggacgagcgtgaagtcgatcttccgcgggctgcggaaacgcaggcagcccttgcccatgtcgtgggcggccagccggtccgcgaacgcgtcgcggacgtccgtgcgcatcaggtagaacgagatgtactgctcctggtcggcgaaggcgatctcgcccgtcccgtcccgctcgtacgcgggcatgccgtacgccatcacctcacggaacccggtcagctcctcccggcacagcgcgcgcagcgccgtgagcgccgcccggcgggcctccggggcctcggcgaggtactgatcgacgttctgagcgctgctgcggaccatgagcggatcgtacggcgacacaccggcggaccggcggtgtgtcgcacccgggagccgcgggtcccccgggcgaaggtggacggatgaataccgcaggcatgctggccgaagcgttcgaccgggtcggggaaacggtccacgcggcggtcgagggactcacccccgacgacctgaacgcccgcgtcgacgcgggggcgaactccatctcctggttggtctggcatctcacccgcgtccaggacgaccacatcgccgacgccgccggaaccggacagatctggctcaccgagggctgggcggaccgcttcgggctgccgttcgacgagacggcgaccggctacgggcacagctccgccgaggtcgccgccgtccgcgtggactccgccgaacccctcctcggctacttcgacgccgtgctcgagcggaccctggacttcgtcgcgggactggagggccacgccctcgaccggatcgtcgacgagggctggtcgcccccggtgacgctcggggtccggctgatcagcgtcatcgcggaggacctccagcacgcgggccaggccgccttcgtccgaggggtgctggaacgcgcctgagcagcggcgcaggacgggggccgcgcacacccgtgcgcagtcccacctgcggtgccatactcggaagaagtcggctggacaggcttgccatcgtccgaaaggtgaccgtcatgagctgggcatcttggacgaccagcggggtcttcgcgggaaccggcggagtgcgcaccgaagaagcgggcatcctgagcggagacctcacggtgcacacgacctggtccgacgggcaggcgtcggtggccgtgcagtacagcggctcgtcggactggttcaccctcaccggcagccccgtgccctgcccctccgaggaggagagccgcgtcttccaccagagcgtggtcgaagccgtccgcgccggggagggcgcgaccgtccctccggtcggcgcgggacccgcctgacgtccctcaccgctcaccacgccccatagagtggatcaccggatccgttcccccagggacgggcgggcggtacacggggcgaggagcggtgcaatggggcgtgcgggcacacggcggtcgaggacacggaagaaccggccgttctgggtggagctgccgctcctcatcggtatcgccctggtgctggccctgctcatcaagacgttcctggtgcaggccttctccatcccctcggactcgatgcagaacacccttcagcagggtgaccgggtcctcgtcgacaagctgaccccctggttcggctcggagccggagcgcggtgaggtgatcgtcttccacgacccggcggactggctcgccaacgtccccgtggacccgcccaacaccgtgcagaaggtgctgagcttcgtcggagtgatgccctccgccgaggagaaggacctcatcaagagggtcatcggcgtcggaggcgacaccgtggagtgcgagggcgacgggccggtgaaggtcaacggcaccgccctggacgagccgtacgtcttccccggcaacaccccctgcagcaacgacgaggacggcggccggttcaaggtcactgtgcccgacggcaagatctgggtgatgggggaccaccgccaggcctccgcggactcccgctaccaccaggacgacccgaaccgggggatggtcccggtcgacgaggtcgtcggcagggccgtcgtcatcgcctggccggtcggccgctggagcaccctgccggtgccgggcaccttcgacagcgtgcccgaccagcctcgcggccccgccgctcgctagcgcgcgaagttccgtacgtagcggcgctgccagggagtctccaccgcccgcgggtggtagccgtcgcgcacgaacgccaccgcctcgtcggcggggaccccgtccaggacggccaggcaggccaacgccgtcccggtgcggcccatcccgccgccgcaggccacctcgacccgcatcccggcggcccgctcccacacttccttgaggaggtcccgtgccgccgcccggtccgccgggagccggaagtccggccaccgcagccaccgcgactcccaggcgaccggaggcggggtgcgcccgaggaggtatacggcgaaaaccggttcggggcctgccggcaagggcttgcgcagtccccggccgcgtacgagccgcccggaggggagggccaggacggccgggtcggcggcgttccacgtctcgatcacgtgtcccaacctatgacccggcagtcgccggtggtacctaccggagcggtcggccggagctcagatggcgtcgagatcctgcgcgagcagctcggccagctcctcgaccgccgcccgcgccccgtcgccctcggcgctgagcaccacgctctccccgtgcggggcggccagggccagcaccgcgagcatgctgcgggcatcgaccgggtcgcggccctcacgggcgatggtcaccttgaccggctggcgggcggcggctttgacgaacagcgacgccggacgggcgtggagtccgctgcgggaggctatggcgacggtctgctggtgcatggatcactccttgggaagggatgtgcgggagggatgtgtgtgcggagttcaggcggcgacggtgacccgggagccgtcggggcccgagggctccgcgtccccggccgcctccggcgccgtcctgcgtgcgcccttgagcaggacgacgagcgcggtcgccaccagggtcccggcggcgatggcgagcaggtagaggaacggctcgccgatcagcgggacgacgaagacgccgccgtgcggagcgcgcagggtcgcgccgaaggccatcgacagggcgccggtgaccgcgccgcccgccatcaccgacggaatgacgcgcagtggatcggcggcggcgaacgggatcgcaccctccgtgatgaacgaggcgcccagcacccaggccgcccggccgttctcgcgctcggtcttcgtgaacagcctcctgcgcacggtggtggcgagtgccatcgccagcggcggtaccatcccggccgccatgaccgcggccatcaccttgaggctgcccggcgtcggatcggcgagaccgccgaccgcgaaggcgtacgccaccttgttcagcgggccgcccatgtcgaagcacatcatcaatccgaggacgacgccgaggatcaccgcgttggagcccgacagaccgttcagccagtcggtgagcgcgttctgcagcgaggcgatgggcttgccgaccacgatgaacatcaggaacccgacgaccgccgacgcgatcagggggatcaccaggaccggcatgatgccgcgcagggtcgcgtggaccgggacccgttggatggccatcaccaccgcaccggccagcagaccggcgaccagtcctccgaggaacccggcgttcaccgtgagcgcgatggccccgccgacgaagccgggcaccagcgccggccggtccgccatcccgtacgcgatgtacccggccagcaccggcaccaggaatccgaaggccgccgagccgacctggttgagcagcgcggcccagctgtccgcctcaccccagacgaagtggtcggcgaccgacttggcgctcgctatctcgtagccgccgatggcgaacgacagggcgatcagaagaccgcccgccgcgacgaacggcaccatgtagctcacgccggacatcagatacgtacggagccggacgccgaagtgcgcgtggtccgcaccggatccgttcccgtccccgtcccccgagccggatgccgtgtcggtatcgggcgtggtggcgatctcgccgcgttccgccttgcggcgggcctcggcgatcagctcggcgggccggttgatgcccgccttgaccccgacgtcgaccagcggcttgccgcggaagcgggccttctcccggacttccacgtcgtgcgcccagatcacggcgtccgccgccgcgacgactgcggggtccagcttcttgaagccggccgaaccctgggtctccacggtcacttcgatcccctcggcgcggcccgccgcggccagggactcggccgccatgtaggtgtgggcgatgccggtgggacaggaggtgacggcgacgatccggaagggggcgctctcggcggcctcggtggctccagcggcttccgtctcggtctccggccgctcctgctcctggttctcggtctccgcctgctcctgctcgggctcctccgctggttcctcgccccggatcagcgccgccaccgcccgcgggtccgttccggcgcgcagggcggcggtgaactccgggtccatcagcctgcgggccaggcccgacaggatggtgaggtggtcgtcgtcggccccggccggcgccgcgatgaggaagatcaggtcggccggaccgtcggccgcaccgaagtcgacacccgccccgctgcgcccgaaggccagcgtcggggcgttcacatgctcgctgcggcagtgcgggatgccgatgccgccgtcgaggccggtcggcatc

SEQ ID NO: 3668 - DNA, 560 bp, Unknown
  Kingdom: Bacteria, Phylum: Actinobacteria, Class: Actinobacteria, Order: Streptomycetales, Family: Streptomycetaceae, Genus: Streptomyces
cgtgggagacgccgatcaccgagctccacggccagcacctcgggcccgtgctcggcatccggacggaactggaggtcgcgggagcgcgggacaagggcgacctcgacgcgctctcggtggggccgctgcccgcgcaggaagcgatcctggaggctttcggccagctcggctacgtgttcagatcggccgacctggagctcggacacgttcggggcaccggccagcagctgccctgctaccaggagatcgaaatcctcccaccgtccggccacgcgcacgccgtcaacgagatcgaggtgaccttcatcgccgcgccgggcggtctggagatcgtgatcgaggcggacaagcgcgccggactgttctccgacggtcacgacacggtccaccgcttcaccgtctcgcatcacgcggccccgcacaccgactggaaggcccaggtcgacgcctggctgaaggaggtcatcgccggtcacgaagcccgtgcgatgccgtactcgggcgttgaacaccacggagaccagcaccggtcgggacccggagcgggtgcggtggtggcc

SEQ ID NO: 3669 - DNA, 686 bp, Unknown
  Kingdom: Bacteria, Phylum: Actinobacteria, Class: Actinobacteria, Order: Streptomycetales, Family: Streptomycetaceae, Genus: Streptomyces
ggcggcgaggtcggcgacgggaatccggacgcggggcccgccggggcggacaccgtctcaccgtccgtgcatccgggggaacaccgggccggacccgaggacgggaccgctcccgtcgtgcccggctggaagaccgtggtcaaccccaagcgcggcatcgccttcgacgtcccggccccgtgggtgctcaagtcgcccggctgggtgagttacgtcgccgagaacagcgatcccgaggagacaccgctcgtcggcttctcggccccggcgatcctcaaggagaagtggtgccggtccgacgacgacggcaacggcacccaggaggacactccgctcgccgccgcgggatcccggggcgagcccggtgcccgcggcaccgccgaagcggcccgggagaacgcccgcctgtgggtctacggcagctacgcccagccgtcgaaggagaaggtcaccaccggagcggcgaagccgttcaccacgaagtccggcatcaccgggagcgtggcgacggccacctcgaccggtgtcgacggcacgggacgctgctcctacgacggcacggcgaccgcgttcgctttcgagaacccggcgggcgagacggtctcctggacgttcgtcggcgtccgcggcgtcgacgacgaggtccccgaaccgaccgtgcggaagatcctcagcaccgtccggct

SEQ ID NO: 3670 - DNA, 1639 bp, Unknown
  Kingdom: Bacteria, Phylum: Actinobacteria, Class: Actinobacteria, Order: Streptomycetales, Family: Streptomycetaceae, Genus: Streptomyces
ggtggtgacggccgcggccggggcggcgctgcatctggtcgcgccggaccgcgccgcggacagcgccctgctgctgtcgatcctcggcgcggtcgtcctggtcatcggcgcggcggtacgggagcgtggcgaggcgacacggcggctggccgaacaggagacgatcagcgaggcggagcgagcgcagcgcacgctgctggaggagcggacgcggatcgcccgtgaactgcacgacgtggtcgcgcaccacatgtcggtgatcaccgtgcaggccgactccgcgccgtaccggatctccgggctctcggagcccgcgcaggaggagttcgcctcgatcgcggcggccgcgcgggagtccctcggcgagatgcggcggctgctgtcggtgctgcgcagcgacggcaccgagggcgaccgggcgcctcagccgggcctggaccggctccagcagctggtggaggcgacggtacgggccgggctgccggcggaactgtcgctcgccgcggacctgggcgaggtgccgccggcggtggatctgtcggcgtaccggatcgtgcaggaggcgctggccaatgtggtgcggcacgcaccgggggcgcgcacccaggtctcggtccgggccgccgcgggccatctgaacgtactggtcgtcaacagccccgcgccgaagccccccgcgccgctggagagcgccgggaccgggcacggtctggtggggatgcgggagcgcgtacggttgaccggcggcacgctggacaccgggccgctgcccgacggcgggttccgggtggccgcccggatgccgctgcctccggccgtgtcgccgcccgccccacccccgtcggaggacctgtgaccatccgcgtgatcatcgtcgacgaccaggccatggtgcgggccggattcgcggcgctgctggcggcgcagagcgacatcgacgtggtgggcgaggcggcggacggccgccagggcgtcgacgtcagccgcaaccagcaccccgacgtcgtcctgatggacgtccggatgccggagatggacggactggccgccgcgcgcgagctgttgaatccgccggtgggggtggtgcaccggccgaaggtcctgatgctcaccacgttcgacgtggacgactacgtgtacgaggcgctgcgcgccggcgcgtccgggttcctgctgaaggacgcccctccggccgatctgatcgcggcggtacgggtggtggcggccggggacgcgctgctcgcgccctcggtgacccgccgcctgatcgcggacttcgcggcgcaacggccctccggggcgacgcgcggcggccaggcgctccggctcaacgggctcaccccgcgcgagagcgaggtgctggagctgatcgcccgggggctgtcgaaccaggagatcgccggacggctggtgctggccgagcagaccgtcaagacgcacatcgggcgggtgctggccaagctggacctgcgggaccgggcgcaggcggtgatcttcgcgtacgagtcggggctggtgacgccgggggacgcgggcgcgtagccggccttcgccgtacggcgcttcgcgggcaggtgagccacccgccgtacggcgcgcgcaatgcccgtgagccaccgtcgccgtacggcgcttcgcg

SEQ ID NO: 3671 - DNA, 12165 bp, Unknown
  Kingdom: Bacteria, Phylum: Actinobacteria, Class: Actinobacteria, Order: Streptomycetales, Family: Streptomycetaceae, Genus: Streptomyces
ggtcgtcgcggccgaggcgggccagggcgaggtaggcggggctggcttcgacgatgtggggcggagcgtgaacggtggccggggccggtggcgcgggctcggtgttcggtgcctggaccgagaccgaggtgcgttgctgcggtacggcggtgggctcgggggtctgttccgtacggggacgctccggtgcgggcaacggcggcgggtcctcggccgggtcccacggtgacggcggtgccgtgtcggggacggaggcttccggtacgggggctgcggccagggaggccttctcggtggcgaggtaggtgttccaccactcgttgtcgcgtgcggtgcgggaccagaaggtgcggaagacccagcgggtctcgtcgcccgcgccgccgaccgcgcaccgtacgcgccgcagatgcccggcgacggacagggcggtcagggcggtggagatggcctgctgaccgtagagcgggagttgcttggccagggtcttcacgctcatggccgcaccgtcgggaaggtggtcgacgaacccggcgacgtaacgctcacgcgtcggcaggagagcgaagtcgtgccgtgttcgggcctgttggtcgggtgcggagcgtttgccgtagccgggcttggccatcgggtacgcggcggagcgtgcgggggtgggcagggcggagctagtgtgctgggtagccaagggatcggctttctagggtatcgatcttgcggtgagaccccggcccggtgcgacaacaccggtcggggtcgtttggttctcgcaccgtaagcagtcgtgacgctgcgccgcaagctgtcacgattagtcatatttcctggccgtgacagggcggggaggtaggggaggttttccccaaaccccttcttctacctaccggttaaagaaggcgctcgaaccccgggtcccgcatcccgacgcccgagtcccggcacccgagcttcgggccggggccacgtgaacgtacccccagaagagtgaatcggctctcccgaggctcggctcctgggtggaggatcacccgaagctcgcgccaacggaatctgcaattccgcgcaatctctcctcggtctcgcgccatccgccgcatcctggattctcacccagcgtagacggaggacactatgacgctcctcaggtttctcggtaccaccagcgacgacggagactgccccactctctacgaggtcgagggcaccactgacatcctcgtccagggcaaccgcgttaccggccccgagcacttggcgcagcttcgcgacgtgaaggacagcgagacgttcgtgctggtgccgcgcgacctcctggtccgcttcgccccacgcaccgctgatcctgagatggtgccgttctccgagatcgccccgctgttccgcgagttcagacacaccgcattccggctggaaacccggcgcggatacgcctcagaccgcaacagtccgaagtgggtacggtggaagaccggcgcggacatctcggctgagccggacaacgcatggcgcgagaatgtccgggcccagacggctcagggaaagcggttcgagcgcgtccggctcgtcgaccagcctccgactgagggacagcagtttcttctggccagcggccagggcaacgtggccgctggtgaggacatccgcaacttgccacgctcccaggcagtgcgacttggcctgcccgaccacgacttctggctgttcgactcccggctgatcgcccggttcgtcttcgctgaggacgacacgaccctcggcgtcatcctcagcgaggacccagccgaagtcgctctcgcttgccaggcgcgagacgcagcctggcaccacgcgacgcgcaccgcggacttcgtgaagccggtagcttcgaccgggtgagcaccgatttccaaaccgcccgcgtcgccctcggtgcacggctccgcgagctgcggagcgaagccgatctcaacggcaagggcgtggccgaggcgcttggctggcaacgttcgaaggtctcgcgcctggagacggggaagcagacccccaccgcgagggagctcacggagtgggcccacgcggtgggacggcccgatgtggcaaccgggctacgggggcggctcgttgggctggagtcgcagtaccggtcgtggcggcgacaactcggcggtggccatcgggcacgccaggatcgggctgtcgcagagacgactgctacgcagctcatccggggcatggaggtgtcgcggatccccggcctgctccaaacagcggactacgcccggcacacgttcgaggtcaacgccgagttccgcagaattcctcgggacatcgaggcagccgtccgggcacgcatgcgccgccaagagtcgctgtacgaggccggcaagctcttccggttcgtggtgtgggaagcggcactgtacgtactgacctgcccccgcgaggtgatggccgcacaattggaccggctcgttgggctgaccggcctggacaccgtcgagatcagcgtgcttcccctcggcgcgcagttgaggcgtgcgccgggccacggcttttggatctatgaccggcgtcgcgtgatcgtcgagacgatcaacaccgagatgtggctcgacgacgaggagaacgtcgttctgtatgagcgggcatgggatctgatggctgaagccgcggtccaggggccgcaggcacgacgtttgatcggtcgtgcgcgggcgtcgttggccctcggttgatcaaccgctccccatgcgtagagcgggattcgcaacccggcgcaatcgccctgcgcatctcgtcctgagctctctaacgtgctggtcatggccacgcggatgcgtgtagctcctcccacataccggcccgaaggaaaagccatgagctcgctgatcatgccctcacccaggcccgaaattgcctatcgcatacttcttggccacaccacgacctgcaccgcttgccgtgtaggggtctcctgtccgacggccgtgcgtcttggccgtgcttggcgagaggctcggcacggatgaggtgttgcgtggagggggacgcgcacgagcttccggtcgaggatgagacgggggcccactgtccagagcatggggtgacgttgttgtggcgtggtgatccgatcagagctgccgatgcgtccggacggccggccgtcgtcctggacgcgctatcggtggggtcggacgggctccgcagcgttgtgtgccgaagcgcttcggtgacggatcttgccgacatgcatgctctgtgccgttccagggagtgcgcctgtccgtgccacgtgttggccccgcccctgccaaccagtcagcttcaccgatcagaggagatgaacgatgaccaccaaccccgtacgggccgatgccggtaagcatggcgggcagccgtcggacaggccgtggacgccgccccaggagccgaagccgtctccggacggcagccgccctcagtgcttcccccagtcgtgagcgccgcgcaggaggtccctacgtacccgtcgctggtgcaggagttggccgatcgcgggttgatcaatgcccggtggcgacgggtgttcgaggctgtcccgcgcagccggttcgtccccgagactgtgtggaggcagttgccggaccggtgcgagccggtcgtgggaacggatgcgtggctggcgttggtgaacagcgacgagccggtcgtcacccagctcgacgacggagcctcgggcgggcccggagtcgcgacgtcgtcgaactcgatgccctcgatggtcgcccggatgctgggcctgctcgaagtcgtcgacgggcagcgagtgttggagatcggcaccggcaccgggtacgtctccgcgctgctctgcgaacggctcggtgacgatctcgtccacagcgtcgaactggacccggtcgtggcccggcaggcggccgacgccctcgcacaggccggctaccgaccgcaccttcgcgtcggggacggtgaacagccctggcccggactggggcccgtcgaccggctcatcgccacctgcgcgttgcggtacatcccgtacgcgctgctccggcaggttcggcccggtggggtcgtcatggccccgctcgcccgggagttctggtccggagcactggtccagctccgcgttcagggcgacggcaccgcgaccggcccgttctgcggcggggccacgtacatgccgatgcgagcacaccgcgtgcctgatctccacgacgtacggggcaaggggcggacccgtgcggcgggcctggaccccgcccgggttcttgacctcgggttcgccctctacgcgggagcgcggctccccggcgtacgcctcatccaccacagcaccgccgacggcgcccgggtgtgggtgacccgggagaacggctccggagcgacggccgccagcggggaggaggtctggcagtacgggcccgggttcctgtgggaagagatcgagcaggcctggtgggagtacgaagcggtcgggcaacccgacgcccagcagttcgggctgaccgtcaccgaccgaggacagcaggtatggctccgggaccctgccgaagtcatccggcccagcaggccctaacgggctcccggcacaggccggttgcccgtccatcgcctctcgccgtcctcccactccccggtcggcaggagacccgccgccgcagccaccgcctcggacgcggcgtggtcggggtggatgtgggcgaccagctcccggacgcctccggcctcgaccaggtgcgccgagaggcccttcgccgcctcgctcgcgtagccccggccctgccacggcgtcccgaccacccaggcgatctccgcccggggtccccgtacggtcgcctggacgtatccggcgaggactccgtccgcgcggacccggagcacccagttccaccacacctccccggggtccggcgaaccggcgctctgccgctcgtaccgggaccgcagcgcggccgggtccggtgggccgccgccggtgaatacgtacagcgcccggtccgcgaggacagccgccatctcctcggcgtacgcgggatcgagcgggagcgcgtcgaggcgggcggtggtgaagggcaggggcgtggtggttgtccgcacggtgcccgaccctatgccgaccaccgggcctcggcaccatgatttccgcagctcacaaccggtgcgcgaggtcactcaccggctcaggcgctggaagcggcggaccgccagcggcaggaacaccagcgtgatcacgagcggccacaccacggccatcagcagggcgtgctcctccacccaggtgttgccgcctgccacggggttcccgaacagttcgcgggtggccgtcgcggtcgaggagatcgggttccaggccgcgatcgtgcccagccagcccggcatcagggacggggccacgaaggtgctggagatcatcgtgacggggaaggccaccgcgtacagcccgcccgccgcctccggggtgggcaccagcatgccgagccagacgcccacccagatgaggctgaaccgcagcagcaggagcagcccgaacgccccgaggccggccatcaccccggcgtcggcgcgccagcccatcagcagcgcggtgacggccaggatggtcagctcggccgcggccaccaccaggtcggccaccccgcgtcccgaggcgaaggcggacggagccatcggcatggaccggaaacggtcgacgacccccttggcggcgtcggtgacgacggccacggcggtgttcatgaagcccatggccatggtcatggcgaacatgccgggcatcaggaactcccggtagtccccacccccgggcaccttcatcgcgctgccgaagacgtatccgtacaggaggacggagaggatggggaagccgagctgccagacgacggcggaggggtggcgctggtagtgggtgagcgtgcggcgggtgatgttccagcagtcggagaccgtccagaagacagagccgtgattgcggaccgggtccgccgcagccgcaacggggttcctttcgcgtgtggtcatgccgccgccacctccgcggagtcgtggttctcggggccgtgatcctccgggccacgacgcccggcgtcgcggtcctcgacgccgtgcgccgtgccgtgtcccgtcaggcgcaggaacacgtcgtccaggctcggccggcgcaacccgatgtcctccaccgcgatcccgtcgtcctgaaggctccgggccacctcggtgagtgcggccacccggtcggcgacctgggcgtgcacccggcgggtggcggcgtcggtgacgacgagcccgcctccggccacccggtcgacggtccacgccaccgcgtcgaggtcccccgcgtcggcggccaccacctcgatccggtcgccgccgacccggttcttcaacgcgtccggggtgtcgtcggcgatggcccgtccccggtcgatgacggtgatgtgcgaggcgagcctgtccgcctcgtccaggtactgcgtggtcagcagcaccgtcgtgccgcccgccaccagcgcacggaccgcgtcccagacctcaccccggccgcgcgggtcgagcccggtcgtcggctcgtccaggaagagcacgtcgggctggaggatcatcgaggaggcgaggtcgagccgtcgccgcatgccgccgctgtactccttggcgcccttgtcggcggcctcggtcaggtcgaaccggtccagcagttcccccgcgcgctgcctggcccggcggttgccgaggtggaagagccgaccgaacatctccaggttctgccgcccggtgaggccttcgtcgactgccgcgtactggccggtgagcccgatccggctccgtacgcggcggggttcgcgcgccacgtcgagcccggcgacctccgcgcggcccgcgtcgtaccgcaggagcgtggcgaagacccgcacggcggtggtcttgcccgccccgttcgggccgagcagtccgtggacggtgccggggcggacggcgaggtcgaatccgtcgagcgcccgcttctccgtcccgctcctcccccggccccggtaccgcttcacgacaccttcggcgagcaccgcgtacccgggcgcgaatcctgacccggttttagacatgagcatggcataaccccctgtttctcgaaccgaccggaagccgactgagtacaccgtaccctcgattgggtacagcgtactccgatacgggtacggcgtacccaaccctgttccggagcactacgctgaccccatggcgaaagacggatcgacagcggcgacggacggcacggccaccgggagcggcgacatcgcacgcagcctggaactcctctggggcaccggggagcgccccagccgcggccccaaaccgggcctcacgctggaccggatcgtcaccgccgccgtcgccgtcgcggacgcggaagggctggccgccgtctccatgcgacggctctcgaccgagctgggcacgggcacgatgtcgctctaccggtacgtccccggcaaggccgaactgctggacctgatgctcgaccgggtgctgggcgaacccctgccttccggcacggaccccgtcgacgctcccgcaccccccgccgactggcgggcgtcgatcgacacgatggcccgtacctacctggacaacctgcgccgccacccctggctgctgaagatcaaccaggcccgtacggtgctcggacccagcgccctgcgcggcctggaactctccctcaccgcgctgcggtccatggggctgcgcgaccccgagctgatcggcgtgatcatcacggtcaacagcttcgtggagggcctcgcccgcacccgggccgacgcggcggaggcggtgcgggagacggggttgagcgaccaggagttctgggacgaccagcgcccctacctggagcgggccatgctcagcggcgcgtacccgatgatggcgagcctgtcggaggacgccttcagcgccgagttcgatcacttcgagttcggactgcgacggctgatcgccggtttcgaggccctggtcgaggagcggacggcggagcgggcgacggacgggacggcagacgggacgacggacgggacgacggacgggacgacggagcggacagcggcccggaaatgacagcacccccggcccgtgccccaatggatatatggacgccagccgggagctcgctcctttcgtcaagcagtacgccgtcctgctgagcacccaccggcaggacgggacccccgtcggcacacccgtcaacatcgccgtcgagggcgatcacgcgttcatccgcacgttctcctccgcctggaaggtggagcggatgcgcaaccacccgcaggtggagatcgccccctgcacgatccggggcagccccaccggaccgcagatcagggcgcacgcacggttgctgcggccgggcacgaaggagaacacgcacgcggcgcggatgctgtcgcgcaagtacccggtcgtgcagggcgtgctcgtcccgctcgcgcaccggctgaagcgggaccggaccctgcactacgaggtgtggccggtgacggacgacgacacctgagcccggggcgagcggcgagcccgccgacgggggttgcgacggcggaaagtccctgccctccgtccggctatccgcgacgccgccgcttcagggccagccagagggccgcgaccccgacgatgacggcggcaccgagggccgcgttgccaccgccctcacccgtgtcgccggcgctccccgggtcaccgcccttcgagggggtcccggacccttcgccggacccggacccggacccgctccccggaccgtcctccgtctccacgcggacgacatcgctgcgggccccctcggagccgaacatcagggccgagccgtccgccgtgtacgtcaccgactccgcctgccgctggaacggggcggcgaccgaccggtcctcaccgaggcggccgtcctcgaaggcgtactcgcgggcgctgaagtacgagcgcagcaccagccgggtcccgtcgggcgagaacgccccgtccgtgacccacggcacctcgccgacccgccggaacacgttcgcggagccggcggtgagcttcgcgggtccttcgtagaggccgccgccgtcctcgttcttggaggcgatgtagacgcggccggtcttcgggtggaccatcagcgcctcggcgttgcgggcgccgtcggcgtaggtcacgtcgtactggacggccgtgacggtggcatcgcgcagggtcttcggctcggggaagcggtagatccagacgtggtcccaggtgccgtcgaggttgtcgccgatgtcaccgacgtagaggtcgccgtccggcccgatcgagatgccctcgacgtccctgggctcacccactccccgcatggtgatggtcgcgagggtcttcccggtgcgggagtcgacggcgtagacgtaggggccgtcgtcgctgtcgttgtgcgtccagtagacgccgggatgcgcgcggctggcggcgaggccgctggactcggtgatgcgggggtcctcgatcgtgaagtcacggtcgggccgtccgtcgtcggccacggcaggaccggccccggcgaacagcggaagggcgacggcgagagcggcggcgagtgtggcggcggcgcggcccgccgggccggtcggatacgagcgcatggcccaagtgtccatcgtcacgtcgcaggccggagccgtgatcggccatgatgacgccatgcgttttctcccggtcggcgattccatgaccatcggcgccaccggcgacttcacctggcgctaccggatgtggcagcacctggaggcgtgcgccggcctcccgtacgagatcgtcggcccgcgcacgacgctgtacgacatcgaggcgaacgcaccgctctcccacgcgtacgccgacccgtccttcccgcccgccgcccgccggcacctgtccggctggggcgagggctggctgcacatggccccggtgatcgcggacgcggtgcgcgagacgggggcggacgtcctgctggtctcgctcggcctgatagacctcggcttctacacggacgccgagcagacggcggccaacgcccgcgcgttcgtcacggcggcacgcaccgcgaacccgcacctgcgcatggtgctgctcccggtgataccgaacgtccgggccgtgacggacgtccccttcgccgcgtcctgcgcccgcttcaacgaactcctcgccaaggccgtggccgacctcgacgaaccgtcctcaccgctcctgctggcctcgcaccccgcggcgtacgacatccgcacggacacctacgacggcacgcaccccggcccgacgggcgagcacaaactcgccgccgccttcgccgacgcgatgcaccaggcgtgggggctgggcggaccgtacgccgagcggcacgcgcaggcgcaggcgcagcctgcctgactcccgggcagcgcaggcccggccccctcacccgctccgcagcgaccccagcatcgacagcgccagctgggtcagttcccccgagacctcctccgggcgggcccggcggctgcgtcgggtgtggtgggccatcagctcgtggacggtgccgaccatcaccatcacgtcgacccggtggtcccggtcctccgcctcgccgcgctccaccgcccgttcggcctccccggtcaggaactccgtccagagggcccgccagagcttgcagtgctcgtccaccacggcgctcacacccagcacctcgacgaacgtcacccgggcctcgcgcgggtcgctggtgacggcctccacataggcgtcgaagagcagacggacccgctccgcgatcgagcggtcctcgatgccatcggccaggagggcgctctccgccgcccgcagcccggtcgtcgtgacccggttgtggagggcgatgagcagcccctcccgggagccgtactcctgacgcagcacctcgaccggcacacccgccgccgcgcacacatcgtgctcggcggtggcccggtatccgttgatgccgtacaactccctggccgcttccagaagtcgttcacgcgcctgcgtgcgcgcggcatccccgggcccggtccgctgaaccgtccagctctccgccaccggtcctccttgagcgcaaggtgcgggagaggagcctgcgcgcctctgcacgaaccgccgccccattgtgctcgccccaccgccgtccggacggcctcgccacacccatacgggggaatacccgcacgcggaaacgcttcttcttcgcgcgccccggatgcgccccaaactcaccccgtactcgacactcaccccgtactcgaccggagcggttcgtcgtcgtcaccctgcccggcggcgcggggcctgccaccactgctccggtccgtctgccgacgaggacgtccggcggtgcgcggccggccccggccccggactcagcccttgacggtgaactctccccgcagcagcgcctcgtcccgggacgaggggcccaccagcagctcgaagcggcccggctccacgacgcggcggccctccgcgtccacgagggtgcactccgccgccgggagttcgaagaggacctcgtgcgactgcccgggggtcagcgccacctgccggtaggccttcagctccttctccgcccaggtcaccgacgtcaccgtgtcgctcacgtacacctgcaccgtctccagcacgggccgcgtccccgtgttggtcaccgtgacccgggcccgtacggtctccgactcgtcgaccaccgacgtcagcacctccaggtccgtgtagtcgaccgtcgtgtagctcatcccctcgccgaacgcgaacgccgggcgctgggtgaggtccgcgtagcgtgaaccgtgctggccgcgcacctggttgtagtacgtcggctgctggcccgcgtgccgggcgaaggacagcggcagccggccggccggctcgatcaggccgagcagcagctccgcgaccgcccggccaccgagcatccccgggttggccgcgtacacgatcgccgccgctccgagcgcggacggcggcagcaccagaggcttggagctgatcaccacgaccaccagcggcttgcccgtcgccgccagcgcgtccagcaacgcgacctggtcgccgacgagttccagggtcgcggtggacctgccctcgccgatcagctcgatccggtcgccgacgacggcgaccggatcgagctcatcggcgagg

SEQ ID NO: 3672 - DNA, 2864 bp, Unknown
  Kingdom: Bacteria, Phylum: Actinobacteria, Class: Actinobacteria, Order: Streptomycetales, Family: Streptomycetaceae, Genus: Streptomyces
aagcgcccacggggccgggtgagcccggcaaccccagccggtccggcgtttgaggacggaaccgtccaggcggacgagcaaagcgcccacggggccgggtgaacccggtgaacccagcccgtccggcgcttgaggacggaaccgtgcacgcggacgagcggcgcgcccatggggccgggtgagcccggcaaccccagccggtccggcgtttgaggacggaaccgtccaggcggacgagcaaagcgcccacggggccgggtgaacccggtgaacccagcccgtccggcgttggaggacgggaccccgggcccagccgggccggtcgtgctcgggactccgtcctcaagcgcgacggcgggctggatgtggcccagcggcccgtcctgaagcgccggaccggcgccgcccggcccgaccttcccgggtggcacgcaaaagagggcgcccaccaggacgccctcgactgcggccgatctcagacgtaccgctccaggatcgacgactccgccagccgcgacagtccctcccgcacgctgcgcgcccgcgcctcgccgacgccgtccaccgtctggaggtcgtccacgctcgccgccagcagcttttgcagcccgccgaagtgctccaccagccgctcgatgatcgctcccggcagccgcggcaccttcgccagcagccggaagccccgcggggacaccgccgagtccagcgtctcgggcgagccgctgtagccgagcgcccgcgccaccaccgccagctccaggagctccgtgtggctcagcgcgtccagctcggtcagcgcctcggccaccgtgcgcgaccgcttcgccgtcggctccgggacgtagtcccgtacgaccagctcccgctccggctccaccccggcgatcagctcgtccagctggagggagagcaggcgtccgtcggtgccgagctcgaccacgtactccgcgatctccgtggcgatccgccgcaccatctccagccgctgcgccaccgccgtcacgtcccggacggtgaccaggtcctcgatctccagcgcggacagcgtgcccgccacctcgtcgaggcgcagtttgtaccgctccagcgtggcgagcgcctgattggcccgggacaggatggcggaggactcctcaaggacccgccgctccccgtccacgtacagcgcgatcaggcgcatcgactgggagaccgagacgacggggaagccgcacgccttggagacccggtccgccgtacggtgacgggtgcccgtctcctccgtgtggatcgaggcgtccgggaccagctgcacgccggcccgcaggatcttggtcatgtccttgtcgaggatcagcgccccgtcgagcttgcacagctcgcgcaggcgcgtcgccgtgaactccacgtccagcacgaatccgccggtgcacatcgactcgacggtcttgtccatgcccagcacgatcagcccaccggtattgccgcggagaatgcgctccaggccgtcccgcagggccattccgggcgcgaccgcgctcaacgaggcgcgcatcagcgcctcgttaccggtgccttggccggactttccgggcgtcgtcgcccggtcgttggctgccactgcactcctccggtcacaggttgcggtgcccttgcgtcccccatgccgtgtccacgggcgggcgagaccagggcaaagtctaccggcgcgcgttgtcttcctgacgaggctgcggcgcctcttgacgagaccggcgcgggaggacccgcagagcatcgcccatgtcggcgacttccgtgaccttcataccggccgggaccttccccgggtccgtcggaacgagtgcgtgggtgaagcccagacggtgtgcctcggccagtctccgctgcaccccggtgaccctcctgacctcgcccgcgagccccacctcaccgatcgcgaccaggttcttcgggagcggggtgtcgctggccgcgctggccagcgcgagcgcgatcgccaggtcggcggcgggctcggtgagcttcacgccgcccaccgtcgcgctgtagatgtcccgcttgccgagcgcgctgatccggccgcgctgctccagcacggcgagcatcatcgagacccgggaggtctccaggccggaggtggtgcgccggggcgaagggatctgcgagtcgacggtgagcgcctgcacctcggcgaccaggggccgcttgccctccagggtcaccgtcaggcaggtgcccggcaccgccacgtcgcggcgggtcaggaagaggcccgaggggtcggcgagtccggtgatgccctcgtcgtgcagctcgaagcagccgacctcgtcggtcgccccgtaacggttcttgaccccgcgcaccagacgcagccgggcgtggcggtccccctcgaaggacagcacgacgtccaccaggtgctccagcagccggggtccggcgatcgcgccgtccttcgtgacgtggccgacgagcagcgtggccatcccgcgctccttggaggcccggatcagcgctccggcgacctccctcacctgggccatcccgccgggcgcgccgtcgatctcgggcgaggcgaccgtctgcaccgagtccaggacgagcagcgagggcttcaccgcgtccaggtggccgagcaccgcggacagatcggtctccgcggcgaggtagaggtggtcgttgatcgcccgaatccggtcggcccgcatccggacctggctcgcggactcctccgcggtcacatagagcgtgcggtggtcctcgtttgccgccttggccgccacgtccagcagcagcgtcgacttgccgacacccggctcgcccgccagcagcacgaccgcgcccggcaccagcccgccgccgagcacccggtccagctc

SEQ ID NO: 3673 - DNA, 3771 bp, Unknown
  Kingdom: Bacteria, Phylum: Actinobacteria, Class: Actinobacteria, Order: Streptomycetales, Family: Streptomycetaceae, Genus: Streptomyces
ccggggagggctccggggggccagtcaggttcaaagggtccaagatcgtcacgcaatgtgatggtcgccgagtgctgcgcaccgcagcaggaggagtgatcgccgtgcctcgtggaggagctcgcgcagtatccggaccggcgccggacccgaacgcgctgcgacgcaaccggccgtccgaccagtcgagttggacgatgctgcccgccgaggggcggccgggcaggccgccctggtggccgctgaccgagcagactcaccgcgagcgggagctgtgggacgagctctggagccgaccgcaggccgtgatgtgggagcagctcggccaggtcctcgaggtcggtctcttcgtgcgcaccctcgccgagaccgagcagcccgactcgaaggtggaggcccgcaagctcgcccgtcagtacatggagagcctcgggctgaccgtgcagggcatgctccgcaaccggtggaagatcgtcaccgcggtcgacgccgctgcggacgaggacgacgacgaggccctcgacccgcccgtgcggcgctccgcccgggaccggatgaaggtcgtgccgttccgtggccccggggcgtagcgccgctgccgccgagttcgtcgtcgacttccccaccctgtggatcgtgccggactggatcgaggcgcactgcccggtccccgacgggttccgccgcggcgaggacctggagctgtacccctggcagctgtggtgcaccgtcaaccactaccggatcaagcccaccgcccgcatgggccaactcgcgccggcgttcttctaccgccggtcgcagatcgtcgccccgcagaagaccggcaagggcccgtggtcggcgacgatcacgtgcgccgaggccggcgggccggtcgtgttcgccggatgggcgagcggcggggagcgctaccggtgcgcggatcacgggtgccggtgcggctggtggtaccggtacgaggcgggcgagccgatgggccgcccctggacgacgccgctgatccagctggttgcgacgtcggaggaccaggtcaccaacgtctacagcccgtttcagtcgatggtgaagcaagggtggctgtccgacttcatgcgcgtcggggaggagttcacgcgcgtacgcgacgagggcaaggtggagaccgtcacgtcgtccgcgctgtcccgcctcggcaacccgatcacggccgcactgcaggacgagaccgggctgtacaccgacgcgaacaagctgcggaaggtcgccgagacgcagcgccgtggcgccgccggcatgggcggcagggtcatggagacgacgaacgcgtgggacccgtccgaagactcggtcgcgcagcggacgtcggagacgaagcgcagagacatcttccggtaccacccagaagcgccccggtctctgtcgtacggcgacaagcggcagcgccggaagatccacacgctcgtctacgccgggtcgacgcacgtcgacctggacgcgatcgaggccgagaccgccgagatcatggagaaggacccggcgcaggccgaacgcttcttcggcaaccggtgcgtcgccggtaccgcgtcgtggctggacctcgcgaagtgggccgccaaggccacatcgcgccggatccgcccgcacacccggatcgtcctcgggttcgacgggtccgactccgacgactggacggcgatcagggccgagacgatggacggctaccagttcaccccgctgtacggggagaacgacgagccgaccatctggaacccggccgactacggcggccaggtcccgcgcgccgaagtgcgggcggcgatggaccagctgatgcgccgctacgacgtcgtccgcctctacgcggacccgccgtactgggacacggaggtcgacgagtgggtggacctctatggggaggagcgggtgatccgttggcacacccgccgcatcatccagatgtactccgccgctgagcggctgcgcaccgacgtcctcaagcgcaacagcgacggggccgcgttcacgcacgacgggtgccccatcacctacacgcacatcgggaacacccggatggccgcccggccgagcgacaagtacgtcctgcgcaaggccagtccgtcccagaagatcgacgccacgatcccctcgatcctggcgcacgaagcgctcggcgacgtcatcgccgcaggtctggccgtgaaggaacagtcctacttctactccgcataaggggggcgtgtggctacgtatgaacaggccctcgagctggtggaccttctcacgtcggagctgatcaaccggcggtccgagatcgaccggaacaacgactactaccggggcaagcagcggctgcggttcgccagctcggagttcgcgaagttccacggcgaccggtacaaggacttcagcgacaactgggtccaggtcgtcgccgacagccccgtggagcggatgaccgtcaccggtttccaggcctccggcgaggagtccgcggacaaggaactgtggaacatctggcaggtcaacggcctggacgctgatagccagatggggttcctcggatcgatcaactcgagccggagctacctcctggtgtggggcgaccccgacgacccggacatgcccgtggtcacgttcgaggacgccagccagtgcatcgtggcgtacgagcccgggtcccgccgtaaccggcgggccgcgctcaagacgtggcaggacggcaacgccgagctcgccaccctctacctgcccgacgaggtgtggaagttccaccggcccctctcgcagcagtccaagagtccgcagctggcggacgtggacgaggcgatgagcctgtggctgccacccggggagcagcgccgccggcggacgtgggagccgcgggagctggacgacgagccgaacccgcagacgaaccccatgggcgtcgtgccgatggtggagctcccgaacaagccgatgctggtggaggagccgatctcggacgtgtccggggtgacggcgatgcaggacgccatcaacctgctgtgggcgcagctgttcaccgcctccgactacgcgtccttcccgcagcgggtcatcctcggcgcggagcgtccggtcatccccaaactcaacagcgccggggagatcgtggggacgcaggccgtcgacctggacaagttccaggtggaccgcgtcgcgtggatcaccggcaaggacgcccgcatcgccgagtggcaggccgccaacctcgcgatgtacaccgaggtcatggaggtggcagtcggccacctcgccgcccagacgaggaccccccagcactacctgatcgggaagatggcgaacctcgccgaaggcgcgctgctggcggccgagaccggtctcgtgaagcgggtccaggagaagcacctgtggtccggccagggcctgcgcgaaggcgcccggctgatcgccctggcccgaggcgaggacgagaaggcgaaggcactgcgcgcgggccgggtcctgtgggccgatgccgagtcccgttcgcacgcgcagctggccgacgccctgctcaagctcaaggacatcgggttccccttcgagtggctggccctgcgctacggactgacgccgaccgaggtggccgacgtcgtggcgctgcgggagaaggagatggagatggacccggtgggcgcgatgacgcagatgatggcgcagcgcccgcccgccggcggcgagctggacgcggcggccgccgaggaccaggaggaggtcctcgcgtgagcgcgcccgcccccgtccgccgacaccaggaggagcgcg

SEQ ID NO: 3674 - DNA, 2438 bp, Unknown
  Kingdom: Bacteria, Phylum: Actinobacteria, Class: Actinobacteria, Order: Streptomycetales, Family: Streptomycetaceae, Genus: Streptomyces
caacggggtccacgcaccgagccggaacacctcgggggcgacccagctcggtgcgtggaccccgttggtgacggagatgatcggcacctcggcggggtcgaagcccggccagagcccggagaacatctcccggctgacggctccgtgcagggtggagacaccgttggcgcgctgggcgagcctgaggcccatcaccgccatgttgaacagctccggctcaccgccggggtacgtctcggtgccgagccgcaggatcttctcgacggcgacaccgggcagctcgccgtcgtcgccgaagtggcgggcgacgagaccccggtcgaaacggtctatcccggccggcaccggggtgtgggtggtgaagacggtcccggcccggaccacttcgagggcggcgtcgaagtcgagtccggtggggatgagttcacggatgcgttccagaccgaggaaaccggcgtggccctcgttggtgtggaacacctccggctccggcgtgccggtcagccggcaccaggtgcgcaccgcgcgcaccccgccgatgccgagcagcatctcctggagcaggcggtggtcgctgccgccgccgtacagccggtcggtgacgtcgcgttcgccgggggcgttctcctcgacgtcggagtcgagcaggagcagtggcacgcgaccgacccgggccaaccagatacaggcgtgcagcgatcgcccgccgggcagggcgagcaccacccgggcgggggcgccgtcggcctcgcggaccaggtcgagcgggagtccgttggggtcgaggacgggatagtgctcctgctgccagccctcgcgcgagagggtctggcggaagtagccgtgccggtagagcaggccgacgccgatgagcgggacgccgaggtcgctggcggccttgagatggtcgccggccaggatgccgaggccgccgctgtactggggaagcgccgcggtgacgccgaattcgggtgagaagtaggcgacggcggaggggagttccgctccggcggcccgctgctcctggtaccagcgggggccgtccagatactcggccaggtcggcggaggcgtcggcgaggcgaccgaggtactcctcgtccccggccagttcggcgagccgcccggcggacagcgaggcgagcaggcgtacggggtcggcgtccgcgggccgccagccctcggggtcggcggaccggaagagctcacgggtctcggtgtgccacgaccaccgcagattgtgcgcgaggtcgtggagaggtcggaggggttcggggaggacaggacgcacggtgaatcgacgaatggccttcacgtactccacctttacaggggacttgcgcatccgggcggacgcaccacggtgtgcgtcccttccgtcacccctgacggtagcggccgtccgtggcggcctgccacggcgcgcggacggctcaccgggtccgggaccgggccaccgcgcgctccccccaggcgccccaatcacctcgcccgtactcccccgtcactccgcccacctgggggtttggccgatttcaccccgtacgcagccttgtggacctccctgccacagggaaggctgccgtgtggcgccgcagagcgggtatccggaacccgtgggggcgccccgggctcccctgaggactgtcccgcaattcccggcgggggcgtgcgcgccgcgtgcggcggggcccggacggtcggctacgaccgagtagttaacacagcgccggatttcccacccgcggacgcggggaaggcttcccccgtacgcggcacgacccggcccgcagacgttctccgtgcatccagaaacatgcacgtaacccccgcgacccacccattcgagtgccattcgagtgaacgcggacaggagcggccatgcccacagcccgtcagcagacagctgagcagctacaaaggacagattcccgtcttcgcggcacacgcggtcggtcctccgcgcccgtgccgtcccccgtgcacgccgagctcctccagccctcaggtgattccatgatcggtcgtattcccgtcctggacgtccgtcctctcgtcgactgcggcagacgggcggcgaaggccgtcgttggtgagaccttccaggtcagcgccaccgtcttccgcgaaggccatgacgcggtggccgccaacgtcgtgctgcgcgatccgagcggacgggtcgggccgtggaccccgatgcgcgagctggcgccggggaccgaccggtggggggcggacgtcacgccgggggccgagggccgctggacgtacacggtggaggcctggagcgatccggtcaccacctggcggcgccacgccgcgatcaagatcccggcgggcattgacacggacctggtgctggcggagggcgcggcgctgctggagcgggccgccgcgggcgtcccgaagaagcacggccgcgaggcggtgctggcc

SEQ ID NO: 3675 - DNA, 614 bp, Unknown
  Kingdom: Bacteria, Phylum: Actinobacteria, Class: Actinobacteria, Order: Streptomycetales, Family: Streptomycetaceae, Genus: Streptomyces
tcctcgcgcagccggcgcagggagcgccagatgctggacttcaccgtgccgacactgatgtcgaggatcgacgcgatctccgggtcggtgcggccctcgtagtaccgcaggaccagcatcgtgcgctggagttcgggcagccgggcgagcgcctgccacagcaccgcccgcagctccgtgccgcgcatcgcgtccgtgtcgcccaccgtctccggcagctcctcggtcgggtactcgttgagcttgcgcctgcgccaggcgctgatgtgcagattggtcatggtgcggcgcagatagccgccgaccgctgccttgtcgctgatccggtcccacgcccggtacgtcgagaagagggcgctctgcagcaggtcctcggcctcgaaccggtcaccggtcaggtggtaggcggtcgcgtacagggaggcccgccgctcctggacataggccgtgaacgccgcttcggcgtccgcgtcctccgtccgggccgtgcgatcccccgtggcctccccgtacgcgttcgccgtccccttgggcgcgtcgatcaccgtcatgtacggcatccgcacctgctccgcggccgacgcgtgctgacgcccggtgcctcgaacacaccc

SEQ ID NO: 3676 - DNA, 5171 bp, Unknown
  Kingdom: Bacteria, Phylum: Actinobacteria, Class: Actinobacteria, Order: Streptomycetales, Family: Streptomycetaceae, Genus: Streptomyces
cccgcggtcccgtcggcggccccgcccacgtctccgcccgcggtcccgtccgccgccgctttcgtcgccgcgcagtccgcacagcggccgaagatcgcgaagtgcttcatgtccgtctcgaagccgaaatcggcgcgcagcttctcggtgaactcggcgacgacggagagatccgcctcgatgacgtccgcgcagtcccggcagaccaggtggatgtggtggtgccggtcggccaggtggtacgtcggggcgccgtgccccagatgggcgtggctgaccagcccgagctcctccaggagctccagggtccggtacaccgtggagatgttcacgccggacgcggtcctgcgcacctcgcacaggatgtcgtccggagtcgcgtgctccagggcgtcgaccgcctccaggacgagctgacgctggggcgtcagccggtagccgcgctgccgaagatcggtcttccagtcggtgctcaccacacgcccagtgtagggcggggcgagcaccggacagcagccccggctccgggcgggctccctacttgaagaacgcgatgccgtcgtcgggcatgtcctcgaggttccgcgccatctcggcgacctcctcgggggtgacgaccttcttcaggtgcgccgacatgtacgggcgcagctcgacctcgggggtggccttctcgccgacccacatgaggtcgctcttgacgtacccgtagagccgcttgccgccgctgtacgggccggaggccgccgtgcgggccaccgcgtcggtgaccaggtcgatctgcggcttctggttggccagctcgccgtaccagatctcgatgacgccctggtcgcgggccatgacgacctcgaccttgcggtccttgtcgatgcgccagtaaccggtctcggtctccagcggccggacctgcttgccctcgtcgtccaggacccaggtgtgggagacgtactccaggaagtcacggccgtcgtggctgaaggtgacttcctggccgaagttgcacttctcggcgccggggaagtcggacacgcccgcgcccgcccagttgccgaggaggaaggccagcgggacgaggtccgggtgaaggtcggacggaatctcgatcatgagcggctcagacgatctgtgagggaggggcgggacgatcgggtgccggtccggtgcggggtcgcgcacggaccgggtgcgacgagggtcagcgctggccctggaacagcttcttcacggtgagcgcggcgaaggcggtgacgcccacgcagaccaggatcagcagggcggagaagaatgcctcaagcacagggggctcctcgtgacgagcgggtgacggcagtgacagggccgggccccagcctaatgggtggggacccggccttctcgttcagcccacgttcaggtcgtcgatcatgccgctcgcgaacgtggccgggaacggtcccccaagagaccggaggcgcgggttccctcacgcgcgcacgcccccagggcggcgaggaagtcgcgtaccggacgattacagttcggcgtatgccgaagaagcttgtgatcaaggtgaccgccgggcccgaggccgccgagcgctgctcccaggccttcaccgtggcggccgtgggcgtcgccagcggtgtggaggtctcgctctggctgaccggcgagtcctcgtggttcgccctgccgggccgggccgccgagttcgaactgccgcacgccgccccgctgcccgacctgctggactcgatcctcgcgggcggccggatcaccctgtgcacccagtgcgcggcccggcgcgacatcggcgagaaggacgtcctggagggcgtacggatcgcgggcgcgcaggtcttcgtgcaggaggccatggcggacggcactcaggcgctcgtctactgaccgggcaggagtccgccgtggctcagtggcgcttcttgccgtccagctcgtcccaccactcgtcggacttcgggtcgccggaggggtcgtcccaccaacggtcgtccgggccccgccggttggcgaccatcgcggcgacgggcgggatcaccatggcgaccacgcacatgccgatggcgaccggcatggaccacaggcgcaccacggcccaggcggacacgaagagcgcgacgcatccgcccatcatgaggaagtagttccgcctgcgtcgggcgtacatgcttccagcgtagaactcctcgggccgcccgcccacccggtggggacccccggacggcgcgaagggccgcaccccgcgtcaggtggcgtccaaccccctggggtgcggcccttcggccgttctgtgtgccgtacggaacggcgtgccgcggatcagacggcgatggcaacctcggagagcccgccggtctgcgcgacgaccgtgcggtcggcgctgccgcccggaaccagggcgcggagcgtccaggtgccctcggcggcgtagaaccggaactgtccggtcgccgaggtcgggacctcggcggtgaactcgccggtcgagtccagcagccgcacgtagccggtgacgggctcgccgtcgcgggtcacgctgccctggatggtggtctcaccgggcttgatcgtcgaagcgtcggggccaccggcctgtgctccacacatggttctgtccttctggtcgggtcgtgcgggtcggtcggtcggactacttggcggggccgagctcgatcggcacgccgacgagggagccgtactcggtccaggagccgtcgtagttcttgacgttctcctggccgagcagctcgtggagcacgaaccaggtgagcgcggagcgctcaccgatgcggcagtaggcgatggtgtccttcgccaggtcgacctgctcggcctcgtagagggccttgagctcgtcgtccgacttgaaggtgccgtcgtcgttggcgttcttcgaccacgggatgttgcgggcactcggcacgtggccggggcgctgcgactgctcctgcgggaggtgggccggggcgagcagcttgccgctgaactcgtcgggcgagcgcacgtcgaccaggttctggttgccgatggccttgacgacgtcgtcgcggtaggcgcggatcgactcgtcctgcggcttggccgtgtactgggtggccgggcgcgtcgggacgacgtcggtcaggtcgcgggagtcgagctcccacttcttgcggccgccgtcgaggagcttcacgttctcgtggccgtacagcttgaagtaccagtaggcgtaggaggcgaaccagttgttgttgccgccgtagaggacgaccagcgtgtcgttgccgatgcccttctcgctgagcagcttctcgaagcctgcctggtcgacgaagtcccggcggaccgggtcctggaggtccttggtccagtcgatccggatcgcgttcttgatgtggttcttctcgtacgccgaggtgtcctcgtccacctcgacgatggcgacctgcgggtcgtcgatgtgggcctcgacccagtcggcgtctaccaggacgtcactgcggctcatgttgttctcctccggggcagtctgcggcggggtggtgcgagatgcggagttgctgggtgcggatgtacgcgcggaggcacggaacgcggcacgtacggggcacggggccggccctgacgacggtcgaagggccggggagaaacgggacggtgcgaacgccccgctcagaaggtgcgacagagcatggcggcgacgcggcacaggtctactgcccgccgcttcgtgaggtccgcctgtcgcttcatgggtccgatcgtagggaggtacgtacggagatgtcaccgtcgtgtcgcatgatgagacacgatcatccgtgatgtgagacagagaaggggcggacaggtgacggatctcgcggggagctccccggaccttccccgcatctgcggaccggacgcaagcgtctcactatccggatcggccggttgaccagggaggccggggcaggtgcggggtgaggtcgggcggtagggcggtcgggtaagcgccgtcggggaggccggcgcggccggtcagcccgtgagggagacgtccgagccggtcacggagatctccaggcccttctccgtcaccttgacctcccggagctccaggcccttcggcagcccgtcgatgtcgccctcgaagtcggtcttcttgcggaccagttcctcgacgccgggaagtccctcacccggcacctcgtccgcgcgcaccttgatcgtctgaccgtcgacgcgggtcacggtggacagcacgctgcgcgagatcggccggccgaggatctcgaccgtgccggtgaccttcgccttgccgttgccgccgtactccacgacgacgccgtcgctggccgccgccgtcaggtcctcgtagctgacgagcgcggtgccggtggcgcgggcggccgtggcgctccggtagccggagccgagcttcacgtcgtgcagctcggcccggacctcgctgacccgtatcgcccgcccggcggcgctggtctccatgccggtgaggctgacgtcgacccggtccagctgcgaaccggcgagctgggtgaggaaggggaaacccttgatcgagatctccgtcgtggcgggcccgccaccgctgatcgtgacccggtcctcggcctcggactcggcgaaccagacggccgcgcggtcgacggcgaggaagaggccgccgagcaccaccaccaggaccagcagtattcgcagtgcgcgcatgtgtcgttcccccaccctgagccgatcggtccccctggcgcccgtgagcctactgccgcaggagagggacgccctggatgatcgacgaccgacggcccccgatcggttcccgaggggccgtcagcggcactgcccgtatggcggtcaggtgcccgtacggcggtcagaggatggcgcggccgaccagatagacggccggggccgccgcggccagcggcagcgccacccctgcggtcatgtgcacgaaccgggacgggtagtcgtagctcgccacccgcagcccgatgagcgcgcaccccgccgccgcgagaccgagcagtgcgcccttcgcgccgaggtcggtcgcattgccggtgacgaggcccgctcctacacccacgagcagggccatggcgagggaggccgcgccgggcagcgggagggcacggacgagcgtggccgccgcgacggacatcccgccgaccaccaccgcgtcc

SEQ ID NO: 3677 - DNA, 1437 bp, Unknown
  Kingdom: Bacteria, Phylum: Actinobacteria, Class: Actinobacteria, Order: Streptomycetales, Family: Streptomycetaceae, Genus: Streptomyces
cacgaaggcgacgatctcgatggctttcgcggtgggcagcggaatccggtccagttcctcatccgtgatcggaaccgtctgctccttggagagctcgtagcccttgccgatctcgtcctgggacagtgcttcgccgtccagctcgcagaccttacgggtgcgcacccgcccgagatcctccaggtggacctggcggaagtggatggagtggtcctgggtcgcggagacgaccttcaccgggatggtgaccaggccgaagctgatcgcaccggtccacaaaggcctcggcattcctacctccatgcccgctgcgggctgatttgccgtgcagttctcaccacccccaccacattctctgcaccattcgtatgtcggcgccatttatggtgctgcgccgacatacggaaaggttgtcgccgacggagctcccccacggcccggcccatcgacacagcgacacatcggcagggcagtgaaaaccaggggcgacggcctccgccggccccatacgtcggccgaacagcacattcacctcggaggagcccaccgcttgcaggtcgcggtaaccgtcacccccacccagatcccggagctccttccggggctcgccaccgtccgcccggtgttcctctggggtgccccgggcatcgcgaaatcctccctcgtgaggaaattcgccgaatccctgggcctggcccggcaggctcgatcgcgatcggcgccggcgaacgcgccaccgacaacgccctggcacgccccatcgccacggcgctcgtcaaccgcctcacccatgtccacctgcgtgcctccgccacccactggctggtgtggacgggcgagaacggcgtccacccctgcgtggtggactacctcgccgaccggcccgaccacctgtggtcgcagccgcccaagaccgaggagccgttccccactccccgctccctggcacatgctctccgacgcgccgcactccttcgggccgacgctggacgaggagacactgaagatcgtggcccacgggacgccgctccccgcccacgccgtctccttctgcgggggtacgccaagatcgtgcgacacacctacggcatcgaggtgatcatcaagggagacgcctcctggcctcgccgcgtcgaggaccgcgacctgctctactacctcgccgaggcgttccggggatggctcgtcaaggatctcccggcacagcgcgagcacgccccggccgccgtgcgcgagacgtcgtaccgcgccaactcgctgctcgtcccactcgccgagatctccgtcgaggtcgcccagactgtcatcgccgaggacgccgacggccacccggtgctgcccgcctggtccctggtggaggccgcccgccacatgccgcgcctggtcgaggcccggcgttgagcaggtcccgcaagcagggcgcggaccgccccgacc

SEQ ID NO: 3678 - DNA, 4628 bp, Unknown
  Kingdom: Bacteria, Phylum: Actinobacteria, Class: Actinobacteria, Order: Streptomycetales, Family: Streptomycetaceae, Genus: Streptomyces
cggtgagccggctcatccgcgccgatctgcgccggggccgggaacgcagcgggcggctccacgacggccgccgctgacggcgcgatcaccccggcccacccccgcacgacccgtacgagagacagcagagaagacgagaaacgcatgacggacaacatcttcgcgacgagcgtgttcttcaagctcgcgatcggcggcagcgacctgggcgcgttccacacctgctccggcctgggcgccgaggtggagatggagacgtacgccgagggcggcaacaacggtttcacctggcagctgccggggcggatcacctggacgaacatcacgctgacccgcccggtgaccgccgacaccctcaagatcgcgcgctggctgaacgagacgatccagcgggtcgagcccaaggacggcgagatcgtggcgctgcgccccgacctcagccggatcatcagctggcaggtgcacggcatcgtgccggtgcgctggcaggggccgtccttcgatccggccaactcccaggcggcgatcgagacgctggagatcgcgcacgagggactggagccctcctgaccggaaccagcgcatccgacaggaaccggacgaaggaaggaggaacgcaatgtcacccgctctccgcgcgagccgcgctcgcgcccagctgaccatcatggaaccgccgtcgaccgtcggcgccaagcccggcgggacactcgcccgtctcacgttgcagttcaaccccgcgaagctctcgctgagcaagagcaccgagtggcggcgcactccgtcccggatggccgggcagtccgcgctgcccgagttcgtcggcagcgggccccgggccctgtcgctggaggtcttcctggacgccaccgccacgcacgacaactccgtggagaaggcggtggagcagttgatgaccgcgtgtgtccccactcccacgagcctggcccgcaagacgcccgccagcccctgggtgcgcttcgactgggggacgtccaagacgacctccttcgacggggtgctctccaacctctccgtctcctacaccctgttcgacgtcgacgggaagccgctgcgcgccacctgctccctgtcgatcgaagaggcgagcgtcgacccggccggacagaaccccacctcgggttcgaaggaggcgcggcgcacccaccgggtcgtggccggggacagcctgccgctgctggcctggcgggagtacggcgacgccaccgcctggcggaccatcgcgcacgccaacgacatcgacgaccccatgcagttgacccccggccgggaactcctcgtgcccgggcgggaagaccacctggccgaggagaaccgatgagcgggaaggaatcccccggccgctccttcgccgccgacccgatcgtcgaggcgcccgccgagctgcccgccgcctgggccacgcagctggtgagctgtgtggtcgacgagaacgtgggcctgccggacaccgccgtactgatgtaccgggaccccgaccacacgttcctcgccaagaccggcatcggcatgggcaccccgctgaagatctcggtggtcaccgtgcaggaccgggcgcgcgagcggctgttcaccggggaggtcaccgcggtcgagctggacaccgacaccaccggatcgttcaccgtcgtgcgggcgttctccaaggcgcaccggctccagcgcggccggaaggtcatggcgtaccggaacatgaagacggcggacatcgtccgcaaggtcgccgccggcgcgggtctggcctgcgggcggatcgaggccgcgccggtcacgtacaagcaggtgacccagccgaacgtgtcggactgggagttcctccagcacctcgcggccgagagcggggccacggtgcgggtggacgacaagggcctgctccagttcaccaagccggaccccgcctcctcggcgccctcgcccgccacctccgccacgcgcaacccgatggtcctggagtacgggaacaacctgctggccctgcgtgcggtgctgacgggtgcggacggggcggacagcgtcgaggtgcgcggctggaacgtggagaccaagacccggctggtggcccgccagcagtccgtccgcagcgacaccgtggtcccggggatgagtccgtcgacggcggcgaagatcttcggctcgggctcccggacgacgatcgccgacaccccgtaccgcacccaggcggagacccgggccgtggccggtgcgctcgccgcctcggtcagcgcaggcttcggggaggtcgaggcggtcgcctacggaaacccccagctgcgggcgggtatgccggtggccctcggcaacgtggggcccgccttctccggccgctacaccgcgaccgccgcgcaccacgtcctcgaaccggacaccggctaccgcacgacggtgatcgtcagcgcatcgccggaccggtcgctctcggggctggcctccggcggcaacgccccctcgcgcggcccccgcatgccgggcctggcgatcggggtggtcaccgacatccgcgaggagggcaggggccaacgcggctgggtacggctgaagttcccgtggctcgacgacacgtacgtcaccgactgggtccgtacggtgcagtggggcggccagggcggcggcggggtgttcagccccgaggtcaacgacgaggtgctggtcgggttcgagcagggtctgctggacagcccgtacgtgctcggcggtctgtacaacggggtcgacaagccgtcgccgcacgacgtcccgctggtcgatccgacgagcgggaaggtcaaccgccgttccctggtgtcccgttcgggcaaccggctggagctgctcgacgctccgcgcgggccgtccggggtacgcatcgccagcggcgacaagcggctcgacgtgatgctcgacgagaagaagggcgagatcacgctgacggtgaaggcccgcggcggcacccgggagctcagctcggtgacgctgtccgcttcgggcatcacgctcgacgcgggcgccacgggcgacgtgaacatcaagggccgctcggtgaccgtcaacggcaagacgggggtcacggtcgacggcgggctgctcgcggtcctcaaggccaagctcatcaggatcaactgaccgcccgtgcgcctcccgtccgccttccgtccgtccgtccgccacgaagcccgacagctccgaagtccctttcacagcaaggagaaccccggccatgccccccgcagcccgcacgggcgacagcaccgcccacggtggcctcatcggcaccccgcccccgggtgcggtggccgtggccaccgtgctcatcggcggccggcccgcggccgtcaccgggagcctccatgtgtgcgtcgtccctccgcacgccgcgctcggtccgggcaacgtgatcatgcccaacccggccgccgcgctcaccggccaggtgctgatcggcggactgcccgccgcccggatgcgggacaccaccagctgcggcgcgcccatcatcagcggtgcgctgaacgtcctgatcgggggcccgatgtgagcggcggcggattcatcgggcgcgggtggggcttcccgctgcgggtcggcccgacgggcgggatcgccctggtcgagcgggaccgggagatcgaggaggcgatcggcctgatcctcggcaccgcgccgggcgagcggccgatgcgaccggagttcggctgcggcatccacgagtacgtcttcgcgcccggcgacggggcgacggccgggcggatcgcgcaggaggtccgcacctcgctggagcggtgggagccgcgcatcgaggtgacggacgtggtgatcgcgttcgacgccatcgaggagggcacgctctacatcgacgtgcactacaccgtgcgggccaccaacgacctgcgcaacctcgtctttcccttctacacgatcccgtcgtcggagggctcttccgagagctcgtccgggaccgctcgggaaacgggagtgcgctgatggcccttccttcgcccaatctggacgaccggcgtttccagcagctcgtcgacgaggccaagcggtacgtgcagcagcgctcccccgagtggaccgaccacaatgtgtcggaccccggggtcacgctgatcgagacgttcgcgtacctggtcgaccagttgctgtaccggctgaaccgggtgccggacaagaactacgcggccttcctcgacctgctgggcgtgaccctgttcccgccggccgtcgcgcgggccgagatcgacttctggctgtccgcgccgcagccggagaccgtgcacctcctcgcgggcaccgaggtcgccaccgcacgcggggaggccgaggagccggtggtgttctccacctccgacgacctgccgatcgtgccgagttcgctggtccggctggtcaccgcgccggtgtcgggcgagcagaccgaccggacgggaccgctcggcgcgggcaaggacatcccgtgcttccaggcccggccggagcccggtgacgccctgctgttcgggctgccgacggccgtgccccggtgcatcgtcgccgtccgcctcgacagccgggtggagggcgtgggcgtcgacccgcgtcagccgccgctggtgtgggaggcgtgggacggagcccgctgggtgacgtgt

SEQ ID NO: 3679 - DNA, 1036 bp, Unknown
  Kingdom: Bacteria, Phylum: Actinobacteria, Class: Actinobacteria, Order: Streptomycetales, Family: Streptomycetaceae, Genus: Streptomyces
ggcgaggaccagcagctcggtgtcgaagaaccagccgctgtcctccaccatcggcagcagccgctcggcgacctcgcgccggaccgccttgaacccgcactgggcgtcgctgaacccggcggccagcgaggagcgcaggatcaggttgtaggcgcgcgagacgaactcccgcttcggcccccgcaccacccgcgaactcctcgccagccgcgagccgatggccaggtcggagtggccggagatcagcggggcgaccagcgggaggagggcgttgaggtcggtggagaggtcgacgtccatataggcgaggacgggtgcctcggacgccgaccagaccgtacgcagcgcccgcccgcggcccttctcctccagccgcgcgtaccgcaccccgggcagctccgcggcgagcgcggcggcgacggcgggggtggcgtcggtgctggcgttgtcggcgacggtgatgcggaaggggtacgggaaggtccgcgcgagatggccgttcaggcgcaccacgcaggggcggaggtccttctcctcgttgtacacggggatgacgacatcgagcacggggacgtcgccggcggtggacgggtcgcgggccgggaggtgctccctgaccggcagacgggtgctgtgcctgccgtccccgctgctgcggccggtcgcgccggggccgctccggaggctgtcggttgtcatgctccgacgttcgccaaccgcgctgtcacaccggtgtgctgagcctgtccccgccctgtgagtccggtcggatcccttgtatctcccgttcctccgtcggcagctcgatcgagaacaccgtgcggcccggctccgagtccactcgtacgcacccgccgtgcgcggagacgacggcctgcacgatggcgagtccgagcccggtggagccggtcgccgtacccgtaccggccccgcgcgagcgggaggcgtcaccgcgggcgaaccgttcgaagacgtgcggcagcagctccgccgggacgccgggcccgtcgtcccgcacctccagcgtgaccggccc

SEQ ID NO: 3680 - DNA, 2555 bp, Unknown
  Kingdom: Bacteria, Phylum: Actinobacteria, Class: Actinobacteria, Order: Streptomycetales, Family: Streptomycetaceae, Genus: Streptomyces
gtgccaccgggcgtaccaggcgtaccgggggtgccaccgggcgtaccaggcgtgccgggggtcccaccgtccttgtgtcccagcttgtccacggcctccttggccttgcgcgtacccgaatcgatcttgtcgctgtatttgcccttggtcttctggtcgaccgtgcgcgcggccttgtcgaggccctgctcgatcttgcccccgtgctgctgcgcgaggtcgccgaccttgtccttggccggccccagcttggccttcaggttgtccaggaaccccattgggtcaccttccgtgcagtgaggactgttcgcgggagcgttctcccgcccccattgtccgtcacctgtccgttcctgccgtttttactcgccttatcgcgcttccccggcgcaaccttgatgtcactctccgcttccgaccgcttccccctggacacccggcatgttcgggagggcccggatatttgggagactgtccgggtgacccctcccgcttccgccccccgcgtcatcaccgtcgtaggccccaccgcagccggaaagtcggatctgggggtctttctcgcccagcggctcggcggcgaggtgatcaacgccgattccatgcagctctaccggggcatggacatcggcaccgcgaagctgacgctccccgagcgcgacggcgtgccgcaccgactgctggacatctgggacgtcaccgagaccgccagtgtcgccgagtaccagcgactggcccgcctggagatcgaccggctgctcgccgagggacgcacgcccgtcctggtcggcggctccgggctgtacgtgaagggtgccatcgacgccctggagttccccggtacggaccccgaggtgcgcgcccgcctcgaagcggagctggccgagcgcggctcgggcgccctgcacgaacgcctcgccgccgccgacccggatgccgcccgatccatcctggcgagcaacggccgccgcatcgtccgcgccctcgaagtcatcgagatcaccggcaagcccttcaccgccaacctccccggcgacgagccggtctacgacgccgtgcagatcggcgtcgacgtggaccgccccgaactggacgagcgcatcgccctgcgcgtcgaccggatgtgggaggcgggactcgtggacgaggtgcgcgccctggaggcgtccgggctgcgtgagggcctcacggcctcgcgggccctcggttaccagcagatcctcgcggtgctcgcgggggagtgcaccgaggaggacgcgcgggccgagaccgtgcgcgccaccaagcgcttcgcccgccgtcaggactcgtggttccgccgtgactcgcgtgtcgtgtggctcggcggcggacaccgtgaccgggaggaactcccgcaccgggcgctgacgttggtcgaacgagcggtcacagcctgatcacgtgatggcatcgggaagctccgcccgtcaattcggcacccgtgatcgtgccatcatcgagcatcgatccaccagtggagtccgagttgggagggcgcgtggcgatggaggccggccctcgcgacacggagcagcgcgacacagagcacgatgtgccgtcaccgcgggagaccgcgggacggctgagtcctgacgggcccgacgagcaggacgtgacccccgaggtcgaggtcgagctgcggcccacccgcaagctgcggatctggcagctcgcgcccatcgtcgtgctggccgcggtcggctcgctgatgttcgccttccccctcgccttcgagttcggcgacggcggcgccatcgtcgccatgctggggctcctgatcagctgctgcgcggccggctggggcatgatggccgcccgccgcgtcggccacacctggccgggactgccctcccgcggttccggagaccgccccgactggcgagtgatcgcgctgtacgtggcgaccggcgccgccctggtcgccctcgccgtctggcgcgtggcccggctgcgctgacggccggacacgcgccgcacccggtccgctcgtgcgggttgtcggcgccgcctcgtacagttggcgtgtgagcacctcgcagatcgccttcctcaagggtcacggcaccgagaacgacttcgtgatcgtcccggacccggacaacgccctctcgctgcccgccgccgtcgtcgcccggctctgcgaccgccgggccggcatcggcggggacggcctgctgcacgtcgtgcggtccgccgcgcaccccgaggcccggggcatggcggacgcggccgagtggttcatggactaccgcaacgcggacggctccatcgccgagatgtgcggcaacggcgtgcgggtcttcgcgcactacctccagcgcgccggcctcgtcgaggagggcgacctcaccgtcgccacccggggcggccccaagcgcgtgcacctcgccaagaacggcgacatcacggtctccatgggacgcgccctgctgcccgaggagagcgtcacggtcagcgtcggcgaccgcgtgggggttgcccatgttgacgttgcgggcgggccagctgcggtcgccgacgctgaccgtgacgct

SEQ ID NO: 3681 - DNA, 609 bp, Unknown
  Kingdom: Bacteria, Phylum: Actinobacteria, Class: Actinobacteria, Order: Streptomycetales, Family: Streptomycetaceae, Genus: Streptomyces
  misc_feature (331)..(395): n is a, c, g, or t
ccccacgtcctcgctcgcctgggcgcagctcgccgacgaggcgttcgagggcggccgggtcgtcgagtcgtacgcgtacgcccgtaccggctaccaccgcggcctcgactccctgcgccgggccggctggaagggccacggccccgtcccgttcgagcacgagccgaaccgcggcttcctgcgggccctgcacgccctggcgcgggccgccgggtcgatcggcgagaccgaggagcacgagcgctgctcgacgttcctgcgggactcctcgccgaccgccgccgacatcctcagctgacccgggtcgtctcccggagcccggcccgcccgnnnnnnnnnnnnnnnnnnnnnnnnnnnnnnnnnnnnnnnnnnnnnnnnnnnnnnnnnnnnnnnnnccgcacctcgacttcgcgggaacgactccgtacgaggactatgtccaggcggatgtcctgacccacctccagcacctgcgctcggacgatcccggcgagatggtcttcctggtcaccacccaggtcatggagctgtggttcacggtcatcgtccatgagtgggagaccgcgacccgcgccctgcgcgaggaccgcatacccgtcgcgcgcgacg

SEQ ID NO: 3682 - DNA, 3107 bp, Unknown
  Kingdom: Bacteria, Phylum: Actinobacteria, Class: Actinobacteria, Order: Streptomycetales, Family: Streptomycetaceae, Genus: Streptomyces
gacggcgacggtcgcgccgtaacgcttggtcagttctcgaagggtgatcacagagctcctcggtgccggtcgtggaacgcggaatcggcggcggtgcgcccacgggccggcccgtggtgctcggctccggagcgggggccgccgcgattcctgtacgaaagcgacgctagaagtccgcggcggcccccgctccggagccgagcaccacgggccggcccgtgggcgcaccgccgccgattccgcgttccacgaccggcaccgaggagctctgtgatcacccttcgagaactgaccaagcgttacggcgagaccgtcgccgtcgacggtctgacactggacgtcaagggtggtctggtgaccggcttcctcggtcccaacggcgccggcaagtcgaccacgatgcgcatgattctcggcctggaccatccctccgggggcgaggcgctcatcgacggcaggccgtacgcgtcgatgcgccacccggtccgcgaggtcggagcgctcctcgacgccaaggcgctgcacccggcccgctccgcccgcggccacctggtggcgcaggcgcgcagcaacggcatcccgctgcgccgggtggacgaggtgctggagatggtcggcctggcgaaggtggcgcggcgctccgcgggggcgttctccctcggtatgtaccagcggctcggcgtggcgggcgcactgctcggcgacccgcgggtactcgtcttcgacgagccggtcaacggcctcgaccccgacggtgtccgctgggtgcgtgagctcgtgcggtccctggccgcggagggccggacggtcttcctgtccagccacctgatgagcgagatgcagctgaccgccgaccggttggtcatcatcgggcgggggaagcttctggccgacaccccgatggccgacctgttggccggcagctcgctgtcgtcggtgcgggtgcgcacccccgacgcggcagacctggccacgctgaccggccatctcctgagggacggcgccgtgagcgtggagtcgcccgccgccgacgagctcgtcgtgaagggccgcagcgccgagcaggtgggcgacctggcccaccggctgggactgcggctgcacgaactgcggaccgtctccgcctcgttggagcaggtctacatggaactgaccgcgcagagcgtggagtacgggacgggcgacacggtgttcggctccacgggtaccgggcggacgcggggagcgggagcatgagcaccgtatcgaccgaggtgagcgacggccgccgtggccgcgcgggctccgaccgcaccggtggcggattcgtcggcgcgttcacctcggagtggaccaaactgtggaccgtccgcacgccgtacgtctgcctgttcgccggcctcctcgtgaccgcggtcttcaccttctactacgggtcgatcgcccggatcaacgacaagccgatccagccggtcggcaacgcgtcggtctcctcggtcgtcctcacccagttcgccctggtgattcttgcgatgacgacggtgacgagcgaatactcgacgaacagcgtgcgcacctcgctgctgtgggtgccggtcaggccccgcgtacagctggccaagacgctgctgagcgccctggtgggcttcgtcaccgcgatggtgtgggccgtgctgggcatcgccctggcctgggggcccttccgggggcacgccgagttcgagctgtcgaaggtggcgtaccaaaccgtcgccatgggcgtgtactccgcgctcatctgcgtgatgacggtaggggtgtcgttcgctctgcggacggcggccggcgccgtggccgtgatcttcttcgtggtgtccgcgctgcccggcatgctggtcggactgggaggtccggtgctgctggccctcaacgcgtacatgccgcagaccgtggggggatatttcatgctgggtgacggcgaggccccgttcccggacgccgtgagtgtgctggtcctgctggtgtgggccgtcgccgcccatgtcgccggtctcttcgtgctgcgccggcgggacgcctgaccaggacggcggaaacgtcccggatcgccctcgccgtggccatccccacgccgggcgttcgggcccgccccacagaatggcccctgacaggtgaggacatccagcgggaggacggccgacgcaccatgctgaacacgcgtaccacctcagccaggtccgcgcgcggtgacgcggctctgtggacggttctcgccgccgccaccggttacgggttccgggacgcgggttcggcgtccctgacgctggacctggtcctccccctggccgtcctggccgtggccgtgccgtggtcccgccgccgcccgggagccgccgtcgtgctggtcaacgggttgtgcgtgatgggcctggccgacgccgcgactcccggcaacgcccacgtcctttcgctggccgccctgagctgtctgctcggcgcccgggtcgccgaggcacggcgcccgctcctggtgctcgccgggtgcgccgcggtcgatctcgcgacgtgcgccgtgctgcgggcgcagcccgtgtggtggttctacgcgctgaccgtcctgcccgcggctctgctgctgccctggctggcgggacggcactggcgtggtcgacgccaactcgtacgggagggatggcggttggcccgcggcctggaggagcggcagcatctggtcgcggaacgggcgcgactgaccgaacgagcggagatcgcggccgacatgcacgattccctcggtcacgccctgagtctggtcgccctgcgcgccggggcgctggaactctcgcccgacctcaccgaccgcgaccgcgccgacctcgccgatctgcgcgggacgatcgcggacgcggtggagcaggtgcgggagaccgtcgcggtcctgcaggacccgcccggcagggacacgagcgcgggcctgccggtcaacgacaccgtcgaggatctcctctcacgggcggtcgccgccggagtgccggtgcgctgggagcggcgcggggcgtcgcctcccctgtcctgtctggtcgagcgcgggatgtaccgggtggtgcaggaggccctcaccaatgcgacgaagcacgcgccggcctgtt

SEQ ID NO: 3683 - DNA, 3193 bp, Unknown
  Kingdom: Bacteria, Phylum: Actinobacteria, Class: Actinobacteria, Order: Streptomycetales, Family: Streptomycetaceae, Genus: Streptomyces
ggggcggccggtccgggaggcggcagcggaggcagcggcacggactccaggtcgaggtcgtccgcggctccgcgcgggcccggtatccggcgggcgccgcgcacctcctcctcgcctccctcgctctcgcgtccgtcgccactcaccgggcccgtccgtaaccgggtggcgaggtcccttcgagcgggcgggtgttcgccgtggagagcagttggaggcccagccggagccggcggcgcgcctcgtcctcggtgaccccgaggtcggcggcggtctgccggtagtcccggcggtggatgtacgccagctccagggcctgccgcagcggtgcgggcatcgaggagacgatgtagtcggcgcgggcggcggccgtggcgctgagcacccgctgctccagctcctccgggtcgggcgccgcgccctcgccgtgctccggcgtgtacgaggaggccgccgcgcggcgcagccgctggacggaccggcggtgggtgaggcgggccacccaggagcgcatcgatccctgcctcgggtcgtacgcctcggggttctcccagacctgggcgaagacctcgcgggtcaccaggtcggcggcgtcctcgtcgtcgagcatccggtgtgcctggctgtggacgagcgccgcgaaccggtcgtagagctcgccgagcgccgccgcctcgccgcgggccagcctctgctgcatcctgcggtcccagcggggtgctgtctccttcgccatgaaccccccagcccccggccctgtcccccggctccgtgatccaccctgtgcccgtgaggaccgaatgtagtccgccgggcgtgcggcgcacgcgcctttgcggcaactctcttcccgcggcgcgtggccgacgacggtagtcgattttcggcctgtgtgcctccccggccgctctgagcagcggaaacggtccgaagcgctcctttctatcggaaatctcctgggcgtcggtcggcgcgtcggtgtttcatgggggtgcggtggggcagccgcgaggaggaacggaaacttccggattgccgggagccccggaacgagaggtccagtcgcgtgacgctgaaggtggacgaggcggagcagggctcctggaccgtgctgcgcatgagcggcgaactcgatctggtgacctcgcccgtggtgcgccagtccgtccacgaggcggtggcggaggggcagcacgatgtggtgctcgatctgtccgaggtgttcttctgcgactccagcggcgtcggcgtgctgatcgcctcgcgccggctgatgaagtcctgcggaggccgcctgcggctgattctcccggcccggggcgcggaggacggttcgcacgtcaacaaggtgctcggggcgctcggggtgcgccggctgttcgacgtctacccggacgcgcggtccgcgaccgacgaggagtgcaggccgctgagcgcctgaagcggctgcctccgatgcgaggttgtcacacaggaggcgctgctcggtgacacgtgagcgctccgggcgtcgtacgctccccgcatggacagcgcagagtacgagcgaaagatcgcgcaccgcttcgccgccttcgaccaggacggcaacggctatatcgaccgtgccgatttcaacgccgcggcggcccgtctgctcaccgagttcggaacgacggcccgctgcgacaaggggcaggcgctctacaccggtgccgaggccttctggcagggcatggcggggatcgccgatgtggacggggaccagcgggtcacccgtgaggagttcgtgggcggggcggtgaagcggctccgggacaatcccgggcggttcgccgagatcgcccggccgttcctgcgggcgaccatcgcggtcgcggacagcgggaacgacggcagggcggcggtggcggacgtggagcgggcgctccgggtcctcggagccagtgccgagatcgcgaacatcgccgcccagagcctggacacggaccgggacgggctggtggcggagagcgatgtggtggcggcgttcgccgtgtacttcacggtgatcgagcccgacgcgtaacaacccctggcgttacggggacggcgcgccgtccccgtaacggctgcgtcacccggccgatgcccgcctcacccgcctcacccgccgaaccgttcccgcagccggtacttgagcaccttgcgcagcgtctcgttgcggggcagcgcgtccaggagctccagctgctcgggcaccttgtggacggacaggcccgcttcccgcagatgggcggagagcccggccagggtcaggggcggggcgccgggcggctgttccaccaccgcgcagacgcgctcgccgcgttcggcgtcggggagtccgatcaccgccgcgtcggcgacggcggggtgtgtgtggagcaggtcctcgatctccttggcggagatgttctcgcccttgcggatgatgatgtccttcagccgcccggtgagcgtgaggtgtccgctctcctggagccgtcccaggtccccggtgatcaggaacccttcggcgtcgaacgccgcggcggaggccccggcgtccagatagccgcggcagacggcctccccgcgcagccgcacctcgccctcactgccgtacgggagcggcttgccgtgctcgtcggtgatccggatctccatgccctccggcggccgtccctccgtcagggccaggtggccgggggtgtcgtccggagcgcccatggtgatcatcgggacctcggtcatgccgtaaccgtgggtgagctggacccccatctcccgcaccaccgcgtggtagacctccggcggcttcggcgctccgccgcccgccagcagacggagggtcgggatgagcggccggtccggggccttgcgctgctcggccaggaacatcgcgtagaacgccgtcgaaccgcccgccacggtcaccccgtgccgccggtactccgccagcgcgtccggcagtgcgaactgctcgaacatcaccgccgggaacccgtacagcagcagcatcaccgtgtagtcgggcccggcgacatgggcgtacgggaacgccatcgatcccacgtcgtccgcgagcagcttcagggcgtgggcgaggcaggagccgcccgcgatcagggagcggtcggtgtgcaggacgcccttggggtcggaggtggtgccggaggtccagtagatccagcggacctcctcgcccgacgag

SEQ ID NO: 3684 - DNA, 1152 bp, Unknown
  Kingdom: Bacteria, Phylum: Actinobacteria, Class: Actinobacteria, Order: Streptomycetales, Family: Streptomycetaceae, Genus: Streptomyces
cggcaccgccccgccgggcggaggcagtcacaccgccagggcctccttccggcggggcggtgccggtcgcggcggccctggccgccgcgacctccctcagagtgcggacaggtagtccggtacgccgatggccggatccatgtcgtccgcggggaccggcgccgcgtacccccgggtgagcggcacgatgccggtccagtgggggagggcgctgtcctcgggctcgtcgttcggcccgccggcgcggaccttcgcggacacttcgttcaggtccagccggatcaccgccgtcgcggcgagttccttggcgttggccggccgggagtcgtgggaacggccgggcacgacctggtccacgatcgcgtccagggccagccgtcgctcctcggggtcggtcaccgtcacggccgtgccgtgcaccaccaccgagcggtagttcatcgagtggtggaaggcggacctggccagcacgagggcgtcgacatgggtgaccgtcagacagaccggcagccccgggtcggcgctcctcgccgagcgcagcggtcgtgagcccgtcgagccgtggacgtacagccgttctcctatccggccgaagagggtcggcaggacgaccggggcgccgtcgcgcacgaagcccaggtggcagaggtaggcctcgtcgaggatggagtggaccagttcgcggtcgtaggaggcgcgctccttggaccggctgggcaccgtgcgatcggtaggaaggtagggggcggcgacgccggagcccgtgtcgtcgggcggtgcggtgtgctgcattgcttactccattgcactagtgcatactattgtttgtgctaggagagtatcggatcagtgggcggcgcgcatcggagattgccgccagtgtggagcgcggggtcagctccggagacctcccgccgggtcatgtgctgccacccatgcgggagttggcggcacgcctggaggtcaatcccaataccgtggccgccgcctaccggacgctgcgcgagcgcggcgtgatcgagacggccggacgccgaggcagtcgggtgcgtccggcccaggtcggcgcgtcgcgcggttcgctgcggatcgacgcgcccccgggcgtacgcgacctcggcgagggcaatcccgatccggagctgctgcccg

SEQ ID NO: 3685 - DNA, 1061 bp, Unknown
  Kingdom: Bacteria, Phylum: Actinobacteria, Class: Actinobacteria, Order: Streptomycetales, Family: Streptomycetaceae, Genus: Streptomyces
  misc_feature (642)..(643): n is a, c, g, or t
ctggtggagtggtcctgcgccgcggccatccggggaccggccagacggtacgggcaggacgccgagcggcggctgcgcgaggcggcggccgggtgcggccgggccagggtcctggatccggtcgcggccgagctggtgcgctaccgggaagtgcgcgagcggtacgtgacggtgacggagttctccacaaccggccggtagtccacaggccccgacgcgattcccgcccggcatccaccatggagtccgcacccaccggcgtccggagaggtacgagccgtgcgacgcggtacgagcggtgcgatccggtacgacaaggaaagcgggggcgggaaatgaacgagaccctggtgacactggtgggtaacgccgcgacggcggtggagttccgtgagacggccaccggcggaatggcgcgattccgtttcgcggtgactccgcggcgctgggaccgcgagaaacagctctgggccgacggccgcaccagcttctacaccgtctggtcctggcggacactcgccgtgaatctggccggttccgtttcggtcggagaacccctcgtcgtgcacggccggctgaaggtccgtgaggaggaacaggccggtcagcgccggacgttcgtcgacgtcgaggccgtcgccnncggagcgtccggagcgcgtcacggacggcgatgcgcaggagtcaccgaaacagcggaaacgcgacagcgcaatggctgcggtgtcctgaaaaggttggtcggagacggcatcgcgcgataacgattccgattcggaatggttgtgcaagggcagtacgggggactgcccttcgcccgttctttaggattcccagtgctcacgggtcacttgggtctgctggcgaggcattccccacacgcgcaccatgcgcgagggtctcgcccggaggggaattctgtgttttctgcgtcttcagcgtccgctgcgccgttcggcacgacaggggcgccccccggccgcgggatcctccgcccggccgccgcgctgctgctctccggtctcgtcgcggctgccgcactcgtcggcgccggaccggcg

SEQ ID NO: 3686 - DNA, 2877 bp, Unknown
  Kingdom: Bacteria, Phylum: Actinobacteria, Class: Actinobacteria, Order: Streptomycetales, Family: Streptomycetaceae, Genus: Streptomyces
gatccgggacaggtcgagtccgggcaggaacgcgggatcaggatcgggcggcgtcatacggtcactctgcggagtgcgggcggagcgagccagccgttttcccggcgcgtgcgaccgggtggcgagcccggggcgggccgggcgatccggcccccgcgtcagcccttctccgccgcctcccccagcggcctccggtccaggatccgggccgtcgcgtccgcgtccaggtgggcggtgccctcctcgccggtcaccgtgacccggacccgggggcccactcccgtgctcgcgcccggcgtcacgtcgatgcgccagctcttcgggtcgcgtacgcccagggtcgtgcgggcctcgtggaccagcgcggggaacagttcgtacgggagcatctggaggtgcaccgtctcgccggccggacgggaggagtcgccgcggatctccatgcggcgctcctcgatgacgatcgcggtgacgtccgcggtgcccgccctggcctccagttccgcggccgtctcccgcatccggccgaggaccagcagcgaagtggagggaccggagaccgtggtggacgtggtgaacgtccgggaggaggaggcggacgaggtgaccgagggccgcttcgacgacgatccctcatcgtccccggacgtgaacagctcgccccggaagaggagcaccagcagcgccgctcccgccaggaacgtgaagagcaccagcaggcaccaggaaccctcgctcatccccggcttctccaccagcgtggactcgggcgcggagtcgatctccgcctcctcggcccggcggctccactccggggtcggacgggtgacgatccgcacctcccagggctcgtccgggcggtactccacgacggcgatggagcgcggccggtagacagggatgtcgaccaggttgatgtgctgggtggtgtccacgcggtacgccggccggccgtcctccggctccggcgccacggtcagccggaaatccaccggtacgtcggccatttcgccgctcgtcgcccgcaggtcctcgatccgggcgagggcggtccgggtgaccggcggcacgacgggccccgggggccgccgcccggcgacgaagccgatcaggatgaggaggaccaggactccgccgccggagaggaagaccgggacccgctccaggatcacgccgaccaccagggccgcgatcgccgccccggtcacccccgatgtgacggtcaggcgcagcccggcgaaaatccggctcacgaccgaacgcccgtgaccagcctgcccgttggcctcggccgagtcttgcgcggccgcgccctgccccgtcttccccatgaccgtgattgtgccggtcgggagcgatccggggcagggggcggcggaagaaatacgacgaggtcagtcctcgccctccaggttcccttccgtctccaggtacacctggcgcagcgcgtccagcaccgccgggtcgggcttggcccacatgccgcgcgattctgcctccaggaggcgttccgcgatgccgtgcagggcccaggggttggcctcctggaggaactgccggttctccgggtccaggacgtacgtctcggtgagcttgtcgtacatccagtcggcgacgacgccggtcgtggcgtcgtacccgaagaggtagtcgacggtggccgccagctcgaacgcgcccttgtagccgtggcggcgcatcgcctcgatccacttggggttgacgacccgggcccggaagacgcgggacgtctcctcgaccagcgtccgcgtgcggacggtctcgggacgggtggagtccccgatgtacgcctccggggccttgcccttgagcgcgcgcacggtggccaccatgccgccgtggtactggaagtagtcgtcggagtccgcgatgtcgtgctcgcgggtgtcggtgttcttcgcggcgacctcgatgcgcttgtaggcgctctccatctcctcgcgggccggacggccgtcgagctcgcggccgtaggcgtagccgccccagaccgtgtagacctcggcgaggtcggcgtcggtgcgccagtcgcgggagtcgatgagctggaggagacccgcgccgtaggtaccgggacgggagccgaagatccgggtggtggcccggcgttcgtcgccgtgctcggccaggtcggcctgggtgtgcgcccgtacgtggttctgctcggccggctcgtccagcgaggcggccagccgcacggcgtcgtcgagcagcccgaccgtgtgcgggaacgcgtcgcggaagaagcccgagatgcgcagcgtcacgtcgatacggggacggcccagctcctcgtacgggatgggctccaggccggtcacccggcgcgaggcgtcgtcccagacggggcggatgccgagcagcgcgaacgcctccgcgatgtcgtcgcccgccgtgcgcatcgcgctggttccccagagggagaggccgacggaggtgggccagtcgccgttgtcggtgcggtagcgggtcaggagcgagtcggccagcgcctgtccggtctcccaggcgagcttggaggggaccgccttcgggtcgacggagtagaagttgcgaccggtggggaggacgttgaccaggccgcgcaggggtgagccggacgggccggccggaacgaaaccgccgttcaacgcgtgtacggcgtgcgtgagttcatcggtggtggccgccatgcgcgggacgacctcggtggccgcgaaggtgaggatgtcggcgaccgcggccggcagcccggcggcgacaccggcgacggccgccgggtcccagtcggcgtcgtccatcgcctggacgagcgcgcgggcctgctcctcgatcgtgtcggcggcggtgcgggtggcggcggactcgtcgagcccg

SEQ ID NO: 3687 - DNA, 643 bp, Unknown
  Kingdom: Bacteria, Phylum: Actinobacteria, Class: Actinobacteria, Order: Streptomycetales, Family: Streptomycetaceae, Genus: Streptomyces
  misc_feature (430)..(431): n is a, c, g, or t
cggtggagcgcacgctctacccgatcctgctcttcgcccaggtcgtgccgaagatcgccgtcgccccgctgttcgtggtgtggctcgggttcggcatcgcacccaagattctcatcgccgtgctcatcgccttcttcccggtggtgatctccatggtcaccggactcaaggcggtcgaccccgagatgctccaactgtccgccaccatgggggcgaagccctggcagaccttcgtgaagatccggttcccggcgtccttgccgcacctgttctccgggctgaaggtggccgtcaccctcgcggtgaccggtgcggtcgtcggcgagttcgtcggggcgaacgagggactcggctacgtcatcctccaggccaacggcaacctcgacaccccgatgctcttcgcggggctgctggtgatgtcgctgatcgnngccgagaaactgctcctgccgtggcacgccagccgccgtgagtcctcgtctgtcaccacgttctgaatccccgtcgcgagaagggccagcccatgcatgcgcgcagactcctgatcggtgtcgtacccctcgccctggtggccgccaccgcctgcggcggcgaggacgcgtcgaccactaccagtgactccggcaagaagctggacaaggtc

SEQ ID NO: 3688 - DNA, 4073 bp, Unknown
  Kingdom: Bacteria, Phylum: Actinobacteria, Class: Actinobacteria, Order: Streptomycetales, Family: Streptomycetaceae, Genus: Streptomyces
cggggccggtcggcacacgatcccggccattcccacgctccttccaccggcgcactcccctccgcgcccccacagggtgtcgccggttcaccgacgactagtagggtgacgaactcgggggcccactgcaccggttcgagaggtggggatacgggaagatggctgtcggcatgagctcgccgcgaccggcgcacaccaccgcaccgcgcgctgcggaagagaagccggacgggtcggcggccggtcctgacggcctcggcacaggcctcgacccggacgaccttcccgacggtctcgtcatcgccgacgagagcgggcacgtcgtctgcttcaacgccgccgccgcccggatcaccgccaccccccgcgccgacgcgatcggccgccctctggagaccgccctcccgctggaggacctcaaggggaagcgctggtggaccctgaccgacccgtacggcggtctcgccacccgcaacggccagcccgagcgcaacctgctgctgcccggcggccgtgaggtgctggtctccgcccgttacgtacgcgagcggccgaccggaccggtgcgccgggtcgtcgtctcgttgcgggggaccgaggcccgccgccgtaccgaacgcagccacgccgagctgatcgccaccgtcgcccacgagctgcgctccccgctgacctcggtcaaggggttcaccgccaccctgctcgccaagtgggagaggttcaccgacgaccagaagcggctgatgctggagaccgtcgacgcggacgccggccgggtcacccggctcatcgccgaactgctcgacatctcccgcatcgactccggccgcctggagctgcgccgccagcccgtcgacatcgccgccgctgtcgcccgccacatccaggccctcaccgccggaggccaggcgcccgaccgcttccgtgtccgggcccgggggcccctgcccgccctgtgggccgaccccgacaaggtcgaccaggtcctcggcaacctcctggaaaacgcggtgcgccacggcgagggaaccgtcaccattgagatcgccccggcacccgcgccggggacgaacgacgagacgggaacggctgtcaccgtgagcgacgaaggccccggcatccccgaggagtcgatgggccgtgtcttcacccgcttctggcgggggagcaagcgcggcggcaccggcctgggcctctacatcgtcaagggaatcgtcgaggcccacggcggcaccatcaccgtcgaccgggggcccggcggcggagccgagttccgatttattctgcctgtgagcatgcccgcctacctggtgtgagcagcccacgggctccccgaccgtcctgcggcctttagactcgacctttggcacctttgcgtcctccagtcgtcgagcggggtcgcgccaccagccaatcggaagcacgggaagagatgtcggcaccgaacaagtcgtacgacccagtcgaggtcgaggcactgaaaccggaagagatcgagcgcctgcgggacgaggcgttcgccgccttcgccgccgccggcgacctcgacgcgctcgcccaggcgaagaccgcgcacaccggaggtacctcgccgctgtccctcgccaaccgcgagatcggcgctctgcccccgcaggccaaggccgaggcgggcaagcgcgtgggccaggcccgcggagccgtctccaaggcgctcgccgcccgccaggcggagctggaggccgagcgggacgcccgggtgctcgtcgaggaggccgtggacgtcacgctgccctacgaccgcactccggccggcgcccgccaccccctgacgaccatcatggagcgcgtcgcggacgtcttcgtggccatgggctacgagatcgccgagggccccgaggtcgaggcggagtggttcaacttcgacgccctgaacttcgtgcccgaccacccggcccgccagatgcaggacaccttcttcgtacagggcaccacgcccgacgggaaggcgaccgagggcgacgagtccggcgtcgtgctgcgtacgcacacctccccggtccaggcccgctcgctcctggagcgcaagccccccgtctacgtggtctgccccggccgggtctaccgcaccgacgagctggacgccacgcacaccccggtcttccaccagatcgagctgctcgccgtcgacgagggcctcaccatggccgacctcaagggcaccctcgaccacatggtccaggcgctcttcggaccggacatgaagacccggctgcggccgaacttcttcccgttcaccgagccgtccgccgagatggacatggtctgctacgtctgccgcggcgagtccgtcggcaacccggaccgcccctgccgcacctgcggcagcgagggctggatcgagctcggcggctgcggcatggtcaaccccaaggtgctcatcgcctgcggcgtcgacccccagaagtacagcgggttcgccttcgggttcggcatcgaacggatgctgatgttccgccacaacgtcgaagacatgcgagacatggtcgagggtgacgtccggttcacccggccgttcgggatggagatctgatgcgcgtcccgctttcctggctgcgggagtacgtcgacctgccggcgaccgagaccggccgtgacgtacaggccaagctcgtctccgtcggcctcgaggtcgagaccgtcgagcagatcggtgcgggcctcaagggccccctggtcgtcggacaggtcctgaccatcgaggagctggagggcttcaagaagcccatccgcttctgcacggtcgacgtcggcacggccaacggcaccggtgaaccgcaggagatcgtctgcggcgcccgtaacttctcggtcggcgacaaggtcgtcgtggtccttccgggcgcggtccttcccggcgacttcgcgatcgccgcccgcaagacgtacggcaagacctcgcacggcatgatctgctccaccgacgagctcggcatgggcgacgacggaacgcacggcatcatcgtgttgccgccggagcacgaggtcggcaccgacgcgatcgagctgctccagctcgtcgacgaggtcctcgacatcgccgtcaccccggaccggggttactgcctctcgatgcgcggagtcgcccgcgagaccgccatcgcgtacgggctgccgctgcgcgacccggcgctcctggacgtgcccgcgccgaacgcgtacggctacccggtcaagatctccgagccgtctcgctgcgaccggttcaccgcgcgcaccgtcaccggtctccagccggaggcccgctccccgatctggatgcggcgtcgcctccagaaggcggggatgcggcccatctccctggccgtcgacatcaccaactacgtgatgctggagctcggtcagcctctgcacgtctacgaccgcacccgggtcgagggagcgatcggcgtgcgccgcgccgcgcagggcgagaagctcaccacgctggacggcaccgtgcgcgtgctggacgccgaggacctggtcatcaccgacgaccgcgggccgatcggcctcgcgggcgtcatgggcggtgccaacaccgagatcgccgacgcggacggcgagcacgcccccaccaccgaggtcgtcatcgaggccgcgcacttcgacgcgatctcgatcgcccgcaccgcgcgccgtcacaagctgtcctccgaggcgtccaagcgcttcgagcgcggcgtcgacccgcaggccgccgccgctgccgcgcagcgcacggtcgacctgctggtactcctcgcgggaggcaccgccgaggccggggtcaccgagatcaccgccccgtcggcaccgcgcaccatcgcgatgccggcgaaccacccggacaaggtggccggtgtggagtacggccgcgagaccgtcgtccgccgcctccagcaggtcggctgcgacgtctacgggcaggacgagctgatcgtcacggtcccgtcgtggcggcccgacctgaacgagccgaacgacctcgccgaagaggtcatccggctggagggttacgagaacctgccctccaccctgccgacgcccccctcgggccgccacgacgggac

SEQ ID NO: 3689 - DNA, 944 bp, Unknown
  Kingdom: Bacteria, Phylum: Actinobacteria, Class: Actinobacteria, Order: Streptomycetales, Family: Streptomycetaceae, Genus: Streptomyces
ccacccgggcggctaccgcgaactgtccggacgcgaggtggaggtgctccgcctggtcgcggaaggccagtccaacaaggccatcggcgtctcgatgggcctctccgccctgaccgtcaagtcccacctcgcccgcatcgcccgcaagctcggcaccggggaccgtgccggaatggtcgcggtcgccctgcggacgggcatcatccactgaccgcaccccgccgggacgtgcaccgatgcgcctccggctggaatacgcgcatggccgcccgtcgacggaacgttccgtcgacgggctccgcgcatacacagatacccttgacacgtgaccgacgcccaagagaccgcagcagacacttcactgcgaaccaccgggggcgctcccccggacgacgtcgccccggcgccgatccccttgctcgaaccgcgcgagggcattcccccggtggtgacgtccgacgacgccctcgccgaggtgatcgcggccttcgcggcgggcaccggcccggtggccgtcgacgccgagcgcgcctcgggatatcgctacggccagcgcgcctacctcgtacagctgcgccgcgagggcgcgggcagcgccctggtcgacccggtcggctgccccgacctctccggcctcggctccgcactgtccggcacggagtggatcctgcacgcggcgacccaggacctgccgtgcctgcgggacataggcatgacccccacctcgctgttcgacaccgagctggccggacggctcgcgggcttcccgcgcgtcggcctcggcgcgatggtggagaacgtcctcggatacgccctggagaagggccactccgcggtcgactggtccacccgcccgctgcccgagccctggctgcgctacgccgcgctcgacgtggagctcctgatcaacctgcgcgacgcgctggaggaggagctggagcggc

SEQ ID NO: 3690 - DNA, 1139 bp, Unknown
  Kingdom: Bacteria, Phylum: Actinobacteria, Class: Actinobacteria, Order: Streptomycetales, Family: Streptomycetaceae, Genus: Streptomyces
gaccggagcggtcacccggctgctccacgcggggtgggccgcggctccgggagcccgcttccggctggacacgcccccgggggtgcggatcaccgtctccccgctgaccgcggcggacatcggacccctggcggacgcggtggccgcagccgccgggcccgcacggccggtcagctacggctgagaccggccgtgtccggcgcgtcggctcggcccgccgcgggctgcggtgcggcggcggccggacgtcccgggggctccggcgtcgcggcagggcgtgcccggctctgggtgagggccgccccgacgaggacgatcagagccccggccggggtgttccagctcagctgctcgccgagcagtgcgacgcccgccgccgtcgcgatcaccgggatgaagtacgtgaccatctgggccgtcgtcgggccgacctcctggaccaggccgtactggagcagtaccgcgaggcccgtgcccagcgcgcccagggcgagcaccgagagggtcgggagcagcgggaaggacgtcggagccgaggtgaacagcggtgtcaccacagccagttgcgccgtaccgagaaagagctggctgcccgtcagcgccagtgtcgacgatccggttccggacagggtgcggcggacgtagatccagccgaccgggtaacagaacgaggcgagcagcgccatgcccgtccccggcaggtccaggccggagaaaccctgccaggcgcccagcaccgtgaggacgccgaggaagccgacgccgagaccggccacccggcggcgggtcgggcggtcctccgacagggcgaccaccgagagcgccatgccccacagcggcgaggtcgcgttgcagatcccggccagcgtcgaggggatcgtcagctccgcgtaggagaagagcgagaacggcagcgcgttgagaaggagcgccgccaccgtgaggtgcccccaggtccgggcggagcgcggcagccgctcccggcgcatcgccatggcggcggccagcaccgccgtaccggccagcagccggccgaaggtgacctggaacggggcgtagccctcggtcccgaccttgatcagcagaaagctgaacccccagatgagcgagagtcccgcgaaccggatccgccagtcgag

SEQ ID NO: 3691 - DNA, 1667 bp, Unknown
  Kingdom: Bacteria, Phylum: Actinobacteria, Class: Actinobacteria, Order: Streptomycetales, Family: Streptomycetaceae, Genus: Streptomyces
gcccgagccccgggaggacgacggccgccccaagcggttcgcctacccgccgcagctcgtcgtcgtcgacggcgggcagccccaggtcgccgccgccaagcgggccctggacgagctgggcatcgacgacatcgcggtctgcggcctcgccaagcggctcgaagaggtctggctccccgatgacgacgatcccgtcgtcctgccccgctccagcgagggcctctacctcctccagcgcgtccgggacgaggcccaccgcttcgccatcacctaccagcgcgccaagcgcgccaagcgcatccgcagcagccccctcgacgacgtgaccggcctcggcgagacccggaagcaggccctcatcaagcatttcggctcggtgaagaagctccggcaagcgacaatcgacgagatctgcgaggtccccgggatagggcgaaggacggcggaatcggtggccgccgccctcgcctcgaccgctcccgcggcacctgccgtgaacacggccacaggggagatcattgaagaggacgacgggggcagctcatgaccgagaacagccacgagaccgcacggaacagcgcggcgcacgagaccgcggaccgagacatcaccggccgggacagcaccgaccgggatgtcaccgaccgagacaccgcagaccgagcagacggagcagcagacgtgagtacgaacaccccgaacgagacgggtgaggcggccatccccgagctggtgatcatctccgggatgtcgggcgccggccgcagcaccgccgccaagtgtctggaggacctcggctggttcgtcgtcgacaacctgccgcccgcgctgatccccaccatggtggagctcggcgcccgctcgcagggcaacgtggcccggatcgccgtcgtcgtcgacgtgcgcggccggcgcttcttcgacaacctccgcgagtccctcgcggacctggaggccaagcacgtcacccggcggatcgtcttcctggagtcctccgacgacgccctcgtgcgccgcttcgagtccgtccgccggccgcaccccctccagggcgacggccgcatcgtcgacggcatcgcggccgagcgcgacctgctgcgcgagctgcgcggcgacgccgacctggtcatcgacacctccagcctcaacgtgcacgagctgcgggccaagatggacgcccagttcgcgggcgagtcggagccggagctgcgggccacggtgatgtccttcggctacaagtacggcctgcccgtcgacgccgacctggtcgtcgactgccgcttcctgcccaacccgcactgggtccccgagctgcgccccttcaccggcgtcaaccaggaggtgtccgactacgtcttcgaccagccgggcgccaaggagttcctcaaccagtacaccgagctgctccagctgatcgccgcgggctaccgccgcgagggcaagcggtacgtgaccatcgccgtgggctgcaccggcggcaagcaccgctccgtcgccatgtcggagaagctctcggcccgcctcgccgccgaaggcgtcgagaccgtcctcgtgcaccgcgacatggggcgagagtgaccggacgcaacctgcggatgcgacgcctgagccgcgccacctcggcgctctccggccgcaagcgcggtgctcagcccaaggtcgtcgcg

SEQ ID NO: 3692 - DNA, 660 bp, Unknown
  Kingdom: Bacteria, Phylum: Actinobacteria, Class: Actinobacteria, Order: Streptomycetales, Family: Streptomycetaceae, Genus: Streptomyces
gagccggctccgtacgggaggtgagccggctccgtacgggaggtcacggcaccttcgggccgcccagatagcgtcccttcgcgtcgtacggccaggcgttggcgacgcagcccttcagcccgtcgatctgctgcatcatcgcgggcgcgggccggcccttccccgggcaggtctcatggccgcgccccagccagtggccgacctcgtggttgacgatcagtgcccggtactccgagacgggtccgtcgaactgcggcgaaccgagctgccagcgcttcaggttgaccatcaccttctcgccaccccggcagttgacctcgccgcgcgtcttgaggccgtactcgccgcagatccggtccgtggtcgccggggtggcgatcttgatcaccagtccggccggcccgtcggcgacctggcggaaggcgtgctcgccgccgtggctccagccgcgcgaatcggcgagtacggcggcgatgtcctcggcggcccggtcggggtcgaccccggtgccgtcctccacctcgacccggtaggcgctccccttgcccttcgcgtcgacccccgcacgggccacggtgaacgtgcccggacccgaggcggggatgtcctcggcccggacgccgtccttcttgcccgaggccgaggccgaggcggaagcgg

SEQ ID NO: 3693 - DNA, 6551 bp, Unknown
  Kingdom: Bacteria, Phylum: Actinobacteria, Class: Actinobacteria, Order: Streptomycetales, Family: Streptomycetaceae, Genus: Streptomyces
gatcatcggcggcccggtcgccgcgttcgcggtcacggcgggcgacgaccgcggcggcggaccggtggccgccgacccgcatcccaccagcccggccgaggacgccttcttcgagcacatgacggagaaggtttcggcgaccgaccccaccacccgggtcggcgcgaccgtcggcatggaggagaagacctggggcacgcacacggtcctggagctgaagaacgtcaagggaccgcagaagtgcaagctgatcgccgtctccaggaccggtgaggaggaggtcgtcacctcctggtccgtcccgcagtgggggtacggcgtcgagggcgccacgaacccgacggcgaagtccccgctgtacgtgcacggcggggcggcgatggaccgcgaggacatcgaccgcttcgaggtgcggaccttcgacggggagcggctggtggagatcggagcctgagccgcgctcccgtcgcgcgccgtcgcgacgcgacgcgcgatcgcccccggccgacaggtgcgctcgggccccccttcgctatagggttgacggctgcccagtgcacgtcagaagggggcctcggtggccgcgcaggatgccgctgtcgaatcgctgcgggaccgggaaatcggtgtcgagcaggagcatctcgaccgtgtttatcaccgcctcgaagagaagatccacgaggcggaatttctcatgaacgacgccgtcaagcgcggccaggtcggtaccccaggcgcgctcgcggagcgggacgcccaggtgttccgggcggggatccacctcaaccggctgaacagcgagttcgaggacttcctcttcgggaggatcgacctgctgctcggcaaggacggggagcgcggcccggacggcgcgtacacctcggtcgagccggccgacgacaccgtacgggaggacgccaccgccgatatcgcggagacgctccacatcggccggatcggggtcctggactccgactacgcgccgctggtgatcgactggcgggccccggcggccgctccgttctaccggtcgaccccgaaggagccgggccgcgtcgtccgccgccgggtcatccgctccaagggccgcaaggtcctcggcgtcgaggacgatctgatgcgcccggagctgacggcgttcctggacggcgagaagctgccggtgatcggggacggcgcgctgatggcggcgctcggccaggcccgcagccacaccatgcgggacatcgtctcctccatccaggccgaacaggacctggtcatccgggcccccgccgcctccgtcaccgaggtcaccggcggccccggcaccggcaagaccgcggtcgccctgcaccgggcggcgtatctgctctaccaggaccggcgacggtacgcgggcggcatcctggtcgtctcgcccaccccgctcctggtcgcgtacaccgaaggggtgctgccctcgctcggcgaggagggccaggtcgcgatccgcgcggtcggctcgctgtccgacgacgcggcgggcctccagggcgcgacgacgtacgacgaaccggccgtggcccggatcaagggctcctcccggatgctccacgtactgcgcaaggccgcccggggtgcgctggaacagggccggcccgcggcgccgcgcgaagaggcgggccagctctccttcggcgaggagcccgaacagcgcgctgcggcgacgaccccgaaccggcttcgcgtcgtcgccttcggggcccgggtcgagctggaggccgacgagctccagcgcatccggcacaacgcgctgggcggcaccgccccggtcaacctgctgcgcccgcgcgcccgcaagctgctgctggacgccctgtggagcaagtcctccggacggggcaggtacaccgacccccagctggtggcggagctgcgctcgtcgttcgacgaggacgtctccaccgagaccccgttcctggagttcctcgacgcctggtggcccgaactgacgccacgccgggtgctggccgcgatggccgacgagcggcgcctcggccgctggtcccggcgcatcctcaaccagggcgaggtgcgccgcctggcccggtcgctgaagcgtctcgacgcggacggccaggggccgctctccgtccacgacgtggcgctcctggacgagctccaggcgctgctgggcaccccgaaccggcccaggcgcaagcgcgaggcggatccgctggaccagctcaccggtctcgatgagctgatgccgcagcgcgaggagacccagtgggagcgggccgagcggctcgcggcggagcgcaccgagtacgcccacgtcatcgtcgacgaggcgcaggacctcacgccgatgcagtggcgcatggtcggccgccggggccgccacgccacctggacgatcgtcggcgacccggcccagtcctcctggtccgaccccgacgaggcgggcgcagcccgggacgaggcgctcggctcccggccgcgccgccgcttcaccctcaccgtcaactaccgcaacccggcggagatcgcggagctggccgcgaaggtgctggcgctggcgatgcccgggatggagtccccggccgcggtccgctcgaccggggtggtaccccgcttcgagccggtacgcgacggtggcctggccgccacggtccgcgaggaggccgcgcggctgctcacggaggtggacggcacggtcggcgtggtcgtcgcgatgaaccggcgcgcccaggcccgcgagtggctcgcggagctgggggagcgggtggtggcgctgggcagcctggaggccaagggactggagtacgacgccacggtggtcgtctcgcccgcggagatcgcggacgagtccccggccggtctgcgggtgctgtacgtggcgctgacccgggcgacgcagcagctcacggtggtctcgggggagcgggacatgccggacgaggacggggtgccggacctgctgagggactgacgccggacgggtttcgcgagtcggtccgtcgcacgggaatcacttcccgggggtctttgttaccttggtactggcaccggctcgatccaagcccccgggcccaaccttcgtcgcttcgagcgaccacttgccgcgaggcgagcatggcgggtcggtgccacctgacagaagaaggacagacccgcgtcacctcctggtggcgcgggtctgttcttgttttcacgggttctgtccctgtttcgaggaccgcccggccggttcgggtccgttgggggttccgccgaacgggtagtttctcgtatggtggaaactactttccgaaagacggcagtcattaccggctaccagccggtaggtgcgacgatcgggaagcgtgtccggggcgagggttccggatgtgcggcaatgaagctcaggaaagcgaaggactcggccatggcaacggcgcccagcgtctcgtactcgatgacggtcaggctggaggtgcccgcgagcggcaccgcggtctctcagctcaccacggccgtggagtcctccgggggctcggtcaccggcctcgacgtcaccgcctccggccacgagatgctgcggatcgacgtcaccatcgccgccacctccacctcgcacgcggacgagatcgtcgaaggtctgcgcggcatcgagggtgtcacgctgggcaaggtctccgaccgtacgttcctcatgcacctcggcggcaagatcgagatggcgtccaagcaccccatccgcaaccgtgacgacctgtcgatgatctacacccccggcgtcgcccgggtctgcatggccatcgcggagaaccccgaggacgcgcgccgcctcaccatcaagcgcaactccgtcgcagttgtgacggacggctccgcggtgctcggcctcggcaacatcggcccgatggcctcgctgcccgtcatggagggcaaggcggccctcttcaagcgcttcgccggcatcgacgcctggccgatctgcctggacacccaggacaccgacgagatcgtcgcgatcgtcaaggccatcgcccccggcttcgcgggcatcaacctggaggacatctccgcgccgcgctgcttcgagatcgaggcccggctgcgcgaggccctcgacatccccgtcttccacgacgaccagcacggcaccgcgatcgtcgtgctggccgccctcaccaacgccctgcgcgtggtgggcaagagcgtcggggacgtacgggtcgtcatgtccggcgcgggagcggccggtacggccatcctgaagctgctcatcgccgccggcgtcaagcacgccgtcgtcgccgacatccacggtgtggtgcacgccggacgtgaggacctggtcgcggccgaccccgactccccgctgcgctggatcgccgacaacaccaaccccgagggcgtcaccggcaccctcaaggaggccgtcgtcggctccgacgtcttcatcggcgtctccgccccgaacgtgctgaacggcgacgacgtcgccgcgatggcggacggtgcgatcgtgttcgcgctcgcgaacccggaccccgaggtcgaccccgcgatcgcgcgtcagacggcggcggtcgtcgccaccggccgctcggacttccccaaccagatcaacaacgtgctggtcttcccgggtgttttccgcggtctgctggacgctcagtcccgcaccgtcaacacggagatgatgctcgccgccgccggcgccctcgccgacgtggtcgccgaggacgaggtcaacgcgaactacatcatcccctcggtcttcaacgacaaggtggcgggcgcggtcgccggagccgtcagggccgccgcgaaggccgccgcgggcaccggagcgacctcctccgcatccgcctgaccccatggttccgggggcccctcacggggtacccgcaggacactccgggccgcacccgcccgtgccgtacggcgcgtcgcgggtcgcggcgccccaaacgcccctttagggtgggcgggcagtgggccctgcggggcccggcatccgctgcggaccgctcggccaagtcgacggagcgtcaccacgagcaaaccgtggcgcttttcattgaccccgaagggttccggattggctttcccgccgctggtgggggcaggatgcgtaatcgggcgagagggtctgacatcagacccgggtccggggactgtcagagggccctggcagcatcggcttcgatctcacgcctcacaggcaagaagaacacgggagtaacaacatgaaccgcagtgagctggtggccgccctggccgaccgcgccgaggtgactcgcaaggacgccgacgccgtgctggccgcgctcgccgagaccgtcggtgagattgtcgccaagggcgacgagaaggtcaccatccccggcttcctgaccttcgagcgcacccaccgtgccgctcgcaccgctcgcaacccgcagaccggcgacccgatcaacatccccgccggctacagcgtgaaggtctccgcgggctcgaagctcaaggaagccgccaagggcaagtaaccctcaacggcgcaacaagagggcggccactcccgaccaggagtggccgccctcgcgcatgccggaggcacatgcgccccgcaggagcccccgcaccatgcccggggcagctgcgggcgtccctgcgggcgcggagggctcaggggtgcatccgcgcgcccttgaggaccttgtccacggcgttgcggggcccgtacacggcgagacccaccagatcgagcgcgtcccgccccaccgcccgtacggccgcccggttgtcccggtcgttccccgtgccgaacaggtccgcggtgaacacggccatcgtcagcgaccgggacagcgccctggcgtgcgcggcggtcatcgtctgctccgccccctcgaagaccagcacgggctgccggagcatcggcaggtacgcggtggagtcggcgtcctcgtagggttcgccgatcacttcggggaccgccgtcccgaggccgctgaccagaaaggcggtcacgttcaggcgctgccaggactccaggtcgtcacggagcagcaccgcgaccttcgtgtcgaagcggacgggagcgttctcggccaccgcggtcccgctctcggtctcggtctcggtctcgtgcgtgtttctcatggttcgagactggccggtggatccgggcggggtcttgtacgttcttggcgtggtgccacggcgggagatccaggatgtcgcggcctggcgtccggccgtcgccggcgtcgtggaggtcttccacgcccgcttcaccgagcacgcctaccccatgcacgtgcacgacgcctggacactcctgatcgtcgacgacggcgccgtccgttacgacctggaccgccacgagcgctccaccccggacggcacggtgagcctgctgccgcccggcgtcccgcacaacggctctcccgcgacctccgacggcttccgcaaacgggtgctctatctggatatgacgcagctcgacgcgagactcgtcggacccgccgtggacacccccgacctcgccgacccgctgctgcgcgcccgcgtcggccggctgcacaccgccctcgcggacccgggcg

SEQ ID NO: 3694 - DNA, 3348 bp, Unknown
  Kingdom: Bacteria, Phylum: Actinobacteria, Class: Actinobacteria, Order: Streptomycetales, Family: Streptomycetaceae, Genus: Streptomyces
ctccatgtgcttgtcggccgtgatgtccgcgatccggcccaccgcgtgccgggcggcctcgacggagacgacgaacagcaccgggatcaccgcgtgcatcgcggtgcccagcgggtcgggccaggaggccgcgccgttgaacgcgatcgtcgcggcggtcagcagccacgccgtctggcgcagcagcgggaacgggatccgcatccaggtgagcaggaggtccagggcgagcaggacgcagatgcccgcgtcgatgccgatggggaagaccagggagaacgtcccgaagcccttgtcctccgcgagctcgcgcacggcggcgtaggaacccgcgaaaccgatcgcggcgatgagcaccgcacctgcgatgacgaccccgatgagtatgcggtgcgtgcgtgtcagctgcatcgcggccacgcgcgatcccctccccgacctctgtccccgaacccggctgctgtactcggccgcgctcttgagcgctttccggccaggcatccgacgcccggcgaggggacagcctggcacatgtgtgcgagttgcgtgtcgcggggagtcgttgtgaggctgttcgcgggtcggccgggctcgcggcggcgggccggagaaagcgagaacccggcctgaaagccggggacttgggtgatcgctggggacgacggcggtggcggcgaggggggccgccaccgccgaggggtcactcgcagccgcgctgccagttccagccgatgaacgtgttcttcaggtcgacctcgaacgcgcaggacgccgtgccgtcggccttgagggccacggtggagcggtgcgtgttggcgtacacgttgcccgtcgggtcgaagatccccttgtaggtgaacgacgcgtcggccacgttggtggagaccgcgcagttcgcgacgcagtcggcggacttgcccgaggacttcagcgaccagcccgcgttccacggttcacggttccactgctgggtcgcgtcggtggaggaggcggtgaccacggtgccgtcggagctccagtcggacgtcgtgtagaggcccgtcatccggatgttgcagcagtcgtacatctccgaccagctccggacctgccggtcggccagggcggtggccggagccgcctgcgcgttcgcgaccgggccggccttcggcaccagccgtgcgggcccgagcaccggagtgcagtcggtgccgatggagacgttctggcgtacggccatgcccgcgggcggcacgggcagggcgccggacagcttcacgtccccgcacgcgcgggcgtcgccgggcgccgccgtcagtgacgcgttcggtgctgcggtggcggaggcggccgtgagcgcgagaagaccggtcgtgagtgcggcggcgagtgcgattcgattgcgcaattcccttgcctttcctcggggttcgccgtggagcgtaacggcgtccgccgcgatcggaacggaacggggagagggttggcatgaagctgacaggcacatgcccctgggggttgcccgcgacggcgaaccccggcccgggggagtgccggttcgcgggaaggcgctgctgggcagggcgtccggggcctcggaggtctcgcggggatcaggtcactgtgcgtgtgcgcgaccgcccggaccgggaccaagcctgggccgggtcccggtcccggtcgcccgaggttcgccggaacgcgcgggaggggtgtcagctcgacttggccttcggcttcgtcttcgacttggggtcgtcgctgtcgctgtcgctgtcgctgccgccgcccttggccgtgtccttcttgctgtcgtcggagccgctcttcgccgggggagtgaccttggcgtcggcggtgtcggcgacagcggcgaccgcttccttcgccgccttctgggcgcccttgacgatgctcgcggacgagggcgtcttcgcacccgcgtaacccgcgccgttgtacgtcagggtgacgacgacattgcccgtgcgcgccacgacggtggcgtacgcgaagtcctcgcccgtcttgctgaggccgtaggtgacgacggtggcttcctcgccgataccggcggcgggttcggcggcgaccttctcggcgccctcggaggccttcgccttggtgacctgcttcgcgtactcggcggtggcgcgcttggcgccgctgcccagcgactggtccgagtcgaagcgagtgaagccgacgtccagccagcggtactgcgagccgtcgacacccttgtcgtccaggccgttccaggagcaactgctgcgggccgccaggtcgttggaccggcctgccgtgccgttctccttcttggcctcgggcaccaggtccttgatcgtcttcttcgtgaccgaggcgcacgggtcgggcagatcgtcgaacctcgccgcttcgacggtgggctccgagggcttggtgctgggggtgccggacgacgaggagcccgcgttcttcttgccgtcggagtcggagtccgacgagcagccgacggctacgagcatcaccggaacggcggcgcaggcgaggatgcgggacaggcgcggggctgatcggtgcatggttccttcactcgggtggcacggagctctcggtgctggaggtctcggttcgtgcggtgtacgggtgggctcggtagcgggtcggtacgtcttccggacagccacggtacgacggccggcggccggcccgtgccgccgccgaggacccccggaggccggaatccggccggtcggggcccgtgggacggggtctattcgctgagcgtctcggccagcttccgggccagtgcctgggccttctcctggagttccttgctgtcggggacctgtgtgacgagggccggctgctcggcgtaccggacggtcacgaccacgttcgatgtgcggaataccacgctcaccgtgcggtgctgtgcggtggaacctgcccgagtgggcagatcgtgcaggaacgcggcatctccgaggttgtcgaggacgcgcgagggaagggcgtcctccgggctgacgctgctgcctccggcgccgccttcgccggcggcgcctccggagggcgaggaggaggacgaggggtccgccgaggccgtggcatcccccgccgggtcctccggcttctccgcgtcggcgcccttgcccttggccttccccttctcgcccggggtcccggtgttcttctccgcgtccggcccgggggtcgccgacgacgacaggccggcggccttctccttcttcgcgtacaccgtgtcggcgcggtcgtcgtcgctgaccgcggggtcgtacgagacgacgcgctcgaagtcgatggagaggctccgggtggcgtccggtgcgtcggacttccaactgcagccgaccttgcggt

SEQ ID NO: 3695 - DNA, 4471 bp, Unknown
  Kingdom: Bacteria, Phylum: Actinobacteria, Class: Actinobacteria, Order: Streptomycetales, Family: Streptomycetaceae, Genus: Streptomyces
gaggttcgggatgcgcccggcggccgccagctccacggcgacgtcgtaccgcagggtgtccagggtgaccagcagcagatcgtggctgcccacgacctctcccatgtcggggcggccggacccgccgggcggccggggcgtgtcggggtcaggaaggtgtgacggcacggtggttccttgctcggtccagtacggcggcgacctgcgccgcataggtgttcaggccctcggcgccgctgcccggcagaccggtcagtccgggcagcagatcgccgaaggcgttgacctcgccgacggcgaagcgccgccagccggccgtgggcaggaggtcgacacccacacagggcgtccgggggaagcgggccgccgcccgctcgcacatcgtcagcgcctcgcgccaggagccgccggccgccgtcacggcggtccggacctcgtcgaggtcgcctcgcgctccgcccaggtgcagattggtcatgggactcgtgctcgtccgcaccacggcgtgcgtcgcccggccgccgaccaccacgatccgcagatccgcggcccgtccccgctgggacgccttcggcagccagcgctcgatgtgcagcccgtccggggccagcgcgtccacgatggcgccgacctccgcctccgaggtgtagcgccgtacccgcagcgagttgaacagccgccccgaggagtcccgctccaccgaggtgctcgcccggacccggccgggacccgccgtctccaccgccagcaccccggacgcggaggagccgtgcgcgagcttcacgaacgcccggggcatccggtgctcgcgcagcaactcccgtacgtcggaccagccgcgtaccggagcggcctccgggccggacgtcggcgaggcgggcacggggacccccgcgcggtcgagaagtccgtggcacagccgcttgtcgaagagcgcggcgatgtcaccgcgagagctcagcacctcggcgcccgcggccgatgccgcgtccgccaccgcgtccaccgcagcggtgaagcgcgcgtaccaccgggccgaaccctccacgcgggtcgggtcgtcgaccccgcggagcagtcgatccacctcggcgtcctcaccgggtgaatcgatccgtacggtctcgcccgccttgaacaccgcctcgccgcgcagcacctggagccagggcacgacccgggccggcggcaggccggcggaccgcacggcctcctcgaagaaggcgacccggcggttgtccggattgccgacgaccgcgaaacgcggcaccgggccgtccccgccgctactcactgaccgcgacatagcgttccggttcgtcttcctcgtcgtccgggtccgcgtagtcgtcctcggcctcgcccgcctcgacgacggccggtgcgcacgcggtcctgacacggtccagcaccggctcggtgaggtagtggtggcgcaggtcgagcgtggacaggtggctcaggggctgcccgttgagcagggcctcgccgcccgtgtcgctcagggtgcccatcgacagagccagggtctccaactgggcgacgacgggcgcggaacccaccgcgacggcgatctcgtcctggatctcgctgttctgcagacccaggtggcgcagccgggggaacatgccgcccgacaggatcggccggatgtcgtcgatggtggcgtcgccgccgtaccacgaactgccgaaccacaggtccagccgctccagagcgggcagttcgctcgcggcgaccgcccgcaccagtccgccgggcaggccgccggactcgaagcgcagcgacctcagcgccgcatggcgcagcggacgcagccccaggccctcctgaccgcagccgcgcacggcgaactcctccagcagcggcagcgcttcgagcaccggggtgacgtcgcacatccgcagccaggagacctcgcactcctcgcccaccacatcggcgaggaagagcccgcgcagggccgggaagcggtccgcgtgggcgacgatcagctccatcaccggggcgaacggcgtgtactccccgttccaccaggggccgatgacgagcgcccggacccgggtcgtgtccaccgtctccaggaactgctcccacagagtggcgaagccggcgtcctcgtcgtaggcgcacaccagccgccaggcgaccgagtcggcggcgggcagggccccggacgacggctccggggtgtggaccggcagtccgtggaagcggtcgaggtgctggatgccgagataggtcatgacccctactccgagacggcggtgtagcggccctcgacaccccggtcgccccagggctcgcacttctcggagaggtcgacgcgcacgccgtgcggctccagggcggaacggaaccgctccgccatcgcgtcggtgaggaagtggtggtggagatcgaggagttccagatgggtcagcggctgcccttcgagcagggcggccgccccttcgtcgcccagcgtcccgttcgacagatcgagaacccgcagctgggcgacgaccggagccgaggcgacggccgcggcgatctcgttctggatctcgctgttgcgcacgcccaggtggttcagccgggggaaacgagtgccggagagcagcggagcgaggtcggcgacgtcggtgttcccctcgtaggccgacacaccgagccagagatccagccgctccagcgcgggcagttcactgtccagcaccccgcgcaccacctcgctgggcagtccgcccgcctggatggtcagcgcccgcagccgctcgtgcttcgcgggcgggaacaccagctcggatccgccgcgcacgccgagctccgtcaacgccgggaaggcggccagcagcgccgtcacgtcggactgctggatccaggtgatctcggcctcctccgcctccagatcaccgacgaacaccgcctccagtgaggtcagccggtcggcggcggcgatcaccaggttgatcggaaccgaggagttctcgtcgtacgcctcgccccactggccgatgatcagggcccggacaccggccgggtcgaccttgtccaggaagtcggcgaactcctcctcccagggccggtcgtcgtcgtacgggtcgacggagacacgccaggccacggtgtccgcggcgggccgggagcccccgtcggtcgtgtgctggaagtcgacggccggaaggccgccgaactcgtgcagatgctgcgcaccgtacatggccctgaactcctgatcctggggacggctgatgtccgcaaggtttatcaagccgcactgacaacgccgcgaccgggaccccgtccacggcggtcgcgacggtccgttgtcagaccctgcccgtagcgtttttcccgtggtcggcacagcgggtgccactaccgaggggagacgtctgtgtaccggcagggcgatgtactgatcatggagctggaggagtcggcggttcccgcccccttcctggaggccccgggcgaactgcgcgacgggcggggacggctggtgctcgcactgggagaggtcaccggacacgcgcacgccgtgcagggccccggccggctgatccgggaagcgggtcagttcggcccgatgctgctccatctcccggagggcgggcgggtggtgcacgaggagcacgcggtgatcccgctccccaagggctggttccgcgtcgtgcgccagcgggagtacgcccccggcgcgatccgcgtcgtggcggactgaccgctccgccatgccggagcacgcacagccatccagaacgagcacggccattcagaacgagcacagcaggggacggggacaaccgatgcagaacgtgaattcctggcggaacgtggcggcggcgaccggccgggcggaccgggcggccgccgaggccggtgtgcggcgcgcctatcgcaccgccggcctggccgagccggaccggatcgtctgggccgcatcgccccgggccgccgtcgaaacggtggagaagctgaccgacgccgggcggtcggtgcgcgaggaggtccgcacccgcccgtgggccgaggaacgccgccggatgtacgacgagctgggcccggcgggctggtcggcgctctggtccgccaccggggcccagctgtgggagaccacgggcgctctcaccgagcggatacggaccggcgtcgtcgccgacctggcgccccggcccgaggacgagggggccgtgaggctggtgctcctggacgccgtgctcggccagcacgacgccgcctggctcgccgccgcccgcctcgaagcccggcgcacccccggacccgcccaggagcacccgtcgcacgccggacggccacctgggcgcggcccgcatcgaagatctgcgcgacgagcgcttttcgttcgcgcgcgtgctggacgaatgccgtgaactgttcatcaagctggggctggctgcggaacagattccgatcatcctggcgggcggcatcgattcgcatgccaaggtgaagcactggctcgaca

SEQ ID NO: 3696 - DNA, 2081 bp, Unknown
  Kingdom: Bacteria, Phylum: Actinobacteria, Class: Actinobacteria, Order: Streptomycetales, Family: Streptomycetaceae, Genus: Streptomyces
ccctcttccgtacgtacgggaccggctcaggccagcggcccggtgaccggctccacggccgcgaccagacgtccttcccgtacgaacgtgtcggcggcggccaggtccggcgcgaggaagcggtccgggcccgggccctccgctccggcggcccgcagtgcgtccacggcggcctgcgaggcgggggcgggagtcagtccccgggcggcgcggatctcgacggcgcgggtcgcggcgtacagctcgacggcgacgatccgggccaggttgtccacggccgtacggagtttgcgggcggcggaccagcccatggagacgtggtcctcctgcatcgcggaggacgggatggagtcggcggaggcggggaccgcgagccgcttcatctcgctgaccagggcggcctgggtgtactgggcgatcatcaggcccgagtcgaccccggcgtcgtccgcgaggaacggcggcagaccgtgcgagcggttcttgtcgagcagccggtcggtgcggcgttcgcagatcgagccgaggtcggcggcgacgatcgcgaggaagtccaggacgtacgcgacgggcgcgccgtggaagttgccgttggactcgacccgcccgtcggggagcaccaccggattgtcgacggaagaagcgagttcgcggcccgcgaccacggccgcgtagtcgagggtgtcccggcccgcgccgttgacctggggggcgcagcgcaccgagtaggcgtcctggacccggggtgcgtcgtcctggtgatgacccgtcagcccggaaccggccagcacccgcagcatgttgtccgcgctgacgccctgtccggggtgcgggcggatggcgtgcagttcgggggcgaggaccttgtccgtgccgagcagcgcctccagggagagggcggcggtgatgtcggccgaggtgtagaggttcttcaggtcggcgagggccatgaccagcatgccgagcatgccgtcggtgccgttgaggagggccaggccctccttctcgcggagctcgacgggggtgatgccgtgcgcggcgagaagttcgcccgcgggccggaccgtgccgtcggggccttccgcgtcgccctcgcccatcagggtgagcgcgcagtgcgagagcggggcgaggtcgccggagcagccgagcgatccgtactcgtggacgacgggcgtgatgcccgcgttcagcaggtcggccatggtctgcgcgacctcgggacgtacgccggtgtggccggaggcgaccgtcttcagccggaggaacatcagcgcgcggacgacctcgcgctcgacgcgggggcccataccggccgcgtgcgagcggacgatgttgcgctggagctgcgcccgcagttccgggctgatgtggcggctggcgagggcgccgaagccggtggagacgccgtagaccggctcgggcttggcggcgagcgcgtccacgatgagacgggcggcggccagggctcccacggcggcggcggagagctcgacccgggcaccgtggcgggccacggcgacgacgtcctcggcggtggttccggacgtccccaccacaacagtgtgcatatccatattcagcagcctacggattgaaagccttcatgtcactagtggtcccgcgcagggccccttacgggaccgcatgagcacgtgagcggcttgcccgccgcgcgcgctgccgggaagctgcccccatgcgtcgactcctgctgctcgccccgttgttgctgttcgccgtctccggctgcggcgtgctccagtcctccgagggcgaggccacggactccgcacgggaggtggccaggaaggcgggcgagcggctctacggtcagcgtccgcgcacggcggaggaggtcggctacatcacgtccggcatcgagggggtggaggtgctgcgggtgaagggcgcctcgacccgcgacggggacggcatcgaggtggtcgtccgcacgtccggcacggcgtacgaccagaagttcgaccccgagccggtcaccgtgcggcgctgtttcgcggtgcgggtgtcgccggagtcggagtggcgcgaggacccccgtgacgtggactgcccggacg

SEQ ID NO: 3697 - DNA, 4182 bp, Unknown
  Kingdom: Bacteria, Phylum: Actinobacteria, Class: Actinobacteria, Order: Streptomycetales, Family: Streptomycetaceae, Genus: Streptomyces
tgtgccggatcccgccgccccctgatcgtcgcgggcggcgggatccggcacagcgccgcggaggagacgctcgccgcgttcaccgccgcgacccgcatcccggtcgcctccacccaggcgggcaagggcgcgctccgccacgaccacccggccgacgtcggcggcatcggccacaccggcaccgccaccgccgacgaactggcccgcaccgccgacctggtgatcggcatcggcacccgcttctccgacttcaccaccgcctccggcacgctcttcgccgatccggccgtccgcttcctccacctcaacatcaccgggttcgacgcccacaagctggccgccctcccgctggtcgcggacgcccgcgcggggctggaggcgctcacagcggcgctcgccggacgcggctaccgggtcgacccggcgtacgagacggagtacaccggcgcgaaggaagcatgggaggaacgggtcgaggcgtccttcgccacccccgaccccaccgcacgacccacccagacccaggtcctcggcctcctggacgccctggtcaccgaggacgacatcctgatcaacgcagcgggctccctccccggcgacctgcacaagctctggcgcacccgctcccgcgaccagtaccacgtcgagtacggctactcctgcatgggttacgagatccccgccgcgatcggcgtcctgctcgccgcggaagcccgcacgccgcgccgccccgtctgggcgctcgtcggcgacggcacgtatctgatgaaccccaccgagatcgtcaccgccgtccaggagaaccttcccctcaagctggtcgtcctccagaaccacgggtacgcctccatcggcggcctctccgagtcggtcggcgccgaacgcttcggcaccgcctaccgccaccgggacgccgacggcggcttcaccggaccgccgctccccgtcgacctggccgccaacgcggcctccctcggcatgcgcgtcctgcgcgccaccaccgtcgacgacctgcgcaccgcgctctccgaggcccgtgacgcgggcggtcccacttgtgtctacgtcgagaccgaaacgcccgacacagtgtcgggcccccctccggcacaggcgtggtgggatgttccggtagccgaaaccgcgagcaggccggcggcggtcaaggcccgggaggagtacgaccggcaggccgccgcccgacgtcgccatctgtgaagcctgcctgaacccgctcgaacccgcctgagcggccagaagcctgaaggagtacgtcatgacgaagaccgtcaaccactggatcggcggcaagacagtggagggcacgtcgggccagtacggtcccgtcacggacccggccaccggcgccgtcaccacgcaggtcgcgctcgcctccgtggaggaggtcgacgcggccgtggcggcggcgaaggccgcgtacgcgacgtggggcacctcctcgctcgcccagcgcaccaccgtcctcttccgctaccgcgcgctgctcgacgcccaccgcgacgacatcgccgcgctgatcaccgccgagcacggcaaggtgcactcggacgcgctgggcgaggtcgcccgcggcctggagatcgtcgagctggcgtgcgggatcaccacccagctcaagggcgagctgtccacccaggtgtccaaccgggtcgacgtctcctcgatccgccagtccctgggcgtcgtcgcgggcatcacgccgttcaacttcccggccatggtgccgatgtggatgttcccgctggccatcgcctgcggcaacacgttcgtgctgaagcccagcgagaaggacccctcggccgccaacctgctggccgagctggcgtcggaggccggtcttccggacggcgtcctcaacgtcgtccacggggacaaggtcgcggtggacgccctcctcgcccaccccgacgtggccgctgtctccttcgtcggctccacccccatcgcccgctacatccacgccaccgcctccgccaacggcaagcgcgtacaggccctcggcggcgcgaagaaccacatgctcgtcctcccggacgccgacctggacgcggccgccgacgcggcggtctcggcggcgtacggctccgccggcgagcggtgcatggcgatctccgccgtcgtcgcggtcggcgcgatcggcgacgaactggtcgcgaagatccgcgagcgcgccgagaagatcacgatcggccccggcaacgaccccgcctccgagatgggccccctgatcaccgccgcccaccgcgacaaggtcgcctcctacgtcacgggcgccgccgcccagggcgccgaggtcgtcctggacggcacgggccacacggtggagggcttcgaggacggccactggatcggcctgtccctcctggacaaggtctccaccgactccgacgcgtacaaggacgagatcttcggcccggtgctgtgcgtgctccgcgtggacacgtacgaggacggcatcgccctcatgaacgcctcgccgttcggcaacggcaccgcgatcttcacccgcgacggcggcgcggcccgccgcttccagctggaggtcgaggccggcatggtcggcgtcaacgtcccgatcccggtcccggtgggctaccactccttcggcggctggaaggactcgctcttcggcgaccaccacatctacggcaacgacggcgtgcacttctacacgcgtggcaaggtcgtcaccacccggtggcccgacccggccgacgccccggcgggcgtcgacctcggattcccgcgcaaccactgagggcccgccccgccgccctcaccggtccccgcccgcaccggcgtgcgggcggggaccgcaacactgcgaaaagcggatgcagggccaccggcccaccccgcatcctgtgacccatgaacaccccggccctcccgccccgttacgagatccgcgcccggcagacagccaccaccgtcaccgtctaccaggcgtaccggcccggcatcgggctgcccgccgcacgcgacgggcggttccccgacgcctggaagcgggaccggatgacctggatcaagcccagcttcctgtggatgatgtaccgctgcggctggggcacgaaggaagggcaggaggtcgtcctcgccgtcgagatcgaccggagcggcctggaatgggccctcgcgcacgccgaactctcccactacgtgcgcgatgtgcaccccgacgagaaggcctggaagcggagcctgcgcgccgcccccgcccgggtccagtgggaccccgaacgcgacctggacctgaacccgctcccgtaccgctccctccagctcgggctgagcggtgaggccgcccggcggtacgcggacgagtggaccgtgtccgtccgcgacgtcaccccgctcgcgcgcgaggtgcacgcggcggtccgcgcgggggagcgggagagggccgcggccctgctgccggtggagacgccgctcgacgtcgccgcgccccggccggtgcggggggcctccccggcaccggacaggtgactttcggcagtgccggacggctcccggtctccgtagcctttcctccgtgaacagccattaccccgcggacaggaccgctcgtgggcccggccccaggtgggcggacccgggaggcctgctggtgtccgccgcggcggcgttcggcgcgctgagcctggtcggctggtggtggggcctgccgaccgcgatcgccgcgttcgtcgcgggtcggggcccagggcgcggcaggacgctcgtcctggtcctggccggggcgctcgtggccgggacggtggcggtggccgtggtgccgtccctgctcactctcgggacgcagttcgtggcggtgatcgtcctcgccgtgctggtgccctggttcgtggggcggttctcacgtcagtaccgggagctggtccgggccggctgggagagagccgaacagctggagcgggagcggcagttgatcgccgagcaggcgaggctgctggagcgggccaggatcgcccgggacatgcacgacgtgctgggccacgacctcagcctgatcgccctgtcggccggggccctgaagctggcacccggtctggacgagcggcaccgccaggccgcccaggacatccggggcagggccggagcggcggtggaacgcctcggcgaggtgatcggcgtcctccgcgaggagagcgagga

SEQ ID NO: 3698 - DNA, 4061 bp, Unknown
  Kingdom: Bacteria, Phylum: Actinobacteria, Class: Actinobacteria, Order: Streptomycetales, Family: Streptomycetaceae, Genus: Streptomyces
acagggcggaccggtccgccgggcgcccgcccggggcaggtgccacggacccggtcgcggctcctcgtccgtcgtggcgcggccacaggaggagggcgccgatcgcgccggccccggcgagtgccgcgagggcggaccaggcggtggcgaagccggcgttcgtgccgagccacccggcgatggggtaggtgatcagccaggcgaggtgcgagagggagaactgcgccgcgaacgccccggggatcgcgttcggttcgaccgaggcgcgcaggaccttgccggtcggggtgatgaccagcgccatgccgatgccgatcagggcccagacgatcgccgtgccggtccacgtggccaggccggccgtgccgagcgtcaccgcggctgccgtgccgccgaccaggactccggcgccggtcaccatgaccgtccgggcggcgacccggtcgagtacccggggcagtgcgagggcggccagaagggtcccgccgccggaggcggcgagcatccacgcgacggccgactgcgatcccccgagctcgtcgcggacgtagttgacggtgttgacgacgacgatcgagcccgccgccgcgaccgtgagattgagcgccatgatgccgcgcagtcgcggtgtgcggagaaaggtcctgacccccgccgtcgctctgtcccatgcccgggtgtgggtgctgggccgggcttcggggatgcgtgtcgacagcacgagcagggcggagaggaggaatccggcggaggtgcccaggaacagccggtcgaagctcaggaacgccagggcgaccgccgccagcacgggggagaggagactctccatcgtggaggcgacctgcgaggcggacagggcgcgtacgtaggcggactcctcggtgacgatgtcgggaatgacggcctggaacgtcggggtgaacgccgcggacgctgcttggagcaggccgaccaggaggtagatgtgccagacctccgtgatgaacggcagggccaggaccaccacggcgcgcaccgcgtcgaggagggtcaggagggttcttctggggaggcggtcgacgtatgcggcggcgatcggggctatcaccacgtacatgaccatcttgatggtcagggcggtgccgaggaccacgccggcgctcggacctgcgaggtcgtaggcgaggagcccgagggccacggtggccagtccggtgccgaagagggcgatgatctgggcgctgaacaggcggcggtagtcgcggtcggcgaacaggcgcatgacgtgtccttccgtgtccgtgcggcggggcgcggcctcgcgccggaggccgcgccccgcggggggaggcggggacgtctctacgcatcggcgccgcgctccggagtgaggccggccagcaggttgaaggcgccggtgaggacgttgagtgcgacgacgccgacgacgtcggctatcgcgcggtcgctgtagccgtgctcgcgcagcgcgatgacctgtgcgtcggtgatcgacgtcggctcgcggtagacctggagggcgagggcgatgatcgccgcgatcccggggtcgtccgaggtgcccgtgcgggcgcgctcgatctcgccctcgtccacccccgtcctgcgggcggcgccgacatgggcgtcgagacagagccggcagccctgccgggtctggatggcgatcgagatccgttcgctggtcccgcggtcgagcttggctcgccccatggcccggctgagctgcagatagccgcccaggacggcgggcgagtgcgccatggtggagaccatgtccccgacctcgccgtgccgggagaccagctcggcgaggaggtcgcgcgacgcgccgaccgctgtgtcgggtgtgagtcgggtcaggcggggcatggcggtccttccgacaggaggctgtgatcgaggggggccgggcgctcgacggatcgagcgcccctgggccgggccgtgcgtggcggccggtcgccgccgttcctgcggtcagtggtgtgcgtggccgccgtggtggtggcccgtgtgctcggacgcggccccgggcgccgcgtccgggccgggagcggccgcggtggtccgcaccgtgaactccgccgtccggacgacgccgtcgtgctggaagtccagatagaggcggtagacgccgtccgacggcgccgcggccatgaaggtgatcccgggccccggctcggtgacgccgtcaccgggctcgccctccgggtggacgtggaggtagcccaggtcgccgacccgtagcgccaccaggtgcccgtacgcgcccaggtagggctgcagatcggtgacgggccgcccgttccgggtgacggtgagcgtcaggtcgctcgccgtgccgggcaggagttcgccgtcgagggagacggtgtactcgccgacgtgagcgctgcgcgagccctcggaaatcggctgcgggtcgtactgcccggcgaccgaggcgtcgatgcccagcgtcatggtcccgccgtgaccggtcgggtggacgtcggcgaagaacctccagtctcccggctccaacgtcagatcgatgctccaggtgcccttcccgtccatcaccgggtgcacgtgctggaacccggtcgtgtcgcgccggacggcgatgaagtgcagcttcttctcgtgctcgggtgtgaactcggtcaccggccgcccgtcgggaccggtcacccggaaggtgaccgtccgcaccccggccggaaagatcgtcgagtcgagttcgagggcgtacccgccctcggagaccgacagcccgccgggacgggctgcgccgtggcgggtcatgtcgtggccggaattgctgttcatcgtgactccacctgtgtgatgtgccttcgggtttccgttctggggacacccgctataacagcataccccctgggggtattccagcgggcgcgccgaatgaggcgtcgcacggccatgagctgctcgaccaccgtgaaccggcggctgcgtgccgccggcgccgttctccgcgcgatcccggaccggctgcgccggcaactgccacccggtcaccttctcggggcgatggcccggctggggtccgacagccgccccgccgcgtacaaactcggcggaccggccgccatactggacgggccggggagggcgcagcgctgacagcggggaacgacgggggcgggaaacggcagatggcggacaccaggctgatccagagccggtaccgactgctcgaactgatcgggcgcggcggcatgggcgaggtatggcgcgcccgcgacgagtcgctgggccgtcaggtcgccgtcaaatgcctcaaacccatgggaccgcaacacgaccgggcgttcacccgcgtcctgcgcgaacgcttccggcgcgaggcccgggtggccgcctccctccagcaccggggcgtcaccgtcgtgcacgacttcggcgagcacgaaggcgtgctctacctcgtcatggaactgctcgacggacacaacctcagccagctcctggaggagaaccagcagcgcccgctgcccgtcgagcatgtcgtcgacatcgcggaacaggtcgccgacgccctcggctacacccaccggcagggcatcgtccaccgcgacctcaagccggccaacatcatgcggctgaccgacggcacggtgaagatctgtgacttcggcatagcgcgcctcggccacgacatcggcatgacctcccgcctcaccaccaccggcctcgccatgggcaccccgcactacatgtcgcccgaacagatcagcggcaaggaggtcgaccaccgcagcgacctctactcgctgggctgcgtcctgtacgaaatcgccaccggcgtaccgccgttcgaccaggatgacgcctgggccgtgctcgtcggacaccgcgacaccccgccggaaccgctgcgcacccaccgtgccgacctgcccggcttcttcgaccgtgtcgtcctcgacctgctcgccaaggcccccgaggagcggcccgccgacgcgggcgacctgcgccgccgcatcgtcatcggccggaccggggagcagcccgcgctcggaccgggacccctcgccctgtccggcgcc

SEQ ID NO: 3699 - DNA, 10456 bp, Unknown
  Kingdom: Bacteria, Phylum: Actinobacteria, Class: Actinobacteria, Order: Streptomycetales, Family: Streptomycetaceae, Genus: Streptomyces
ccgcccgggcggtggcgacgctgcgcgcgggtggacggcggcccgggtcgccgcccaccgccccgcacggtacggccgggccccggccggccccgggctcccgggcgacaccgtgagcgccgaccgccgggacccgcgcgaggagcaggtccgccgcatgctggacggcccgcacccggccctgccgccggacctggccgcgcgggcggtccggcgcggcggacggcgcctgcggctgcgccggtcggtgcggcggacggctggctggctgctggccgtggcgctcgcggtgttcctcgtctgggccggggtcgagcagccgtgggcgaccgagccggcacaggtcactcctccgttggagggctggtgagccgttggggtccgccctctccgggcctacgctggagaggccggtcgtcgaacgagccgaggaggccgtgatgacgaggaagatcgcggactgccgcaagtatccgagcgagatgaactgcaccctcaccatcgccggtgaggaggacgaggtggtccgggccgcgagcgagcacgccgcgtcggtccatggacatgaggacggtcccgaactgcgtgagcaggtcaggggcatgctggaggacgagaaggtgggcgtctgacacgtgaggggcgcccgcgtgttccggcgggcgccctcgtgttccgtgctccggccccgaggcgtcagcccagtgcctgggtgaggtcggcgatcaggtcgtcgccgttctcgatgccgacggagagccggaccaggtcggccgggacctccagcggggagcccgcggcggaggcgtgcgtcatccggcccgggtgctccaggagggactccacaccgccgagggactcgccgagcgtgaagagcttcgcgcggttgcagacctcgaccgccgcctcctcgccgcccgcgacgcggaaggacaccatgccgccgaaggccttcatctgcttggcggcgacctcgtggccggggtgctcgggcaggcccgggtagaggacctgggagaccttggggtgccgggtcagcaggtcggcgaccttggtcgcgttctcggtgtgccggtccatgcggacggcgagggtcttgatcccgcgcagcacgagccaggcgtcgaagggtccggcgaccgctcccatggcgttctggtggtacgccagttcctcggcgagttccgggtcgctgacgatgagcgcgccgccgacgacgtcggagtggccgcccatgtacttggtggtggagtgcacgacgacgtcggcgccgagcgcgagggcccggtaggagacggcgggccgcgccatcgacaccgctccctgcgcgagggcgaaggcgatgacgaggcgcagcagccagcccctgccgggcccggtccgtggtccgggtgtcatcacatgatgccgaagaggatgcccgcgccgagcaccacgagcgaggtgagcacggcccacttgacggtgaagcgggtgtggtcgccgaactcgaccttcgccatgccgacgaggacgtacacggcgggcacgagcggcgaggacatgtgcagggcctgaccggccagggaggcgcgggcgatctccagcggcgagaccccgtgggccgcgcccgcctcggcgaggacggggaggacgccgaagtagaagccgtcgttggacatgaagtaggtgagcggcaggctgagcagaccggtcacgatggccatgtgcgggcccatcgcgtcggggaccgcgccgacgacccagtcggccatgttctcgaccatgccggtgccggtgaggactccggtgaagacggcggcggcgaagaccatgccggagacgttgaggacgttgtcggcgtgcgcggcgatccgggcccgctggtcgggcatgtgggggaagttgacggtgagcgcgagggccgcaccgagcaggaagagcaccgggatcggcatcagttccatgatcatcgccgtcagcagggcggcggtgagtccggcgttgaaccagtagagcttcgggcggagcgtggaccggttcgggtcgaggccctggaactcgtcctcgtcctcgtccgcggggtcggcgtcggtgccggcccccgtaccgcccgtggaggcggaggcgtccttgcggaggcggacctcgccggcggtgccggtaccgccggcggtgccgccgccgcgcgtactgcccgcgccggtggacacggtctcctgctccggctcccgggcgagcgcctcgtcgagcgtgagcatgcccaggcgcttgcgctcccggaggccgagcacgtacgccagcacgaacacggcgagcagacccatggccagcgccgggatcatcggcacgaagatctcggaggcgtccagcttgagtgcggtggcggcacgggcggtgggaccgccccaggggagggtgttcatgacgccgttggcggtggccgcgacgccggtcatgacgaccaggctcatcttcaggcgcttgtagaggggatacatcgccgagacggtgatcatgaaggtggtggaaccgtcgccgtccagcgagacgatcgcggcgagcaccgccgtaccgacgacgatgcgcatcgggtcggcccggcagaacttcaggatgccccggacgatcgggtcgaacaggccgacgtcgatcatcacgccgaagtagacgatggcgaacatgagcatggccgcggtgggcgccaggttgccgacgccttcgatgacgtagtcgccgagctgcgctccctgtccgacggcgacacagaacagtgcggggatcagtaccagcgccgcgatcggcgacatcttcttcgtcatgatcaggaccaggaaggtcgcgatcatggcgaagccgaggattgtcagcatgggggatacctaacgttcatccttgaactcccaccggtgtcggcggtccggatgacgttaggggcgctctcgcgccgttaacaagatgttgacgtgtgagcaatacgagcaaaaccccaggtcaacacagtgatgctaaagagcgggggtcacggagaccggaagggcgttcagtacggcggtgccggacagcggatccaggagcgtgccgtcgagcaactggttcacattcacccccggatgggcggcggcgaccgtcatacgggtgccggggcggctgtgaccccagccgtgcggcaggctcaccaccccgctgcgcacggtgtcggtgatctcgacgggggcctcgatcccgccgcccgacgactcgatccgggcggtggccccgtccacgagcccgaggcgggccgcgtcgtcggggtggatctggagggtgcagacgttggacccgccggtgagcgagccgacgttgtgcatccagctgttgttggaccgcagatggcggcggccgacgaggacgagcggggcgggccggtcgcccagcgcccggcgcagccgcggcagatcggcggcgatcggctccgggagcagttcgatgcggccggagcgggtgcgcaggacctccgggagacggggtttcagcgggccgaggtcgatgccgtgcgggtgggcgaggagctgttccagcgtcagtccgtacgggccgaggcgcagcatcaggtccagtcgccgttcgggaccgttctcgccggtcaggccggcggccagctcctgcggggccccggcgcgggtgagggcggtgccgatggccaggtcgtcgacggcggacggcggcgcgccgtgcatgccgctcaccgcgaggacgagacgggcgtggatctcgctctcgtccatccggccgtcctccaggggcacggcggcacgggtgtagcggacctggttgtgcacggcgaagccgttgaacgcgaagtcgaagtgggcgctctgcgagggcggcggcggtggcaggacgacgtcggcgtgccgggaggtctcgttcaggtacgggtcgacgctgaccatgaagtcgagtccgccggcgagggccgcgtcgagacggtcgccgtcgggcgcggagagtaccgggttggccgcgatgaccagcagggcgcggatgcggtcctcgcccggggtgtcgatctcctccgcgagcgcggcgatgggcagttcgcccttggcctcggggtgaccggagacccggctcgaccagcggccgagcgcgaaacccttgcccgggacggctgtacgcgtcccgggctcggcgggccgtggcgcgcgcccggtcgcggagagcgggaacagcgcgccgcccggccggtcgaggttgccggtgaggatgttgaggacgtccaccagccagctggcgagggtgccgtgctcgacggtgcagctgccgatgcgcccgtagacggcggccgtgggggcggcggcgagttcgcgcgcgatggcggtgatggtgtccgcgtccacgtcgcaggaggcggcgacggcgtccggtgtgaagtccgccagggcaccggcgagttggtcgaggccctccaggtgtccggcgagcggaccggggtcggcgagcttctccgtcaggagggtgtgcgcgagcgcggccagcagaagggcgtccgcgcccggccggatcgcgacgtgccggtcggcgatgcgggcggtgcgggtgcggcgcgggtcgatgacggtgagggtgccgccgcgcccgcgcagggccttgagccggccggggaagtccggggcggtgcagagactgccgttggactccagcgggttggcgccgatgaggaggaggtggtcggtgcggtcgaggtccggtacggggatggcgtgcgcgtcgccgaagagcagaccgctggagacgtgcttgggcatctggtccagggtgctcgcggtgaacacattgcgggtccgcagggctccgagcagcaggggcgggtagagggagcccgccatcgtgtgcacgttggggttgccgaggaccacgccgaccgcgttcggcccatgggtcttcgtcagctccggtatccgcgcggcgatcaggtcgaacgcctcgctccaggcagcctcgcgcaactccccgtcgtcgccgcgcacgagggggacgcgcagccggtcggggtcggcgtcgagccccccgaaggaggcccccttggggcagatgaagccgcggctgaagatgtcgtcgcggtcaccgcgcgcaccggtgacggtggtcccctcgatggtgagggtgagcccgcaggtggcctcgcagagggggcagatacgcggtgcggtgcgggtgtcgtgggacatgggccctccccggggcggcagcggtggcaggacgacgtcggcgacatgggccgggcgggcgtggagccccggcacgggcgagcataccgaccggtacgcacggtggggaggtgttgcgcggaggagatggcggggagaaggcgagcggccccccggtcaggggtcccggctcagtcgagcgtctgggcgaggtaggacctgaccagggtccgcgtctcggcgacgatggccgcgtcccccgacggtgcggtacggaaggccagttggaggagcgcgtcggcggcctcgacgctcaccaggatcgcccggtacagcccctcgtcgggccggcggccgaggtgacctgcgagcaggacggcgagccggtccgccaggcgccggttggcgtcgtccgccgcgtcctcggccgggaacggcggcccgaaatcgacgagcgcgaaaccggggacgctccgcttcatcgccaggtactcgtcgagcaccgcgtcgatggcggcccgccagtcggtggcggggaggtccgcgagccgggccgcgatgcggtcggcgtatgtgtccaggttgcgcagcgcgagggcgtcgacgagcgcgcgcttgttggagaagaaccggtagacggagccgatgggcacgtcggcgcgctcggcgacggcccgggtggtgagctgctcgtatccggtctcgtcgaggaggccggcgcaggagtcgagtatccgggccagccggtcggcgctgcgctgctgcacgggggcgcggcggaggttcgggttgacatggggcacgggccccatgatgccgtgcccacgccgacggacgaacggcagcggccacccggcggacggcggcggcgcccgtcaccgggagtcctcgccttcccgtccccgccacggagggcgcgacacgggccacgaatggcgcgatgtatgccgttgacgtgccccgctccgattcctacggtagtacataggattcgtcgtccggcggatccgagggctttcttgggcaccgggagtgcgggatgagcgcgatcgaccaggcgaggaagacggccgaggggctgacgtattcctcgggcttcggcaacgagcacggctcggaggcggttcccggggcgctgccgcacggccgcaactctccccagcgcgctccgctcgggctgtacgcggagcagctgagcggctccgccttcaccgagccgcgcgcggacaaccgccgctcctggctctaccggatccgcccctcggccgcccacccggcgttcacccggaccgacaacgggggcctgcgttcggcgcccttcaccgagacggtgccggacccgaaccggctgcgctggaacccgctgcccgaccccgcgcccggcacggacttcctgagaggcctgtggacgctcggcggcaacggcgacgccacgcagcgcaccggtatggcgatccacctgtacaacgccgactcctcgatgacggaccgcgtgttcagcgactccgacggcgagctgctgatcgtccccgagcgcggcggactgctgctgcgcaccgagctgggcctgctgcgcgccgagccgggtcatgtcgcgctgatcccgcgcgggatccgcttccgggtggagctgctggaggagaccgcgcgcggatacgtctgcgagaactacggccgcccgttcgcgctgcccgatctcggcccgatcggcgccaacggcctggcgaacgcccgggacttcctcgcgcccgtcgccgcgtacgaggaccatgagggcccggtggaggtggtcaacaagttctgcgggaacctctggtcggcgacgtacgaccactcgccgctcgacgtggtggcctggcacggcaaccacaccccctacgtctacgacctgcgccggttcaacgtgatcggcacgatcagctacgaccaccccgacccgtcgatcttcacggtgctgacctcgccgtccgacaccccgggactggccggggtggacttcgtcgtcttcgcgccgcgctggctggtcggcgaggacaccttccgcccgccgtacttccaccgcaatgtgatgagcgagtacatgggcctgatcgacggtgcgtacgacgcgaaggcggacggcttcgtcccgggcggcggctccctgcacaacatgatgtcggcgcacggcccggaccgggcgaccttcgaccgggcgagcgcggcggagctgaagccgcagaagatcgacgacggcctggccttcatgttcgagacccgctggccggtcacggcgaccgcgcaggcagccgccgccgaacacctgcagcgcggctacgacgacgtgtggcagggtctgagccgcaacttccggccgtagacggcggaaggccggaggggacggggacgacgtgacagagagccaggagagagccggggcggacgcccggaggaccgacggcgacgccacgaccgggaccgggaccgacggggacggcgcggacgcccgggcggccccggtgccgcatccgcccgccttcgcccccgactccctcgtcctgaaccggaagctgccgctctggtaccaggtctcccagtccctccgggcctccgtactgggccgcccgcaggacgcctccgcccggctgcccaccgaggagcagctcgccgcgcactacggggtcagcgtgctcacgatgcgccaggcactcaaggagctggagacggagggactgatcagccggcaccggcggcgcggcacgttcatcgagccgcgcgcccggcgggtctccccggtccggctgctgggctcggtcgacgcgatcgtggcccagcagtccggggaggcgacgaccgttctcggtcacggcccgacggcggtgccgggtgatctcgccgagttcttcccgggctgcgccgaggtgacctgctaccggcggctgcgccgcgacgaggagagcgacgagcccaccaactgggcggagaacgcggtccgtcccgacatcgccgcccggatcgacgtggccgacctcgaacgctggccgatgaccaaggtcctgcgcgacgtcgtcggggtgaggatctcccggatcaccgacacggtggaggcccgcctcgccgacccggtcaccgccgagctgctccaggtcccgttgctcagcccgatcctgcactacacgggcgtgacgtacgacgaggagggccgcgtggtggacgtggcccggatccgctaccggggcgaccgcttctccttctccgcccatctgcgaggcgagcggcggagctgagaaggcccgttccccgcttcaccgcacgaccgccgaggtcacgggaacataacgggtctggtccaaacttgcggggtcgttcaccgtcccgtcggtgaacggacgcgtgcgggacacccctcccgaggagcgtggccggcgtgagagtcatcgtcgtaggagccggcgtggtgggaaccatgcacgcctggcacgcagtcagccgcggccacgaggtcgtacagatcgagcgcgagagcgaggcgcgcggggcatcgctccgcaatttcggacagatatgggtcagcggccgggccggcggcgaggagctggagaccgccctgcgcgcccgcgagctgtgggaggcactcgggcagcaggtgcccggactcggcttccgggcctgcggttcgctcaccccgctgcgcacggcacgcgaggtcgccgtcgccgaggcggccgtcgcccggcccgacgcggcggcgcgcggctacaagctgctcgccgccgacgaggcgcgggcggtcaaccccgccctgcgcggcgcgttcaccgccgccctgtggtgcgagcgggacgcggccgtcgaaccccgcaccgcccaactcgcgctgaaagaacacctgctggcctccggccgctacacctacctcggcgaccgtgaagtgcgggacgtcgtcgggaccgcctcggtgcgcgacgaccacggcgacgtccacaccggtgacgccgtgatcctcgcgaccggcgcctggctcggcgggctggtccgcgaactcgccgggcccgagctgcccgtgcgccgcgtccgcctccagatgatgcagaccgacccgctcggcgaaccgctcaccacgtccgtcgccgacgccgacagcttccgctactaccccgcctaccggggcgaggcgctcgacgccctcaacgccggacaggcccaggacccggtcgccgccgagcaccgcatgcagctcctcatggtgcagcgccgcgacggcggactgaccatcggcgacacccatgagtacgagcaccccttcgccttcgacaccgtcgaggagccctacgagcacctcacccgggtcgtcgaggccttcctcggccgcccgctgccacgcgtacgccaccgctgggcgggtgtctacgcccagtgcaccgacacctcacgcgtcgttcaccggcagcaggtgtccgacggggtctggctcgtcaccgggcccggcggacgcggcatgacgtgctcgcccgccatcgccgaaacgaccgccgaccaactgggctggtgaaacacatgacttccccgaccgacatcacgcgccaccccttccgcctcgtcgtcctcgacatggccgggaccaccgtcgccgacggcggcctcgtcgagcaggccttctccgccgccgcccaacgcgtcggcgtacggccaggatccgaggagcacgcccgccaactcacctacgtccgcgccaccatgggcgaatccaagatttccgtcttccggcacctcttcgcgggggaggacggcgaggacaaggcccagcgcgccaacaccgccttcgaggaggcgtacggagaactcgtcgacgccggccgcatcgcccccgtccccggcgcccgcgaggccgtcgaacggctcgcgtccgagggccgcaccgtcgtcctgaccaccggcttcgcccgccccacccaggacgccatcctcgccgccctcggctggcaggacctcgtcccgctcaccctctgtcccgccgacgccggcggccgtggccggcccttcccggacatggtgctggccgccttcctgcgcaccggggccgtggacgacgtccggcggaccgcggtggtcggcgacacctcgtacgacatgctcagcggcgtacgctccggcgccgggatcgtcgccggggtcctcaccggcgcccacgacatggaccggctgactcggcacggcgcgacccacgtgctcgggtccgtcgccgaactgcccgacctcatcgcgcgggccgaggcgtgagcgcgccgacctccgccgccggtggg

SEQ ID NO: 3700 - DNA, 7217 bp, Unknown
  Kingdom: Bacteria, Phylum: Actinobacteria, Class: Actinobacteria, Order: Streptomycetales, Family: Streptomycetaceae, Genus: Streptomyces
gtcccgaactcggcagcgccctcggcgtcgcgttgatcggcagcgtcggcttcgcggtctaccgctccgagctgggcgaccggctccccgaggggctctcggcccgggacaccgacgaggcgaaggacaccctcgccgccgcggtggataccgcccgtgggcttcccaccgatgtcgccgaccggctgctgacggtggcccgcgactccttcgtacagggtctccagacgaccgcgaccgtcggtgcggtggtcgccctgctgctggcagtggcggcggcgaccctgttgcgcaacgcccggatgccgggttctccgccggtcacggaggagaacgacacggccaaacccctagagagagcggacaactgacatgacggacacggcctccacggccaacgcggtccagacccctgtgggcgtctgggccggcttggtgcgccacgacgacgagaccgactcctacaccatctccttcgcaccggacgggacgatcgcgctgcgcacgtccgtcacggtgggcaccgggacctggaccgccggggaggcggggacgttctcctacgacctcaccgagaccttcatcccggcgagcggtcgcgccgggcaggtccgggcgcacgtggaggcccggatcgagggggccgcgcacaagggggccggcaccgcccggatctacacccccgacggcacgctggtgcacagcgccacggccgagttcgccggcgaccgggtcggtgacgcgccggccgactggcacgccgacgccggcccggcgtagtgggcctgggcacgcctgcccggggacgcacgctccaccgcggggacgacggattcgaggaggctgcctccggctggctgctcaacgtcgagcaccgcccctgggccgtcgtggtcgccaccggcaccgaagacgtcgccgcggccgtccggtcggccgccgaggcgggccggccggtggcggtggagtcgaccggccacggcaggtcggtggcctccgacggagcggtcctggtctcgacgaagggactgcgcgggctctcggtcgacccgcggaccgcgaccgcccgcatcggggcgggtctgcgctggggcgaggtgctggccgccaccgccgagcacggcctggcgccgctctgcggctcttcggccgaggtcggggtgatgggtttcctgaccggcggtggactgccgctgacctgccgtacgtacggcttcgccgcggaccgcgtccgctccctggaactggtcacggccgacggccgggtccgtaccgtcgcgccggaccgggaccccgacctcttctgggcggtccggggcggccggagcaacttcggtgtggtgaccgaggccgagatcgacctggtgcccctacggagcgtctacgccggcgagctctactacccgggcgaggacccggcgtacgcggcgcacgtggtgcgctcctatctggcctgggcgcggggacagcccgaggagatgtcctcctcggtgacactgctgcgcttccccgacgtgccgcgggtgcccgacgagtaccgtggccgctccttcgtcctggtgcacatcgtctgcaccgtcgacgagcggcggtccgagcacctggtggcaccgctgcgcgcgctcggccccgagaaggacacctgcgccaccctgccgtacccgcggatcaccgagatccaccacgacccgaagcacccggtcagcgtgcacttccgcagcgcgctgctgcacgggctcgacgacgcggcggccgagaccctggcctcgttcatcgacccggcgcagcccggcgagccgtaccgcaacatcgagctgcgccacctgggcggggcgctgagccggccgcccgagcgggcgcacgcggtgagtgccagggacgcgtcattccatctgtggatgcggatgccgaccccggacggtacggcggacgaggcccgccgggtctcggacgaggtgctggcacggctcgggccgtgggacaccggcggcctgctgccggggttcctgttcgaccacgactccggccccgagcgggtccggagggcctacgcggcaccggactaccggcggctgacccgactgaaggccgcgtacgacccgcacaacctgttccgcatcaaccacaacatcccgcccgtcccggacggtgcgtgaaagggggagcgaccggaatgtcgctcacaacggagataccggcgcccgcgtcggagacacaggcgctactgaccgaggccgccgagctggccgggaccggcgggacccggttgttgccgctcctcctggcggcggcccgcgaggtgtcggtggaacgggagtgggacctggtgcacgcgctgcgggtggcgggcgtgccgggcgtctgaggtcctcgccggagccttgaacaccaccaaagatcggggccgcgtccgttgtggaccggtcgggtgcgaaacatgatcgactccgccggttcacggcgatggtcttgccccgccggacggaggggcttacgttctccatccatgcaccgatctacgtgcgtagaaaacgcgtagaggctctctgacgccgcgtcgaaggagcagctcatgtcccacgtcgtacgcgccgcactcgtccaggcgacctggaccggcgacaccgaatccatgatcgccaagcacgaggaacacgcgcgcgaggccgcccggcagggcgcgaagatcatcggcttccaggaggtgttcaacgctccctacttctgccaggtccaggagcccgagcactaccgctgggccgagccggtcccggacgggccgaccgtccggcgcatgcaggacctggcccgcgagaccggcatggtggtcgtcgtcccggtcttcgagatcgagcagtccggcttctactacaacaccgccgccgtgatcgacgccgacggctcgtatctcggcaagtaccgcaagcaccacatccctcaggtgaagggattctgggagaagtactacttcaagcccggcaacgccggctggccggtcttcgacaccgcggtcggcaaggtcggcgtctacatctgctacgaccggcacttccccgagggctggcgtcaactcggccttggtggagcccaattggtgtacaacccctcagccacctcgcgcggactctccagccacctctggcagttggagcagccggcctccgccgtggccaacgagtacttcgtcgccgcgatcaaccgggtcggccaggaggagtacggcgacaacgacttctacggcaccagctacttcgtcgacccgcgcggccagttcgtcggggacgtggccagtgacaaggaggaggaactcctcgtccgcgacctggacttcgacctgatcgaggacgtccgccagcagtgggccttctaccgggaccgacggcccgacgcctacgacgggctggtggagccgtgaccggactgcacgagcgccacctcgccgtcagccccgagtggctggccctctactaccgcgaccccctggaactcacccacggagagggccgccacgtctgggacgcggacggcaaccgctacctggacttcttcggcggcatcctcaccacgatgaccgcccacgccctgcccgaggtgaccaaggcggtcgccgagcaggccgggcggatcatccactcctccaccctctacctcaaccggcccatggtggagatggccgagcggatcgccaccctctccggcatccccgacgcccgggtcttcttcaccacctccggcaccgaggccaacgacaccgcgctgctgctcgccaccgcgtaccgccgctccaaccagatcctcgcgatgcgcaacagctaccacggccggtccttctccacggtctccatcaccggcaaccaggcctggtcgcccacgagtctgtccccgctccagaccctgtacgtccacggcggtgtccgcagccggggaccgtacgccgagctgagcgacgagcggttcatccaggcgtgcgtcgccgacctggaggacctcctcgggcacacccgccggccggccgccctgatcgccgaacccgtccagggtgtcggcggcttcacctcaccgcccgacggtctgttcgccgcgttccgggaggtcctggaccggcacggggtgctgtggatctcggacgaggtgcagaccggctggggccgtaccggtgaccacttctggggctggcaggcgcacgccgaaaacgggccgccggacatcctcaccttcgccaagggcatcggcaacggcatgtcggtcgggggagtggtggcccgcgccgaggtgatgaactgcctcgacgccaattccatctccaccttcggcggttcgccggtcaccatggccgcgtcgctcgccaacctctcgtacctcctggagcacgacctccagggcaacgcgcggcgcgtcggcgggctcctcatcgaacggctgcgaggcatcgccgccgcgtcacccgccgtacgcgaggtgcgcggccggggcctgatgatcggcatcgagctggtgaggcccggcaccgacgaggccgacccggaggccgcggcggccgtcctcgaggcggcccgtgccggcgggctgctcatcggcaagggcggcggccacagcaccagcgtcctcaggatcgccccaccgctgaccctgaccgtcgccgaggccgaggaaggcgcggcgatcctcgcggacgccctgcacgcggcgggctgaacccgcccggccgggcccgtacgtatacgaaccgcgcggggcggccccggccgtacgcccggagggccggcgggggcccgccccgagttaaggagacacccatgagccgcaccgtcatccacggtggcctggtcatcaccgcgtccgacgagatccacgccgacgtgctcgtcgagggcggccggatcgccgccctcgccgcccacggaaccgacgccgccgagagctggagcgccgaccggcggatcgacgcgacgggcaagtacgtcatcccgggcggcgtcgacgggcacacccacatggagatgccgttcggcgggacgtatgccgccgacaccttcgagaccggcacccgggccgccgcctggggcggcaccaccaccatcgtcgacttcgcgatccagagcgtgggccgctccctgcgcgaagggctcgacgcctggtacgccaaggccgacggcaactgcgccatcgactacgccttccacatgatcctcgccgacgtgaacccctcctcgctcaaggagatggaccacctcgtctccgaaggcgtcacctccttcaagctgttcatggcctaccccggcgtcttctacagcgacgacggtcagatcctgcgcgccatgcaacgggccgccaccaacggcggactgatcatgatgcacgcggagaacggcatcgccatcgacgtcctggtcgagcaggcgctcgccgagggccgcaccgacccccgctaccacggggacgtccgcaaggtcgccctggaggccgaggccacccaccgcgccgtgcagctcgcccgggtcgccggttcccccctctacgtcgtccacgtctccgccgacgaggccgtggcggagatcgccgccgcccggcaccagggactccccgtcttcggcgagacctgcccgcagtacctgttcctgtccaccgacaacctcgccgagcccgacttcgagggtgccaagtacgtctgttccaccccgctgcgccccaaggaacaccaggaagccctgtggcggggcctgcggaacaacgaactccaggtcgtctccaccgaccactgccccttctgcttctcgggtcagaaggagatgggccgcggcgacttctccaagatccccaacggcatgccgggcgtcgagcaccgcatggacctgttgcaccaggccgtcgtggacgggcacatcacccgccgccgctggatcgagatcgcctgcgcctccccggcccggatgttcggcctctacccgaagaagggcaccatcgccccgggtgccgacgccgacatcgtcatctacgacccggctgccgagcagaccctttccgccgagacccaccacatgaacgtcgactactcggcgtacgagggcaaacgcatcaccggccaggtcgagaccgtgctctcgcgcggtgaaccggtcatcgaaggacggaagttcaccggacgcgccgggcacggcatgtacaccccccgcgccacctgtcagtacctggactaggagatcccgccatggacttcggactcgtcctccagacggacccgcccgcctccgccgtcgtcggcctgatgcggcgtgccgaacgcaacggcttccgctacggctggaccttcgattcggcggtgctctggcaggagccgttcgtcatctacagccgcatcctggagcacacggagaagctgaccgtgggcccgatggtcaccaacccgggcacccgcacctgggaggtcaccgcctccaccttcgccaccctcaacgacatgtacggcaaccgcaccgtctgcggcatcgggcgcggcgactccgcgatgcgcgtcgcgggccgcaggcccaacaccctggcccgcctgggcgaggccatcgacgtcatccgggacctcgcggagggccgggaggcgacggtcgacggacagccggtgcagatcccgtgggtgaaggacgggcggctgccggtgtggatggcggcgtacggacccaaggccctggccctggccgggcagaaggccgacggcttcatcctccagctcgccgaccccttcctcaccgagtggatgatcaaggcggtacgggacgcggcctccgacgccggacgggacccggactccgtcaccatctgcgtcgccgcccccgcctacgtcggtgacgacctcgaccacgcccgggagcagtgccgctggttcggcgggatggtcggcaaccacgtggcggacctggtcgcccgctacggcgagcactccggcctggtccccgaggcgctcaccgcgtacatcgccggacgctccggctacgactacagccaccacggccgcaccggcaacccggacaccgccttcgtcccggacgagatcgtcgaccgattctgtctgctcggtcccgccgaggcgcacatcgagaagctccaggcgctgcgggacatgggcgtcgaccagttcgcgctgtacaacatgcacgacgcccgggaggcgaccatcgacgcctacggggccgagatcatcccggccctgaccgcctgaccgcctg

SEQ ID NO: 3701 - DNA, 4337 bp, Unknown
  Kingdom: Bacteria, Phylum: Actinobacteria, Class: Actinobacteria, Order: Streptomycetales, Family: Streptomycetaceae, Genus: Streptomyces
aggacgacgagcaccgcgcccgtgcggtgggcggtgctcgcggcggtcccgctggccggggcggcactggcgttcactcttccggcgggccggaacgggaaggatcagggaacgcgcgcggttgcggggtaggagcagcactggatccacaggaccacccgcgggacgcggaccgcgggccgccccgcgaggcggtcccggacgtgggccggtccgcgggacgccaaccgaagcgcagcactcaggaggacgtacgcatgaccgccgcactctccgccgagctcaagaacctgctcgacagccccgtgttcgtcaacatcgccaccatccagcccgacggcagcccccaggtctccccggtctgggtcaagcgcgacggcgacgacgtactgatctccaccaccatcggccgccgcaaggagaagaacctccgccgcgacccgcgcgtcaccgtgctcgtccagccctttgactccccgtacacctacgccgagatccgcggcgaggcgacgctgacgacggacggcgggcaggaactgatcgacgagctctcggtgaagtacaccggcaagccgtacgcggagttcaacccgaactccgccgccgacgacccccgcgtcgtcgtccgcatctccccgcgcaaggtcgtcggcggcctgtagggcccaccgagggcgtgagaacgctctccgagcccttcccgggccgtttcggggcgtcccggtaccagaaagttgtccccgcgatccccaagggtcgcggggcactggtgcgggcctactacccttgaggcgtgactattcgcctgcacgacaccaacgcccggcagatccgtgacttcgtcccgctcacagcgggctgcgtctcgatctacctctgcggcgccactgtccaggcagcaccgcacatcggccacatccgctcgggcctgaacttcgacatcatgcgccgctggttcacctaccgcggctacgacgtcacgttcatccggaacgtcaccgacatcgacgacaagatcatcgcgaagtccgccgagcagggccgcccgtggtggtcgatcggctacgagaacgagcgcgcgttcaacgacggctacgacgtgctcggctgcctgccgcccacctacgagccccgcgccaccggccacgttcccgagatgatcgagatgatgcgcggcctgatcgagagcggtcacgcctacgaggccgacggcaacgtctacttcgacgtgcgctcgctgcccagctatctggagctctccaaccaggagctggacgatctgcgccagccctccggcgaaggcgagaccggcaagcgcgaccagcgtgacttcgccatgtggaaggccaccaagccgggcgagcccagctgggagacgccctggggccgcggccgtcccggctggcacctggagtgctccgcgatggcccacaagtacctgggctccgccttcgacatccacggcggcggcatcgacctgatcttcccgcaccacgagaacgagatcgcccaggccaaggcctacggcgacgagttcgcgaagtactgggtgcacaacggctgggtcacgctgtccggcgagaagatgtcgaagtcgctgggcaactccgtcctcgtcagcgagatggtcaagcagtggcgcccgatcgtcctgcgctactacctcggcaccccgcactaccggtcgatgatcgagtacagcgaggaggccctgcgcgaggccgagtccgcgttcgcgcggatcgagggcttcgtccagcgcgtcaccgagaagaccggggaggtcgtcgcccccgccgccgaggtgccgcccgccttcgccgaggcgatggacgaggacctgggcgtgccgcaggcgctggcgatcatccacaccaccgtccgccagggcaacagcgcactggccgccgacgacaaggaagccgcggcggcccgcctcgccgaggtccgggccatgctcggcgccctcggcctggacccgctcgacccgcactgggcgggcgagagcgaccgtggcgaggatctgcacggcgtcgtcgacaccctcgtgcgcctcgtcctcgaccagcggcagtcggcccgcgcccgcaaggactgggccgcggccgacgccgtccgtgaccagctcaaccagtccggactcgtcatcgaggacagccccaccggcccccggtggacgctgggaccgcgctgagcccccctgtcgagcagtgcagatgtgccgcccggcgatccgggcggcacactttccctatacatacgtacgtctgaaagcaacgaaacaggtagatcatggccgggaacagccagcgcaggaaccgccgcacgtccaacaagaagggcatgcaggtcggcagcggtggccagcgacgccgtggtctcgaaggcaagggaccgacgccgcccgcctccgcccgtaagggacacaagaagaaccggatcgccggcgcccaggccaagcaggccgcggcccgccgccccgcgccccggcgcggcggtgtgaagggcacctcggagatggtcgtcggccgcaacccggtctacgaggccctgcgggacggcgtgcccgccgtcaccctgtacgtccagcagtacatcgacaacgacgagcgcgtccgcgacgccctcaagctcgcgggcgagcgcggcaacatcaacctgatggaggccccgcgtcccgagctcgaccggatgacgaacggcctgaaccaccagggcctcgtcctccaggtcccgccgtacgagtacgcgcacccggaggacctcaccgccgccgcgtacgacaacaacgaggacccgctgatcgtcgccctcgacggggtgaccgacccgcgcaacctcggcgccatcgtccgctccgtctccgcgttcggcggccacggcgtggtcgtccccgagcgccgcgcggccggcatgaccgccggtgcgtggaagtcctcggccggcacggcggcccgcacgccggtctcccgggtcaccaacctcacccgcgcgctggagggctaccagaaggcgggcctcacggtcgtcggcctggccgccgacggcgagcacacggtggaggacctggagcagctggcgggtccggtcgtcatcgtcatcggcagcgagggcaagggcctgggccgtctcgtcggcgagacctgcgactaccgggtgcggatctcgatgccgggcggcgcggagtcgctcaacgccggtgtcgcggcgggcatcgtgctgtacgaggtggcacgccgccgcggatagcagtccgcaggccctccggggccgcggcgttcgcgtggcaacgcgcaccgcaacaggctcgcctgccgggcgagttgacgcgcgaacgccgaacatgcttccaggttgcccgagtttggcctgatcttgacgggtctcggacacatccgggtgatcgaggcagtgtcctaaccacacatcactcggttagatgagtgtggacaccagaacgcctcggttcgacgagcaacctgccctgagcatgaccaaggtggacagcgaccccgcgcaggtcatcgtcaaccacgccagcttccgggtgcagctcgccccgggccagcgcgcacggctgcgcggtgcccccgcggaaacggcccgcatccccgccatgagcggtgccggcggcggccgcaggcgggcaccggtcgtctggagcgggaagtccgctcccggcgaccccggcgcgacaggccttctccaggccgtgcgcaactccaccgccggacacctcgacgccggactcggcggggcgtccggaggcgggcacggagcgggcgcgacgcaggtcatcccgctcctggaggagacgcagcccaaccccgtactgaccgctccccaccagccgggacgcaccggtccgctgctgccgcccatgcggcaggccgtcggtgcgtacgacccggtcgacgggcccgacgacctcggccggcccgacgccgacgactacgacgaggccgacgcggccgccgagtcccgcacccggcggggctcgggcgatcccgtccggcacgcctactaccccggccaccggatgaacctgggcgtcgtcctgctccccatgcgggtgctcctcggcttcatctccatctacgccggcatgggcaagctgtgcgaccccgtctacttcgacggcggcgagcgcggctcgatggtgaagtggctgacctccctgcacccgtgggcgatggccgagccgctgcgcgacttcgcgctctcccacccggtcggcgccggactgaccgtcgccttcctccaggtcgtcgtcggcgtgctcaccgtcctcggcctctggcagcgggtcgccgccgcgttcggcgcgctgctctccg

SEQ ID NO: 3702 - DNA, 4413 bp, Unknown
  Kingdom: Bacteria, Phylum: Actinobacteria, Class: Actinobacteria, Order: Streptomycetales, Family: Streptomycetaceae, Genus: Streptomyces
ggcggcggcgcttgcggcgctcgctctcctcggccgcgtcgaccagtacggcacgcacccgttcgccgttgcccttctccccggctccgccggcgcccatgcccgcgccgcccatcggcataccgggcgagccgggcatgcctggggagcccggggcaccgggtgtctggccgggggctccgggcgtctgaccggggttgagcccgttgccggaaccgtcgccgagcgggccgccgccgagggcggagaggctgttgtcgaggccggccgagtttcctccgccattggtgagaccgaggccggacagcggcaggtcgcgggagacggtgctcggcccgccgcccccggagccgccgccggaaccgttgccgttgccgttcagcccgaggttgtcgaggtccagccgatcacgggtctcccggttcgggtcggagttgagcccgtccaggtccacggtgcgggtgttgccgtccgggtcggtgatcgtcgtacgcccggtctccgggtccacggtctgggtggtgccgtccgggaacgtcgtcttgagcatcccgttgtcgagcaccgtcttcgacccgtccgggttggtcaccgtcgcgccgtgcgtcaggtcgacggtcttcgtcgaaccgtcaggattcgtggtggtcaactccccggtgtcggggtcgaacgagctgcggctgccgtccgggaacacattgttcagatcgccgtcgaggcccagcgaggtacgcccgcccgtcggcgtctccagtccgtcgccgttcccgccgagacccaggtcacccagcccgtcgagcccaccgttcccaccgttcagaccgcccaggtcacccagatcgctggtcgacgtactcccgtccgggttcgtcgtgacggtctccccggtccggggatcgacgacctgctgggaaccgtccgggaaggtcgtcgtcagattcccgtcccggtccagcgacgtgaccgagccgtccggattggtgatcttcgcgccgtcacccagatccaccgtactcgtcgaatcatcaggattcgtggtcgtcaaccgaccggtgtcggggtcgaacgagctgcggctgccgtccgggaacacattgttcagatcgccgtcgaggcccagcgaggtacgcccgcccgtcggcgtctccagtccgtcgccgttcccgccgagacccaggtcacccagcccgtcgagcccaccgttcccaccgttcagaccgcccaggtcacccagatcgctggtcgacgtactcccgtccgggttcgtcgtgacggtctccccggtccggggatcgacgacctgctgggaaccgtccgggaaggtcgtcgtcagattcccgtcccggtccagcgacgtgaccgagccgtccggattggtgatcttcgcgccgtcacccagatccaccgtactcgtcgaaccatcaggattcgtggtcgtcaaccgaccggtgtcggggtcgaaggaactgctggcgccgttggggaagtcggtggtgatcccgccgccgtcccggagcctggtgttgccaccggtcggcgtgttcaggccgccgcccgggccgccgtttccgaggaggttgcccaggctgcgggtgaactcctcgttcgggttgttccgggtcccgtcctgcgggttgttgccgccgaggttgccgaggctctgggtgagcggggggatgaccggcggcgggagctgcccgttgccgcccagtggaccgccgtcggtgttcagcgtgccaccgtcgcccaacggcgagttgaggttgcccaggtcgccgaggccgttcaacgcgttgttgctggcgttgcccaggtcgttcaggaaatcgttgttggcgttcccgaggttgttgagatcgtcgagcgcctggttgttgatgttccccaggtcgtccaggacggtcttgttgttgttcccgaggtcgtcgaggatgtccttgttgttgctattgaggtcatccaggatgtcgttgttcttgttgttcagatcatccaggatgtcattgttcttatcgttcagatcgtcgagtatgtcgttgttgttgttgttgaggtcgtcgaggaagtcgttgttgttgtcgttgagcttgtcgagccactcgtcgatgtccggcccgccgttgccgccggggtcgttgagcttgtcctcggcgtagtcctcgcccgcggtactggtggtcctgggcttcggtacgttctcggtgaagtccttggcgaggtcgaggaagcggttgttcagcttcgacgtctccgtgatggcgggccggacgagctcctggtcgacgccctggttccagagctcgacggccctctcgccgaccttcttccagttggcgatgtcgctcaggtcgccgtaatcggggtgctcctggaggaagccggccttcggtgagtgcctgaccgtggtgtagcccgcgccctggtacccggtgtgtgtggtggcctcgatggcgctcatgccgatgttgtgctcgttgacccagcgggcgaggtcgtcgagcacgaagcgcagcacccgaagggggtcgtagtagtcggtcttcgcccacgtcagccaagcgtccaacaggttggaggcggcgtccttgaggctctggctccccgtgctcagagctcgggagtacaccgtgctccccgtggcgctcgcgtcgtcggcgttcgagctcgccccgaaggtctccacatagccctcgtagttgtcgtgcaccttcttcaggaggtcacggaagacgttcgccgcgtcccctttccagctcgcgtcctcccgggagaagcgctcctcccagtccttgaggatgaccgccttgtccttgaagaactgcgcggcccggtcgaaggactccccggtcgccacgaaggacttgagctccaccgcgttggcgtcgtccaccggaaggccggcgaacttgactccgtcggtgccaccgtcccgcagggccatgagcgcggctcgcggcccgttcatgtagcgggccagcgggatggtgctcatctcctgcttgttgtagtccttgaagtcgttgccctcccggacgccggcgtcgtccacgtcgtccgcgtccgtgcccgcgaagtggatgtcgttgtccgacttcacccggccctcgaagacgatgcgggcctgcatgagcgaggacttcttgttcttgtccaggaagaagatgtcgtagtcctggccctcgttcacgaggaagccggactccgagacgacggacttgaggtcccgttcgcggatgtccatccggaacagcgggcccccgctggtcgaggtgagcttctcgaagatcgtcttgcggtccggcaccggatagccggtgatgtgcgtcaccagcgtcgcccaggcgtccgaggattcggactcgaacccctccagcttgtcgacattcgccttggagttcgggtcctcgttctggacttcagccacgggtacccccttcggtactggtccgggtcaggatgtttcctcgtcgtcgccacccgagccaccgacggtgagggcgtccacctcgtcgaaggtctggagcagcgtctgcgcgtcgatcgcgtcgaggttcttttccttggtcttgttcgcttcctcgatggtctcggtgagggcttccttgagctccttgaagagcgtcacctgctcaccgaggagttcgtcgatcttggtggcggacgtggtgatggcggtcaggaacgtcttgccggagaccaggtcctcatggtctccacggccgatgtgcccgatccgcaggatctggtcggccttcttcgggttgtccgtggtggtgtatccggccaccagatcgccgagcgggcggatgccgctgtcgggggtgtcctcgcgggtgaccttggcgtccttgcgtaccggctcgacctccaggtcccggaagttctccatctgcttgaggtcgaagtgcttgacgtcggccttctcagccatgggacgtcctcctggggttcggtgccgggcggttcgggaagcgtcgggcggcggtcggctcgcccgcaccgcgtccgggttccacccgccacgacggcgggtggaacccggtgggggaactaacgggcgcgcacaccgccccagttgtcggcgctcctgcgctcgtcgcgggagtggttgtcgtggatgctctggaccagctcgccgctgtcgccgaggagcagggccatgttcttggtcgcctggtcccactcggcctggactccgcggtacatcgcctggtcgtcaccctcccaggaagtgatgagcggcttcagctcgtcctccaggttgttgagggtggtgatgatctgcttggtctgctgggtcagctcctcgatcgcgttgcggaccgtggagtactgcacatcgatgatgccgtcggccatgacatctcctctcgggtggccgggcgccagggcccggccacccgagaggag

SEQ ID NO: 3703 - DNA, 3163 bp, Unknown
  Kingdom: Bacteria, Phylum: Actinobacteria, Class: Actinobacteria, Order: Streptomycetales, Family: Streptomycetaceae, Genus: Streptomyces
gagcagcgccccgcagaccgacccggtggcgcgggaggggccgctgtggttcaccgcgagccgcaacccgtgccggacgtcctcgctgaccagcgcgcagtacacggcgacggcgaggacctcctcggcggcgtcgctcgcacccagcgcctcgatcagggccgggcccgggatgccctgccgcacggagccgagggcctggcgcagggcctcggtcaccggctcgtggccgggtcgttcgacgagcagggccagcacgttctgcacggacccgtccaggctctcgccgcgtgccagtccgtgcacgagtacggcgaaggctccggcggccagctgcgcggcggggtggccgtgggactgggccgcgcactcgacggccagttggagcacgagacccggctcccagcccacgaggagcccgaacggcgcggaccgggtgagcgcgcccgcgtcccgtgcggtggggttcttcggccggtcgagggtgcccatgacggggtcgccgaaaccgcccaggcattcccggccgggggcacggcgggcgtagagccactcctcggcggccagccagccgttgtcctcgcgccgctcgtcgggcccccagtcgtgctgagtggcggcccagcgcagatgcgcccggtgcacatcggtgggcgggtgccaggccccggtgtcgcggcggacctgggcgcggatcagaccgtcgacggtgaacagggtgagctgggtgagggcggtgacggccccgcgtctgccgtgcgcggggacgtagtcggtgaccccctcgacgccgtgagcggcgcggatctcctccagcacgaggccgctgaccccggctccgagcgcgtccccgacggctccgccgagcagcgccccgcggacccggctgcggaagtcctgctgttcggcccggccccagaccgccgtggtccctgagctcaccccgccccctccccgtcaccgcgtgctcgcccgttcgcgggcctctgcgggcgaccgcgcaagcactgtaatcgaacgggaacgggcggtagagggggcgacctgggtacgtacgggtatgtcgacggacgtcccgcaggtcgtttttgaccggtgcgagatgtcagcggtggagcggtgctcgaaaccgagccgttccgccaccaccccggcgacggtcgacttcccggtgttcggggttccgccgatcagcaccacccgcacatcgcacaggtccccggccctacgactccgcccgcgcccccagccgctcccgctgcgcccgcacccacgcgtagtccgggtccagctccagcgcccggtcgaggtccgccagcgcctccgggatccggccgagcgcctcgtgcgcgagggccctgctgccgtgtgcccaggcgtagtcggggtccagggccagggcccggtcgtagcaggcgacggcctcctcgggccggcccgtcgcccggtacacctcgccccgctccccctccgttccggccaggccgggggacagctcctcggcccggtccaggtcggcgagagcgcccaccggatcgcccaggacggtgcggacccgggaccgtctcaccagcgcccaggcgtactccggccacagcgcgatcgcccggtcgaagtcgtcgagcgcctcctcgtgccggcccagcacatggcggaccaagccccggctgccgaggggcacggcgtcggacgggtccagggcgtgcgcccggtccaggacggtcagggcctcctccaggcggcccatccgccggtaggtctccccccgctcccgcaccgcccaggcccaggagggcgcgatctcctcggcccggtccagatccgcgagggcctcctcgtagcggccgagcgagcgcaggatcaccgcccggccctggtgggcgcgttcgctgcgcgggtccacggcgatcgcccgcccgtggtcggacagcgcggcgtcgagctcgccggcgcggaagcggtcccaggcgcgcaccaccagcgcggcggcccggtccgtgtcggtcagctcggcccgggtcagcaggagcccgagggcggcggtggggcgggggccgtggtccgttatggctgccagcaggtcccggccccagtcgcgcagtacggcgttgtcggcgtcctcacccgcctccacgagggtccgggcccagtggcgcgcgcgggacggcgcctgcccgcacagctcgatcccggcgcgcagggcctcgggcagcgcggtgcggggacgggcgcacagccggtggtacagcacgtccagggccgcccggcgccagggctgttcggcccagaggcgttccgggtcgatgccctcggccgccgcgtcccgccgggccgcgaaggcctcggccagccggtcgtgcgccgccttccagcgccgcggcgatccggtgcgctggagccggagcatcggggcccggacgacggcgtggtagcgggagtggccggagtgccgctcggcgacgaacggcagctcgtgcaaccagtcgtagagatcgggcacggcgtgcggcccgttccgcggtgcggccacggcgacggcgaccaggtcctcgtcgaaccggcggggcagcgcgcaggccagcgcggccgcccggcgtgccgggtcgctctcccctgccaggaagcgttcgacggcggtggcgttcgcctccccggccgccccgggattggcggcgagcgtggagaccaggatgggcagcccgccggagagccgcagcacctcccgtacgacggactccgtcaccaccccgcgcccgtgcaggagttggcgcgactcggcctccgtgaagggcccgagcggcacgtcggcgaccagccggctccggtcgccccagtgcacggggtccaggcggcgctgaccggccagggtgagcacgaggttggcgggcaggtcgccgtaccgcccgggggtcagcaggtccgccagccaccggtccagttggggtgcggtgcgctcgtaggtgtccaggaacagggcgatccagggcacggtgtccgcgacccggtccagctcggcgacgaagaccggagtgaggacccgtaccggttccgccagcagcagggcctcctcctgctgccgggcccgccccccgaacaccgcccgcagtccgcccgcgccacgcgccacgaccgccgggtcgatgccgccggccagtgccccgac

SEQ ID NO: 3704 - DNA, 6281 bp, Unknown
  Kingdom: Bacteria, Phylum: Actinobacteria, Class: Actinobacteria, Order: Streptomycetales, Family: Streptomycetaceae, Genus: Streptomyces
gcggcccggcgcgccgggccgcctcgcgggttcagacgctcttccgggccgcctcgcggcgctgccgtttgcccagcggcgcctgggagaggtcctcggcggtgctcctgaggttcttgtagccgtagccgcgttcggccagccacgccttcgcggccgtctcggcgcgttcggtggcttcgaggatgtcctcctccgcctctcccccgtccacgtaccggaaggtgaaggccggtcgcgcggcgaggtcgtagctgaggtttccctcgggcgtgaaggccgcgcgcaggacgtcgtgctccccggcccgggccaggagctcggcccgctgttcggggccgagctcgtcgaagacaccacggaccatgatgcggaaggttcgagtactcatccggcgaccctaaacagcgggaacgaagtcgctccaccgagtttcccgcgacggaccgccactgccgtatcaccgccgtacggtacggcgtcggcccgcacccgggtccgtggtcgggccccgcgttgcggcaggggtgcgtccggcacgtacggtacggcaggtgaacgaaccgctcgaagccgtgaccggcccctctgcggacgaacgcgtccgggccacgacgacccgcgtgttcctggcgctcgccccgccggacgacgcgaaggacgagctggcacaggcgctgcgcccggcctacgacgcctacccccggatgcggtggaaccgtatcgaggactggcacatcaccctggctttcctcggtgaactgccggtcgccgccgtcccgcccctgatgcctccgctcgccgggctcgcggcgggacgacggcctctgcggctggcgctgcacggcggcgggcacttcgacgatcgggtgctgtggaccggggtcacgggggagctcgaagggctgcatcacctcgccaccgacgtacgcgccctcgtcagggagtgcggtgtgtccttccccgagcggccgctccggccccatctgacgctggcccggtcccgccggggcgaccacgcggccacggtggcggccgcggaagggctcgccgcgttcgccggccggagctgggaggccgggcgtctccacctggtcggcagcaacatcggccggggcccggggccgatccactaccgcgacatcgaggcctgggacttccgccacggaacggacgggacctgaagagattcttccggaagcgtgacgccatcgcgaacggccccccgtcggcgtcaggttgcggcagaaccgtccccacggcctggtcacgttccggtgagtcgtaacaaagccggtcagttcgagcctcgttcgggcgccgcggaccttcggcgtatccacccggccgacgaacccgacgcaaggggagccgggtcggcgtccggtctcacgaagtttcgtgccgcgcgggccgggcgtgtgtcagcaggaactcggtcgcccgcgcgatggcctcggcggacgtgccgtggacggcctccgactcgtcctcccgcaggtccgcacccgtggcggtgtaccaccaggcgtcggcgcccggatcgtggtgaatgacggcgtccccgcccgcgtagtggagcggaatggactcgctggctgacttcttgggcaccgcgtggggccacttgaggcgggccgactggcgcttgatgccaccccaggccgcgccgagctgcgcgtagctggatccaccgcgtccggcgacggtggccgcgctctcggccaggcggtcgacggaccgcttggcttcgtagagggaccgcagcatcgccagctgaacatcgggagcggccatgagcgaggcgtcgaagggcttgccggccgcgcggtaggccagcgcgcgcgtcgagatccgttcggccagtgaccggaccgcgtcgagcacctgctcgtccatggcgaacgtgtcgttgtcgccgggctcgttccaggcggggtccaccggagtcaggaccgtggcccagaagttctcatcgctctggtcaggggtcgggacagccatctcgtcatccatgcgacaaccctaactgtcacctcacatttcggcaattcattttgtcgaggcatgcagtgacagccttagctgtcaccggaactccataactatacctttcgtaaggtacagttatggggatcgagacggttctcacagtgaggctcaccaagggatgaccatcagcacgaagcggcgctggctgctcctgacagtggtgagcgcggggctcctgctgatcacgctggacaactccatcctgtacgcggccctgccgactctggtgaaggatctcggcgcgagcagctccgaggggctctggatcatcaacgcctacccggtcgtgatggccggcctgctgctgggcagcggcacgctcggcgaccgggtgggacaccggcggatgttcctgatcggcctcgtggtcttcggtgcggcgtcgctcgtcgcggcgttctccaccagtccggaggcactgatcgccgcgcgggccttcctcgccgtcggggcggccgcgatgatgcccgccacgctcgccctgatccgcgtcaccttcgaggacgagcgtgagcgcaacatggccatcgcggtctggggcaccatggccgtcgtgggcagtgcgctgggtccgatcatcagcgggatcctgctgcagcacttctggtggggatcggtcttcgtcatcaacatcccggtcgtgctcgcagccgtcgtggccacgctgtacgtcgctccgccgaacgaccctgacccctccaagcgctgggacctggtctcctcgctcctggcgctcgtcgccctggtcggcctcgtcatcgcgatcaaggagacggcgaagaccgaccccgctccggccgtcatcgccgccgccgtcctcgccgccgcgaccggcgggtggacgttcgcccgacgccagcgccgtctgccctaccccctgctggacttcgcgatcttccgcaaccgggccttcctcgcgggggtgctggccgccggattcgccctgttcgccatcgccggcatgcagctcgtcaccacccagcgcttccagctcgtggagggcttcaccccactacgggccggattcctcgtcgcggccgtcgctgtgggcgcgttccccacggcgatgctcgggggcgccgtcctccaccgggtcgggctgctgcccctcatcaccgggggtctcgccgtgggcggcgtcggcaccgtgctggtgctcatgaacttctccaccagcgtgggcctgctcgtcaccgggctgatcatcaccggcagcggcctcggcgcggccatgtccgtcgcgtccagcgcgatcatgggcaatgtcccggctcgcagggcgggcatggcctcgtccgtcgaggaggtctcctacgagttcggaagcctggtcgcggtggccctcctcggcagtctgctgaccgccgtgtactccgcgaccatcgagctccccgccggggtgtccgagcgtgcgcgcgacagtgtcgacagcgcgctcgccctggccggagaaggggcggggaccgacaacgcgctggtcaccgccgcatccgaggcgttcgacggcgcgtacctcgccgtgatgatcgtggtcgccgccgtcctcgccgtcggcaccctcgcgaccggcgtcctgctgcgccgccacggccccggttcggcgctgtccggccccgcacaccactgagtcccgcacaccaccgaccccacgccacgggagcaacgcatgcgaaccagcaaacggacccagatcctcgaagccgccacccgtgtcgtacagcgtgaaggcgtcaagagcgtcaccttcgactccgtcgccgcggaggccggactgacgaagggaggcctcctctaccacttcgcctcgcgcgacgacctcgtccgggcgatccatcagcatctggccgaccagtgggaagccgacctggtcgcggcggccgggaagcccgcggccgaggccacccgggaggaacggctcgccgcatacacccgggtcgccatccagagcgccacgcgggccgagctgctgctcatgctggaaggttcgacgaacaccgcgcacgcggccgcgtgggaagccgtgacggaacggtgggcgccgtccccgccgtcggcggccgacgatccggcggccctcgaccggttcattgtccgcctctcggccgacggcctgtggctgtacgaatccctgacctccgagcgcctggatcccgcaacgcgtcgggcggtcgccggccgcatcgccgatgccctgactcaccgcgacagctgatcacggtcaccggttcgccggcttcagccgctccaccgcggcacggagtcgttgccggccgggcgccggccctccgagggctcagtaggcgtcggcagcctcgcccagggcagtggtgagccggcccaggacttcctgcagcccgagaacctcgtccaaggacagtcccgtggcggccagcacgccacgggggacggacagcgcacggtcgcgcagtcgtgcacccccgtcggtcaggtcgatcagaacggagcgttcgtcctcgcggctgcgctcacgccggaccagtccggccgtctccagacgcttcagcagcggcgaaagcgtcccggagtccagatggaggcgctccccgatgaccttgaccggctggggaccgtgctcccacaggaccagcatgaccaggtactgcgagtaggtgagtcccaggtccttcagcgcctgccgatagaagccgccgaacgcgcgcgacgcggcgtgcaacgagaagcagacctggtggtccagtcgcagcagctccgtgtcgggaacgtcggagaggtcgggcgaggcgcccggagcggtggtcatgagaaccagcgtaccgccgccacacgattgagttgtgcacaacttagttgtgtgcaatctttatgttcgtcgccgcgaccatcccggtcgcggctcgagtggagggtcaccatggacgcgttgtacaccgccgccgccaccgccaacggccgcgagggccgtgccgtgagctcggacggccagatcgacctccccctcgccatgccgtcggccctcggcggcaacggccggggcaccaaccccgagcagctcttcgccgccggctacgcggcctgtttcgccagcgcgatggccgcggtcggtcgcgagatgaaggtcgacaccaaggacgcctccgtgaccgccgaggtctccatcggcaaggacggcgacggtttcgggctcgcggtggtcatgcgcgtggaactcccggactccctcgcgggcgagaccggtcggaagctggtcgaggccacccacgcctactgcccgtactccaaggccacccggggaaacatcgacgtcgagctggtcatcgagtagtcactcctctcttccggtcgcgcctgttcgctgcgcgcccgccccggcccccgacgttgtcgcggcgggggccggccgggaaggccttcggccggcccccgcgcatcgggacgtcactccttcaagcgggccagcaccgcgcccaccgcgcggtgcacggcctcgcgcgccccgtcggtcgggtcgagcgtctcgaagccgtgccgcccctccggtacgtcgatgacctcgacgttcgctccgcagcgggccgcctcggtcaggaactcctcgaccgtcgtggcgatttcggcactctcgcgttccgcccggaccagcacgacgggaagacggccggcccgggagaccgctcggaccgggtggaagcggctgccgcccagtccccagctcggcagcggcgcgaggatcgggtagttcgccgccacgcagcgcagccacgccggggggttcgtcagccagtccgccatgatcgggcccccgccagagaagaaccacagggcgacccggtccgcgtccacccgtggatcggcgcgcacccgctccaccgcgtcggccacgtccgcggcggccacctcgtagtcggtcacggcgtgcaggcggtggtcgagcgtcacgcccacgaccccctgtcccgcgacgtggcgcgcgtatcccgtcagggtcggccagtcccggggggtgggccgtgcctcggcgggcaccggtccgccgtgcacgaacaccacggccgggtgcgggcccggaccgtccggcaggtacaggtcggtgttcccggcccgttcgcggtgccgttcgggcacgtcgaggaggaacggccgcagatgcgcgggcgttcgggcggcgtcggcggcggtcagccggtgtcccccgccggacgccgcctcgatcagggtcccggccagcgcggcggggcaggacagcatcg

SEQ ID NO: 3705 - DNA, 7774 bp, Unknown
  Kingdom: Bacteria, Phylum: Actinobacteria, Class: Actinobacteria, Order: Streptomycetales, Family: Streptomycetaceae, Genus: Streptomyces
  misc_feature (7597)..(7598): n is a, c, g, or t
cccgccgcctgcccctggcggaccatccacaggatcgtgaagcccagcaccaccagacccgcgagggcgaccacgagccgcgacctgagcaccacgcccacgatcaccagcagcgccgcggccaggaacggcagcaggatcgacaccagcacccccgactccgcggcggtgatcccctcgaagaggtcccgcacccggtagtcgtgcccgacccgcccggcgtaccagtcgcggaacgggctcagcaccgccgaggccgccccggccagggcgacgagggagccgaggacgttgcggatcatcgtcagcctccagggcgtcgtcccgcgaacacacgcgtcccccgcagccgacgctacgccgggacgatcacccccgccacgcggacgatgacgggaccgtgacagggtcatgacttggacatggggtcgcgtgcggcatgctgagggtgacgacgcacgccatcggcgcgacgtaccggcaacgaaactcaaggggggctgcatccatgatgcggcgacagatgaagctcgcggcggtcctggtcgtggtggtgctcgcgctcaccgggttctccacctccaccagcggcggcaagggcggcaagagcaagagcggcaagagcagcagctcgggcggcggcggctgctccagctcgaagaagagcaacaacggctaccgcgacaacgacttcgacgacgactacgacgactcctcgtcctccggctcgtccggctcctacggaaccccgacgcccaccgcgtccgacgcccccgcctaccggatcatccgctgcgcccagccccgcaagggcaagcgcaaggcggtcacctcgtcgctgatcgagctgcgggcgaacgagccgggctcgcaggcgtacgagatcgacgtgcggttcgtcgacggcctcggcaacaccatggacaccgccgagaccaccgtgaacctcgacggcggcgaggtccgcaccttcaccctgcgtatggagagcccccgcaaggtgtccaaggtcaaggagtgcgaagtgaccgtcgaggtcctctgaggccgtgtacctcgcgcggacgggacggacggacggggctcatcgcacccgggctccctcgaacgctcaccgcacctggggatccccgctcccaccccgtccctcgaacagctccgcctgccgctccggcggcagattgcccagggcgatcagcgccggggcctgggacatcgcctgggtcctggccgcctccttcgcggaccacaccgcccggacggtgccctgcaccgcctccgtcgggtagcgcgcgatcaccgtcgccgaccgcagcgccgccgccaccgcgccgcccggctccgtcacctcgctgaccaggccgatctcgtacgcccggccggcgctcagccgttccgccgtgcccatcagggacatccgggcgacctccccgaacggcatccgctgggccatggcgatcgcctcgtacgccgggaccatcccgtacgtcgtgtgcgggtcgaagaacgtcgcctcccgcgaggcgaccacgaactccgcctcgcccagcagatagaacgccccgccgcaggccatcccctccaccgccgcgaccacgggcttccacaggtcgttcgccttggggccgatccgcaggaggggatcgtcgacggcgtacggggacgggggctgcgggacggtgacgccccggtcgatccccgtacagaaggcacgcgttccggccccggtgaggacgaccgcccgcaccgactcgtcgtaccgcaactcctgccagaacgagccgagttcacccgccgtctccaggtcgatcgcgttgagcttcgccggccggtccagggtgacgagcgcgaccccggtcttctcgtcccgctcggtgcgcagggccatcgctcaccgctccaggagccagcggacgagcgtgacgccgcccccgggtcccaccgggcagaacgcggcccgcaccggagctccgatccgcagccgcgccgggtccaccgagttcagcggggcgtccggggaggcgacgacgttccccgccagccggatgtgtggggcctccgccagctcgaccagcaccgcgttgtacggagcctgttcggcgtaggcggggagcagcggcggatgcgggacgacgtacgaccagagccggccgcgcccgctcatctcccgccagtcgctcgcgaacgtcccgcagtgcgggcagcagggccggggcgggaagcgcagctcgccgcaggcgggggaggcgcaggcctgcacgcgcagttcgccgcgcgcggcgtactcccagaagggtgcgccgtcctcgtcggcgacggggagcagcagggaatcgttcacggccatgtcctcaactcctcagcagtacggccgacgtcggcacgccctcacccgcggtgaccaggcaggtggcggcgtcgggaacctgggcggtggaggtgccgcgcagttgtttcacgccctcggtgatgaggttgaagccgtggacgtacgcctcgctgagtccgccgcccccggtgttgaggggaagccgcccgccgctctccagcgctccgccctcggtgaacgcgccgccctcgccgcgcccgcagaagccgtagccctccagggagagcgggacgagcggggtgaacgcgtcgtagatctgggccacatcgacgtcgtcgggcccgaagtcggcctgtttccagagctgtcgggcggcggtccaggcagggccggtgagcgggtcgtcgttccagtagttgaccatcccgtggtgctgggcgggcagtccctgggcgacggagtggaggtagacgggcttttgccggcagtcgcgggcgcgttccgcggagacgacgacgcacgccaacgctccgtccgtctccaggcagttgtcgaagaggcagagaggctcgctgatccagcgggaggtcatgtacatctcgcgggtcagcgggcggtcgtacatgatcgcggccgggttctggttggcccggttgcggcaggcgagcgccacgttgaagagatggtcgcgggtggccccgtactcgtgcatgtagcgccgggccagcatgccgatctcgtcggcgggccgcagcagcccgtaggggcgggtccactgggcgggtgtggggagctggacggtggtgttcttccacggccggggtccggagccgcgtttgcgcgaccgccaggcgacgccgacgctcgcctgtccggtggcgacggcggcggcgagatgggcgagcgtggcgcaggagccgccgccgccgaaccccaccttgctgaagaaggtgacgtccccggcgccgatcgccttggcgacctccacctcgtcggtctcctccatcgtgtacgaggcgaagccgtcgacctcggcgggagcgatgcccgcgtcgtcgagggctgccaggatcgcccggcaggcgagggtcttctccgattcggggagccgtttcgcgaacgccgtctgcccgatgccggctatcgccgtcgcgtccttgagcgttgccatccgctgacctcccgcaccgtcgcccctgctgacagcggcagaggctaccgctaatctgacggatagtcagctagtgcggcggcaggagggcgcgtgatgcggggcgacgaggaatggggcagcatcccggagctggtgcggacggcggcgcggcggttcggctccgccgaggcggtggccgacggccgtacccggatctcgtacgccgagctcgccgagcgggtggagcgggccgcggccgcgtgcctcgcctccggtgtggaaccgggggaccgggtcgcgatctgggctccgaacaccctggactggatcgtctccgcgctcggggcggtgacggccggcgcggtgctggtcccgctgaacacccgcttcaagggcacggaggcggcgtacatcctgcggcgcagccgggccagactgctgttcgtcaccggcacgttcctgggtacctcgtacgtggcgtcgctgcggcgggcggaggtgaggctgccggacctggagcgggtggtggtgctcgcggacacggctcccgaggactacacgagctggccggacttcctggcggcgggggagagcgtcccgccctccgccgtacgggagcgggctgccggcatcgccccctcggacccctccgacatcatctacacctccggcaccacgggccgcccgaagggtgcggtgatcacccatgcgcagacgctgcgcgcgtacgcgatctggagcgaccttgcgggcctgcgcgaaggcgaccgctacctcatcgtcaaccccttcttccacaccttcggctacaaggccgggatcatcgcctgtctgatgcggggggccacgatggtgccgcagccggtgttcaacgtggacacggtgctggcgaacatcgcggcggaacggatctcggtcctgcccggcccgcccaccctgcaccagtccctcctggaccacccggcgcgcgacgcccacgacctctcggccctgcgcctggtcgtcaccggggcggccgtcgtcccgctccagctggtggagcgcctgcgcgaggaactccacatcgcgacggtcctcacggcgtacggcctctccgaggcgagcggcatcgtcaccatgtgccgccggggcgacgcgccggaggtcgtggccaccacctccggccgcgcgatccccggcaccgagctccgcgtcctggcggaaccgggcgctccgggcgaggtccaggtccgcggcttccacgtgatgagcggctacttcgaggacccggacacgacggccgccacgatgaccgaggacggctggctccgcaccggcgacgtgggtgtcctggacgcggcggggaacctgcggatcacggaccggatcaaggacatgttcatcgtgggcggcttcaacgcctacccggccgagatagagcagctcctcggcctccacccggacgtggccgacgtcgcggtcatcggcgtcccggacccgaggctcggcgaggtcggcaaggcctacgcggtccgccgcaggggcgcgacgctcaccgcggacgacctgatcgcctggtcccgccgcgagatggcgaacttcaaggtgccgagggcggtggaattcgtcccggagctgccgcgcaacgcgagcggcaaggtggtgaagggggagttgcgggggcggtagacctcggatcggggacgttcgttcggtttcgccggatggggcgaatgaggaaggccgtcgccataccctcgtggcggtatggtcgagggtatggcaaccaagaagtacacggtcaccctgccggaggagctggcggaggagatccgcagcgaggtgggccccggcgcgttcagcgcgtatgtcacgcgggccatagagcggcagcgcgagcatgaccggctgggggagctggtggagcgtctggagggcgagtacggccccgtcaccgatgccgacctgacggcggccgaggccgagcgccgcgagatcgagcagtggttcgccgaccaggaagcggacgcccccgcacgccgggacgcggcggccgtctgatgccggacatcacttacgtactggacggcgaggccgtatcgcgggcggccctcggcaacccggagatgaagagccgactcaaggacgcccaccgggcgggcatccgcgtggtgaccagctcaatgaccttgatcgaggcctatcccagcaagatccggcggccggtgtgggaccgggcgatgtccgggatcgtcgtcgaacccgtcaccaaggacatcgccgacgaggcgatccgtctcctgcgcgaggccggactccacggccaccagtacgccatcgacgccgcgctcgccgcgatcgcgaaccgtcagccgggccggacggcgctgttcacgtccgacgtggacgacctggggaagctgtgccggccgagagttcagctgcggggcctgtaggcacggtcccggacatgcgggaggggcccgagtgcttcccccgactcgggcccctcaccattcccccgtaccgcgaccgcggcggctccccctcggcgtcgccgcggtcgctttccccctggggccccgctcagcgcgggtccggccccgtcatgtggctgtccgtgggcttgatcgcgggttcgctcgtcatgtggctgtccaagggcttgaccgtgggctcgcccgtcatgtggctgtcctcgggcttgatgtcgcccgcggtcccgggctggacctggggcggcttgatcttcttcgcttcggtcatgggtgaactccgttactcggtgcagggactgttggcgaagcccgtccggctgctcccccgtgggctgccggacgggctattcagagccgttcaccttagtgctcggttccactgccgaatcgtctgccccccgacgcgacgtttcgacagaggcaagactgcacggcggcgataaacgaacgatgaacgtgactcagctttcgctgggggctcccgtcatggagagcagacgggaaacggcctcgctctcgggagccctcagctgctcgaagacggagagcgcctcccgccagcagacctgggcccggtcggcctgtcctatgccgtggagcgcccggcccagcaccgtgagcacattggcgcgccgccactcgccgcctatgtggagcagcatggtgagcgcctgctccgccagggcggcggcctgcgccgggcgctcggcggtgagttgcacctcggccagacggaacagcgtcataccctcccagaggcgctggcggctctcccggaacacggacagggcctcggtgagccgcacttgcgcctcctccggccggttcgcgcgtgccagcgccagccccagggcgtagcggccgttcgccagtcgcagcgtcaggcccatccggttgtagagcgcgacgccctcgcccgccagcttcaccgcactggcggtccggcccatggcgagatggacacgggagaggttgcacagggcactggcctcgccggcgtgattcccatccgcgcgaaacgcggtgcacgcctgcctgagcagcgcctcggcctcctcctgctggttgcggtaaccggcgatgatgcccagctcgttcggggcgttgcagtgcgtccacacgtcgtccaccgaaggggccagcagcatggctctgcgtgcctcgtcctccgcctgatcgaaacggccggccatgctgtgcacctgcgcgagtgtcgtccgcgccctggcctcggcgtggggatcgccggcctcgaccgcggcgtccctcaccacggtggccgcagactcgaactgacgcgcgttcgctcccgactcggcgaggtccttcgcggccagcagaaggtccaccgcacgccgtatcgaggcgggcgcgcgattctgctggacacaggcgagcaggcaacttgcttccgtgtagagccagtcgagagctcggccgtgatcggtgaacgagagccctacgcgctccgtcccctccaggtggtccacggtccggtcccccggccgctccagcgcgtacacccccgcagccgtcgccaggtagaagtccagcagccgcgacagcgccagctcccgttccaccggaggctgttcgtcccgctcggcgcacgcacgcgcgtagaggcgcaccaggtcnnaggctcgtgtcgaccagggcctccaggaggtcctccgccacgtgcgggtccaggtccagcagggccgccgccgcggccagggagatgtccgggccgtccgcgaggcccaggaggcggaaggcgcgggcctgggccggttccagctggccgtagccgagctcgaacgtggccttcac

SEQ ID NO: 3706 - DNA, 713 bp, Unknown
  Kingdom: Bacteria, Phylum: Actinobacteria, Class: Actinobacteria, Order: Streptomycetales, Family: Streptomycetaceae, Genus: Streptomyces
tcgcggtacaggccgcgctgtcggcggaggtcacccacgcccacccggacggcatcgcgggcgcggtggccgtcgcggtggcggcggcgctctcggcgcgcggcgaactgacgctggacgcggtcgcggaccggacgcccgaagggccggtacgcgacggagtgcggcgcgccgcgcggacgccgttcaccacggaaccgtggaaggccgcggacctcctcggcaacggacagcgcatccgggccgacgacaccgtgcccttcgcgctgtggaccgcgacccgccacggggacgacctggaggcggcgctctgggcgacggcggagggactcggcgacgtcgacaccacgtgcgccatcaccgggggcgtggtcgggtcggcgaccgggacggccggtgcgccggagggctggctgcgcaggcgggagccgttgggctgaggcgacggcgggcggcgacggagtcggggcgacgggaccgaggcgccgggtgggccggtcgcccgggggccgatgctctcgacctgataccgatatcggacgcatcgaaattccgttcgcaaacgtgtcgtaccgtgagcgcatgaccaccccgccgcacccgccgcagggcccgtacgggccgccgcccccgcagaacccctacggccagaacccctacggcgcgccgccggccgcgccgggggccgtgccgcagcagccctacggctaccc

SEQ ID NO: 3707 - DNA, 723 bp, Unknown
  Kingdom: Bacteria, Phylum: Actinobacteria, Class: Actinobacteria, Order: Streptomycetales, Family: Streptomycetaceae, Genus: Streptomyces
caccgcgtcggcccccgcctccgcggcgatctccaggtcggcgtccagggtgcgcggatagcggtccaggtcggcggcctcgccgaactggagcggattcacgaagacggtgaccacgacctggccgtccgcaccggccgccgcgcgggcggcccggatcagggcggcgtggccctcgtggagcgcgcccatcgtcatgacgacggcccgctcggccccggcggggcgggacagcgcgtccagctcggcggcggtgcgcaggagggcgggccggaccgtgcgcgtcatcgggtctcccccggtccggggccgccgggggcgctcctggtcggccaggacgacgaggaggtcctcggccagctcggccttgagcaggccgtgggcgagtgcccggtcggccgtggcgcgggccatctcgatatatccggccaccgcctgcggggcgtgctcgcgcagttcgccgatgtgggcggcgaccgtgcccgcgtccccccgggcgaccgggccggtcagtgcggcgtcaccggagcgcagggcgttgtccagggccgcgccgagcagcggaccgagcatccggtcgggggcggcgaccccggccttggccagcagctccatcgactgggcgaccagggtgaccaggtggttcgcgccgagggcgagggccgcgtggtagagcgggcgggactcctcggcgatccactcgggctcgccgcccatctcgat

SEQ ID NO: 3708 - DNA, 1990 bp, Unknown
  Kingdom: Bacteria, Phylum: Actinobacteria, Class: Actinobacteria, Order: Streptomycetales, Family: Streptomycetaceae, Genus: Streptomyces
gagcgggagtgtacgaacgtacgctccgggcgtacgctcgtacatccgtgcatccgcacgcccgaaactcgccccctcctcccgtactcaccgatctcccgcacccactgatcttccgtagcccctgatctcccgtacccaccgatcttccgaggcccgactgccatgaagaacccgccggtcatggacgccaccactcgccgctggcgcgcggcgctcttcctcttcatgctcgccaccggggtgagcatggcgtcctgggtcgcccgtaccccggccgtccgcgacgcgctggacgtgacgaccggatcgatgggcctcgtgctgttcgggctctccgtcgggtcgatggccggggtgctggtctccggcgggctggtgcgcaggcgcggcgggcggcgggtgatcgccgccggggcggctctgctcgtggccgggctgctggtgatcgccgggggcgcggcgctggaggtgtcggccggggtgttctgcggactcgcgctgttcggcgccgggatgggcctggcggaggtggcgttcaacatcgagggcgcggccgtcgaacggaccctgggccgtcccgtcctgccggtgctgcacggctgcttcagcctggggaccgtggtcggcgcgctgctcgggatggggctgacggcggtccgcttcccggtcggctggcacctggcggcggtggctgtcgccgtggcggcggccggggtgtggaccgtacgggcgatcccggcgggtacgggacaggaggaggcggaccccgacgacgcggcggattccgacgatgccgccgctgcgggatccgggaccggcggcgaaaggcacccgggcggaatccgccggcagctggcggtctggcgggaccggcggctggtgctgatcggcctgatcgtgctggccatggccttcgcggagggctccgccaacgactggctgccgctgctgatggtggacggccacgggacgagtgcgacggccggttcgctgacgttcatgctgttcgccgtcgcgatgacgacgggccggttcactggcggacccctgctggtgcgctacggcccggcggccgtggtccgggccagtgccctcgtggcggcggcaggcgtggccctggtggtcttctccgaccacgcgctgctcgccggggcggcggtggtgctgtggggtctcggcgcctccctcggtttcccggtcacgatctcggcggcgggtgagggcgtgcggaatgcttcggcccgggtcgcggcggtgtcgacggcgggttatgcggcgttcctggtcggcccgccctcgctgggtttcctggccgaccaggtggggctgcggaacgcgatggtggtggtgctcgtgctgctgtgcggcgcggcgctgaccaccggggcgctgcggatgccgccctccggggtgagggaggagccgccgggtgcgccggctccgggaacccgtcagtccgacctggtgtagatcaggctctcgcccgtaccggccgtggaccggcgcaggtccccgtccgggagcagggtcagttcggtgggcttcccgggtgtgcaggaggaggccgggcggccggaggacaccgtggagggtccgatgcggaccgggccgtccccggcgggccggtcggagaggggggcggtgaactcgcagtggtaggtggatccggaggcgagggggccctcggcggtgaggacgaggacctcgtcgcccacatccccctgccggatggtcaacgtccgtgatgacgcgccctgttcaccgggtatggagcccgtccaggtgcccaggaagtccttcgggacggctccctcgccgccctgctccccaccaccggacccgccggagcccgacgggccgggggaggcggtcctgcccggggcggcgccgttcatgaaggcgtacaccgatccgcccgcgcctatcgccacgaccacggcgacggcgatgagcgcgacggtggccccgacggagcggcgttcccggg

SEQ ID NO: 3709 - DNA, 712 bp, Unknown
  Kingdom: Bacteria, Phylum: Actinobacteria, Class: Actinobacteria, Order: Streptomycetales, Family: Streptomycetaceae, Genus: Streptomyces
  misc_feature (277)..(278): n is a, c, g, or t
gcgaggacgggctgcggctctcggcggtcggccgctgcttccgcaacgagacccactacgacggcctgcgtcgcctctgggggttccacatgcgtgaggtcgtctatctcggcaccaaggacggagccgccgaacaccaggaacgtggcggggagttcatccaggaggcggccggacgcctcggcctgaccctgacccgggcggcggcagacgacccgttctacgacaacggggggtcgcgggcccgtctgatggcgctggacccggtgaagtacgnngcggctcggcatccgggccggctcccacggccccgcgtacagctcctgcgtcgccttcggcatggagcgctgggtgcacgcgatgatcctcgcccacggcaccgccgagcaggccctggagcggctccgcgccgccggttcctgatccgatcttcactcctggccgaccggccgtcacccgaacagaagcaagaggagcgatttctcccatggaacgtgtcgtagcgtggctcaacgagaagaatcccggcctcgacggcccgatcggcgtcgaggaggacctcatcgaggcccgcctcatcgactcgatggacttcctggagttcatcgacctcctggaggagatctcgggcagcagcatcgatctgcaggaggccaccatcgacgacttccgcaccctcgcgcgcgtcaaggagcgcttcctcggctccgcc

SEQ ID NO: 3710 - DNA, 4898 bp, Unknown
  Kingdom: Bacteria, Phylum: Actinobacteria, Class: Actinobacteria, Order: Streptomycetales, Family: Streptomycetaceae, Genus: Streptomyces
agcgagaacaccccgtccgcgccgggcagtcgcagctgcggcgtcaccgcgagccggccgcgtaccgtctccgcgcccagggtcgcgatcagcgggctggcggccactccggcggtccagatcagggtccggcagggcagcacccggccgtcggtgaacgtgacctgctccggtcccgcctcggcgatcgagaccccgagcgacacctcgatgttccgcttgcggagcacctccagggcggcctgccccagcttgtcgcccagctccggcatcagcttgggcgcgatgtcgatcagatgccacttgatcagccgcgcgtccagccgcggatagtgccggaccgcgctcgtggtcaggcgctggagacaggcggccgtctccgtgcccgcgtaaccgccgccgaccaccacgaactggagccgggaggcacgttcggcctcgtcgtgactggcgtccgccagatccagctgggcgatgacgtggtcccggacgtaggcggcctcggccagcgtcttcatcccccgggcgttgtccagcagcccggggatgtcgaaggtccgggtgacgctgcccgccgccagcacgaggtagtcgtacggctcgttcacgatctcgtccgtgatcttccggatcacgcagaccttcgcctgcgtgtccacgccgatcgccccgcccggcacgatcctcgtccggtggcggcggctgcggcgcagcgacaccgcgacggactggggtgtgagcaccccggaggccacctgggggagcagcggcagatacagctggtaggagaacggagtgacgagcgtgatctgggcctctcccggagcgagcctgcgctccaggcggcgtacgcactcgacgcctgcgaagccggcgccgacgacgagaatcctgggtggtgccacggtctgcgtcccttctcgggcttgcgtggttctgcgctcgcctgccccgtttaccgggtgattcactcctcatccttaaccggacccccgggcatccgcctcctgacaggggtgaacgggggcccgggcacggccgcgaagcggccgaccgccgtcgtggccgatggacctcggggaccggccggcccccctttgcccccccggagcgtggggagttcggcggccgcaccccgtgcgaggatgctgcggtgaccacctcgcccccctcgcccgtggccgacgactcctccctggccgacgacccgccccgcgatcacggcctgggcccccgcgccgccgcggtcctcgtgttcggatcgtcggccgcggtcctggtggtcgagatcgtcgccctgcgcctgctggccccgtacctcggcctcaccctggaaaccagcacgatggtgatcggcatcgccctcaccgccatcgcgctgggctcctggctgggcgggcgcatcgcggaccagatcgatccgcaccggctcatcggcccggcgctcggggtgtcgggtgtggtcgtcgcgctcaccccgctcctgctgcgcaccgccgctcagtggtccccggcgctgctcctgctggtcgcgtcggcgaccctcctggtgcccggcgcgctgctctccgcggtgaccccgttcgtgacgaagctccggctcaccagcctcgccgagaccgggacggtcgtcgggcggctgtcgggcgtgggcaccctcggcgccatcgtcggcaccgtcctcaccggattcgtcctggtctcacggctgcccgtcagctccatcctgatcggcctcggcacgctgctggtggtcggcgccgcactggccgggtggcgggcccgccgtcggcggcttgcctcggctgtggcgctggccgccgtcgtcgcgggctccctcgccaccgcgttcgcccccggcggctgtgacgcggagacccggtaccactgcgcccaggtcgtcgcggaccccgaacgggacagcggccgcaccctcgtcctcgacggcctgagccactcctacgtcgacgtcgaggacccggcacatctgaaattcgcgtacgtgcgcgccatcgcctcggtggtcgacaccgccttccccgcgggcgagccgctgaccgcccaccacatcgggggcggcggcctcaccttcccccgctacctcgcggcctcacgccccgggacccggagcctcgtctccgagatcgacggcggagtcgtgcgcatcgaccgcgaccggttgggccttgcggagtcgaccggcgtcgacgtacgtgtggaggacggccgactgggcctgcgcaggctggaggcggggagccacgacctggtggtgggcgacgccttcgggggagtcagcgtgccgtggcacctcacgacgtcgcaggcgctgggagacgtccgccgggcgctcgacgaggacggcctgtacgtcgccaacctcatcgaccacggcgagctggccttcgcccgcgccgaggtcgccaccctcgccgagaccttcgagcacgtcgctcttctcgggaaacccgcggacatcgggctggatccgaccgcgtccaccatgggcggcaatctggtggtggtcgcctccggccggccggtcgacgcacccgcgatccaggaggccctggacgcccgggacgtcggctggaagatcgccaccggggacgatctcgcctcctggaccggggacgcccaggtgctcaccgacgaccacgcgcccgtcgaccagctcctccagcccagccgcacccggacggcccggtgactcccgggccgtccgccgggcggctcacccgtgccaggaccgccacagggacgcgtacgcgccgtccgccgccaccagctcgtcgtggctgcccagctcgctgatccggccgtcctccacgaccgcgatcacatccgcgtcgtgcgcggtgtgcagccggtgcgcgatcgccaccaccgtgcggccctccagcacccgggctagcgaacgctccaggtgacgggcggcccgcgggtccagcagcgaggtcgcctcgtcgagcaccagcgtgtgcggatcggccagcacgagacgggccagcgcgatctgctgggcctgcgccggggtcagcgcgaacccgcccgaaccgacctcggtgtccagccccttctccagggccttcgcccagccgtccgcgtcgaccgcggccagcgacgcccacagctccgggtccttcgccccgtcgcgggccagcaggaggttgtcccggagcgagccgacgaagacgtggtgctcctggttgaccagggccacatgctcgcggacccgttcggccgtcatccgcgacagctcagccccgccgagcgtcacctcaccggtgcgcggcgcgtagatccccgccagcaggcggcccagcgtggacttgcccgcgccggaggggccgaccagggcgagccgggtgcccggagccacgtcgagcgacaccttgtgcaggacgtcgacgccctcccggtagccgaaccggacgtcgtccgcccgcacgtcccggccgtccgggccgaccccggcgtcgcccgcgtccggctcgatctcccggacgccgaccagccgggccagcgacacctgggccacctggagctcgtcgtaccagcgcaggatcagaccgatcgggtcgaccatcatctgggccagcagcgcgcccgtcgtcagctgcccgaccgtgatccagccctccagcacgaaccagccgccgagcagcagaaccgcgccgaggatcgtcacgtacgtcgcgttgatgacggggaacagcaccgaacgcaggaacagcgtgtaccgctcccacgccgtccactccgtgatccgccggtccgacagcgccacccggcggtcgccgagacggtgcgcctccacggtccgcccggcgtcgacggtctccgcgagcatcgcggcgacggccgcgtaaccggcggcctccgagcggtacgccgagggggcgcggcggaagtaccagcgtcagcccacgatcagcaccggcagcgcgaccagcacggccagcgccagcgggggagcggtcaccgtcatcgcgccgagcagcagaccggcccacacgacgccgatggccaactgcggcacggcctcgcgcatcgcgttcgccagccggtcgatgtccgtggtgatccgggacaggagatcgcccgtgccggcccgctccaggaccccgggcggcagtccgacggaccgtacgaggaagtcctcgcgcagatcggcgagcatctcctcacccagcatggccccgcgcagccgcatgctccgggtgaacagggtctggaccaccagcgcgaccgcgaagatcgcggccgtgcgctccagacgcaggtcggctacgccgctggacaggtcctccaccagtccgcccagcagatacggtccggtgatcgaggcgatcaccgccaccgcgttgaccgcgatcaggacgacgaacgccctgcggtgccggcgcagcagactccgtacgtaactccgcacggtcgtcggcgtgcccacgggcagtgtcgtcgccgactccggcgccgcggggtcgtacgccgggggtgcgacgccgatcatgccctctcctcgatttcctgggtgctcttcatggcggggacttcgccgacgccgttcagcgcgctcgcggcggccgcctcgtcgtcggtctcccgggtgacgaccgcccggtagcggggttcggtgcgcagcaggtcgcgatgggcccccacggcgaccacggcgccctcgtggacgagcaccacccggtcggccgcgtcgagcagcagcggcgacgaggcgaacgccaccgtcgtacggccccggcgcagcttcgcgatcccggcggcgacccgtgcctcggtgtgcgagtcgaccgcggaggtcggctcgtccagcaccagcgcctccgggtcggtgaccagcgaccgtgccagcgcgaggcgctggcgctgaccgccgg

SEQ ID NO: 3711 - DNA, 903 bp, Unknown
  Kingdom: Bacteria, Phylum: Actinobacteria, Class: Actinobacteria, Order: Streptomycetales, Family: Streptomycetaceae, Genus: Streptomyces
gtccaggggggcccagcggtcggaggagaagacctcctcgtacgcctcgtaggccaggcgggcgttggcgagggcggacttgcccttggccgccttcgcctcgtcggagccgatggcgtcgagccgcttgtcgatctcggtgtccacgcgggacacgaagaacgaggccaccgagtggatcttggagaggtccaggcccgcggccttcgccttctccaggcccgccaggtaggcgtccatgaccgcgcggtagcgctccagcgagaagatcagcgtcacgttgacgctgatgccccggccgatcgtctcggtgatcgccggcaggccggccctggtcgccgggatcttgatgagcgtgttcggccggtcgaccagccacgccagctgcttggcctcggcggcggtggccgtggtgttgtgcgccaggcgcgggtcgacctcgatggagacccggccgtcctggccgccggtggcgtcgaagaccgggcgcaggatgtcggcggcgtcgcggacgtccgccgtcgtgatcatgcggagggcttcctcgacggtgaccctgcgggcggcgaggtcggtgagctgctgctcgtaaccgtcgcccgaggagatcgccttctggaagatcgacggattggtggtgacaccgacgacatggctctggtcgatcagctcggccagattgccggacgtgatccgcttgcgcgacagatcatcgagccagatcgccacgcccgcctcggagaggcgcttgagtgcgtctgtcatgagttgcatctcctactagtcgtgtctaccggcgtcagcgcgtggcggcggcgagagattcccgcgccgcggcggccacgttctcggcggtgaagccgaactcctggaacagcaccttcgcgtcggccgaggccccga

SEQ ID NO: 3712 - DNA, 3886 bp, Unknown
  Kingdom: Bacteria, Phylum: Actinobacteria, Class: Actinobacteria, Order: Streptomycetales, Family: Streptomycetaceae, Genus: Streptomyces
cgcgtcggccgaggccccgaagtgctccagcgagacgatccggcccgcatcacccacgtaccggtaccaggtcaggccgatacccgcctccacagcgacccgcgccctcaccgacggcggcagcacactgtccttgtacgcctggtcctgctcctcgaaccactcgaccgacggcatcgagacgacccgcgtcggcaccccggccgcctggagctgctcacgcgccccgacggcgacgtggacctcggaaccggtcgcgatgagcagcacctgcggcgtgccgccctcggcctcgaacaggacgtaaccgcccttggccgcgttctcgttcgcctcgtacgtcggcacaccctgccgggtcagcgccagaccgtgcggcgcgcccttgccgaacaccttggtgtagcggcgcaggatctcgcgccaggcgatggcggtctcgttcgcgtcggccgggcgcacgatgttcaggcccgggatggcgcgcagcgcggccaggtgctcgaccggctggtgggtgggaccgtcctcgccgaggccgatcgagtcgtgcgtccacacgtacgtcaccggcaggtgcatcagcgcggacagtcgcaccgcgttgcgcatgtagtcggagaacaccaggaaggtgccgccgtagatgcgggtgttgccgtgcagcgcgatgccgttcatggcggcggccatggcgtgctcgcggatgccgaagtggatcgtccggccgtacgggtcggcctccggcagcgggttgcccaccgggaggaacgacgacgtcttgtcgatcgtggtgttgttcgagcccgcgaggtcggcggagccgccccacagctcgggcacgatctcgccgagcgcctggagcaccttgccggaggcggcacgggtggccaggcccttgccgggctcgaagacggggagcttctcctcccagccctcgggcagctcgcccgcggcgatccggtcgaaggaggcggcgcgctccgggttggccgtgcgccacgcggcgaacgacttgtcccactcggcgcgggcctcacggccgcggtccagggcctggcgggtgtggccgatgaccgcgtcggagacctcgaaggtctgctccgggtcgaagccgaggacccgcttggtcgccgcgatctcgtcgtcgccgagcgccgagccgtgcgcggcctcggtgttctgggcgttcggggcgggccaggcgatgatcgagcgggccgcgatgaacgaggggcgctcggtctcggccttggccgcctggagcgccgcgtacagacccgccgggtccaggtcgccgctggggagctggtcgacacgctggacgtgccagccgtacgcctcgtaccgcttcagggtgtcctcggagaccgcggtctccgtgtcgccctcgatggagatgtggttgtcgtcccagagcaggaccaggttgcccagcttctggtgcccggccagcgaggacgcctcggccgagatgccctcctggaggcagccgtcacccgcgacgacccacaccatgtggtcgaacggggaggtgccgggggccgccccggggtcgaagaggccgcgctcgtagcgggcggccatcgccatgcccaccgcgttggcgacgccctggcccagcggaccggtcgtcgtctcgacgccggtcgtgtggccgtactccgggtggcccggggtcttggagccccaggtacggaaggccttgaggtcgtccagctccaggccgtagccggccaggtagagctggatgtagagcgtcaggctggagtggccggcggagaggacgaaccggtcgcgaccggtccactcggcgtccgcggggtcgtgccgcatcaccttctggaagagggtgtacgcggcgggagccaggctcatcgccgtgcccgggtggccgtttccgactttctgtacggcgtccgcggcgagaacgcgggcggtgtccacggcccgctggtccaaatcggtccactggaggtctgtggtggtcggcttgatgctcaccctgagtcagggctcctctccactgtcgtaaaccggtgactgttaccgcaccgggcgctgtcgagcctacccccgttgacaggcacactttccgagcactttccagggtgtgggcgacccgtggagttcgcctcccggcggaatgcacatccggggaacagtcacccccaacacgaccccacccccgcgaagggcggcgtatccgcaacgtctagagtgaacgggttcgcgcaagtcttcaccgggcctctccgcccggagcttgctgggatttctctgtcaggggtgtgcgtgacggccgtcgagtcccgacccgcaggggtcgccttgactcccagcccggggggccatcgcccgttcggggcccgcgtcaaggccttcgtggcgcttaccaagccacggatcatcgagctgttgctcatcaccaccgttccggtgatgttcctcgctgcccagggtgtacccgacctgtggctcgttctcactaccaccatcgggggatatctctccgccggtggcgccaacgcgctgaacatgtacatcgaccgtgacatcgacgcgctgatggaccgtacgtcccagcgcccgctggtcaccggcatggtcagcccccgcgaatgcctcgccttcggcatcaccctcgcggtgatctccacggtctggttcgggctgctcgtcaactggctctccgccgctcttgcgctcggcgcgctgctcttctacgtcgtcgtctacacgatgctgctgaagcgccgcacctcccagaacatcgtctggggcggcatcgcgggctgcatgccggtcctcatcggctggtccgccgtgacgaactcggtctcctgggccgccgtcatcctcttcgccgtcatcttcttctggacgccgccgcactactggccgctgtcgatgaaggtcaaggaggactacgcccgggtcggcgtcccgatgctcccggtggtcgcctccaaccgggtggtcgccaagcagatcgtcctctacagctgggtgatggtcgcggtctcgctgctgctcaccccgctcggctacaccggctggttctacaccgcggtggcgctgctgtccggcggcgcctggctctgggaggcgcacggcctgcagaaccgggccaaggccggagtgaccggggccaagctcaaggagatgcggctgttccactggtccatcacctatgtctccctcctcttcctcgccgtcgcggtggaccccttcctccgctgacacaccctctccgtggggacgggcgggtcgcgtggcacaagccacgcgacccgcccgtcgccagttcatctacccgtcggtagcatcctgttcatggcagagacggcagcagacgcagcggacaccggacagacctcgcgcacggacgccaggaaggcggcgcgcgccgagcgcagggcggcgaagctcgcccgtgagatcggcgccttcgccaagcagcacggcggcgcggagggacagctcgcctacatcggccaggcgggcgcccgcatcgtcctggtcggcgaggacggcgcctggggcgacctcgtggccccgacctacgcggtggccgagaacgcggcgcggaagtccggcatcacgatgcacgaggagttcgacggcgagttcgctctcaaggtccgcaccggcccgtacgagtggtcccggatggccgggatccaggtcggcggcccctccaacgacagctgaggcggcagcgccgctttcggcaccgccgggcaacacctgacacggggcccgcccgttaggccgtgcacacgcacgccttcccagggagccccggatgtccgacatcgttcccgtggccgacctggtcgaccagaactgccacggcgtcctgcgcaccgagctgggtctcggc

SEQ ID NO: 3713 - DNA, 790 bp, Unknown
  Kingdom: Bacteria, Phylum: Actinobacteria, Class: Actinobacteria, Order: Streptomycetales, Family: Streptomycetaceae, Genus: Streptomyces
ctcctgcaccagcctgagcgccgcctcccgccagcgcagcgcggccagctcggaccccagggagcgcagccggccggccacggcatcctccaacgcgccacccgccccggccccgtcgtcctgctcgtcgaggatccggcgcacctcgggaaccgacacgtcgaggccgcgcagggagcggatcatgcccagccgctccacggcctccggagcgtacctgcggtgtccgccggcgctgcgggacgcctccggcagcagcccccggtccgaatagaagcggacggtcttgacgctcacgcccgcgcgctcggccagttcaccgatggtgcacagaccgtcgtacgaggagaacacttgaacctccaccagggggagttcctacggtaccggcgagcgctgccgggagatcgggccggtgcgcgggagacaccgtgacgaggagggaccatgaccgtattcattctggtggccgggacgttcaccggaccgcacgtgtggcgggacaccgccgctcggctgaccgcggacggcgccgaggtacgaacggtggcgctcaccggactcggcggacgtcccggagatcccggcgaaaccgtcgacctggagacccatgtcgcggatgtgctcgcggtgatcgacgcggtggcggcggtggccggccgggagatcgtgctcgtcggccacgactacgggatccacccggtgctcggcgcggccgaccggagggcggggtcgatcgcccggatcgtccacctggacgccgggatgccgaaggacggagtgcccgccc

SEQ ID NO: 3714 - DNA, 1786 bp, Unknown
  Kingdom: Bacteria, Phylum: Actinobacteria, Class: Actinobacteria, Order: Streptomycetales, Family: Streptomycetaceae, Genus: Streptomyces
  misc_feature (1305)..(1306): n is a, c, g, or t
atgcagacgcccgccggccgcgcggccggcgggcgtctgcatggccccgccgtcgcccagttgggcctggttctccgcgaccgcgccgacgacgacgggggtgtcgttgagctgcccggccagggtgtcgttgctgtcgacgtccaggacgtcggccacgatgcaggtgatgttgtccgggccgccaccgcgcagagcgagctggatcagctcctggatggtctcctgcgggccctgatagctggcgagggtctcttccatcgtctggtgcgagacaacgccggagaggccgtcggagcagatcaaatagcggtcgccgacgcggacttcgcggatggagaggtccggttcgacatggtcgccgctgcccagcgcccgcatcagcagggagcgctgcgggtgggtggtggcctcttcctcggtgatccggccctcgtcgacgaggcgctgcacccaggtgtgatcctgggtgatctgcgtcaggacgccgtcccgcagcaggtacgcgcgggagtcgccgacgtgcaccaggccgaggcgctgaccggtccagagcagggcggtgagcgtggtgcccatgccctccagctgggggtcctcctcgaccatgacgcgcaactggtcgttggcctgctgcacggcggtgccgagcgaggtcagaagatcggatcccggtacgtcgtcgtcgagcgggacgagcgtggagatcacctcggagctggcgacctcaccggctgcctgaccgcccatgccgtcggcgatggcgaggagccggggaccggcgtagccggagtcctcgttgccctcccggatcatgcccttgtgcgacccggcggcgaagcgcagcgacagactcatgcgcacctcgcccgtcggctcggggtacagcctgtctcgagccacactgcccaccctccggtcgggaaccgggcagcgtccgccgtcgggaccgccgcggctcgctcgctccgctcgctcattgtcgtactacttccgcagctcgatgacggtcttgccgatacggatcggcgcgcccagcggaactggtgtcggggtggtgagccgggtccgttccagatacgtgccgttggtggacccgagatcctcgacgatccactggccgtcacggtccgggtagatcctggcatgcctgctggacgcgtagtcgtcgtccagcacgatcgttgaatcgtgggcccggcccagggtgatggtctggccctggagcgcgaccgtggtgcccgtgagcgtgccttcggacacgaccagctttgtgggcgccccgcggcgctgccggccggactnngcgccgcttgttgttgttggcggccctgttgggggcgcgcgtcggcggcagtgcggcgtgagccgcgctgcgtgacgcgcgttccgaacaggtcgctgcggatgacctgaacggccacgatgacgaacagccacagaacagccaggaaacctagccgcatgaccgtcagggtcagctctgacattgcccccgcttcacccttcggcttgccggtaaacgatggtggtgctgcccacgacgatccgcgagccgtcgcggagcgtagcgcgggtggtgtgctgcccgtctaccacgatgccgttggtagacccgagatcctggatcgtcgagggcgttccggtccggatctcacagtgccggcgcgatacgccggggtcgtcgatccgcacgtcggcgtcggtggatcgtcccatcaccaacgtcgggcgggagatctgatggcgggtgccgttgatctcgatccagcgccgtgtccgggcg

SEQ ID NO: 3715 - DNA, 1607 bp, Unknown
  Kingdom: Bacteria, Phylum: Actinobacteria, Class: Actinobacteria, Order: Streptomycetales, Family: Streptomycetaceae, Genus: Streptomyces
gcccggcaccgggaagaccaccaccctcgtcgaatccgtcgccgcgcgggtgaaccggggtgccgaccccgcccgcatcctcgtcctcaccttcagccgcaaggccgccgtcgagctgcgcgaccggatggccgcccgcctcggggcggcccggggcccgcaggccaccacgttccactcgtactgctacgccctggtccgggcccaccaggacgccgatctgttcgccgatccgctgcgcctgctgtccggacccgagcaggacgtcaccgtccgcgagctgctcgcgggccagctcgacctggagaaggagggcctggcccacgtccgctggccggacgagctgcggtcctgcctgaccacccgaggcttcgccgacgaggtgcgcgccgtgctggcccgcagccgtgaactgggtctcggcccggacgcgctggccgccttcgcccgccgtaccggccgcccggactggacggcggcggcccagttcctcgccgagtacctcgacatcctcgacgcccagggcgtgctggactacgccgagctggtccaccgcgcggtcctgctcgccgagcgccccgaggtggcggagcggctggccgggagctacgacgcggtgtacgtcgacgagtaccaggacaccgacccggcccaggtgcgcctgctgcacgcgctggcgggcaaccgggggcgcgcgccggggcacgaccgggagtgcggtgcggatgcgcgcggcggacggacgctgatcgccttcggagaccccgaccagtcgatctacacgttccggggtgccgacgtgaacggcatcctcgacttccccgacaccttccgccgggcggacgggggccccgcgcccgtgggcgtcctcaccacctcccgccgctccggggccgcactgctcgcggcgacccggctgctcacccgccggatgcctctgacccggctgcccgccgacacggtccgcgtccaccgcgacccggtcgccgtccgggagggcggcctcgtcgagacgtacacctacccgaccgcgtccacggagctggagaacatcgcggacctgctgcgccgcgcccatctggaggacggggtgccgtggcaggagatggccgtgctggtacgggccggaggccgctcgctgcccgccgtccgccgcgccctcacctccgccggcgtccccctggaggtcgacggcgacgacctgccgctgcgccacgaaccggccgtcgcccccctgctgacggcgctgcggacggtggccacggcggcgctgcaccaccgtcccgccgaagcggaagcggaggaccagccggaggaggaccagccggaggaggaccagcccgagaaggggcacgagaaggggcccgccccctggctcgacaccgagaccgcactcactctcctcacctccccgctcggctccatggacgccgccgacctgcgccgcctcggccgggccctgcgcgacgaggagcgcgccgccgggatccgggtccccgccccctccgacgcactgctggcccgcgcgctggccgagcccgaacggctggtcacgcacgacccggcgtacgcccacggagcgcagcgcctcggcggtgccgccgcct

SEQ ID NO: 3716 - DNA, 8269 bp, Unknown
  Kingdom: Bacteria, Phylum: Actinobacteria, Class: Actinobacteria, Order: Streptomycetales, Family: Streptomycetaceae, Genus: Streptomyces
  misc_feature (7979)..(8071): n is a, c, g, or t
gtgacggccgtgccggccgtggtcggcgagggtcgcgtacgcctcggtcatgtccaggacgctggcgttggcggtgccgagcgcgatggagggggaggcggtgaggtcgggggtgtcggtggggatgccgagggcgaccgcggtgtcccggaccttcccggggccgacgtcctgggccatctgcgcgtagacggagttgacggactcgtcggtggcggtgcgcacggtgatgtcgccgtggtcgacgtcgtcctcgttggcgggggcgtagtcggtgggtccctgcggtccgacgaccatgcgcttgttggcgccgtcgtagacggtgttgggcgtgatgcgttcgccgtcctgggtggtggagtcgttgacgacggcggaggtgaggacgaacggcttgaagatcgagccgacctggtagtcgcggcgggtcgcgttgctgacgtactgcttcgtgtagtcgatgccgccgtacagggcgacgacctcgccggtgccggggacgatcgaggccccgccgacgcggacgttgcggtcggccttgcgttcggcgctggtcctggacatcacgttggcgtcgacggccttgacgaaggcgtcctgcttggccttgtcgagggtcgtggtgatgcggtggccgccggtggcgagggtcttctcgtcgaggatgccgcgccggttcaggtagtcctcgacggcctgcacgatgtagccgcgctgtcccgagagaccggtcgagggtttggcctcgtcgggggtggggaactccgtcgtcgcccgttcggccgcatcgagccagtcctccttgaccatgccgtccaggacgtagttccagcggcgctgggcggcggccttgttgccggggtgggcgacgacgtcgtaggcgctgggggcgttcagcagggaggcgagataggcgccctcggcggtggtgagctcctcgacgttcttgccgtagtacgcctgggcggcggcctggatgccgtacgcgttgcgcccgaagtagctggtgttgaggtagccctcgaagatctggtccttggtctcctcgcggttgagcttgaccgcgatgatggcttccttggccttgcgcaggacggtgcgctcctggccgaggtagtagttcttcacgtactgctgggtgatcgtcgagccgccctgcttgcccttgccggtcacggtgttccagccggcccggaccatcgccttcacgtccacggcacggtcgtcggagtagaagtcacggtcctcggcggccaggaccgcttgccggacggtcggggggacctgggagagcttgaccttctcccggttcacgtcgccgtcccgggcgatgacgctgccgtcgcggtagaggtagacgttggactgggcggtggccgccgcgttggcggccgggatgtcgacgagccggtaggcggcgaagattccgacgccgaggaggacggcgaggccgaggacggtgccgagggccatccgccaggtggggatgacacgccgccagccggtccgccgctccctgctgttctttcgttccttccggtccttccggttcttcccgctgttccccggcggctctccctggtggcttccgggtgcggccgccgcgcccgaggggtcgcggggggcccagtgctgtgactcgtcgctcatgtccgtggggctcctcgggcgtggtcagttctcccatagtgcccgtttcacccgaaaaacttcggttctccctggttcgttccctccgccggtcgtcgccgccgtcccgaaaacacggtcgcgggggccggggcgcctgcactaggctcgtgcgctttggtgtcgggagccggtggcggcgggggagaggggacgacgtgcggctctatgcggtggtggcggggggtgcgttccggcgctacgccacctaccggacggctacggccgcgggggtgttcaccaacacggtcttcggcttcatcgtggcgtacacctacgtcgccctgtgggacgtacgtccgcagctcggcgggtacgacacgtcccaggcgctgacctacgtctggctcggacaggccctgctgatggcctgcgccatgatgggcggcggcttcgaggacgagctggtggagcggatccgtacgggggacatcgccgtcgacctgtaccgcccgatcgatcttcagctgtggtggctggcgggcgacctgggccgggcggcgttccatctgctggggcgtggtgtcgtaccgatgttcctgggggcgctcgccttcgatctggcgctcccggcatcgctctggacctggccggcgttcttcgtctcggtgttcctgggtgtggtggtcagcttcgcgctgcgctatctggtcgcgatgtcggcgttctggctgatggacggggcgggcgcgatgcggatcgtgtcgctggccgggctgttcttctccgggatgctgctgccgctgaacctgttccccgggctgctgggggaggtggcgcggatgctgccgtggtcctcgctgctccaggtcccggccgatgtgttcctcggcaagcacacggggtgggggctggtggaggcgtacgcgttccaggtcggctgggcggtggtggtgctgctggcgggccgtctgctgcagaccgcggcgaccaggagggtggtggtgcagggtggctgagagcgtgatggcggcggacgagaaggccccggtgccggaggtgtcggaggccttcccgttcccggagcggccccggctgctggagggcgtccgggcgtacgggctgatcatggccatgtgggtgcgctcgacgatggcgtaccgggcctcgttcgccatgacggtgttcggggacttcgcggtgacggccttcgacttcgtgacgatcctgctgatgttcacgcacgtcgacgcgctgggcggctacaccctgcccgagatcgccctgctgtacgggctgtcggccaccgcgttcgggctgtgcgatctgctgctgggctcgatggaccgggtgggccgccgggtacgggacgggacgctcgacaccctgctggtgcgaccggtcccggtgctggcgcaggtcgcggcggaccggttcgcgctgcgccggctggggcggatcacgcaggggctgctggtcctcggctacgcgctggtctccctggacatcgcgtggacgccgctgaaggcgctgatgctgccgatgatggtggtgagcggtgcggcgatcttcggggcggtcttcgtcgcgggggcggcgttccagttcgtcgctcaggacgcctcggaggtgcagaactccttcacgtacggcgggacgacgctgctccagtacccgcccacgatcttcgcgaaggacctcgtgcgcggggtgacgttcgtggtgccgctggccttcgtcagctggctgcccgcgctgtacgtgctggaccgggagtacccggtcgacctgccggagtgggtggcgttcctgccgccgctggtggcggtggcctgctgggcgctggcggggatcgcgtggcgggcggggctgcgggcgtaccggagcaccggcagttgagcgggaatgatcacggaggagggtacgggcatgggtgagggcgcgggcgcgggcacgggcgtgggtacgaccacgggcacggccacaggcacaggcacaggtgtgggcacgagcccgaccccggccacgggcgggaccggcgatggcttcatcgcgctcgacggcgtcgagaaggtcttccaggtccgccgccgcatcggactgctgcgccgtgagcgccgggaggtgcgggcggtggacggcatcagctttcaggtcgcccgcggcgagatggtcggctacatcggcccgaacggggccgggaagtcgaccacgatcaagatgctgacgggcatcctcaccccgagcggcggccggctgcgggtcgcgggcatcgacccctcccgcgaacgcacccgactggcccaccgcatcggggtggtgttcggccagcggaccaccctctggtgggacctgccgctgcgcgactcgtaccggctgatgcaccgcatgtaccgcatccccgaccggcgttaccgggagaacctggaccgctgcgtcgaactcctggacctgggcgagctgttggacgtccccgtacggcagctctcgctgggacagcggatgcgcggcgacatcgcggcggcgttgctgcacgatccggaggtgctctatctggacgagccgacgatcggcctcgatgtgatctccaaggccaaggtgcgccagttcctcaaggagttgaacaccgagcgcggcacgacggtcctgctgacgacgcacgacctcaccgacatcgagcagttgtgcagccgggtgatggtgatcgaccacggccgtctgatgtacgacggttcgctggcgggcctccacgaggtgggggagagcgaacgcatgctcgtggtggacctggagagcgaactccccccgatcgtcctggagtcggagggtgcgggaggggggccggccctgcgggcggtcaaggtggagggcccgcgccagtggctggcgttccccgccgccgcgtcggcggccccgctggtggcgcgcatcgccgcggactacccgctggtcgacctgtcggtacgggagccggacatcgaggccgtgatcgcgaggatgtacgagtccgcgccgtgacgggcgatctcccggagcgacgcgcgcaggtcatgggcctggatgtctgtgccgggagcgggtgcggtcaataggctgcgcggtatgacaagtgagagtccggacatgcgcgcctccgatgccgagcgtgagcggatcgcggaactgctgcgcgaggccgtggccgagggccggctggatatggacgagttcgaccagcgcctcgaaacggcctacaaggcgcgcacgcacggggagttggagccgctggtccaggaccttccggcaccgggatcggcggtcgctccggtcggctcgtccgcccccgccccgctgcgggggtccgccgcgaactggcccgcgaggatcggcggcaacgccacttcgaagggagcgttcgccctgtggggcgggttcaaccggaaaggccgctggacggtcggccggatgttcaccgcgttcgccctgtggggcggcggcgagatcgatctgcgcgaggcgaacttcgaggaccgtgagatcgtcatccgctgcatcgcgatcatgggaggcatccatgtgaccgcgccgcccgagctgaacgtcgatgtcagaggcgtcggcatcatgggcgacttcggggagggctccagcgaggagggcgagcccgccccggacgccccgtacgtgcggatcaccggcttcgccctgatgggcggcgtcggggtggaccgcaagaggacgaaggcggagcgccgccggctgaaagaggcgagggaggcggaacgggaggcgcgtcagcggcgcgggctggagggcccggacggcggcgcggccggcggcggccgcaaggaactatgagggtccgggcccacccggctgctcagcacctcacagagcgtcggaccggggagtgccggcccggtccaggatcttcaggtccagccggtctccgagcgcgcggtacccgtcgtcgttgaggtgcagatggtcgccggagtcgtacgagacgaggatccggttcggcgcggcggggtcgcgtaccgccgcgtcgaagtccacgtacgcgtcgaagaccgtgcccgcccggatctgctcgttgaccgccaggcgcacggcgttgcgctggggcgtccaggtggcgaacccctcgaacggggtcagcgtcgcgccgacgaccctgagtccgcgggcgtgcgcccggtcggtgagggcgcgcaggctgtccacgatgcgctgcgggtcggcctcctggggggactgctgtacgtcgttgatgccgagcgcgacgacgaccgtccgggccccggcgaccgccaggacgtcgcggtcgagccggtcggtgcccgactggccgccggtgccgcggccgacgcccacgacccggttgcccgcgatgcccgcgttggcgattccgtaccggccgcccagccggtcggcgaggacgtcggtccagcgggcgttggcgtcggtggtggagccgctgcccgcggtcagggagtccccgaaggcgacgatcgcgccgcgcgcgctttcgctgcggacgtccacggcggtcagatagcgccagtgggtggtgctccaggtgccgcgttcgtcgatcaggtacgaggtctggtgcgtgtaggggtggtaggtgaccggcccgccggcctgcggggtgcggaagctgacctggaggtcggagtcgggggccacgggcaccacgacggggtcgctgatgacctgtccgcccggcgcgacggtgacggaggcggcgcccttgaaggtcaccggccgggtgttgacggtggcctggtcgacgaccaggggacccgtgccgaagaggttcgacagcgtgatgcgggcgacctccccgccgatgctggtgtgtacgacgttacggatggtgcgcccggggagtccgtcctcggtgccgggttcggcgcggacgggtgcggcggcccaggtggcgacccatctcccgcccgaggtcgcggggtcgaccgggttacgggccgccgcctgggtctcggccggcgggagcgggaccgaccgggggccggagagcagcgtcgtaccgaaggcgacggcggcggcgagcacggctgtgcccgccactagggcgatgagcagggcatacccctggcgcctgggcatgtgcggtggttctccttgtgatgatcgtgctggccccatgatgcgacaggccgtcgggaactcgacgtgcggcccgggagtaggggaggtagggacaatgcgtacgtcacgggggcgaggcgcacgcggacgggtggagcggatggaacggaccggatccggcgagcaggggcaggacgagggcgcggtgcagaagtcggagcagtcgcaggagccgtcgcagcgtacggcggagcagtcgcaggacccgtcggagcgtacggcggagcagtcgcggggaccgtcggagcctacggcggagcgcgcggcgctgcgggcgcaggagccgtcggagcgtacggcggagcgggaacaggagccgagggcgggtgcgggcccgctggcctcgttcgcgtacaccgccgccgacgaggagaaacagcgcggcgtacggcgcatgaagctcacggccaccggcctccttctgctcgtcgcgctcgtctacgtcctggccacctgggcgaagaactcaggcgtggggggctggccgggctacgtcgcggcggctgccgaggcggggatggtgggcgcgttggcggactggttcgccgtcacggcgctcttccggcgtccgctcggcctgcccattccgcacacagccatcatccccaccaagaaggatcagctgggacagtccctcggttccttcgttggcgagaactttctctccggagacgtcattcgtgaccgaattcacgctctgggggtcggtcggagggtcggtgtgtggctcgcggagccggcccacgccgaccgggtcaccgccgagctggcgacggccctgcgcggtgcgctgacggtccttcgggattccgatgtgcaggcggtggtcggcgaggccatcacccggcgcgcgaacgcggtggaggtcggcccgggtctcggcaagatgttggagaagatcgtcacggacggcggccaccgcaaggtcgtcgacctcgtctgcgtacgggcgcacgactggctggtggagcacggcgactcggtgatgaacgcggtgcaggggggcgcccccggctggaccccgcggttcgtcgacaagcgggtgggggagcgggtctacaaggaactgctgcggttcgtcacggagatgcgggacatgccggagcatccggcgcgcggctccatcgacacgttcctgaccgacttcgcgtccgacctccagagcgacgccgacacccgggcccgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacggctggctggaggacgccgcggtgtacgtcgtgacgacgtaccgggcggagattacctcgctgatcagcgagacggtcgcgggctgggacgcggaccagacctcgaagaagatcgaggcgcacatcggccgcgacctccagttcatccggatcaacggcacggtggtcggcgcgctggcgggcctggcgatcta

SEQ ID NO: 3717 - DNA, 6303 bp, Unknown
  Kingdom: Bacteria, Phylum: Actinobacteria, Class: Actinobacteria, Order: Streptomycetales, Family: Streptomycetaceae, Genus: Streptomyces
acaacgagggacgggcacccggtgttcccgggtgcccgtccctcgttgtcggtgtcggccgctggacggtggccgacggctcagaccgtgatcagggcctccagcggtgcgcctgcgaggcccggctccaggcgggcccggcccgcgaggaaaccgagctccatgaggaccgcgacgcccacgacctgggcgccggcccgccggatgagctccagcgaggcctcggcggtgccgccggtcgcgaggacgtcgtcgatgaccatgacccggtcctcggcgtcgaggtcctcggcatggatctcgatctccgcgctgccgtactccagctcgtaggactggctcagcgtggcgccgggaagcttcccggccttgcggaccgggatgaacccgatgcccgcccggaccgcgacgggcgcggccaggatgaagccgcgcgcctccaggccgacgatcttcgtggcgccgtgccgtacgcacagctccgcgagggcgtcggtgagcgccgtgaaggcaaccgggtccgcgagcagcggggtgatgtccttgaacatcacgcccggcttcgggtagtccgcgacatcgcggatccggctgagcagcagctccctgatggattcggtggtgctcgtcatcgttcagcgcttcccgggggtacggccgtgcgaccggggacggccgatcgtcgtgcccgccgtctcggcgtcgtcgcgcaggtcctcggggccgtcctcgggcgactcgcccttggcggccgcggcggcgcgcttggcgaggatccgcttcttcagggccttcatctgcggctcgcgttccttgaggtcggcgacgagcggcgtggcgatgaagatcgaggagtaggcaccggccgcgagaccgacgaacagcgacagcgagatgtcgttcagcatgcccgcgccgaggacgccgccgccgatgaacagcagaccggccaccggcaggagcgccaccacggtggtgttgatggagcggaccagggtgctgttgatcgaccggttggcgatctcgctgtacgtgaagcgggtctgcttggtgatgtccttctggccctccttgaggctgtcgaagaccaccaccgtgtcgtacagggagtaaccgagaatggtcagcagaccgatcaccgtgcccggggtgacctcgaagccgaccagggcgtagacgccgaccgtgatggtgatgtcgtggatcagcgcgatgagggcggcgacggccatccgccactcgaaggcgatggccagatagatcaccaccaggatcatgaagaccccgagaccggtccacgccttgttggcgatctgttcgccccagctggggccgaccaggtcagcgttgatgtcgttggcggggatgccgagctcgtcggagagcgtctccttgatctcgttggccttggcggtgtcgacctcggtgatctggatgcgcaggccgccgttgccgagctcctggacgatcgccaggtggccggaggcctcggtcgccacgtccgtggcctgggacgtcgagatctgggccttggtgtcggtcgtgaagaccgcgccgcccttgaactcgattcccatacggaggccgccgaccgccacgccgatgatggccgtgatggtgatcaggatcgagatgccgtaccagatcttgcggttgcggatgaagtcgtagccgacctcgccgcggtagagccgggcgccgagattgccgagtcgcgacatctcacgcctccttcggttcggtgggggcgttgacacggcgcgagcggcgcaacggcggctgggcgccgagccgcttcgggtccagcccggaccacgaaccgcccttggagaagaacttcgtccggcccatgagcgtcatcaggggcttggtgaagaggaacaccacgacgacgtcgagcagcgtggtgagtccgagcgtgaaggcgaagccctgcaccttgccgacggtgacgatgaagaggaccgccgcggccaggaacgacacgaagtcggagaccaggatggtgcgccgggcacgcggccaggcgcgctcgatggccggacggagcgtgcgtccttcgcggatctcgtctctgacgcgttcgaagtagacgatgaaggagtccgccgtgatcccgatggcgacgatggcgccgcagaccgcgggcaggttcagcgcgaagccgatggccgggcccagcaaggccatgatcgcgtacgtcagaagaccggagaccagaaggctgagcagcgcgatgaacgcgagaccccggtagtagacgaccaggtagatgacgaccagcgccagaccgattgcaccggcgatcagacccgcctggagctgctcactgccgagcgcggcggtcaccgtggtgacgctgacttccttgaaggtcagcggcagtgcgccgtaggacaggatgttgccgaggtcctcggccgactgctggtcgaagctgccggagatctgggcgttcttgctgagcgccgtgcgcaccgagggagcggagacgacctcaccgtcgaggacgatcgcgaactggttcatcggcggctgctgctgcgagagccggctggtgatcgtctggaacttcttggcgccggcggaggtgaactccatcgacacgatccactcgccggtctgctgctcgatggcgcccttggcgtcgtcgacgtcgctgccggagacctcggccgggccgaggacgtacttctcgtagctgcccgggacgttcgagccgcaggcgacgatcgagtcggtgggcttggcgttctgccctgcctccgagcgctgcttggggtcggtgcagtcgagcttggcgaactcctcctggagcttggccgtggccgggtccgcagagggcgatgccttgggggaatcggacggcttcggcttgtcggaggcgccgggggtcgggtcgtccttcgtcagggcgccggtgaccgcgcggccctgggtggtggcgctcgccgagggggtggcctccgagccggtggcctcctcacccttgggcttgtccgcgccttcggcggactcaccgggcttcggggtggcgctgcccgagggagtcgcggaaccggacggcgtgggctctgcggggccgctcgcctgcaccgtcagaacaggccggaagtagagctgggcggtggtgccgacctgctcctgggcctgcttggaattcgtccccttggggatgttgacgatgatgttcttcgagccctgggtctgaacctcggcctcggaaacgcccagaccgttgacacgccgctcgatgatcccgaccgcggtgtccatgttggtcttgttgatcgcgttcggcttgccgggctggttctgagcctccagcgtgatcgacgtcccgccggccaggtcgatgcccagcctgggcgtggtgtgcccggacaggaacaacccgccggtgagcgcgaccatggcgatgaggatcagagccagggcacgccccggcctgccctgaccgccggacggccctcggcccttcttgggtgctgccaccttctcgtttctccctgtccaaccgccccgcgccgggtacgcgcccgagcggccacgaagtgtagtggggaccctgcccccgcggacgaccgcacggtcccggggacgccgcgcgccggtgggcgcgcgacgtccccgggatcgtgagaactacttggagtcggcctcgccgtcggtcttgctctcgtccttggcgtccttgacgtccttgaccgcagcgtcctcgggctcggcgtcgtcggccgcgtcgttcttggccaggtcgatcttggcgacctcggcgtcgtcggactcgccggtcagcgaggaggcgtcgtcgggaacgacggtgccgtccgcgtccagctcctcgtcgtccccgtgcacgatgcggttgtactccgcgtcgtccagaacggcgccgatggagttcttcgcgaaaatggcgtgcacgccgggagcgatctcgaggagaacggtgtcgtcgtggacttccttgacggtcgcgtacatgcccccgatcgtccggacgccggtgccgggctgcatgtcgttacgcatctgcgcggccgccgcctgcttcttcttggcggagcgggtcatcaggaacatggccccgatgagcacgatgaaggggaggagagtcaagatatccacgggacgggaattccttcgcacgaccgcgctggaatgcggcctgtatatacgggggtgggtacaccgaccggtaagggcggcatcggcggagtctaagcgagtccgcatcgatggaacaacgcccagcatggcaccggggttcctgtgcgcgcgaacctgtgacgcatcacgccccgaacaggccctgttgtccctttgctccgtgctgcggcgggaccagtcccagatgcgcccaggccgccggggtggcgacacggccgcgcggagtcctggccagcagtccttcccgtacgaggaagggctcggcgacctcctcgacggtctcccgctcctcccccaccgcgaccgccagcgtggacaggcccaccgggccgccgccgaagagcttcagcagggcgccgaggacggcgcggtccagccgatcgagtccgcgggcgtcaacctcgtacaccttgagggccgccatcgcgatctctcggtcgatcgtgccctccgccttgacctgggcgtagtcgcggacgcggcgcagcaggcggttggcgattcggggggtgccgcgggagcgtccggcgatctcggcggccccctccacgtcgatgccgacgtcgaggaggcgggcggagcggtggatgacgcgctccagctcggcgggggcgtagaactccatgtgcccggtgaagccgaagcggtcgcgcagcgggggcggcagcagtccggcccgggtggtggccccgaccagggtgaaggggggcagttcgagcgggatcgcggtggcgccggggcccttgccgacgatgacgtcgacccggaagtcctccatcgccatgtagagcatctcctcggcgggccgggacatgcggtggatctcgtcgaggaagaggacctcgccctcctggagggaggagaggatcgccgcgaggtcgccggcgtgctggatggcggggcccgaggtgatcctgatcggggcgttcatctccgccgcgatgatcatcgaaagagtggtcttgccgaggccgggggcgccggagagcagtacgtggtcggcggtggcgccgcgggcgagggccgccttgaggaccaggtcgagctgttcgcggaccttctcctggccgacgaactcctccaggtccttggggcgcagggccgcctcgaccgcggtgtcctcgccgtcgagatggccggcgtcgaccagccggtcgtcgaagaccgggccggtcggctcgtcggtctcgggtccggtctcgtcccagttcatcaaggccttcttcggtggttcggtgccggtcagcgtgcgcggttgagagtctgcagggctgcccgcagcagctgcggcacggggggtgccgtgccctcggcgacggcggcctcggcctgcggcgcgacggcgttgacggcttcgtcggcctcgcggctcgcgtagccgaggccgatcagggcggcctggagctggtcgcgccagccggaggtgaggggggtgccgatgccctgctggccgatgtgcgcgccgaccggttcgccgagccggtccttgagctccagaagcagcttctgcgcacccttctttccgatgccggagacggcggtcagcgccttctcgtcgccggtggagaccgcgaggcgcagggcgtcggggctgtgggtggcgagcatcgcctgggcgaggcgcggtccgacgccgctggccgtctggaggagctcgaacacctgccgctcgtcgtcgtcccggaagccgtacagggtgagggagtcctcgcggacgaccagcgaggtggcgagccgggcctccttgccgacgcgcaggtcggcgagggtgtgcggggtgcactggaccgccatgccgatgccgccgacctcgatgacggccgtggtcggggcgagggcggccaccgggccggagacgaaggcgatcatgcggtgcggcctttcaacgtacggggagtgcgggaggtgccgggtgcggcctgcgtgcggtgcgcggcgacggcctgctggagccggttctgcgcgggggcgcgccagatgtggcagatggccagggccagggcgtcggcggcgtcggccggcctgggcggtgcgtccagtctcagcagccgggtcaccatcgcgccgacctgggccttgtcggcgcggccggatccggtgaccgccgccttgacctcgctgggggtgtgc

SEQ ID NO: 3718 - DNA, 1758 bp, Unknown
  Kingdom: Bacteria, Phylum: Actinobacteria, Class: Actinobacteria, Order: Streptomycetales, Family: Streptomycetaceae, Genus: Streptomyces
gcccggtcgacgccggaacggcgaccccacgcgggtcggtccgagcctcgccggagggttcccccgaaaggaggacgggccacgggccgctccgtacgactcccgccgggtcacgccgtctcccgcgaccgggcggcctgacctgcggcggattcctccgagccacgccggcgtgcacggttcgcggggcgaggtaattcgttcgggtgagcagagggaatcagggtcggtgtcgcgctcgctgtctgacattgtgtgccgtgcgccggagccatcgggtcgagtgagggcctgggaatctccggcgggacgggacggcggagaagccgtcgagcaccagccggaccggccggacgcaccggaccacgcaccgagccggccgaacgacccggaccacggaccgtgcggccgccgacgaccgtcccgtgccgaagggcggccgatgccgtcccggtccgctctcccgttgtccgttccccatctcccaccctcatcctccggatcctccggtcccgctcccggtcgccgcgacggcggcaccgccgtctccgcacgccatcgcggcccactcccctcaccgcccctggagcacgctcgtgcacgtcgccctcaccggtgccaccggatttctcggactgcgcctgttacgtcgcctgctcgacgcccatcggtcggtgaccgtcctcgcccacgcggggtcggggaacgctctgcaccgcatcacccggttcttcgaactgacgggtgcaccggaggcgttcaccgcccagcttcccggccggctgcgggtggtggagaccgatctggcgctgccgaggctggggctgtcggggcggatgttccagaggctcgccgacggcctcgacgcgatctggcacagcgcgggctccatcaacctggagggcgatcttcccgagctgcgccggaccaacgtcgaagggacgcggcacgtactggagttggcggcggcgggtcgtcgggcaccgctcgtccaccacgtgagtaccgcgttcgttgccggtgcgcggcgggagggggtggcgtacgaggacgagctggacgacgcccacggcttcgagaacgcctacgaacagtccaagtacgaggcggagctgctggtccacgcctggtcccgggagcacggccgtccgatcctggtcctgcgccccagcatcctggtcacggacctgccgccgcatcccgagctgcccgcgcatccgctgctggtcgtcgagcggatcctgcgtgacgcgcaacgtgccgccgaccccgcggagccgggtccgcacggcccgacccgcgtccggacggtgggacatccgcacggccggctgaacctcctgccggtggaacacgcggccgaggtcatggtgcggctggccggactgccgccctcgggcggggtcgacacgtaccacgtcgtccatgaccgcgatgtgcccgtaccgacggtcgtggccctgttggaacggctgggtccgatctcgatcgacctggtcgccgccaagccggatgccccgtcgacgctggaggcgctgctggacttctacccgggcatgacgatctacctcgcccaccggcggcggttcgacgacacccgggtcaggagccggctgggatcgtcggcggcctccgaccccgtggacctcgactacctctggtccggtctcgccccgcggagcggggcactccccggagcgccgggtatccccccggccgtcctcccgtccgccccgaacgcctgaccagcagacgtcc

SEQ ID NO: 3719 - DNA, 3832 bp, Unknown
  Kingdom: Bacteria, Phylum: Actinobacteria, Class: Actinobacteria, Order: Streptomycetales, Family: Streptomycetaceae, Genus: Streptomyces
ccggccgccgaggagcggtggggccgcagaggcggccccaccggcgtcaccggccgggcctccgcccatccgggcggtttcccgcaggtttcccgtggtgccccccacgctccggtagccgctgcccgggcttgcgggtgtcgcgcgttccatggaacgccgaccggcgacgcatgccgcgcctcccctttacggtgacccctgccggctcggccgcttccgcgtgcgtcgcggcccggccatgtcccggtccgacgcggtgcccgcggctgtcggccgacatctcgttcgggttccgactccctgttctccctggtttcgtcagtcgctgggtccggacagggacaagagctgtcaaggatttacgaaatcaacgcgacatcttgcggacattcgtcggcggtggttgagtgtggctcgccgcacagctcggggctgtgggcttcccgcactcctgccctagaggggtccaccgatgagaagttccgttcttcgtcgtacctgcgtcaccgccgtcgccaccgccctgaccatcaccggcctggccgcctgcggcgccgagggcgacagctccgcggacggcaagacgcacatcacggtcaactgctggccccagccgagtgcgaagatcgaccaccagcggttcgacgaggacgtcaggacgttcgagaagcagaaccccgacatcgacgtcaccgcacacgacgcgttcccgtgccaggaccccaagaccttcgacgcgaagctggccggcggccagatggaagacgtcttctacacctacttcaccgacaccgagcgcgtcgtctccatcaaccaggccgcggacatcaccgagtacgtcaaggacctcaaggcgtacaaggacatagcccagcccctgcgcgacgcgtacaccgtcgacggcaagatctacgggatcccgcgcaccaactactccatgggcctgctctacagcaagccgctcttcaccaaggccggactcgacccgaacaagccgcctgccacctgggaagaggtccaggcggcggccaagaagatcgccgccctcggcgacggcaccgtcggcttcgccgagtacagcgcccagaaccagggcggctggcacttcaccgcctcgatctactcccagggcggcgcggtcgtcagcgaggacggcaagaaggccacggtcgacagccccgagggcaaggccgtcctgcagaacctcaaggacatgcgctggcgcgacgactccatgggcgccaagcagctcctcatcatcaacgacaccctccagatgatgggctccggcaagctcggcatgtacctcgccgcccccgacaacgtcccgcgcatcgtcaaggaggccggcggcgagtacgaggacctcgccttcgccccgatgcccggcggcaagggcaccctcatgggcggcgacggctacatgttcaacaagaaggccaccccggagcagatcaaggccggcctcaagtggctggagtggacctttctcaccccgggccagggctacatgaacaactacgcccgcgccgccgaggacaagtccccggtcggtctgcccgagccgcgcctgttcaccggcgccaccgacgccaaggaccaggagctgaagaaggcctccgccaacgtcccggtcgccaactaccaggccttcatcgacggtggccagcagctcgacatgaagctggagcccaagcacggccagcagatctacgcggtcctcgacggcgcggtctcggcggtcctgacgaagaaggacgccgacatcgacgccctgctgaaggacgcccagtccaagatcgacggaatcctggcccggggctgagagagccatgaagaccacgtcccagcccgcagcgcaagcgacaccgcggtccgccggcacgacgcttcccccgggggacgcgcgcccggcgggccgcgggccgctgggcccgctgcgcaggaagttcgccgaccaggccaccgcctacgggttcctgatcggcggcctgctctgcttcatcctgttctcctggtacccggccgtccggtcggtgatcatcgcgttccagaagtacacccccggctccgaccccgaatgggtcggcaccgcgaacttcacccgggtcttccaggacccggagttcgccgccgcctggcgcaacacgctcaccttcaccgtgctcgccctggtcatcgggttcgccatcccgttcgtcatggcactcgtcctcaacgaactgcggcacgccaaggccttcttccgggtcgtcgtctacctccccgtgatgatcccgccagtggtcagcgccctgctgtggaagtggttctacgacccgggcgcgggcctggccaacgaggtgctcggcttcctccacctgccgacgtcgaactggaccaacggcgccgacaccgcgctcgtctcgctcgtcatcgtcgccacctgggccaacatgggcggcaccgtcctcatctacctcgccgccctccagggcatccccggcgagctgtacgaggccgccgagctggacggcgcgtccgtctggcagcgcgtccggcacgtcacgatcccgcagacccgcttcatcatcctgatgctgatgctcctccaggtcatcgcgacgatgcaggtgttcaccgaaccgttcgtcatcaccggcggcggcccggagaactccaccgtcaccgtgctctacctgatctacaagtacgccttcctctacaacgacttcggcggcgcctccgccctcagcgtgatgctcctgctggtgctcagcgccttctccgccctgtatctgcgactcacccgcaccgactgacaggagcgtcgcccgccatgacccagacagctccacccccggtacggaaacagcccgccgtccgcgccaggaagtccggcgacctcccggccgagcggtcggtacgtaccgtcatctcgccactggcgctcgccggtcgacgcggcaaggccgcctactggtcggtgttcaccctcgtcgtcctgctcttcgcgttcgcgttcctcttccccgtctactggatggtcacgggagcgatgaagccgcccgaggaagtggtgcgcaccccgcccaccctcgtccccgagcagtggcgggtgagcggctacaccgacgcctgggacctgatgcggctgccgacccacctgtggaacacggtcgtccaggcgaccggcgcctgggtgctgcagatcgtcttctgcacggccgccgcctacgccctgtccaaactcaggccggccttcggcaacatcatcctcggcggcatcctcgccaccctcatggtccccgtgcaggccctcgtcgtaccgaagtacctcaccatcgcggacatgccgctcatccacgtcaacctgctgaacgacccgctggccatctggctgccggccgtcgcgaacgccttcaacctctatctgctcaaacggttcttcgaccagatcccacgcgatgtcctggaagccgccgagatcgacggggcgggcaggctccgcaccctgtggtccatcgtcctgcccctgtcccgccccgtcctcggcgtcgtgtcgatcttcgccctggtcgccgtgtggcaggacttcctctggccgctgatggtcttctccgacaccgacaaacagccgatcagcgtggcactggtgcagctctcgcagaacgtcccgctgaccgtgctgatcggggccatggtcatcgcgagcatccccatggtcctgatgttcctggtcttccagcggcacatcatcgccggaatcagcgccggcggcacaaaaggctgatcccgcaggacggcaccctccgtgccgcccgtcccggacccgccgccgcccccggcc

SEQ ID NO: 3720 - DNA, 1914 bp, Unknown
  Kingdom: Bacteria, Phylum: Actinobacteria, Class: Actinobacteria, Order: Streptomycetales, Family: Streptomycetaceae, Genus: Streptomyces
tcggagaggtgtataagagccaggcccaccacagcggcgggggggccggagcggtccccggcggcggagcggtgacggccgaccgggcgcgggccgaggagtgcacggagccggaggcgagccttcccgcgtcgagcgccgacgggcccagcatcgaaaagatcaaggagcgcggcaagctgatcgcgggcgtcgaccagaacagcttccgctggggctaccgcaatccggcggcccgggagctggaggggttcgacatcgatctggtgcgggccatcgccaaggacgtcctgggcgacccggacgcggtgatcttccgcgcgatccccaccaaccagcgcatcgccgccctggagaacgaccgggtcgacgtcgtcgtgcggacgatgacgatcaactgcaagcgactggagcaggtctccttctccaccgcctacttccaggccgggcagcaggtgctcgccccgaaggagtcgacgatcaccggctacgacgcgtcgctgaagggcaagcgggtctgctcggccgagggctccacggcgtacgaggcgctggagaagaagtccttcggggcgctctacaaggacgacttcgagggcaccgagcgcgaccgggacctgctgaccgtgcccaaccagctggactgcctggtgcggctccagctcggcgaggtcgacgcggtcgtcacggacaacgccctggcggccggtcaggcggcgcaggacccggcggtggagctcaaggggaagaccccgttcaccacggagtactacggcgtcgcgacgaagaagggcgccgacgacctggtggcccgggtgaacaaggtcctcgtcgactaccgggcgggcggcgacgacagcgcctggatgacctcctaccgcaagtggctggcggccggactgcccggcatagcgggcccgcccgcccccaagtaccgcggcgactgaaccggagcgccgctgcgcgcacggaccggggcgagcggaccggagcagaccgaaacagaccgatcccgccgggcccaccggcccggcggggagagcggagaggtgatcgatgggcgtcgcgggatccttccccagcttcgcggggaggccccccggcccggtcatggaccgggaggaggcggaccgtgcgctggcccggctcggtgcggagcacgaggccatcgagacctcgctcctcgcgctccaggaccacgccggccgccggctcctggagggtgccgagctgaccggcgtcacccgggagcgctgggccacgaccgagcagtcgatcaccctgctgtggggctatttcgacgcgtacgccggcgccctgtccgaggctcgggagatccgtgcgcggcggcgccacccgaatcgggaggacctcaccgcgctgaccgaactgctgcgcggcgaggccgtcaccgtcgccaacccgggtgccgtgccgccgccctcggtcgcgggtccggccaggctctccgagcggttctccctccaggagctggtcgcccggatgaacgagctgtacgccaggtccctggacatggtcgtctcctccgactccgtgtggtcggcgctgcccgcccggatcgatctgctcgccgccgagctgcaccggacgcgttcgctggcgcactccgtgggggtgcggcccggtgagcatccggccggggacgatctggcggagatcaccgaggagctggccacgctgcgggtgcaggtgatctccgacccgctggcgttctggctgccggggcccggcagcgccgcgccgggcggcggccgccccgacacctcgcgctacgaccgggcggcccgcgccctggaggacgtacggcgggagatcgaggcggtgctcgcggtgcggcaggacgccgaggcgcgcctggtgcggctgcgggacgtgctctcgcggcccgaccgc

SEQ ID NO: 3721 - DNA, 3444 bp, Unknown
  Kingdom: Bacteria, Phylum: Actinobacteria, Class: Actinobacteria, Order: Streptomycetales, Family: Streptomycetaceae, Genus: Streptomyces
accgcgtcgaggagttcctcggtggtgtcggcggtctgtccgccggcgaccaggacagggaccgggcaggcgctcacgacgtcggccaggtcggtcaccgagcgggggcaggggaccttgaccaggtccgctcccaggtcggcggcgagggtggcgacgtgcttgatgagcacgaggtcccgggggtcgctgatctcgggaccgcgcggatacatcatcgccagcagcgggacgttccaccggtcgcaggcgtcggcgacggcggccatgtcggccacctgggcggcctcgccggcggagcccacgttcacatggacgctgacagcgtcggcgcccaggcgcagggcgttctcgacgtcgctgaccaggtacttggcgtcggggtcgggcgcgtgcatggtgctcacgctgaggtgcacgatcagcgaggtccgcgtgaagggctccgggtcgagccggcgcagggtgcccttgtgcagcacgatcgcgtcgaccccgttgtcggagagccgccccaccaggtggttcaggcccgccgcggaggcgatgggcccgtcggtgacggagtggtccaggggaaccaccagcaggcggtcgggtgagttccggtagagcttgcgggcgcgcaggcgcgcgccgaacgagccgttgagcgtcatgggggtgctccttctgcgctcgtccccggtcatgccgtgaccagcgtctgcgcttcgaggtcgtcgcggccgaggccgaactcctggtgcagcgcgttgaccgcgtccggcacccggtccagggggatgatcaccgagacccgcaggttggtcgaggagacccagctcgcggtggtacccagtcgggccaggacggcgaggagccgggcggtgcagtcgggccggttcagcaggcccacccccaccagcgagaccttgccgaccttttcgtccacctccgtcgcgcagcccagtcggtcgctgatccgggcgagggcctcccgcgcggcgggcagccggcttcccggcagggcgaagcccatacggaggcccggaccgtccggggcgccgaaggagagcaggtcgatgggtacggcggaccgtgccagttcggtgaggatgtccgccgcgagaccgtcccgtgcctggtccgagcgggtgagggccatcgcgatgttcatgtcgtgcgcgacggcggtgacgggtccctgtgtttcgagcatgtcggcgctccgtccgaggatggtggttccgggttctgccgagaacgtgccgcgtaccaccacgtccaggtcattggacgcggccagttccaccgcacgcgaatgcatcacccgtgcgccggcgaaggccatttcggccatgaccgccgcgtcgacggtgggcagcacacgggcttccggtacgacccgggggtcggcggtgtagatccccggaacgtccgtgtggatctcgcaggcgcgggctccgagcacggcggccagcgccaccgcggtggtgtccgaaccgccgcggccgagtgtgatcacctctcctctcccgtcgccgccctggaagccggagaccacggcgatccgtccgcgccccagttcggcgcgcaggcggctcgtgtcgatcgcggagatcatccccgcgccgtgcgtaccgctcacgccgatgcccgcctgcggcccggtcagggagacggcgggcagcccccggtcgtgcagggcgacggcgagcagcgcggcggcggcgttctcccccgtggcgagcagttggtcgagctcccggggcggcggcgcggcaccgagctccgcggcggccgacagcaggacgtcggtctcctcgccacgggcggagacgacgaccaccgaaccccgctccgtggaatgggaacgggcgacgacctccgcgacctggcggatcttctcgggagtcgccaaggaactcccgccgaacttctggatcgctgctggcatatgtcctcgcaccggatgatcggggcacatgacgttgcgcgaattcatttctacacatcggcgatgcgtaccggatcacggatacacgtgatgtagggcgtcggcgttccgagaattcccggacgcccgaagtcggcgcgcaggtcgtcgatatcccgcgttggcgtgatgtggcgcggcaccgatacgcataacgtccgcgggtagtccgattgttctccgtgtacggcccggggcccgaggagtgtcatggcgaatgacagcggaaggccgttcaccggccatggcgtggacgagggcgggaggtcggggaatccggcgccggcccggacgccggacgaggacggtgtcacccgtatcggtgtgatcggcgcgggcccccgcggcatctcggtggtggagcggctctgtgccaacgccggtctgccgtacctgcgggagcgccggtacgccgtgcacctggtcgatccgttcccgagcggcgggcaggtgtggcgcaccggccagcgggccgaactgctgatgaacacggtggcgtcgcagatcacgctgttctgcgacgagtccgtcgcgtgcgcgggaccggtcgtgcccggacccagcctgcaccagtgggcgaccctgctggaggagctgggatcgggaggtcttccggccgatgtgcgccgggaggcgacggcgctgggccccgacgcctatcccacgcgccgcctgtacgggcactacctgatgtgggtcctcgaccggctgaccggcggggctccccccaacgtcaccatcacggtccaccacgccacggccgtggcactgcgcgacgcacccggcggccggagttcccaggtggtcacgctggaccggggcggcgagatcgccgagctggacgcggtggtcctggcccagggccacataccggtggaacacacgccgcgcgagcgtgagttcagccggtacgcgcggcgcagcgggctcctctacttcccgccggccaacccggccgacgtcgacttcgccggtatcggggcgggccggcccaccgggctgctggggatgggactgaccttcttcgacgtcgtcgcgctgctgaccagcgggcgcggaggggtgttcgagcgggacggccggtccctggtgtaccacccctcggggcaggagccggtgctgtacgcggggtcgcgccgcggcattccgtaccacgcgcgcggggagaacgagaagggcgtctccgggcggcacgagccgctcttcctgaccccggcggccatcgaggagctgcgcgaacggcaccggaccaccggcaccctgtccttcctcgaccacgtctggccgctggtgtcgcgggaggtgcgcgcggtctactaccgggccctcctcgccgagggggatgacgcggcggccggggcggtgttctgcgcggagttcgtggcccggggcggccccgaggggaccgaggagtccgcgctgctggaccgttacggcattccggcggagcggcgctggagctggcc

SEQ ID NO: 3722 - DNA, 1225 bp, Unknown
  Kingdom: Bacteria, Phylum: Actinobacteria, Class: Actinobacteria, Order: Streptomycetales, Family: Streptomycetaceae, Genus: Streptomyces
tgtgcgcgagttcgtccgcgacgtgccgcgcgagcaggtcctgaccgtcgccacggccatgcggcccgcgctcgccggggagagcgagcgcggcccggccgtacgccccgaagccaccgtctccgaggccatcgaagcggtctcccgctccggcgaccccgccgcccgcgtgatggacggcggccggctcgtcggcgtcgtcgaccacgcgtgcctgctcgacgtcgtcgccggaacgaccggacccggccacgcgaccgcgaccggcgcccagggtgcccccgccgcccccgacgcgccggacggctcccgcgaggtgaccctctgatggccaccgcacaggccaccccggcccgccccgtgcgaacgggtgcgcgccgaggaccgctggccgcactccgcgaccgcccggccgccgccaagctgctgctgctcgcgctcgtcgccgccgtcgtcgtccccgtcgtgcacggccgctggggcggtggcctctggcccgacgcgctgaccgccgacctctccgcgccgctcggcgacgtgacggactggatcgtctccaaccgggacagccacccgctgttcctctacttcttcggacacatcagcaacgccgtcgtgctgtccgtacgcggtgtctacctggtcctcctggccctcggctgggccggcgtcaccgtgttcgccgccgccgtcgcctggcgcgtcgcggggatccggctggccctcaccgcggccgcctcgttcctggtctgcgggctgctcggcatgtgggtgccgaccatgcagacgctcgcgctgatggtcgtcgccgtcctcgcctccgtcgtgctcgggctgctcctcggcctggcggccggtctttccgaccgcacgttccgcctcctgcgcccggtgctcgacaccatgcaggtgctgcccgccttcgcgtatctgctccccgtggtgctggtcttcggcatcggcgtccccggagccgtcctcgccaccgtcgtgtacgcggctccgccgatggcccggctcaccgcactcggcctgcgcggcgcggacgccggtgtcatggaggccgtcgcctcgctcggcgcgaccggacggcagcggctgctgagtgcccggctcccgctggcccgcaaggaactcctcctcggcctgaaccagaccatcatgatggcgctctccatggccgtcatcgcctccgtgatcggcgccggcggcctcggcgaccgcg

SEQ ID NO: 3723 - DNA, 569 bp, Unknown
  Kingdom: Bacteria, Phylum: Actinobacteria, Class: Actinobacteria, Order: Streptomycetales, Family: Streptomycetaceae, Genus: Streptomyces
  misc_feature (161)..(182): n is a, c, g, or t
gcaccatggtgccgtcgtctccctccccggccggagccgcggccacgacgggagccgcgaccgcttcccgctcctcccgcaccggctcgggcgccggaggcgccgtcaccacgaactcgggatcgagcccgcgcagccgtacgtcgaccgaaccgggagcnnnnnnnnnnnnnnnnnnnnnncgctcggccagggcgcgggcttcgtcaccgctggcatccgcggcgacggcgagttcccgccggagattgtcgacgtagggggtgaggtccatgacgccatgatggcacaccaatggcaccacgtcgagccaccttggcgcggcccctatggaaacccgtctgaactgcaacctcgcaaccagggcggcaagaacagcatcgcggaggcacttcaaggaaccaaggatggcaccacagcgccaccgcatggcaccatgcggcaccacagggtgccactcagtccaccagtggctccgcgtggcacacgccgccccgcagccgaagccggatgtactgatggcaagcgccgcacatcacgacagcgccaggcccgccacacccccaccc

SEQ ID NO: 3724 - DNA, 2312 bp, Unknown
  Kingdom: Bacteria, Phylum: Actinobacteria, Class: Actinobacteria, Order: Streptomycetales, Family: Streptomycetaceae, Genus: Streptomyces
acctcgtacggtgacgtctcccaccgggtcgcaccggcgcacgacccggtgggagacgtcaccgtacgaggtcaccgtacgaggtcgatctccgcccagaccgtcttgcgcgggaccggcccggagaggatcccccagtggtccgccagcgcctcgacgatgagcaggccgcgtcccctctccgcgtcgtcctcgggcggcttcacagcccccggtccgggcggcatgctgtcgccgcgcgtgtcggtgacctcgatccgcagcgtgcctccgccgacggtgaggccgagttggaagtcccggcccttcacgcgcccgtgcaccgtggcgttggccgccagctcggcgacgatgtgtcccgccgtctccgcttccgacgggagcccccacgctccgagatgggccacggtgagcagccgtgcgagccgggcccctcggcgggtgggggagagcagcacggtgaacgcccggtctgcgtgcatgcgttgggtgcggacgatttcttggttcatgtcactcagcgtggccgcatctgcgtaccgtgcccagtgaccgagcccttgcgtacggtgattgtcctgggcttgtccggcgttgtcccggctgtccccagtgacgtgcggggaagggacgtggttgggaaaagaacggcaggcgcgtcggaagcgggagctcgcatgagcgtggtcggtgacggtacggagcgtggggacggcggggtggacgagcccggctgggacgtcgatcccgatgacgagtcgggagcggcggtggtcgcggcggtgggccgccagatcaaggcctggcgcgaggcggcgggcatgcgggcctgcgagctggggtcggcgctgggctacggcgaggacctggtctacaaggtcgagggcggccggcgcatcccgcgcccggagttcatggacggcgtggaccgggcggtgggggcgggcggcaagctcgcggcgatgaagtccgacctggcggaggtgcggtacccgaagaagatccgggagctggcgaagttggaggctgccgccgtggagctctcggcgtacgggaaccacaacctccacggtctcttgcagaccgaggagtacgcgcgtgcgttgttcgggatgcgcaggcccgcgttctcacaggacgaggtggagcggctggtggccgctcgtgtggcgaggcagtccatcttcagccgctctcccgcgcccgagttgagctttgtccaagaagaggcgacgctgcgacgccctctcggaggcagaatggtgtggcgccggcagctcgaacacctgcttgatgtggggaagttgcgccatgtcgagattcaggtgatgccgaccggtcgcgatgagcatgccggaatgggtggtgagatgcaggtgctgaagttcaaggacggctcggcggtcgggcgctccgaaggcgacttcggcagtcggccggtttccgatccgaagcacctacggatcatcgaactgcggtgtggcatcatccgggcgcaggctctcaacccgagggagtcgcgggccttcatcgagcaagtgctgggagagacatgatcagcgacacctctgccgggagcgcgtccgaactgcgctggttcaagagcagctacagcgacagcagtaacagcaacgagtgcgtcgaggtcgccaccgcccaggacgccgtccacgtacgcgactccaagaaccttcagggcccccgtctcgccgtcgcgcgcgccgcgtgggaggtcttcgtcccgtacgtcgaggaaggccgctgacctccgcctcaacccgtgtgcagcatcagcccgatgcccaccaccatcagccccgccgccgcgatcctcggggcaccgaagcgctccttgaagaacagcgtgccgatcgccgcgcccacgatgatcgacgactcgcgcagcgccgcgatcggagcgagcggggacctcgtctgggcccagaggaccagcccgtacgcgaccaccgagagggccgcgccgagcagtccccgtgccgcgtacggccgtagctgcgggaggagttcggcgcggcggcggtagtacgcgtacgccgggatcgccaggccctccaggatcatcagccaggcgatgtagcccagcggggtgcccgaggcgcgcacgccgacgccgtcgaccgtggtgtacccggcgatggccagaccggtgccgagggccgccacgatcgccggccagtgcgggcgcttgccggatccccggatgccccacagcgccagtccgaccagcccggccgaggccaccgccacgcccgccgtggcccaggcgttcggacgctcgccgacgaacaccg

SEQ ID NO: 3725 - DNA, 5504 bp, Unknown
  Kingdom: Bacteria, Phylum: Actinobacteria, Class: Actinobacteria, Order: Streptomycetales, Family: Streptomycetaceae, Genus: Streptomyces
cgtcgtcgctgccgcaggcggtcagcgccagtgcggcggccagagcggcgaccacgacggcgccggtgcgtagagagctggtcacgtggagttcccccttgctgttttccggtcgaaagaccgcgccacgttaccaaggtccgcaacgatcaactcccttgagcgggagcgaaataggcgtgccgttcgtctctctccccggagggtgcgaccggggcggataagcctgtaatcaaaggaacacccggcgtgcacgtgcatctgctcatgcattggcatatgaacagagctatgatccgagctagttgacacttgcaccttgcaactcggggagcgtcctgtgcaccacgtgtacaacggcatggcggccacagagcttcgcggagtcgtctggcagaagagcaggcacagcaactcccagggatcctgtgtggagttcgcgcggctgcccggagggaatgtggcgatgcggaactcccgtcaccccgacgggcccgctctcgtctatacgcccgcggagatagaggcgctgctgctcggcgtcaaggacggcgagttcgaccacctggccgccggcgcctgacgcggggtccggcccggggcgggccggacccgagtgctcacggacccgtcttcgggttctcctggagccggaaaagagcccagacgaccttgccgtacagcgggccggaaggcagttccccgagctgtacgggagaggggtgccagccccagctgtcactgacgcattccaccaggaacagtccgcggccggattcggccgaatccgccgcctcgcccgccaccgggctctcccggctgggatcgcgcaccgcgcacaccagtcgcgaggtccagcgcatcagatgcagtcgcaccggcgggtcctggaattcccggggcggatcgccgggcaatgcgtggcgcagggcgttggtgacgagttcggacaccaccagggcgacatcgtcgaaacggtcgcccagctcccatcgctccagcgtcgaccgggtgaacttccgtgctccgccgaccgcttcgtagcgtgcgggcagagcgcaggacgccgatccggcaacccctgaggggtcggtggggggaagcccctgccgtaacggctcgagcatcgtcgatccattcgtccccatacgaggcactcccgggattcgcggctgtagcggcactgcctgtagcggtactgcggggggtacagcggcacaacacgagcacgcaggtgcgcgaggaccatggttccgaatgcgcagggcagatgcaagggcagatgcacgtgcacgcgcctgacctgcccgataccgtggtggttctggggtatttcttcccggggtcagtttcggagctttctggacgtcttcccatttccgtaatcgaatgagtacgggctgaagcgttttggtggcagaatccggcactcggggttggggggctccggatgccagggagagtcatggggagggtcggaccagtgtcggcaggcgagtcgagtggatcggtggtgcggcgcatcctcctgggctctcagctcaggagactgcgggagtcgcgcggaatcacccgtgaggcggccggctactcgatccgggcctccgaatcgaagatcagccgcatggagttgggacgggtgagcttcaaggccagggacgtcgaggacctgctcacgctctacggagtcgcggacgaggcggagcgcgactccctcctcggcctggcccgtgaggccaacgtggcgggctggtggcacagttacggagacgtgctgcccggctggttccagacgtacatcggcctggagggcgccgcatccctcattcgtatctatgaagtgcagttcgtgcacgggctgttgcagaccgaggcatatgcccacgccgtcgtctcgcgcggaatgcgcggagcctcgcccgccgagatcgaccgccgggtggccctgcgtctggagcgtcagaaggccctcgtctcggagcgtgcgccgacgttccatgccgttctcgacgaggcggcgctgcgccgaccgtacggcgaacgcgacgtcatgcgtgcccaattgcggcatctgatcgatatgtcggagcagccgaacatcacgcttcaggtcatgcccttcagccatggcggtcatgccggcgagagcggatcgttcacgatgctgcgtttcccggaatccgatctgtcggacattgtctatttggagcagctgacgagcgcgctctatctggacaagcccgaggaagtcgcgcagtacgaaaaggccatggcgggcctcgcccaggacagccccactccggaagacagccgggatcttctgcgcggtctactccaactggcgtaatttctcgttacgatgacgtcgcatcaggagtctgcgaacgcctgcagtaagggattgcatgtccttcttccatgaactggcccaccagtacatcgacggcgagtggctgaccggcagcggctcgtgggacatcatcgatttcaatccctacaacggtgagaaactcgccgccgtcaccgtggccaccgcgctggaggtcgaccgggcctaccgggccgccgagcgggcccagcaggaatgggccgccgtcaatccgtacgagcgccgcgccgtcctcgaacgcgcgctccgcatcaccggggaacgcgcggaggagatcgccgaggcgatcatcgacgaactgggcggcacccgggtgcgggcccagtacgaggtccggggtgcgacggagttcctgcgtgaggcgatccgccaggcgctgcggcccaccggccggctgctgcccgccgtgggggacggcagggagaaccggctctaccggctgcccgtcggcgtcgtgggcgtcatcagcgccttcaacttccccttcctggtgacgatgaagtccgtcgcgcccgccctggcgctcggcaacgcggtcgtcgtgaaaccccatcagaacgcgcccgtcgtgggcggcggtctgatcgcgaagatattcgaggacgccgggctgccggccgggctgctcaacgtggtgatcaccgacagcgcggagatcggcgacgcgttcatcgagcaccccgtacccaaggtgatctcgttcaccggctccgaccgggtcggccggcacatcgccgccaccgcggccggcgccttcaagcggaccatcctcgaactgagcggcaacagcgccctggtggtgctggaggacgccgacgtcgactacgccgtccgggcggccgtcttcagccgcttcctgcaccagggccaggtcagcatggcggccaaccggatcctgctggaccggtcggtggcggcggagttcaccgagcggttcaccgccgaggtggccgccctgaagaccggggacccgagggacccggagacccggatcgggccggtcatcaacgccttccaggccgacgcgctggacgccctcgtcgaccgggcggtcgcggacggcgcgacggcactcgtgcgcggccggaccgtcggcaacgtcgtcggcccgaccgtcctgaccgacctcgcggaggactccccgctgcttcagcaggagatcctcggcccggtggccctgctgatgacgttcgacggcgaggaggacgccgtgcggatcgtcaaccggggcccgtacggcctcagcggcgcggtgcacacccgggacgcggagcgcggggtgaagttcgcgcagcgcatcgtcagcgggatgttccacgtcaacgactccaccgtgcaggacgatccgctggtcgccttcggcggcgagaagacgtccggggtggggcggctgaacggcgaggccgtcgtggaggcgttcaccacccagaggtggatgtcgatccagcacgggcgttcggtcttcccgtactgaggcggcctccggtactcccgtgctgagggggcctccgccttcctcggttccccgggccccggaacgtgatgcggtaggcgctcggtgtgatcgggtcctggagccgccgcggcgcccatgcgccgagttcgtccccaggccgcctccggtccccggcgcggccgcacgggcgccgagggtgctcctccgtgcggcgcgcaccggtccgttccggctgctgccccggccgtacggctgagggcacaccgaccggctgttcgcaaggcggcgggctaccctagtcaaagttgaataggaagaggggtgtcatgtccgcgatccggctgctggtcctcggcgccgtgcgtatgcacggccgcgcgcacggctatcaggtccgcaacgacctggagtactggggtgcgcacgagtggtccaacgccaagcccgggtcgatctaccacgccctgaagcagatggcgaagcagggactgctcctcgcgcacgagacggccccctccacggcgggcggcccgccgcgcaccgagtacgaggtcacggacgaggggctggcggagtaccgcgccctgctgcgtgacgccatccgctcctacgaccagcagatggacgtcctctcggcggcggtcgggttcatcgtcgacctgccccgggaggaggcggtcgggctgctcaaggagcggatcgaggccatgaaggggtggcgggactcggtcaccgagtactacacgcccgaggagggtcccggatccctcggccacatcggcgagatcatgaacctgtgggtgcactcggccgacgccggcgtggagtggacccggggcctgatcgcccgcatcgagggcggcgcgtacaccttcgccggtgagggtgaaccgttcgtcggggtgctggccgatggcgaggagaacccctacgccaccggcgtccccgatcccggggaccacgactaatcaagtttgacgaatgacggatcggggtttacctttcccctgctagtcaagtttgactacgggaaggtgcggacatcatgaccgacgcgatcgtcatggacggcgtgcacaagcggtacggggagaagcgcgccctggacggactggacctggccgtcggcagcggcaccgtgcacggagtgctcggccccaacggggcgggcaagaccaccgccgtacggatcatgtcgacgctgctgcgccacgacgcgggccgggtgaccgtggccggcctcgacgtccgcgagcgggcgggtgaggtgcggcggaggatcgggctcctcggccagcacgccgcggtggacgagcagctcggcgggcggcagaacctggagatgttcgggcggctgtaccacctgggcgcacgccgggcgggcagccgggcggacgagctgctggagcggttcggcctcgcggacaccgggcgcaaggccgtcaagcagtacagcggcggcatgcgcaggcgcctcgacctggccgcgtcgctgatcaccgacccggacgtgctgttcctggacgagccgacgaccggcctcgacccgcgcggccggaccgaggtgtgggaggcggtgcggtccctggtcggcggcggcaccacggtgctgctgaccacgcagtacctggaggaggcggaccagctggccgaccggat

SEQ ID NO: 3726 - DNA, 2405 bp, Unknown
  Kingdom: Bacteria, Phylum: Actinobacteria, Class: Actinobacteria, Order: Streptomycetales, Family: Streptomycetaceae, Genus: Streptomyces
gtgatgtcgccgcggaccagacgtacggcgggggagacagaggtgctcatgcggccatcatgccgcgcgccggaggccttcgccgcccggtccgttcaggaggcccgcagccttcgccatacggccttggcggcgtggtggccggacatgccgtggacccccggtccgggcggggtggccgaggagcagaggaagacagcggggtgcgcggtggcgtaagggacgcgggcgagcttgggacggatcagcgtctggaggccggcgaaggctccgcacgcgatgtcgccgccgatgtaattggcgttgcgcgcggcgagttgcggcgggcccgcgagggcgcgagcgagcacgaggtcgcggaacccgggggcgaaacgctccagttggcgttcgatgacgtcggtggcgtcgccctcccaacccgccgggacgtgcccgtacacccagaagacatggcgtccttcgggggcccgggaggggtcgatcaggctgggctgggcggtgatgaggaagggaacgtcggggtcgcggccctcgacggccgccttcagtgcggcgttgatcgttccggcgtcggcaccgaggtggacggtgcccgcgcggcgggcctgggacgcggtccaggggacggggcccgacagcgcgtagtcgatcttgaaggcggaggcgccgtagcggtagcggtggtacgcggagccgaggccggcgatccgggcgagggcggagggtgaggtgtcgaagatgtaggcgcgggcgggggggagttcgtccaggcgcttgacctcgctgccggtgcggatcgtgccgccctgttcgcggaggtaggaggcgagggcgtccgagatggcctgggagccgccgcgcggcaccggccagccgttctcgtgggcggcgagcgcgaagacgagggcgatggccgaggtggcgaagccgctggtgggagctatggcgtgcgcggcgagcccggcgaagaggccgcgggccttctcaccggagaagcggcgggagagccaggtggcgggctggaggccgagcagaccgaagcgggccagccgatagggatcgcggggcaggccgtcccagggggtgcgcaggaagtcggcggccagggtgtcccagcggccgacgaagggagccatgaggcggcggtaggcgccggcgtcggcggcccccagcgacatcgcgctctcccccaccgagcgggtgagcgtggccgcggtgccgtccgggaaggggtgcgcgaggtcgacctcggggtgcagccactgaaggccgtgccgggccagcggcatgccccggaacgcgggcgagccgatcccgagggggtgcacggcggaacaggggtcgtgccggaaccccgggagggtcagctcctcggtgcgggctcccccgccgatggtgtcgtgcgcctcgtggacctccaccgagcagccccggcgggccagttcggctgcggcggtcagtccgttgggccccgcgcccaccacgaccgcatcgagcatcgacggcaccttgggactccttcgtcggccggcagtcggacctccaggatattcgccgccaccgaccgtgcgtacgcgggtaccccgggttcggtcgtggcgggtcagccgcccgtgcgcagggcggccagaacgcgctgggcggtggcctcgtcgcgggcggccgtgaacggcaggtcgttgccgcccgcgatgcggaacggggcgccggacagggtcgactggacgccgcccgcctcggtgaccaggagcaggcccgcggcgtggtcccaggcgtactcccagttgaaggcgacggcatcgagggagccgcgggcgacggcgaggtactcgagtccggccgagccgcaggggcgggccgcgatgccttcggtgcgcaggccgagcagggcccgcttctgggcctcgctggtgtagtcggggtgcgacatcgccaccttcagcacggcgccgggcgcggactccccggagcgtatcggcgcgccgttgagcgtggcgccccgaccgcgtacggcgatggccatctcaccccggaccggtgcgtacgtccaggaggcgtgtacctcgccgtggagggcgagggcgaccagggtgcagaatccggcctcaccccggacgaactggcgggtgccgtcgaccgggtcgacgatccagaccggggcgtcgccgccgagggcgtcgtagaccgccgggtcggcgtgcacggactcctcgccgacgacgaccgagccgggcagcagtttcgtgagggcggcggtgaggtgttcctcggccagccggtcggcggcggtgaccaggtcgtgcgggccgctcttctcgatgatctcgtgggcggcgagcttccgatggcgcggcatgatctcggccgcggcggcggcgcgtacggcggcctcgacctcggcc

SEQ ID NO: 3727 - DNA, 5001 bp, Unknown
  Kingdom: Bacteria, Phylum: Actinobacteria, Class: Actinobacteria, Order: Streptomycetales, Family: Streptomycetaceae, Genus: Streptomyces
tctcccgcttccgtccgtccagctccgcggtcccgcccgtctacagcttctcgaccggcgcgtaccgcagcaggagcttcttcgggcgttcgtcgccgaagtcgaccgtcgccttggcctggtcgccgaagccctcgacggccgtcaccgtaccgagcccgaactggtcgtgcgtgacccggtccccggccaccagggtgaccgtcggcttctccgcgccgccgcgccgggtcgcgaagcccgaggggccggagcgggagcgggaggaggacagcgaggacgtgatgccggaggtgggcccggcgggggcggccatcggacccttgcgccgccagtcgaggtgctgttccgggatctcctccaggaaccgcgagggcgggttgtacgagggctggccccaggcgctgcgcatcgcggcccgggtcagatagagccgttcgcgggcgcgggtgatgccgacgtacgcgaggcggcgttcctcctccagctccttggtctggccgagggcccgcatgtgcgggaagacgccgtcctccatgccggtgaggaagacgaccgggaactccaggcccttcgccgtgtgcagggtcatcagcgtgatgacgccggagccgtcctggtcctcgtcggggatctggtcggagtcggccacgagggcgaccctctccaggaactccgcgagcgtgcccgcaccctcctcgtcaccgcgctcctgctcgaattcgagggcgacggcggcgagttcctggaggttctcgatgcgggtctcgtcctgcggatcggtggaggcctggagttcggcgagatagcccgtgcgctccaggaccgcttccagcacgacggcgggcccggcgccggactcgacgatcgtgcgcagctcctccatcagcgtgttgaagcgcttgacggcgttggacgagcgggcggccatgccgtacgcctcgtcgacgcggcgcagcgcctgcgggaaggagatcttctcgcgcatcgacagggcgtcgatcatggcttcggcgcggtcgccgatgccgcgcttggggacgttgaggatgcggcgcagcgggacggtgtcctcggggttggcgaggacccggagataggccaggacgtcccggacctccttgcgctcgtagaagcgcacaccgccgacgaccttgtagggcaggccgacgcggatgaagatctcttcgaagacacgggactgggcgttggtccggtagaagacggcgacgtcgcccgccttggcgtcgcccgcgtcggtgagccggtcgatctcgtcggcgacgaactgcgcctcgtcgtgctcggtgtcggcgacatagccggtgatgcgggcgccgctgccggcgttggtccagaggttcttggggcggcggctctcgttgcgctcgatgacggcgttggcggcggagaggatcgtctgcgtggagcggtagttctgctccagcaggatcgtcgtcgcgctcgggtagtcctcctcgaactggaggatgttgcggatggtcgcgccccggaaggcgtagatcgactggtccgcgtcgcccaccacgcacagctcggcgggcgcgtcggcctccccggccgggccgaccagctcccgtaccagcgtgtactgggcgtggttggtgtcctggtactcgtcgacgaggacatggcggaagcggcggcggtagtgctcggcgacgtccgggaaggcctggagcaggtggaccgtcgtcatgatgatgtcgtcgaagtccagggcgttggcctcgcgcaggcgtgcctggtagagcgcgtacgcctgggcgagggtcttctcgaagccgtccgcggcctgtccggcgaaggtctcctcgtcgatgagctcgttcttgaggttggagaccttggcggtgaaggacttcggcggaaactgcttcgggtccaggtcgaggtcgcggcagaccagggccatcaggcgcttggagtcggcggcgtcgtagatcgagaacgacgaggtgaagccgagcttcttcgactcgcggcgcaggatgcggacgcacgcgctgtggaaggtcatgacccacatggcgttggcgcgggggccgacgagctgctcgacgcgctccttcatctcgcccgcggccttgttggtgaaggtgatcgcgaggatctgcccggggtgcgtcccgcgctcggccagcaggtgcgcgatgcggtgggtgaggacccgggtcttgccggagccggccccggcgacgatgagcagcggggacccggcgtgcacgacggcggcgcgctgctcggtgttcagcccgtcgagcagggcggcggagtcgatcaccgggcgcgcgtgaccgtcccggtagtacccgtcccggggcggcgggggcgcgtcgtagacgccctcgaagagtccctccggcaccgcttcgggcgcgtggtcctcggggggcggcgggggaccgtcctccgcgggctggaggccggtcaggaaactgtcgtcaaagaggctgctcatcgcctcccgagtctaggcggccccactgacaaggttccgccgaagccgggaaagggctcttcgtaccggccgccgacacgcccgtgccgggtacggacggagaccggacgtcgacgttccgtgaagaagtgcccggtcggagggggtggcgggcccccgatccggaaaggtcacgaaaatgtatcgggcatatcgctcatcgtccttcccagcggcggtgccggttggctagcgtgctcgatcaggtgatccgtacctcctgaggcgaaccacgcctgacggacacctctgccgaatccgtcccgccgcactggcagttcggaaccggggacccacacgcaccaccggggtgaatcggtccgtgcgctcgcatccggaccgtaggacagccttccgttccgtccgaacccgacagctaacccggtaggcggtccacggaaggagatgccggtcttggcatcgcatcgcaagccgcgcacgaaggtgcgcaccaccacccccgcagtcgggctgacgacggccgcgctggcctccgtgacgctgctctccacccagagcgccacggccgcgcccgcggagccgaagcccgccgtcgaggaggtccagaagaaggtcgacctcctgtaccggcaggcgggcgccgcgacccaggagtacaaccgggccaaggccgcctccgcgtcccagcagacgaaggtcgacgcgctgctctccgacgtggcgaagcggaccgagaagatcaacgaggcgcgccgggcgctgggctcctacgcggcggcccagtaccgcaacgggggcatcgggcccgcggcgacgttcttcctcgcggacaacccgcaggggtacttcgaccagagccggctgatggaccgggcgacggagcgccagcagaggtccgtcaccgagttccgtacgcagcaggcgtcggcggcgaagaagcgcgcggaggcggtgaagagcctggagacgctcaccgagacgcaggccacgctcgcctccagcaagaaggacgtgcagaccaagctcaccgaggcccgcggcctgctctcgcggctgaccgccgaggagaaggcgcggctggcggagctggagcgcaagaaggaggccgaggcgaaggagaaggcggcgaagctggccgcccggcaggccgccgaggcgaaggagcgggccgaggccgaggagaaggcccgcgaggaggccgcgaaggagtccggcgacggcacgggctcaggtacgggcacggatccgggcccgggcgccggcagcggtacggacagcggctacgccgccaaggcggagaaggtgctggccttcgcccgcgcgcagatcgggaagccgtacgtgtggggtgcgtcgggcccctccagctacgactgctcggggctgacacaggcggcgtggcgggaggcgggcgtgaccctgccccggacgacctgggaccaggtggaggtcgggacccgggtcgccacgtccgacctgcagcccggagacctggtcttcttctacgacgacatcagccacgtcggcatctacaagggtgacgggatgatgatccacgctccgaagccgggtgcgaacgtgcgcgaggagtcgatctactacatgccgatctacgggagcgtgcgcccggcgtagagcaggcgcacggcgcggagggtgtggcccgcgcgaacgggccgcaccccgcgcgggctcagctccagaccgtggcgatgaagatgttggcggccgtcagtccgccgaccgcggcgaacgcgcccttgtccaccgtctcgtcgtcccgcttgacgtagacgagggcgaggatcacgaccagcagcgcgagcttgacgccgatcttgacgttgttcacggtctggccgtcggcctggttgagtccgaccagggcgatgccggtgacgagcatggtcagcgcgccgtgcagcatggcggggatgaagcgggcggtgcccgctcccatggccttcatctgcgtcaggaagccgcccagcagggaggcgatgccgatgatgtgcagggcgacgaagacattgatgagtacgtccatggctccggagcctagccatggccaaggttttacctttcagtgaggcaaaccttccttgtgcgctatctccggtattgaccgcattgccctgatgtacgagcgtatcggtgatcaatcatggccgccgaaacgtcacatcagggcaatagcggtcatggcgactgttttcccggaaccaggattagcgtccttcacggacccgccggtatcccccggcggccagccgacaggaaggatgccgcccccgtggcagcgcaccgcaggtcagcccaccgaaaacccaagcagcgcccgttcaccggctctgctgcccgcaccgccgccaccctggcgctcgccggtgccgccaccgccggctcggtcaccggagcgggcgccgcccccgccgaaccggcccctaccgccacacaggtcaaggcgaaggtcgaccggctgtaccacgacgccgaggtcgccaccgagaagtacaacg

SEQ ID NO: 3728 - DNA, 1904 bp, Unknown
  Kingdom: Bacteria, Phylum: Actinobacteria, Class: Actinobacteria, Order: Streptomycetales, Family: Streptomycetaceae, Genus: Streptomyces
acggccgcggccgtacgctcctcgatgccacggatcagggcggccaggtcggcgcagtagaccgacgggttgtcgaagccggtgccgctgtcggagcggtagcggtgggtgtagagcccgccgccgcacgagcgcacgaccgggcagcgacggcaggtctcgctgactccggccaggccgagctgccgcgcccggacgccggggtgggccgcgacctcgtcgaaggtgttgcggaagacgtcgaacccggtggcggcggcgccctcgtaggcgctcttgagcgagtcgacctgttccagcttcccgtcggtctcgatgacgacgaggtcggtgggggccaggccgagggactcggtgaggctggggccgccgttcaggctggagagcacggaggcgaacatccggacgggcatggggcggccctgctccgtccagcggtcgaagaccgccaggagccagtcggcgtacgcggtgggtgagccgtccggccgcgggggcgggtcgtcccaggtggcgtgcggcagcaggaagtcgacgagcgggggttcgagtccggcgagggcgtcgtgcacggccaccggatcgttgtggatgtcgaccgtgcacaggaggccgaggtccaggtggcggtagcgctcctcgcggagcagttcgacggctcgcagcaccatcgggtggctgctgcgtccgtcggcgaaccgacggtggcggtcgttggccgcgcggtcgccgtcgagcgagatcccgacccggacgtggaactcgtcgaagaggtcgaggtaacgggggctgagctggacgccgttggtgtggatcctgaggtccagctcagcgatgccgttcagagccgagccgagctcctcgcagacccgtcgcagtcgcgcgggccccgccaggagcggttccccaccgtgcaggatcactgttacggagggaagcgcatgagtcgtcgcatgctcggccagacgccgggcagtccaggaaattgcctcgtcagagatggtcttggggcgtgtcagccagctctggtcggcatgttcgtagacataacaatgatcacaggccagatcacacctgctgtgcactttcagcacgaattcacggaaggggaccaggggtcctgtcatcccgccattctagccgcttctgacgtcggctcagagagccgaattgaacgtggagatgcgggtggacctggccgttgtggcaccgcatacgcggttgatcttcctggcggcctcggcactgcgaacatcggtcgccgagagaggcgcgcgggtcttcgcagaggcgaagtcgggggtggttccgtaggtcttcacggccgtcctagggggatcctgaaggggtctgtttccggacattgaaacgctgccggattccgtgtcatcacacgtcccggcacgcgcactttactaccgcggaggcccttccacatgccggcggagcagccttcacacctggtttcgaaagtcgaaacacgccttccgttcggccgctcgggtgagcggcgcgcgagcggcggaaccggcgggccggagcgccgacttcgctgccgccggccctcgcaggtgagaggcttcccgccgtcggcgaagccgctcacacctgggccgggcgcgcgagccgtgacgcaccctcgccgcacgcgccgggacgctccggcgggagggcgattcactcgttcaccggttgctcgccggggacgtcgtgctccgcacgggcccgcgcaggcagtccagaacgcgttcatggctgtcgcccacgacgtccgtgacccgcacccggaccggcggtgcgtccacccgcacggcctcccaccacaggatcaggaccgcgagcagcaccagtggagcggggaagagcagcgggccgcggcgcacccggcaccggctgtcccggag

SEQ ID NO: 3729 - DNA, 1749 bp, Unknown
  Kingdom: Bacteria, Phylum: Actinobacteria, Class: Actinobacteria, Order: Streptomycetales, Family: Streptomycetaceae, Genus: Streptomyces
cgccgggtcctccccggcggccgaggcgacccggcgcagcagctcgccctcctgcgggtcgcccagcgcccagatcggtgcgatgtgccgctgccggtccagggccacgccctcgttcaccgtacggtccaggtggatggccaactggggtacgcgcagcaggggttcgtcgatctgcacgagccggctgcgcgggccgccgtcggggccgcgcagcgcgagccggccggagatgcccaggtcccggtcgagccacgtgttcagcggaaccccgccgtagatctccactccgatctgccgccaccccgaagtcccggtgtccggtgccggcttgatccgcaggttcggcgagtcggtgtgggtgccgacgatccggaacggggtgtgggaaggcgcgtcctcggggacgtaccaggcgatcagcgcaccggcgcggctgacgaagcagccgccggtcgcccccgtccagtcgtccgtgccgcgcagttcgcggaacccggccttctccagacgctgggccgcactggccaccacgtggtagggggaagggctggcggcgatgaaggagagcaggtcgtcggtgtggctgcggtggggggccggagtcatacggcgtccgcctttccggtgttcggcagtgactgggagggtgacggtccgccgggccggtcgggcccggcgctggcgtccccggcggagcctccggagccatggcccgggggcccctgccaggggcgctccccgaggagctcccgcaccggccggtcgggccgggcgctgaactccgcgagcacgtcggtgtaggacgagaggaggtcgtgggcggtcgtgtggtcccacaggtcggtggagaattccaggaacgttcgataacccttcgcggggtcccggcgcggcgcaagcccgaagcacagctcgctgcgggaaagcggcggtgccagatcggccacctcgacccggagcccggggatctcgatgtccgtgtcgacggagttctggaacgccaggacgtgcggcacccggtcggggacgctgacagcgcccgagtcccgcatcgcctgcatgatgcgcgcggtgggcagcacatgcgccatggcgccgagcgcgcccgcgcccgtacggaccgccagctccgcgcaggtctcgtcaagattggctgaatccagtcgtacgcggaccatcaccgcggtggacgtcatcgccacgagcgactccgaagcggtgccctcgcggttggcgtacggcacgctcagcaaggtgtcctcctctcccgacaaccgggtcaggaacaccccgagagccgccgccgcgaccgcgaacggggtggtgtgccggtcggccgccagcttctccaccgccgcccgcaccgcacccgtcgcgaccccgcgcaccgtgtccccgtgcccgctcagcttctgcggacgcggccggtccgtcggtacggggacggcggacggcaccccgtccagatagcgggcgcagaacgcggcccgctccgcctcggcgccgggatcctgttgctcccgctgccaccgggcgtacccgggcgcctgcatcgccggatcgggcaggccgtgcgggacgcccgcggcggccgccgtgtacagcgcggcgatctccgcgagcagcacggacagcgaccagccgtcggcgcagatgtggtgcaggacgaacatcagctcccagcggtcctcctcgacccgcagcagccgcgtccggggcaccagcggccgccccaggtcgaagggg

SEQ ID NO: 3730 - DNA, 3387 bp, Unknown
  Kingdom: Bacteria, Phylum: Actinobacteria, Class: Actinobacteria, Order: Streptomycetales, Family: Streptomycetaceae, Genus: Streptomyces
gttgttgaccaggatgtcgatgccgccgagcgccgcgactgccgctccgaccgcctcgcgcacggaggtgtcgtcgcccacgtccgcgctgagggcggtcagcgtccccggcacggcgtccgcgttcaggtccaggacggctacggcgacgccgtgcgcgtcgagcatgtgggcgacggcgagtccgatgccggaggctccgccggtgacgacggcccgcaggccggagagggacggggccgtcatgccgtcacctccgcggcctccgcgacgacaccggccgcgtcggccggttcggcgtccacggcagtcccggcggcggctgccaggtcgtcggtccagaacgtgccgccagggtaggcgaaggtcgccagcgaggccgggtacatctccgcggagaatcccggagcgaggggggccgtgtatctgccgtcccgtacgacggccgggtgctcgaagtgcccgtgcagatggtcgacgaactcgatgacccggtcctcggtggtcccgctgagtgccacgtagtcgaacatcgccaggtgctggaccagctcgcacaggccgacaccgccggcgtgcggacagacgggaacgccgaacttggcggcgagcagcaggatggcgaggttctcgttcaccccgccgacccgggccgcgtccagctggaccacgtcgacggcgtccgcctggaggagctgcttgaacacgatgcggttctggacgtgttctccggtggccaccttgaccggggccacggcggcccggatccgggcgtgccccaggatgtcgtccggactggtcggctcctcgatccagtacgggtcgaacgcggccagcgcccgggtccactcgatcgcctcggccacgttccaccgctggttggcgtcgagcgccagccggacgtccgggccgacggccgcgcgggctgcccggcagcggcgcatgtcgtccgccaggtcggcgccgaccttcagtttgatctgggtgaagccggcggccaccgcctcctcggccagccgcgtcagcttctcgtcggagtagccgagccagccgggcgacgtggtgtaggcggggtagccctcggcccgcagcgtcttctcgcgcccggcgctgcccttcctgccgcgccgcagcagctccagcgcctcctcgggggtgagcgcgtcggcgatgtagcggaagtccacctgggagacgagccattcgggctcggcgtcggcgagcagcttccacagcggtacgccccggcgcttggccgccaggtcccacacggcgttgaccacggccccgatggccatgtgcatgacgcccttttcggggccgagccagcggagctggctgtcgccggtcaacgcccggctgaccagccccggatcggcggagagatcctccacggaccggccgaggatgtgcgggcgcagcgcgtcgagcgccgcgacctggacgtcgttgccgcggccgatggtgaaggtgaagccgtgccccgcgaggccgtcgggcgcgtcggtgcgcaggacgaggtaggccgcggagtagtcggggtccgggttcatcgcgtcggacccgtcgagttggcgggaggtcgggaaacgaatgtcgtaggtgtccatcgcgacgacccgtgtgatgccagtggacaacggggttcctttcacacctgggctgcctgttcggcgttcggcttcgtctgcccgccgacgcggagcagtcccaaccctcagcacagatcgggtgattggcctgttgagcgagaacgatacggcgctcatgagaggcgaggcaagtagacatcggatgtttcttggtgcgggtgcactccggcatcgccgcccacccctcccgccggagtggaggaggccctacgacgacgggcgcccgccccttggggacgggcgcccgggccgtgcgcggccggccgcgcaccgggatcggaggggactcatttcacagcacgctgtcgagccaccggaccacgttggagatgtggatcgtcgcccatgcctccgccgtgcgcgcgtcgcgcgcggcgagggcgtccaggatcgcccggtgctcggacagggtcctcgccaccgccgtctcctcggtgatgccgcgccacaggcgggcccgcacggtggccccggagatgctgtcgagcaacgagcacagcagcgggatcccggaggcggaggcgatgcgccggtggaactccaggtcgctggccacgagttgttccagactcggtgcctcgccgagccggtcgaggagggcgccgagctcccggatctcctcctcgtcgatccgctccgccgccagggcggtcgccgcgggctccaggatggcccgcaccttcagtgcctggagcgcctgatcgtcctggtggaagtccagtacgaacgacaccgcttcgagcagcaggggcgggtcgaggctggagacgtacgtcccgtcgccctgccgtacgtcgaggatgttcagcagcgacagcgccttgaccgcctcccgcagggagttgcgcgacagtcccagctcggcggcgaggtcggcttccttgggcagacggtcgcccggacgtagcgcgccggagacgatcatctccttgatcttcccgatcgcctcgtcggtaacggccaaggcgtcctcctgtccacggcgaaatacatcggatgtgttctgtccgctgtcaccctacgccagggggaagaggacccgacccggctccgggaacgccaggcgccgcagcgtcgcggcctcgcgttccagaacggcgggatcgtcgcccgggacgaattccaggagggcctcccggggcacgggccggtcaccgagcagcctgaacacccggtcccacaggctgtctcgggcggcgaggggcagccggtggttgcccggccaccaggagaagacgtggaccgcgccgacacggtcggccaggacatcgagaccggccagcgcctcctcgtcgggagcgttctgcggcggctgccagtaggcccccactccctccacccccgcctcttccaggagccggaccgtggaggccgtcgagtcggtcagcgttccggcgtggaactccggggcgagttcgaggccgtggtcccgcgcgatcagcgccgcctcccgcagacccgcggtgatccgggaccgctcctcctccgtgacgtccgccgacccggaggtccccgcccagacacgtacccgcggcgcccggagcgcgaccgcgccgcgggcgacctccgcgaaccctggcagctcgtccgggaggcagtggaagtacgagccgtacgagcaggaggccaggccgtgcagctcggtcgcgtcccggaccgcccggagaacctctggctccccgggcggggcgtgcacgtccgccccccactcgatcacctccagaccctcttcggc

SEQ ID NO: 3731 - DNA, 1246 bp, Unknown
  Kingdom: Bacteria, Phylum: Actinobacteria, Class: Actinobacteria, Order: Streptomycetales, Family: Streptomycetaceae, Genus: Streptomyces
gcccaccacacctcaccggcccgaggcgagcgcccgtccgcacgactttccgggcccgacggacacgaaggccgggacggcggccgggtcgaccccgccggctgccggggccggcgcgagcggggaccgcggtccgagcggccccggccgtccacgaccgcggccacgagcgcgagcagaaccacggcgaccagcgccacccaccagaacgtgttcatcccccgaccgtaccggcggccgggacgggcgcgacgggacgcccggtgggcgcgcttccatcgaaccggtgacagagcaggtgagttcccccacaacggagggcagcggaggagcgacgcggagtttcgcgccttacgctcgacaaaccgcagaacccattccgcaggcaccgtacgaagcccgggcggaatcgcacgaaccctccccgttcccgcgtaccggaggttcacgctccatgaagctcaccgtcgtcggctgctccggctcgttcccctccacgggttcggcatgctcgagctacctcgtagaggccgacggcttccggctgctcctcgacatgggcaacggcgccctcggcgagctgcagcgccacgtcggtctctacgacctcgacgcgatcttcctcagccatctgcacgccgaccactgcatcgacatgtgcgcgtatttcgtcgtgcgctactaccgccacgacggcgcccgccccgtccctctcccggtctacgggcccgagggcaccgagcagcgtctgaccgtcgcccacggggacaccccctccgaccgggcgatgagcgaggtcttcgacttccacaccctcaagtcggggtccttcgagatcggtcccttctcggtccgtacggagaagctctgccaccccgtcgacaccttcggcatccgggtcgagcacggcggctccgtcctcgcctactccggcgacacgggggcctgcgaggcgctggaggacctggcccgggacgcggacctgttcctctgcgaggcgtcgttcgtcgacggcaaggaggacatccccgacctgcacctcaatggccgcgaggccggcgaggccgcggcccgcgccggagcgcgccgactcgtcctcacccacatcccgccgtggaccgacgccgaccgcaacgccgccgacgcccgtgcggtctacccgggcccggtggaactggccgccccgggtgcggtgtacgagctctgaacccgcgaccggcgggaaggccgaagcccccgctccccg

SEQ ID NO: 3732 - DNA, 1348 bp, Unknown
  Kingdom: Bacteria, Phylum: Actinobacteria, Class: Actinobacteria, Order: Streptomycetales, Family: Streptomycetaceae, Genus: Streptomyces
ggcccgccccctcccccgcgctctatgctgcgaggaggaccgagcccaccgaggaggccccgcgtggcgacagggcgcaccgaccccgaacggcgggaccgcatcatcgacgccgcgctggacctcatcgtcgacgagggtgtcgcgggcgtctcgcaccgcaaggtcgccgcccgcgcgggcgtgccgctcggctcgatgacgtaccacttctccggcatggacgagctgctgcacgaggcgttcacgcgtttctccggcacgatcgtcgccgtcttcgaggaacgcctcggcgccgcgaacacccccgacgaggcgcgcgaggccgtcgccgatctcgtccaccatctctccggcggcaatcagcgcgagctgatcctcacccacgagctctacaccctcgcggcgcgccggcccgcctaccgcgagctcacccgcacctggatgggacgcagccgccgcgccctggaatggcacttcgacccggccaccgcccgtcagctcgacgcgctcatcgagggtctgtcgatccaccgcgccctggagaccgagcctcacggtcgcgccctgacggtcgaggcgatcgcccggatcacggcatcgccccccacccggacacccgctccggcgggatcgtccaccaggtccggccgcacaccggaaccggggccacgtcggtccgcagccggctgacggccggtcccggcgcgcaggtcctggacgaggccacggacgcggtggcgaaatcgatgcggactacggcccgacccatcgacctacacttgcacctacaactacatttcgaccggactccccggagtggtcgatgcggcacaccaccactcccccagattattgcatagacatgtatcttgatattcatcgccgtcgagaaggggagccgttccgtgacgattcacaagcagccgcgcgccgcctccgaccagaccatgtgggaggccgtactcggcctgcacgccttcgtggagcgtcagctcgcgcacaccctgcaacgccgtttcggcgtcggcctctccgagtaccgcgccctggagaccctcacccaggccgagaacggcgaacgccgcatgcaggagctcgcggaccacatcggcctgagccagagctccgtaacccgcctggtggggcggctggaaagcgccggctacgcctacaaggacacctgcgccgacgacaagcgcggcgtcttcgccgtcatcaccgacgagggccgcaagcactaccaggacgcccgcgccacctacgccgacgtcctcagctcggctctcaacaccgcgagcgccgacgaccagctcgcccgcgcggtgcaggcgctgcgcagcgcctg

SEQ ID NO: 3733 - DNA, 5787 bp, Unknown
  Kingdom: Bacteria, Phylum: Actinobacteria, Class: Actinobacteria, Order: Streptomycetales, Family: Streptomycetaceae, Genus: Streptomyces
atgtcggcggaggtgatcgccgccgacctggggctggacctgtacacggtcgacctggcgacggtgatcgacaagtacgtgggtgagacggagaagaacctggagcggatcttcacggaggcggcgggagtgaacggcgtgctcctcttcgacgaggcggacgcgatcttcggcaaacgctcggacgtgaaggacgcgcacgaccgctacgccaacgtggagagcgcgtacctcctgcaacgcatggagtccttcgacggcctggccatcctcgccaccaacctccgcgccaacctggacgacgccttcacccgccgcctggacctggtcatcgacttcccggtcccggaccccgaacaacgcctcctcctctgggaccgctgcctgggcccgacactcccgcgcggcacggacctggacctgcccttctgcgccgagaacttcgagctggcgggcggcaacatccgctcgatcgcggtgacggcggcgtacctggcggcggacatggggggcgcagtgacgatggagacggtgatccacgcgatccagcgggagtaccagaagctgggccggctgacgctggcttcggagttcgggccgtatctggggctggtgcaggggtgagggccgggggccagtaagtggggcggccttgagggctgggatcagaccttgacgatgcgcacgcgatcgccgcagagcatggtcaggtcctcgggatcggaggtcaggatcacggccggcttcggagcgtggagcgcggtggcggcgaccacggagtcgatggcgtacttgtgcccgtgaaggccggcgttgacgagcagtgccatcgccgtacgcccgatctcctcggtgaccggctccacgttcagccgggacacggcccagttgaagcgggcggagttcactcgtgcgtggtgtgcctcgatgagggtgaggatgctggtcacgacccgcatgtcctcctgctctgccccacgcaccagggacatgacccggcggtcgtcggcgaccaccttcgacagcccttcgctgtccaggacgagggtgcccggccggttcatcaagccgcgctccccacgccgccgtcggcgtctccgcgcagcagggcacgggcggcgtcgatctccgcctggctgaactcaccgtgctccgcctcgtgggcggcggtcagctcggcgaggttgtcccgctcgatctgacgctgcacggcggcatccacatacgcagagaacccccgctttccgacgcgcgcgcggacggcggcgatgttgccggagtgcaggctgacggagacgttggcggtggggccttcgccgggtctgtaggtgagctcctcgttcatgagctcagtctaatacttcttctagcatatagggcgccgtgcataccggcgtgggcccctgcccctctcatcggggccttccgccccgcaggtctcggatttcggacccttcctggggccggtgcaagcgggcgaggggcggggtgtaggggaatccgagccttctcactcgtcgccggattgcccgggcgacggagagggctgtggttcgaaactctttgtgatgctcgccgccgaccctccgaggtcgatcatcctcgtgatgtcccggatggcagtcgctaccgcgtggcaattgcggttcttgaactcgacaacgagattgtcccaccctccgcagataagggacaatacgtacgatccattcaaatcaccgtgtgggtaccacccaagatcgatggtatagccgccggggacgggttcccagccgccttttcctgcgcgcatatgctccagggatagcagatcctgcccgaggtgggcatccctctctctttgtgttagtttctccggggcggaaatctcaaagaagcgattgaaggcgatcatccagcccgacggcaaacgcaaaggcataaggtctggcatgtgagattcctaatctctcttcgcgacgcgcggatgtgagtgaactgtcggtgtccctgatcccacgtttgtcatctctgcccgcaaccagaaggcttccgagtcttcgtcccaaccggtctggaagtcgaacttcttgtaagcgtggaacgttccgctctctcccctggttcgttctcctgtcagaagtgcctcgcgctccatctctttgatctgagcttcggagagcgcgcataggaattgtgcagcgccgccgttctcggtcttctttctgcgggcaacgtcatcctttccccgacagtgcttgccgccgctgtactctctaggtgccttgtgggtggatttttcaaccagccgctcccattcttctttctcctgcttcttcttttcctcttcggggtcaatgtcggcgcgatcgaacttctcagcataccattctatgctgtccttgtactcgcttagctctttcttcatttcgtgctcttttgctcctatctccatcaggtcgactacctcgcttgctgttcggattacctccgaaagtctttgggcctggtcgtggttcactattctggctgatcggacgactgccaaagtcgcctcggccttgctcttgatgtcctccggagtggaggccatcaggagtcgccgggacggtagcaggatcaaatggtgtgatcggccctgcatgaggaaggcgacacggatcggcttctgctgctgctcgccgtcgcgccccttcgacctatcgccagggttcttctttttatcggcagcgggtgcggtaccttcttttccatccttacccttgagcttgttccagagcgccttgcccttcttcgctatgaagtcgacgatcttgtcgatcgcccgcgtgaccggtcgtgacaccgactggaagaccgacttgaccttgttggccaggccgccgatgccgaggagtgcggcgaggaagccgatcaggagagggacgctcgatgcgagggcggcttcgatgagtttggggacgccggcctggccgccgttggcgatggcgatgaccgcgtccaggaccgcgttgacgaagtccgcgatctgggcgccctgcgtcacgatgaacgtgacgatgtcgatgattcccttgaccgctcggacgaacgcggaggcggggttgagcagggagatgatccaggtgatgcctgcgatgaggacggtggggatcaggtaggtcgtcagtttgctgaggatggtggccttgaggtcgcccgcctcggcctggatttccttgaccgcgccggcggggccttcggcggcgaggttcttcgcgaccgggacggaggtttcgaccgccgacatcgcttcgtcggggacgcctttgcgggtgacgcgggtgcggatgttgtcccaggtcaggccgagcatcgagccgatgagctggatgattcccttgaggtcgaatttcgccgggaggtccaagccggctttgacggccgtgcccaggagccaggagacgacgccggtcttgaggtggtcggcgatgttcgtgatgaagaggttcaggcccgcgccgaccgctttcacgaggttgccgaggaacccgatcgggtccttgatgatcttcatgatcgcggaggcggccttggcgaggatgcccaggagcaggttcttcagctcgttgatcgtcttgatggcgccgacgatggcgtccttcgccttgtcgatgaggcccttgttggcttcctggagtttcttgatctcctcgtcgatcttgttgagcgccgccgtgtatttctgggccaggtcctggaccagttgttccgacttctcgttgacggtggcttccaggtcgtcgaacttgcctgcgaaatccttcgccgcttcctcgccgaactgcttcaggtcggcggggagtttgtctacctccgccttcaactccgtgcggcccttggcgatgcgggccttcgctgtgccgagttcggcgccgatgatgtcggccacctgggagatgaccgtctgcatcttcgagacgtagagcttgcgggactcctggtagaggtcgttcgccgctttcggcaggccggcgaacttgtccttgatccagcggcccttgcccatgaggcccgagtaccgcttgtccttgtacttcttcatccggctcttgtggtcggccgtgaacgcgtcccgcgccgacttctcgcccgacgtgaacgccgagtcgaccttcttgtccaggccggacagggtgtcctcgacgtccttcttcgtgccgtcgtagaccttctggagttttgccgtgacctcggcgcgcttcttctcgtccttcgacttcgtgtcgttcttcccgccgtcgacctgtttgccggcggcggcccgggtggaggtgaggcccgccatcgcctgggcgccggaggccgcggcgttctccttggcggtggagagctgctggtcctccgccgccttccccttcgcgggggccttcgccgcgtccgcctcggaggtcttcttcgccgacagggcctccttgaactccagttcgttgcccttggcgagctgttcctcggtgacctcggcgtccgccatggtcttgtcgttctcggcgggtccttcggagaagtccgtgacggccgcgggctgtttctcggggaccgcgtccgtcgcggagggtgcacccgggttgcccggggcctggtccggggtgagcggggtgacgtccttgtccttggcggccgaggtgtcgggtggggccttcgtcgccgtgtcgatgtccttggccgaggactccttgccgtcggtgaccttgccgtcgacctcggccttgacctggtcggccttgccggacttggcgaacttgtccgcctcgtcgaggttcttgggggcctgggagtcgatcgccttgttcaccgcgtcgatgaacgccttcttgtcgaactccccgggcttcgccgcgttcatcttctcggcgttcgccgccttgccctgcgcctccttgtcgtccggcggagccaccgccgcgtcctgcgacgccttcgactccgccgcggccggggcatgggccgcgagccgggtcttcttccccgccacatccgccttcatggagcggaagcgcgccgactgtgccggcggcgtcttcaccggcgcggtgtagcgctgggcgaccagccgcgacaccgccccgttccccgccatgcgctgcagtcgctggatggagcggcggtcggggggtgaaggggccggttggggagccgtgtccgttcggggtgcgccggtgcgcgaggtctcggaaggcttctccggaaccgccttcatccgccgccctcccgccctgctgcccctcccgcttccgccggccaggaggccgcccggacgtggtgcatgcgtggtggccgccagcgtgccggggaatccggggacgtacgcagcacgggcggaccgcggacggggcacagccgggcggcacccgtggcgcggtcgcgttgcctcatcgggcagccctccctgcgcggcagggcggccgaccgtccgttcccggtgatcgccgcagtcacgagaatggcccgcgtcccacggtcgagcagtgcgtccaggagtgtgtcgaggagagggccttatgccgtcgtacctgtcccccggcgtctacgtcgaagaggtcgagtccggatcccggccgatcgaaggggtgggcacctcggtcgccgccttcgtcggcttcgcccagaagggcccgttcgacgagccgacgctgatcaccaactggagccagttcgtcgccacgttcggcgacttcgtcgacggcgcgtacctggcgtccgccgtctacggcttcttcgccaacggcggcggcgtctgctacgtcgtgcgggtcgacgacggcacgg

SEQ ID NO: 3734 - DNA, 3224 bp, Unknown
  Kingdom: Bacteria, Phylum: Actinobacteria, Class: Actinobacteria, Order: Streptomycetales, Family: Streptomycetaceae, Genus: Streptomyces
cacctgctcggtcgcgaggagccgcagcccggccgacccgaactcctcggtccgccgcacgttgagcgcctcggcccgtcgcaccagctccccggcctgcgccgagagccgccgccgcagcacctcgtaggcgcccgcgtccacatcgccctccccgccccgaggcgcggtgacggtggcggtgatgtcgctgtccatgcgtacggctccctacgtgtctcatcgtcttcagccggcccggcgttccccggcggtccggactgccctgccggtccggtgcttcccggtggcccgggctcccttgccggtccggggttcccggtggtccggcggtccccagccggtccgtcgcacaccctgccggtccgtcacacaccctgcggtccggcgctccccagcccgtccggcgttcgagggcggaaccctgggctcggtgggcccgcttcctggcgtgcggggcaggcccgagttccagcccgtccggcctcagacgccggacgggctgtggtgcgcgccggaccggcgggacgcgtgctacccgaccggcgcagcccccaccccgttccgggacaccaccccacccgcgggagcaaccttcgtaccgcgcgtcagcgacgacaccggcagatccgcgagacccagctccttcgccgccgccaacaactgctccacctggcccgccgccgcaccggacgaccccatcagccgcatcagcagcgccgacaccgtcaggttccgcacatcacccgtggagaacgagcccagcacccggctgatgtcgtccgtgaaggacgacgaaccgtccagccacggcccggccagtgcctgcgcggtcgccgagttgtcgacgaacccgtcgacggccttgccgagcgagatcgacgagacgatccggtcgaagaacatggagtcgccgccgacgatgtcgatgtcggcgttctccagacccgtcgccaggaccgtcgcctgcgcctcggcgacttgccgctgcacttcgagaccggccagccggatctccttctccgcggcgagtcgcagccggtactcctcgtgcccgcgcgacgcctcgtccagtgccgccatcgcggcggccttctcggtgagccccgcggcctccgccttcagcttctcgccgatggccgccgcgtcggcggtggcctgggcctgcgtaccctccgccgcggcgagcgccttgagccgtgcaccctccgcctcggccttgagccgtgcctccatcgcctcggcctccgcgagaccggccttctcgatgacctcggcctccgcgtcccgcacctgtacggcggcgagcccgggagcggccgtctccgcctggatgccctcggcgagccgcagcttggcctgcgcgtcgaggtccgcggtcttgagccgggcctcggcgagcgtgagctgctcggccgccaggtgcgtggacgcggcctccgccgcctcggccgccttgatgtccttgaccagcttctcctgggcctccgcctcggccgcgatgatgaccgacctgcgggaccgctcggcgtcctcgacggcgcgcagggtgaggatcgactcctcctgctccgcgaccgtgcggtccaccgcgatccgctcccggatgacgtcggcgacctcgcggcgctcggcctcgacctccttcgtggcggcgatccggttcagctcggtctcgcgctcgcgcccgatgacctccagcatccggtccttctcgatgcgctcgctctcgacggcgatgacgcgctcgcggttcttctgcgcgacggcgatctcccgcgcctggttctcgcgctggatgccgagctgctcctcggtcttgatgaacgcgctctgtgaaccgagccgttcctcctcctggacccgggcggtggccgcctcctcgcgggcccgcagcacctcgacctcgcggcgctgcttgatctccgcctcggcctgccggcgctccagctccaggatcgtctcgcgggcgtcgacgtcctgccgggtgatctccttctgctcggtgcgctggaactcgttggtgcgcacgtgctcgatcgcggtcagctcggtgatcttccggatgccctgggcgtccaggatgttggccccgtcgagctgggccatcggggtctgctccaggaagtcgatcgcggcgtcgtcgaggtggtagccgttcaggtcggtgccgatgacctggatgatccggtcccggaactcctcgcgcttggtgtacaggtcgacgaagtcgagctgcttgccgacggtcttgagcgcctcggagaacttcgcggcgaagaactcctggatggcgaccttgtcgctggcccgccccgtgccgatggactgcgcgaccttgatgacgtcctcgacggtcttgttgacccggacgaagaacgtgatctgaatgtcggcgcggatgttgtcccggcagatcaggccctcgcgcccggcgcggtggatctcgatcgtcttcaccgagatgtccatcgtctcggccttgtggagcacgggcaggacgacggccccggtgaaggtgacgtcgaccttcttggtcttggagatgatcagcgccttgccctgctcgaccttgcggaacagccgggtgatgacgaaggcgatggcgatgacgatgagcaggacaacggcgatgagcacgccgatgcccaaggagatggcatccattgaagagtccttggcggcttgtcggtacggaagtggcacaggcgaggtaggggtggccggtcgtcacggagacggccggccggcggcggcggacgagtcgcacggacgggaccggcggggaggcctggaggccgaagccgcggagggctcgaagtccggtgtcctggtgtcccggccaggtcggccaggtcggccgggtcagccggtcgcccggcccggcagctcgtgcggtcgggtgttcggaccgggatcgagcgccgcgtcgtagggcgagacccagaagaactcgccgtcctcgtcgtacgcgtagagcagtccggttccgcccatgacgagcggcgcttcctcgacggccggcccggagagccgggaggcggacgggaacggtccggccgtgcggacctgcacgatggccgtcgatccgtcgtgcgacacgacctcggcctggccgaacgtcgcggtgacggagccggtgcggatcgtgcagacgctcccgacgaagtccagccgcgatggcggaggttccgccgggaaggaccggcggaagcggtggagga

SEQ ID NO: 3735 - DNA, 3029 bp, Unknown
  Kingdom: Bacteria, Phylum: Actinobacteria, Class: Actinobacteria, Order: Streptomycetales, Family: Streptomycetaceae, Genus: Streptomyces
  misc_feature (2756)..(2781): n is a, c, g, or t
tggccgggcagcgccacggcggcgtcctgccgctcggcggggctgatcggcagcagcttgcggcggtcccgcggggtgtgcgaggcgtggatgccgccgttgaggatggtctggagccggtcggagatgtcggcgtagtcgtcgaatccgaggacgccgtccgcctccggcagggcctcggcgaggtccttgccgtagcgctcggccatgcagccgacggcgacgacggcctgggtgcggccgtgatccttcagatcgttggcttcgagcagggcgtcgacggagtccttcttggcggcttcgacgaacccacaggtgttgacgactgcgacatccgcgtcggaggcatcctcgacgaggtcccagccgtccgctgccaagcggcctgcaagctcctccgagtccacctcgttacgggcgcagccaagagtgacaagggcgacggtacggcgttcgggcatgggctcaagactactttgtcccggcggcccccctgccgtgcagggttgccgactcctgccaccgccccttccccgctacggggagtaacagagtccgggccgggaaacgccgacgggcgcccggcacgaggccggacgcccgtcgggacgtgcgcggaaacggaggtgcggcggatcagccgacctcggggtcgcccttggtgtaggaaagccgttcgacctggcccggactgaagcggtcctcgacctgcttgccgttgacgaagagctcgatcgccccggcgtcgccgaggacgaggtcgatgcgctccttgtcctggaaggtcttggactcgccctggagcagcagcccgtcgaagagcagccgtccgttgtggtccttggccgagatccagctcttgccccggtccgcgctgagcttgaccgtcaccttgtcccggggggcggcggcgatggcgctctcggagggcacgggcttggggtcggagggcttggtggcggtgggcttggccgcggtcttgtcgggcttggagccctccgcgatctgcgcggtgttcgagggttcgtcctcgccgctgaagagcgtgaagccgacgaacccgatgacggccacgatggccgcgaccatggcggcggtccagttgggccgccgcggttcggagcggatgcgttccgcttcgaagagcggagccgcgggggtcggtgcgggacggccgccgtgatcggcgtcgtactcctcgaccagcggttccggatcgaggccgacggcacgggcgagcgtgcggatgtggccgcgggcgtagacgtcgccgccgcagcgggagaagtcgtcctgctcgatcgcgtgcacgatggggatgcgcacccgggtggagctgctgacttcctcgaccgtcagagctgcggcgatacgagcctgctgaagggcacgaccgatcgaaggccggtcatcttcgggggagttgccgatggacacgggggcgcctttcgagcgtgagccacctgctggatgttcagtctagggggggtacgaaagagaggggcaaccgggagggacgactttgtacgccatcgggttcgccggacggccccgccgccggctcctgggcggagcggggacggagcacagccccgatcgaggactggtcaacctgtagtgggccgaacggggtgggagtacgggtgaggtgacgacggagcgagctgcggggaggagcacggttccgtccctcccttcaactggacgtacgaccgtacgaaacggttgcccacaaaacctttacggagcggattccccgcggatgacggccaacaccccgtcgagctcgtcgggtttcaccatgacgtcgcgcgccttggagccctcactgggtccgacgatgttgcgggactccatcaggtccatcagccggcccgccttggcgaagccgacccggagcttgcgctggagcatcgaggtcgaaccgaactgggtggagacgaccagttcggcggcctggcagagcaggtccaggtcgtcgccgatgtcctcgtcgatctccttcttctgtttcgttcccaccacgacgtcgtcccggaagaccggggccatctggtccttgcagtgctggacgacggcggcgacctcgtcctcggtgacgaatgctccctgcatacgggtgggtttgttggcgcccatcgggaggaagagcccgtcgcccttgccgatgagcttctcggcgccgggctggtcgaggatgacccggctgtcggcgagcgaggaggtggcgaaggcgagccgggagggcacgttggccttgatcaggccggtcaccacgtcgaccgagggccgttgggtggcgagcaccaggtggatgccggccgcgcgggccagctgggtgatgcggacgatcgagtcctcgacatcgcgcggggccaccatcatcaggtcggccagctcgtcgacgatcaccagcaggtacgggtacggggacagctcccgctcgctgccctcgggcgccttgcacttgccgttgcgcaccgcgtggttgaagtcgtcgatgtgccggtagccgaagttggcgaggtcgtcgtagcgcaggtccatctcccgcacgacccactggagcgcctcggcggccttcttggggttggtgatgatcggggtgatgaggtgggggatgccctcgtacgcggtcagctcgacgcgcttggggtcgacgaggaccatccgcacgtcgtccggcgtggcccgcaccatgatcgaggtgatcaggcagttgatacaggaggacttgccggaaccggtggcgccgnnnnnnnnnnnnnnnnnnnnnnnnnnatcttctcgaccttcacggcggggccgagctcgatctcgtagcgggtgacggtcgggccccgggtgaacccggtgaccgcggcgtcgaccttgaactcggagaagacgttggtcagcgaggcgacgaccacgtcgttggcggcgctgcgggtcttgcccggtccgccgcgctccagcaggtcgagcgagggcagcgagtacgtgatgtcgccggacagctggagttgctcggcgcgggccggcaggcc

SEQ ID NO: 3736 - DNA, 2268 bp, Unknown
  Kingdom: Bacteria, Phylum: Actinobacteria, Class: Actinobacteria, Order: Streptomycetales, Family: Streptomycetaceae, Genus: Streptomyces
ccgcggggccgtgcccgcagcagcagtgctcgcgggtacggccccgcggccgtgtccggctcggttcccgtcccgccgcccggcagtgcttgaatgcccacgtgagcgactacgacgtaccccggggcatcgacgtcctgcgggtgttctgcggacccgacggccggcacggcaacgccctcggcgtcgtacgcgacggacgcagccaccccgacgaggcctcccggcaactgctcgcccggcggctcggcttcagcgagaccgtgttcgtcgacgacccggagcgcgggagggtggacatccacaccccgggggtccggctgccgttcgccggacacccgctggtgggcaccgcctggctgctggacctggaggtcctggaactggcggtcggggacgtgttcgcgcgccaggacggggagttcacctggatcaccgcccgccccgagtgggtcccgccgcgcaccctccagcagtacgcgagcgccgccgaggtcgaggcgctgccgggcccgccgcccggcgaggggtggctctacgcctgggcctgggaggacgaggcggccgggcgggtgcgtgcgcgggccttccctcggcgcggggaggaaggcgggatcgtcgaggacgaggcgacgggtgcggcggccctgctgctcagcgcgcggctcggccgggccctgaacatcacacaaggacgcggctcccagatcctcaccgcacccgcgccggacggcacggtggaggtcgggggccgcgtcctgatggccgtccggggctgaccccggacggtccgtccgcgtgtcctgggctactggatcgcggcgccgaacgccttgccgacggccgggaggccgtccttgcccggctcatagctggtcacgggcgcgaccgcgccgccggtgacgttggaccacggcatcaggtgcgcggcgccacgggcgccgggaccgttgggcgtgccgatgtacaggtgcgtggcggtggcggtgatgctggtgccgagcagttcacccgcgccgggaacgcccggcagaccggccgcgctgcccgggacgatccagcggtcggtgaggccgggagcgccgagcagcgtgaacgtctggacggcgccggagtccacggccgtgccctcgttctcccccgggataccgacggccagcagcatggacgtggccgaaccgaccttccggggggaggcgttgacgacggtgacctgctcgccgaaccggtcgcccgcctcggccgccccggtgacgtcggccttctcctgctggatgtcctggagttcgctgaccgcaccgcccgcggtgacgcgcagggtgaccacgcggcccgcggtcgtcttgtcgacaccctcgacctcgatgccctcgcccggcgaaccgacggcgatgatcgagtcgccgtccgtggcggcgcccgcgggccggtaggaggccatggacagcgccttgccgaagaggtcacccgcctcggaccccccgctgatgccgtcggtgtcctggtggagcgacttcaccggcgtcgggaccttgttggcgttcaggtcgtgcttgaggatctgcatgccaccggtgtccgcgacggttccgatggcctcgttcgggatgccgatcgcgaggtggttgggcgaacccgcgacggagtagccgaactggtcgccggcctccgcctcgccgccgatgtcgtccttgccctggttgaccgagacgctggtggtgccccgtacgtagaacgcgttgcccgcgtccgtgatgggttccaggtcctcgccgggcgcaccgatcaggatgtacgggtcaccggcggcggtgttcccggcagcgagcgagaagcccaggtagtccttggcctcggaggccgaggtgacgaacgcgccggtcccggcgccctgctcgaacgtcgttccgccgcggcccttgcccaggcccgcgggggagccgtacacgacctggaccaggcccgcgtcggcgatgtcgccgatgtcctcgttgggcgtgccgaccaccaggtcggtatagccgtcggcgttgaagtcgaccggagccagcgcggtgccgaagccgtccttggcctccggcccgccgccgacgcccggtccgccctggatcacctcggacggggcgaccccgttgccgtacacgacgcggaccagaccggcctcggcggcggcgcccaccgtcgccttcgggtcggcgacggcgacgtcgcggtggccgtcgccgttgtagtcgacgaactccggcgcggtcacggtctccgtgaccc

SEQ ID NO: 3737 - DNA, 1704 bp, Unknown
  Kingdom: Bacteria, Phylum: Actinobacteria, Class: Actinobacteria, Order: Streptomycetales, Family: Streptomycetaceae, Genus: Streptomyces
  misc_feature (1119)..(1129): n is a, c, g, or t
ccggcgtcgttgccgagccagaagccgagggtggcgagggcgagggcgatgacgatggggacgaagacggcggagatgcggtcggcgaggcgttgtgcggaggctttgccgttctgggcgtcctcgacgaggcgggccatgcgggcgagttgggtgtcggcgccgatgcgggtggcttcgacgacgaggcggcctccggcgttgatggtggctccggtgacggtgtcgccgacggtgacctcgacggggacggactcgccggtgagcatcgaggcgtccacggcggacgcgccctcgaccacggtcccgtccgtcgcgatcttctccccgggacggaccaggaaacggtccccgacctgcagcgcggcggtcgggatcgtcgtctcgacgccgtcgcgcaggaccgtgacctccttcgcacccagctccatcagagccttcagcgccgcaccggccttccgcttcgagcgtgcctcgaagtagcgcccggcgaggatgaacgccgtcactccggccgcggcctccaggtagatgttcgcggcgccgtcgctgcgggcgatggtcagctcgaaggggtgcgtcatcccgaccatgcccgcggtcccgaagaacagggcccacaacgaccacaggaacgcggccgacgtgccgacggagatcagtgtgtccatcgtcgccgcgccgtgcttcgcgttggtccaggccgcacggtggaacggccaggcggcgtacacgacgaccggtgcggtcagcgtcagggagagccactgccagtagtcgaactggagagccgggaccatcgccatcgcgatcaccggtacggcgaggagaacggcggtgatcagacgctggcgcagggaggtgagtccgtcgtcctcgctctcggcggccgcgcccgccgtgtccgtatcgttgctcccgggggaggcggtggatgcgggcggcgcgggtggccgggcggtgtagccggtggcctcgacggtcgcgatcaggtcctcgacggacacgtcggcgcccaggtaggtgaccttcgccttctcggtggcgtagttcaccgtggcctcgacgccgtccatccggttgagcttcttctcgatacgggccgcgcacgaggcgcannnnnnnnnnntcttgatacccctagggggtatctctatctctccccatgtataccccccgcccctatgaagtgcaaggtccgaccgcgatgaatgcgcctgttacgcgccggtgtgcgcgaggtgcgcgtcactcgtctgcggggtcggctcgcgcgccgtcgggctggtgcgttcagatagagggctgcgccgccggtctaccgacccgtaggctggccattggactagacctatagctgtgtatcggaggaatggggacccatgagcaaccgtgcagtcctggaggtgatcgctctcgacgcggaggacgcggtcgctgcccaggccggtggtgcagaccgcctcgaactggtcaccgacatggccgccgacggtctgacaccgtcacgggagaccttcacggcgatcaggtccgccgtggacctcccgctgcgcgtgatgctcagggtggcggacggcttcgccgccggtgacatcgacgtactggtcggcaaggcccgcgagatgcgggaggcgggggccgacgagttcgtgttcggcttcctcgacgcggagggccacgccgacctcgtcgccgtcgagc

SEQ ID NO: 3738 - DNA, 4233 bp, Unknown
  Kingdom: Bacteria, Phylum: Actinobacteria, Class: Actinobacteria, Order: Streptomycetales, Family: Streptomycetaceae, Genus: Streptomyces
gtggggaaccgatgaaaaacgccccgaattgggcaaagctgccaccggacagcgtcgtttcaccaggaggacccgtgccgcccacgacacccccagcagctgacacctcggcaccagctgacaacaccgcccggagggcacgcgaggagatggaagtcaaaccgccggaagcacgcgtcgtccgttcgggccagccgaggatcatgggcaacgtgccgcccaagaaccccaacttcaccggccgcgagtcccttctcgcggccgtggagcggcagctgaccgaggacgagacgacggcggtcctcccgcacgcgctgcacggcctcggcggcgtgggcaaatcacagatcgcggtggagtacgtctaccgccacagcggcgagtacaacgtcatctggtggatccccgccgagcaggagagcctgatcctggccgcgctcgccgagctggcggccggcctcggcctggaggtcgggccgcaggcgaacaccgccgtccccgccgtccgggaggccctgcgcaccggcaagcccttcgacaactggctgctggtcttcgacaacgccgaggacatcgagtcggttcgctcgtacttccccaacggtggcccggggaagatcatcgtcacctcgcgcaaccgggagtgggaacgggtcgccacccccctcagcgtcgacgtcttcgaccgtgaggagagcatcgccctgctccagcgccgggcccggggactgagcacccatgacgctggccggctcgccgaggcgctcggcgatctgccgctggccgtcgaacaggccggcgcctggcacgcggccaccggcatgccggtcgacgagtacctccaactgctggacgaacgccgccccgagatcctcgaactggccccgtccccggactaccccctgcccgtcgccgcggtctgggacatctcgctcggccggctgtccgccgagaacccggccgcccgccaactgctccagatctgcgcctgcatggcgcccgagcccatcccgctgagcatgctccgcggcggccgcaacgtccagatcaccccggagctggatcgtgtgctgcgcgacccgctgctgctcgcccgcgccacccgcgacctgagcaagctctcgctggtgcgcctcgaccacaaggccggcacgctccagatgcaccggctgatgcagaacgtgatcgtcgcccggctggatccggaggagcgggagacgatgcgcaacgccgcccatctgctcctgaccaccgccaaacccgggctgcccgcctcaccggaacagtggcccgcctacctcggactgctgccccacgtgatcgcctcggacgcggtcgacagctccgacggctgggtgcgcgacctggtgttcgacatggtcaccttcctctactactggggtgcccacgaggcgggcgcggacctgtcccggcgggcgtgggaggcctggagcgagcagtcggccgatgaggacctgcatgtcatccggatcaccaagatgctcggcttctacctccagcagctcggccggatcccggaggcggcggcactgtgcgagcaggccatggaggtctcgcgcagcgcgccgatcccggaggaggagctcatcgactccatgctccagatggccagttcgctgcgctaccggggcgacttcgacgccgcccgcgagctgagcgccgaggccttcgagcggtcgagcgacctctacggcccggaggacccgacaaccctgaacgcggcccacagctacggcgtctcgctgcgggtctacggcgacttccgacgggcgaaggagatcgacgaagagaccgccaggcaacgccagttgctctacggtccgacgagcggcctcaccctgaacaccctgagcgccctggcggcggacacccgcgaggcgggcgacttcccccgggccaggaccctgcaggagtcgacgtaccagacctaccggacgcacttcggccccaccaacgcggcgacgatccgggccgcgctgaatctcgcgatctgccgacgccgggccggattcctggagggggcggccgagctggtcgaggatgtcctggagcgcttcaccacccggtacggcgcggagtaccccgagaccctgggggccgccctggcggcggtcgtcgaccgcaggatcgcgggcaggctggaggactcccggcgcctgggccggcagatcctcgaccgctaccgggagatcttcggcgagcaccacccgtacaccctgtgcgccatggtcaacgtggccgccaccctgcgggccatgggcgaggtggaggaggccgagcggctggacacggtcgcggggacacggctccgggcggacctgggtgagcggcacgtctacgcgctggccgccgcgctgggccgggccaacgaccactacgcccggctggacttcgccggcgccctggaggtggacagtgccacgctgccgctgctcaccgaagtggcgggcgaggaccatcccttcactctcgtctgcgtggcgaacctctccctggaccagcgcggactcggccgcccggcggaggcggaccggctcaacgcccaggcggtggagggtctgacgcgagtcctgggggaccagcatccgtggcggacctcggcccggctgcaccagcgcatcgagtacgacgtgacggtgattccgttgtgaggcgacgggccgggccgggtctccgacgcccggtccggacggaccacgggacccggccctgaccggcgggccgggagaacactgacgggggcgacgcatgaccacggtcatattcatccacggcacgggcgtgcgaccaccgcacgccgagaccctgtacgcacgggtcacggcctcgctcgccgaggccgccccgggcgcgcgggtcgtgccgctcgactggggcgagcggtacggtgcccagctcgccgcgggcggggcgagcatcccgaacgaggggtccggagccaccgaacgggacgcggagcgcgaggaggacgacgggaccgctgcctgggagcgcctctaccgcgacccggaggcggagctggccctcgccgccgcgcgcggctcctcgggcgagataccgccggggaccgccttcctcgacgaggagttccgggagcggctggcggagctggccgccggcgccgcttccgtccacgatccggaggactggaccgatgtgtacggaggcggggtcgtcgccgatctggagcggcgggtggccgggctgctggggatggaggaggcggcgttcttcccgaccgggacgatggcccagcagatcgcgctgcggtgctgggcggggcgtacgggcgacgcgacggtggcgctgcaccccctgtcccatccggagctgcacgagggcggggcactgggcgcggtgagcgggctgcgcacggtgcatccgacgtccgggccgaggctgccgagcgccgaggaggtccgggagttccccgaaccgttcggcacgctgatgctggagctgccgctgcgggacgccgggttcgtgctgccgtcctgggaggagctgacggcggtggtggaggcggccagggagcgggacgcggtggtgcacttcgacggggcgcggctgtgggagtgcggcccgcacttcgggcgggagctgtcggagatcgccgccctcgcggacagcgtgtacgtgtcgttctacaagtccctggacgggctgtcgggcgcggtgctggcgggcccctcgacgctggtggaggaggcccgggtgtggcgccaccggtacgggggccagctcttccagcagtacccggcggcgctctccgcgctgctgggcctggagcgggagctgccgaggctgccggactacgtggcgcacgcgaaggtggtggccggggcgctggcggaggggttcgcggcgtcgggggtgccgtggttccgggtgcatccggagccgccgcacacgcatcagttccaggtctggctgccgtacggggccgaggtcctcgacgaggcgtcggtccgacaggccgaggagacgggcgtgacgctgttccggcgctggttcgcgggtgcggccgggacggggctgccgcccggggtgtcgttcaccgaggtgacggtggcgggggcgggtctcgagtggtcggccgaggacgtgcgggatgcggtggcggggttcgtggggtatctgacgcaggagcttcgctgaccggccggcccccggtcccgggggccttgtcgagtggggccgggcccgcgggac

SEQ ID NO: 3739 - DNA, 3673 bp, Unknown
  Kingdom: Bacteria, Phylum: Actinobacteria, Class: Actinobacteria, Order: Streptomycetales, Family: Streptomycetaceae, Genus: Streptomyces
ccctggcagatcgtcggcgcgctgactctcgcctccctgccgctcttcgacgggcacagcgccgccacgctctgggcgtccgccgtcgccgaggcccgcgccgagcagggccaggccgccggatacgcgctcgccctcacacccctggccatcgccgtgatccggatcatccagggcggcggcaccctccgccgcctcctgctcctcgcgatcagcctcgtcggcctcatgggcgccatcgacctctacgaccccatcacctggatcaccggagtagacccgtcatgaccaccgccaccacgggcgccagcctcgccgcctgcgccatcgccatcacgttcatggccatctacctgcggaaatggtgggtcggcggacgcgccctgaaagacctcgcgcccatggtccagggctttgtctgcggaggactggccaccatctgcttcggcggcctcgccggatggctcgccggatgcgcccgccaagccgtcggcagcatcggcggcaaagcagtcagcggcaccaccggcaccccgtccggagacaccctcgccgccggctccctcggccgcctcagcgaagagggcggagtggtcgtgttcttcctcttcgtgctcctcgtcgtcatctacaaggccgcgccgaaggacgacaaggcccgcctgatcagcttcttcgtcgccggagcagtcctctgcgtcaccgccggagtcgccgggatgctcgacgggctgcccgacctcatcaactcgctgggcctgtccgggcggaacgccctggaaaggaacgtctgatgtccgagccgaccgccatgcagcgccacgcccgcactctcaccctcgggcagcgcctcctcctccgccgcctgggcgaccgcgccgccgcctgggtccgtgccggccgccgggacgacctcgacggtgtggccgcggtcctcggctgcgtcgtgcgcctggccgtcctcgccgccggggcgtacggggcgtggctcctgatccgccgctggcccgccatcctgtgggtcgccgtgcccgtgtggtgctgggccgcgatccgcgccatccccacggaggccaccgaggccccggcggagaagcagccgatggccgaggacaccacggcccagcgcgagcagctcctcgacctcatccgaaccctcaccggcgaccgccccggcgtccacctctcgaccctcctcgaccacctccagaagcacgggcaggccgagggttgggaggtcggcgatctgaaggaccggctgaccgctctccaggtgcccgtacggaagagcgtgaaggtggcccgccgcgtggcgtacggagtgcaccgcgacgacctcccgcagccctccccggccgaggtcacgcaggacgccgcgtaggcgtctaccactcccgtctacctgcggatctaccaccgcgactacctcgatctaccaccctggctaccacccggctaccccctccaggagggaccgcatgcagcccttgaccgacgtcgtaccccgcctgcgccacgcccgtgcggacgccctcgcgcaggccgccgccgcactcttcgcgcgcgccagcgccatctacgaggccaccgacgcagacgccccacaggcgaaccgcgagcggcgcgcagctcaccggctggccgcacgcgcggagcgcctcgccgcccggtcgtatcggtggaggcccgcgcccgtcacggagaactgacggctgcccgatccgcccgagtgagacgggcggtgaggggagccggacagcctggctccacgaagaaggagaagtcatgagcactgagcacgacgaggccgagtacgaaccggaggcgacgatccacgacgccatgaccgacacacagatccgggagtacgaccaggccgtcgaggaccgcctcgacgccgaggaaggcatcgagcactaaccctcacccggtgcgcccggcagctggcaggcgggcgggcgcaccggcccatcgcagagacaggacgcacagcatggcactgcccaagagcatcagcaccggcgacctcgccaagaagaacgccgagagccaggccgcccgcgcgcaggagaagcgcggaagcacccccaacccccagcagaagcagggacgatgacgactatgaccatcaccaccggcctcgccacccgcgagggaaccgcccaggacaacgcagactcaggccgggtgtacgtcctcgccgacggcaccgtgggcgccgccgtcatcgacggcgtcggccacggcccgcacacctcccgtaccgcgccgctcctcgccgagaccgccgcccgcatcgccgcccggcgcggcccgctcggcggcctcctcgccgcctccgagctcatcgccgaccgtggtgccgacggggaggaggccgacgcggtcgccgtcgccgtacgggtccgccccgacgacgacctcgccgtcatcaactggactggcgacgcccgcgcgtatgggtgggatggtgagcggctggagctgtacaccgacgaccacaccgtcggaaagcagctccgcgcgaacggagtcgccctggacatcgcccgggagcacgacaactggctgcgcacgtcgctcgcccgcgcgacgatcggcaccgtctacaccgccagcacccgcgaccaggttgtcatcctcacctcggacggcgtccacgaccagatgtccgccgacgccctggaggacctcgtgcgcgagcaccagggggacccgcaggccctcgccgacgccttggtcgccgccgcccagcccgacgcagatggataccgcgacgacgcgaccgccgtagccatccgcgtcagcgcgtgacagctccgcccctgcacgccgggtagcgcccggccagacgcccccgccggcccgtaccggcgggggcgtcgccatgcccagcgttcagatgctgttgaggatctgcgtacgacggtcctggtactccgcgtccgtgatcgccccggcagcacgcagctggtccagcgtcgccagccgactcccgacatcctgctgcgccccggccgccgacaccggcaccgctgcgggcgcggccccggcggcgatgtgcgaccgcagcttgtcggcgagagcctttccgtccgccttcgggatcgacttgatctccgccttgttgcccgaggtgaacacgctcagcgccccggacagcatcccgcccgaccactgcaccgagctgatcttgctgtaggggaagtcctctacctgctggctcagcaccccatgtttcaggaagatcagccgcatgctggtcatcgccagcagcccgttgcccttcccgtagatgcccgtggcgagcatttccacggtctcgccctcccacagcacctcgggcagccgctgaatctcccgtttcgagccgagcgtggaactcagtttctccgctgccgcgtcgatgtccggacgtacgttgaacgccatttccccatcccctcccacgttgtgagcggatcgtaccgacagcgcaacactcgccccacctactcccggaatcccacgctcaacaccccgccgctggacaagatccacgcctagcgcaacactgttgccaccaccacacgtgtgtcaccagcccctgaccatcaccggcaggggctttcgtacgcccgggcgaagggacgcaccgtggacatcgagcacctcaccgccgcccaggccgccg

SEQ ID NO: 3740 - DNA, 4509 bp, Unknown
  Kingdom: Bacteria, Phylum: Actinobacteria, Class: Actinobacteria, Order: Streptomycetales, Family: Streptomycetaceae, Genus: Streptomyces
cggtcgcgggctccggccggcacggcggccgcgggcgcgcgttccccgtcgccgctcctcgctccggcgccgaccccgtccccgtcacgcgccgcaccccgcggcgtcgtgggacgcgggtccgccgggggagccgcccgccgcagcgtcgcccggatcgcgtccagttcgcgcgccagctccgcggccggagggaaggcgtcgtcgcgctccagcagcacgcccggcggctcgacccgggagcgcagctcggccagcacctgaaggaccggagcggtcaccgggtgggcgtgcgtgtcgtgccagacgccgttcctctcgaccccgcccgccacatggacgtacgcgatggcctccaccggcagctcgtccagcgccttcgccgggtcctggccgaggttgacgtgattcgtgtgcagattggccacgtcgatcagcagccgtaccccggtccgctcgaccagctccgccaggaactgcccctcggtcagctcctcgcccggccaggtgatcagcgccgcgatgttctccagggcgagcggcaccggcagcgagtcctgcgcgatccgcacgttctcgcacagcacgtccaacgcgtcccaggtgcgcggcaccggcagcagatgccccgcctccagccccggcgacgcggtcagcggccccccggcccgtacgaacgcgatgtgctcggtcaccagtggcgtccccagcagctcggcgcgcgccgcgagggaggcgaggcgcacggggtcagggcggtcggcgccgccgagaccgagcgccaccccgtgcggcacgacccgcacaccgcgctcccggagccgtacgagggagtccgggagatggtcggcgcagaggttctccgcgacggcctcgacccagtcgatccccgccagcgcctccacctcgtccgcgatctccggccgccagccgatgccgatgcccagttccatgacgcccccgtccccctgctcacctcgttctgtcccggggtcatggccccgtcacgtggcgatgaacccgaccagggggacgttcagagctggatttgaggttcccgtaccgccgctcccgttatggcatcggcatcatcgtgggcggcaccgggcgcgaggtgaaggactggtcaccggtcggcgtcaccggcagcggaacctgcggcgcctgcccgtcctcgggcatcgacggacccgagggactggccgtcgacccgctcgccgcctcgcgcgccagggcgtcgaagtcgacgaagccggtggcctccagcatcgtgatgtggtccagcacggtttggttggcgtcgctcgcgagctgccggatcagcgtgttccgggtggtgtggcggacctggccgatcaggccgaagaccttgccgtgggcggcccgcaggatgttggcgaacttccgctcgtacgcgtccccgctcgccgccgtcagctcccgcagccacccctgctgctgggcggtcggctggttgggcagctccaccccgagcttcgccgccacgtcccgggcccgccggtccaggtccgcgtgcccgacgaccagatggtccccggcggccttcgtcgcctcgctgggggcccgttcgatcgcctgctgcccggcgggcagctcccacagtccggcgagccgcaccttgaccaggaagtcccggtccgtcgcggagagcggcccccactgggtggcgacgctggaggcgttgagattggcctcgccggtgcccgaacggtccgcgtaggaccagaccgggaacgcgagcgcgccgagcgtggcgaccagtgccgcgatgatgagggccgttccgttgatgcgtcgcaacaaggtgtctcccgggccgaggcgtgacagcgtcgaacaggcgtcaatcaaccgccaaccgactcgccgtgcaggctacttggcggtaatgccgatgcggcagtaccgggagatacgtagacggacgcagaaacgctcagccgcgcgggcggattccgatgccgcttccgctcagcggtgcagcgccgggtggtcggcgaccaccgtgcaggaccccggggcgatctcggtgaaccccgcgtcccgcaccaccggcagcccgctcaccgtcagctcccgccagcgctccgcaccgggggtggcgacggcgagcgggaacccggcctcgcgccacgccttgcgctcggtgtcggacagctcccaccaggcgagctgcgccccgtgccccgcttgcgccatcgtcttgcccgccgacatgtccagatcggggttcagccacagcaccggaccggagagatcgggcgcggcgggcggctcggggtcctccagatcggtgcccgacacctggagcttggccagctccttgggccagccgtccagcgggatcggcgggaacacccgtacctccgcgccgtcctcgcccgtcaccgtgatgccgtccagcgccgcggccttgcgccactccgcaccgcgcgcccggcgcacgaccttacggatccgggcgtcctgccagtcccgcatcgccccggcccactcgccgtccccgagggaccgctcgtcggagaggatcgtcagcaccgcacgggcggcggtccgcagcgcgtcggtgcgggcgggcgggtccgtcttctccaggtggagcaccagcggcagcacgaactgccgcgcctggtcgcggtcggtcggaccgtcgtggaacgggctctcggggacgggggcgggggtctcatcgctggtcaccgtcccagtctgccaggccgaactggtcacctgcttggcggaacgatcgggtccgggtgaggatgctccgcatgaagagcgatctcttttccagcgaccacatggcccagccggccaccgcccccggcatgaccctgcagaacaccaaatcgatcaagtacgccgtcaacggcgagatgcacgcccggcagggctcgatgatcgccttccgcggcaacctccagttcgagcgcaagggccagggcatcggcgggatgctcaagcgcgcggtcaccggcgagggcctggctctcatggctgtccggggccagggcgaggcgtggttcgcgcacgaggcggcgaactgcttcatcgtcgagctggaccagggcgacgccatcaccatcaacggccgcaacgtcctctgtttcgaccccacgctctcctacgagatcaagacggtgaagggcgccgggatggtcggcggcggcctgttcaacagcgtcttcacgggctacggcaagctcggcctgatgtgcgagggcaccccgatcgtgatccccgtgacggccgcccagccggtgtacgtggacacggacgcggtcgtcggctggagccagcagctcacgaccagcctgaaccgctcgcagagcgtcggctcgatggtccgcggcggatccggcgaggccgtccagctgatgctccagggcgagggcttcgtcatcgtgcgacccagcgaggccaggcccgagaagacctccaactgaccctgaacccaagggccgtgggtcaccggtacggcctccgcggcgcctgggtgccgcgcggggcagccggcggcggtcaagggcggcgccgcccttgaccgccgccggctgccttgtccgccggctcgccgcccggcgcgggtgagtaggctcgtggacgtggatacggacacggacgacacgtactgcgagaccccggggccgatcgcaccggccccgcccgccggagccgccgagggccctccgtacgccgagtgcgtgctgtgccgcgagccgaccgagtacccggagtcgacgaagggtgccacgctctgcccggtctgcgcctggcaggaggcgggccgcacggcctgttccggctaggaagaggcccaggagcggacacggcctagcgacggtcgtccatcagctccgacaccttcacgaagcggtacccgcgctcgcgcagttccggcacgatccggcgtacggccgcctcggtggccggggccgcgctgcgggtgcagtgcatcaccacgagggacccgggccgcaccccgtccagcacctgctcggccaccgcgtccgcgtccgtggcgaaggcatcgccgctgaccacgtcccactgcacggccgtcacgttcgccggggccagcgcgcgcagcgccgtgtcgtcgtaacagccgccggggaagcggaagtacggcaccacgttccgcgcccccgccttccggaacgccgagaaggcacgctccacctcctgggccatcgcggccttgccgaccaccggcaggccgtagcagggggagctgaaggcgtggtggctgtaggagtggttggcgatctcgaacatcgggtccgtgccgatggccttcgcctgcgccggatactcctcggcccagcgcccggtcatgaaaacggtggagggcaccttcagccggcgcagcagcgcgaccagttccgggttgtcgaaacgctcgccggaggctgcccgagcgccctgatcggccgtcatgtcggcgtcgaacgtcagcgccacgaccttctccgccggccggccggc

SEQ ID NO: 3741 - DNA, 4623 bp, Unknown
  Kingdom: Bacteria, Phylum: Actinobacteria, Class: Actinobacteria, Order: Streptomycetales, Family: Streptomycetaceae, Genus: Streptomyces
cagcgcctcgtcgcgggcccgctcggccaccaggtcgccgagcgggacgttcgccgcttcgcacaggcgcagggcctccaggcccgtgttggcggtggcgatgcgggaagccagggtctcgtccgcgccaccccggcgggccaggtccgccaggaagggtttgtcgacctgggagcgggccgagtggaggtccaggtggcccgccgccagcttggagagtttggcgaagccgccgcagatcgtgaggcgggcgacggggtgacggcgtacgtatttcaggaccgcgcccgcgaagtcccccatgtccagcaacgcgatgtccggcaggccgtactccgacaccaccgtcttctccgacgtcgagcccgtacagcccgccacatgggccaggcccgcagcccgcgccacgtccacgccccggcggatcgagtcgatccacgccgagcaggagtacgggaccaccacccccgtcgtgcccaggatcgacaggccgcccaggattcccaggcggccgttccacgtcgagcgggcgatctcctcgccgtggtcgaccgagaccgtgatctccacgtcccccgtcccgccgtgctccgccgccacccgctccacgtgctcgcgcatcagccggcgcggcaccgggttcaccgcgggctcaccgacgtccagcggcaggccggggagggtgaccgtgcccacgccggggccggcccggaacaccacgccggagcccggcggcagtctccgtacggtcgaccggaccagtgccccgtgcgtgacgtccgggtcgtcgcccgcgtccttcaccactccggccatcgccaccgccccacccggcccggccgtcagctcctccagcgccagcgcgaacgccggtctctggcccttcggcagcgtgatggtcaccggatccgggaagtcgccggtcagcagcgccgtgtacgcggccgtcgtcgccgccgtcgcacaggcaccggtcgtccagccggggcgcaggccggtgtgtttgagttgggcactgcgaccgccccgcgcctcagcgttcatgagaagagtccgttccgatgcctgtacagcctgtgcgtgttcttgtcctggggggtacgaccgaggcgcgccgactggccgagcacctggtcgcccatcacccgggggtccgggtcaccacctcgctcgccgggcgcgtctccgctccccggctgccgcccggtgacgtgcgcgtcggcgggttcgggggacccgacgggctcgccgcctgggtgcgtgagcacggtgtggacgccctcgtcgatgccactcaccccttcgccgcgaccatgagccggaacgcggccgaggccgccgtgcaggcccatgttcctctcctcgccctccgccggcccggctgggtcgcccaggacggcgaccgctggcacaccgccggatcgctcgccgaggccgccgggctgctgcccgcgctgggggagcgggtcttcctcaccaccgggcggatggggctcgccgccttcgcgggagcgggactcgacgatctgtggttcctcgtgcggtccgtcgatgctcccgagccgccctgcccggcccgcatggaggtactgctcgaccggggcccgttcgacctccagggcgagcgggaactgctccgccgccatcgcgtcgatgtgctcgtcaccaaggacagcggtggggacgccaccgcccccaagctcgccgccgcccgtgaggccgggatccccgtggtcgtcgtgcggcggccaccggtaccggaaggggtgccggtggcccgtacgcccgacgaggccgtggagtgggtgcgccggctctacgcctccgggtagcggcggggcgtccacacgatggatcggtcggcgtcggaaccggccctccgcacccaccgggtctgcgacgagcccacgatcagcagcgtccgcatgtccacctccgccgggtcgacgtcggccagccgcaccgtccgtacgctctccgtcgggccgcccacatcgcgcgccaacaccaccggggtgtccggggaacggtgctccaggagcaggtcgcgggccttgcccacctgccacgtacgggactgggagcccgggttgtacagcgccagcaccaggtccgccgaggccgccgcgcgcaggcgctccgcgatgacctcccacggcttgagccggtccgagagggagatcgtggcgtagtcgtggcccagcggcgcacccgcgcgggccgccgccgcgttggccgcggtgacgccgggcaggacccgtacggggatgtccgcgtactcctcctgcgaagccgcctccagcaccgccgtcgccatcgcgaagaccccggggtcgccgccggagaccaccgcgacgcggtggccccgccgggccaggtccagggcgaactcggcgcgctccgactccaccttgttgtccgagccgtgccgcgcctgacccggacggaccggcacccggtccaggtaggtcgtgtagccgaccacgtcgtcggcggcggcgagtgcgccgcgcgtctccggtgtcagccacagcgggccggccgggccggtgcccacgaccacgacctcgccgtcggcccttccggaggggcgcggcgcgtcgacgcggctcggcaggaccgcgaccgagaagtacgggacggacgccgggtcgatgtccgccaggtcgcccgtgcgctccccggccatcgtcgcccgctccacgtaccgcgcctccgcgagcctccccgacgcctcgaacgccccgcgcaccgccgggaacgtacgccccagcttcatcaccacggccgtgtccgtggcggcgagacgggccgtcagctcctcctccggcagcgtgccgggcaggatcgtgaggatctcctccccctcgacgaggggggtgccgagccgggccgccgccgcgctgacggacgtcacgcccgggacgacctcggtcgcgtaccggtcggccagacgcttgtgcatgtgcatgtacgagccgtagaacatcgggtcgccctcggcgagcaccgcgacggtcaggcccgcgtccagatgcgccgcgagacgggccgcggccttctcgtagaactcctccagcgcgccgcggtaaccgcccgggtggtccgtggtctccgtcgtgacggggtagaccagggcctcctcgatgtggtcgggccgcaggtgcgccgccgcgatggaccgggcgatcgagcggccgtgccgggcgctgtggtaggcgacgacgtcggcctcgccgatggcctggacggcccgcagggtcatcaggttcgggtcgccggggccgagcccgacaccgtagagccggccggcgccactcttgatcccgttcactggagaggtcactactcttcctcgctggcgatggcgttgagcgccgcggcggctatcgcgctgccgccgcgccggccgcgcacgatcaggtgctccaggcccgaagcgtgctcggccagggcctccttggactcggccgcgccgatgaagccgaccgggacgccgatgacggcggccgggcgcggagcgccctcctcgatcatctccagcaggcggaacagggcggtcggggcgttgccgaccgcgaccaccgccccctccatccggtcccgccacagctccagggccgccgcgctgcgcgtggtccccatcttcgcggccagctccggcacggacgggtcggacagcgtgcacaccacgtcgttgttcgcgggcagccgcttgcgggtgaccccgctggccaccatcgccacgtcgcagaggatcggcgcgccggagcgcagggccgcgcgggcgtcggccacggcgttcggtgagaaggcgaggtcgcgtacgaggtcgaccatgccgcaggcgtggatcatccggacggcgacctggctcacgtcggcgggcagcccggccagatccgcctccgcgcggatggtggcgaaggactggcggtagatcgccggtccgtccttctcgtactggtgcacagtgctgtcgctttcttctgccggtcgggggagggggagctgggggagcgtgctcaggcgcgggcctcggccaccgccgcggcgagtgccgccgggtcgttccggaccgccgtccgggggtcacggtgttcgccccgtacgtgcgagatccggtgcccgtcgggcgtgacgaccacgtcgatccactccccgtgggggtggccgcagcggcgttcgcacccggaccagtacacagggagccgtccgaccggtccgacggcggcccccgcttcggcccgcacgtcggacagcgacttcgcgcagccggggtggccgatacaggcgccgacgccggtccacggggagtccgggccggtgatcagaccggccgccgccagggtgtcgagcgcctctgccgcgcgccccgaccgcccggaccgcgcgggtgatccgggcggtccgaagaggccggggatgacgatcccgcgccagggggtcagccgcagctcgttcccgtaccgccgggccgtttcggtgagcagccgccactgggcgggagcgagccggcccagcggcacgccgacgctgatcgcggtcacggtcgtggtcgcggtcgggctggtgtccggtgcggtgaccgggccgggggccggggcctcagccgtacgggga

SEQ ID NO: 3742 - DNA, 3001 bp, Unknown
  Kingdom: Bacteria, Phylum: Actinobacteria, Class: Actinobacteria, Order: Streptomycetales, Family: Streptomycetaceae, Genus: Streptomyces
ggccgtcgtcaccgacgccgcggccaaaccgtcgcccacgccgccgccgtccgtcttcgagaacccctgaccggtctccggtccgacccggtctccggtccgacccggactacggttcgacgacctgcaccgtcggcggcgtcccgttccaggtgcagaacaccgagtacgtcttcccgctctccccgcccccgtcgctgaagtccacccggatccaggcgtcgttcgtccacacctgcatcgaccagcccggctcgggcgtggccgagacgagcttcgccgagcgcgcgccgagctcgaacaccacccggccgccgtcggtgcgatagctcttcacctcgcccgaggtcgacggcgcgggcggcttcgccggggtcgtcgacggcgtacgggaggggcgcggggccggcggcgaggggctcgttccgccggtgcgcggcgaggcggatggggagggggaggcccggtgggtcgacgagacgagcggcgccccggtgctctgcccgatgcgctgaggaggccccgaacccaccgagaccggcacggcccggggtgggtcgtaggccgtccccgtcatgaccgtgtgcacgccccaccacgtgagcgtgaccgccgcgccggtggcgagcgtccacgccagcgcgtgtacgagtcctcgttgcatcggcacatcctgcaccacccggcccgcccccgctctcccccggaggccgtgaacaaccgcccttctccggcctttgcggaggtttccgacgaggccgggaccgggcccgccggcatggcgtacggtgccgcccatggcaagtgtgctcgtggtcgaggacgaccagttcgtacgttccgccctcatccggcacctcagtgaggcctcccacacggtacggagcgtgggcaccgcgctcgaagcgctgcgcgaggtcgcgcacttccgcttcgacgtggtcatcctcgacctcgggctgcccgatctggacggcgccgaggcgctgaagatgctgcggtccatcaccgatgtgcccgtgatcatcgccaccgcccgggacgacgagagcgagatcgtccggctgctcaacgacggtgccgacgactacctgacgaagccgttctccgtcgagcacctctccgcccggatggcagccgtgctgcgccgctcgcgcgccgccggcagcgaggcgccgccccgggtcatccgcgtcggcgggctctccatcgacccgctgcgccgcagcgccgagctggacggagccgaactcgacctgacccggcgcgagttcgacctgctcaccttcctggccgggcgacccggcgtggtcgtcgcacgcaaggaactgctggccgaggtctggcagcagtcctacggcgacgaccagacgatcgacgtccatctgtcctggctgcgccgcaagctcggcgagaccgccgcccggccgcgctatctgcacacgctgcgcggcgtcggcgtgaagctccagcccccagccgacgcccccgccgctgtcccggccgaaacgccggtcacggagccgcccgcatgagatgggccctggtcaaggtctgtctggcggtcaccgccatggtcgtcatcgccttcgccgtgccgctcggactcgtcatccgggagatggccggcgaccgggcgttctccgacgccgaacgccaggccgcgatgatcgccccgacgctctccatcaccaccgaccgcgaggagctgacccgggccgtcctgtccaccgaaccgggcgaccggggacgcctcgccgtccatgtccccgccgagggcgggcctttggacatcggcacccggcgcgccacccccaaggacgtggccaccgtgcgcaaggccgggcgcgcctccatcaccgaggtcgccggcggcttcgcgctcctccagccgaccgcgctgggcaccggggacatcgccgtcgtcgaggtgttcgtccccgagggcgaggtctcccacggggtcgccaccgcctggctgatgctggcgggcgtcggcgtcgcgctgatcgtgggctcggtcgcggtcgccgaccggctcggcgtacggatggtgcagcccgcccagcgcctcgcgggcgccgcccaggacctgggggaggggcgcctgggcacccgggtcccggaggaggggcccaccgaactgcggtccgcggcggtcgcgttcaactccatggccgaccaggtcgtccagctcctggccaacgagcgcgagctggccgccgacctctcgcaccggctgcgcaccccgctcaccgtgctccggctgaacgccgcgtccctcggcgagggcccggcggccgagcagacccgggcggcggtccagcagttggagcacgaggtcgacacgatcatccgcaccgcccgcgagcagcgcccgcagccccagggcgggcagacgggggtgggctgcgacgcctccgaggtgatccgcgaacgcatggccttctggtcggcgctcgcggaggacgaggggcgcgaggtgcgcctcgcgggagtcgaccgtacggtgcgcatccccgtggcccgtcccgaactggccgccgccctggacgcgttgctcggcaacgtcttccgccacacccccgagggcaccgccttctccgtcgacgtccaccacagcggcgacgcggtcatcgtgctcgtctccgacgccggtccgggaatctccgacccgaaggccgccctcgcccggggtgccagcgggcgcgacgcggcgagcgggtccgtcggctccaccggcctcggcctcgacatcgtgcgccgggtcgccgagtccaccggcggcgacctgcgcatcggccgatccgtcctcggcggcacggaggtccggatctggatcggcctgtacggcagccgccccgagcgcggccggcgcggacacggccggcgggtcggccgcagcaccggctggccgcggcgcaaggagccacggaccacgaccggccccggggcccagcattaacccgcgccgatgggttccttaagcccgccctaagaa

SEQ ID NO: 3743 - DNA, 2604 bp, Unknown
  Kingdom: Bacteria, Phylum: Actinobacteria, Class: Actinobacteria, Order: Streptomycetales, Family: Streptomycetaceae, Genus: Streptomyces
cgccaccgcgtccgggtcgggcgcttcctcgaagttcacccggcccatgtggcggttcatcgacttcatcagtgcccacacgccgacggcgagcgccgcgaagacgaggaagccgaggacaccgggggtgaccttgttcttgtcgagctcttcggcggcgagcgggacgaggtgcgtcagtgcctgggtcgcgtacatatcaggcattgtcgcggatgcccgcgaagaggtcgctctcggggagggaggtatcgaccagagacttcgccagctcgtactcctcggtgggccagacctcgcgctggatgtccatcgggacgcggaaccagccgccctcggggtcgatctgcgtggcgtgcgcgatgagcgccttgtcgcggatctcgtagaactcgtcgcagggaacgtgcgtggtcagcgtgcgttccacgcgctcgaactcctcccagcgctccagccactcgccgtacggggactccaggccccgggcgaggagcgcctcgtgcagggcgacggtgcgcggccggttgaagccctggttgtagtagagcttccgcggcgtccagaccgggccgaactcgtcctccgggaaccgctccgcgtcggccgcaccgtcgaacgcgatcatcgagatcgtgtgcgtcatgatgtggtcggggtgcgggtacccgccgttctcgtcgtacgtggtgatgacctgcggccggaacgcgcggatcttcgccaccaggcgacccgcggcgacctccgggtcctccagggcgaagcagccctcgggcagcggcggcagcgggtcgccctcgggcagccccgagtcgacgaagccgagccactcctgctggacgcccaggatctcccgggcctcgtccatctccttcttgcgcacctcgtggatgttcttctcgatgtacgcgtcgccctggagcttcgggttgaggatggagccgcgctcgcctcccgtgcaggtcacgaccagcacgtccaccccctcggacacgtacttggccatggtggccgcgcccttgctcgactcgtcgtcggggtgggcgtgaacggccatcagtcgcagctgctcagtcaaagctcgatcctcagtcattggtcgctctggtcgatcatgggtcggtcaggtcggtcccggtcgctgtcggagccggtccgggtctctgtctcaagaggtgccgcacccgcgcggcaccggtgtggggcgcggtcgggcgccgggcgggcggcttctatagtgactgaacgaggggccggaaaattcctcgatgcccggtccggagggaacgatcatgacgacggttcgtgaggccctgcccgaggggcggtacggccggaccgaggatcagcgtgcggaccgcaagctgaagatcgtcggatcggtcctgggcgtcgccctgctcggcgtgatcgggtggatcggcttcgactacgtgggcggccagggcatcagcgccgagatgatcaagttcaaggtcgtctccgacgcgcgggccgatgtccacctggaagtccgcaaggaccgcgagggccacggctactgcctggtgcgggcgctcagcgaggacggctccgaggtgggccgcaaggaggtccgcttcgaccgggccgaggaccggatcgacgaggtcgtgaccgtggtgacccggtccagggcgaccgcggtcgagccgatgggctgcaccgccgacgacggcccgacgggctgatcccagccgcaccccctgtgacctgcgacgatacaggtcgcatcggccggccggggggtatgacggtttaccttctcccccttttcctgcggaattgttaggctcgtggtttcgcccacccgtggaagcacatgcttctgggtagggcgatgctttgtattcccagcaccgacgaggagcacctgtgacccagaccagcgaaaacgtcacctggctcacgcaggaggcgtacaaccagctcaaggccgagctggagtacctgtctggtcccgcgcgcacggagatcgccgtcaagatcgcggcggcccgtgaggagggtgacctccgggagaacggcgggtaccacgcggccaaggaggagcagggcaagatggagctgcgggtgcgccagctgacccagctcctggagcacgcgaaggtcggcgaggcgccggccgacgacggcgtggtcgagcccggcatggtcgtcacgatcgccttcgacggcgacgagagcgacacgctgaccttcctgctcgcctcccgcgaatacgccagcgcggacatcgagacgtactccccgcagtccccgctcggcctcggcgtgaacggcaagcgcacgggcgacgacgcggactacgagctgccgaacggcaagacggcctcggtgaggatcctggcggcgaagccctactccggctgatccggccggtcacgacggaacgaggcgggagccccggccacggacggccggggctcccgtgcgtcgtcgcccgtacccggggcgttcccgcggcccgggtcaggagcagtcgccgctgcggccgagggtcttctcgggcttcgctccgggacgggtccactgcggggtggggcggctggcagcgcccaagctcgcggtcccgtccgcgtc

SEQ ID NO: 3744 - DNA, 4625 bp, Unknown
  Kingdom: Bacteria, Phylum: Actinobacteria, Class: Actinobacteria, Order: Streptomycetales, Family: Streptomycetaceae, Genus: Streptomyces
caccggcaccggccgcacctgccgcccgcgctccgcccggaccatccccaccgtgagccgctgccgggcggaggcggcggggaggttgcgcagatacgcgtacccgcgcagccgcagcttcccgtccgcgccccaacgcgcctccagcagccgcgccaccgcggggatgtccgtacgcgtgagccgggcgctcgcgccgcgcacgccggggtacaccgctcgccgccgtcccggcatcccctcgaccacgaacgtgcccgctccgttggcccgttcgaaggcgaggaccgtcagcaactcctccaggcgccgctcccgcaccagcgtccacttgatgcgcagctccaccggcagtccctccagcgccccgggtcccgcccggtcgacgaaggccccggcgccctccaggaacgccgcccggtacgcctcgccgcccatcggcagaccgtccaggaagtacccgaagtcgtcgcgcaggcacgacgcgtcgtacgcccgccgctgtgccgcgtcccggccgcccaggaacgcgctgacctgctcgcacgcggcgatccggtcccgtacgcccgtgacgtccgtacgccgccgggtgatcgagccctcccgcacccgccagtagtagacgtgctcgtgcaggacgtcgacggacccggcgagatggtgcgcggggatcatcaccggagtgtcctcgtacagcttgcccaccgggaaggcgaaaccgtgcgcgtcccagaaggagcgccggaacaccttgttccacgccacccggtcggcgaggaggcgcgggtcccgggtgatgtgggtgcggggccgggtggccgtcagccagcggtactgccacgcctgctgccgtccctgagcggtcagccgccagacattgccggtcaccaggtcggaaccggtcgactccagcgaggccgtcatccgctcgtacgcgtcgtgcacgacgatgtcgtcgctgtcggcgaacgccagataggggacggtgggggtggtgtgccggacgccggtgttgcgggcggcgctcagcccggcgttccgctgccgcaccagccggaagcggtcgtcccgggcggcgaactccgccgcgatccgggcgctgccgtccgtcgaaccgtcgtcgaccatgaccacctcgatcgcttcgagggtctggtccgccaccgaccgcaggcagtcctccaggtaggcctcgacgttgtggacggggacgacgacgctgaggagtggtggcagtggtggcttcatgtcctggtcaacagggggcgggtcccggggtcaccggcgctgacccgaacgggtgaaaccggctcctcggccaccccggcccgcgattaggctcggctgccatgcccacccgagcttccgtgaagcggttcgtgcgtcgccaggccatgcgggccgcctaccgtaccgacctgcgccgcccgctcgacccggacctcgccgtgtacggggcgtactggaaccggggcgtcgcctgcaaccccgccgcgatccacgccaaggcccgcgaactggccccgcacatccggggcgtgtgggtcgtctcctcccggcaccgcgaccggatggagccgggcatgccgtacgtcatcgagggctcgcgctcctactggcgggccatggccaccgccggctacctggtcaacaactccagctttcccggcggtttcaccaagcggcccggtcagcgctatctccagacccaccacgggaccccgctcaagaccatgggtctggaccagcgcgcgtaccccgctctcgcccggaagaccgacttcgccaagatcctcgcccatgtcggccagtgggacttcagcctctccgccaacccgcacagcacggaggtctgggaccgcgtctacccgggcgcgtacgaacggctcgacctcggctacccccgcaacgaccgctacaccaccgccaccgccgaggacatcgcgaagatccgcgccgaactgggcatcgccgagggacagaccgccctcctccacgccccgacccaccgcgactaccgcgacggcttcgtacccgatctcgacccggagcggctggcggacgaactgggcccggactacgtgcttttggtgcgcgcccactacttctacggacgctccgccgaggtcggcgggacgggggcggcgcgggtcatcgacgtcaccgggcacccccgggtcgaggaactgtgcctggcggctgacgcgttgatcgccgactactcctccctgatcttcgactacgcctgcctggaccgcccgatcgtcgtttatgcccccgactgggccgcctaccgcgccgcgcgcgggacgtacttcgacctgctctccggccgtcccggcgacacccccggccccgtcaccaccaccccggccgagctggccgacgtgttccggacgggggagtggcggtcaccggaggcggccgcgctgcgcaccgcgttccgggagcggttctgtccgtacgacgacgggaacgcggcggaacgcgtcgtgcggcggttcttcgccccgtccctgtgacgcgggaccccgccaccggtcggccggcgcgttccgccacccgaatggctcaaggcgcgcctcccgtgccgattcctccgcgccgcacggtcgttgagcccaacagctcgctcaccccgccatgttgggagacgtccatgcaccggtccgcctacgagcagatggaactctgcatccaggagtatctgcctgtcgaaggacccgcgtccggcgcctaccgcgtcgtcgacctcggatcgcgcatctccggcaagcagacccgtacccaccgggcgctgctcgcggggcaccccatcgactacttcggggtcgacgtgcaggacggccccaacgtcgacgcggtgatgacgaagccctaccgcatccctgcccgctccaacagcgccgatgtcgtgctctccggacaggcgttcgagcacatcccgttcttctgggcgtcgatgctggagatcgcccgggtcctgaagccgggcggacacgcgttcatcaccgccccctcgcgcggccacgtccacgacgcgcaggactgctggcgctactaccctgacgggttccgcgcgctcgccgcccactcgcggctcgaactgcgcgaggcctacaccgacttcccgccgaggaagggcatctggcacgactaccgggccatcgacacgaaggccgcctactggggcgactccgtcggcgtcttccgcaagccggcccgctacccgcgcctgaccatgttcgccgtacgggagttggcggtgtggtgggcgaaccgggtcggcggcgtggacggcgtcccgctgcccagcccggtggacggccgcgagcggtgcggcaggcccgaatccgtccccgtacccgagcaggcgcccgccccggagcggacgcccgcgccggaagaggctcccgcgcgtgccgagtcggcgggctgagccgtgagaggcgcgatgtggcggtccggcgggatcaatagcaggttgacgaaagatgacatgcggtgcaaaccgcgcgtactgtcccggggcatggcttggcgcaacgccgtcaacggcgtccttcagcagctcaccggatatcagctcaggcgggtcacggtgcctgccgcccgcaccgctcccgtcggtcccgcaccggctccggcagccgcacccgcacccgccgccgctccggcggtcgcgaggccgaagcccagggcgaagaagcccgcccccgcgttcccggcggactacgacgacgaggcgaaggagatcatccgtgcggtcaagccgtactcgatgacctcgccggagcggctcaacgccttcatcctcgccacccgtcacatcgtccggcacaacatccccggcgacatcgtcgagtgcggcgtctggcgcggcggttcgatgcaggcctgcgcccggacccttctggcagccggggagaccgagcgcgacctgtacctcttcgacacgtacgagggcatgaccccgcccaccgccgaggacctgcggcgcgacggccggccggcccaggaactgctggacgcccagggcaaggaccggccgatctgggcggtcgcctcgctggaggacgttcaggcgggcttcgacaccgtcccgtacccgaaggaacgcgtgcactacgtacgcgggcgggtcgaggacaccgtccccgggcaggcccccgaacagatctcgatcctgcgcctggacaccgactggtacgcctccacgaagcacgaactggagcacctgtactcccggttggtcagtggcggggtgctcctgatcgacgactacggctactggcagggatcgcggcaggcggtcgacgagttcctcgacaagaccggcgagcaactgctcctgctccggatggacgagggccggatcgcggtcaagccctgaccccgcgccccgtggcagcaccgagcgcatcgagccccgtgcccttccggtacggggctcgaacgtgctcccggcacgccccgggacgcgtgactccgccctccgcgtcacccgaacggaccccctcgggtgacccgtccctccggcgcgggttgtaccccatggccccggaaggcccctcacgccccgaagtgcccgcagcacccgaagacccgtccgtgtaaccgag

SEQ ID NO: 3745 - DNA, 533 bp, Unknown
  Kingdom: Bacteria, Phylum: Actinobacteria, Class: Actinobacteria, Order: Streptomycetales, Family: Streptomycetaceae, Genus: Streptomyces
acgaggagctgtcgggcgccccggaggagaccggcgtgcggcgggtggcgggactgcaccgcggggaacggctcgcggcgctgggcgactggtcggccgggctgaaggacgccgcggaggtgcccgaaggactgcgggtgacgctgccgctgctggacatgcccgtccacctggcgtggctggagcggcggctcgcggctgcgggcggttcggtggagcggcgggcggtgacggggttcggcgaggcggcggagcggagcccggtggtggtgaactgcacgggactcggggcgcgccagctggtgcccgacgccggggtgcggccggtgcgggggcagctggtcgcggtggagaacccggggatcgaggagtggtacaccgaggcggatccggcgtcggccgcgacgacgtacttcttcccgcagccgggccggctggtgctgggcggtacggccgaggcggacgatccgcgcacaccgcgtcacgatcgcccgcgccgtccccgggtcgggctccgtgcgcggatcgtacgc

SEQ ID NO: 3746 - DNA, 1002 bp, Unknown
  Kingdom: Bacteria, Phylum: Actinobacteria, Class: Actinobacteria, Order: Streptomycetales, Family: Streptomycetaceae, Genus: Streptomyces
cccccgtggcccgccccccacgcgattggattgctcatgagaagacctcatcggagacaattcgcccgctggctcgtcgcggcttcgctcgccgccgtcgtcgtggcacccgcccatgcgtcccagcccaccgacgcggcaagcggcgccactgtggcctccggtgatgtcggctacgtcatgggctacttcaaggagtccctcaacggatcaggcgatgtcaacgccctccacctggctctgagcaccgatggactggagtggacgccactcaacgacaacaagccggtgctcacacccacggccggcaccaagggcatccgcgatcccttcctgtaccggctcaacgacgatacctgggtggccgtggcgacggacattcccagaggaggtgatttcgccgagcccaatccgaacatccacgtctggacctccccggatctggtgaactggtccgccgaccggctgctcaacgtcaaccggacccatccgaactcctacagctgggcgcccgccgttcactgggaccggagccggcaggcgtacgggatcacctactcgacggtccccgagggcagcggatactcggtcatcgcggtcgcgtacaccaccgacttccgcaccgccaccgcacccacgacgttcttcgacggcggcccggcgggcgtcatcgactcgcatgtcgtgaccgacgtcaacggtatgaactacctgtactacaaggaccacgcgaccggcggccctgtcggcgcccggtcggcgtcgccggcgggacccgaactggtcgtccttccgctccgtcaaccaccccgcacgccatctccggcacgcggatttcgctctccgtatcgatgaggtggcgagcgccggcgaccgtgccgacgcgaccttccgcgtcgggtactgaccgctcaccgatccgcgagagggcacccccctgggccgtgcctcgcgtgcggtgtgcgccaggtacccccgggtgtccgcccccgaccccagctt

SEQ ID NO: 3747 - DNA, 514 bp, Unknown
  Kingdom: Bacteria, Phylum: Actinobacteria, Class: Actinobacteria, Order: Streptomycetales, Family: Streptomycetaceae, Genus: Streptomyces
ttccggcgacggacgacgaacaccgccgccgcgcccagcaccacggccgcaccgcccgcgagagcgatcgaggtggtggcggaggacgaacccgtggtggcgaggctgccgttcgtgccggtgttcgccggggtgcccgacgccgaaccctgcgccttgtggccggagccgttgtcgccgggcttcgtcttggagggcttgggcttggcgtcctcggtcttgccgggcttgctgccggcggccttgacgtcgaactcgtacatgtccgcgccgggcgccccgccgcaggagccgtcctcgttgaagaagtcggccgcgatgaacgcgacaccgttgccggccggggtggccttgtcgagagtgaggcgcagcttcacgtcggcccgggcgccgggcttcagcgcgccgacgccgtcgatgtagttgtcctcgttgaggtcctgccacttcggggacgacttggtggaccactggaggcggaagaacttgcccgtgtccttgagaccggtcttgt

SEQ ID NO: 3748 - DNA, 1350 bp, Unknown
  Kingdom: Bacteria, Phylum: Actinobacteria, Class: Actinobacteria, Order: Streptomycetales, Family: Streptomycetaceae, Genus: Streptomyces
caccgcgaccgccgcctccggggaccgcggacacccgcgccgcgcctcaccggcgggtctcccgccagacgcggacgagcttcgtggcgtcggtgcagatcgcgcccgtccggcaggcggtgcacgtcatcgtgtggccgagcagggcgcggtacgccgcgtcgggggagtcggtcgtggtcacgttcgcctctctgctgatctcggcccagacgaattcggaggtgcggttgagcgtgtgtccgtagaggtccgccgtggcgagggcggcgaggacggctgcgtgcgcggtggcgctcaacccggcggggagatcggcctcgacgcggaagacgtccaggccggtggtcgtgcgcggttcggtgcctgtggcggcggcgagcatgccggtcagcgccgcgacccgcgcttgtgcagagcgcacacttctcccctggtggaccgaatgtcactccatgtaatgctgagtattcagcttcaacctgatgggttagctttgtcaacagcgacgcccatatcgacgccgaacacacggagctgctcaaatgccacgtgatacgccgtacttgcaggtggcggatgctctgcgggctcgtgtccgggccggtgaatgggcggtcggggacaagctgccgtcccgggcgcggttcgccgaggagtacggcgtcggccagtccgttgcgcagcgggccatggaacgcctgatcatcgagggcatcctcgaaggccgggccggctccggcacctacgtccgccgggcccgcgagcgtcggcgcatggtccgctcacgtcaccgggagctgcgcaacaacagtccgttcgcctcggacatgggcgagctggaccacgaggccgactgggagtgcaccagcacggcacgggtccccgcgccggaggacatcgccgaacggctggcgatcgagcccggcgacctctgcgtcgtgacggactacgagttcctcgccgatggactgcccgtacagctcgccaagagctgggagccgatggccatcaccgacgggacgccggtcctgcttccggagatgggcccgcacggcaggatcggcgtcgtcgagcgcatgcggtccatcggcgtgcacatcgccaccggcctcgaactgccgcgcccggcccgtgcgacgcgggagcaggcgaatctgctcgggatctccatcggcgacctggtcatcgaagtggagcgtacgtacttcgaccgtgacggccgtcccgtggagacggccgacatcgtcgtgccggacatccgctgggagatcgcttacgagatccgcgtcgaccagcctgattcctgagccggggaacgaggccgggggacgggggccaggggtgagg

SEQ ID NO: 3749 - DNA, 2176 bp, Unknown
  Kingdom: Bacteria, Phylum: Actinobacteria, Class: Actinobacteria, Order: Streptomycetales, Family: Streptomycetaceae, Genus: Streptomyces
tggggccgcttcctcaccgggagcgaccagggccgtctccgcttcggtgacaccaccggcgacggcaaggcggacatgtacgtccacacgatccacaacggcgaggtcgcggtgcgcaccaacatgggcacttacttcaacgcaggcacccggatgatcactctctgacggtcccggttctggccggcctccaccgggccggccagaacccgcggaggaacgcgacccccgggcgaaaggcttcagggcgcccagggcgccagcatgcccttcatcgcgtccgtcatcgcgagttgcagcagggggccgtaggtgatccggccgacgccgaggcggcggaagcgatcgagatcgtgcttgaccggatgggccgtggagttcacgggcacggagacggcggccgtcaccgccgcgagcagttcgtcgttgtcctggatgcgcaccgggtagacgctgtcggcgcccgcctgtaccagggcccgcatacgttcgatcgcctcgtcgaggacggaggaagcgtcctccgcgtacaggaacaggtcggtgcgtccgttgatccagaccgggaccccggcgtcgtcggccgccgcccgcaggccggcgatgtagctcgcgtgctcctgcgtgctgcgcacgcgtccaccctccgagtggacggtgtcctcgatgttgagaccgacgccgccgacctcgatgagaccggcgacgagatccgcgggcttctgtccgtagccggcctccaggtccacggagacgggaacgtcgaccgccgcgatgatcggtccgacggcggcgagcacctcctcgaaggtctgcccctcgtggtcgtcggccccccgggaatcggcgagcggatggctgccgaccgtcagcgcggggaatccggcgtcggccgccgtccgggcggaccagacgtcccagacggtcggcagtacgaggggccggtgctcggcgtgcagttgcttgaggcgttgagcgcgctcaacggtggtacgagagtccatgtggaggacgctaccccccgcgtcgccgaatgcaacgtgccgacgggtgccgccgggggtggggtgaaggccgcttccgtcagtcggccaccgtggtcgatgtactcgttgaccagcgcctggtgggggagcgcgtcgccgtccgggtcggatacggacgccctgaacgcacacggctcagggggtgtcgagcggcggggaccgctctcccacggagcccgcacacagggaagcggccccgcacgccggcggggccgctcatacagtgccttcgacgggccgacggtgtccggccaccccggaccgctcgcggcccggggccctcacccgtcggcgggatccgctccgccggggaggacgccgggacggctcccccggatcacgcggtgtgcagggtcagcccgtaccggttgaggatctcgttgacgggctggtaccaggtctccccgccgccggagcagttgccccagccgccggaggtgacgccctgggcctggtcgccgctgatgaacgagccgccggagtcgccgccttcggcgcagacgctcgtcttggtcatctggtgcacggcgccctggctgtagttgacggtctcgttcttggcgagcacgttgccgcagcgccagtgcgtggtggagccggagcggcagatcgaggctccgatcggcgcctcgttcgagccgcggacgagctggtcggagacggtgccccagccgatgacgaccggcacggtccaccagccgttggccacgttcacccaggcgtagtcgttgccggggaaggacgagccctggaagttgccgatggccgagccgtcccagccgcgcacggactggccggcgccgccgcagtgcccggcggtgacgaagccgccgtggacggagaacccgatggagcagcgcacgttgcccgtgtagtacgggtcgcctccgaccgttcccgcggcgaaggtctgcggcgcttcggccgtcgtctccacggtcacgggcccggccccgcgggccttggcgacgaaggatcggacatcgttgtcacgccgctcggaggcgacgacgttcacgacgacacggctggtcgccgggtcgacgtgccagctgctcacgccggacggtgcgggcagggcgtcgatgcgcgccttcgccgcgtcgagctgctcggccgagtgctcgacg

SEQ ID NO: 3750 - DNA, 1676 bp, Unknown
  Kingdom: Bacteria, Phylum: Actinobacteria, Class: Actinobacteria, Order: Streptomycetales, Family: Streptomycetaceae, Genus: Streptomyces
gaccgcctacggcgggcggtgggtcgtgaacccgtccggcgggctgacctccaagggccatccgctgggcgccaccggcatcgcccaggccgccgagctgacctggcaactgcgcggcgatgccggtggcgcccagcggatggcccttggagatcagcccgccggacgggttcacgacccaccgcccgccgtaggtggtcgccccggactcgacgagcttgccggactccccctcgccgcacaggcccagcgcctcgtaggtgaggagctcgttgacggagaagcagtcgtgcagctcgatgacgtcgaggtcgtccgggccgaggccgcaggccgtgtagacctgctgggcggcggcccgggacatcggggctccgaccgcgtcgatgcaactgccggaggcgaaggaggcctcggtgtcggtggtcatggcctgggcggcgatctccaccgcgcgctcccccaggccgtgccgctcgacgaaccgctcggagacgaccacggcggccgccgccccgtcggaggtgggcgagcactggagtctggtgaggggccggtggacggtgcgtgcggcgaggacgtcctcgaccgtgtacgggtcctggaactgggcgtacgggttgttcaccgagtgccggtggttcttggccccgaccgcggcgagctgcgcggccgtcgtcccgtaccgctccatgtgttcacgggccgcgttgccgaagatctgggcggtgggcggggacatctcgaagccgtgggcggctgccatgatcccgtagtgccgggcgacgggcgaggtcgcgaagtcgccgccgccgtccgcgccgttgcccagcgagccacgggccatcttctcgaagccgacggcgaggacgcagtcgctgccgccgccctcgacgaactgccgggccagcatcagggcggtggagccggtggcgcagttgttgttgacgttgtagacgggaacaccggtcaaccccagttcgtagacggaccgttgtccggcggtggaggcctggaagcagtagccgacggggacctgttcgacctggtcgtagcggacacccgcgtcctccagagcggcggagcccgcctcgcggaccatgtcccagtactgccagtcgcgggtctcgggcttctcgaacctcgtcatgccgacgccgacgatgtaggccttcatggtgcgactccttcttgtccggtgcggtcagtccctggggaggccgaggatccgctcggcgacgacgttgagctggatctgggtggtgccgcccgcgatggtcaggcagcgggacatcaggaagccgtggagggcccgctcccccgccgccggttcgtccaccgcaccgtcggggccgcggagttcgagggtgagttcggcgaccttctgctggtggagggtctggacgagtttgcggaccgaggccccggcgcccggttcgcggccggagacctgccggagggtggtgcgcagtcccacgcaggcgagcgcgtgggcctcggcggcgagcgcgccgatccgcgtgcgggtcgcctcgtccagcccggccgagcgggcgatcagggcttcgagcccgctgtcgaaggtcatctggtcggccatgtggacgcgttcgttgcccagggtgtcgcgcgcgacccgccagccgccgccgacctcgccgacgacggcgtcggcg

SEQ ID NO: 3751 - DNA, 761 bp, Unknown
  Kingdom: Bacteria, Phylum: Actinobacteria, Class: Actinobacteria, Order: Streptomycetales, Family: Streptomycetaceae, Genus: Streptomyces
gccggcggctgctcggccgcgatcgacggcctgagcgaactggccgggctcgccgtcgccgctcccttccgccgtcggggcgtcggggccgcgctctcggcctggctgacggaacgggccttcacccagggctgccggacggtgtggctggagccgggcgaccccgatgtcgagcgggtctacgcgggcatcggctaccgccggatcggcgagaaggtcaacatctcgctcgacccggccggcaactgagccacggccccggaccgccggcagagcgacggcctcggttcaacaggtgagcgacggcctcagaccaggcgtcgtgccgtcgcccaccgggtcagttcgtgccggttggagagctggagcttcctgaggaccgccgacacgtgcgactcgaccgtcttcaccgagatgaacagctgcttggcgatctccttgtacgcgtacccgcgcgcgatcaaccgcagcacctcgcgctcgcgctgggtgaggcggtccaggtcctcgtcgaccggcggggcgtccgtggaggcgaaggcgtccaggacgaaaccggccaggcggggcgagaagaccgcgtcgccctcctggacccggaagaccgagttcaccagatcggtgccggtgatcgtcttggtgacgtagccccgcgcgccgccccggatgacgccgatgacgtcctccgcggcgtccgagacggacagcgcgaggaagcgcaccgggttctcggccgtacccatcatgggggcgcagcggcg

SEQ ID NO: 3752 - DNA, 1073 bp, Unknown
  Kingdom: Bacteria, Phylum: Actinobacteria, Class: Actinobacteria, Order: Streptomycetales, Family: Streptomycetaceae, Genus: Streptomyces
gccggtggaattcggtgagtacgtcgtggagtacgcggcggaccgccaggcgtatcgccgcgaccgcaggatggggacccatgtccggtgcccttcgtggagttcgggaggagcgtcgagcgccggaacgcgtgagtcccgtcactcagagtgcgtcgatggtgacagaggcaagctgttcatcgagcattgcacgccttcccatgcccctatggtccctcggatgggtgattggagggccaatttgggtccgcaggccgcctggtggtcaggattcggccttacggtgcacccgcgcgacccagtcggcgggcttggcgatctcggctttggtcgggagggtgttcggtgaggtccagacgcggttgaagccgtccatgccgacctcttcgacgaccgatcgtacgaacttctcgccgtccttgtactgccggagcttggcgtccaggccgaggagcttgcgcagggcctggtcgagacggcctgcgccctgggcgcggcgctgctggaacttctcgcggatctcggagacagagccgacgacgtcggggcccacgccgtccatcacgaagtccgcgtgtccttcgaggagggacatgacggcggtgaggcggccgagcacttcgcgctgggcgggggtctggacgatgtcgacgaggctccggccctcgtgctcgccctgttcgccctcgggccttccggcgccggagagggactgggcggcctcgcggaggcgctccaggaaggtcatcgggtcgacgtcggtctcgtcgaggaacgtctggatctcgccctggaggtggtcgcggagccagggcacgccggtgaactgggtgcggtgggtctcctcgtggagggcgacccagagccggaagtcgtgcgggtcgacgtccagctcgcgttcgacgtggacgatgttgggcgcgacgaggagcagccgtccgccgccgtcggcggaggcgggcaggtctctggtggccggggcgaacgtctcgtactggccgaggacccgggaggcgaggaaggagagcagcatgcccagctcgacgccggtgaccttgccgccgaccgcg

SEQ ID NO: 3753 - DNA, 569 bp, Unknown
  Kingdom: Bacteria, Phylum: Actinobacteria, Class: Actinobacteria, Order: Streptomycetales, Family: Streptomycetaceae, Genus: Streptomyces
gacgcggggaccgccggggccgccacccgtccggcgtacgcgacaatggagcaatgaccacgctcgcccccgccctcccgcagctccgcatcggcccgcacaccgtgcagccgccggtcgtgctggccccgatggccggcatcaccaacgccccgttccggacgctgtgccgggagttctccggtggcaaggggctgttcgtcagcgagatgatcaccacgcgggcgctggtcgagcgcaacgagaagaccatgcagctcatccacttcgacgcgaccgagaccccgcgctcgatccagctctacggagtggacccggtcaccgtcggcaaggcggtccggatgatcgtggacgaggatctggccgaccacatcgacctgaacttcggctgcccggtccccaaggtcacccgcaagggcggcggctccgcgctgccgtacaagcggcccctgctgcgagccatcctcagggaagccgtctcggccgccggggacctccccgtcaccatcaagatgcgcaagggcatcgacgacgaccacctcaccttcctcgacgccggccgcatcgcc

SEQ ID NO: 3754 - DNA, 685 bp, Unknown
  Kingdom: Bacteria, Phylum: Actinobacteria, Class: Actinobacteria, Order: Streptomycetales, Family: Streptomycetaceae, Genus: Streptomyces
  misc_feature (438)..(439): n is a, c, g, or t
gcccatcgtggagtccctgcacccgacgtccgacgcggactggctgatcgtcgccggcgatgtggcggagcggcccgaggacatccgctggacgctcggactcctcgccgagcgcttcgcccacgtgatctggacccccggcaaccacgagctgtggaccctggccaaggacccggtccaactgcgcggccaggcccgctacgaccacctcgtcgagctgtgccgagacctgggagtgacgactccggaagacccgttcccgctctggccgggcccggacggaccggtggcgatcgcgccgctcttcctcctgtacgactacaccttccgtgccccgggaacgcacacgaaggaggagtcgctcgccgtcgcgcacgaatccggcatcgtctgcaacgacgaatacctcctgcacccggacccctatccgacccgggnnccgggcgccggctcgcggagcacgaccccgagatacccctcgtcctcgccgggcactggccgctcgtccgggaacccacgtcggtgatgtggtatccggagttcgcccagtggtgcggcaccgaactgaccgccgactggcaccgccgcttcaacgtcaccgccgtggtctacggccacctccacatcccccgtacgacctggtacgacggggtgcgcttcgaggaggtctccatcggctacccca

SEQ ID NO: 3755 - DNA, 509 bp, Unknown
  Kingdom: Bacteria, Phylum: Actinobacteria, Class: Actinobacteria, Order: Streptomycetales, Family: Streptomycetaceae, Genus: Streptomyces
accgaggtccagccgctggcgtccggcgtcacgggtgcggtcgcgccgttcgccgggggcgtcgcgtccgaggtggagccgctcgcggaggggctgaccggcgacgcggtcgcgccgttcgcgcagggggtcaccacccgggtgcagccgctggccgagggtgtcggggcgcaggcccggccgttcgccgacggtctggcggccacggtccgcgaggacgcacgtcccgtcgtcggccacgcgggcaccggtgtccagaacgtcacctcggtcgccccgtccttcgcgacggacgcggcgcccgcgctctgagtggggcgacgcacccgcgcactgggagggcgacgtgcccgcgccctgagatggacgtggtgcccgcgccctgaatcggaggcagttcccgcgcgccgatgagcagcgcggttcaccgcatcggagtacccggcccaaggggacccgggccgggtgctccgggtccgaccagcctcttccggctcccggcgagcccc

SEQ ID NO: 3756 - DNA, 3402 bp, Unknown
  Kingdom: Bacteria, Phylum: Actinobacteria, Class: Actinobacteria, Order: Streptomycetales, Family: Streptomycetaceae, Genus: Streptomyces
gtactcggtggccgcgttccaggccggggccgagcaaccgccgcccggctgcgtcggggtcggcgtcggcgtcgggccggtcgggtccggcgtcggggtcggcgtggggccggtcccggtgccgggctcgaccacggtggtgccgcgcgccaggtcaccggcgagggagtaggacttcccgccgaaggtcacggtccagttcgacggcgtggaggtcggcaggtagtagacgaagtccagctccaccgaggcgccgggagcgagcgtctgccaggccgggagcttcagcgagacgcggttgtagtcgcccttgaggccgccgatgttgttggccgccgtgtggtcgctgcggatgatcgtcgtgccgaagccggactggtccttggcgttggccggggcggaggtggagtagtcgaactggaactccgtaccgccgggcagcgtggcctgggtccggttggtgatcttcagcttggggctgatcgggtagttggagtcgcccagcgggaactgtccgaaggagacgtcgatgttcacggcctgggtgggcaggtcgatcgtggagcgcttcgcgccgtacggggtggccgacttgaacgcgtcgtacatcgcggtggtcagcgtggagccggtctcgtactggcccttggccgcgttccaccggtagtcgcccgccagctcccagatcatcgtgccgccgatgcccttgtccacgacgtagtcggccttggccttcaccgactgttcgtcctcggtggagaggaacaccttcttctgggcgttccacagccacggggcgaccagcgtggagtcgtacttacggacgtacgtgccggtcagctgggtgttcgcggggaagccgtagtcggtgacgtagtcgccgacgatgcccttctccaggttcttcgcgtgccacatcgggttggaaccggcaggcgattccttgccgttggtgtccttgtcgtgccagaggttgtcgatcccgaccgcgccgtcaccgcacttggtcagacccgcgcccgccgggcagtcggtcgtggccgccctgccccacagtccgtcggtgccgccctgcacgttcttgaagccgcgggtgtagtacggcagaccgatgttgatccggccggccggcatcgagccgcggaagtagtggtaggcccagtcggtgttgaggtagccggtgccgccgtactgcgaggtggagtacacgctcgcctgcgccagttcggcgtccttgccgtcgtcgaacagggaggcgttcgggccgacgtactcgttccaggcgccgtgcaggtcgtaggacatgatgttgacgtagtccaggtacttctgcatctggtacgtctccatgcccctcagcaggtagccggaggagggggcggcgacggtcagcaggtagtgcttgccgtcggcggcgcccgcgcggtcgagcttctcgcgcagcgtcttcatcagggcgtcgtagcccttgaccagcccggcgcggcggccgttggacagcgtgtggtccagcgggttgcccgcgtccttcatggtggtcgcgtactcgtagtcgatgtcgacgccgttgaagccgtacttcttgatgaagtcgacggtcgagtcggcgaaggtgttgatgcccgcctggttgaccgacccgtcggcgttggtcgccatcgagtagaagccgcccgagtcgacgcgcttgccgtcggggccgaagtagccgcccgtctcggcccaaccgcccacggagaccagcgtcttcacgttcgggtgctgcttcttgtacttcgtcagcaggttgaagtgccccttgtaggggagcgtcgggtccatctccgcgcctgcgacaccgggccaggtcatgccggtggaggcgttgtcggcgctgtcgggtccgaccgagagcttgttggagccgtcgatgtgcgcgaaggcgtagttgagatgcgtgaccttgtcccacgggatgtcggggaccaggtaggcgtccttgccgtccttgccggtacgccagttggtgaagtagccgatgacgcgccgtttgtggtcggcgcccatcttctcgcggccgtcggcgtcgtagacggagcagtaggggacgtcgacgccgggggtccggtagagcccgtcggggcgacaggaggtctggtcggcggcggccgacggacctgcggcgagtgagctcatcagcagtccggcgacggcggcgccggcggcgagcagggtggctctcgctcgggtgggggacagcatgtggtcgttcctcctggggaggtcggcagaacacaactggcaaaaggggtgggtcgtgtcggggtcctggtgtgcgcacaccgccggaccgaacctcggaggtgacgcagagattaagaggactagaccagtgcgtcaataggtctggacctttaggtgtcaactttcccgatggcgtaccgatgactacgttgtcgacttcccgccaacggaaacgcgccaggttccctgtgacccagcccacagtgctcacccgcatggccgtgaggcgtccgtggcagactggttccgtaccagtagcagcgcactccggggtcggtgcaattccgaaccggcggttatagtccgcgacccgtccgcagccagcggccggttgaccaggtgagattcctggaccgacggttaaagtccggatgggaggcagtgcgcggcgggttgtcatcggtacgccgccgtcggcggacgcatggccgggagtctcccgtgacgccgtgcgttcctggcgttcccgttctcgggatttcggcgtttccgctggtgagccgctctatctgtcgtcatcgacaggccccggagtccgtgcccgaagaggcaggaggacccggtggacaccgcagccgacatcaccgccatgcgccgagcgatcacgctcgcggcgcgcggtctcggctccaccagccccaacccggtcgtcggatgtgtgatcaccgacgtcgccggagccgtcgtcggcgaaggcttccaccagcgcgccggagggccgcacgccgaggtccacgccctgcgcgcggccggcgagcgggcccgcggcggcaccgcctacgtcaccctcgaaccctgtgaccacaccggccgcaccggcccctgttcgcaggcactcctggctgccgggatcagccgcgtcgtgtacgcggtcgccgacccggacccgggggccgccggcggcggcgacaccctgcgccgcgccggggtccgggccgagcagggactcctcgcggacgaggccggggcgggcaacgccgcctggctgacctcggtgcgccgcgggcggccgtacgtcctgtggaagtacgccgccaccctcgacggccggatcgccgcagccgacgccaccagccgctggatcacctcgcccgaggcccgcgccgacgtccaccggct

SEQ ID NO: 3757 - DNA, 2959 bp, Unknown
  Kingdom: Bacteria, Phylum: Actinobacteria, Class: Actinobacteria, Order: Streptomycetales, Family: Streptomycetaceae, Genus: Streptomyces
ggatgaccaccgagccgaggaccttccctccccgccccctgccagcggtcaaggccgtgtacgcccgccaggccggctgcccgtcctccttcgccctggcggtggcggatttcgaaccctgggaggagggagtggagttcgagacggcggacacgagcgcggtgccgggccggtcggccgccgaggtgtccgagctgcacgaggccttcggctccggcgtccgcgaggaactggagaaggtcgcgacactggaccccgggaccacggtggcggtcgcggtcgtcctgcggtccatcaaggtgcacgaagtggactcccaccccctcgcgttccaccgggcggggcggctcgccgtacgcaacgcgatggccgaggcatacggtccaccgccgcgaccgcgacgcgaacacccctgaggccgggccccgccaggcggccgctcatggccgaccgagcgaccaccgggagaagttagggtaccctaacttcatgtcgatcgccgcctcccgccacccgcacgtcgaggccgcctcgcccgcctgggcccaacccccggccggcggggccgaggtggccgagccgtatctgctcaccaccgcggtgttcgacgactccgaaccgacgagacccatgacctcgggcgtgcacacgcacaccgacgccctgctggtctggccgcacaccggctcgatcaccctgcgcacccggaacaccgtgcgccgcctgctcccgggacagggcgcctggcttcctcccgacaccccgcacgcggcgtcccacggggcgggcggcatcagctgctacacctacgtgtcgcaacgggccgtcccgccggggtggtccgccacccgcccgatgcgcgtgagccgtgcgctccaggaaatgctgctgcacctcgacgcgaccgcgatgcccgacgacctccgactgcggacacagcgcgtcatcatcgagatgctggaggaggacaccctgccggcgatcgaggtgcccgtaccggaggaccggcggatccaggtgctggcggacgacgtcatgcgcgacccggagagcgacctctccgtggaggggtgggcggccagacacgcgttgagcgtgcgcacggtcacccggacgttcagccgtgacgtcggaatgccgttcgcccggtggcgctcactggtccggatgtccgccgccacagccctgctcgcccagggacacccggtcagtctggtggcgcaccgcagcggttacgccaccaccagcgcgttctgcgcggccttccgccgggtcaccggcgccagcccgacggagtatctgcgcgagcaggccgctccggcgcccgccgcccgctgacctgaggccggggcccgcccgccaggtggccgattcacgacagactgtggccggtacgcgacccctgaacggtccccgccttcctagtgtctctccaggtgagggttgccttacctaggaatcaaggagagacatgtcgacattcaccccgacccggcgcgggccgggcgccctggtccgcgccctgacggcggcggtcgccacggtcgtcgtcctggcgggctgcggtggcgacccgtccggctccggcaccccggagtcgcagtccggagccgggccggccgcgttccccgtgaccatcgagcacggccacggaagcacgacgatcaagcggaagccgaagcgcgtcgtggcggtcagctggatgtccctggacgtggtcgcggccctcggcaccgtccccgtcggcgtggacgagcagtggggcggcgacaagcaggggtacaccccgtggttccgcagcacggtcgagaagctcggcggaccgctgcccgagaccctcgaccacggcgacgcgggcgagatcgacttcgagcagatcctcgcgctggaacccgacctcatcgtcggcctgtactccggcatcaccgacgtcgactaccagcgcctctcccagatcgcccccaccgtcccctacctcaagaagccgtgggacggcggaacctggcaggagatgacccggaccatcggcacggcgctgggcgagaccgagaaggccgaaagcctcgtcaccgacgtccagggacagctggccgcggtggcgaagggccacccggagttcaagggcaccaccttcgcgtacggactggccctcgcccccggctccaccgacgtcggcctctacgtcgactacgacgcccgggtccgcctgctcaccgagatgggcttcgagaacaccccgtcgatggagaagatcgcctccaccgtgaagggcacgaactggtacggcggcatcagcctggagaagctcgacaccatcgacgccgacatcttcgtcgcgtgggccaacggcgccgacgaggtcgagcacacgctgaaggacccgctcttcacccgctggaagccggtcgccgaccgcaagtacgccttcgtccaggacccggccatgggcatggccaccagcggtccctcagtgctctccatcccgtgggcgatcgaccgttacgtcccgatgctcgccgacgccgtcgcgggcaggggcaacaccggcgcgggctcctgaccgccgtccgccgctccgcccaggtgacgccctcctcccaaggacaaccatgacgaccgccccgcccacgggtgacctcaccgccggcgccgagcgcgctgagcccggcacgcgcgacggcgcgggaccggcccgacgccaccggcaccggctgctgatcctgctcaccgccaccgccctgctcctcgtcgtcgccgtcctcagcgtgatgatcggggcgcgcgccatcgcgcccggcaccgtgggggacgcgctgttccacttcgacgactccgacgaacacgtcatggtgcgtgaactacgggtgccgcgcaccgtgatcggcctggtcgccggcgcggcgctcggcctcagcggcgcgctgatccaggcgttcacccgtaaccccctggccgaccc

SEQ ID NO: 3758 - DNA, 7261 bp, Unknown
  Kingdom: Bacteria, Phylum: Actinobacteria, Class: Actinobacteria, Order: Streptomycetales, Family: Streptomycetaceae, Genus: Streptomyces
gcccgtacaccgcgtactccggcggacccgcggtgctccagcaccagggcggccgccccgtcgaacgccgtgtcccgcccggtgagcctgcgggccggagcggtgtccggctccgcaccgatcaccaggacccggtcggcgcggcccgccgcgagcagcgtcatcgcccagcgcaccgcgtccgttcccgaggtctccccgttgcacagcatcagattgggcccggtgaggccgaacctgatggcgacggaggaggcgagcacattgctcgacgcgttgggcagatccatgggactggcggcggacgcggtctcggcggcgatggtctccaccgtgcggcagacggtgtcgaggttgccgtagttggagctggcgaccacggccgtacggtccccgcccagcacgcctccgtcgtcgtcgaggagccgcgcctcctccagcgcgtcccggacggcgcagtaactcaactgggtggcacggtccttgtagcgcagacccttgcggccgagccgttcgcgcggatccacgggggcactgcccggacgcggttcgccgagcaggtccgccggagtgtccacgcccgcgagcgcgatgccgatcccggtcacgaggatgctcatcgcactccctccaccacggcgacggcgttgatcccgccgaagccgaacgcgttgatctgggccaccgaaagatcggcacgtgccgcctcgccggtgacgaaacggaagtccgccgcctccgccaccgggtgggagagccccggggtgggagggacgagaccggcgtcgagtgcgtgcagcgcggtgatcaggccgatcagcccggaggctccggaggtgtggccggtcatcgacttgatcgcggtcatcaggggaccgccgacgtgcggtccgaaggcctcggccaccgcggtggcctccgcctcgtcgttcagcagcgtcccggtgccgtgcagcatcaccaggtcgatgtcctccggcttgaccccggcgcgctcgtgcgcctgccggatggccgcggcgatcccccggtggtcgggggccgtcgcgtggtgggcgtcgcagttgagtccgaccgagcgcagccggccgcggacgccgccggtgcgtccctgcgcctcgcggcggatcacgaccgccgccgccccgtcgcccatgaccgcacccgtacggtcccggtcgaagggcctgacccggtccgggggcaccggatgcacccgctccaccagcccgtacatgctctccgtgagcacgtcgaccccggccgcgatcaccgtgtctgcctcgccgagctccagcaggtcggttcccatcgccagcgcgtacagcgaggcggagcaggcgttggcgaaggtgtagacggtggtggcgccgaagcgttcgcgcagggcgcggccgaagtgcagcccctccgcgtccatcggtgtgccgtcgcgccaccacagttcggccgagcgcagctcgcgcagtccggtgccgacgagcacgggcaccccggagaggtcctcgcccagaccggcgtcgcgggcggcctgggccaccgcttccaggagccaggccgtggcccgccccggcacgtcggcgccgggcacgggccggtcgtcgatctcgtacgcgtagcgcgccgcgtaccgggagcggtcgaagccgcgcagctcggcatgggcgctgcggcccgcgcagagggagtcgaacagttccagcgggtcgcggccgacgcccgccgccgcgcccgttccggtgaccagccagctcatcggccctgcccctcgtacttgccgaggacgacgaccgcgttgttcccgccgaacgccagaccgttgttgaccacgatgttcaggtcggcgtccacggcttcgttgggcacgcagtcgacgtcgcactcgggatcggtgcgtacgtggttgatggtcggcgggatgaagccgtgcacgatcgccagggagcaggcgatggcggacagggcgctggccgcgcccatggtgtggccgatcatcgacttgatggagaccgtgcgcggcggctcgccgaagacctcgcggatggcctgcgcctcggtgatgtcgttggcccgggtgcccgtgccgtgggcggagatcaggtcgacctgctcgggcttgacccccgcgtcgtccagagccagttgcatcgcccggccgacgctcgcgccgttcggggcgacctggtggtgggcgtcgcagttcagcccgtagccgaggacctcggcgtagatccgtgctcctcgtgccagcgcggacgacaggctctccagcaccagcactccggcgccctcgccggtgaggattcccttccggtccacgtcgaagggctggcagcgctccggggcgatggtgcccaggcggtagaagccggcgaacgtcttgcggcagagcgcgtcggcgccgccgcacagggcgaagtccacctccccggcgcgcaccgcgtcgtagccgtagccgatggcgtagttgccggccgcgcaggcggtcgggatggtgacggcctccacatcggtgagccccagctcgtgcgcgatggcggtggagagccgtccggcccgcacgcggcgggccaccacggggtccatgtgctggggtccggagcggatctcggtctcgaccaggctgtccaggtcgcgggactccccgtcggtggtgccgatggagatgagcccccgcttggtccgcagttcctcgggcagcagcccggcgtcctgcgtggccatcctggcggcggcgacggagaaccgggcggcccggcccagcttgtcgagatcctgatcacggatccagtcggccggttcgaaatcgctgatctcgcagccgttggcgtaggcgaagcccgtggtgtcgaagctgctgatgggcttggcaccgctgcgccccgcccgcagtccctcggcgaaggcggctgccccgacgccgatgctggagaacactccgaacccgctcaggaccactcgctgcgcaccgtccggatccgccggatccgcggagaacgacgtcatgaaatctccccaaccagtctcgatggtccgtggtgtggtgacgccgttaccagccggctatttcggcgacgacctggtacacgctcttgaggttgaccatccggccgagctcggcctggtcgatctcgatgtggaactccttctccagcgacgcgaggatctcgatggcgcgcagcgagtccgcgtcgtggtcctccttgaagaggctggtctccgtgacgtcctcgggctcgatctccaggatgtcgcagacgatgtccttgatcttttcctggcgctcgtcgatggcggtggtcatggtcggtctccttggcgtgtcgtggtgttgaggaaggtcgcgcggtgcggcccaccctggtgcactgcgggtgcgccggacggagccggtgcaccttgctgcagaggtcgtgctcgggccgcgtgctcagacgccggtgctggactgcacctgtccgtcgcccgcccgtcccggacgggagcgccgcaggtcgagctggacgaaggcgcgctggagccagcggtcccggccgtcgtagcgggggtggaacgcggtccgtccgtgcagggccagccggttgtcgacgtacgcgagatcgccgggctccagcacgacggtcctgcgggtctcggcgaaggcctcgccgagttcgtccatcgcccggcgcgcatcgtcgtccagcggccgggtgctggtgaagtcgaccttcacgtcggggtcctcggccgctccgctgaggatgccgtgcggctcgggcagggagctcagctcgccgaaggaggcgggcggggcggtgacgtagcgcggctcgtgaagcagccggcgggtctgctcggacagcatcggcagggcgttgcggatcgacgccacccgcagccctgcgacgttgtcgtggtcgttgcgcaggcacatcagcccgaccaggtccggccgcagcggatggaacgcgttctccacatgcatggtcagctgggtcgcgcccgcgttgccctggaagtcctccatgccggggaccggaacgacgtcctgtaccagggccccgtgcttctcctcccggaaggccatcagttcaccgagctggagggagatcagagcgaggaccgaggcgggcagcgaggtggagcgctggaccgaaccggccttgtgcggggtgtccggcagtacgtcggcgtgcaccgggaggttgcgcagcagcagcatcgcgtcggggccgggatcgcggacgaagcggcgcagcgtctgccgcagccggatcggaaggcgtgcggagaattcacgggccgcgtcgatccagacgcggtcgtcgatctctcgcgggtggatatcggtcagctcggccgcgaccctttcgagttcgcccttctcttcctcggtgagcgcaatgccggccttgcggtccagcacgtttccgacgtcgacggacatgtttctcctcgcctccgggaggtgggtggggcacaggaagccgcgccgccattgttcgatccggcgcctgcccagaatggctggcttcgaagggggaaatagctcccttgcaacaactggcaaaaagaagggacggctgctgtgcgccgctgaccggccgccggtcagagcaggcccatctgggcggcccggaccccggcctggaaccggctgcgggcgtcgagaccgaccatggtggaggccacgtcgttgcgcaccgtccggacgctgacgccgatacgccgggctatcgcgtcgtcggtgagcccgtcggcgagcagccgcagcacccgctcccggcgcggccgggacggcggagccgccagcggcgatgtcgcctgacggacctccatgctgttgtcccacagccggtcggccaggccgttcagcgcgtcgaggccggagccgccgcgcaggacgcgggcgccgccgcacgcgccgaagaggaccccgacctcgccgtcgacgatcacggcacgggtggggacatgcggcagggtgcacggagcggcgccctgcgcgcccagccaccgggcgtgttcgacagcggcgggccggtgcaggaacgaggcgctccacacctgccgcagcacggcctcccgtcggagcaccgcctcggcaatgtgccgggagaactcgaacgatcccggggagtggtcgggcaccagcagcaccacctcgcgccggacggtggccaccagccgctcgacgagagccgacgcctcgtcggcgctgccggtcccgagaggctcggccggccgttccaccgcccgctcgtgcacggcgatcagccgttccaccgccagcggtccggggagtccggcggcctgcgcgtcctggaaccggcgggtcgccagggccgggagcgccagggcgggttcgaccgcccgcagcgcgccgtcgtcgtcggccgaggccgtgacgagcccttcctcccgcagttccgcgacgacaccgcccagccactcctgcgtcgtgtcgagcacggcggcaagttcggccggacgccatcttcggcggcgcagcatcacgcgatagacgaattcggtctggcggtcgagtccgaccgcatactctcgttcgctcatctcgggcccccgtgaatatcatgaacatgcagagcgtgaaggcctctgtggcgaacggaaggtgatgtcaccgcagacacagagcacgacgcattccctcacgcccacggaatgcggataacaggacacacccacccccggacttcagtcctgcgggtgtcccgtcgacgaatcgtccggcattcagccaccggccgaattcacgttcccatgtttatccgcgccaccccgccggggcaatgccggctacatgaagctgccagtgcgaggcccgtcagaccgtcagaccagcacctagctgcaccgccgcgtcgatggccgcggccccgtgccgtctgccgggccggtggccgagccgtgaaatcgggcccgccacgcacacggcggcgaccacccggttgccggggccgcgcaccgggaccgccacggccgcggtctcgtggccggcgtcgcccgcgtcctccccgacggtctgcgcccatccctgctgccgtacgcaggtgagcgtcgccgcggtgaaccgcgctccgcgcaggctccggaagagcagttccggggcctcccaggcgacgagcacctgggccgccgcacccgcgtgcatcgggagggccgcgccgaccggaaccaggggtgacggcgcaccgcactccgcggcggcgaggcagaccctcagatcaccgtgcctgcggtagagacgggcactgacccccagccggtcgcgcagtccgtcgagcaccgggccggcggcggcgaccagccggtcccggcccgcctccaccgccatgtcccccagccgcggcccgaggacgaaccggccccgccggtcccgggcgaccagccgcagcttctcgagcgcggtcgccagccggtgcaccgtgggccgcttgagtcccgtgcgctccaccagctccgccagcgaagcaggccccagctccatcacttccatcagcagcgacgccttgtcgagcaccccgacaccgctgaccgcttccacccgttcgggagccacggcggtcatacccggaacctctttctcaccccgtcgcacggagtggacggtagggatgaactcgcttgcggcctggggaccgagtcggcaaggacccggaccccaggcatcccgacggcgtcaacgggggggaattcggccgccgcacaggggggttcgcggaagggagcgaacaccgcacctgacgcacccatcgaactgggtcgtggaggccggggcaatgccggcttcaggaacctgccagccgaaccacgccgcggacgagttgtgcgcggcggccgggtcgacgcggccaggagtatagagaacgcataggcaggtacccaaccctggagagatcgcccggcaggggcggatcacggaggaggggaccatgagccaagaagcggcgccggatccggcagaggtaccgctcggggacggcttggaggacttcccggaggggtactcggaggacggagcggccgacgacgaccaggggctgcgctgggccgcactgctggcggcgttcatcgacgacgccctgggcccgggtcccggcacaccgcccccggacgctccggccaccgagccgcccgcccccggggaggcgtgacgggcgaccgcggcgaggtgacgaccagcctagggggtgtcctgcgcctggcgggagaacagcaggcgcaccagcggcgagcaccggtagcgttccggtgc

SEQ ID NO: 3759 - DNA, 2406 bp, Unknown
  Kingdom: Bacteria, Phylum: Actinobacteria, Class: Actinobacteria, Order: Streptomycetales, Family: Streptomycetaceae, Genus: Streptomyces
acaccggctggatcgccctgcaccgggtggagatgaccggcctggactcgatggaatgggtgggctgggagaacttcgacaagatcctgcacgaccccgagttctggacctcggtcagcaacacgttcctgatcggcgtcatctccaccgtcccgcagctcctggtcgccctcggtctggctcacctcctcaactacaagctgcgggccagcacgttctggcgcacggtcatcctcaccccgtacgcgacctcggtcgcctcggccgcccttgtcttcgccctggtgttccgggccgacggcggcctgctgaactggacgctcggcctggtcggcttcgatccggtcaactgggccaacggccactggacctcgaagctcgccatctccatcatcgtgatctggcgctggaccggctacaacgcgctgatctacctcgccgcgatgcaggccgtccccaacgacctctacgaagcggcctcgttggacggcgcctcgcgttggcagcagttccgcaaggtcaccatcccctcgctgcggccgacgatcctgttcaccatcgtcatctccaccatcggctcgatgcagctgttcggcgagccgctgctgctggaggggggcgccctgggcgccaccggcggcaacgagaaccagtacgagacgctcagcatctacctctacaactacggctggaacctcggacatctcggtccggccgccgccgtcgcctgggcgatgctcgccctcctgctgatcatcgccgcggccaactggttcatcggccgattcgtccgcaagtccgcggtctgaccgggagcacatccatgaccctgaccagccccacccctgccccggccccggtgaagctcgcgccgacgccggaccgcaccacctctccccagcgaccgcgccgcttccggatgggcgcgggccagcagatgaaaggcggcccgttcgcgtacatcgcgctcgccgtcgtcggcttcggctcgctgctgccgctctactggaccctggtcgcggcctcccgcacccaggacgaagtcctcgcctccaccccgccgttcctcccgggcggcaagctgctggagaacgtccagaccgcctgggagcaggccaacctgggcaaggcgatcctcaacagcgtcatcgtctcgtcctcgatcaccctcgccacgctcttcttctgcacgctcgccgggtacgcgttcgcgaagatgcgcttccggggccggggctggctgatgaccgcggtcatcgccaccctcactatcccgccgcagctcagcgtggtcccgctgttcatgatgatgtccggcctcggctggggcgggcagctcgaatcggtgatcttcccgacgctggtgagcgctttcggcgtgttcttcatgcgccagtacctgatcgaggcgctgccgtacgagctgatcgaggcggccaagatcgacggcgcgaacaacctccgcatcgtggtgagcgtggtgctgccggtggcccgccccgcgatgatggtgctcgggatgctcaccttcgtccaggcgtggaacgacttcttctggccctacctcgccctgaaccagcagaacccgacccttcaggtggccctcggccagctcagcgcctcgtacacccccgaccagtccatcgtgatggcgggcgcgctgatcagcacactgccgctgctggtggtgttcgtggtcttcggcaagaagatcgtcggcgggatcatgtccggcgcggtgaagggctgaccccccttcccctcctccttccctctcacctctcatcccactttccctcagggagcgctcccacatgacagccgtccgacctgacacggtcccgcagcaggcccccgccgccacggcccccttcccgaccggtttcctctggggcgcggccaccgccgcgtaccaggtggagggcgcggccgccgagatgggccgcaccccctccatctgggacaccttcagccacacgcccggccggaccctcggcggggacaccggggacgtggcggccgaccacttccaccgctaccgcgacgacgtcgccctgatgaagcgcctcggactccaggcgtaccgcttctcgatctcctggtcccgggtccagcccaccggccggggacccgccgtggaacgcggcctcgacttctaccggtcgctcgtcgacgaactgctggcggccggcatcaagcccgtcgccacgctctaccactgggacctgccgcaggagctggaggacgcgggcggctggcccgagcgtgcgactgccgaacggttcgcggactacgcggccatcatggcccgagcgctgggcgaccgcgtgggcatgtggaccacgctgaacgagccctggtgctcggccttcctcgggtacggctccggggtccacgcccccggcc

SEQ ID NO: 3760 - DNA, 5190 bp, Unknown
  Kingdom: Bacteria, Phylum: Actinobacteria, Class: Actinobacteria, Order: Streptomycetales, Family: Streptomycetaceae, Genus: Streptomyces
cgtcgccctccctcgcctcctccggggaggcgagggagggcgacgaatcggcggactcgggcggcggagccggtgtcgagttcggcgtggacgtcagcatcggcgggggaagcgggagcgagggcggttccggttccggcggtgacggcgggagcagtggctccgggggcggcgcggcgaagcagccgcccgcgagcgacccgacgaccgaggctttccggagcgtgcgggtgggaagctgtctgcccatccaccggaccgggtccggtggcgactggaacgtcggcgccccgcccgacgcggtctcctgtgacacccggcgcgccggcctcttccgcgtcacgcggaccggcggcggcagcgtcgtctgcgagtcgggcgccggcagcacgtcctggacctctccccgctccggggcgacggaggccgtgaagctctgcctggagcggatctgggtgaagcggtactgcatcctcgccgaggacaacggcggcagcatgtcactggggtccaccaccgccgtcgactgcggagccaagcgcgtccccgtcccgtacaaccgggtcctggccgtctccggcgtctaccgtgccccggcggacgccaactccgcgcactgccgggagggtgcttcggacccgcgcacgtactggtccctggtggtcaccggccgcacgatcctggtctgcttcacctatccgaacacctgagggccgacccctcgcagccgtgtgcggtgtcaggagccgtgcatgatctggatcaggttgccgacggtgtcgtccaggatcgccgtggtgacggcgcccatctccgtcggctgctgggtgaaccggaccccgagcctgctcagccggtcgaactcggcctgtacgtcgtccacggcgaaggcggtggccgggatgccgtcctcgaccagggccgtcgtgtacggcctcacggcggggtgcttgttcggctccaggaggagttcggtgccgtcggggtcctccggcgagaccacggtcagccagcggtcctcgccgccgagcggaacgtcgtgcttcttctcgaagcccagtacgtcggtgtagaagcgcagcgccttctcctggtcctcgacgaagacgctggtcaggttgatcctcatggggtgctctccggtgtcttcggcccgagccatcggctaacgatgtgctcaagggggtcggtgttcaggtcgtggaacttgcagcggccctcgcggcgcgtgacgaccaggcccgccgcttccaggacggccaggtgctggctgacggcctggcgggacaggcccaggccgtgtccggtcgtcagccgcgcgcatatctcgaacagggtctggccgttccgttccgtcagttcgtcgaggatgcgccgccgggtggggtcggccagggccttgaagacatcgtccgccatgcccccacgataggcaagtagcgacttgcctatcaaggtggggaggtccggcttccccctgctccgtgccgccgggcgaggggtccgcaagggtgtgggcgccgacctgtcccggtcggggtccgcccggccgggcagttcgtcctcgcatcccccacggctccgagcgtgatccgccggacaccgcctacgtgggtgtgtcctgccggtcggccgccccggcggtcccgggggcgggagcggtctcggcgatgaccgggaagcggcgcggggccagggtgatcagggcgagcagagccagggccgcggctccggcggccccgatgtagacgtggtccaccgccgcgtcgaccgcccggcgcaggtagtccgtcgccgccgcggagagggcgcccgggtcctccagggcgcgggccaccgcgtccaggtcgtcggggaggccggtcaccggcgcgtcgaggaggcgtgcggccaggacgccgttggcgacggccccgaagagcgccgcgccgatgctctggccgacctggcggcagaagaggacggacgccgtcgtcgtaccgcgctccgcccagccgaccgtcgactggacgcccacgatcaggggaagctggaagaggccgagggccgcgccgagcaggagcatgaggagagccgggtgccagggctcgccggggtaggggagaagggggaacgccagcaggatcagcagggctgcgccgatgccgatgatcgcggtgagccggaatccgatgcggttgtagacccggtcggacagggccgccgtgacgggccagctcagcgtcatcacggagagcacgaacccggccgctatcgggccgaggcccagcaccgactgggcgtacgtggggaggaagacggtcggcgcgaccatcaacaggcccaacgcgccgagcgccaggttgaccgaggcgatggtgcgccgccgccacacccagcccgggatgatcggctccgccgcccgccgttcgatcacgacggtgagcgcggccagtaccgcgctcgccccgaacaggccgagggagggcgtcgagaaccagggccaggcgacaccgccctgtacgagcgcggtgagcagcagggcgccggcgcgaagacggcgagcgcgccgaggtgcatcggatgggcgtccgattcgaagtgccagaaagcgagatcgagcggggcgagaagctcggtacccaacgggggcctcatgtcgtcgaaggcggcagggccggggtgcggccggtcacccgcagtcaatcccttgcggtcgataacggtcaagcactgacatgttacgtactgttacgccaccgggtggattcagcgggccgggatgaggaattcgcaccacacgcatttgccgctgccccgggactccacgccccagacgtcggacagccggtcgaccagcatcaggccgcgccccgacaccccggactcccccgcgtcacggcgccggggcagtgcgctggagcggtcctcgacgtcgacgcgcagccgtcgctcggatccggcgagcacccggatcgtcacgacggcgccgccgtcggtgtgcatgagcgcgttggtgatcagttcgtcggccgcgagctcgatctcgtcggcccggtccttcgctccccaggcccggaccgcggcccggatcatgtgccgggacgaactcagcgcctcggggtcgttctgggcgacgtgctgctggagcctgccgcccggctgcggggcgtgcgcggcccggcggcgcagcagcaggaccgcgacatcgtcctggccgccgcgctcgtcgacggcgtcgcagagctggtcggccagcttctgaaggtccttggggccgttggtgaccagtgcggtgagcagttgcatcccttcgtcgaggtcggagcccggcagctcgacgaggccgtcggtgaacaggatcatcgtctggccggggtccagttcgaccgtgccgaccgggtactccagccggccgaactccgccgagaggccgagcggcagaccgccatcggacggcatcctgcggcagctcccgtccacgtcccgcaccagcgggtcgacgtgtccggcgcggaccagctggacgacgccggtggtgaggtcgacctcggcgtaggtacaggtggcgaagcggtcggtgtccagttcatggaggaagacggaggcgcgcgccatgaccgtggcggggctgtgcccctcggcggcgtacgcgcgcaggacgatcctgagctgccccatgacggctgcggcgtgggtgtcgtgcccctggacgtccccgatgacggcgccgacccggccgccgggcagggggatcaggtcgtaccagtcgccgccgatgtcccggccgaggcgggccgagcggtagcggacggcgacctgcgccccgggtacggccgggatgcggcgcggcagcatcgcctgctggagtccctcggcgaggtcgtgctcctgctcgtagagcatcgcgcgctggagactctgggcgatcgaggtgccgagcgccatcagcagattgcgctcgtcggcggtgaagccccccttgtcccggtagaggaggccgagggcgccgatcgggcgggcctgggcgatcagcggcatgtaggcggcggaggtgatcccgaggtggctgatgtcgggccacaggaccgggtaggaggcggcgaagtcgtcggcggactcgatgaagcgcggggtcagggtgcgcaccacttcgctcatcgggtactgctcgtccacccgggtgtaccgggtgccggggacgtacgccccctcggggccgtcggccacgaggtggatgcggccggactccagcaggcccatgacgaggctggtggctccgaggtgggcgagcccctgggagttcttgaggacggcgatgacgtccttgaccgtacgggcgtgggccagtgcggcggtggtgccctcgaccaggctcgtgcgccggcggcgctcctcgtccagctcgcggcgggcggtggagtcggccagttcctgggtggcgtcgcggacgatcccgatgatgcggcgcgggcggccggtgccgtcccggcggacgaagccctgggtgtgggtccagcgcagcgtgccgtcccgccggtggatccggaagtacgcgccgtagttggtgcgaccgctcttcagggcgtgcgagaccagcccgtccagacgctgggcctcgtccgtcggcacgcgcggcgccagcgaggccggccggtcgtcgtactcgtccgcggtcaggtcgaacacgtcgagggcggcgcggtccatgtgcatgaggccggtgtcaagatcccagtcgaagctgcccatacggttcagggcgaggctgaggtccgggtgggcgggccagtcgtcggggagtgacagggcacccgctacccgatcatccatgtgggccactctgccaccatttatccgattcctcttgtccgatccgccgaccggtccgtacggcgtccgggggcggtgccgtacggattccgccgacgggccgcgagccttggcgtccgggaccgtcagccgacgaacacgtcgtcgaggcccgcttccatgggctcgtccggcccgaggggctcgacaggtccgtcgggccccgggggctcgtccggctcggcggggaggacctgggtcggctccggcgcgacgtccgggtcaccctcctcctcgtactcccacggctcctcgggcggcgtgtcaccgaagtcgtcggacggctccgcgggtccggggtccgtgggcgcttccggctcggcagggccggaggggccc

SEQ ID NO: 3761 - DNA, 3554 bp, Unknown
  Kingdom: Bacteria, Phylum: Actinobacteria, Class: Actinobacteria, Order: Streptomycetales, Family: Streptomycetaceae, Genus: Streptomyces
cccgcctccggcaccctcaccgccctgcacgccgcccccggccaccaggtcgaggtcggcgcgctgctcgccgtggtccaggaggaccccgccgccatccccgtaccggaggagaccgcatgagcaccgccctcgaaaccgaagagcaccaggccctgcgcgccgccgtcgccgccctcggcaagcggtacgggcgcgactacatgaccaccgtcatccgcgagggctcccacaccgacgaactgtgggcggaggccgccaagctcggctacctcggggtgaacctccccgaggagtacggcggcggaggcggcggcatggccgaactctccatcgtcctggaggagttgggtgcggcggggtcacccctcctcatgatgatcgtgtcccccgcgatctgcggcacggtcatcgcccgcttcggcacggacgaacagaagcagaagtggctgccgggcctcgccgacggaagcctcaccatggccttcggcatcaccgagcccgacgccggctccaactcccaccgcatcaccaccaccgcccgccgcgacggcacgggtccggacgccgactggctgctcaccggccggaaggtcttcgtgtccggcgtcgacatagccgacgccacgctgatcgtcggccgcaccgaggacgcccgctccgggaacctgaagccgtgcctgttcatcgtcccgcgcgacgccgagggcttcggccggaaccagatcgacatggaactccacgctcccgagaagcagttcgagctggtcctggacgacgtgcgcctcccggccgacgccctggtcggcgacgaggacgcgggcctcctccagctcttcgcgggactcaaccccgaacggatcatgacggccgcgttcggtatcggcatgggccgctacgcgctcggcaaggccgtcgagtacgcccgcacccggcaggtctggaaggccccgatcggctcccaccaggccatcgcgcacccgctggccaccgcgcacatcgacctggagctgtcccgcctgatgatgcagaaggcggcccggctgtacgacgacggcgacgacgtcggggcgggcgaggcggcgaacatggcgaagtacgcggcgggcgaggcgtgcgtgaaggccgtcgaccaggccgtgcacaccctcgggggcaacggcctgacccgcgagtacggcctcgcgtccctgatcaccgcgtcccgggtggcccggatcgctccggtcagccgcgagatgatcctgaactacgtctcgcaccagacgctgggcctgccgaagtcgtactgagcctcgcggccccacggccttcccgatccgcttccgtccgacctctccccatccctcccccacaggggtgattctgaccctccacacccgcacggcgtcccgcgccgccacccgggcggcgcgggcatccgcgacgacaggggaccgccatggtgttccgcagcgagtacgcagacgtaccggccctcgacacgcccatccacgaagcggtcctcggcgaggccgccgggttcggtgacaccgtcgccctgatcgacgggacgaacggcacctccctcacgtacgcccagctcgacggcttccaccggcgcatcgccgccgcgctggccgaggccggtctccgcaagggcgacgtcctcgccctccacagcccgaacaccatcgcctacccggcggtcttctacggggccacccgcgccggcgcctccgtcaccacggtccacccgctggccacacccgaggagttcgccaaacagctcgccgacagcggggccacgtggatcgtcacggtctccccgctcctgacgaccgcccgccgggcggccgaactgaccggcggcatcagggagatctacgtctgcgaccaggccgagggccacacctccgtcctggacatgctgtcctccaccgctcccgagccggaggtcgccatcgaccccggcgaggacgtcgcggcgctcccgtacagctccggcacgacgggcacccccaagggcgtgatgctcacgcaccgctcgatcgcgaccaacctggagcagctgagaccgttcatcccgatgggcgagggcgaccgcatcctggcggttctgcccttcttccacatctacggtctgacggcgctcatgaacgcgccgctgcgctgcggctcgacggtcgtcgtgctgccccgcttcgacctggcgcagttcctggaggccatccagacgcaccggatcaccggcctgtacgtggcgccgccgatcgtgctggccctggcgaagcacccgctggtgggggagtacgacctctcctcgctccagtacatcgtcagcgccgccgccccgctcgacgccgacctggccgccgcctgctcggcccgcctgggactgccgccggtgcggcaggcgtacgggatgacggagctgtcgcccggtacgcacgtggtgccgctctccgtcgagcagccgccgcccggcacggtcggcaagctgctgccgggcaccgagatgcggatcgtgtcgctggaggacccggcggaggacgcggagccgggagcggacggcgagatcctcatccgcggcccccaggtgatgaaggggtacctgggcaggcccgacgccaccgcggacatgatcgacacggacggctgggtgcacaccggcgacgtgggacgggtggacacggacggctggctgttcgtcgtcgaccgggtcaaggaactgatcaagtacaagggctaccaggtggctcccgccgagctggaggccctgctcctgacgcatgagcagctcgcggacgcggcggtgatcggggtgtacgacgcggagggcaacgaggtcccgaaggcgttcctggtccggagcccggccggggacggactgacggcggacgacgtcatgacgtacgtcgccgagcgggtgtccccgtacaagaaggtgcggcaggccgagttcatcgaggcggtgccccgggccgcgtcgggcaagatcctccggcgcgagctgcgcgaccgggagaagacggaccacgcggaaacaccggaggagaagtgaccctgatcggacggacggcggaccggggagtgacgacgctgacgctggactccccggcgaaccggaacgcgctctccgcgtccctggtgggcgaagtccgcgcggcactggcggcgtgcgcggcggatcacaccgtacgggcggtgctgctcacccacaccggcacgacgttctgcgccggggcggacctgaaggcgccgccggacccggaggcgttcgtgggcctgatgcgggagatcgtggcgttgcccaaaccggtcgtggcccgggtggcgggccacgtccgggcgggcggtctgggcctgctggcggcgtgcgacatcgcggtggcgggcccggcgtccaccttcgccctgacggagtcccggctgggcctggctccggcggtcatctccctcaccctgctcccccgcctggaccgcacggcggcgaaccgctactacctgaccggtgagcgcttcgacgcggcggaggcggcctccgtgaccagcgagaggctggccgccgccgc

SEQ ID NO: 3762 - DNA, 814 bp, Unknown
  Kingdom: Bacteria, Phylum: Actinobacteria, Class: Actinobacteria, Order: Streptomycetales, Family: Streptomycetaceae, Genus: Streptomyces
  misc_feature (425)..(471): n is a, c, g, or t
gctccgccgcgcccttgaggaagccctcggggtccggcttgctggcgccgacctgctcggcggtgacgcggacggcgggcatcggcagcgctgccgcacccatccgggccgtcgcgagcgcggtgtcggcggaggtcaccagtgcgtgcggcagctcggtgatcgccgccatgaacgcgggcgccccgccgatcggcacgacgccctcgacgtcggcggtctcctccgccagcatcacccggttgtccgcgtagttctcctccacggggcggtccggaagcaggacggccatcgtggcgtacccctggcggccgtggaccaccttgagcgccgcctcggggtccagcccgtgctcgaccgcccaccgccgccagcagcgctccaccaccgcgtcggagttcacgagggtgccgtccatgtcgagnnnnnnnnnnnnnnnnnnnnnnnnnnnnnnnnnnnnnnnnnnnnnnngggcgcgcgtgcggcggggcggtaccagagcaacccccgcccgccggtcagggagtgcgggcgggagctactttgttccatcacgatacaaaaagccgggccggaacgccaatccccctgctcaccgtccggatctcagtggcgtccgcgtccgttcgtctccgcctccagcgcgcgccgggtgttcggcccgtacacgcccaccgggtcgccctggatcgccttgtacgactggtagatggccaccgcgttctccacccggtcgctgtagttctggtcggtcggacccgagtagagccacacctccctgagccggttctgcagtacgccgacctccgggccg

SEQ ID NO: 3763 - DNA, 1591 bp, Unknown
  Kingdom: Bacteria, Phylum: Actinobacteria, Class: Actinobacteria, Order: Streptomycetales, Family: Streptomycetaceae, Genus: Streptomyces
cccggcaggtgctcaggcgtccctgcgtgcggccgccccgccgcgggcgcggtaggcgcgcatcttgtgccgtgcgccgcacacgtccatgtcgcaccagaggccgttcgacgacggcgcccggtcgtagaagacccagcggcactccggggcggcgcacgccttgaggcgggtggcgtgacgcccggtcaggccgtggaccaggagcgcttcgagcaccgggcgcaccacctccgccaccgccccgccggaggccggccgcagggcgagtgtgccgtcggggcgcacggccggagcacccgcgaccgcggcgatgagccggttgagagcgtcgaccgcctccggcgaggtccgctcgaccagaaaggcccgcacggtctcccgcgcctccgcgagcgaggccagatctcccggatcgatcgacgccgggaagccgtgcgcgccgagccatcgggccgccgtctccggccgggcgaggtcgtcctcgttgtggagatgggtggccgtgttgcagaagtcctcgaccagttcgagctccgcgggcgcagggttccgtcgcatgatcgccactttaccaaagttaccgacaaaccggcttagctggtaacgtcgatggtccggcggggttccgcacctcccaaccgcacatcaggaggctcaccatgatcgggaagctgaccaggacgttcgacactccggacggggcggtgcgctgggacgtgctggggaagggggagccggtggtcctgctgcacggcaccccgttctcctcgctcatctggcgcgacatcgccccggcgctcgcccgcgaccaccgcgtccacctctgggacctgctcgggttcggacagtcggagcagcgcgacgggcaggacgtcggcccggcggcgcaggcgaaggtgttcacccggctgctggagcactgggagctggagcgcccgcgcgtgatcgcccacgacatcggcggggccgtggccctgcgggcgctgctcctgcacggtgcgcggtacgcggacctcaccctggtggacgcggtggcctgcggggagtggggcaccgggttcttccggctcgtcagggagaacgcgcacctcttcgagcaactccccggctacgcccacgaggcgctcgtcgagagccatctgcgccacgccacgcacaccggctaccgcccggacgtcctgtccgcacatgtcgatccgtggcgcggcgagcgcggccgggccgcgtactaccgccagtaccggcaggccgaacaggccgcgaccgacgagttccagcacttgctgggggacgttccggtgccgacccggatcatctgggggcgtgaggaccgcttcctgccggcgcccttcgccgagcagctgcacgcgctgatcccgcactccgaactgcactggatcgagggcgcgggccacacggtgcaggaggacgcccccgcgcagctgctggccctgctgacccgggacttccggccgaccgacgccgggggcggggcctgggcctgagcgcactccgacgggcggtgcccggcgtacggccgcacgttcccgtacggcggcccgcacgagagcgcgggccgccgtacggg

SEQ ID NO: 3764 - DNA, 5989 bp, Unknown
  Kingdom: Bacteria, Phylum: Actinobacteria, Class: Actinobacteria, Order: Streptomycetales, Family: Streptomycetaceae, Genus: Streptomyces
ggcggcctgcgcggcctcgatcgccctccggaccgcggggtccgtgctgcggcggaccgctcgcccggtggcgcgtccggacgccgacgcctgaccgtcggcgtcgagcacctccgcgtccacgatctccggcaacggcacctggcggaccaggacttcctgcccgctgtaggtgtcgaacgcccgggtctcggccagttcgtacccatcggacgggggcagcggaaggcggtagcggtcggcaagcacccgacccgcgtagtcgtccacgacgcctccccagagcgcgctcttcccccggccatcggaaccgcgccaattcgtcggtcacggtcgtccggcgggcaattgacccgccgttccggctgcgtacggcctccggcctcttacgatacgtggcaacgcgggccgacgggccgggtcgtgccaacccggcccgcacaaacgtttcccatcgaccgatccagagcgttccgggcggtcagttaccgggtgcgccgggcggtcagcccgtgggggtgaacgtggcgaacgccgtttcgcgcagcgtccggcactcgtcgccctgccactcgtccaccttgcagctgatcatgatcgagtagccgcgctcggcgtccaccttgaagccccggttgagcaccttgacccggacgccgttgtggttgcgttcgaacgtccagtcagcgacggtcggatagccgttgtactcgaccttctttatgccgccgtgcttgtagccgtcgctgaggaccttggcgctcgcgacggccccgcgccaggcggccgcagcgtcgtccttgggcgagttgttgaagtcgacctggacgcgggggaagctgccctgcttgtcgttgtagatgccgccggagttgctgcccgcgatggcggtgcgcttgaagcccccgggcatcgccatggtgaagtggaaccgggtgtcggtgaccttctcgtacccggcgggaagggcgtcgcccgggcccgtgccgtcgcccttggggtcgtcggacccggagtcgtcggcgtcgtcgccggacgggtcctcggaggcccggccgtcgtccgtgccctgaccgtccttctgaccgccgcccttctctcccgccgaaccgccgccggtgtcgtcgcccttgtcgtcggcgcccccggacgatgctccggccgacgcggcggtgtcgcccttgccgccgccgttgtccgcgtcgtcgccgccgagagtgagcgcgaggaccgtgccgagaacggccagcgcgacgacggccgcgatgatcgcgagggtgcggcggggcaccacgtcggtgatcgaggcacgcgtggacgcggccgaggacggcgggcgctgtccgggtacggaagcactcgccgccgtcgtcggcttcggggcgccgatgggcgcggtggaggccgcgacggctcccttcgcggccgtcggcgtggacgcggcgggcttcgcgcccgggaccgaagacccgggcggagacggaggcttgggcggggcgacgggcgagccggcggcggcggccggagagctcgccgacgccgcgaccgcgcccgcggccaccgccggggtcttcgcgttgcgcacggagcgcagggctccgcgcagccggtcgcgggcgccctcgccggactcgcccgacccggtggactgcttcggcggcttgggtgccttgggctgcttcggcgtccgcttgacgagggggtcggcggcgggcgccggcggcagcgccatgatctgggtggagtccgcgggggccggcgcgggaacgtcgggggtgttgatgacgtcgttgagcaacgcccgcgccccggcgtcgtcgaggcgctggtcggggtcccgggcgagcagtccgtagatgacctcggtgagcggaccggcgttcttcggcgggtcgagcggttcggtcatcacggccgtgagggtggcgatggccgagcccttgtcgtacggcgggcagccctcgacgctcgcgtacagcagtccgccgagcgaccacaggtccgcgggcgggcccggcttgtgaccgcgagcccgttccggcgagatgtacgagggggcgccgacgagcatgccggtggaggtgaccgacgggtcaccctcgacctgggcgatgccgaagtcggtgagcacgacgcgcccgtcctcggcgatcagcacgttggacggcttcacgtcgcggtgcagaatgccctcgcggtgcgccgagcgcagcacgtcgaggatggcgagtccgacctcggcggcccgcctcggcgtcagcgtgccgtcctcccggatcgcctcggcgagcgacttgccctcgatcagctccatgacgatccacggacggtcgtcctcgtcgaccacgtcgtagacggtcaccgcgctgttgttgcggatccgtgcgatcgccttggcctcacgcagggtgcgcgtgatcagccggcgcttctcgtcctcgtcgatcgccgaggggaaccgcagttccttgaccgcgaccgtgcggcccagcgtctcgtcgtgggcgcgccagaccgtacccatgccgccccggccgagcacctcaccgagccggtagcgccccgcgaggagacgaccgtccttgtcccgttggggctcccgtgcctgctccgcctccgacatgcgtcccctctgcgatcaacccgccctggcagagcgttcattgtccctcaccccgggaccggtcctggtgccgggtccggggtccgccgcgccgcgacccgaagagggaagcccccacagcctcctacctacccggcctccccgtccaggccggtccgggcgtcctcccccgctccaccgggccgacggagcccaactggcccggtgaagcagggcggtgaccgcggcaccgggaccccgcggccccgggagaccgtgtcctagatcggcacaatgtccggtgcgccgagccgggccgcgtccgccgtgaggtcgtcgggctgccgctgcgactcgcgttcggcctccacccgcttctcgtagtgctggacctcccggtcgatccgttcctcgtcccagtccagcaccggcgccatcagctccgcgcagagccgggcactgcgggtgccccggtcgaaggtctcgatggagatccgggtgcgccgggtcagcacgtcgtcgagatggcgggcgccctcgtgggaggccgcgtagacgatctcggcgcgcaggtagtcgtcggcggcgggcaggggttcacccagggtgggatcggcgaggatcagttccagaatttcctcggtcattgagccgtaccggttgagcaggtgctccactcgggcgacatggagtccggtccgggccgcgatccgggcgcgcgcgttccacagggccttgtatccctcggctcccaggagcggggtgtcctcggtgacgcaggcggcgacccgctggtcgagtccgtgcaccgcctcgtccaccgcgtccttggccatgacccggtaggtcgtgtacttgccgcccgccacgacgaccaggccgggagcggggtgggccaccgtgtgctcgcgcgacagcttgctggtggcgtccgactcgccggccagcagcggtcgcagtccggcgtagacgccctggacgtcgtccctggtcagcggggtgttcaggacggagttgacgtgctggaggaggtagtcgatatcggcgctggaggcggccgggtgggccttgtccaggtcccagtcggtgtccgtggtgccgatgatccagtgccggccccaggggatgacgaagaggacggacttctcggtgcgcaggatgaggccggtggaggagtggatgcggtccttggggacgaccaggtggatgcccttggaggcccggacgtggaactgcccgcgctcgccgatgagcccctgggtgtcgtccgtccacacgccggtcgcgttgaccacctgcttggcccggatctcgtactccgtgccgccctcgacgtcctgcacgcgtgcgcccacgacccgctcgccctcgcggaggaagccgaccacccgggccccgttcgccacctgggccccgtaggacgcggcggtgcgcaccagctcggtgacgaagcgggcgtcgtccatctgggcgtcgtagtactggagggcgccgaccagggcgtccttcttcagcgcgggagcgacccgcagggcgtgcttgcgggagaggtggcggtggacggggaggccgcggccatggccggaggagaccgacatcgcgtcgtacagcgcgacgccggagccggcgtagagccgctcccagcccttgtgctgcaaggggtagaggaagggcacgggcttcaccagatgcggggccagccgttccaggagcagcccgcgctccttgagcgcctcccggaccagggcgaagtcgagcatctccagatagcgcagaccgccgtggatcagcttgctcgacctgctcgatgtgccggacgcccagtcgcgcgcctcgaccagaccggtcgagaggcccctggtggcggcgtccagcgccgtgcccgcgccgaccacacccgcccccacgaccagcacgtccagttcgcgctcggccatggcggcgagcgcgatggtgcgctcggcgggtcccagtgtcgctgtcctcactgctgcctcccggtggatcggggtggtcggacacgggagtgccacccggccgaggggccggccgcccgtgtccacccctcgattctgtccgcgctccccgagttcagccaccgcctgtggacaacacccgggcgaccggagccacgcaatgcgacatataggtcatatttacgcctagtctgacattgcgctgtccacagcagttgcgatcttcgctctccgcacttagggggtcttcctgtatgcccgcagacctcgccgtcatcggactcggtcacctcggcctgcccctcgcccaggccgccgtgaccgccggaatcgacaccgtcggctacgaccccgacccacgcccctacgcggaactcagagccggccgcagtcccgtcgagggcaccctcaccgcgtccgagatccgccgcatgctctccggcggcttccggcccaccaccaacgccgccgagctcggccgggtccgtaccgccgtgatctgttcccccaccccgctcggccccgaccggacgatcgacctcaccgcgctcggcgacgccgcccgcgcgctggcggcccggctgcgcccgcacaccaccgtgctgctggagtccgccgtgccacccggcaccaccgagaacgttctgcgtcccctgctcgaagagggctcgggactcgtcgccggacgcgacttccatctcgcctgctcaccgagccggctcgaccccggcaaccgcacccacgtcctggccaacacccccaaggtcatcggcggcctcacccccgcctgcaccgagtcggccgccgccttctacggacggctcaccgacaaggtcgtacgggcccggggcccgcgcgaggcggagatgacgaaggtgctggagaccaacttccggcacgtcaacatcgcgctggtcaacgagatggcggtgctgtgccacgacctcggcgtcgacctctgggacgtcatccggtgcgccgagaccaagccgttcggcttccagcccttccggccgggacccggcgtcggcgggcacggcgtcccggtggacccgggctgcctgccctacagcacccgcacccccgggcacccgctgcggatggtctcgctggcgcaggagatcaacgaccggatgcccagttacgtcatccagcgctgcgcgaccctcctgaacgagcacggcaagtccgtccggggcgcgcgcgtgctgctgctcggcgtcacctacaagccggacagcgccgaccaggaggccgcccccgcccgcgagatcgccacccggctgatggacatgggcgcccagatcggctatcacgacccccacgtcctggactggcgggtgcgcgaacggcccgtcccgcgcgccgactcgctgtacgaggcggcggccgcggccgacctgaccgtgct

SEQ ID NO: 3765 - DNA, 4604 bp, Unknown
  Kingdom: Bacteria, Phylum: Actinobacteria, Class: Actinobacteria, Order: Streptomycetales, Family: Streptomycetaceae, Genus: Streptomyces
cccggccccgggcggtgccggagcgccgcgcacggcaccgccggccgccggggtgccgcgtgaagcccgaccgccgccggggtccgctcagccggaccccggggcgtacgtcccgaagctccacacattgccttcggcgtcccgtgccatgtagtcccgggagccgtagtcctggtcggtcggctccatgaggatctccacgccgaactccttggcgcgggcgtagtgctcgtccacctcttccaccaccacgtacacccccgccgggcccgcgcccgtcatcgcctgcgcgaacagtccctcgcgccccctggagccgagcatcaccctgccgttgccgcaggacagctcggcatgcagcacgctgccgttctctccctcgtagaccgcttcctcggtgaagccgaggccctgcgtcagcgtcctgatcgcggccttcgcgtcgtcgtacaggatcgtcgggtagatcgtgggaacgccgctcgccccgtctgtcatcgcactcacctctcccggtgtcgcctctgccgtccggaccacgtgatgtgatctgcgtctcagtcttccaccgggcactgacaatgccctcccgggaagcgttcccgcaggtcaggtgtgttgggttcggttcggttcaggcgaaggtgtcgcactgcgccatgtcgcccgtacggaacccggtggagaaccactgctgccgctgcgcggccgaaccgtgcgtccacgactccggggtgacccggccctggtacctctcctggatccggtcgtcgccgaccgcggccgccgcgtccaggccgtcccggacatccgcccgggtcagctccgtgatcagcggccggccggtcgactcgtccggcgtcgtcgtggcgtggtgcgcccagaccccggcgtagcagtcggcctgcagctccaccttcaccgcgttgctgttctcgccctgccgcccgtcctgcgaccggctcagcgtgcccatctggttctgcacgtggtggccgtactcatgggccacgacgtacgcctgggcgaacggcccgccgctggagccgaacttcgtccgcagttcgtcgaagaacccgaggtccagatagaccttccggtcgccgggacagtagaacggcccgaccgccgaggtggcggcgccgcacgcggttccgacctgctggctgaacaggaccgtcggggcggccgagtagtccgcgtcgcgccgcgcgaactcctggcgccagaagtcctgcacgctgttgaccactgccaccgtccggcagtcctcccggctgttcgcgtcctgccccttcaggcagctctcctgcacctgccccgccgacgacgaggtcgccgcggggtccgcgtcaccggaggagagcccgagctgatcgggcccgacgccgaagagcaggcccaggatcagggcgatcaccccggcgacgccgccgcccacggtggctttcccgcccgggatccggctgccgcgaacatcctggacctcggaggtgtccagatcggcgtcgtcgtcgaactgcacggtcgcaccaccctcgggctcgggtgggcgacggggtgccgccctgcgccgagtatcggacggttcgtcccgacaggcacgcggaaaagaagttgcgcaccgccagtagaatgggccgtatggccttcctccttgtgcattagcggcgtcgagagacctccgccctcgtccctccgccgtccatactgccctggagtttttccgtgatcaccgcttccggcatcgagctgcgcgccggcgcccgcatcctcatcgaatccgcttccttccgcatcgccaagggcgaccgcatcggcctcgtcggccgtaacggagcgggcaagaccaccctcaccaagtgcctcgcgggcgagggcacccccgccgggggcaccatcaccaagtccggcgaggtgggctacctcccgcaggacccgcgcaccggcgacctcgacatcctcgcccgcgaccgcatcctctccgcccgcggtctcgacgcgatcctgcgcaagatgcgcgagaacgaggaccggatggcgaacgggcagggcgccacccgcgagaaggcgatgaagaagtacgagcgcctggagacggagttcctcaccaagggcggatacgccgccgaggccgaggccgccaccatcgccgccgcgctcagcctgcccgaccgggtgctcggccagccgctgcacacgctctccggcggtcagcgccgccgcgtcgagctggcccggatcctcttctcggacgccgacaccctgctcctggacgagccgaccaaccacctcgacgccgactccatcgtctggctgcgcgactacctcaagtcctaccgcggcggcttcatcgtgatctcccacgatgtcgacctggtcgagacggtcgtcaacaaggtgttctacctcgacgccaaccgcgcccagatcgacatctacaacatgggctggaagctctaccagcagcagcgcgaggccgacgagaagcgccgcaagcgcgagcgccagaacgccgagaagaaggccgcgaccctcaacgcgcaggccgacaagatgcgcgccaaggccaccaagaccgtcgccgcccagaacatggccaagcgcgccgaccggctgctctccggcctggaggccgtgcgggtctccgacaaggtcgccaagctgcgcttccccgacccctcgccctgcggcaagaccccgctgatggcggagggcctctccaagtcgtacggctcgctggagatcttcaccgacgtcgacctcgccatcgacaagggatcccgcgtcgtcatcctcggcctcaacggcgccggcaagaccacgctgctgcgcctgctcggcggcgccgagaagcccgacaccggcgagatcatcgaggggcacggcctcaagctcgggtattacgcccaggagcatgagaccctcgacccggagcgcacggtcctggagaacatgcgctccgccgcgcccgacctcgacctcgtggcggtccgcaagacgctcggctccttcctcttctccggcgacgacgtcgacaagccggcgggcgtgctctccggcggcgagaagacccggctcgccctcgcgaccctggtcgtctcctccgccaacgtgctcctgctcgacgagccgacgaacaacctcgaccccgccagccgcgaggagatcctcggcgcgctgcgcacctacaagggcgcggtcgtcctcgtcacccacgacgagggtgccgtcgaggcgctccagccggagcggatcatcctgcttccggacggtgtggaggacctctggggcgcggactaccgcgacctcgtcgccctcgcctgatccaccggggatagatcattcggcctacgcgtgatccatcatctgcgtgaggacgtctcgtactccggtggtgcgcccggcgctcacctgccgggcgccccttttccggccgcctttccccgtacggccctgacctgcctgttctccttccggtcagggccgtacgctctcgtgcgccctttggaatcggggattccgctcgtgtcgacgtgcttctcgtccgggaaaccgctcgcaccgaccttgccgaatgggtggccaggaagcgcgggaggggtgatcatgagagtccagagcgcacttcccatgaggaggcacgggtggccgagactctgaagaagggcagccgggtaaccggcgccgcgcgtgacaagctcgcggcagacctgaagaagaagtacgactccggtgcgagcatccgggcgctggccgaggaaaccggccgctcctacggattcgtccaccggatgctcagtgagtccggagtgacgctgcgaggacgcggcggcgcgacacggggcaagaaggccgcttcggcctgaggcctccgaccctttcggcgtgccgacgtttcggcgtcatcgggcccaacggaattcggggtggccacccggctgaccgcaaggtcgtccgggtggttactgttcagtcacttaataacgagtgctgactgcaccccatccggaggcgtcccatgacctcgctcgacactgtgctcgacaaggacggcgtacggctcaccgtcgacgacgccgtcgccacggtgacgctcaccaatccggccaagcgcaacgctcagtctcccgctctgtggcgggcgttgaccgaggccggaagggcgctgcccggcacggtccgggtcgtcgtgctccgcggcgagggcatgtccttctccgcgggcctcgaccggcaggccttcactcccgagggcttcgacggcgagccgtcgttcctcgacatggcgcgtggcccggaggccgagctcgacgcgaccatcgccgaataccaagaggcgttcacctggtggcgccgcaacgacctcgtgtcgatcgcggcggtgcagggccacgccatcggcgccggcttccagctcgccctcgcctgcgatctgcggatcgtcgccgaggacgtgcagttcgccatgcgcgagaccagcctcggcctcgttcccgacctcacgggcacccaccccctggtgcacctcgtggggtacgcccgtgcgctcgaaatctgtgccaccggccgcttcgtgcacgccgaggaggccgagcgcaccg

SEQ ID NO: 3766 - DNA, 3536 bp, Unknown
  Kingdom: Bacteria, Phylum: Actinobacteria, Class: Actinobacteria, Order: Streptomycetales, Family: Streptomycetaceae, Genus: Streptomyces
cgctgccgtacggggacggccgcccagcccgtctgggccgccgtccccgtacggcagcgggccgccgttctgctgcgcttccacgacctcgtcctcagccgccagtccgaggtcctcgacctcatccagctggagaccggcaaggcccggctgcacgcccacgaggaggtgcaggccgtcgccgtcgccgcccgccactacgggcgcaaggccgtctcgtacctcaggccccgccgtcacaccggcgtcgtcccgaccctcaccaaggtcaccgaactgcgccagccgcgcggcgtcgtcggccagatcgccccctggaactacccgctcgaactctccgtgggcgacgcgctgcccgcgttcgtctccggcaacgccgtcgtgatgaagcccgacacggagaccgcgctcaccgccctgtgggcccgcgacctgctgatcgaggccggactgcccgccgaggtcttccaggtcgtcctcggcgagggccccgtcgtcggccccgaggtcgtcggccgcgccgactacgtctccttcaccggctccacccgcaccggccgcgaggtcgccgtcggtgccgcgtcccggctggtcggcgtctccctggagctcggcggcaagaacgccatgctcgtgctggaggacgccgacgtcgagaaggccgccgccggagccgtccgcgcctgcttctcctccgccggtcagctctgcatctccatcgagcggctgtacgtccacgagtcgatcgccgacgacttcgtggagcgcttcgccacccggacgaaggccatgcggctcggcaacgccctcgcgtacggggccgacatgggctccctcgtcggcgaacgtcagctggagaccgtcacccgccatgtcgacgaggccgtcgagaagggcgcgaagctcgtcgccggaggcgtcgcccgccccgacatcggcccgctgttctacgagccgaccatcctcgacggggtggagaccccgatggccgtctgcaccgaggagaccttcgggccggtcgtctcggtctaccgcttcagcgacgaggacgaggtgatcgcgctggccaacgccactccgtacggcctcaactccagcgtctggaccaccgactcccggcgcggccaccaggtcgccgcccggctgcgcaccggtaccgtcaacatcaacgaggggtacgcccccgcctacggcagcgtccagtccccgatgggcggcatgaagcagtccggactcggccgacggcacggctccgagggcatcctcaagtacaccgaggcccagaccgtcgcccagcagcggctgatcccgctcgcgcccgccttcgggatggacgacgagaagtacgccgcgttcatgacccgcagcctcagggcgatgaaggcgttccggctgcgctgaccgccccagcgacttccgcccttttcgtaccgatcccgttccgaggagtgccatgtcccaggacagccctgcccagaaacaggccgtgagccacgtcatggccgaggacgacgccgcgtacgactacgacgtcctggtcgtcggatcgggcttcggaggcgcggtgtcggcgctccggctgaccgagaaggggtaccgggtcgggatcctggaggcgggccgccgcttcacccccgccaccctccccaagacctcctgggacctgaagaactacctctgggcacccgcactgggcctcttcggcatccagcgcgtccacctcctcggcaacgtcatggtgctcgccggggccggggtcggcggcggatcgctcaactacgccaacacgctgtacgtgccgcccgccccgttcttcgaggaccgccagtgggcctcgatcaccgactggcaggacgaactgaagccgtactacgaccaggcccgccggatgctcggcgtccgcctcaacccgaccatgaccccctccgacgtccacctcaaggccgccgccgaggccatgggcgtcggcgacaccttccatctggccccggtcggcgtcttcttcggcgacggcaaggacgccgacggcaccgcgagggccaggcccggctccgccgtccccgacccgtacttcggcggcgcgggccccgcccgcaaggcctgcaccgagtgcggcgagtgcatgacgggctgccgccacggcgccaagaacaccctcaacgagaactacctccacctcgccgagaaggccggagcggtcatccacccgatgacctccgtcgtcgggatcaccgacgaccccgagggcggctaccgggtcctcaccgtccccaccgaccgccgccgcaaggcgaggcccacgaaactccgcgcccgcaaggtcgtcgtcgccgcgggcacgtacggcacccagaccctgctgcacaccatgaaggaccggggactgctgccccggctctccgcgaggctcggcgagctgacccgtaccaactccgaggcgctggtcggctcccagaccagcgaccgccgctaccgcaagaagcacggcaccgcgaaggccgacttctcgcagggcgtcgcgataacctcctcgatccacccggacgacaacacccacatcgagcccgtccgctacggcaagggctccaacgccatgggcgcgatgtcgatcctccaggtgccctacgggacccaccgggtgcgcggctggctcgccaacatggtcaagcaccccactctcgccctccgttcactctccaaccaccactggtccgagcgcaccatcatcggcctggtcatgcagtcgctggacaactccctgacgacgtaccgcaaaccgggcggcatcggcaagggcctgctcaccgcacgccagggccacggcgcgcccaacccgacccagattccggaggccacccgcagcgccaccctgctcgccgaggagatcaacggcttcgccgggtccaacgtcggcgaactgatgggcaccccgctcaccgcccacttcctcggcggctgcccgatcggcgcgagcgagcaggagggcgtcatcgacccgtaccaccggctctacggccaccccggcatcagcgtcgtcgacggctccgcggtctccgccaacctcggcgtcaacccgtcgctgaccatcaccgcccaggccgagcgcgcgatgtccttctggcccaacaagggcgaggcggacccgcgcccggatcagggcgaggcctacgagcggctcacccccgtcgagccgctcgcgccggccgtgccgaaggaggcgttcggcgcgctgaagctgccgttcctgggcatccccgtggtgccgccgaaggggacggcggaggccggagcgaacgtgaagggcgtcgggaacacacccgtacccaatccgtgatctttctccgggcaactgttcggtgagctgcgcggtcgaacccgtaccgcgatgactgtctcagcggtcacacagctcctgccgagtcccagaggaccccgatgacacccttctccccgagaaccgcgctgcggcgtgcggcgggctccctcgccgccgcaggtctgctggccgcggtcccgctcgccggggcggccggccc

SEQ ID NO: 3767 - DNA, 3346 bp, Unknown
  Kingdom: Bacteria, Phylum: Actinobacteria, Class: Actinobacteria, Order: Streptomycetales, Family: Streptomycetaceae, Genus: Streptomyces
cgccgcccagtacgccgcggtccgggccaccctcaacgaactgctcgactgcatcccgctgctggtgcgcaacctggagcactcccagcagcagcacgcggcggtcgtcgaggcggtgctcgaccgggacgcggacgcggcccgcgcgatgatgcgcgagcactgcggcggcacggcggccctgctgcgcggcttcctcgcctgagccggaccccgatcggcgggacgcccccggtggtgcgtcggtgtccggcgcggaggcgaatccgtaaccactctttaacgcacgccccttgcgattcccccgacgttccacaaaggtgtgccgacgaacctttgatcgaagcagttccaacgatgaagtcgacacacatctggagcgcctcatggctcagggaaccgaaacacccgccggcccacccggtgacgcgagcccgggggtgtccggcacggacgcgtacctgcaccgcaggaccctgcgccgggggagcgccggctggctcctgctgaccgggctcggcgtcgcctacgtcgtctccggcgacttctccggctggaacatcggcctgtccaagggcggcttcggcggactcgccgcggccatggtcctgatgggcgtcatgtacgcgtgtctggtcttcgcgctggccgaactctccgccatcctgcccacggcgggcggcggttacggcttcgcccggcgggcgctcggcacctggggaggcttcctcaccggcacggccatcctcatcgagtacatcctcgcgcccgccgcgatcgcgctgttcatcggcgactacgtcgaatcgctcggcctgttcggcctcacctccggctggcccgtctacctcgcctgcttcgcgatcttcatcggcatccacctctggggagtcggcgaggcgctccgcttcagcctggtggtgaccgccatcgcggtggccgcgctgctgatcttcgccgtcggcgcgttcaccgagttcgacgcgagccgcctcaacgacatcccggcggacacctccgccttcggctcctcctcctggctgccgttcggcctcctcgggatctgggccgccttccccttcggcatgtggttcttcctcggggtggaaggcgtgccgctcgccgccgaggaggccaaggacccggtccgctcgatgccgaaggcgctggccatctcgctcgtcgtgctggtcttcctggccgtcatcaccttcatctccgccaccggcgcccagggagccaacgccatcaaggaggccgggaacccgctcgtggtggccctccagggcaccggtgagccgaccaccctgagccgcttcgtgaactacgcgggcctcgccggactggtggcctccttcttctccctgatcttcgccggatcccgccagctgttcgctctctcccgggccggctatctgccgcgcttcctctcgctgaccaaccgccgcaagtccccctacctcggcctgctgatccccggagtcatcggattcacgctcgccgcctggagtggcaacggcggccggatgctgaacgtcgccgtcttcggggccacgatcagctacgcgctcatggcgctctcccatctggtgctgcgccgccgcgaaccggagctgccgcgcccctaccgcacccccggcggcgcgctcacctcgtccgtggccttcgttctggcatgctcggccctggtggcgaccttcctcgtggaccgcgacgcggcgttcatcgccctcggcgtgtacgcggtggcgctggcctacttcgccttctacagccgtcaccggctggtcgcgggagccccggaggaggagttcgccgcactggcggcggccgaggccgaactcgcccgcgactgagcccgcccgggcgccgggcccccgcctccggaggcgtacgggacgggagcccgtcctcctgacagcgaccacgtgatcaccccgacccgaaggagcccgttccatgtcccggcccgtcatcggcatcagcacctaccaggacccggcccgctggggtgtgtgggagatgcccgcggtgctgctgcccgccgcctatccctgcctcgtccgggcggcgggcgggctcgccgtgctgctgccgcccgacgacgcgcgggacgcggcccgggacaccgtcgccgccctggacgggctggtgatcgccgggggagcggacgtcgaaccggcacgctacggggcggtccccgatccccgcaccggccccccggcccgtgaacgcgacgcgtgggagctggagttgatccgggcagcgatcgaacgggaagtcccgctgctcggcatctgccgggggatgcagctgctgaacgtcgccctcggcggcaccctgcaccagcacctggacgaccacaccggcggtcccggcgtcttcggcagtcatccggtgacccccgtccccggcaccgcgtatgcggacgccgtcccggagaccgcggtggtacccgcctaccaccaccaggcggtcgaccgcctcggctccggtctggtcgcctgcgcccacgcacccgacgggacggtggaagccctggaactccccgggcacggcagcctggtgctcggcgtgcagtggcacccggagatgggcgaggacacccgggtcatggcggccctggtccgggccgcccgggggcgcgcgggcctgcccgctgcccttcccgccgacgaggcgcccgtacgcgcgctgatctgaccggccccggtcccacccggcaggggcggcggcctcgcggacgccgtccgtccgtcagcggcgcggttcggagccgcccggaacgggtctgccggagtcctcgaaaccgggacctgagaaatccggaccggagaaatcgggtcccgcgaacgccggcgagctgaagcgggagccgtgagcgccgttgcccggacccggcggggacgccgccgcctcggtgagctgctggaggaggaacggcctgatcccccggtcgcggagcgccgcgagccacacctcacgggcgtcctcgacggcgggggaccggtcgggcacggacgccgtgccgtccgccgactgcttcgccgccgtgcggtagagggcgacgacgctgaccagggccgtgaccgccgcgaccaccagactgaaccagccgacgccgacgagggtgcccgccagggcgggcagggcctcggcgagccgcagaccgtaacccagcagcaggaacgtcgccgcggccaccgcggcgagcaccggcgtcagcaccccgaggacggccagcacgccgccgagtacgtcgacctccgcctggagcacggtcccgcagcagcccggtcaccagcggcagcagcagggcccgggcggcgggaccgtgctccaggcg

SEQ ID NO: 3768 - DNA, 1521 bp, Unknown
  Kingdom: Bacteria, Phylum: Actinobacteria, Class: Actinobacteria, Order: Streptomycetales, Family: Streptomycetaceae, Genus: Streptomyces
ccgcgcaggaacccggcgaggaaccacggatcgagggcggccggatcgggacgcagcagttggaggttgcggccgagcgcggcgcccgcctccctctcgccgacgacccggacgacggtcccgccgccgagcacgggcaccacgacgtcgccgggttcctgcgcggcaccgccaaccaccggcaggccagcagctacgcctccacggcggcccggctggacgcccgacgcctccacctgccccggatgccgctcgccgaacagcggaggtacggggagcggttccgcgaactggccgcgttcgaggaagcgctgcggacggcggagcggctcggcgggcaactggtccaggggatgtacgacggcctcacggacggcacggtcacacccgcgtgaggtgaaccacaacggttgggtacaacccggggccggccggtcggtggaggtgtatacgctcaccccacacgtccgacatacgcgtcccaggagcagcacatgcacggctacggcccgacgccgcagcagcagacgacatcccggccgtccccggcgacgctcacggcggtgcgcgtgatcctcgtgacggtgaccgtgctgagctgcggcctgttgggctgggtcgcgatgctgcggctggcgatcgtcacccgcaggccgcgcgagtgggtcctgctcgtggtcgtgatggtcctcaacgccgcgctgttcgccttcatcatggccacaccggacgaccccgacgacatgtcggacgcgtcggtgctgttgatgctgctctggatactcgccctgctggccggggtgatcacctattacctgtacgtggagattcgccactacagctccctccgttccctcggctccccgcccccgtacgccgctcccgcacatcccgcgccgctcccgtaccagcagcatccggctcagccgcagccgcagccgcagcaacaacaccagcacctgcacccgcagcccaacccgtacaccgtgcagaccccgccgcccacgcccacgcccgcgccccggcgcctcgaccaggtccgggccgagctggacgagctgagcgactacctccgcaaggagggcgagggccggtgagcgggcggatcatcgccgaccggtacgaactggcgaccatcctcggccagggcggcatgggccaggtgtggacggcctacgaccggcgcctggaccgccgcgtggccgtgaagctgctgcgccccgaccgggtcgccgggcccaccggcagcgacgcggccgacgagctgcgccgccggttcgtccgcgagtgccgggtcaccgcgcaggtcgaccaccccggcctggtcaccgtccacgacgcgggcagcgaggacgacgacctctacctcgtcatgcagtacgtcgagggcgccgacctcgccgaccatctggccgagcggaacccgtacccctggccgtgggccgtcgcggtcgccgcgcagctctgcgcggtcctctgcgcggtgcacgcggtgccgatcgtccaccgcgacctcaagcc

SEQ ID NO: 3769 - DNA, 1757 bp, Unknown
  Kingdom: Bacteria, Phylum: Actinobacteria, Class: Actinobacteria, Order: Streptomycetales, Family: Streptomycetaceae, Genus: Streptomyces
ccggtcggcagcgcgccgcgtcggccgtaggggtcaggtcggggcgccgggtgggcagctccagtgtcgaggagaggcggcgcggtccccgcgccgtgtggaccgtgaacggggtgcccgaggccaggcggaccgtggtcgtccgggagccgatcccgacctcgtacgtcgcgtcccggtaccgcaggcccttcagcgtgacgccttcacgcagttggggcggcagcgtcgggtccaggcgcacgccgtcctcgcgcaggcgcaggcccgtcaggccgtgcgtgaacacctggaggaaaccgcccttcccggtcaggaagtcctcggccgggaagccggacagcgggtcctcggcgcccgacttctcaccccgcgcctcggagaacagctcgtacgggccccgcatgaagggtcgcaccgcacgctggaggtacgtgtacgtcgagcagcccggctccccgatctccgccgcgtcgatcgcgtgcaccgagtccgtcatcgccgggccgtccgggtcggtgcgggccgcgtagtggtccagggtggccgccgcggcgcccggctccatcggccactccagcgggtaggtcagcaggaccgtgtccgcctgcttgatcgtggagccgttgtaccccgcgtactggaggaagatcttcttctccgcgtcgtacgggatgcgcaggtggtccgccaccttgttccaggcggcgggcgggctctggccgaggatgcgagcggcacgggtcgcgttgcgcagcgcggtggcggcgaccgcgttggtgaagacgccgtcgtcgacgccgttgctgtactcgtcggggcccgccacgtcgttgacggagtagctgccgtccgcgttcgccgtggcgcgcgacgcccagaactcggcgatgccccggagcaggggccagcccctcgacgccagccagtcgcggtcgccggtggcgaggtagaactgccagacggccagcgagacgtcgccctggaggtggttctgggtcaggcagtgcggcgggtcccagctctggcactcggagtcgaggcggccccggctcgcgctggtccaggggtagaacaggccccggtaacccagtttctcggcgttcgcgcgggccgcgtcccgggtgcggtagcggtattcgacgaccgaacgtgccagctccgggcgggtggcgagcagccccgggaacatccacgtctcggcgtcccagaacaccatgcccgcgtagttgtcactggtcagaccggccggggcgatgctgtcggaggatccgcgccgggtgctcgccagcagcccgtactgggccgagcgcagccagccctggaggcggcggtcgccggggaccagcacatcggcggaccaggtctcgcgccaggcggcctcgttcgccgcgaagacccggtcccagccgcgccgtgccgcccggtgcgccgcctcgcgggcgtcctcggccggggtgcgggaggtcagggcggtgtcgacgccgacgtacttctcgaaggtgtacgtccggcccgcgcggaccggcgtcgccctcggggacgtacgggccgccggccgcaggctctcgaccgcgcccgagtcgcgccgcatcgtctgggcgacggccccctcgatcccggttccgagcgtgcggaacgtgccgtcctcgcggagcgtgatccggcgcgcgccccggtcgtcgagccggccggtgacggtcgcggcgccgctccagcgcggggtcatccgcaggcgtacggctccggtgtggacg

SEQ ID NO: 3770 - DNA, 569 bp, Unknown
  Kingdom: Bacteria, Phylum: Actinobacteria, Class: Actinobacteria, Order: Streptomycetales, Family: Streptomycetaceae, Genus: Streptomyces
cggagaggccgacgagcgggtgccagaaccaccacccgctcgtcggcctctccgaggaactgctggagcgccggccgcacgcggtgagcgacggccagctccagcgggcctgtctggcacgggccctggtgctggagccccggctgctgatctgcgacgagatgaccgcgatgctggacgcctccacgacggccgccctggtcgccgtggtcgagcgctaccgctccgcgtccggggcggccctgctcgcggtcggccacgaccgggtgctgctggagcgctggtgcgaccgtacggtccgctggggtgagcggaccggcggaggcgagcgcgtggcggtcggctgagcatcgcgcggagtacggctgggcgccacacgcggtcggctgagcaccccgcggagtacggctgggcaccacacgcgtacagctgagcaactgacgcgtacggtcgagaagttgacgcccacggctgatcagctgacgcccacggctgagtgcttctcacgcacgaggaacggcgaacaacggatgcggcccggccgaccggcgggccgcatccgttgttcg

SEQ ID NO: 3771 - DNA, 4664 bp, Unknown
  Kingdom: Bacteria, Phylum: Actinobacteria, Class: Actinobacteria, Order: Streptomycetales, Family: Streptomycetaceae, Genus: Streptomyces
cccggccggcgacaacccggcgcaacgccgccctggccgttctgctcgccctcggtctcgccgctcccgccgccaccgtggcgaccgccggacccgcgggcccgaacgcggccgtcgtcgcggacgagcggacgctccagtacgagatcaccgggcgcaccacccccgccgcccgaaccggcatcgcccgcgtgggcgtctcgatcgacgaggtgcacgaccacggcgtcgtgatcaccgcggacgccgcgcaggcgcggaagctccgggagcgcggccacaccctggaggccctgcccgcgccggtctccgatccgcgggcggccgacggcgtgagcgccctcgacttcccgtccgccgactcccgctaccacaactacgccgagatgaacgcggagatcgacgcccggatcgccgcgaacccctcgatcatgagcaagcgcgtcatcggaaagacctaccagggccgggacgtcgtcgcggtcaaggtcagcgacaacgtcggggccgacgaggccgagcccgaggtcctcttcaccgcccaccagcacgcccgcgagcacctgaccgtcgagatggcgctctacctgctccgcgaactgggccagggctacggctccgacccccgcgtcacccaggcggtcaacggccgcgaactgtggatcgtgccggacatgaacccggacggcggcgagtacgacatcgcctcgggctcgtaccgcagctggcgcaagaaccggcagcccaactccggctccagcgcgatcggcacggacctcaaccgcaactgggcctacaaatggggctgctgcggcggctcctcctccagtccctccgcggagacctaccgggggacggcggccgagtccgcgcccgagacgaaggtcgtcgcggacttcgtgcgcggccgggtggtcggtgggaagcagcagatcacggcggccatcgacttccacacgtacagcgaactggtgctgtggcccttcggctacacgtacaacgacaccgcccccggcatgaccacggacgaccgcgacgcgttcgccgcggtgggccggaagatggcggcgagcaacggctacaccgccgagcagtccagcgacctgtacatcaccgacgggtcgatcgacgactggctgtggggctcgcagaagatcttcggctacaccttcgagatgtacccgcgctcgacgtccggcggtggcttctacccgcccgacgaggtcatcgagcgcgagacctcccgcaaccgggacgcggtgctccagctgatcgagaacgcggactgcatgtaccggtcgatcggcaaggaggcgcagtactgctcctgacgggacgagccgactccactccggtgcggggcagcgtacgggcccgcaccggagtctcaggcgacgtcgtggacgctgtgctcgccgagatccggggcgtgccgggcgaccgtgcggtagtcgaggtcgtcatggaggaccgtcagcccgtggtgggccgctgtggcggcgatgatcaggtccaccgcggaggcgctgcgatgctgcccggcgcgtgccatgcggtgctggaccgacgtgatccagcgtcccgctcccttcggtacggagacgtccgggtagaggtcggtgaacatctccacgatctcgtcgtactcgcgctcgttgcgggcgccgtacaggaactccgcccgctgcggatggcaggaggcgatcgtcccggcctcgatcgcatcggaccacgccgctcggagggtgctgtcggagagcagtcgtacgaggcccgacgtgtcgagcaggtagatcaccgcccgtccttctccgcccggtgccgccgctcggcgtcctcgaccgcaccccaggtgcgcgcgcgatcgaagtggcggctgatgcgtgccgcccgctcctgctgctcggcgtagaagcgcagggcgatgttgacggtctccttcttcgtccgggccctggacagggtcatcgcccgctccagcgcttcatcgtctatgtcgatctgggtcaccgacatgtccggccctcccgtcgtgcgccctgcgtcatgtggagcatgtacaaagaaccgtatgccaccaacattcctcccgcgaggcgcttccggccttagggtgccgctatgtgcggaattgtgggttatgtcggtgggcagtcggcgcaggacgtcgtcgtcgcaggactcaagcgcctcgaataccggggctacgactcggcgggcgtcgccgttctcgcggacggcgggctcgccgccgcgaagaaggcgggcaagctcgtcaatctggagaaggagctgggggaccggccgctgccggccgggcggaccggcatcgggcacacccggtgggcgacccacggagcgcccaccgacacgaacgcccacccgcatctggacaacgcgggccgggtcgccgtcgtgcacaacgggatcatcgagaacttcgcggccctgcgccgcgaactggccgggcgcgggcacgccctggagtcggagacggacaccgaggtcgtcgcacatctgctggccgaggcgttctcggcgggcggggacctggcggaggcgatgcggcaggtgtgccggcggctggagggagcgttcaccctggtcgccgtgcacgcggaccagccggacgtggtggtcggcgcccggcgcaactcacccctcgtcgtcggggtggggcaggacgagtggttcctcgcctcggacgtcgccgcgttcatcgcgcacacccggtccgccgtcgagctgggccaggaccaggtcgtcgagctgagccgcgagggcgtcgtcgtcaccggcttcgacggggagctcgccgaggtgcgcgcgtaccacgtcgactgggacgcgtccgccgccgagaagggcggatacgcctccttcatgctcaaggagatcgccgaccagccccgggccgtcgccgacaccctcctcggccgggtcgacggggagggcacgctccacctcgacgaggtgcgcatcccggccgccgaactgcgggaggtcgacaaggtcgtcatcgtcgcctgcggaaccgccttccacgccgggatgatcgccaagtacgccatcgagcactggacccggctgccctgcgagaccgaactcgccagcgagttccgctaccgggacccgatcctggaccagcgcaccctcgtcgtcgccatctcgcagtccggcgagaccatggacaccctgatggcgctgcggcacgcccgcgaacagggcgcgaaggtgctcgccatctgcaacacgaacggctcgacgatcccgcgcgagtccgacgccgtcctctacacgcacgccgggcccgaggtcgccgtcgcctccaccaaggccttcctcacccaactggtcgcctgctacctcgtggcgctctacctcggccaggtgcgcggcacgaagtggggcgacgagatccgtacggtggtgcgccagctctccgcgatctccggtgaggtcgaccgcgtcctcacgacgatggagcccgtgcgcgagctggcacggtccctcgcccaccacgacacggtcctgttcgtcggccgccacgtcggctacccggtcgccctcgaaggcgcgctcaagctcaaggaactcgcctacatgcacgccgagggcttcgcggccggcgagctgaagcacggaccgatcgcgctcatcgaggagggactgccggtcgtcgtcatcgtcccctcgccgcgcggccgttcggtgctccacgacaagatcgtgtccaacatccaggagatccgggcccggggcgcgcgcaccatcgtcgtcgccgaggagggcgacgaggccgtcgtcccgtacgccgaccacctcatcacggtccccgcaacgcctacgctgcttcagccgctggtcgccaccgtgccgctccaggtcttcgcctgcgagctcgcgacggcccgcggcaacgaagtggaccagccgcgcaacctggcgaagtccgtgaccgtggagtgagcgagcggcccggggcgtccggggtgcgagcgcgacaggaacagcgagggtggggtcgtgatcatcggggtcgggatcgacgtggccgagatcgagcggttcggcgcggcactggagcgtacgccccagttggccgaccggctgttcgtcggcagcgagctgacgctgcccagcggcgagcggcgcgggatcgcctcgctcgccgcccggttcgccgcgaaggaggccctggccaaggcgctcggcgcccccggcgggctgctctggagcgacgcggaggtctgggtcgaggagagcgggcagccccggctgcgggtgcgcggcacggtcgccgcccgcgccgcggaactgggtgtgcgcggctggcacgtctcgctgagccatgacgcgggagtggcgtcggcggtggtcatcgccgaggggtgagcacccgcccggccggacaagccgcaggggtgagtccgccgtcggcgcggtgggcgtacgggggtggcgtccgcccgcctgatcgcggagggttggacccatgcgacgtgcctacagcgtggagaccgtacgggccgccgaggccgccctcatgcagcggctgccggagggcgagctgatgcgccgcgccgccgccgggctcgccgtggcctgcggcgatctgctccggcgcaacggccgcgtgtacggctcccgggtcctgctcctgg

SEQ ID NO: 3772 - DNA, 4752 bp, Unknown
  Kingdom: Bacteria, Phylum: Actinobacteria, Class: Actinobacteria, Order: Streptomycetales, Family: Streptomycetaceae, Genus: Streptomyces
acgatgatgaggagcgcgaagagcgcgctcagcaccccgtcgacggtggagttggtgacgacggtccgcatgtcgtccatgttcttcgcaggcgccagcacctcacccgcgtcgatgcccgcctggtacttgtcgcgctgggcgaagaagccgaccttcacgtcgtcggagaagatcttctgccagctcgccgtgagcgtgaccgccacatcccaggcgagcggcaccgcggtgacccacgcccacttcagacggccggacttgacgagcagagtggtgcagacggccagtgcgacggccgccagcaactggttggcgatgccgaagagcgggaagagctggttgatgccgcccagagggtcgtgcacgccgacccagaggaagtagccccagccgccgacgacgacggcgctggcgaaccagacgccgggcttccagctgacctcgcggaagggcttgtaggcgttgcccagcatgtcctggagcatgaagcgcccgacccgggtgccggcgtccacggtggtgaggatgaagagcgcctcgaacatgatggcgaagtggtaccagaacgccttcatcgcggacccgccgaccaccgcggagaagatctccgacatgccgagcgcgaacgtgggcgcgccaccggtccgggagagcaggctcgcttcctcgacgtccttggctgcctgggccagggcgtccggactgatggtgaagccgaagttggccacggcctgggaggcggactggacgctgtcgccgatcacgccgacgggcgcgttgatggcgaagtagaggccggggtcgatgatgcaggcggcgatcatcgccatgatcgccacgaacgactcgaccagcatggcgccgtagccgatcacccggatctgcgtctccttctggaccatcttcggcgtggtgccggaggagaccagggagtggaagccggagagcgcgccgcaggcgatggtgatgaagacgaacgggaacatcgagccggcgaagaccgggcccgagccgctggaggcgaagtcggtgaccgcgggcatcttcagggtcggcagggcgacgaccacgcccagggccagaagcccgatcgtgccgaccttcatgaaggtggagaggtagtcgcgcggggccagcagcagccacacggggagcacggaggcgaagaacccgtacacgatcatccagatgaccagcgtgcccggctccagcgtgaagaagtccgcccacgacgattcggcgacccagccgcccgagacgatcgcgaggagcagcagcgcgacgccgatgagggagacctcgctgaccttgccgggccgcagggtgcgcagatagacacccatgaagagggcgatcgggatggtcatgccgatggagaagacaccccacggcgagtgcgcgagcgcgttcacgatgaccagggcgaggaccgcgagcaggatgatcatgatgatgaagaccgcgaccagggcggcgatcccgccgaccggccctatctcgtcgcgcgccatctggccgagtgaacggccgttgcggcgggtggagaagaagagcgtcaccatgtcctggacggcgccggcgaagatgacgccgacgacgagccagatcgtgcccggcaggtatcccatctgcgcggcgagcacggggccgaccaggggtcccgctcccgcgatggcggcgaagtggtggccgaacaggacccggcggtcggtgggatggaagtcgacgccgttgtccagccgttcggcgggggtcgcgcggttcttgtcgaccttcagcacccggcccgcgatgaaccgggagtagaagcggtacgcgatcgcgtacgagccgagggccgccgccagcatccaggcggcggacacctcctcaccccgcgagagcgcgagggtggcccagcctgtggcgccggccagggcgaccaggctccagaccacgatggatttgggggacataccccgtttccccggcgcctgcggtgccggtggtgctggtgcgggcgtttccgccatgtggtgactccgtcccctcgctgatcaccggtgtaatgggcaggaaatctaagggacgcgtccgcccagcgtcaccccctgtccgcattgcggtccggcaacggtgatgtgtcgcaacgggacacggggacggcgccgattcggttcatccggtgcggaccggaccgccgcccggtcgggatcagccggttcgggacgctcccgcgccccggtcagatccagccccggcgcgccgcctccgcgcccgcctggaacctgctgcgggcctgcatccgggccgtcaggtccgcgttcatccgccgcaccgtgcgcagggacacccccagccgccgggcggccgtcgcatcggtgtgccccttcgccagcagggacagcaactcgtcctcctgcggggtcagcccgttgccgtcgcggcggggcgcggagccgagaggagaggcggcggcccacagttgctcgaacaggagccgggccaccgcgacggcccccttgctgcgcaactccagcgctcccgcccggccgtcgtcggggtccagcggcaccagggccacctccccgtcgaccacgaccatgaccagcggcagcgtgggcagcgtacggctctccgcgccgagcgcgcccagccggttcacatagcgcagggtcgacggatcgttgcggaagctgtcctgatagatgctgcggagccgcaccccacgctccagagcccgccggtccagcggcccgctggcctccagcgtgtccggcgactgcgcgccgccgggcagcagcgagaggcactccgtcctggccagttcggccagttcggtcagccgctcgcgcaccgcgccgagtccctccagccgcttgatgacgtcgaagcccccgcccgtccgccggccccggtccgtcgtgagggccgacatcgcgtcccgcgcgatctcaagtcctcgctgctgcctggccagttcggcttcccggcgggagaggaggaacggcaggctggcggccgggtccagcgcgcggaagaccggcgggccctgttccgtaccgcgagggccgtcgtccagcagacacaactcggccagctggtccagagcgcggcgcacatcctcctcgctccggccgagccgcgccacgatctcgtccagccgcagctccggctcctccagaacgagccggtacaccagctccgtccgtgcgtccagccccagtacctctaacatctctggctcccccgcagatgtcacgccgtccccgcacgccagtacgggacgccacttcagcaccgggcgcgagtgtagggcgacgcgttgtgaaggtatagaccaagtccacgggatggatgggccccgagagaccacgcatggccaaaagagccgaggccgacggcggcccggacgggcacccggcggtggcacgaatggccgcaaggtgtctggcagttgcctgccacccccgcatcgtcccaggcagcgggccccgtacggccgtcggcgaggctggcaccctgctgccccgcaactcccggccacccggagaccgtggcacccgggacggcgatgacgacaggatcaggccgtcacacggcattcacacaccgctactttccgaggagttccgcatgcgggcgttccgtgttcctgcccttcgcctctcgccggccgtcgccgtcgccacggggacggcgaccgcgttcgccgcctcgggccgggacggcttctcctgggggtgacccgggccgacgggacgcctccgtgttcctggtgaccgcgctcctcgtgcgcaccggaccctcgcgccccgaccggtggacagcgcgggagctggcccggtcgctgcgctcccgccacgtccgcgcgggcccccggagcgccggtccgcactccccgggcccggtccatgtctacgtcgccgagagcccggacggctcggtccgcgccgcgctctacatggagagccctgacctcgtgcacgccgaactggccgcgctggactacctcctggccaccctgagcgccgcccggcctgcctcgctcgactggcggaccgcggccctgggggctgtctcgggccgccccgaccagcaccgaccacccgaaccgaaaggaccggacccgccatgccacgggagcgtcccaccgtgtcagtgatcatccccaaccacaattacgagaagaccctgcgggcctgcctggaatccgtctacgcccagaccctgcgcccgctggacgtggtcgtcgtggacgacgccagcaccgaccgctcgcgcgacatcgcccgcgcgttcccctgcgtactcgtcgcccgcccggacaacggaggggtctccgccgcccgcaacctcggcgtcgccgcgtccgcgggacaggtgctgttcttcctcgactccgacatcgcgctggctcccgacgcgatcgagaacgccgtcgacctgctcatggacgacccggagaccggctgcgtccacggcgtcctggaccccgaaccgctcttcgacgacggcccggtggaggtctaccactgcctgcacgcgcacttctggcgacaccgcagcgccggagtcgtcggcaccgccttcttcgcgctcgccgcgatcgagcgccacgtcttcgaggcgaccgggcccttcgacgagaacctccgcgactccgaggacgtcgagtacagcgaccgcctcgccgccacccaccgcatccgcctcagcgagcgggtgaccggccgccacgacgacgtggaccggctgctgccgatgctc

SEQ ID NO: 3773 - DNA, 6588 bp, Unknown
  Kingdom: Bacteria, Phylum: Actinobacteria, Class: Actinobacteria, Order: Streptomycetales, Family: Streptomycetaceae, Genus: Streptomyces
gggacgccggggccgctgtcggcgccccggtctccgggagctgaggttccggggctcgaaggcccggggctcgaaaaccttcgtcggcggagccggtcagctcgtggtggcggaagcgcggttgcggttgaactcctggacgtttttctgctgttcgtcatagctgtcggtgaaccgggtgtcgccgggaccgaccgtgacgaagtacagccagggtcccggcgtggggctgacggcagcgcgcagcgcctcctcccccgggttgccgatgggtgtcggcggcagacccttgatccggtagctgttgtacgggctgtccagttgggtttccgcggtcgtcgtgtccagggtggagcgcttgagggcgtagttgatggtggagtccatctgcagcggcatgtccttgagcagccggttgtagacgacccgggccaccttgcccatgtcggacgcggtgtcggcctcggcctggacgatgctggcgatcgtgatcgtgtcgtagacggagacgttgttgcgctgggcccccgccgtgacgtggtccgcgccgaagtgcttgcgggcggtgtccgccatgtaccgcagcagtccggcgggctcggtggcggcgtcgatcggatacgtggccgggaagaggtacccctcggggttgccctcggcctgggcgggcagagccaggtccgccgtcgtcgcggccttgcgcgtgctgccgggcttcaggtcgagcgcccggtcgacggcctcgtacacctgcgaggcacgacggccctcggggatcatcagcgtgctgtgcgggctttccttctcgtgcccgccctcgtccgatccggtcagggacagcgggaccaggacggcggccgacacgacgagcagggcgaccgcggccaggacgaccttgccgcggcgggtcgggcggagtctgcgacggggtcgggcgtccggggactcgttcaccatgcgggcacgttaacccggagcacgagccacggccggtagctcggccacggcgtcggctccggcgacacgaacgccgtaccgggcggccggaacacacggcacccagaacacgcgaacaagggatcgggtgttcgctggaacgtgtgatcgtcagcggattcgttgctgttcacccgtccgggacgtgatgattgcagagcgcagtcaacgggctgcagaccgctactgcgcagtcccacagatgcaccacgtacaaggagaaagaccagatgaacttcctgaccaacctgcttgccggcgtcgtccacttcgtgggttggctcgtctgaccattgctccgcccggcgccgtcgctccccgtcccacgggagcggcggcgccgccgtgtgtacggaaggccggctcagccgttcgccgccgccggtccggcgaagggcggcagcgcggtgaactcgggtgcgaccgtcaccgccgccgcgaggacgtcgagcgtccggcggacccgggtgagcgggtggtccgggaattccgcgtcccactgcgcatggtccgccgcgtggaagggcagtccgccctggacctcgggggcgtagggatgcggacggaagtactggtcggggccgagcttggccatcaccacggcttcccgcacgccggtcgtgccgcgctccgccgcctggatcttcaccacggtgctgcacccggcgcgcggcacggtgaagctgccgatgaaggcctgcccgctgggctgtcccggcagcggcagtttgagtatctggcgcagggcaggcagctcgcccagtcgcttcaccgaggcttcgatgagtccgccgccggcccgtgcggtgaagtgggtgagcccgtggcgcagggctgggccgtcgtccagcgcggcggggagatccggcggcaggtcgaagaagtgcagcgacagcacatcaccgtggtcgttcagccaggtgtcggtgtccacggttcggtagccggggagttccaccccgaggagagctctcatgcgcggcgatcatgccgtacgcgggtcgcgccggtgacatcagggggctgtcacatcgtcccggcgccggaggccggtcctgccgggcggtcagggagccggcacgggggccgggtgggagtcgcggcggatcagggcggcgtagcggccgtcgcggtcgagcagttcctcgtgcgtaccgcgctcggcgacccggccgtcctccaggacgacgatctggtccgcgtcgcggacggtggagaggcggtgcgcgatggtgagtgtggtccgtccggcggacagggcgtcgatcgcttgctgcacggcctgttccgtacgggtgtcgagcgcgctggtcgcctcgtcgaggatcagtaccggcgggtcgcgcaggatggtccgggcgatggcgaggcgctgcttctcgccgcccgagaagcggtagccgcgctcaccgaccagggtgtcgtagccgtcgggcagggaggcgatgtggtcgtggatctgcgccgcgcgcgccgcggcctcgatctcctcgtcggtggcgtccggcttggcgaagcgcaggttgtcggcgaccgaggcgtggaagaggtaggtctcctgggagacgacgccgaccgctcgggcgagcgtgtcgaagtccaggtcgcggacgtcgaccccgtcgagcgtgacccggccgccggtgacgtcgtacagccggggtacgaggtagctcagggtggacttgccggaaccggtggatccgacgaccgcgaggctgccgcccgcgggaacggtcacgtcgatgccggtcagcgtcgggccgttcttctcgtcgtagctgaagtcgacgtcctcgaaggcgatctcgccgcggatcttctccaggcggaccgggtgttccggttcggtgatgtcgaccgtgaggtcgaggtactcgaagatgcgctggaagagggcgagggaggtctgcatctgcacaccggtggagagcaggctgacggcagggcggaacagaccctgctggagggtgacgaaggcgaccagggtgccgatggagacggcggcggctccggacgcgaaggtgagaccggccgcccagtagatgacggcgggcatggcggccatcacgatgccgatcgtggacatccgccagcggccggccatgttggagcgcacttccaggtcgaccaggcgctcggactcctcggcgaaaccccgggtgagggagtcggagcggcccatggtgcggccgaggaggatgccactgaccgagagggactcggtgaccgtggcggccatcgcggccatctgcttctgacgctgggtggtgatcctcttgcgctcccggccgacacggcggctgatcgcgacgaagaccggcagcaggagcaacgagacgacggtgagccgccagtcgagggcgagcatggcgacgacggtcgcgatgacggccgtgaggttggagacgagcgaggtcgcggtggaggtgaccgtcgcctgcatgccgccgatgtcgttggctatgcgggactggacctcgcccgtgcgggtgcgggtgaagaaggcgagcggcatccgctggagctgggtgtagacggcggtgcgcaggtcatgcatgacgcgctggccgaccgtggtcgagatcagggtctggagcacgccgaagacgctggtcatcacggcggtgaggatcatgccgagcgccagcagggtcagcaggcccgtgcgcccctgcgggatcgcggtgtccaggatctcgcgcagcaggaacggggaggcgaccgataccagggaggacgcgccgaccagcaggccgacgacggccaggcggccgcggtaggggtggaagaggcggaggatgcggcgcacctcggcgggcggccggccggcggcggcatcgggtggggacgtccacgtgggctcgtcgggtttcatgggctccttcgtcgggcgtgaggcgtggccgggccgacccggcctcgcacatggagagcctagctcattgttacctatactcacaatgaacaaggtcctgatattgttcccgtatggacgccccagattcccccggcccgcccggctcccccggctcacccgacaccgacggtgtgctcgccgagcagttgctgcggctgacccgccggctgcaccgcatccagagccgccagctggagccggtcgacatcactccggcccagttccggttgctgcggacggtcgcgagttacgacgcggccccccggatggcggatctcgcccggcgcctggacgtcgtcccgcgcgccgtgacgacgctggtcgacgcgctggaggcgagtggccgggtgcgccgcgccccggatcccgacagccgccgggtggtccgcgtcgagatcacggacgagggacgcgccacgctgcgatccctgcgcagcgcgcgccgggccgccgcggaggagatcctggctccattgaccgccgatcagcgcgaggttctcggcgggctgctgtccgctctggtcgacggcatgccggaacgccgctgctgaacaccgcgccgagccgacgaggagatggccgacatgccgctgctggagcccgacccggaagccctgcgccccggaaccgcacgggaacccgcccccgaccgggtcaccgaccgcagcgcgggcggcaccccggagccgctgcggagcgagctgacggccctgctcggccccgacaaggtgctctggaagatctccgacctcgtgcggtacgcctccgacgccagcccctaccgcttcctcccccgggtcgtgctggtccccgaggacctcgacgacgtctccgcgatcctgtcgtacgcccacggcaagggccgcgacgtggtcttccgggccgcgggcaccagcctcaacggccaggcgcagggcgaagacatcctcgtcgacgtacgccgccactggaccggcgtcgaggtgctggacgacggggcgcgggcccggatccggccggggacgacggtgctgcgggccaacctcgccctcgcccggtacggccggctgctgggccccgacccggccagcgccatcgcctgcaccgtcggcggggtcgtcgccaacaacgcctccggcatgacggcgggcaccacccgcaactcctaccggacgctcgcctcgctcaccttcgtcctgccgagcggcaccgtcgtcgacaccgccgacccggccgccgacgaggtgctggcccgcgccgagccggagctgtgcgcgggactgatggagctgaaggcggagatcgaggcggacgaggagctggccgccaggatccgcgccaagtacaccatcaagaacaccaacggctaccgcctggacgcctttctcgacggggcgacgccggtggggatcctgcgcgggctgatggtcggctccgagggcacgttcggcttcatctccgaggtcgtcttcgacactctgccgctggaccggcggatctccagcgcgctgctgttcttcccctccctcaccgccgccgcggccgccgtgccccggttcaacgaggcgggggccatcgccgtggagctgatggacggcaacacgctgcgcgcctccgtcagcgtgcccggtgttccggcggactgggcggcgctgccccggaccacgaccgcgctgctggtggagttccgggcggccgacgaggcgggccaggaggcgttcgagcgggcggccgacgccgtcgtcgccggtctggacctggtcgtcccggccgtgtcggtgaccaacgcgttcacccgggaccccgggacgatcgccgggtactggaaggcccgcaaggcgttcgtcacggcggtcggcgggtcccggccctcggggaccaccctgatcacggaggacttcgcggtgccgcccgcacggctggccgacgcctgcgaggcgctgctggagctccagtcgcgccacggtttcgacgccgccgtggccggtcatgccgcgcacggcaatctgcacttcctgctcgcgttcgacgcggcgaagccggccgacgtcgagcggtacgacgcgttcatgcaggagttctgcgcgctggtggtggaccgtttcgacgggtcgctcaaggcggagcacgccaccggacgcaatatcgcgcccttcctggagcgggagtgggggccgcgcgccaccgagctgatgtggcggacgaagcaggtcatcgatcctgccggggtgctcgctccgcgcatcgtcctggaccgggacccgcgggcccatctgcggggcctgaagaccattccgaaggtggaggcggtcgccgacccgtgcatcgagtgcggcttctgcgaaccgacctgccccagcgaggatctgacgaccactccgcgccagcggatcgtgctgcgccgcgagatgatgcgccaggtggacggttcaccggtcgaggccggtctcctggacgcctacgggtacgacgccgtggacacctgcgccggggactccacctgcaagctcgcctgtccggtcggcatcgacaccggggcgatgatgaggggcttccggcaccgcaggcacacgccgcgcgaggagcggatcgccgcgctcaccgcgaagaacttccgtgcggtggaggcctcggcgcggctggccgtggcggtggccgacgcggtcggcgaccgggtgggcgacggtccgctc

SEQ ID NO: 3774 - DNA, 1664 bp, Unknown
  Kingdom: Bacteria, Phylum: Actinobacteria, Class: Actinobacteria, Order: Streptomycetales, Family: Streptomycetaceae, Genus: Streptomyces
ctcgggagcctcggcgaccggggcgggctcggcgttctccaccggctccggggatccggcgggcgcggtggccttacgcacggcgcgacggcgcgtgcgtgcgggcggggcggtctcggcgaccgtttccccgcgcgtgtcgtccgcgtccggggcggcggacccgtcggccggtatggccggcgtgacgtccacggcgggggccacggcggcgccgggcgggcccgccggtcgggaagcggcgcggcgcctgcggcgcggcggcagcttgtccccgggggtgttctcttcgttgttcccggtcgtgccgggttcgttcggctgaggcatgcgggcggttctcccgtcgtgctcccgggcgccgcgtctgattccggtccggcacggtccgcagtggtgcgataccgccgtccggggcgcgggcgccgcacgggagctgatgtctggctcgccggttccgtatgcggtgtgcgtacggcctggcgaaagtcttgtgggtcagtgcgcggcccgacccaggtggctcccgagtcggagggctgcgctacaacgaccgccttacgcggaacctgcaccttccggcgccgtcgcgacggctgccccggcgaccgcggaatgtgcggtcggggcggcctcgcggtcgggcgcgagcgggtcggtcaccgtgccggactcctcgtcgaagagcccctgcgccagcctcgtcaccgcggcggggacgggcggcgccaggtcggccacagctcggagaccggacaggacgtcgtcgggtcgcacggcaggtgtcacgtgccgaacaaccaggcgcagtatcgcacagggccgctcgcccggcctatcgaccggagcgtcgacgacccgcaggtcggcgaccgcggcacgggcgtcgaacgtccggatgccgttcttcgccttgcgctggacctctacggcctcggcgtcgttgaacgcggccacggcggtgcgggcgtcctcgggatcgacgccgtccaggcgcatctcccagatggatgcggtgagccgctcggccaggcccgaggtgcgggcctccaccgcgtcgatgatgtcgaggccgtccggcatcgactcgtcgagcagtccgcgcaggacctcggggtcccgcgcctcggtgagggcgatctccaggaactccgcctcactgccggtgccggtgggtgcggcattggcgtaggagaccttggggtggggggtgaagcccgccgagtacgccatcggcacctcggagcggcgcagtgcccgctcgaaggcccgctggaagtctcggtggctggtgaaccggaggcggccgcgcttggtgtagcgcaggcggatgcgctgcactgccggtgcgggcggcgggccttcgggctgtcgcttgcccagtggttcttctcctcggtgcggggcgggcgcggtggcgcaccgcccacaaaattcgggtggcccccgggtgccgctccggctcacccccgcttgacgaatttctcgccgagcagaggggtctcggacgcctgcgccgcgctggggacagtcgttgtactacccagagtacgcgcaggcatcccctgcggttcccgggaccgtgcgccttccgtggagccgaccagcgcccgccaggcgtcgcggcgcgcctggcgcacggtttcccgggcggacgcgagggc

SEQ ID NO: 3775 - DNA, 382 bp, Unknown
  Kingdom: Bacteria, Phylum: Actinobacteria, Class: Actinobacteria, Order: Streptomycetales, Family: Streptomycetaceae, Genus: Streptomyces
  misc_feature (148)..(301): n is a, c, g, or t
ggcgctcccgtacgggagcgactgaccaaggacgcgccggtggtacgcgacctgcgcgggcgcacaggctgcggcccgtacagcctcgacctcaccgccggtgacgtcgtcgtggtctccggactccccggcagcgggaagtcgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcacgactgcggcacccagacctgggtccgccgctggctcgcccggcacgccgtgagccggggccgcacgctccacctg

SEQ ID NO: 3776 - DNA, 2500 bp, Unknown
  Kingdom: Bacteria, Phylum: Actinobacteria, Class: Actinobacteria, Order: Streptomycetales, Family: Streptomycetaceae, Genus: Streptomyces
tctccagtcccgcggcctcggcgagggcggagcgcggagcggcgccgatcgcggcgagcacgtcgtgggcggggtgctcctcgccgtcgtcggtgcgagctgcgagcaccatgccgtcctggccgacgatctcggtgaggcgggccccgaagtggaagcggacgccgtgcgcgctgtgcagttcggtgaagatctgacccagctcggggccgatgacctggtgcagcggggtgggctcggcttcgacgacggtgacctcggccccgtagccgcgggcggcggcggcgacctccaggccgatccagcctgctccggcgatgaccaggtggccgttgtcgcggccgagggcggcgagcacgttgcgcagccggtcggcgtgggcgagtcggcgcaggtggtggacgccggccaggtcggtgccggggacgtccaggcggcgcggttcggagccggtggccagcagcagcttgtcgtagtggatgacggtgttgtcgccgagctggacggtcttcgcgtaccggtcgagcgcggtgaccggctggccgaggtgcagttcgacgtcggcgcccgcgtaccaggcgcgttcgtgggtgaagacgctgtcgcgttcggccttgccgtccaggtagcccttggagagcggcggccgttcgtaggggtggtcgcgctcgtcgccgatgaggatcacccggccggtgaacccttcggcgcgcagcgtttcggccgccttcgcccctgcgagtcctgctccgacgatgacgaacgtctggtgtgcgtcgaccacttgatgcctcctcagtgctgtgctgcgcggcgcccccagctgcgagcgtcccgcacgcagcgtgatggcgaaagagggggtgcccgggacaggtcacccccagtggtcaggttccagtctgccggtcagccgcgacgggcggtcagcgcggcgtgcagggatcgtgcggaggcgtccgtgagcgccgcgatctggtcgacgaggacccgcttgcgggcgtggtcgtcgggcgcctggtcgaacagggcgcggaagtgcggttccaggccttcgggggcgcgggcggtgagggcggcggccagctcggcgatcacgatgcgctggtcggcgcggatggcctcctgctcggcgcgctgcatgacgtaccggtcggcgaccgccttgagcaccgcgcactcgtggcgcaccgcgcgcgggacgaccagttcggcgccgtaccggccgaggcggcccggtccgtacaccgcgcgggtggcggtctcggcctccatgcagaagcggccgatgagctggctggtggcgtccttgaggcgggcctgggccacggcggagccgtcgtagccgtgcggccaccagtcctggtcgatcagccggtccaaggcctccgacagctcctgcgggtcggtgccggccgggacgtagcggccgatggcgaccgcccagatctcctcgcgctccggctcggcgtagaggcagttggggtcgatgtgcccggcgtgcagcccgtcctcgaagtcgtgcacgctgtaggccacgtcgtcggaccagtccatgacctgggcctcgaagcaggtgcggtcctcgggggcgccctcgcgggcccacgcgaagaccgggaggtcgtcggcgtacaccccgaacttggcggagtgcgggtccgtggggtgcgcgccgcgcggccaggggtacttggtggcggcgtccagggcggcccgggtcaggttgagaccgacgctgaccaggtcgccggtgtgcgggtcgcggacgaagcgcttgggctccaggcgggtcagcaggcgcagggactgggcgttgccctcgaagccgccgcagtcggaggcgaagtcgtcgatcgcctgttcgccgttgtggccgaacggtgggtggcccatgtcgtgggccaggcacgccgtctccaccaggtccgggtcgcagccgaggaccgcgcccagctcgcggccgacctgggcgcactccagggagtgggtgagccgggtgcgggggctggcgtcccagacgagggagcgggtgccgggcgtcacgacctgggtcttcccggcgagccggcgcagggcggcggagtgcaggacccgggcgcggtcgcgctggaaggcggtgcggcccgggcgcttgtcctcctcggtgtcgaagcgctcggtgtcggcggacccgtaggggctcgacccccgtccgctcggtgcgctctgtgcgccgtgtgtccggtctgccccgtgtgcgccctgtgtgccgtccatggttccgacagtagcgaccgggacggacaacgtggtgggagcgggcccgggatgtcaggcggaagcgagcaggctcaccgcgtcggccggggcgagagccccctccgaggcggaccgtgcctggtcgtagcggtgcagtacgaggcgggccatcgccgggtgggcgccgagcggggtggcggcccggtgcggtacggcgtcggcgcaggcgctcgcgaagcggccgggggcggtgaagtac

SEQ ID NO: 3777 - DNA, 3437 bp, Unknown
  Kingdom: Bacteria, Phylum: Actinobacteria, Class: Actinobacteria, Order: Streptomycetales, Family: Streptomycetaceae, Genus: Streptomyces
gcggggcacggcacgtgagggggccggcaccgggcgggtcctggcagggtcggtctgcttcatggcgggaactctctctcggtcatgcgttcggggcgccgaaccagcggtgcagcgcggtacggagcggtgtcgtccccccgtcgacccaggcgatgtgaccgtcggggcggagcaggaccgcacggagaccgctgccgccgggttcgtcccgggacccggtccccggtccgtgcgatgtcctggccgccgccgggcggacccggtcggcccagccggccaccgcttccggcggcagacccgcggcgaagtcgagcagcaccccgcggccggtgcggagcagttcggcggtgctggagggaccggtctcgacggtcagctcccagtccggcgcccggctgccgagcagcggggtgtcgctcccgccggggtagcggacgtccaggccgctgatcgtgccgaccaggtgccggaccacctcgtcgtggccgagcagttcggccatgaccgcgcgcatcggctccacctccgcgccgccgagcagcaacgtggcctgcgcctcgatgttgcccagcacccggcggccgacggcgtgccgctcctcgtggtaggtgtccaacagctccggcggcgcccacccccgtacctgcgccgccagcttccagcccaggttcacggcgtcctgaagacccaggttgagggcctggccgccgaccggcatctgtaggtgggcagcgtccccggccagcaggactcgaccctcgcggtaccgctcggccagccgtcgggcgttgccgaaggcgttcacccagaccggttcgcccgcgccgatgtcctctccggtgaccctcgcccatacggcggcgacctcggcgaactgaggctcccgggtccgttgggcagcgggctttccgaactcgtgcaccatgacccgggtgatcccgtccgggcggcggtgggcgatggccaggccgtgctcatggcgttcgaaccggcggtcggggacgtcgattccggccacgtcggcgcggaggagctcgcgcgtcgcgtccgtaccggggaaggcgaagccggccagccgccgtacggtgctgttctcaccgtcgcacccgaccaggtagccggccgtgaaccggacccggccgccggggcccgccacctcggcctcgacgccggacccggtctgccgcagccccaccagctcgtgaccgcgcctgacgaccgcgccgagaccggccgcccagtcgcccagcagtcgctcggtgcgggcctgctgcaccttccactggccccggtggcggctgtccagcccgctgaagtcgagacggatccccccgaagtgcccggccatgtcgtggggcggccgacccagcgcgtcgagcagaccccgctggtcgaggagctccatcgtgcgggcgtgcagcgtcgaggcccgggactcggtggtgggttcggccagccgctccagtacggtcacccgcgccccgccggtccgcagctcacctgccagcatcagcccgaccggcccggcgcccacgacgatcacgtcggtgtccacagactccgtggccatggtcagccctggttctccgcgtagtccttcgcatggccgagggtggcccggctgttggtgctcagcgcgttgcgcacgtactcccgggcatccgccacgctcgcgtccggaccgagcacccgggcgatgttggcggtgttgaggaccacggtgtgctgcgaggaggcggcgacgcccccctcgttctccgcgaaggtccagtagccggtgtgcagcgtcatcagcgcgggcagggtgacctgcttgtaggcgatcctgtggtgcgggaaggtcacccggtacgacttggtggtgtgcgtggaaccgtccttcgcgcgggtgtccatctccagggactgcaaccccggggtgtcctcctccaggcggacgctcgccacgtgcggaagccgctcggcccagagacccgcctcgttgatgaagtcgtagacgtccttggcctggccctggacctggacggtgtcctcgaaggagaaggtgagctcctcggacgcgtgggccaattcgacgttctgcttcagtgaggcgagttcggaacggctgttgcgatcgacggcctcgtcgatccacttcaggctcgcggggtcgtcgtcgaccgcccggtagtcgtgcagcagccgcacccgggacgccgtgtcggacagcggctcgacgatccaggtgccgcccatggcggcgaccggcgggctggagacctcctgccggaaggtaatccgcagtgcgcgcgggtccagggtgcggtgcgacgtccagttcttggcctcgccgttggcggtggcccagatccggatgcgttcctcgtcggcgccgcgctccacgtgatcgacgtggatggtgggcgggaagatccggggccagttctccacctcggcgatcagccggtagacggcggcggccggggcgtcgacgtcgatctcgtgctcgaccatgcggttcgtcatgggtcctcttctccgcgggtatcagaagttgccgaggccgccacagacgttcagcgcctgtgcggtgatggaggcggcggtgtcggaggccaggtagccgaccaggcccgcgacctcctggggggtggagtaacggcccagcgggatcttcgcctcgaacttctcgagaatggcctcctcgctcgtgtcgtaggcggcggcgtagccctggcggacgcgctgcgccatcggggtctcgacgtacccggggcagacggcgttcacggtgatcccggtcggggccagctcgttgccgagcgacttggtgaagccgacgacaccgtgcttggaggccgagtacggggcgccgagcacgacgccctgctttccggcggtggaggcgatgttgatgatccggccgcggtccttgtgccgcataccgccggtgttcagcacttcacgggtcatcaggaacacgctgttgaggttggtgtcgatgacgtcgaaccagagatcgtccgcgatgtcggcggtgacgccgcctccggaccggcccgcgttgttgaccagcacgtcgaccgggccgaaacgttcgacggcctggtgtacgaagcgatggatgtcgtcggcggaacggacgtcgcagggggcgccgtcgacgtcgagtccttcgtcgaggagctccttgacagtgcgggccacgccgtcctccgtacgggcgcagaggaacacgcggtggccctgccgggccagcagcctggctgcctccagcccgatgccgctggtggcgccggtaacgatggcgaccttcggattctgctccgtcatgctgtctcctgactgcgttggtgggcgacttgctgtacggggtggactcgcgggcgcactggtgcgggcgcgaggcggtccggggcgccgtcggccccgccgaggcatcgacggtggac

SEQ ID NO: 3778 - DNA, 3079 bp, Unknown
  Kingdom: Bacteria, Phylum: Actinobacteria, Class: Actinobacteria, Order: Streptomycetales, Family: Streptomycetaceae, Genus: Streptomyces
cgaggccgtggccgccgcgacgcgttcggacgggacctccccgtacagggtcgtgcgggggcgggacgggcggcccgcgagttcggcgatggcctccaggccctggatcgagcggtacgagccgtaactcgacccggccatccgggagatggtctcctccatcagtgtgccgcccaggtcgttcgcacccgagcggagcatctccgccgcgccctccgtgccgagcttcacccagctcgtctggatgttggtgatgtgcgggtggagaaggagtcgcgccatcgcggtgacggcccggttgtcgcggtccgtcgggccggggcgggcgatgccggccaggtagacgggggcgttggtgtggatgaaggggagcgtcacgaactccgtcaggccgccggtctcctgctggagtcgggcgagggtgcggaagtgaccgagccagtggcggggctggtccacatgcccgtacatcatcgtcgaggacgagcgcaggcccacctcgtgcgccgtcctgatgacctccagccaggtggccgtcggcagtttgcccttggtgaggacccagcggacctcgtcgtccaggatctccgccgccgtgccggggatcgagtcgagcccggcctccttggctgcggtcagccagtcgcggatcgacatgccggtgcgggtcgccccgttgacgacctccatcggcgagaacgcgtggacgtgcatgccggggacgcgttccttcaccgcgcgggcgatgtcgaagtacgccgtcccgggcaggtccgggtggatgccgccctgcatgcagacctcgaccgcgccgacgtcccacgcctgcgccgcccggtccgcgacctggtccagggagagcgtgtacgcgtcggcgtcggtgcggcgctgggcgaaggcgcagaagcggcagccggtgtagcagacgttggtgaagttgatgttccgcgtgacgatgtacgtgacgtcgtcgccgaccacgtccttgcgcagcgcgtcagcgatccggcacagctcgtccagcgccgggccgtccgcgtggagcagggcgagcgcctggtcgtcggtgagcttcgtcgggtcgtcggcggcctggctcagcgcctggcgtacgtcggcgtcgatgcgggaggggaccatgccgggggccgccgcctcgcggagcgcctcccagtccccgtacacctcgtcgaagtcgtcgcggcggtcgccggtgcggccctcggtgtcgatggtggtgtggagatcggtgcggccgaaggagctgaaaccctcgtccggctcctgccagggcaggccgacggggatcgcgtcctcgcgggccaggcccgtctccgggtcggccagggcacggacgtgcgggaggaggcgggggtccagccagggctcgccgcgctggatgaactccgggtagatggtgaggcgttcacggagcgtgaagccggattccgccgtcttcgcggccagttcgtcgatgtgcggccaggggcgctcggggttcacatggtcgggcgtgagcggcgagaccccgccccagtcgtcgatgcccgcgccgatgaggagcgcgtactcggcgtccaccaggttcggcggggcctggatccgggcggacgggccgaggatgtgccgggccaccgcgatggcggcggccagctcctccagctccgcgtcgggcatcccgcgcatcgccgtgtccggcttggcgcggaagttctgcacgatgacttcctggatgccgtggtaggcgcgggccgtcttccgcagctcgaagagggagtcggcgcgctcctcgtaggactcgccgatcccgatcaggatgccggtggtgaaggggacgttggagcggccggcgtcctccaggacgcgcagccgtacggccggttccttgtccggggagccgtggtgcgggccgcccggctcggaccacaggcgggtcgccgtcgtctccagcatcatccccatcgagggagcgacgggcttcaggcgctggaggtcggtccaggtcatcacgcccgggttgaggtggggcagcagacccgtctcctccaggacccggatcgccatggcgcgtacgtacgcgagcgtgtcgtcgtacccctccgcctccagccactcccgcgcctcgggccaccggtcctcgggtcggtcgccgagcgtgaacagcgcttccttgcagcccgtcgccgcaccctcgcgggcgatcttcagcacctcgtcgggcgagaggaacatgccgtggccggcccggcgcagcttgccggggacggtgacgaaggtgcagtagtggcacttgtcacggcagaggcgggtgagcgggatgaagaccttgcgcgagtacgtgatcacgcccggccggcccgccgcctccaggcccgcgtcccggacgcgggaggccgacgccgcgaggtccgtcagatcgtcgccgcgcgcctggagcaggacggcggcctcggtcacgtcgagggcgacaccgtcgcgggcgcgtttgagcgcgcgccgcatggcgttggaggtcgggcgtccgctctgagcttcggtcatgaaccgagcatacgagcgaggtgcgcgcgccggaccagggcatcggggtcgcttgtcgaggattcgccggtcgcgacgtgcccgtggtcactcgtgcgggccgactcacccggatgagaccccgccgacggtgtcctcacgcttagtgtcggaacggtgatggaaacgatcgtcctcgacatcggcgaaaccctcgtacgcgacgaccggcactgggcgtcctgggccaactggctcggcgtaccgccgcacacgctcagtgcgctggtcggcgcggccgtcgcccagggccgcgaggccacggacgcgctgcgcgtcctgcggcccgatatggacgtcgaggaggcctaccgcgcgcgagccgccgccgggcgcggggagcatctcgacgagtcggacctctaccaggacgtgcggcccgcgctgggcgagctgcgggccgcgggcatccgggtcgtggtggcggggaacggcaccgtccgggccggggagctgctgcggggcctggacctgcccgccgacctggtggtcacctcgg

SEQ ID NO: 3779 - DNA, 3867 bp, Unknown
  Kingdom: Bacteria, Phylum: Actinobacteria, Class: Actinobacteria, Order: Streptomycetales, Family: Streptomycetaceae, Genus: Streptomyces
ggccagcagcgtccagacgcccagaccgagcaccagcacggaccccgtgccgatcccggccgcggcgaccaccgtcatcgggccgctccgcgcggcctcccgggcgttcttccccttccgggccacttcccggtcctggtcggtgacgccgaagaccccggcgtcgccctcgtacggagacggcccggcttcgttcttcacctggaccgccagctcgaacgggatcggctcgtcgccgtaggactccgtgagcttcgggctgagggacaccgacaggtagtaccagcccgcgaagcgcatggcgctgacctgggccgaggagtcgaaccggttgcggtaggccaccggcggcagcggcctcagggaagcggacgcgggccctccggagtacgagagcgtggcgtcggagacatggccctgggcggggttgtccagcgacagggtgagcgcgctgcccacgaagtccttggtggcgctcgtgctgttggaaagcccggcggtggcgtggatctgctgcccccagtccaccggcacccggtagaagcgggtctgccccgggacgaccgtgtcctgccaacggccgttctccagaccggtggcctcggagtacccggccccgccggaccgcttctgctgcttcccggtcagcggcttcggcgaggcggacggccaactgccgggcccctcggtcggcatggacgacccgctcttcagccggggctcctggaggaaacgcaactccagcccccaggcagcggagttggacgtctccttgctctcacgctcgacgaggacgtcgtactggccgctctcctggcaggtggtgctggattccttgatggtccgggagacgtacgcggcgatgggacgcgcgtactcgcccgcgccgaaggtcgcccgctccgcgctgcacggggtgtcgtcggtctcccgaagactgacgttgatgccgtcgccgtacgcgacctcgccgctgtcgccgggcaccgcgaccgccgagacataggcggcggagacctcgtccagcgtgacccggtagtagagcttctcgcccggcctgatggtgctgcggtacgggacaccctcgtcgagttcggacgcctcgacgttcgccgtcgccccctgcaccttcttcgcttccgggtcgaacgcgtacgccccggggccggccgcgtgtgcctgtcccggcagggccgccgccgcgcacatcgccgcgagtaccgcggccaccacccggcccctgttgcgctgcctcttcacgcgcttcccctcgtcgtcctcgcgtgccggtgccgtcgaccgcccggccgcgatgccggtccatcctgccccgctggggagtgtccgccaagtatcgtcgtccgccctccgggcggggcagacgagactttgcggacacggctagccgccgctgtctccagccacagccgcattgccccttcttgtccgcgttcctacctcagccgacaccccatcggagttcactggagcaatttatgtatgtgctcaagtggactcaagaggccgagagatacggcgtcacgcgcgcacgacaaagggcccgttcgccggcgaacgggccccggacagcacgaagccccggccgctcagcgaccggggcccgtaacagactgtgccgtctcacacacccgaacctgcgggcacggagtcggtcgcctccgtccacagatcctgctcggcgcgatccgcctggatctggcggtacacgaggagcccgccgatggcggccagtgcgaccaggagaagcttcttcaccgcgcgacctcgtctttccttggcgtaagggccttctgtcgccgactatacacaccggccgataccgatcggtgacctgcccggaaccccggagtaccccctccccggcgtcccgaacgatctcccggaaccctctcccgaccgtccgcgagggcctgtccagcccggttgcaccatacgagtggtgttaatccgaagatcggcgcagagcgggcgtcgctccccgaaatcacggcccggatccacatgatcggagaagtcagcaaccggaccgtccgaaagcgaggggccatgagcaccttccagcccaagaacctctggaccgccttcatcaccgccttcttcgccctcctggcgtcgctgggcctcgccaccgccacggcgggcaccgcgagcgccacgaacgccgcggcgcagccgagcgccacgccccaggagcacacggccgccacggcggcaactccgatcgatccctcggtccgatggacccttccgcgtgaccgggccctcccgcccacgatgaagcagcgcatccgtgccgaggcccacggctcctccccggccacccggcacctgtcgctcgaccccgcggagaccgcccgcacgaccggcccggccgactcccaccgcacagccccggaaggcgactccccggcgccacccccctgatcccggcgcccgccgcactccggggcccctggtccggttcacaccggccgggggcctttccatgtgctgcctgccgtacatggatccccggtccgcggatggaccgcgaatccgggccgccggccgagcacttgggacggccgaacagctcagccccgccccagtgcggcgaggcccttctgcaggtcttcgctgttcatcaccggctggatctcgatcttcgcaccgagcctctcgaagagcggctccgcgatggtgggcagctgcgaactgtcctgcatgtcgaagacgaacgtgcagcaccgtccgccctcgctgggcccgaagtaggccgcctccggctccagccgttccgtcatcgacttcatgacctccggcagcgtgccgttcttgatggcctcattggagatctgtgtgtccatatgagctctcagcatgaccctcatggcatcgctccttccatccagggcgaccggcgtgcgtccgtgctccctgaccttcagtgacatcgggatcagccttccgcgggtggtcccggcggcaacgtgtcgcccaccatccaggctgcccttcgtcgtgacctgaagcacccggcgcgggcgcctcgcgcgggcgaaacctctggaagatccgctgatcggcccgatgccggccggatacgccgaaggccccccaccgtctccggtggggggccttcgtgctggtggggctaacaggatttgaacctgtggcctcatccttatcagggatgcgctctaaccaactgagctatagccccgccgcgctgtcgcgctgacttctgaagattagcgcacgtcggggccagtcccaaaatcgatactcggcgcgctactcgtcctcggccagcgtgagctcgacgccgcccacgaagcccgccgaaaggttgtagatgaaggcgcccagcgtcgccagcgcggtggccagcaccacgtcgatcacggcgatgaccgaggtgaagatgagcacgcgcggcagcgacaggaacgactggagatcgaagccgttgctctcgttcgagccggtggcctcgctgatcgttccgccgacggtctcgaagacgcccatcgcgtccatgaccatccacagcaccgccgacgccaccaccgtgcagatgcccagcgcgatcgacagcaggaagctgaccttcatcaccgaccacgggtcggccttggccacccgcagacgggccttgcgggtacgcggagtggtccgcgcccccgtgcgcggcttgcgcgtcgcctgggcgccgcccacgccctgcgcaccgcccagcgtgccgccggccggctgtccggggcgctgctggccgccctgggtgccgccgccgggcgcctggtacgcctggggcgggtggtacggccccgacggccccggtgcgggctcacgctcgccgggcagggg

SEQ ID NO: 3780 - DNA, 597 bp, Unknown
  Kingdom: Bacteria, Phylum: Actinobacteria, Class: Actinobacteria, Order: Streptomycetales, Family: Streptomycetaceae, Genus: Streptomyces
cctcggcccgcagctccccgtcgcgaccctcgccgaagcgaccccgcagatgtccggcgagagtctgttcgtaacggcgcaccaccgacagttcgtacgtccgcagccccggcacctcccgggtgaggcggtagcgctgcacggagaactcggggttggcggcgtacatccgcagcacgatgcgcgcggcgtcgcacaccgcgccgaccgggtcgctgtcgtcgacggcggccaggaactcggtcgtctcggcgaggcagcgctcgtggtccgggaagaccacgtcctccttggacgggaagtagcggaagaacgaacgccggcccactccggccagcgccacgatgtcgtccacggtcgtccgctcgaagccccgctccaggaagagctggaaggccgcctgggcgagcacctcccgcatgggtgccttcttctcggatcctcgcgcctcgctcatgcggcgaaacgtagcaccgcgagaaggattttggcactgcgtacctttacagagggtactgagtgccataatcttccatcagtacgaatgacacccaggtgggaccacacccaggtaggcaggagagccggcgtgagctt

SEQ ID NO: 3781 - DNA, 1372 bp, Unknown
  Kingdom: Bacteria, Phylum: Actinobacteria, Class: Actinobacteria, Order: Streptomycetales, Family: Streptomycetaceae, Genus: Streptomyces
gccagggcgagcggcagcccggggcggaccaggtacacgaggagcgggagcaggccggcggcggcgaccggcaggacgatccgggagcggttacgggggctgagcgcggagcccacgaacagctcggccccgatgtgcccgacggccatcgcgcagagcagcagcccgagcgcggcgggcgagaccccgatcgcgtcggcgtacggggcggcgagcgcctccggggccaccacgaacatcgcgggcagccagaacagcagcagcagcgcccggatgcggcggtctcccagcaccaggcgggccccggacagcgactccttgagaagggtcccgccgccgtcaccggtggcggcgcgggcggggcggtcgcgggtgccgaagcggagcagggcggccgagcacaggaaggtcaccacggtgacggtgatcgcgccgcgcggggacagcacggtgagcagcacacctccggcgccgaacccgatgagcatcgcgctctgcgagacgatccgcagcagcgaacggccgagcacgtagaggtcgccctcgccgaggatgtcggtgagcgccgccatccgggtcccggtgaagacgggcgcgatggccgcgaccaggcagcgcagggcgagcagtccggcgaccggggtggtgggcaccagcatcacgacgacgcaggcggcgcagagcagatcgcagacgaccaggacgcggcgggccgggtagcggtcggcgacccccgcgaacagcgtcccgccgatcatgtacggaagcagccccagcgcgaacgtcagcgcgctgagcagcggggagccggtgaggtcgtagacgagcacggtgagcgccagctcactgaccacgacgccgagcagcgagagcagatgcgcggcgaagacggcccggaactcaggtacggcgaagaccgcgccgtagccggccgacggggtggcggaagattcctgggacatggggagagcctggggtcgagcacccccggagcctagactttcggctggagccgaatgttccaccgcggggcgagggagaggcatgccgttccagctgcacttcggcgagagcgatctgctgcgctgccggttcgcgctgtcaccgctgttcgagacccaggaggcggtgcgcaccctgtcgcgcccctaccgccacggctaccacctgccctggctccgccggatccgggaggcggccgcggccctggacctggagccgctgtggctgctgatgccggaccgcgggcacaacccggacttcatctgccctccgccgataggaccgctggccaccttcgaggaggagatcgcggcggtgcgggccgtcgatccggaggtggcgcgggccgacatggcgctggcgctgggcg

SEQ ID NO: 3782 - DNA, 5235 bp, Unknown
  Kingdom: Bacteria, Phylum: Actinobacteria, Class: Actinobacteria, Order: Streptomycetales, Family: Streptomycetaceae, Genus: Streptomyces
gtctcgtccaggacgcggtgcagcccggtcacgtcgcgggtgaccgtctccgcgtccgggcccgccgccgcgacgtgctcggcctcggccttggcggcgatcagctccggcagatacgcgggggcgtcgacgtgggtgagcagggtgggcaggtgggcctgcacctcgccggtgcgcatcaggtggatgccggtcagcagcgcccggaaggtgtagagcagcggcttcagttcgccgttgttcccgtggagccgccactgcgtccccgcgaagccccggtagtggtgggcgtggttgcgggtgagaacgcccggggcgagcgcggtcagctccgtgtggagcgggctcgtgtgcaccaccagcggggacagcagctgctccaggacgtagccgttcggccggagcatcagacggacgaacttgcgcaggtcgtgggtgacgaggtccagttcgaccccgtcacgctcccacatccgggtgcgggtctcctccggctcgtgcagccccaccaggtcctcggcgggcaggacgtggaccccccgcaggtccacgtccgagtcccgggaggggaagccgtacagatgggcgccggagaccgtggcgaaggccagggggccgggcgcgtgcgcgaggtcggggcgcagatcggtgaccgggagcccggcccgctccagggagatgtcggtggcggtggtcatcggtcaggcatcccagagcgcggcgagggagagcaggtcgctgcggtactcgatgcgctccgaccactccttgggccaggccgccgcacccaggtgcgctccggccagcgctccggtcaggcaggcgatcgaatcggagtcgccccgggtgcaggcggcccggcgcagggcggtgacgggctcctcggggaacagcaggaagcagtgcagggcggaggcgagggcttcctcggcgacccagccgtcgccggtccgctcgcacgggtcggtctccggtgacggatcgcgcagcgcttcctggacgcgtcccagcgcggtcaggcactcgtcccagccgcgctggatgtacgcctccggggtggcgtctcccgcgtggcgccagaggtcgccgagccagcgggtgtggtagcggccccggttctcgtaggcgtagctgcgcagctgcccgatcaggccgaggggttcggcgccctgggcgagcaggaacaccgcgcgggccagcaggtcggaggcggtcagggcggtggggtggccgtgggtgagggcggcctggagctgagcggcgccggcgcgctgctcctcgctgaggccggggaccaggccgaggggagcgacccgcatgttggcgccgcagcccttggagtgcgtctggctggcctcctgccagacccgggtgtgttcgagcaggcggcaggcggtgaggcaggtgttgcccggggcgcggttgttgtccggcgagtggtaccaggcgacgaactccgcgcggaccgggtccaccagccggtcgggggtgagcagtccgctgtccatggcggtgcggatgcctcggcccagcgcgatcgtcatctgggtgtcgtcggagacgactgcgggcgtcaggagggggatctgccgccagggaccgaacttggcgaggatggcgggtacgtcgttgaactcggtggggaagcccagggcgtcgccgagcgcgagcccggtcagcacgccggtggccgcctgcttggtgaggggcggggtggtgatcgtcatctgtctcgtccttccggtgcggagtacgacgggtctgcgggggcgtccggtcgtggcgggcgcaggagcggcgggtgcagggcggtggcgtcgcccgcccggtagagggcggccggtttgccccggccgccggtgcggcgcggcgggccctcgacggcttggacgaagccgggcgcgttcaggaccttgcgccggaagttggggcggtcgagctcgacgccccagacggtctcgtagacctgctggagctcgccgagggtgaattcggcggggcagaactcggtggccaggcagctgtactcgagtttggcgccgatccggtcgtgggcgtcggcgaggatccggtcgtggtcgaaggccagtggtccggtggagccggcgtcccaccaccgggcgctcgccgcgtcgcccccgccgcgcggttcgggcaggtccggcaggagtgcggcgtacgcgacggagacgacccgcatcctcgggtcgcggtccggcgcggtgtaggtgcgcagctgttcgaggtggagggtgccgacggcgccctggccgaggccggtctcctcggcgagttcgcggcgggcggcgtcctcggcggactcgtggggcagcaggaagccgccgggcagcgcccaccggccccggaagggctcctgaccgcgttcgacgagcagcacgtgcagccgggcctcgcggacggtgaagaccgcgagatcgacggtgaccgcgaacggggcgaaggcgtgcgggtcgtagccctcggggacggggttgctcatcgtttctccgggaggggggcggcgaagtcccagccggtggcgaggagttcgtcgacggcgtcgacggctacggcgagccgcgcctcgggcgggccggtgatctcgatgaaccgccttcccgtgcgggtgagttcggcccggaagcggtcggtcatccagggccgcagctcctcgccgtcgcgcagcccgtcgtcctcgaaggcgacgccctcgtggtcggtgagcagccacaggtggtgggcggtgcggtcggcgatctcctcgacgagcgggttgcggccgccgacgtaccgctcgtgccagacggtggtggcgaaggagtccgtgtcgcagaagagcaccggggacccggcgcgggccgcgtcctcctcccggtcgttctgggccttcgcgatgagcgggaagtcgtcggtggtgaagctgacgtcctcccagacggccccgggccaccgctcgcgcagggcggcgagcttgtgctcgctgtactcgcgcccgtactcggcgacgtagccggtgcgcgcccacacgccgccgcgcgtgcggtagtgggcggcgagcgcccgcgcgagggtggtcgtgccggtggactccgcgccgaggacgacgacccggcgggcgagggcggcccgcacgggtggccggaggaagtcccagcagccggcggggtccttgcgcacggcggtgccggagaccgggaagagcgtgcggtcggggtcgacgaggacggacgccgcgccgaagcggtggcccagctcctccccgtacgcctccgaggtgaagacggcgtccacccgttcgggcacggcggcggtgaacaccgccatgtgcgcgtcccagaccgccgggtcatggacatccatgtgcgtgtcgtcgaccgcgcccaccaccgtgacgtccgggtggacctcgcgcatccaggcgacccggtcggcgagcgggacggactccacggaggcggcgcagaccagcacggtcagccgttcgcagcggtcccgggcggtctcgacgaggtggtggtggccggcgtgcggcgggtagaacttgccgaggaccaggccgtgttcgtagcgcttcatgccgcggccacctccgcgggacgtgtggtgcgggcggccaggtcgcggtgccagcttcgcaggccgacgaggcagagcgcgaggaacccgacgtacagcagcgaggtcagatacagccccttgtgggcgtacagcgggatgtagaccacatcggccgcgatccagagccaccaggactccagccgcttcctgcactgcccgtacgtcgccatcagcgacagggacgtcgtcagcgcgtcccagaacgggacggtggagtcggtcgcccgggacagcagcagggtgatcccgagggtccccgccacccccgccgcgagcagccaggtccattcggtgcgggtcgttccgcgcaccggcaggacggaggttcctggtccacccccgtgggtccaggtccaccagccgtacgcggcgagggtgatgaagacgatctggaggccggcgtcggcgtacagaccggactgggcgaacaacaggatgaagaagaggttgttggcgatgccgatcggccagttggcgaggtgctggcgggccacgagccagacgcacagcgccccgcttccgaagcccagcacctcggtccagctgaccggggtgtccaggatcgtcaccaggggctgttgcaggggatcgagtacgtccgcgaggctcacgcccgcctccttcttaatagtcactctgactataaaggctggacgggggcagcgaaaggcccacggccggttctgttcgaactttccgaacagataccggccgcgggcccggggagcgcgctgttagagaccgacctcgcgcatcagcatgccgacctcggtgttggtgaggcggcgcagccagccggacttctggtcgcccagcgggatcggcccgaaggacgtccgcacgagccgctcgaccgggaagcccgcctcggccagcatccggcgcacgatgtgcttgcggccctcgtggagggtcacctcgaccaggtagttcttgccggtgttctcgaccacgcggaagtggtcggcgcgggcgtagccgtcctccagctggatgccgtccttgagccgcttgccgaggtcgcgcggcagggggccctggatggcggccaggtaggtcttcttcacgccgtacttggggtgcgtgaggcggtgggccagctcaccgtggttggtgagcatgatgatgccctccgtctcggtgtccagccggccgacgtggaacagccgcgtctcgcggttggtcacgtagtcgccgaggcactggcggccgtccgggtcctccatcgaggagacgacaccggcgggcttgttcagcgcgaagaagagatacgactgggcggcgaccgtcaggccgtcgaccttgatctcgtcctggtgcacgtcgacgcgcatgccctgctcgacgacgatctcaccgttgacctcgacgcgggactgctcgatcagctcctcgcacgcccggcgcgatcccatgccggcgcgggcgagcaccttctgcagccgctcgccctcctgctcggcgcccgggtgggtcttggggaggttgatctcgggcttgttcgcatagcggtcgcggttgcgctgctcgatcttggcgtccagctcacgggggcgcgagggggcggcgcggcggaaaccgccggtgcggccgctgccgccctgcgcgggcttcggg

SEQ ID NO: 3783 - DNA, 1846 bp, Unknown
  Kingdom: Bacteria, Phylum: Actinobacteria, Class: Actinobacteria, Order: Streptomycetales, Family: Streptomycetaceae, Genus: Streptomyces
tcatccacgcgtcgccgccgtgccagcacgacagcgactgccagcgcctccagggcaacacccaccccgacctcatcgcccccacccgcaccgctctccaggcgaccggacggccgtgggtgctggagaacgtgcgcggagccctgccgaagctggacaggcccgtgatgctgtgcgggccgatgttcggggtggagacgtaccggcaccggtacttcgagaccggcggcggcttcaccctccctcagccccaccaccccggccacacggtcccccaggcgaagatgggccgacccgtcccgcccggccactacgggcagttcgtcggcaacttctccggcgtccagcacgcccgcaccgtcctgggtgtcccctggatgaaccgcgacggcatccgcgaatgcatccccccggcctacagccgctggatcggcactcacgcccggtacagcctccgcgccaagggggtggccgcatgagcgcccacctgcgcaccgccgtcaacctggccacccggggcgtgcccgtcctgccgctgcgggcggggaaggtcccgttcgggaactgcccggcctgccgggacaacgcctgtggcggccggccgaacatgaagacccccggcccgtgcgactgcccccgcccgtgccacgcgtgggctgctgccaccatcgacctcgacgtcatcgccgggcccacctggtcgacggcgtggaagcaggcggcggttgtcgcctggcaccccggcgggatcggcctgaccgtcgtcgacctcgaccacgccgacgccgtcgcgtgggcacgccggaacctgcctgccacgcggaccgtgccgacgacacggggcgagcactggatctaccagggtgcgatgcagtcctcgaatcacgtgcgggacggcgtcgacatcaagtcggccatgtcctacgcccggtggctcggctctggcaccggcaccatgacctccctgcccgacacggtgcgggccctggccgtcaaggagccgtcgccggtccggcccgtcaccgtggccgtgccgaccgggtccggggagtgccgtcaccgcaccccggcctacctcgaacgcggcatcgccatggcggagcagcgcatcaccgaggcggccagcgccgtgcacgcgaccgtgtatcgcacgttcctggctgtgctgtccgcccacggccggtgcggctgcctcaccgacgcccacgccgcccggctgttcgccgccgcgcagaccaagggcgaaagcccgcgccactgcaccgacgcgtggtccaacgcccgtaccgcactggggatgtgacatgtccgaggacgagaagaacccggcgcgcgaggtcatcagcgagtatgcgcagtcccacttccggtacttccgcaccgccgacggcaccgtctacgcgcagaagaacggccaccccgtcgcccgcccgatccgctcccagggcacgacgggcagccaccggcaggaactcatggtcggcatgttcaaggacggggtcggcgtcttcaacggcaccgcgctcaaggaggcgttggacttgatcgaggcgctggcgatgaccgagaccacccaggccgtacacatccgcgtcgcccccggcttcgacggagccacctggctggacctcggccgcgccgacgggcagtccgtccgcatccaccccaccggatgggaagtcacggtccccgaccctcgggaggtgtgctggcggcgcacccagctcaccggcgaactccctctgcctgccaaggacaccgacggcaagggtatcgacctgctgatgcggctgtgcaacttcgccaacgccgaaaccgagtgcctggccatcgcctggctcatcgg

SEQ ID NO: 3784 - DNA, 4027 bp, Unknown
  Kingdom: Bacteria, Phylum: Actinobacteria, Class: Actinobacteria, Order: Streptomycetales, Family: Streptomycetaceae, Genus: Streptomyces
ccggagggcgcgggtcccgcgccctccggttccgccgacggaccgcccacgccccgttcacggcgctggctgctgggcttctgggccgccgtgttcgcggcgttcctcgcggtgtcgcccggccggatgacgttcgacaccaagctcggcgtcgtcgccgatccctggcgcttcctgggcgacctgggcgagctgtggcacagccgggccgggttcggcgggatcgccgaccagtacgtcggctacgccgtcccgatgctgccgtactacggggccgccgacctgctgcacgtaccggtctggctcgcggagcggctgtggctgtcgctgatcgtggcgaccgccttctggggtgcgctccggctggcggagcggctgcacgtgggttccccggccacccggctgccggccgcggtcgcgtacgcgctgtggccgacgtacaccatcgtcgtcggctcgacctcggctgcggccctgccgggcgccctgctgccgtgggtgctgctgccgctgacgaacccgcgcctcgcgccgaggatcgccgcggcccggtccgcgctgctgatcccgctgatgggcggcgtcaacgccgcctccacgctggcctcgctgctgccggtgggcctgtatctgctgtcccgtcccggcgggccgcgcaagcgcgccctgctggcgtggtggatcccgggcgtgatcctggcgaccgcctggtggatcgttccgctgctgctgctgggcgccttcggcgagaacttcatgccgtacgtggagtcctcgtacaccaccacgacgaccatgtcggcgaccgaggtgctgcgcggcggcgggaactgggtcggctacctgaacttcggcgaggcctggctgcccgccggctggaccgtcgccaccgcgagcgtcaccatcctgggctcggcgctcgccgccgccctgggcctggcgggactggcgcgccgtgatctgcccgagcgccgctggctggtgctgaccgtgctgagcgtcgcgctcatcacgctcgccggctacggcggcccgctgggcgggctgttccacgggaccgtgcagggctggctggacggctggctggtgccgttccgcaacatctacaagttccagacgggtctggcgctggccctggcgctgggcctcgcgcacctcaccgcggtggcctccgtcgccgccgcggcgcgtggcggcggccacccggtgcgcgcgcgccggctcgtgccggtgatcgccgccgcgctcgtgctgcccgggctcgcctggccgtacgtcaacggctcgatcctgcagacgggttcgttccagcagctgcccacgtactgggagacgaccgggagctggctgaagaagaactcggcgagcgaccgcgccctggtggtccccgcgaccgcgcacggcatctacacctggggttcccccatcgaccagccgctggacgtgctggcgaactccccctgggcgcaacgggattacgtgccgttcggtacgccgggcaaccggcgggcgatggacgcggtcgagcaggcgctgaccaccggcggcgaggtccccggactgagctcgtacctcaaccgggcgggactgcactacgtggtggtccgcaacgacctggatcccgatcagttggggtacgtccccacgaccacggtgaagcgcaccctggaggcgtccgggtacaagcgcgtcaccggcttcggtccggtgatgaccggcggccggatcgcggcggacacccccgtgcaggtcgagggcctctatccgcggcagcgggccgtggagatctacgagccgccggccgggacggagcgtcctgggcgggcgggtacggcaccggtggcctcgacggccgtcgtgagcggcggacccgagtccctgctgccgctgtcggcgagcggcgcgctgaacggccggccggccgtgctggccggcgacgcgcacccgggtctgggacggccgtcgctgtacgcggcgggcgacgggctgcggcgtgccgacacccggttcgggctggtcaactccaacacctcgtacacgtacaccgccgatgagcgcaacgcggtggaggccgcgcaggatccggaccggaacccccggcagatcctcccgacgtccggcgcggagcatcagaccaccgccgtgctgcggggcgccaagaaggtcagtgcctcgtcggtggggaactggctgttccatctgccgcagtacgacccggtcaacgccttcgacggcaacccggacaccggctgggcggaggggtccccgggctcgcccgaggacgagtgggtgcgtatcgacttcaccaccccgacggagcttccgggctcgctccaggtgacgccgctgcccagcgcgaacgtgcgggccgcgccgaccgtcgtgcgggtcgagaccgagcggggcttcaaggacagcccgctgaagccggacggatcgacgcagacggtggccgcgcccaccgggcaggcgtcctggctgaaggtgacgatcctggagtcccagcagggacgtcccggactcaccggcgccggtttcaccgacatcgcgatccccggggtgcaggtgacccggatgctggagctgccctccgacgcaccgcgcgagggtgcggactccacggtctactcgctgcggcggggcagcgaccccggcggtctgtcgtcggtggcggccgaggtcggcctgcaccggcagttcaccgcccgggaggccgggccgtacaaggtctccgccggcgcggtgccggtgcccggcgaggccctggacaagctgctgttcgagctgacgggcgagcgggacaagatcgaggtcagcgccgactccacggcacggctgggcaccagcctcagtccgcgcaacctgaccgacggtgatctgaccacggcgtggatcgcgggcgaacgccccgtactgcatctgtcctggccggagaagaaggaggtcggggagatcgtcttcgcggcggccggcggtctgtccacccgccccgagcaggtgcagatcagctcccccgacggcacggcggtggcctccgtggacgagaacggcatggcccgcttctcgccgatcaggaccgaccggatggacatcaccatctcgcgtcaggcaccgctgaccgtccacaacccggtcgccgacgaccagttgcagctaccggtggggctgagcgaggtctacatcccggccctggaggagtaccgctcgccgcagccgaagccggacaagaagttcagcctggcctgcggaaagggtccggtcctgtccgtcggcggtacgttcctggagacccgcgccgagggcctggtgcgggacctgacccagcgtcgccccatcgcggtcaccccgtgcacggagggcggcacggtggagctggccgcctcgtccaccacggtcgaggcgggtgacgcgggaccgctcgccatcacggacgtcacgctgagcaaggggacctccgaggccgcggcgagcacgccgcgttcggtggacgtagagcggggtgacggcgaccggcgcacgatcgccgtcggcgccggcgaggcctcctacctccagatccacgagaaccacaacaagggctggaaggccaccctggacggcgaggagctgacgccgctgcggatcgacggctggcagcaggcctggctggtcccggagggcgagggcggcaaggtcaccctggagtacgagccggcccggatctaccaggtgggtctgatcggcgcgggggtcctgctcctggcgctcgtgggactcgccttcgggcgccggcggggagccgagccgtacgcggccgaggagcagcccgtcgctcccggtccgggtctggtcctgggcaccgtggcgctcaccctggtgggggtggtgatcgcggggccgctcgccctggcggtgccggttctcgccgtactcgcccacttccggccgaagttgctcgcgtccggtcgcgttcgccgcgatggccgccgcgggtgtcgtcgccgcggtgggcaccggggacaccacggccgcgggcgagggcgcgttc

SEQ ID NO: 3785 - DNA, 7498 bp, Unknown
  Kingdom: Bacteria, Phylum: Actinobacteria, Class: Actinobacteria, Order: Streptomycetales, Family: Streptomycetaceae, Genus: Streptomyces
cctcgtcggatcccaccaccgccccctccggcaccacgccgcgcagcccggcgggcgaaagcacggacaccggcggaacgaacggcaccgccggcaccatcggcggctccggagaaacggggagcaccggcggcaccggcggtgacggcgacagcggaggggacggcggaggcgacggaggatccatcgagggcgttcgcggccccggcttccccggcgaccgaccggtatgaccggccgcaggagcccgtacgtcagtgcgtcagtgcccggaggtcgccttcaggccgaccacggccaccagcagcagacagacgaagaagatccgggcagcggtcgccggctcgttcagcgcgaccatccccacgatcgccgcaccggccgcgccgataccgacccacacgccgtacgccgtgccgatcggcagcgtcttcgccgcctgtgacagcaacaccatgctcgccacgatcccgaggccggtgaacacgctcggccacagccgggtgaacccctcggtgtacttcatcccgatcgaccagcccacttcgagcacaccggcaatgatcaacagaacccacgccatgactggcacctccgacgacgaaaccacgtgaacagaacgggtgcgtcgtctttgcagacccggtacggcgcgtctcgtcggggtggtcccaccgtagcaaaaaacgaggaaagagcctggtgacaccggtcaccaggccctgaacagcacgggtctacagatacaagccggtcgaatccaccgaaccctcgaaccggtcggcggccaccgcgtgcagatcgcgctcccgcatcaggacgtacgccactccccgcacctcgacctcggcacggtcctcggggtcgtacagaacccggtccccgggctccaccgtccgcacgttctgcccgaccgcgaccacgacggcccaggccaggcgccggcccaccgcggccgtcgccggaatcaggatgccgccgccggagcgccgctcgccctcggacgcgtcgttccgcaccagcacccggtcgtgcagcatccggatgggcagcttgtcgtcgtcggcggagccggtggcgccgcgatggccctcgtgggtgttgtcgctcacgcccgcaacctacctgccggaccccggtccgtacgcctccgggtgcggaacgcctccggacgcgtacggaccaccggtcacttgcggcggcgcccggacaccgtgagcaggcccaccacaccgatcaccagcagagccgcggggatcacccgctccagccgcggggagccgtcctccgcgacgaactgcgccttcacctccgacacggagcggttcaccgcgacgaaagcgcggccggccgtccggtccaccgtctgggccgccttcgccttggcgtctccgatgatcgtcttcgggtgtacccgcaccccgatctcgtcgagcaccacagcgagctgctcgcgcctgctgatgatgtccgcctcgatctgcgcaggggtcctggcatccgacactgcgccgcctccgtggtcgtcgtccggtaaaccttcgtctgaaccttcatcgacagtctgtcagctcgaacccccgcacacccggcggcacccctattaccctcggtcccgtccgacccgtgcaccacccgaggagacccccatgagcgagcgactgaagcccggcgacaccgctcccgccttcacccttcccgacgccgacggcaacgaggtgtcgctcgcggaccacaagggacgcaaggtcatcgtgtacttctacccggccgcgctcacccccggatgcaccaagcaggcctgcgacttcacggacaacctcgacctcctgacgagcgccgggtacgacgtcatcggcgtctcccccgacaagccggagaagctcgcgaagttccgcgacacggagaacctcaaggtcaccctggtgggcgacccggcgaaggaaattttggaggcctacggcgccttcggcgagaagaagctttacggcaaagtggtgacgggcgtgatccgttccaccgtcgtcgtcgacgaggacggcaagatcgagcacgcgttctacaacgtgaaggcgaccggccacgtggccaagatcatcagggatctgggtatctgagacccgccggcgcccgccggaaagcgcccgtcccgcacacgatcccgacacgctccccggccggagaacgtgtcgagatcgtgtgagggagatcgcatcgaccccggaagtcggtttgcgaccgccatgactgcgcagaagcctttcctggaacacactccgaggaaaggacccggccatggcggcccccgacccccaccaggcggccgaccccgaagcggtcaaacgccaccccgcactcttccgggccatccggaaacggcggaacccgcggctgcgccggacggacatcacggttaccgacgacgccgcggtcaagcgggccgtgaaggccgcctcgctcggtaacgccatggagtggttcgacttcgggatctactcctacctggccgtgacgatcggacacgtgttcttcccgtccgggaacgacacgacccagctcctctcctccttcgcgaccttcgcggtggccttcctcgtacggccgctcggcggcatgttcttcggcccgatgggcgacaaggtcggccgcaagaaggtcctcgcgctgacgatgatcctgatggccgtcggcacgttcgcgatcggcctgatcccctcgcacgacacgatcggcgtctgggccgcggtcctgctgatcttcttccggatgctccagggcttctcgacgggcggtgagtacggcggcgcctcgacgttcatcgccgagtacgcccccgacaagcggcgcggcttcttcggcagcttcctcgaattcggcaccctggccggctacgtgggcgcggcgggcctcgtgacggccctgtacgccctcctgaccgacgcgcagatggaggcctgggggtggaggatcccgttcctcgtcgcgggcccgctgggcctcgtcggcctctacctgcgactgcgcctggacgagaccccggccttccagaagctggagggcggcacggcgcacgcgagcgaggcggcggacggcgtcgagtccacggccaagggcgacctcgcgaagatcttccggcagtactggccgacgctgatcctctgcatctgcctggtcggcgcgtacaacatcaccgactacatgctgctgtcgtacatgccgacgtacctctccgacgagctcggctacagcgagacccacggcctgctgatcctgctggcggtgatggtcttcctgatgacgatcatcagccaggtcggcaagctctccgaccgtttcggccgcaaaccgctgctgatgaccggcatgctgggcttcctcttcctctccctgcccgcgttcctcctcatccgggtggacggcatcctcccgatcacggtcggcatgctgatgctcggcctctccctggtctgcatgctcggcacgatgtcggcggcgctcccggccctgttcccgacgaacgtccgctacgggtccctgtccgtcggctacaacctctccgcgtcgatcttcggcggcacgaccccgctggtgatcacggccctgatcagctggaccggctccaacctgatgcccgcgtactacgcgatggcggcggccctgatcggcgtgatcgcggtcgcctgcatgaaggagaccgcccagcagccgctgatcggctccccgccgtcggtcgagacggacgaggaggcggccgaactggtgcaggcacaggcaccggatccgaagttctgactcgcccccttcccggccccctcgggggaacggcccgtaccgctcgcgtcgagcggtacgggccgttccacgttctcaccggatttcgggagtgactgtccgataagcggttcgttactccgtacgaggctgcgcacttgcggccgagatggagagggagcccatggggaacagcccgtacacgcgggagcggctggcagaggcggcatcgtcctcgcgcacgctttcggaggcgctgacgaagctgggggtggatccgaagagtccgacacggcggtatctctccgaccgcatgcggaaactcggtgtggacacccgccatttcgagcgggatggcgctcgctggaccaaggaagtgcttcaggaagcggtcgtccactcgaccacgatgtacgaagtgctgcggcgcctcggccttgaggtggtagggggtcagcacacccacatcagccgccgcgtcaaggctctggggatcgacacgtcgcacttctccgcaccgccgagaaagcgcgggatacggcgtcggcgtccggaggacctgctggtggaccaaagtcggaccctcgcgcgccgcatacccggcgagcgcctcaagcgagccatgatcgccatgggcgccacggagctctgcgccctctgcggcacgggacggacatggcgcgaacggcctctgcctcttgaggtcgatcacatcgacggcaactggcggaacaaccaaccgcggaatcttcggctgctctgccccaactgccattcgacgaccgacacctatcgaggtcgcggcaagggacttcgcgcttcggcacggagcgaggtccgttgagcacccgtagcgcctatacacgggagcggctggccgaggcagcccgtcagtgcgccgacatcgaggaggtcatcgccttccttggcactcgcccctacggtcggctcagccgctacctattcgatcgcttcaagcatttcgggatcgatgtttcccacttttcccggtacggctaccgcagagccaaagcgcgcccctccaccgacgaactcgcacaggccgtcgccgctgccgtttccatcgccgacaccctgaggcgactgggccggacggacaccacgagccaacggcagcacctgagcgggtggattgccgaggacgggctcctgacctctcactttctggggcagggtcaccagcgaggacgcgccggtcctaccccgctcaggaccgttgaacagatcctggtcaaacacgacggaacacgcaggacgaggacggccctactgcgccgggccctgagggaggtcggcctcgcggaggagtgcgccgggtgcggcacccccgcactctggctgggcagacccatgacacttgaggtggatcacatcaacggcgactggagcgacgaccgtagagcgaatctccgactcctgtgcccgaactgccacgcggtgacccgcacctggtgcagaggtggcggcaccgcgaaggtctgaagctcttttctggatttccgccacaccctccgtacggagggcagtaaggttgacgtcgatctgcgcccgtacgccatctggttgagcggcgatctttaggtggtcgtgtatgtcggttcgaatccgaccgggcgcacccaccacagtgcggcccggcccctgctgagggccgggccgcaccgcgtcaccccgccaactcccgcaccaccggcaccaacgcccggaacgccttcccgcggtggctgatcgcgttcttctccgccggggtcagctccgcgcacgtgcgggtctcgccctccggctggaggatcgggtcgtagccgaagccgcccgtgccggacggggtgtggcgcagggtgccgttcaggcggccctcgaccacgcgttccgtgccgtcggggagggccagggcggcggcgcaggcgaagtaggcgccgcggtgttcgtcggcgatgtcgccgagctgggccaggagcaggttcaggttggcccggtcgtcgccgtgggtgccggaccagcgggccgagaagatgccgggggcgccgccgaggacgtccacgcagaggcccgagtcgtcggcgacggccgggaggccggtggcgctcgccagggcgtgggccttgaggagcgcgttctcggcgaaggtgacgccggtttccttgacgtcgggaatgtcggggtacgcgtccgcgccgacgaggtcgagatcgagtcccgcgtcggcgaggatggcatggagttcggtgattttcccggcgttgcgggtggcgaggatcaggcgcttcatggggcgattatcgccccggggccgggcggggcggtcgcgcccccgacccgccccgtccctggcgcctacgggctgcagaccttgccgatctccgtcgccgcgtcggtcaccggggtgatgtcgggggtggcgtcgccggcctcgatggacttgcggacgcctgtgacgcccgtctggaggtcgtcgacggccttggagaggtcggcgttgtccgtggagtcgccgagcttcttcagttcgcggtcgatctcgtccagggactcggatgcctgggtgacgtcctcggaggcgttggagacggccttctggaggttgccgacgctggtggcgatggcgtcggcggtgcggacgcagtcgagcgccttgtcgagtcctgcgcagcccacggccgtggtcagcgtcagcagggtggcggcggtggcgagtgcgaggcgttggtgacggcgcgatgccatggttcggtccctccccggggatcgttacgtggacggacgcacggttcgacccgtgcgcccgtatccgtaacgacgctctgtggtgcgtatgtggttgcttctttacccgcggagggcgggtcgctacgcgtcctgggtgcgggcgagcgcgtcgcgctggagtgcggcgaggtcgacgcagccggcggtggccaggtcgaggagcgcgccgagttccttgcggtcgaagggtgcgccctcggcggtgccctggacctcgacgaaacggccgtccccggtgcagacgacgttcatgtcggtctcggcgcggacgtcctcctcgtagcagaggtcgaggagcggggtgccgtcgacgatgccgacgctgatggcggcgacggtgtcggtgagcggcttgcggccggccttgacgatcttcttgccctgggcccagacgacggcgtcggcgagggcgacgtaggcgccggtgatggcggccgtacgggtgccgccatcggcctggaggacgtcgcagtccaggacgatggtgttctcgccgagggccttgtagtcgatgacggcacgcagcgaacggccgatcaggcggctgatctcgtgggtgcgtccgccgatcttgccgcgtacggcttcgcggtcgccccgggtgttggtggagcggggcagcatggagtactcggcggtgacccagccttcgccgctgcccttgcgccagcgcgggacgccttcggtgacggaggcggtgcagaagactttggtgtcgccgaaggagatgaggactgagccctcggcgtgcttgctccagccgcgttcgatggtgacggggcggagctgttcgggggtgcggccgtcgatgcgagacatgggcccgactttatccggtggcgggggtggctccgttcgggtgcggtggcggcttccgtggggagcgtgggcgtgggtgtgcggtcctggcgcggccccgtcatccggcgggggacggggc

SEQ ID NO: 3786 - DNA, 2536 bp, Unknown
  Kingdom: Bacteria, Phylum: Actinobacteria, Class: Actinobacteria, Order: Streptomycetales, Family: Streptomycetaceae, Genus: Streptomyces
atgtagccgccggcctggctctcggaccgggtgctccaggagatgtcgttggcgccgcaagcctgctggaccggcaccttcgtgccgtcgccggcgtcggcgccggacccctccgcgctgcccccgtccttcgcgtcgggctcctcggcggcaccctgctccgtgcccttgtcggcacccttcgaggcgtcggccccggcggcgtcggccccggacacgtccgcggcgggcacgtcggtggcggaggcactcggcgcggcgccgtcctccgtgtcctggcacgccgtcatcagcagggtgccgcccacgagggctgcggagacgaggaaggccttgcgacgcttgccgaacatgagatccccttggtggtcgtgagcgtggtcgtggcagcgaagcgagtccgaccgcccgggtgttccttgatcactatgggggggccgagggccgaaagaagccccatgtgccgttccaggacagcgctgtcacagaccgaagacatgatcacggcgtggacgcccggcccgcacacaaccatcaccctccggacggaacgcctccggaggcaggtcctcctcgtcgacggcggccaccatgctgacggtccagtaggccaagtcccacccgggcatcaagttcgacgcggtcgagcccggccccaccgccacggacatgaacgcggagctcggcatcggacgctctcccgggcgagcacccactcctacttccagccatgcccggatgatcgttccgatgggcgacagcgcgacggattccgaagatccttcacaggtagggcacatacacggcaagacctgcgccttccgacccctccggcaccgacgcggagcggcgcgaggggccggtcggccctctccatccgtgaagacatgtccatatgagagccaaccccattttccctgcttatgcggacggtcacccccgtgtagacatggtcacggcggccccagacacaaatccggggggccgcctccgccatgttttgggggtacatccgccatgcccagacccacccgccgccaggccctcggagccgtcatcggcgtcgccgcgagcggagcgctcgtcggtatggccgccgcgtccacggaaaccgtggcggccgacgccggaagcagcggcatcgcacccggcgggaccggagcacccggttccttcgatgaggtcttcaagggccgccgcatccagggcacgcccgccgaggcccacgccggcgcacacgcacacgccgggcacgccggcgccggctaccgcgtgctgatcgacggccgcgaactccccgtgatgcagcacgggaagagcggctggagcagcacggtcaaccactacgagagattcgcgaccccgatcgaggccgcacgcaccgcggtcatctcgctcaagggcgccgtcgtcgttccgttcgaccccaccgcctgacccgggagcagcagccatgaccgtacggaagaaccaggcgaacctcaccgcccccgagaagaaggcctttgtcgacgcggtactggaagtcaaacgccgaggggtgtacgacgagttcgtactcgcccaccgcacacggttctcgatagacatgaacaccggcgtgtacgtgggccacttcggaccctcgttcctgccctggcaccgcaagttcctcatcgatttcgagaacgaactgcagaagatcgacgcgtcggtctcgatcccctactgggactggaccgccgacaacaccgtcggctcctcgctctgggccccggacttcctcggcggcaccggacgtcccctggacgaccaggtgatggacgggcccttcgcgcattccggcgggaactggacgatcaacgtctcggtcgacagccgcgccttcctcgcccgcaatctcgcctatcgcgttcccacgctcccaccccgttccgacgtcgacgccgccctcgccatgcccacctacgactccccgcccttccgtgacggctcggcgggattccgctccgcgctggaaggctccgcgggatatatgagcatgcacaatcgggtgcacacctgggtgtggggtcatatggagacgagcgtctccccgaacgatccggtgttctggctgcaccacgcgttcgtcgacaagctctgggccgactggcacgcactccacccgaccagcgccgagtacctccccgccgggggcacggccgatgtgatcgatctgaacgacgtcatgccgccctggaccgacaccaccccgcagagcatgctggaccacacgccgttctacacgtacgcctgagttctcgtcacggggtgctcctggtcccgtccgtgacccggtcgagtccgtagaggtcggcgacacacccgccgggccagtacgaacgcccgccctggctgaacggctccagcatgttgctgatcaccaggcgctcgtacggcaggacccgcctccctgcctccgccccctcgcgcagcctgcggtcctgggcgtcccacttctcggcccggccgtggcgctgagcaacctggacacggcgatgcggtcccgggccga

SEQ ID NO: 3787 - DNA, 2854 bp, Unknown
  Kingdom: Bacteria, Phylum: Actinobacteria, Class: Actinobacteria, Order: Streptomycetales, Family: Streptomycetaceae, Genus: Streptomyces
ccctgcgggtcctgctccttcatcagccggtaggccgcctgcgcgcacaggaacgcacccgtcaggttcacctcgacgaccgcccgccagtcctcggcggcgtgccgctggaggacctcgccgccgaggactggcgggcggtcgtcgaggtgaacctgacgggtgcgttcctgtgcgcgcaggcggcctaccggctgatgaaggagcaggacccgcagggcggccggatcatcaacaacggctcgatctccgcccacgcgccgcgcccgcactcgatcgcgtacaccgcgaccaagcacgcgatgaccgggctgacgaagtcgctgtcgctggacggccgcccctaccggatcgcctgcgggcagatcgacatcggcaacgcggcgacggagatgaccgagcggatgtcggccgggatcctccaggccaacggggagtcggcgacggagccgctgatggcggcgtccgacgtggcgcggacggtggtgcacatggcggagctgccgctggaggcgaacgtccagttcgccacggtcctggcgacgaacatgccgtacatcggacggggctgagtccgcatgtgatcgcatgcgcgcgaactagccattgagtgaccgaatttgccgatttctccgctctcgatcgagcaagcgcgtgctgtccgtatgatcgcatcccgttacgccttcaccagaacgacacagaaggaacaccacatgcgcatacgcaccgctgcgccgatcgccctggccgccgccaccgcgctggccggctcgctcctcgccacggctgtgccggcctcggcggccgcccaccagggcgggctgcacttcggggccgtgcagtacgacggccccggcaaggacaaccggtcgacgaagtcgctgaacgccgagtgggtgaacgtccacaacaacagcaagaagaaggtccagctcaagggctacaaggtgaaggacaacaccggctacacctacaccttcggcagctacacgatcggcgcgggcaagaccgtcaagctccgcaccggcaagggcaagaacgtctcgggcaccgtgcactggaaccggggctcgtacgtctggaacaacaccggcgacaaggcgcggctgatcaagccgaacggaaagcttcaggactcctgctcctggaagaagtccaccaaggcgaacaagggtgccaagaactgccactgacgcgccccgggagggccggtcgcggtaccggggggggccgcgaccggccctcccgcacgccgtaccgccctgccgccttgccgcagtgccgccttgccgccgtaccgagaatgggaatgccgggagcggcggcacggttggacccctgcatgacctctgatcccgcgcccgaagtcctgcgctacaccgccttctccgccgaccccgcgggcgggaaccccgccggcgtcgtcctggacgcctccgggctggacgaggaagcgatgctcgccgtcgcggcggagctgggctacagcgagtcggcgttcctgacggagcggaccggcgagggcgcgtacacgatccgctacttcagcccgaaggccgaggtgcccttctgcggccacgccacggtcgccacggcgctcgccctggccgaacgggacgggccgggcgagctggcgttcgccacggccgcggggccggtgccggtgaccgtcgtacgggagggcggcgaactccgggccaccctcaccagcgtggccccgcgcgtcgaggagaccgccgcggccgacctgacggaggcactggcggccctggactggacggccgccgatctcgacccggccctgccgccccggatcgcctacgcgggtgcccggcacctggtgctggccgccgccacccgggagcggctggcggacctggactacgacttcgcgcgcctcgaagcgctgatgcaccggctcgacctgaccacgctgcaactggtgtggcgcgagggacccgaggtcttccacgtccgggacccgttcccggtgggcggggtcgtcgaggacccggcgacgggcgcggcggcggcggccttcggcgcgtacgcccgggagctggggctcgtacccgaagcggccgtgctgacgctgtaccaggggacggacatgggccgccccggaacgctcaccgtcgaactgcgcacgggcgacgcccggatccgggtcagcgggacgggcgcacggatcggctgacccgctcccccggagcggcggttcagccggtggcgtccttggccggggagacgtgggcgtaccagcgctccgtctcctccgggtcgagggggcgctccagcagggcgtcgccgcgcatgccggggaagaagcggcccgcgggccaggaccgccggtaggagggttcgtccaggaccagcagccggacgccgtcgacgacggggatgtcggcgggggcgccttcgttccagatgatctcgccgtccggggccaccaggtcgaaggagcccacggtgtccacctgaccgggggtctcccggcagacggccacctcctgcgacgacggcgcgtgaccctccacatggccgccgccgatgagcgcgtcggcgagcagggtgtgcagctggaagttgtcccctatgccggagagccgcaggaggtagccggtgccgctggcccggtggaggacgacgagcggttcgtcgtccagcacgaggagggcgtgggcgagggacttcagctccgtgccggaggcccgctccaccgcgccgagcagccgcagcgcctcgccccggaagccggccgtccgccgcacgccggggtggttcagcatcgcgacggcggccgtcggctggtggacccttcctcagtgggagacggccgccgtcgcgatgc

SEQ ID NO: 3788 - DNA, 7769 bp, Unknown
  Kingdom: Bacteria, Phylum: Actinobacteria, Class: Actinobacteria, Order: Streptomycetales, Family: Streptomycetaceae, Genus: Streptomyces
ggtggtgtgggcgcgccagatgaggtggaccgacaccggctcggcgcctcggagggggcggtaggtgatgccgtcgcggcggtactggacggcggtcgcctggggggtgaggccgacgcggcggccggtggcgatggcggccagccagtcgtcgatgtcctgggtgaactcgaccgtcggccggccctgctccggccacagatccagggcggtggtccccgtgcggcggtcgatggccaggacgcggttcgggatctcgtccaggcggacactgcggcggcgggcccaggggtcgtcggacgccatggccacgtagcgggcctcggcgccgatccgggcgtgggaccacggtgtcaggtcgatcggagcgcggatgacggcgaggtcgcacagcccttcggccagacccccggtgggagtgttgtgacggatgagacgcaggtcggtctcggggtgctgctcgtgccagcggcgctggaactcggtggtgtgccggccgaaggcggaccaggcgtgaccgatgtgcagtcgggtgtgcccggtggtggcctcgcggacgaattcctccgcgccggcgagcaggacgcgggcgcgggccagcgctcgaacccccgcggcggtgggtgcgacgctgcgactggtgcggtgcagcagccgtaccccgaggagactttcgaggccggcgagggtccgggagacggcggcctgcgacatgccgagtgcgtgaccggcgtcggtgaaactgccggtgtccacgatggccaccaggcaccgcagatgcttcagctccagagcacccgccatgctccccgactcatccatacgcccatcgtatagatgagtgcgccggtgcattttgcgcagagcgacggctctcccatcgtcggtggcatgaagctcgatacttccccggccgcgacgccacgctccaccggaggcgacggggtggcgccatcacggggcgcggggcgcggagccggtatggccctgatgctgggcagcggcctgtccaaccagacgggtgcctccgtcgcggcactggccttcccggtgatcgggcccgcgggggtggtggcggtacgccagtgggtggcggccgtcatcctcggcgccgtcggcaggcctcggctgcggcacttcaccgccgaacagtggcgtccggtcctgggcctcgccctggtgttcgccgggatgaacctctccctgtacctggcgatcgacaggatcggcctcgggctggccgtcacgctggagttcctgggcccgctgaccgtcgccctggccggatcccgccgccgtgtcgacctggtcgccgccggggcagccgcgggcgcggtggccgtactcatgcgccccacgccctccaccgactacccgggcatcggcctggccctgctggcggcggcctgctgggcctgctacatcctcctcaaccggacggtcggtgcccggctgcccggcctggaaggctcggccgccgcggcagcggtctccgccgtgctctacctgcccgtcggcgcgtgggtgctctggcaccatccgcccacgctcaccgcgctgggctgcgccgtcatcgccggagtgctctcctcggcggtgccgttcctggccgacctgctggcgctgcgtcgtgtcccggcccacttcttcggggtgttcatgagcgtcaacccggtcttcgccgccctggtcggcctcgccgtcctcgggcagcggctcgatgtcctcgcctggctcgcgatcgcggtgatcgtcgccgcgaacaccgccgccgtctccaccgcacgccggacgaccccgtgaagatcacggctacgttctttgcgcgcccggcctgtccctatggcagcggcaccgtggtgaggaagtccaggacgagcgggctcgcgatggcgcggttctcctcgaaataggcgtgccgcgccccggggatcagatgcagacgggcgccggggatgcggtccgcgagcagaggagcgttggcggccgggttgagcaggtcgtcggtgccgtgcacgaccagcgtgggtgcgccgatgcccggcaggagctgccacgcgtcgtgctggttgccggccgccaggtgacgccgtcgggcgtgggcgggcattcccgggtcgccgagcgtccggtacggtccggggttcgccgccagccacgccgtggtgtacatcagctccagcagggcctgccgcgccgcacccggttgcgtctgcgccagggacctgcgcacgtcgtcggtgcgttcaacggcgtgcgggccgccgggcgatgtgcacccgagcaccagggcgcgcacccggtccggatggcgcgccgcgagctgctgggcgacccgcccgcccatggaggtcccgtagacgtcggcccgctcgacaccgagggcgtcgagcaccgcgatcgcgtccagggcgaacagctcggtgctgtagggcagatcgggcttgtcgctcgcccccgtaccccggtagtcgaacgtcaaggtgctgcggtcgccgtggaagtcgtcgcgcaccgagtcccaccagtggtggttgttcgactggcccgccaggaggagcaggggcgccgccccctcgccccggacctggtaggcgatacggatcccgtcgggggtcatcgtgtgcggcatacggatcctcactcctcatgggccggtggccggagatgcaccgacccgttcgggcgtgttggccgggaacgccacgaagccgcggcgagcaccgcgccgacggcgcaggcaggggaaaggtcgaggcccacgacatcatcgactcctttgccggtccttctccggcagcagtgcgagcaccgcgacgacggctcgatgatcggttcccggtacggcgcgctcgctgacggagacccctgccagaccgggaccgtgcaggacgtgatccagctggaccacgggtgggacgagggaatggccgacaggccacgtgggggcccacccgtggccgagctcggcatgcgtgtcggtcaggccggccgcgagcaggtcccgcatcggggcgtggtcgagggaagcgttgaagtcacccaggaacacggtgtccgggccggcgcgccgtgccagagaggtcaatgcggccatgtcccgggtccaccgctccgggcttccgagggggtagtaggtgtgcaccgccatgaactggacgctgcggccgccgaccgcgacctcggcgacggtctggggccaggcggtgtcagcttgcgtcgtcccggcgtcggtgagcgggagccgtgagtagatcgaggagtcgtactcggggtgcggctcctggtgcggcagcaacgcgtccaggcccgccttgtcgagggcctccacgccgcccggcggcatttgctgcacagccagcacatcgatccgctccgctcggaccagcttcaccaccgcccgggcgtcggcggcgcctccgttggtgttgagggtggccacacgcagctcaaccgcgttcgccggcacctgccggccatcaggcaggaaccgtggtgccagcagcaccgcgtgagcgatcaccagagctgcgacgccggccagggcccatcgggaccgcagcgcaggaaccgcggcgatcagcagcagcaccagcacaccgatgacggttgtccagggaaagagcaccatcggcatcgccagcggtgttccggcgtcgaggcccgtcagccggacaacgagcagagcgacgggcgcggcgagcgcgaccccgcagcccagcagcccccatcgccgtccgcgaccaccggcccgccgccggctcgcatcgcgcggagcgtccgcaaccgtgtccgtcacccgtccccaccccggagtcatgcccggtggaatgaacgtgatcaccggatcccggatcgtagacgcccgcgggcgccgcacggttccgccggcctgccggacccgggacgaagctgagcgggaggtcaggcccggagccggcgggcgggagcggtgtgtatcagtctcccgtcacaccgtcggtccgctcgcgcagaagatccgcgtggccgttgtggcgggcgtactcctgaatcatcaccatgtagacccagcgcagactgagggggacaccgtaggaggacatgaacgccatgtcgaggtcctgcccggccgtcgcctcgtcgcacgcctcgacctcggcccggaacaacgcgaagtcccttgccgcatcggctgcgcagacgccttcgaacccctcgttcccgtccgacggtccgctgaagacgtcaccgacatcttcacctgcgaaactccgccggaaccaccaccgctccatctccgccatatgccgcaccagaccgagcagactgagggtcgacggctcgacggccgcccgggccaactgcaccgactccagtcccgcgcacttggccatcaacgtctctcgatgccagttcagccagccctccagcatgcggcgttcggccgcgatgcccagagcgcccaactgctcaccgcgctccaccggcggcgccgtccatgtcatggcccccaccgtgccgcacccgcgagcagggttcaagcagtgcccccgccgcggccgtgcgggatcaggttccatcggtccactgctcgggggtgcgaagctgtccgcgatcggtcgggcgcgtatctgtctcgtgccggatggagcccgggacgaggagggactcggcggtccagggcagaggtcgtgaggtcgtggaggtccgcccggtcggcggcctctgccgggctgctcagggcaggatcgagtcgatgtagccgccgtcgacacgcaaagcgccgccagtggtcgcggacgcgtacgacgaggagagatagacgaccatgtgggcgatctcctcgggctcgatgaggcgctggatcagggactgcgggcgatgtttgatcatgaactcgcgctgtgcctcgtcccagggcagcttgttgccgaccagctcgcggacgaagtcctcgacgccaccggtgtgcgtcgggccggcgatgacggagttgacggtcacgcccgtgccggccgcctccttggcgaagccgcgactgacggcgagcagcgaggtcttggtcatgccgtagtggatcatttcggcggggacggccacggccgagtcactggcgaggttgaggatgcggccccagccccgttccgtcatgccgggcagacaggcgcggatcagccggacggcggagagaacgttcacctcgaagtagcggcgccactccgcgtcgtcgatctccagcggggcggcggagccgaagacccccaggttgttcaccaggacgtcgaccaccggtacggcctccagcacggccacggcgcccttctcggtcgccaggtcgcccactgcggcgatgacgtcgtcgctgccggagtcggcacgcacccggtccatcgcgtccgtgacgcgctccgcgttccggccgttgacggcgacccgggcaccggcgcgggcaaggccgacggcgatggcgtatccgatgccttgggtggagccggtgaccagagcggtgcggccggaaaggtcgatctgcacgatgcgttctccttgccgaggatgtgcggctgtacatacatcgatacagatgcaggtcgatgccgcgatacatacatcgatgccggtgtacgacagtcacgcgagcacccgtccccgtgacacgcaaggggtggggtaggtgcttgcggcgatcgaggcggtggtgggttgcgggtgtcggggtccggaccggcgagccgccggcagtccaggcccacgaccgctgacgtatcgggttcactcagctcgatgccgaggcgtcgacgatctgccggacgcgctcggggtgacggacttgggatgccgagagaccaccctcccgctgcgcctgcgccgcttccgccgccgcccgcttccaccagcgcctgaccgatgcccgcgacgttgccgtgcccgaagatgccccaggtggcgctgatgagccgctgccggcggccgtcgcgctcggtgtactgccgggccaggaaggcgaccagggcctgagcggtggtcaggcggcgggtgggacagccggggttcgcgggattcgtcgggctcaaggcgttacctccgggccgggcgacggatgcgccgtgtacagcgggagtctggcgtcgatcgactcgtcccgccaggtgtcgcggatccatcggtggtcgggatggtcgcggatcagccaggcgcgctcctcccccggcccggccatcacgttcaggtagtacagcgtccggccgggcggggcgatggacgggccgtgccagccgtcggggatgaggacggcgtcgccgccgcgcacttcggcgagaacgtccgtgccgccgtcgcgcgacggggagacccggtgatagccgatgccgccgtccgccacctcgaagtagtagatctcctccagttcgcactcctcgcccggcacgtgctcgtcgtgtttgtgcggtgggtacgaggaccagttgccgccgggggtgagcacctcgaccgcgatcagccggtcgcagtcgaaggtgtcggcggcggcgaagttgttcacctggcgcgagcaggtcccggagccgcgcagctcgacgggtacctccggcgcggggccgtagcgagcggggagtcgtcgctcgcacttcgctcctgccagggcgaagcggccacctgcgccggaggcgatctgtgcgtgggagtcgcgcggtacgtaggcgaagtccgagaccccgctgaacacgctctcccggcccagcagttcgaaggtctcgcctgccgtacgcaccgtacaggcaccggccaacggcaggacgatccattcactaccgccggtgtcgagcgcgtgaacacctcccggctccagctccagcacccgcagcgccgaacggtcccagccggcccgctcgggatcgatgtcgacggcgtacgccccgcgcgcggcgctgccggccggcaggtggtgccggcctcgcacgccctggtgcgggtgctgaccctggcgaggttcttggtgcgggtgctggccctggtgggggtgatgcgtcgtcatggcccatccctacccgtgctgagcagcgatacggcggtgtcgacggcgcgcgtcacgtccccgtcgaccgggtagagcagcgaacgccccaccaccagcccccgcacggtgggcagccgcagcgcgtcgcgccatttcccgtaggcggcgtcctggtcgtccccgacctcgccgccgagcaggaccgcgggcagggtggaggcctccatcgcccggcccatggcgtcggggtcgtcggtgacggggaccttcagccaggtgtacgcggacgtccccgcgaggcccgaggcgatggcgatggaggtcgccacggcggcggcgccgagatcgttgcggaggcggccgtcgacgcggcggcagaggaacggctcgacgaagacgggcagacggtgcgccgccatcgcgtcgatggtccgggctgcggtgtgcagggtgtccagcgaaccggggtcgtcgtggtcgatgcgcagcagcagcttgcccgcgtcgaacccgtggcggaccaggtcgtcggggcggtagccggtgaaccggtcgtcgagctcgaacgcggcgccggccagcccgccccggttcatcgagcccatcacgaccttgtcctccagggctcccagcaggaggaggtcgtccagcacatcggcggaggcgagcactccgtcgaccccgggacgggagagggcgaggcagagccgctccagcagctcgaagcggttggccatggcgagggagcggtcccccacggcgagcgcgccgcgcg

SEQ ID NO: 3789 - DNA, 4349 bp, Unknown
  Kingdom: Bacteria, Phylum: Actinobacteria, Class: Actinobacteria, Order: Streptomycetales, Family: Streptomycetaceae, Genus: Streptomyces
ccatcgtgagccggtcgcccacgccgtacgggaccccgaccgtttccacggggtggagctggagctcgcgggcgaccggctcacgatggagcaggtggccggcgtgctgtcggccgtgtggggtgtaccggtgaaggccccctcgatggacctcgaagaggccctcgcggcgggtatgcccgcttggggcgcgggtcacctgtggagcaacgccatcacccagccggcccgccccgaattcgccacggagctggggattccggtgacctcgttcgccgactgggcccacgggaatctgacggcggaggcctgacggcccgggagcgctccggggcgccctacggcaccacggagaggaccgtcaccacggtcaccgtggagatcgccgcctggaggttgcggatcgcctcgcgcacgctcacacccgcccagtgaccttcggcgatgtgggccatgcgcggggtgacctgcttcttcggcagaccggggaaagcctgggcgtgcatgcccgtggcgtgcagcagggcgatgagggcactggtgcggacatccggctcggctccgcgcagcaccgcggcggccagccgggcgcgcagctcccgctcgacggttccatcggcctccgggtagcggcgcacggggaagacgccgagcgcccggtgcttctcctcggtcaccagaccacgcgcgacgaggctctccacgacgtcctgcgaacccttggcgtggtcccgggtgagccagtcggtcaccttgcggctgctggacgtcccgtggacccagcgcgccagccggtcgagccggccgtccaggagcgggtcacccgtcggggacgggtcgaagacctcgacgcggccgcccttcacggtgacgcggcccgtcatgaccagctccaggagcatgccggccgccacgccccagcgggccgcgctctcccccttcgccgcgccggtcgtgtcgtccagcgacagcagcatgatctcttcgcccagtgagacggccatggtgcgactccccgattcgttacgtgtcgaccggacagacgtacggtcaccgtcggaggttgtccagggaacgaaaccgctgctcaggagggttccgcggcggcgaaggcaccccgggccagccggtgcagcagggcggcggtcaccgaccggccgggcagggcctcgggtcgggccaggtgcggggtggagttcagcaggccgaagacggcgtgcacggtgacgcgggcccggttctcggccagcgacgggtagagggcgcggacgacgccgacccagacctcgacgtactcgcgctggagccggcgcacccgcttgcggtccgtgtcgcgcagccggtccagctcgcggtcgtggagggtgatcagggggcggtcgtcgagggcgaagtcgatgtggccctcgatgagcgcgtccaggagggcctccggggagccgtcaccccgggcggcgtcctccgacacccgcatacgaccgccctccaggagccgttcgctgatgcccaccagcagctcggcgagcatcgcgtccttgccggggaagtggcggtagaggccgggaccgctgatcccgacggcggcgcctatctcgtcgacgccgaccccgtggaagccgcgctcggcgaagaggcgggcggcctcccggaggatctgctcgcggcgggtgggggccgcgacgcgggcggtggcatgggtgctcatgaggatccattctagacagggtcgttagcgctcgttaacctgagggaaacgcgttaacgatcactaacagcagcgcgacagcagcggttgactatcgcggtacgggcaagggggctcgacacgatgcagcaggcaccggtcctggcgagcgcggccgatcccgcctcggaggcctggcaggccaacgaggcggcgcatcgcgcgctctccgacgagctggcgggacgcctcgccacggcacggctgggcgggggtgagaaggcgcgggcccgccacgaggcgcgcggcaagctgctcccccgggaccgggtggacaccctcctcgacccgggctcaccgttcctggagctggccccgctggcggccgagggactgtacgggggcgccgccccggccgccggggtgatcgccgggatcgggcgggtcagcggccgggagtgcgtgatcgtcgccaatgacgcgaccgtcaagggcggcacgtactacccgatgaccgtgaagaagcacctgcgcgcccaggaagtggcgctggagaatcgtctcccctgcctctatctggtcgactcgggcggcgcgttcctgccgatgcaggacgaggtcttccccgaccgggaccacttcggccggatcttctacaaccaggcccggatgtcgggggccggcattccgcagatcgcggcggtgctgggctcctgcacggcgggcggggcgtacgtcccggcgatgagcgacgaggccgtgatcgtccgcaaccagggcacgatcttcctcggcggcccgccgctggtgaaggccgccaccggcgaggtcgtcacggccgaggagctgggcggcggcgaggtccactcccgtacgtcgggggtcaccgaccatctcgcggaggacgacgcgcacgcgctgcggatcgtccgcaacatcgtcgcgaccctcccggaccgcaccccgctcccctggtcggtcgagccggccgaggagccgaaggtggacccggccggtctgtacggcgcggtcccggtggattcccgcaccccgtacgacgtgcgcgaggtcatcgcccgcgtggtcgacggttcccgcttccaggagttcaaggcggagtacgggcagacgctgatcaccggcttcgcccgcatccacggccacccggtcgggatcgtcgcgaacaacgggatcctgttctccgagtcggcccagaagggcgcgcacttcatcgagctgtgcgaccagcgcggcatcccgctcgtcttcctccagaacatctccggcttcatggtcggccgggactacgaggcgggcggcatcgccaagcacggcgcgaagatggtcacggccgtggcctgcacccgcgtgccgaagctgacggtcgtggtcggcggttcgtacggcgcgggcaactactcgatgtgcggccgggcctacagtccccgcttcctgtggatgtggccgaacgccaagatctcggtgatgggcggtgagcaggccgcctccgtgctggccaccgtcaagcgcgaccagctcggtgacggctggagcgccgaggacgaggagacgttcaaggccccgatccgcgcccagtacgagacccagggcaacgcgtactacgcgaccgcccggctctgggacgacggggtgatcgaccccgtggacacccggcaggtcctgggcctcgcgctcacggcctgcgccaatgccccgctgcccccgaaggacccggccgggcccggcttcggcgtcttccggatgtgaggaacagatgacgatgttcgacaccgttctggtcgccaaccgcggcgagatcgcggtccgggtgatccggaccctgcgggagcagggcgtgcgctcggtcgcggtcttcagcgacgcggacgcggacgcccggcatgtacgggaggcggacacggcggtccggatcggcccgccggccgcgtcggagagctatctctcggtgcccgcactcctggaggcggcccgccgcacccgcgcgcaggccgtgcaccccggatacggattcctggcggagaacgcggagttcgcgcaggcctgcgcggacgcggggctggtcttcatcggtccgcccgcctccgcgatctccctcatgggcgacaagatccgggccaaggagacggtcgcggcggccggggtccccgtggttccgggctcctccggcagtggcctgaccgacacccaactggtggcagcggcacaggagatcggcatgccggtcctcctgaagccctcggcgggcggcggcggcaagggcatgcgcctggtccgcgacgcggcggtgctggcggaggagatcgcggcggcccgccgcgaggcacgggcctccttcggcgacgacaccctgctcgtggagcggtggatcgaccggccgcgccacatcgagatccaggtgctggccgacacccacggcaacgtgatccacctcggcgagcgcgagtgctcgctccagcgccgccaccagaagatcatcgaggaggccccttcggtcttcctcgacgaggagacccgggcggcgatgggcgaggcggccgtgcaggcggcgcgctcctgcgggtatgcgggcgcgggcacggtggagttcatcgtgccgggcgacgacccggcctcgtactacttcatggagatgaacacccgcctc

SEQ ID NO: 3790 - DNA, 2159 bp, Unknown
  Kingdom: Bacteria, Phylum: Actinobacteria, Class: Actinobacteria, Order: Streptomycetales, Family: Streptomycetaceae, Genus: Streptomyces
ggcgccggccggccctgctccggccggaaccgctccggccggaaccgcttcggtcggctcggtcgccgcggcccccgcggtctccgctccggccgggctcaccctgtccgtggcgtccatcgggcgatcgtaggggcctggcacctcgtcaatgcgacgaccgggcgggtcttttacaccgattcatcactctttgtgggcaggatggggccatgacgccaccgaagcaggaggcaggatgacccgcatcgccgcggttcacggggccctgccgccccaccgccacacccagcgcgaggtcaccgacatggtggcccgcacctgcctgccgcccggcgccgaccgtcgtgtcctggaccggctccacgagaacgcccgggtccgcacccggcacaccgtgctgcccctggacggctaccgcgacctcgacggcttcggcgcgtccaacgacatgttcatccggtccgccgtggacctcggcgcccaggccgtacgcggtgcgctgcggacggcggggctgcggccctccgacgtcgacctgctgatgttcacctcggtcaccggcatcgccgccccctccgtcgacgcccggctggtgacccgactggggatgcggtcggacgtcaagcggctgcccgtcttcggcctcggctgcgtcgccggagcggccgggacggcccgcctgcacgactacctcctcggccgccccgacgacgtggccgtgctcctgtcggtcgagctctgctccctcaccttccagcgccacgacgcgtcgcccgccaacctggtggcgaccgcgctgttcggcgacggagcgaccgccctggtcgccctcggcggccgccgggccgtctccggtcccgagatcgtggccacccgcagccggatgtacccggacaccgagcacgtcatgggctgggacatcggcagcaccggcttcaccgtggtcctcgatccggcggtgcccgacgtcgtccgccgctatctcgcggacgacgtacgggagttcctcgacgaacacggcctcaagccgaaggacgtcgcccactgggtgtgccacccgggcggccccaaggtgctggagaccgtcaccgaggtcctcgatctgcccgagggtgcgctggacgtcacctggcgctcgctggccgacgtcggcaacctctcctcgtcctcggtcctgcacgtcctgcgggacaccatcgaacagcgcaggccggagccgggaacccccggactgctgctggccatgggcccgggattctgctgcgaactggtgctgctgcgctggtaggaaggagagacccccatgacctcgacctggtacaccctcctggtgctggccgtcgcggccgagcgcctcgccgaactcgtcgtggcccgccgcaacacccgctggagcctcgcccggggcggcgtcgaatcgggccgcgggcactatccggcgatggtcgcgctgcacaccgcactcctgctcggctgcctggcggaggtccggttcgccgaacgtcccttcccgcccggatccggctgggcgatggccgccgtcgtcgtggccgcgcaggtgctgcgctggtggtgcatccgcaccctcggcccccgctggaacacgcgggtcatcgtggtccccggcctgccccgggtcaccggcggcccctaccggtggctgagccatcccaactacgtcgccgtcgccgccgaaggcctcgcgctgcccctggtccacggggcctgggtgaccgccctcgtgttcaccaccctcaacgccgcactcatggccgtgcggatccggtgcgaggacggtgcgctcgcccgccttcccgccgtggacgcgcgcacatgatcgacgtcctggtcgcgggcggcggaccggccggactggccgccgccatccgggccgcgtcggcgggcctggaagcggtagtggtcgagccgcgcaccacccccgtcgacaaggcgtgcggcgagggcatcatgcccggcggcgtcgcggctctgcgcgacctcggcgtaccagtgagcggccacgaattgcggggcatccgctacaccgacggccggcgcagcgcggaggcggccttccggggcggccccggcgcgggcgtccgccgcaccgaactccacgccgccctgcacgagcgggcctccgccctcggcgtacg

SEQ ID NO: 3791 - DNA, 2820 bp, Unknown
  Kingdom: Bacteria, Phylum: Actinobacteria, Class: Actinobacteria, Order: Streptomycetales, Family: Streptomycetaceae, Genus: Streptomyces
gtacacggactcccgggccggcgacgaccggttcacggacacccgtccccgcgacgaccggttcggcgacgaccgcttcggcggggacgagcccgtaggggcggggacgtcgccggcccgggagtccgtgtacgcgtcggtgaaccgctcgtcccggggccgctcttccccgaaccgctcctccgcgaaccgctcgtcccggcgttcttcgccccgggccggccggtcttcgcgcgaggcgtccgtcccgtaccgctcctccccgtaccgggagcccgtgtgccgggagtccgtgtgccgggcctcgccgccgtaccgctcctccgtgtcgtacggggccgagtggggcgccgagcgcggcgcgggcagggtgtcgtcgcggagccgttcgtcggtgctcggggccgccgtgccccagtcctcgtcgtcctccacgacgcgccggcgctcgggggcgggccgggaggggggcttctgcgggacaccgccgcgtacgtgttccagcagcgtgcgcagcgtgggctggatcgcgcgccggtcgccgaactccatgtccagggcggcgggcagggtctccgcccagaactcccacagcggccggatccagccgtccacgcgccggccgccgcgctcccggcgctcctccaggagctccagctggcgcggggcgatgcgctcgacgagctcgacgaacatcgggtgcggttcggtgcccgcccggccgagcccgaggggctgggcgcccatcagcttgcggcagtagtcctccacggtccgctcgtcgtccagcaccgtccagcgttcgtaggagcgcagcagctccgaccagctggagatgccgccggggaagtccccgagccgcagccgtacgccggggacgctcgctcccttctccgggaacagccgcagccgcacccgggcgggcgaggcggtctcaccgtccaggatgtcgacctggccgttccacatgcagcacagcagacggtgcaggatcgtgcgccggtcctcctcgctgctgaccatccagtcgtcctcgaagccgaggcgctgccgccagcgcagcacgtcgtgggcctgctcgtcgtccttggccctggcccactggcgcagcaccttgcgggcctcgggcacctgggtgaggctcatctcgctgcggaagaggaccacggtgatcgagtcgctctccacgccccggtactccacggagttcttcgcgtcggacggcagccgcagcgccttggcgaggtactcctgcacctcctccgccgcctggacccgcgggtgggtgaccaggacccgcagggggccggtgccctccggggtgaaaccgaccggcagcagaccggcgagcttgcggctgaacaggtcgagcgcttccttgctgacctgctcggtggcctccgcgtcaccggcggcggccgccagcagcgtgctcatcgaaggcagcaggggccgctcctccaactgcgccccgctctcggcgaagagccgggtgatccgaccctccagccgggccttgacggctccgaccgccccgtcggggctgcggtggctccgcgcgtgcacctcccgccaggtgtccccgtcgatgagccgcagcagcagcgacgcctcgttgtcgctctcgcggaggccctcgccgcggacgagccgggccacgacgtcctcgtagaagtggttgaggctgcgctgcggcggcagccaggtaggagattccggtgcgctccgcgtacagctccaggcccttctgctcggccgacttgcgctcctggtcggcgtgtttgcggaaggcgttcaccagccgcgccagatcggtgcccgccgtgtccgcctgtgactgccagcgctgctgctgctcgcgccacgcctcgtgccagacggcccggcagcgccagcggtaccagctgtcctgtgcctggagggcggcccgtacgtcgtcgtcaccccaccgggccggggacattccggcgatgcggcccttgatccggggggtcttcggcggctggtcggtgacgcccgggggccgcttcggggagcgggagcgggcggtgagcatgccgaggaacccgagccgggtgatctcgtcctcgctgtccgggacgccccggacgaggcgttcggcgaggaagggatcgacgctctgcaagagtttctcgatcgccgggcgggggctgaaccggcccgccatcgcggcggcctgacggtcggcgatggactggagctcggacagcaggcgctgcatgtccccgatccggttgttgagcgcctcctcgatcgcccggccgccgcgcggcagcggctgcgggtcctcgacgggcaactgcttgcgttcccacagctcttcgagctgggagtcggcgaacagctgccggaccagcggcacggtgtcgtccttcgccgggttgcgcggccgttccaccagttcggtgaccgcgacccgcaacagccgcccggcgaccaggtcggccagctggtccatgggtgcggtcatcgacgcgaccagactggtggacacgccctgccggccgatgccggtgggggacagggcgctgcgctgcacgccccggttgatgaagctcgcggcgaaggtctggaagtcgtcgtcaccggccatcgaccggccctgcgcccggctgtcgcccagttcggtgccgatcagcgacatcaccagcgacacgatggagcggcgcaggtcgtcctggcggatgcccgcggtcgggctgaagaggaacgcggtcggcaggatcccggtacgcagccggaccggggtggtccccgggtagcggatgccgaggccggtctcctggtcgaggtcgccga

SEQ ID NO: 3792 - DNA, 3355 bp, Unknown
  Kingdom: Bacteria, Phylum: Actinobacteria, Class: Actinobacteria, Order: Streptomycetales, Family: Streptomycetaceae, Genus: Streptomyces
ccccgggccccgctcctcagtcgccggaggggctcgaaagatgtcctcaggcgccggaccggctgggtcggcccggaacggtcacgcccagagctggccctgaagcgtttcgatcgccgcttctgtcgtctccgccgtgtagacgcccgtcgacaggtacttccagccgccgtccgcgacgacgaagacgatgtcggcgctctcccccgccttgaccgccttgttgcccacgccgatcgccgcgtggagggcggcgccggtggagacgcccgcgaagattccctcctgctggaggagttcgcgggtgcgggtgaccgcgtcggcggagcccacggagaagcgggtggtgaggaccgaggcgtcgtagagctcggggacgaagccctcgtcgaggttgcgcaggccgtagaccaggtcgtcgtagcgcggctcggcggcgacgatccggatgccggggcggttctcgcggaggtagcggccgacgcccatcagggtgccggtggtgccgaggcccgcgacgaagtgggtgatggacgggaggtcggtgaggatctcgggtccggtggtggcgtagtgggcgcccgcgttgtccgggttgccgtactggtagagcatcacccagtccgggtgctcggccgacagttccttcgcgacgcggacggcggtgttggagccgcccgcggccggggaggagatgatctcggcgccccacatggcgagcaggtcgcgccgctcctgggaggtgttctccggcatgacgcagacgatgcggtagcccttgagcttggccgccatggcgagcgagatgccggtgttgccgctggtgggctccaggatggtgcagccgggtgtcagccggccgtccttctccgcctgttcgaccatgtggagcgcgggacggtccttgatcgagccggtggggttgcggtcctccagcttggcccagatccggacgtccccggacggggacagccggggcagacgcaccagaggtgtgttgcccacggccgccagcggggagtcgtaccgcatcagcgcatgccgccggcgacggccgggaggatcgtgacgttgtcgccgtcgctgagcttggtggagatgccgtcgaggaagcggacgtcctcgtcgttgaggtagacgttcacgaagcggcggagctgttcgccgtcgacaatgcgctcacggatgccggtgtggcggctctccaggtcggcgaagaggtcggcgagggtgtccccgttgccttcgacggccttcgcgccgtcggtgtaggtgcggaggatggtcgggatgcggacctcgatggccatggcgtgggctcctgtcgaaagcgtggaggtggcgtggggcgcgcgtttctgcccccgcgcagggggtggtgcgtgtgggtgggcgcgcggaccgcggctcaggccgggcggctcacgggcaggctgcgggcgggacagatcgcgctggcgagcctgcacaggtcgacgtgcagccgcgcgacgagcagcgtgcccggcgtcttgttgctcacgtcatggggaaccatgcgggcatcgtatcgattccctgtgcggaaacccgagtgtcatatcagatagtggatggtgagcgaccgctatgtggacagcgtggggtgggcgagaccttccggcaggtagacgaccgtgggtgcgccggtcttcgggtgggtgctgacctcggcggcgacgccgtacacctcgcccagcagttcggccgtgaggacctcttccggggtgccggaggcgacgacgcggccgtccttgaggacgtagaggcggtcgcagtagtaggcggcgaggttgaggtcgtgcagggcgaggaggttggtggtgccgaggtcgcggaccagggagaggatctccagctggtagcggatgtccaggtggttggtcggctcgtccaggacgacgagcgacggctgctggaccagggcgcgggcgacgagggcgcgctggcgttcgccgccggagagcgaggcgaacgtacggggttcgagtgcggtgatgccgacccgggcgagtgcctcggcgaccagggcggagtcggcggcggtgtccgcctcccagaaccgcttgtgcggggcgcggcccatcgcgacgacctggccgacggtgagctcgaagccggcgtggccgtcctgcgggacggtggcgatgcgccgggcgcgggccttcacggggagggtggcgaggtcgtcgccgtcgaggaggacacggccgtgggtggggcgcagggtgccgtagacgcaccgcaggagggtggtcttgccgctgccgttggggccgacgaggccgacggtctcgccgtcggcggcggtgaggtcgacggcgtcgacgaggtggcggccctcgccgaccccgtacgagaggccctcggtgcgcagggtggtcacgggcgggctcctcgggcgtacgcggtggtggagccggctccctcgacgagtggcagcttcatgcgggcgctccttcggggcggcggcggagcatccagaggaagaacgggccgccggtcagcgcggtgaggacgccgaccgggatgtcctgcggggcggcgagcgtccgggcggccaggtcggcgaggaccaggaacaccgctccgccgagggcgacgaccgggagcagcgcgcggtgcgcggcgccgacggccatccgggccatgtgcgggaccatcagcccgacgaagccgatcgccccgctgtacgcgacgagcgccccggtcatgagggaggcgaggacgaagacggcggcccggaagcgggcggtgtcgaggccgaggacggtcgcgccctcctcccccaccaggagcaggtcgagcggccgggccagggtgaggagtacgccggtgccgaggaccagggtgatcgcggggagcgcgagcatgtcccagcgggccgcgccgaggccgccgagggtccagtagaggacttcctggaggtggtcggcgcgggcggaggtgaccaggatcaggctggtcagggcggagaggacgtaggagacggcgaccccggcgaggacgagccggttggtggtgaggccgcctccgccgcgcgccagggtgtagacgaggagcagcgagagcagcgcgcccgcgaaggcggccgccgggatggtgacggtggtggcgagggtcgcgccgatgccgaggacgatcaccaggacggcgccggtggaggctccggaggagacgccgaggaggaacgggtcggcgagctggttgcgtacgagggcctggaggacggtgccgatgacggcgagtccggcgccgacgacgatgccgagcagcacccggggcagccggacgtccaggacgatcgtgcggaagggactcgcgtccgcccgcccgg

SEQ ID NO: 3793 - DNA, 569 bp, Unknown
  Kingdom: Bacteria, Phylum: Actinobacteria, Class: Actinobacteria, Order: Streptomycetales, Family: Streptomycetaceae, Genus: Streptomyces
  misc_feature (183)..(184): n is a, c, g, or t
ttcgctgcggtgccgcagcggcgctcgaactcatgggcgtcctcccggaacacttcacgtttggcggtcgttgcaaactggtgtagaccagttgcgtcacggtccggggtccgtcccgaaggcagggcgccggtgatcgtcatctttcgggatcgtccggttacccgcccgcgaagttgggcnntgacgaaacggacccgcagcgggcggccgtctgcgcgcgaaaccagggagaaggacatggccaccaaggctgagaagatcgtcgccgggctcggcggtatcgagaacatcgacgagatcgaaggctgcatcacccgcctccgcaccgaggtccacgaccccagcaaggtcgacgaagccgccctcaaggccgccggcgcccacggcgtcgtcaagatgggcaccgcgatccaggtcgtcatcggcaccgacgcggaccccatcgccgccgacatcgaagacatgatgtgaccggctgaccccacgccggaaaccgcaggccccgtcccccgccggaggacggggccgcgccatgtccgcacacccccgcccacgctccccacgga

SEQ ID NO: 3794 - DNA, 1095 bp, Unknown
  Kingdom: Bacteria, Phylum: Actinobacteria, Class: Actinobacteria, Order: Streptomycetales, Family: Streptomycetaceae, Genus: Streptomyces
gccgccgacgggaccgcgggcggaacctccggcggggtcgccgacgcgggtgcgaacacgccagcgaaggacgcctccgccaagtcgtaggctgggcgcatgaagagccccctgctgtccctgcccggtgccgttcccgccgaaggccgcgacgaaggtgtcgccgcgcactacggcgacctgttccgcgagcaacgcgccctggccgacggcaacggcttcgtcgacctctcccaccgcggcgtcatcaccgtcaccggcgacgaccggctgagctggctgcacctgctgctcacccagcacgtcagcgacctcgccccgaaccaggccaccgaggcgctcatcctgtccgcaaacgggcacatcgagcacgcgatgtacctggtggacgacggcgcgacggtgtggatgcacgtcgagccggactcccagggagacctgatcgcctacctggagtcgatgaagttcttctaccgggtcgaggtcgccgaccgcaccggcgacatcgcggtcgtccacctcccggccggctccatcgcggaggccccggacgaggtggccgtacgggagaccccgcagggccgggacctgttcctgccgcgcggggacctggaggcgtacgccgccgcccacggccccgccgccgggatcctggcttacgaggcgctgcgcgtggagggccaccggccgcgcgtcggcttcgagaccgaccaccgcaccatcccgcacgagctgggctggatcggcagcgccgtccacctccagaagggctgctaccggggtcaggagacggtggcccgcgtccacaacctggggaagccgccgcgccggctcgtcttcctgcacctggacggcagcgaggtgcacctgcccggacacgggacgccggtgcggctggccgccgacggccaggagggccgccagctcggcttcatcaccacctcggcccgccaccacgaactgggcccgatcgccctggccctggtcaagcggaacgtggccgtcgacgcggagctgctcgccggggacacggcggcagcccaggagacggtcgtggagccgtagcactccgtccccgcgcccgccgtcacacct

SEQ ID NO: 3795 - DNA, 1451 bp, Unknown
  Kingdom: Bacteria, Phylum: Actinobacteria, Class: Actinobacteria, Order: Streptomycetales, Family: Streptomycetaceae, Genus: Streptomyces
ggtgaccggggtgggcgtcccacccttactcgatgagtgaattgcgaatttctgcaattcgctacatgctgtgtgggccgttccgccgccgtgcgcgggccacggtccgcgcgcggctctccggcccgcggcggtgacgtaccgccgaggagaggcgccgccgtgccggtccccctgtatcaggccaaggccgagttcttccggatgcccgggcgtccggcgcgcatcagggtcctggagctgctccgggcggggccgttgccggtgcgggatctgccgccctcgatcgaggtggagccttcggtcctctcgcagctgcgggaggccggggagcgcgtccgatgatcgtgccaccggacacgttgccgtaccggcatgtgctgacgctgcccgcgatggggtcggccgtgcgcatcgcccgggagaccgccgaacaggtgctggcggagtggggggtggggccgcgggttccgtgccgggatccggcgctgctgatcctcagtgagctggtggccaacagtgtgcggcacgcggcggtgctctcgccgaacgtgaccgtggcgttcgcgggcggtcctgacacgttcgcgttcggcgtgcacgaccgccatccgtaccggccggccctgttcgcctccgccgggacggctcccgggcggggtctcgccacggtgatggagctgacccatggtctgggcggcagcgcggtggtgcgtggcgatgccgacgagggcggcaagagcatctggatcacccttccgctgcagcggagcggccggagacgctcaagcgcggcacgctggtgaagaccatccggctcaccggtcgcgccggtgagatcgagtgcgacacgaagaaggtcaagggtctggtgctgaggacggagttcctgaagaaggcctgacccggccggtccccgggttcatcctcgtggtgcgaaggcgcgaggatgaacccatggagaagagttctggtcagctgtggtgcggcgggttcccggcgtgcggaacggggccgcgccggtgagcacaccgctgtaccgattgaaggcggagttcttcaagacgctggggcacccggtccggatcagggtgctcgaactgctcagtgaacgcgagcacgcggtctcggagatgctgaacgaggtgggggtcgaggccgcccatctctcgcagcagctggccgtgttgcgccgtgccggtctcgtgacggcccggcgggagggctcggccgtccgctacacgctggccgatccgggggtggcggagctgctgcgggtggcgcggacgatcctgaccggggtgctggcgggccaggcggagctgctggccgatctgcgggcggcgggcggctccggggacgacgccccggccggggctccggacgatgtcgcggacgagaacgacgacggccccggctgatcctccgtaccgcacggccgcggggcggga

SEQ ID NO: 3796 - DNA, 5337 bp, Unknown
  Kingdom: Bacteria, Phylum: Actinobacteria, Class: Actinobacteria, Order: Streptomycetales, Family: Streptomycetaceae, Genus: Streptomyces
gtaccggatcgggcagccgggggcgcagcgctccggcgacctgctgggcgatggagagctggcccgtcatcagcaggtgcagcaccgcctcccggccccgggactccgcgaggtccacccggcggcgtttgcgctccagggtctcggcctgccggcacacggacagcggcaggaccacgtcggccagcagcgtggcgagcccggcggccacgggccggggggtgacgacggcgagcacgggggcggcgcggtcgtcggcgctcaggggaaacagcagggcggtatgcgcgccggtgtcgagggagtacgcctgggctccgcgctccgtgcgggcgctcgcgacctcgacgacgagcgccgccacgtcggggaccaccgtccgcgccgtacgggccgccgcgtgcagcaccgtcccgtccggcccgacgatcccggcccagccaccggcccgaccggccagccagcgcagcagctcggccgttccgcccgtgcgggccagccggtgcatcagcagaagatcgtccgcacgctcccgtgctcgcacctgtttccccgttcccgccccggacacagccgtagcaccggtggaccgcccggcacgactgactgtgcggaccgatacccctgcggctgccccactgggcgcattgaatctcccgtctccctaccctgcgttctatcgtccgaacgtgttccagtccgtcgggggacggctccggaacagggggacgcggggaacgggacggcagcgactcacgggggtggtcgctgtcgtcggttcccgccccgcgggtgattgtcagtggtgccttctatcgtcgacgccgccggacccggcttcccgggtccggcttccgacgcgccgggaaaggctcccatggagttccgtatcgaacgcagtgccctgaccgacgccgtgtcctgggcggcccgtgtcctgcccgtgcggtcgcccgtccccgtgctgggcgggctgctgctggacacggagggcgagggcgggccgctgcggatctccgggctcgactacgaggcgtccgcgcgcatcgacgtggacgccgaggtcgtacggcccgggaaggtgctcgtcatggggcggcggctgctggacatctgcaaggtgctgcccgagggacccgtggagtgcgccgtggagggctcgcggttcacggtgtcgggcgacggggcccggttcggcctctccgtgctgccgctggacgactacccgtcgctgcccccgctcccgcaggtccggggcacggtggacgcggagctgttcgcggcggccgtggccgatgtggcggtggccgcgggccgcgacgacacgctgcccgcgctcaccgggatccggctgggtctcgacggcgacacgatgacgctcgccgcgaccgaccggtaccgcttcgccgtacggaccctcccgtggagggcgaccgcccccggcgaggccgccgacgtcatcgtctccgcccgccgcctcaccgagatcgcccgctcgctgggccgctccgggctcgtgagcctcgccctggacgccggttcggcggggttcgagcatgccgggacgcggaccacggtacggctgctggacggccggctgccgcgccacgagaagctgttcgcgatggcggacccggcggtcgcggtggtggaccgcgtccggctgacggaggccgtcaagcgggtctccgtcgtcgccgacggggacagtccggtgcagatgaccttcgcccgcgccgacggctccgtgaccctccgcgcgggttacgaggacgacgtggcgtcccagcggctgccggccgccctggaggggtccgaggagctgacggtggccttcaaccccggctatctggcggacgccctggcctccttcacggaaccgtccctgcggctcctgctgctgggacccggacagcgcgcgatgatcacggacgtggcacgcacggacgtccaccggcacctgctgatgtcggtgaagccgcagttggtgtgaccggggccgggacgccggaacgggggtgcgcccggcgcgagccggccacacccccgttccgggtggggtcatcgggttcctcaggggccctcgcggaccggtgaggtgcggtacggaatcagcagctcaggttcggaccggtggtggtgccgaggatctgggtgaactgcgtgaacttgttgatgcggctctggacctgcgccgggttgccgccgttgcactccagtgcgccgttgatcgagcggatcgtctcgccgaagccggcgttgttgacgatggcgttgtgcggcgtcatggtgccggggccgttctgggtgttccagtaccagaggccggtcttccacgccacggcggcgtcctgctccaccaggtacgggttggccagcaggttgatgcccagggcgtcgcccgcggccttgtagttgaagttccagctcagctggatcgggccgcggccgtagtaggcggcctggccggccgggcagccgtaggactgcgtggtgtcgcagtagtgcgggtagttcgcctcgttgacttccttgatgtagaacagcccgccggtctcgtggctgacgttggcgaggaaggccgcggcctcgcgcttcttcacctcgtcgctgccggtgttggcgaaggccgggtaggcgctcagggcgtcggtcaggcccttgtacgtgtagaaggcgttccggttcgggaacatctggttgaactgggcctcgctgacgacgaagccgttgttctcgcccgggttctcgccgccggtgccgcaggcccccttgtcggcccacacgtccgacgtgcccggacgctcgttctgggtccaccacttcgcggtgtagttacggccgttgtacgagaccgcgccgccgttcgtgtagacggaggaggagctccaggccgtggcgcaggtggctgcctgcgcggtggcggcgggaagaacgacgagcgccgcgacgatcgcgccgagcgcgaccagcagactcatgacacgtcggatcacgtgatcacactccttggacgcggcgcgacgtccggcctgcgccgccgtgggggtgccgacactcaagcgaggatggtctggacctgtcaaggtctagaccatcctcggaataggtggcggttccaccggtcccggcccctaccgcccggaccgtcgcgtcaagagggccctcaacagcccctattccggagggagtccatccggatcaccgtcggacagaggcggacccgaaggtaaaatcttccggcccgcccagcatgcggacggttccggacggcctgcggacacaccgggaccggcaggctcagcaggtgagtccggatcccggagccacccgcgatgccggtgacgcgttcgtaccgctccacccgcgcgaccaccgacccgggttgccgccgtcgcactccaggacccaagggccgggtgtcgtcgcactcgcgccagtagtcggccaagtccgcccagtctgggcctgtcaggcctggaccagcaccccggtggcgccgcgcggagcgcgaaacgcgcgcggcggcggactacgggtcgtccccgttgtccgccgccgcgtcgctgtccggccgctcccgcgaagcgtgcctagaggaacgagttgatctcgatggtctcggtccggccggggccgacgccgatcgcggagatcggtgcgcccgacatctcctccagggccttcacgtacgcctgcgcgttcttcggcaggtcgtcgaaggtcttggccttggtgatgtcctcggaccagcccggcaggttctcgtagatcggcttcgcgtggtggaagtcggtctggttgtaaggcagttcctcgacgcgcttgccgtcgatctcgtacgccacgcagaccgggatctgctcccagccggtgaggacgtcgagcttggtgaggaagaagtcggtcaggccgttgacccgggtcgcgtaccgcgcgatcggggcgtcgaaccaaccacaacgacggtcacggccggtggtgacaccgcgctcgccgccgatgcgccgcagcgcctcgccgtcctcgtcgtgcagctccgtcgggaacggaccggccccgacccgcgtcgtataggccttgaggatgccgatgacccggctgatcttcgtcgggcccacgccggcgccggtgcaggcgccgcccgcggtcgggttcgacgaggtgacgaaggggtaggtgccgtggtcgacgtcgagcagagtgccctggccgccctcgaagaggacgaccttgccgtcgtcgatggcatcgttcaggatcagggtcgtgtcggcgacgaacggcttgatctgctccgcgtactggagcatgtcctcgacgaccttgccggcctcgatggcccggcggttgaagaccttggccaggagctggttcttctgctccagggccgcctccaccttctgttccaggatcgactcgtcgtagaggtcctggacgcggatccccacccggttgatcttgtcggcgtacgtcggaccgataccccggcccgtcgtgccgatcttgcgcttccccaggaagcgctcggtcaccttgtcgagcgtgacgttgtacggagtgatcaaatgagcgttgccgctgatcagaagcttggacgtgtcgacgcctcgctcattcagaccgctcagctcggagagcaggaccgccgggtcgaccacgacaccgttcccgatgaccggggtacaacccggcgacaggattccggaggggaggagatgcagtgcgtacttctggtcgcctacgacgaccgtgtgaccggcgttgttgccgccttggtaacgcaccacatagtccacggatccaccgaggaggtcggtggccttccccttgccctcgtcaccccactgagcaccgagcagcacaagtgcgggcacaggcgtacaccccttccgggcggggcatgtccaaggtcagggggcgtacgtaaaggtcgtacctgccgtacgacgatgtacggcaaagcctgagccgtcgaaccgggtgccccggaatagacgaagcccctggcgcaatagcgcaaggggctcttgcaccaagatgctacccgaggaaggaccgaggtgtcggctgcagagccccccggcgacggcgacgaccagctcctggtggtcatcgacccggccgcccgccggaccgacggcgagtccgtccgtatcgccaaggacgtgctgagcgccggctcgcacgccaagatctgccttccggacacccccgaggagttcgcgcgggccctgtcccggcggggttcgcgcagacccgtggtggtcggcgacgatcacgcactgctgcgcgcggtggcccagctccaccgcgaacgggagctgggccaccgcg

SEQ ID NO: 3797 - DNA, 2734 bp, Unknown
  Kingdom: Bacteria, Phylum: Actinobacteria, Class: Actinobacteria, Order: Streptomycetales, Family: Streptomycetaceae, Genus: Streptomyces
ggcccccacggtcccccggggtccgtgagtgcgccgtcccgcccgggggaccgtgggggccccgataaccttgggcccgtggtgaaggaagagaagaacgtgcaggagaagaaaccggccaaggccgcgaagagcgagcagacccgcacgctgattctcgaaacggcgctccggctcttcgcggagcgcggctacgaccggacgaccatgcgggccatcgcccaggaggcgggcgtctcggtcgggaacgcctactactacttctcctcgaaggagcacctggtccagggcttctacgaccggatcgccggcgaacacgcggcggctgtccggcccgtgctggagggcgacggggatctgaccgtacgcatcagaggcgtgctgctcggctggctggacgtggcggagccgtaccaccgtttctccgcccagttcttcaagaacgccgccgatccggacagcccgctctccccgttctccgaggactcggcggccgcccgcgacgcggcgatctccatccacgagcgctgcatcgccggggcggacgtcaagagcgacccggaactggctccactgctgccgcagttgatgtggctgatgcagatgggactggtgctgttctgggtgtacgaccgcagcgagggcgccgagcgcagccgccggctggtcgagcgcaccgcgccgatcgccgcgcgcgccatctcgctctcccggttccgggtgctgcgaccgctggtgcggcagatccacgcgctgctggtggagttcctgccgggtcctgcgacggcaggacgaccctgaggtcccgcaggcccccgcagacccggaggccccggcggctcccgccgggggacccggtcagatccggctgagctcccacagacgccaggtgccggtgccctcggagaggtactgggagccggcgacctcggacttggcgacgacgtagtccttcttctgccacagcggcagcagggggacgtcctcgccgaccagcgactgcatctccttgaagtcgccggaggtacggctacggtcgctgaactgctgcgtggcggtgatcagctggtccatcttcttgctggagtagccgctgtgcagcacgttgccggtgccgacgagcggctggctgaaggtgtcggggtccgggaagtcggggaaccagccgacggtgtacatgtcgtacttaccggctgcgtactccttctggtacttcgtccactccacggcctcgaccgagaccttgaacagcccgtccttctccatctgacgccgcagttcggcggtctccttggtgtacatgtcgccctcgcggtaggcgaagttcaccgggaccggcgtcttcgctccggcctgctggagcagctgcgcggcgcgctcggggtcggaggaggggtaggcgtcgaagaacggggtgctgtgcccgatgaagccggtggggatcagcgagtacagcgggtcgaccgtgccctggtagaccttccggaccaggggaccccggtcgaggagcgcggcgacggcctgacggaccttcttgtccgcgaacggcgtgccctcgcggacgttgaagatgatgttgcggatctccgcgctggtcgcctcggtcacccgcacgtccgggtcgttcacgttcagttcggcgagcgtctcggacggcagctggcggtgggcgacgtcgacgtcaccggcgtcccaggacgtctgcaggtcctcggaggtcttgaagtagcggatggtgacggcctggccggtcttcttgagcgcacccttgtacttcaggttcggcaccagctcggcgcgggtcccgtgctcgtacgacttgaggacgtacgggccggagccgtcgacctgattgcccggacggatcttgtcctcggggtacttcgtggtgtcgacgatcgccgcggcgccggtggcgatcttctgcgggaaggtcgcgtccttgccggacaggttgaacgtgatcgtgcggccctcggtcgtcaccgagtcgagcgtggggaagagtccggcggggccgacgtccgacttgatcgtgaagatccggtcgaaggagtgcttgacgtcctcggcggtgatcttgcggccgttggtgaaggtcaggtcgtcacggagcttgcactggtacgtctggagcttctgcccgacgaatccgcagctctcggcggcgtccggctccggcgtgaccgcaccgggcttgaaggtcatcagcgactggtagatgttgctgtagatcgcccaggaacccgcgtcgtacgcgccggccgggtcgagcgaggtgacgacgtccgaggtcccgacagtgatcgcatcggtcttcgcctcccccgacgggagcagttgccaggcgccgacgcctgcgatgaccaataccgcgagaatcgcgagaatccgtacccggaccgaccgcattgccgtgctctcccttaccagccccacctcgacggttgcgctcagttccgcacatcgccgcacgttcgcgcttacccaatcacacgattttcacatctggaagagtaaatggggcactcacagccttttgttggacacatacccgaacccctgtccgaaaaggctgtttcctgcctcccacctgcggctttccgtcgctgacggtgaccctgcggtgtggattccatgacgaggggtccgggactcccggaccgtcgcatccgcaacggaaccaggaggtgcccggcggatgagggccgggtccggccctcatccgccgggc

SEQ ID NO: 3798 - DNA, 634 bp, Unknown
  Kingdom: Bacteria, Phylum: Actinobacteria, Class: Actinobacteria, Order: Streptomycetales, Family: Streptomycetaceae, Genus: Streptomyces
ctcgtcggtggcgccgaggacggcgagccgggtgaggatgcgccagcgcagctccgggtcgagctcgggtccgccgtggacggtgccttcgtcgagccaggtccggagcgtgtcgggctgggtggcggcgtcgatgaagtggcgtacggcgatgaggcgcaggcccggctgtgagccgtcctcggtacggcggatgaggtcgcggcagaggtcggtgagggtggcgcgggcggcgggcaggtcctcggggacggtgtagcggtcgacgacctggccggcggcgaaggccaggacgccctggacgagcgcgaggtcggtctcgtgcgggaggtgcgtgcgggcggtcgcgaggtaggtggcgggagggagttccgcgtcgcggaccatgtcgcgggcggtgttccagacgacggcccgggtgagggcgtcggggacgccggagaggctggtgaggacggtgtcccaggaggcggtgtccaggcggaccttggcgtaggtgaggtcgccgtcgttgacgacgacgagggcggggcggcggccggggcggatcgtgggcgtcccgtcgccgggtacgtcgagttcgaagcggtcgcgcagggcgaggtggccggggccgccctggacgcccagggcg

SEQ ID NO: 3799 - DNA, 1205 bp, Unknown
  Kingdom: Bacteria, Phylum: Actinobacteria, Class: Actinobacteria, Order: Streptomycetales, Family: Streptomycetaceae, Genus: Streptomyces
ccgcccggccgggcggtcagcggcagcatggtccggccgtgctgcacgatcggcttggcgcgcacccggggatcgccgaccggtgcggcgcccacgaggtcgtcgagcggcacctcgtgggcgcgggcgatcggcagcatcagttcgaggctggggcggcggccccccgactccaggcgcgagagcgtggagacggagatgccggtggcggccgagaggtcggcgagggtgaccccgcgatccttgcgcagccggcgcagacgtggcccgacgccggtgagaacagcctcgagttccgggtcgtcccggtcgtgttccttcatgcggccattgcagaatcggcaagccggtttgtcaaccggccaactcggtcgacggcagacccagaggtcccggagcgacccggacaagagggctgacacgtcctagtgggcgaagacctcgaaggtgaccgccggccggccgccgaactgttcggctgcggcctcgaccatgccggtcaggaaagtccggcagtaccgctccgggtcctcctgggtcagcgcctcgatgtacgtgcggtgctccagcagcgaccggaccgaacgttcgagaccggccgtcgcgtctacggcgtgggtgggcctgtcgctgcccgccacggcggtccagcgcacgccgtcccacggccggagtccccgctcgccgagttccgggaagatccagcggttgcccgcgtcggcgacggcgtccagtgcggcgcgcccgacggcacggtggtccggtgtgttccaggcggccccgccccaggtgtcccggtgattgagggtgaccaccagttcggggcggtgacggcggatggccgcggcgatgtcgcggcgcagcccgatgccgtactcgatcacaccgtcgcggtggtccaggaactccacggtccgcacgccgacgacggcggcactcgcccgctgctcccgctcgcgcaccggcgcgcactcctcgggcggcagtgagtcgatcccggcctcgccgcggctggcgaggaggtagacgacctcacggccgccgtcggtccactccgccacggcggcggccgctccgtactccaggtcgtcggggtgggcgaccacggccagggcgcgctgccagtcgacgggcatggggtcgagtcgctgcgacgtcataccggcaggctacccacgtaccgtcgagacggcaggctgcccggc

SEQ ID NO: 3800 - DNA, 3245 bp, Unknown
  Kingdom: Bacteria, Phylum: Actinobacteria, Class: Actinobacteria, Order: Streptomycetales, Family: Streptomycetaceae, Genus: Streptomyces
gtgcgcgccctgtgccgcgtgcgcgccctgtgccgcgtgcgcgccgtgtgtggggcagctcccggcggcgggtgcctccgggagctgctcctgcccgtgtcggtgccggctgcgccggaccggtgcgggtcctacaggtgcgggaggatcgacggcatcaggtcctggaaggtgcggccgttggccgggttcccgagggccgtcatctgccatccgctgcccgcgcggtgcaccttcgccatgatctgggcggtgtactggccgccgccgtcgagcgtgtaccgggcgagctcctggccgttggtctcgtcgacgatgcggcagaaggcgttctggacctcctggaacgtctgcccggtgaaggagttcaccgtgaagacgatctggtcgatgtggaccggaatgcgctggaggtcgacgaggatcgcctcgtcgtcgccgccggagcccgcgccgccgaccaggttgtcaccggtgtgcttgaccgagccgtcatcgctgacgaggtggcggaagaacacgacgtcgaccggctgcttgtcggcgaagagcaccgccgaggcgtccaggtcgacctcgcgggtgcgcgagccgaacaggccacggcgcggagccgcctgccagccgagccccatccgtaccgcggtcagggtccccccgtcgctcttctgcaggctgatggcctgacccttggtcatattgaccgtcacgcgctgtcccctctcggcattgccccgcaaccatccgtgtgcggtttccccgcaccctacgcattcccccccgggcggcagcaggctcggtccgtttttgtgtcggtcttgcaacacacccggcgcggcatgcccgacgctacggaatccactccggaatccacgccgtattccccccccccggagccggcgcgggacgggcgcgcgtcagcggcgatcccgcgccggccgggccgccgggatcaggcgagacccgcctccttcatctgccgcagctccttcttcagctcaccgacctcgtcgcgcagccgggccgccacctcgaactgcagatccgcggcggcggcccgcatccgctcggtcatctcctcgatgatcccggccagctcggtcgcgggccggtcgctgaggaccgcgccgggcgaggccgccctgcccttcgccccggccttggcagccttgccgccgagcgcgggcaccggcgccttggcctccttgccctgccggtagccggtgccgagcagctgctcggtgtcgacctcctcgcgggcgatggtcgcgacgatgtcgttgatcttcttgcgcaggggctgcgggtcgatgccgcgctcggtgttgtacgcgacctgcttctcgcggcggcggttcgtctcgtcgatcgcctgcgccatggccggggtgatcttgtcggcgtacatgtggacctgaccggagacgttacgggcggcgcggccgatggtctggatgagcgaggtgccggagcgcaggaagccctgcttgtcggcgtcgaggatggccaccagggacacctcggggaggtcgagaccctcgcgcaggaggttgatgccgacgagcacgtcgtactcgccggagcgcagctcgcgcagcagctcgatgcggcggagggtgtcgacgtcgctgtgcagatagcggacctggatgccgagctccaggaagtagtcggtgaggtcctccgacatcttcttggtgagcgtggtgaccaggacccgctcgtcgcgctcgacgcgcttgcggatctcgtggaccaggtcgtcgatctggccctcggtgggcttgaccacgacctcggggtcgacgaggccggtggggcggatgatctgctcgacgaacccgtcgccgcgcgagagctcgtacttccccggagtggcggagaggtacaccgtctggtcgatccgcttcaggaactcctcccacttcagcggccggttgtccatagcggacggcagccggaagccgtggtcgacgagggtccgcttgcgggaggcgtctccctcgtacatcgcgccgatctgcgggaccgtgacgtgggactcgtccaggacgagcaggaagtcgtccgggaagtagtcgaggagggtgttgggcgcggtgccgggcgctcggtcgtcgaagtgcatcgagtagttctcgacgccggagcaggtgccgatctggcggagcatctcgatgtcgtacgtcgtgcgcatgcgcagtcgctgggcctccagcatcttgccctgcttctccagctcggccaggcgctgctccagctcccgctcgatgccgccgacggccttctccatgcgctcgggcccggcgacatagtggctggcggggaagacgtggaccgtggggtcctcactgatgatctcgccggtcagcgggtggagcgtggacagtgcctcgatctcgtcgccgaacatctcgatgcggacggcgagctcctcgtagaccgggaagatctcgatggtgtcgccccggacccggaaggtgccgcgggtgaacgccaggtcgttgcggctgtactgcatctccacgaagcggcgcagcagctggtcgcggtcgatctcctcgccgaccttgagctggaccatgcggtccacgtactcctggggcgtgccgaggccgtagatgcaggagacggaggcgaccacgacgacatcgcggcgggtgagcagcgaattcgtcgccgagtggcgcagccgctcgacctcctcgttgatggaggagtccttctcgatgtaggtgtccgactgcgggacgtacgcctcgggctggtagtagtcgtagtacgagacgaaatactccaccgcgttgttcgggaggagctcacggaactcgttggccagctgggcggcgagggtcttgttcggcgccatcaccagggtggggcgctgcagcttctcgatcatccaggcggtggtcgccgacttgccggtgccggtcgcgccgagcaggacgacgtccttctcatccgcgcggatacgccgctccagctcggcgatggccgccggctggtctccgctgggctggtagggactgacgacctcgaagggcgccaccgaacgttcgatcttggaaacgggccgcatgcaaccaccgtacggctcgccactgacaacggccccggatcaacggtgccgagcccctcccacggtgctccgggggcgccgcccggcccgcgggtccggggccgggtcgcccgtcacggccctggggtcgaacaggagcaccacggcggcgaggagcaggaag

SEQ ID NO: 3801 - DNA, 512 bp, Unknown
  Kingdom: Bacteria, Phylum: Actinobacteria, Class: Actinobacteria, Order: Streptomycetales, Family: Streptomycetaceae, Genus: Streptomyces
cgcgctgcgggcccaccagccggggcaacagatacgcgccgccgccgtccgggacgagtccccggcgtacgaagacctcgatgaaccgtgccgtgtcggccgccaggaccagatcgcacgcgaacgccagatgcgcgccgatcccggccgccgtcccgttgacagcggcgatcaccggcttctcgcagtccagcacggcggcgatcagccgctgtgcgccgagccggatcgtccgggcgacgtccccgggggctcgttcgcctgtcggggccggggtgccgcgcaggtcggcgcccgcgcagaagccgcgaccggtggcggtgagcacgacgacccgtacggcggggtcggcggaggcctcggccagcagggcgatgatccgctcccgctggtcccgggtgacggcgttcatgacctccggacggttgagggtgatccacgagacgccgccgtcgacggcgtgcagcaccgtcgggtccgggccggcgcccggcgcgtggtccacggctccc

SEQ ID NO: 3802 - DNA, 1607 bp, Unknown
  Kingdom: Bacteria, Phylum: Actinobacteria, Class: Actinobacteria, Order: Streptomycetales, Family: Streptomycetaceae, Genus: Streptomyces
cgagacccagatcgtgaacgcctccgaccggctgatcgccaacaccgccgaggaggccgacgagctcgtccgcttctacgacgccgatcccgccgccgtcgccgtcgtgcaccccggcgtcaacctggaccgcttccgcccggccgacggccgtgccgccgcgcgggcccggctcggcctgccgcaggacgcgctgatcccgctcttcgcgggccgcatccagccgctgaaggccccggacgtgctgctgcgcgccgtggcggtgctcctggaccgggacccgtccctgcggtcccggatcgtcgtgccggtggtcggcggcccgagcggcagcggactcgccaagcccgagggcctgcagaagctggccgcccgcctcggcatcgccgacgtcgtacggttccatccgccggtgggccaggaccggctcgccgactggttccgcgccgcgtcggtgctggtcatgccgtcgtacagcgagtccttcgggctggtcgccatagaggcgcaggccaccggcaccccggtggtcgccgcagccgtgggagggctgccggtggcggtgcgcgacggggtcggcggcttcctggtggaggggcacgaccccgaggcgtacgcccgcgcgctcgggcggttcgcggacgcgccggagctggtcgagcggatgggggaggccgccgcggcgcacgcccagtccttcggctgggacacggccgcctcggcgaccgccgacgtgtacacggccgcgctctgcgaccaccgccgccgggcccgggcgcaccacggctgagaccgccgtgtgcggcggatgccgctggtccgtgccgtgcgcggcgcgcccctgtcgtacgctcgctgcatggctgacgtaccggacgaaactgcagcggcccaggtcatcgaggcgacgctgaacgatgccgggctcgtatgggagagcccggagcgcggcaactacgtcgtgacgctgcccggcacccgcaagctgtcgacgacctgttcgctgatcgtcggcaagcactcgctctccctcaacgcgttcgtcgtccggcaccccgacgagaacgacgccgaggtgcaccgctggctgctggagcgcaacctccgtctgttcggggtgagttacgcgatcgattcactcggcgacgtctacctggtcggcaagctgccgctgtcggtggtcaccgccgacgagctggaccggctgctcggctcggtgctggaagcggccgacggggcgttcaacaccctgctggagctcggtttcgcgagctcgatccgcaaggagtacgcgtggcgggtgtcgcgcggcgagtccacccggaatctggacgcgttcagccatctgacccggcgtccgtccgacaactgacgcccgtccccaccggctgacccttggattctcccggcggcgcaggggtctttccctgtgccgccgagccgtgccatgctcaccgtcaacgcgcatatgaacgtcattcatatatctgaaaggctcagggttatggcgacgactcaggggagtgggcgggggaccatcggcagacgcgcgatgctgggcggtgccgtggccgcggcggcgggcgcggtggccggcagcgccaccc

SEQ ID NO: 3803 - DNA, 3282 bp, Unknown
  Kingdom: Bacteria, Phylum: Actinobacteria, Class: Actinobacteria, Order: Streptomycetales, Family: Streptomycetaceae, Genus: Streptomyces
  misc_feature (245)..(261): n is a, c, g, or t
gggctgggtggcctcgatgcgggcgagggcgtcggccacgagtgcggtggaggtggtggtggcgtcggcgagccggcgggcgctctccgcgagtccgggaaccggcggcggaaccggggctgcggggcgggggctgcgaccggggcctcgtacggccgggccggtctgctcggtgggctccgctgaggacatgggcgtgccgcctccctcgtggtgcgggccggccggtcgtcccggctgcgccnnnnnnnnnnnnnnnnncaaccgttccggccggaacggttgcccggggctgtcgccccgagggcccggcatgatccaggcgaaaggcgctgggtcacgggcggacgtggatctcaccgatgccgctgccgaggcccgcgcagtgcgcggtggactgaccggactcgccgggcctgagggtgacgtggttgccgtcgacgtccggggaccagccgcagacgaggtggacccagaagacctgcgtctggctgccgttgttgctgcagagcgcgaagcccgtgtagtcgtcgatggcgtgcttgccggtgctgcaggagaggccgggcggaatcgcgcccggggcggcggtcgcggtgggcgcggtgaccgtgatcgccagtgcggccgccgtcgaagcggcggcgagcgccagcagggcggaccgggagcgcttccccgtggccgtgccgcccttgctcctcgtccccgtgaacaggttcatggttctcctccgtggtgcgtgcggatgttccggtggtgcgtgctgggtgatcccgagcgggatcaccgcagctctgcccacgctccgtggccgaaaacaccgccttgcttcactctccgtgcacgcgccgggcggcgcccccgctcccggcgtacgctcgaatgtgccggtcatcagggatcgccgaccctgaccggggcttttccgaggaggcgacgtgagcggacaccgatgggccgcgcgggcggccgcggctgcggcggccgtcgctctcaccgtgacgggtggcaccctcgcgcaggctgacgacgacatcgacacgctgagcgccgaggagatcgccgaacgctcgcgcgacgccctgctcgatgtgaaatccctgcatctgagcgcgcgcgggagtctcgacgggagcggcccggagatgcgcctcgacctcacgctggaccgcgaggggaactgcacgggcggggtcgacatgggtgaggacggctcggtggagatcgtgaagcgcggcgacgacgtctggctgaagccggacgccgccttctggaaggagcacgtgccgatcggtggttccaccttcgacgcgatcctcgacggccgctacatgaaggcctccgcggacgacccccggctgctcagtgtcaccgaggtctgcgacctcgacaccttccgcgagctgatcgcggacaacgccggcaccgcggaccgtggcacgctgaccaagggtgagaagaccgaggtgaacggcgcgccggccgttccggtgacccgcgccgagggtggcgaacgcctgacggcctacgtggccgccgagggcaccccgtacccggtgcggatcaccgtgcggaacgccggcgaggaagggaccgtggacttctccggcttcgaccggccggtgcccggcgccactcccccggcggacgagacggtggacgtcacggccctgctgggccgcagcatctctcccgtgtagcgcgcgcccggtcggcgctccgggcgtgacgggggcgccggccggggtcgaaccgccggtctcagcgcgccgccggactctcccggcgggtcagcgccacgtacagcagcagcgaggaggcgagtccgaccgcccagccgtagtcggccagcggcttcaggaacgggatcagtccgtcggcggggaagggccccttcccgggagccgagtgcgagccgcccaccgcgaggacgccgccgaccgcgaaggccgccaccgcccgccagttccagccgccccggtaccagtaccggccgccgggccggtacaggtcggccaggtcgaggacggtgcggcggacgatccagtagtcggcgatcaggatgcccgcgacggtgccgagcagtccgccgaccaggcccagccaggtgaagatgtacagctcgggcgtctcggtgagcttccacggcatgatcacgaccccgagcacacccgtgatcagcgctccggtccggaagctgatgaacttcggcgcgagattcgccaggtcgtacgccggggagaccacgttcgccgcgatgttcaccgagatcgtcgcgatcagcacggtgaccaggccgaagaccaggccgaagacgttgtcggtacgggccacgagctggaccgggtcccagatggccaccccgtacacggcctgcgatccggaggtgacgaagaccgaaagcagggcgaagaacgtcatggtggtcggcagcccgagcgactgcccccggatctgggcgcgttggcccgcgccgaagcgggtgaagtcggggatgttgagggagagcgtcgaccagaaggcgatcatgcccatcaacgaggggaagaagaccggccagaagtcggcgccccagccgagcgcggacggttggtccaggagcgggccgaagccgcccgccttgaccgcgacccagacgagcaggacgagggcgccgaccaggacgaagggcgccgcccagttctcgaagcggcgcagggtgtccatcccccggtagatgatggccagttcgagtgcccagaagaggacgaagcagagccagagcgtccagggctgcccgccgatctccccggcgccggcccagccgccgaagagcttgccgagcagcgtgaagatgccgacgccgccgatccaggtctggatgccgaaccacgcgcaggcgacggcggcccggatcagggcgggcaggttcgccccgcgcagcccgaaggaggcacgggccaggaccgggaagggaatgccgtacttgggcccggcgtgcccggtgagcagcatcggggccagcacgatcacattggcgagcgcgatggtgaacacggcctgtttccagtccatgccgagcgccaccagaccggaggcgagcagccacgacgggatgttgtgggccatgccgatccacagggccgcgaagttgtacgtcgtccaggtgcgtcgctcgaccgggacgggcagcaggtcgtcgttggcgaagcgggggtcgtcggggacgtatccgtgggcgagttcgacccggcccggggcggccgggccgggtatcgcgtcgctcggggaggacgggga

SEQ ID NO: 3804 - DNA, 608 bp, Unknown
  Kingdom: Bacteria, Phylum: Actinobacteria, Class: Actinobacteria, Order: Streptomycetales, Family: Streptomycetaceae, Genus: Streptomyces
ggtgggctgcccgtagacgtctccgtcgtcgtagatgggttcgatctggggctcgttgacggtggcggtgggatccgagccgtaggtggctccgtcgtcgtagatgccgctcatgctgttctccttcgggttgtgggccgccgtgccgtacacagcggcccaggggcggtcaggggacttcgtcggcatcgacggtctcgaagtgccgccaacgtccgctctcccagtactcgacgcgggctttctcggcggggctgtcgcctccgagggcggcgcggatcagggcgtaggccttggcttcgctggtgtggtcggaggtggcgttcacgtcgggcccggtgacaatgacccgccacgggttccggggcttcttggtggccatcggtctactcctcggcgtcttcctggtcactgcgccaggtgtcgcagttctggcagtgctcgtcgtcctgctggttctcggtaccgcagttctcacaggtccacatagtcagtcctcgtctcgttcgtatcgggcgtcccagtgccggtcgtcagcctgggctacttcgcgtgcggtgtcctcccacggcggcaacggggccggggcagacggcggggtcacgggg

SEQ ID NO: 3805 - DNA, 9102 bp, Unknown
  Kingdom: Bacteria, Phylum: Actinobacteria, Class: Actinobacteria, Order: Streptomycetales, Family: Streptomycetaceae, Genus: Streptomyces
cccggcggacgtgccggtgacgccgccggttgccccggcggcgctccaccacccgaccggggtacgtggggcgggtggctgacggcgcaccgcgtgtacgagtggtgcgccgcgccggcccccgtgccgtgtcagcgcccggcgaagtccgccgcggcgagcagggccgtgtccgggtggtcggcgaagatgccgtcgatgccggtggcgaggtaggcggcgcaggcgccgaacacgtcgccgtaggcgttggggtcggtgccgcgccggaagtcggcgggcaggaagctgttctcgttgcgcagtgtgtacgggtgcagccgcaggcccttggcgtgcgcgtcccgtaccagcgtggtcggggtggtgagccggcccgaggcgtccttggggatgacgaggtcgagtgtgggcccgatgccctgggcgaaggaggccatccacgccagcccggcgggcttcacgaggtcggcgacggtgcgcgggtcgcccgactcgacgaagtcccaggggcgctccttcgggccggacagcaggacgatgcgcggggtgtcgacgaggcgcgcgaggcgctggaccgagccgggctcgaaggactggaggatgagcgcggcgttcctgcggtcccggccgtagcgacgcagcagccgggcgagcggctcctccaggccgaggcccagcttgcggaagtaggtggggtgcttggtctccacgtacagccagaccggctcgccgcgcttgcggccctccttctccgcccagcgcagcacctcctcgaaggtggggatcgtccagcggccgttgtagagggtgttgtccggacggctgcccgggatgcgctccttcgcccgcagggtcttcagctcggcgagggtgaagtcctcggtgaaccagccggtcagggagaggccgtcgatgctcttggtggtcctgcggccggcgaactcggggtggtcggcgacgtcggtggtggcggtgatgtcgttctcgtggcggcagacgaggtgaccgtccttggtcggcacgaggtcctgctcgacgatgtgcgcacccatgtcgagggccagctggtaggagccgagggtgtgctcggggcggtaaccgctggccccgcggtggccgaccaccgtcggcacgggcagatcgcgcagcgaaccgtggccgccgccgtggccgcgcccccgctcggccgcctgggcggtggcgggcaggcccagggccgccgtgccgaggaccgcggcgcccagaagggtccgccggccgggggtcgtccgcgcacgctccgtcatgaatgctcctcgcttggtgatgtccgggaccggtcgagcgaggcccgatcgtaggctgggagatgtacgagaggacggaccttcggccaacatggcggaaacacacgtcaacactgcgtatccgcttcgtgaacccgatgtgcgatcagcgcatacccgcgagtatcgtcctcacctgcaccgaccatcacccgtcggcaccggccaccgcccgtacgacctattccatcgcggccggccaggccacgacaccggaggaaccgttgtcccgtctcacggtcatcaaggcagtgctcggaccgattctgcgcctgatgttccgcccacaggtggaaggcgccgagaacattcccgggaccgggccggtgatcctcgcgggcaaccacctcacgttcatcgactcgatgatcatgccgatctgctgcgaccggccggtgttctacatcggcaaggacgagtacgtcacgggcaagggcctcaagggcaagctgatggcctggttcttcaccggctgcggcatgatcccggtggaccgggacggcggccggggcggggtcgcggcgctgatgacgggacgccgggtgctggaggagggtcaggccttcgcgatctacccggagggcacccgctccccggacggccggctctaccggggccgtacgggcatcgcccggctgacgctgatgacgggtgcgccggtggtcccgttcgcgatgatcgggaccgacaagctgcagccgggcggcgcgggcctgccccggccgggcaaggtcacggtgcgcttcggtgagccgatggagttctcgcgctacgagggcatggaccgcgaccggtatgtgctgcgggcggtgaccgactcggtgatggccgaggtgatgcggttgtccggccaggagtacgtggacatgtacgcgacgaaggcgaaggcggcctgacccgcacggcggttacggcgaagggcccgcaccccctcgggggcgcgggcccttcctcgtacggctccgcgtacgaccgtaaacggcctacgggtgctcgaccccgtcttccagcttctggccgcgcagcaggaagcaggcggcgaccgccgccgccagcagcaccgccgcaccgacgcccgcggccgaccgcagtccgtcgacgaacgcctcctgggccgccgagaccagcggccccgcctgggcggcgggcagtgccccggcggcctcgaccgccccgcccagcgactcgtgggcggccgactcgacgtcggcggggatgccggacggggtcgggaagccccggtagacgccggtgacgatggagccgagcagggcgatgccgagggccgcgcccagttcgtacgcggtctcggagacggcggacgcggagcccgcctgctccttcgggacgctggagaggatcacgtcggcggtgacggtgaaggcgaggcccgcgccgacgccgacgaccagcagcatggagccgagcagcggatacccggtgtgctggtcgagcagggtcacactgcccagggccagccctaccgctgccagaccgcccgagacgacggagcggaccgagaagcggcgggcggcgaacccggccagcagacctgcggtcaccgcgccgatcgcggcgggcagttcggccagcccggcctccagcggcccgcggccctgcaccagttgcaggaactgggagaggaagaagaccagacccgacagaccgaggatggtcagcaggtcggcgaggaccgcgccggagaaaccccggtggtggaagagccgcatgtccagcaggggtgcgggcagccgcagttgcctgcggacgaaccaggtgagcgcaccggcgccggcgacggccgccaccccggcctcccagctcaccccgtgcgcggccgcctccttgatggcgtacacgacaccgaccatgccgaccagggagagcccgacgctgagcatgtcccacggcccgggggccgggttcttggactcggggatcagcttgatgccgacgacgacgaggacggccatcacgggcaggttgatgaggaagaccgaaccccaccagaagtgttccagcaggaacccgccgacgaccgggccgacggccgcgcccgccgaggccatcgcgccccagatcccgatggcgaggctgcgctcgcgcgggtcgtggaagaggttgcggatcagggccagggtggacggcatcagggtggcgcccgcgacaccgagcagcgcccgggccacgatcatcatctcgggcgtggtcgcgtacgcgttgagcacggagaccgcgccgaacgcgacggcgccgaccagcagcagcttcttgcggccgatccggtcgccgaggctgcccatcgagacgagcaggccggcgatgacgaaggagtagacgtcaccgatccagagcagttgggtgccggtcggttcgaggtcctcactgaggaacggggtggcgagaccgaggacggtcgcgtccacggccaccagcagcacggcgaggacgaggacggcgagcgcgatccaccgacccgggcggcgtacggcgtccgtggtgtccgggttccggtcgatgctgatcattgctccacgctccggcgtgctccgccgagcagcagctcgacgatcatgtgctggaaatcctgtgcggcgacccgtcccgcctggacggcccaggcgccggtgccgatgagcccgtagagggcctccgtcagccaggcgggggtgaggtcgatacggaactcgccacgttcctgaccgcggcggaagaaggcggagacgcgggcgtcggcccggttccagccctcgttgacctcgtcaccctcgaagagctggttctcgttgacgaggaaggacagcagtccggcgctgggttcgacggccgcgatgaggcggcgcaacccctcctcggaggtgtcctcgtccagccgggccacgtcgagggccgcctcgaactcctggatgccgagattctccagcgccctcaccagggcgtcgcgcccggcgaagtggcggtgcagggtggcccggccgatgcccgccgccctggcgacctcgtccatggtggcggtcgatttgcgggtcagcagggcggcggcactgcgcagcacctgctcacgatcgagagtcatgagacgaccataacccagttgagacaggtctgtctcagcaaagggtgtgcaggcacgcaggaggagagggaggaaagagcgagagaggaaaggagcgagaggggggggcggggcggaaacaaaaaagtggccggaggtgaatccactccttgccactctcaacttatagcgcacggggggccttgcggcaaggccccccgtatgccgcagaatcgtccgccgtagccgggatgggacgccgccccccgtacgcaccgcagatcggaaccgatgccgtgaaacccctgaccgccagcgcgttcgacctccccgaccgcctctccgccaaggccgacccggcgctgatcgccgatgacgagcagcacttcgcggccatcgcccactgcctggagcagtcgatcgccgaactgaccgaccggctcgcggccgaacgcagggcacccggcggggcgagccggcaggcgatggaccgggacgtggagatccaccggctgaccggccggctgcgcgccctgcgccggttcggcctcgacctgtgcctcgggcacatggtcgccgcggacggctccggacccctgtacgtgggacggctcgggctgaccgacagcacgggccgccgactgctgctcgactggcgctcccccgccgccgagccgttcttcggagccacccacgccgatcccatgggcctcgcgagccgccgccgctaccgctggaccggcggccggatcagcgactactgggacgaggtgttcaccccggagggcttcgccggacatgccgcgctggacgaccagtcggcgttcatcgccagcctgggcggcaaccggtcggcccggatgcgcgatgtgctgggcaccatccaggccgaccaggacgccatcatccgggcgggttcccggggcgcgctcgtcgtcgacggcgggcccggcaccgggaagaccgtcgtcgcgctgcaccgctccgcctatctgctctactccgatccgcgcctcggccaccgccgcggtggcgtgctgttcgtcgggccgcacgagccctatctggggtacgtcgccgatgtcctgccgagcctcggggaggagggcgtgcagacgtgcaccctgcgagacctggtcgccgagggatcggcggcgggcgccgagaccgatccggaggcggcacgtctgaaggcgtcggcggatctggtgaaggcggtcgagccggccgtccggttctacgaggagccgcccaccgcgggcgtacgggttcagacgcactggtcggacatctggctgagcgccgccgactgggcctcggcgttcgaggcggcggacccgggcactccgcacaacgaggcgcgcgaccagatctgggaggagctgctcacgatcctcgtggacaagcacgacggcgacgctccggaggaacagttgcgcgcctcgctgcggcggaaccgggagctgttcgcccttttcgaccgcgcctggccgctggtcgaggcggccgacctggtcggcgacctctggtccgtacccgcctatctgcgtaagtgcgccccctggctgacctcggaggaggtcgggcggttgcagcgtccggacgcccgggcctggacggtgtccgacctgcctctcctggacgcggcacggcagcggctcggcgacccggaggcgtcccggcacaggcgccgtcacgaggccgctgccgccgccgagcgcgagcagatggaccgggtcgtcgagagcctgctcgccgacgagaccctggccgacgcggacgcggacggcgagggtgcgctggtgatgctgcgcggggaggatctccggcagtccctggccaccgccgaccggccgagcggcgccgaacccgacctgctggccgggccgttcgcgcacatcgtcgtggacgaggcgcaggaactgaccgacgcccagtggcagatgctgatccagcggtgcccgtcgcggagtttcaccgtcgtcggggaccgtgcgcaggcccggcacgggttcaccgagtcgtggcgggagcggctggagcgggtcggtctcgaccggatcaccctggcctccctgaccatcaactaccggacgccggaggagatcatggcggaggctgagccggtggtgcgggccgtgctccccgacgccaacgtgccgacctccgtccgcagcagcggcatccccgtcacgtacggccccgtcggggacctggacaccgtcctcgccgactggctcgccgcgcacgacgacgggatcgcctgcgtcatcggcgatcccaccttccgggcgacgccccgcgtgcggtcgctgaccccggagctgtcgaagggcctggagttcgatctggtcgtcctcgtcgacccggaggacttcggcgcgggagtcgagggggcggtggaccgctatgtcgcgatgacgcgggcgacccgggaactcgtcgtcctgacgagctcctgaggccggcgggcgggctcagtgccagggcaggccggcgcggtgccgccagtaggcctccggctcctcgaccagggcgtcgaggccggcccgctgctcgtcgtcgaggtcgacgacggctgcgtgcagattgccggagagctggccaaccgtggcggcgccggagagcacgacgtcggcccagggctggtgcaggaccagcgcgagggcgaccgcgtcgccgcccacgcccgcggcggcggcgatctcctggaacatggcgggggcctcgtcaccggcgaggcgcccgttggccatgccttccttgacgatcacggtgagtccggcgtcgtgggcctcggcgagcgcgggcgcggccgaggtctccagggcgttgtaggtggcctggaccgtacggaagaggggttcgccgtcgaccgtgacggccagggccgcccggatggcgtcggcctgggcggggccgctggtggagaggccgacggtgacgccgtcggcggccagggcggcgaggcggccgagcagttccttgtcggtgagcgccgggctgtccggggtgaccgagtggacctggtagaggctgagccggtcgccgaggagggcccgggtctcggcgtactggcgctcgaaggtggcgaggctgtggtccttgacctcgtgctcctcggcctcgacgccccagtcggcggtgtaggtgtacccccacttgctgccgacgacgaggtcggtgaacgagggccgggcgtccagccactcccccaggaactcctcggcgcggccgtaggagcgggcggtgtcgacgtaccggacgccctgggcgtaggcggcgtccagcagttcgtgggtgcgggcgcgcagggcgtcggggtcgcggtcggcgggcaggtcccggtctcggtggagattgatgtagccgggcctcccgacggcggcaaggcccagcccgatgtgggcggtcggggtcgtcgcggcggccagggcggcgaagggcatcgcgggctcctcggggtcgggtttcggttactcctaccccggtgagcgcggcccgcgacacccttcgtccatctggtgcgacaccgctcccgcgcgcacctgagcggtgttaccgcccgcgggcggtcgcccaggcgtgctggacggccaggtcttccttcacctcggcgagctgtacggcgacggcggagggcgccgttccacctcggccgtcgcgggaggcgagggcgccccgcacatggagcaccgtgcggacctcgggggtgaggtgctcggagatctcggcgaactgctcgtcggtgagctggtcgagctcgatgccgtgccgctcgcactccttgacgcaggcgccggccacctcgtgcgcgacccggaaggggacgccctgcttgaccagccattccgcgatgtcggtcgcgagcgagaagcccgccggggccagctcctccatgcgctcgcggtggacggtgagggtggccatcatcccggtgaaggcggggagcaggacctccagctggtcgcaggagtcgaagacgggctccttgtcctcctggaggtcccggttgtacgcgagcgggagcgccttgagcgtggcgagcaggccggtcaggttgccgatgaggcggccggacttgccccgggccagctccgcgatgtccgggttcttcttctgcggcatgatcgaggagccggtggagaaggcgtcgtgcagggtgacgaaggagaactccttcgtgttccagatgatgacctcctcggcgatccgggagaggttgacgccgatcatcgcggtgatgaaggcgaactccgcgacgaagtcccgcgaggcagtgccgtcgatggagttggcgaccgagccgtgctcgaacccgaggtcggcggcgaccgcctccgggtcgagcccgagcgaggacccggcgagcgccccggagccgtacggggagacggccgtgcgctcgtcccactggcgcagccgctcggcgtcccgggagagggactggacgtgcgcgagcacgtggtgggcgaagaggacgggctgggcgtgctggaggtgggtgcggccgggcatcgccacgtccgggtgggcctcggcgaggccgaccagtgcgctctggaggtcggcgatcaggccgccgatggtccgggcgtggtcgcgcaggtacatccggaagagcgtggcgatctggtcgttccgcgaccgcccggcccgcagcttgccgccgaggtcggcgccgaggcgctccagcaggccgcgctccagcgcggtgtg

SEQ ID NO: 3806 - DNA, 3480 bp, Unknown
  Kingdom: Bacteria, Phylum: Actinobacteria, Class: Actinobacteria, Order: Streptomycetales, Family: Streptomycetaceae, Genus: Streptomyces
ccggctgctcgtcggcggcgggttccgcgccccgcaccgcggaggtgcgggagtccgccccgggcgtctcccccgcgccgtccggcaccgcatccgccacccccaccgacgtcggctgggtccagctgatgacccccatgaaccagcaggcggtgaagctcctgacgctcgccgccgagcgggctgccgaaccgcgggtgcgcgccttcgcagctcggctgcgcaccgggcacgaggccgaactcaaccgtctacgccgcctgttgaaccgcatggggctacccctcaccgatgtgcacgcgggacacgagatgcccgggatggtgaccgaacaggacctggaggccgcccacgcctccgaggggcccgcgctcgaccggctcgtcctcgcgcggatccgggaccatctgcgccggtccgctcaggtgtcgcgctccgagatcaccgcgggcgaccgcgcggacgcccgcgaactggcccgcgccctcgtgacggcgcgcgaggacttcctcgcccagctgcaacggctgccggacgcggtgcgggccctcggctgaacggggcggccggcctgcgggtataaagggctgcatgacagccgaagtgccgcagcccgtacgccccgcgaccttggaggacgtggcggccgtggccggtgtgtcacgggcgacggtgtcccgggtgatcaacggggcgaccaccgtggaccccgccctgcgcagcgtggtcgaggaggcggtggcgaccaccggctacgtgcccaaccgggccgcccgctcgctggtgacgcggcgcaccgactcggtggccctggtggtctcggagcgggaacggcggccgatgtccgagccgttcgtcggcaggatgttctcggacccgtacttcgggcgggtcgtcagcgggctgctggaggtgctgcgcccggcgggcatccagatggtcgtgatgctggccgacgacgaggcgtcccggagccagttgctctcctatctgcgccacggccatgtcgacggggtcgtactgatcaccacgcacgccgacgacccgcttcccggactgctccaggagacccggatgcccgccgtcctcgcgggccgtccccaccgaccgtccccgctggcctatgtggaggtggaccagcacgccggggcgcggctggcggccgatcacctggcctcgctggggcgacggcgcatcggcaccatctcgggaccccaggacatgcccgccgggcaggtgcggctgaccggtttcctggaggccgtcgccgcccacggcatcgacgacgtggcctgcgccgagggggacttcacccatctgggcggggccgcggcgatgcggcggctgctggcggaccgccccgacctcgacggggtgttcatcgcctccgacctgatggccctgggcgcgctcccggtcctgctccgggccgggcgcgatgtgccgtccgacgtggcggtggtcggcttcgacgacagcagcgcggcggccgcctgcgacccgcccctgaccacggtccggcagccggtggaggagatggcggcggagatggcccggctgctgctgaagcagatcggcgaaccacgcggcccctctccctccgtgctcttcccgccgacgctggtacggcggcagtcggcctgatccgcaggacgggctgccggagggcggcctgccgaagaacagcctgccggggatcggcccgccggtgtcggaccgagcggtatcggtctgctcgcggaggacgatctgccggaggacggctgcctgccggtcaggccgtcgtgcccggcgcttccggcacgggggcgtcgcccgggaacggctcgtccgccaggccggccccgccgaagccctcggcccgcaccggtacctggggaccggaggtctcctggagccagcgggtcagcacccggtgcaccgcctcggcgccgaccagcccgccgcccggcggcacgggtgcgccctccgcggtctcggcggccacgatgtcgagcgggtccgtcagtccgcgcggatagagcaggaacggccgggactgttcgccgccgaggccgccgtgcgaaccgatctgctcctcgaaggcgtgcacggtcccggtggcggggtcgtaactggagttgaccatcacgtcggcgacgtgcgggaaggtgtcggtgcgccgtacggcggatgccgccccgacgccgaagaccgcgagcggcccctcgccgtcggtcaggtcggcgacgggcacttcggccccgccgggcccgagcaccacggagccgtgctcgccgcagcggacgaggaggaagccgatccccgggtggttggcgagcgtggagagcagcgccggatggcggcgctcgatctgctcgcgggaggcgcggcccttgatgtcggggaaggagatcagcccgaggttgccggaggccagcacgatcgggtcggagagcttggccgggtgctcggcctcctggccctcgacgggacggtgcagggcgatccgcaccgcgtcgcgggcctccgaggcgctgcgggtgcgcccggcccggcggggcacgggcagcccgcagcccgcccggacgaggtccttgagcgtgagtccgtactgtcccgcgaacgtctcccctgggctctggccgtggtcggagagaagcacgatccggtaggcgcgcggggtgtggtcggcgatcttggcgatcagcgcgagggagcggtcgaggcgtacgaggaccttctccgcgtcgcggctgtggggtcccgagtggtgggcgacctcgtcgtaggcgacgaggtcggcgtagacggcggtgcgcccggcgaacatgtcgccgaggacggcggcggcgaccacgtcgcgctccacgacggtggcgaaggcgcggatgaacgggtagagcccgccgcgcttgatccgcggggtgaccttccgggcgcgggcccgggtcgactggccgatctcgcggaggacctcggcgacgaaggaaagggctgtacgggtggcgttggccgggtcggagaagtaggcgaagtatccggcgcgggagcggcggcccttgccgcgccgggcggccatggagagcaccagggcgagttgtccggctccgccgctgaagaggttgccccggctcgcgccgtcgacggtgagcagaccgccgtcgcgggtgcgctcgatggcccggcgctgcatttcgagggcgctcgcgggacggctggagaccatgacggtgcgggtctccttctcgtaccagcggaacgcgggcacgtcgtggttgctgccgtgcaggatggcgagctggctggcgccggtctggctggaccagtcggtgcgccagggggtgagccggtgcccggaggagtcggcgagccacccggcgacggtcggcatgagaccgtccgccgcggccttcaccaggacgtcgtggccgactccgtcgagctggaggaagacggtgccgggcggtccttcgcggcccggttccggcgagcccgggg

SEQ ID NO: 3807 - DNA, 3104 bp, Unknown
  Kingdom: Bacteria, Phylum: Actinobacteria, Class: Actinobacteria, Order: Streptomycetales, Family: Streptomycetaceae, Genus: Streptomyces
ccgagccccgtcccgccggtcgtccgggcacgcgccgggtcggcacgccagaaccggttgaagacccgggtcgcctcgccgggcttgagcccgaccccgtagtcccggacggccacggcgaccgcgccctgtgccacgcccatccgcaccacgacgtcccggccctcaccgtgctcgacggcgttgaccacgaggttacgcaggacgcgttcgacgcggcgggcatcggcctcggctatcaccggctggtcgtccccgacgaccaggatccgggtgcccttgcgctcggcgagcggttcggcaccgccgatcacccggtgcaccacggtccgcaggtctatcggctcagcctccagggccgcggcgcccgcgtcgaaccggctgatctccagcagatcggcgagcagcgactcgaaccggtcgagctggtcgcccagcagctctgcggagcgcgcggtgatggggtcgaagtcggcacgcgcctcgtggatgacgtcggcggccatccggacggtcgtgaggggggtccgcagctcgtgcgagacgtcggagacgaagcgccgctgcatccgggagagctcctccagctgctggatcttcagctggaggttctgggccatcttgttgaaagcctcgccgagccgggcgatgtcgtcctcgccggtgaccttcatccgttcctggagtctgccggcggagagccgctcggcgatgccggctgccatccgcaccggtgtgacgacctgccgcaccacgaaccaggcgatggccccgagcagcacgacgacgaacagtccggcggtcgccagggtcgtcttgaccagtgtcagagacttctcctcctgcgtgagcgggaagaggtagtacagctcatagggctgctgatcgatgtcgtagagccgcttgccgacgacgagccccggctgcgactccttaccgtacgagtaccggatcagggagtacgtctggaacgcgccctgtcccttgcccacgtcccggcgcagcctttcgggcacgctcgccgcctcgacgctgcccgaaccgcgcgctgcacggctgctcgcgccctcggacaccgagtcgacgctgagcgccaccacgttgaaggcgttcttgccgccgctggcgagctggtcgacgagctcggtgcgccaggaggtgctgccggacatgccgtcggtgcgttcactcccctgcccgtcgggggcgaggggggcgttggccttttcctgggccgcggcgaagccgccggcggcctgggtctgggcggccttgcccttggcgtcgagcaggccgttgcgcacctggccgatgacgacgaagccgagcagcagcacgacgccgatcgacatcagcagggtgcccgcgacaacgcggagctgcagattgcgccgccacaaccggacggcgggcagcagcggacggcgtacccaccgcatcagcaaccgcggtacgggcccgccgggcgtccggtcctcgaacagccggccgccctgcaggaaacggctcatacgtgacgccttccgtcccgaatcggcagcccgctccgtacggactcccggctcgccgggcctcggagcagaactgcctcgggccatctcagctcggtccggccttgtagccgacgcctcggaccgtcacgacgatctccggccgttccgggtccttctcgaccttggaacgcagacgctggacatgcacattcaccaggcgggtgtcggccgcgtggcggtaaccccatacctgttccagcaggacttcacgggtgaagacctgccacggcttgcgggcgagcgcgaccagcaggtcgaactccagcggagtcagggcgatggactgcccctcccgcttcacggagtggccggccacgtcgatgaccaggtcaccgatggtcagctgttccggcgcgggttcttcggaccgccgcagacgtgccctgatccgggcaaccaactccttaggtttgaacggcttgacgatgtagtcgtcggcccctgattccaggccgaccacaacatcgacggtgtcgctcttggcagtgagcatgacgatcggcacaccggactcggccctgatcagcctgcacacctcgatgccgtcccttccgggcagcatgaggtcgagcagcaccaggtccggcttggcctcacgaaatgcggccagtgccttgtcgccgtccgctacgaacgacggctcgaaaccttctccacgcagcacaatcccgagcatctcggccagtgcggtgtcgtcgtcgacgacaaggacgcgtcccttcataatcgacatcatcccattagctaatcgttacctgcgatgacctggcacacagctctgccagtccgacccccgtgaccggggaaacaacgccctcctcggtgacgatcgccgtgatcagttcgggcggtgtgacgtcgaaggccgggttgtacgccggggccccgaggggtgcgacgaccatcccgcctccgccgccggccgatacgccatgctgcgatgtgagctccgtcacttctctcccggagcgctgctcgacgatgatcgatgtgccgtccgcggtctccagatccacggtcgtcgtcggcgccaccacgatgaagggcacgtggtggtacttcgcgagaacagccagcggatagctccccaccttgttcgccaccgagccgtccgcggcgatgcggtccgcccctatgagcaccgcgtcgacctccccggccgcgaacagggaccccgccgcactgtccgtgagcaggctgtacgccagaccgttgcgcgcagcttcgtacgcggtcagccgggccccctggagcagcggccgggtctcgtccacccacagccgtcgcagccgaccccgccggtgcacccgcaacgccacggcgaacgccgtcccctcgccgccggagaccagcgccccggtgttgcagtgagtcagcagccggtaggcgccgcccggcaacagctcctcgagcagcacctcgccgtactccgccatacgcctgctggcctgggcgtcctcccggtgcagcgcccgcgcctcggccagcgccgccgctgcggccacctcgtccccctcccccttcccgacggcctcccagtaggccgccgcc

SEQ ID NO: 3808 - DNA, 2007 bp, Unknown
  Kingdom: Bacteria, Phylum: Actinobacteria, Class: Actinobacteria, Order: Streptomycetales, Family: Streptomycetaceae, Genus: Streptomyces
ctcgtccggagacacggacggcgacctcagccgcccgcgacgacggcgtgcgggctccgctccgtacgggtcccggggaccggcgccgaggcgtcggcgccgagcgccacgatccggttgtccgcgtccacgtgcacgacccgcggcacgagggcacgggcctccgcgtcgtcgacctgtgcgtaactgatcaggatgaccaggtcaccggggtgcacgaggtgtgcggccgcgccgttgatcccgatgacaccggagccgcgctcgccctcgatgacgtacgtctccagacgcgcgccgttgtcgatgtcgacgatatggaccagctcgccgggcagcaggtcggcggcctccatcagggcggcgtcgatcgtcaccgaaccgacgtagtgcaggtcggcctgggtgacggtggcccggtggatcttggacttgaacatcgtacgtatcatcgaggaactcctgatcataggctccctgcctgcgtatttgcaggtcaagggctgtttcctcactctacaacgagtcgcatgtccgggcggcgttccccaggtttttcaggactcgtgctgaccacagcgatcgacctcgaaccagcctcaaggagccattgtgcccgtgggaccgccccaccccgacgaaagccgcacctgggctcgaagggctacaaactcggccgaggcaggaacgccagagagacgatcgccgccaacacctcccggtagccgtggcgccgtcgaccgccaccctgtggccgcgacggcgcctccggcaccacccgctgctacaagtcccacaacaggtccggcacccatcgatcagcaatccccaccatggccagcagcctaccgagcaaattgcgataacttcttgccatgaccggactctccgggcgcagggcggcgcaatcgggccgggccaggatcaatccatcgggtagaagtcgggcgtcggcatcagcctcgcgatcgagaacggctcgaactcgggatccgccagtacgcggtagacgaactcgccggtggacatactcacttcttgccacggatacgggtcaccctgcgtcacaatgggccagttcgccggatcatcctcggcggatgccagccagaagtagctgcacttcatctcaccgaacgcccagggaatgagaccgcgctgaccaggccggtacatccggtagggcttgaaggcggggtcgggcccgctctccgggccgccgtcgaggaacttcttccatatcccgaccaggtcgagcattctcgtggcatcgacggtaaaaatacgcaagaactccgagaattcccccttgccgaacgtctcggccagcttcttgtagtcctcgggcagcgctgtaccgagctcttcctcaacactgttccaggaaatttccagccgagacggctcccagtgcgtgacctcagcgattcgcgcaatccacatgctctctacattccgatcggaggctcggaccgggcgtgtgccagatgtgcgacacgtccccggtatcgctctatggggtgttgtcgaccggcagtgaaccgctgggccgctccaactgttccaggttatgtcgagccggtccggcatcggatcggtggcactgaggtagtgcaccgggacctggcttgccgactgccgccgactccaccgccggtacgagcgcaaggccgagcacttcctggccttcacgagcatcgcctgcaccctcatctgctaccgcggactcaccaatcgagatgacttctcgtacgtctcctcgaccgtgacgtctcccttctcgaactcggcgacggcctcatggagatcaaggccaccgcgggcgacagccgactcggcggcaacgacggggaccagcggatcgtcgagcacctgaccgaccgcgtacggcggcacggcgtggacctcaccggcgacgtcgccgcgacccagcagctgcgtgaggcggccgagacggcgaagatcgaactgtcggcggcgcgcaccacgcccctcggcccgaggggc

SEQ ID NO: 3809 - DNA, 2381 bp, Unknown
  Kingdom: Bacteria, Phylum: Actinobacteria, Class: Actinobacteria, Order: Streptomycetales, Family: Streptomycetaceae, Genus: Streptomyces
tccttgaccagggtgacgggtccggccggcggggtggggcggtggtcgtcgaggtggtgcacggtccccatgacggggaccgtgctggcgggttcggtcatggtgaacgtgccttcctacgagtggtggagggactggcggcgggcggcggccacgatctccccgtggtcgaacgcgagcgtcccgggggtgtccaggggcatccaccggacggcggcggcgtcgtccccggcgcgggcggtggtgtcctcggggacgatggcggcgtaggcggcggtgatgtaccggccccgggggtcgcggtccggctcgtcccacacgccgacgaacacgaggtcggcgggggcgacgtgaacgccggtctcctccagcagttcccgggcggcggcgttacgggaggtctcgccggggtcgacgtgaccacccggcagcgcgtacatgcccttgtgcgggtcccagccgcgctcgatgagcagcacttcgctgccccggatgcacacgacgtcggcggtgtagcggatgttctcgaccagttcggtcatgatgaacgtgcctctcctgctcagtgattcgggttggggtgatgggggcggccggtttccttggccggggtcggccgcccccgctcagctctgctcggccttgtggacggcccgctcagcgagcttcacgcgctgctcggcctgcttgcgggcctcacgggcggtggccctgtcggcgcgcggcgcggtccgctcgaccgccttcgcggcggcgaggtcctgacgggcgtcggcctgcaccttgtgcagcgcggccagctcctgcgcaccgcgttcggcggcggcctggtcgatgcgctcgatcttccggcggatgtccgggtcgacgcagtccgcgagggactgccggaaccccttgcggaacagcttgccgcgctcgcgggactcggccttggtgtagctgtgcacgatggaacctccctggtggggccgggctgtccggctccccaaccgcccccgaaccaggctgggttcgggggcggcgggcagccgtcaggccggtcggttcgcctcgtagaggcccttgagggaggtgtcgaggacgggttgtccggggctgcggtggtactggttgccgtactcgatcagggcgtcgcagaggtagtactcggcttcggcggcgcgcatggggtcggtggtgtcggcggcggccgcgaacgtccagccgttgaagtacgcgcgggcccggggttcgtcgcgcagcagctcccggagcctggtgtcagcggcggcggtgtgagcggcgaacgcgtcggcggggacgtcgacggcgttgctctcgtacatcagccgctgcaaccggtgcgggacctgctcggcaagccactgctgggtgtccagcggcttgttcgcccacgcctgtaaggtgctgccgtcctgccggggatatgaggtcatgctcagcctttctgtaccggggccggtctgtccggctccccttgcctccccggccgtggccggggcgacgcgggcagccgtcagacgagctgcagttcggaggtgtggcacaggacggggccgatgaacagcccgatcctgtgcacggtccagcggcccttggtgagggggccgggcggtgcttcgtcgacgatccggccggtcctgccggccgcgcgcgggtcgtcctcacacgagacgatcagcaccttttgacctgcctggaacacggggctctccctccctggtcagcggctcttgcggccggtcttgccgctggtgccgccgaccgacttcacgacggtcacgacgccccaggcgcagacggaggcgaccagggcgagcagggcgaggttggcggcgatggcggtgaggacgccgacgaggagggggccgaagtagaccccggcggcgacggccccggcaccgacgccggagccgagcgcgagacgctgcaccgtccggtccggcggagcctgatggacgtgcaccacctgcgggaccacgttggtgggctggtaggtggcggggaggtggtcggtgtaggcgggggtgccgtccgggaggttcacgacggacggtcggcggggttcgggcaggtggttcatgcggggtccctccgggtcaggcgggggtgtcgtggcaggtgacgcacatgccgagcgagggcgggatgcagtaccccgcgtcggtgcggcagttggggcaggtgcggcgggcccgcatcgccgcagcgagcgcggcggcacgggcaggggtcatgggacggacgggcttggcccggtcgatgcggtagaggtaggcgaccagcgggggcctgtggcggcggatccgctggatttcgacgacggggtcctgaccgcccggccgcagccccagcgctcggagctgacggcgggtggc

SEQ ID NO: 3810 - DNA, 5214 bp, Unknown
  Kingdom: Bacteria, Phylum: Actinobacteria, Class: Actinobacteria, Order: Streptomycetales, Family: Streptomycetaceae, Genus: Streptomyces
gcggtgatgggcggcaccgggcgggtccggccggcgttgcccgaccagtcgccgagggtctccgccagcagcgcgtccaggtcgatgccggtcaggtcgccgacgatcacggccgtcgcggtggacggacggacatgggcgtcgaagaaggcgcgcacggcggtctcgtcgatccgccggaccgtctcctcggtacccaggcgcgggcgggacatccgggcggtggccgggaacagctccttggagagctgcttggcggcacgccgggacgggttggcctgctcgtgcgggatctcgtcgaggcggttgcctacgaggcgctcgatctcgctctcggcgaaggccggggcccgcagcgcctcggcgaccagaccgagggccttggccagccgggaggccgggacctccagggagacccggacgccggggtggtcggcgtgcgcgtcgagcgtggcgccgcaccgctccagctcggcggcgaactcctcggcactgtgcttgtcggtcccctcggagagtgcccgcgacatgatcgtggccacgccgtccaggccctcgggctcggcctccaacggcgcgtccaggaagatctccaccgcgacgacctgctggccggggcggtgacagcgcagcacggtcagcccgttgggcagggcgccgcgctcgggcgccgggaaggcccaggggcgggccgtgccgggcgtgggctgcgggtggtactccatggctactccagtcacggcggcgtcgctcacttgtccgccccctcgtgcgcgtcggtgccctcggtgcctgccgcgccctcgtcggactcgtcggcctcgtcggccggctcgatgggctcgtacaccagcaccgcccggttgtcggggcgcagggccgcctcggccgccgcgcgcacctcctccgcggtgacgtccaggacgcggcccacggcgctcagggcgagctgcgggtcaccgaacaggaccgcgtagcggcacagttcgtcggcgcggccggcgaccgtgccgagccggtccagccactcgcgctccaactgtgcctgggcccgctccatttcctccggagttggtccctcggctgcgaaccgggcgagctcctcgtcgaccgcggcctcgatctgctccacctcgacgccgccggacgtcttcacgtccagccagcccagcgagggtgcgccggcgagccgcagcagcccgaaaccggccgccaccgccgtacggtcgcggcggaccaggcggttgtgcaggcgggaggactcgccgccgcccagcacggtgagcgccaggtcggcggcgtcacaggcgcgggtgccgtcgtggggcagccggtaggcggccatcagcgcgcgcgccgggacctcctcgtgcaccacttcgcgcagctgctcgccgatgatcccgggcagcgtcccgtcgcgcggcggctgcttgccgtcgtgggaggggatggagccgaagtacttctcgatccaggcgagcgtctgctcggggtcgatgtcgccgaccaccgagatcaccgcgttgttgggcgcgtagtacgtacggaagaacgcgcgggcgtcctccagcgtggccgcgtccaggtcggccatggagccgatgggggtgtggtggtacggatgaccctcggggtaggagagggcggtcagcttctcgaacgcggtgccgtagggcacgttgtcgtaacgctggcggcgttcgttcttgacgacgtcgcgctggttctccatggactcctcgtcgagcgcggcgaggagggagcccatccggtcggcttcgagccagagagccagctccacctggtgggtgggcatggtctcgaagtagttggtccgctcgaagctggtcgtcccgttgagcgagccgccggccccctggacgagctcgaagtgaccgttccccttgacctggcccgagccctggaacatcaggtgctcgaaaaggtgagccagaccggtgcgtcccttgacctcgtggcgcgagccgacgtcgtaccagaggcagaccgcggcgaccggggtcagatggtcctcggagagcaccacacgcaggccgttggccaggcggtgctcggtcgctgtcaagccgccggagccggcctgtgcggtggccgtgtgacccatgggcatgtacgtcccttcgatcgcgatactggacttcctgccagacctgccactctaagcaagcgcaccggcacctggcgaagttcccgttccgtggatgtttccgtcgatggtgtcgtgggtgcccccctcggcccccttcggatgggtcgaggtcggcgttgtcagtccggcggtccacaatggaccgcgtcagtagctcgtgttgtaccgaacaagctcaggttgtccgaacagaatctgtgaaggagtcgcagccgcgatggcccgccgtagcacgaagaccccgccgccgccggacgacttcgaggagaagatcctcgacatcgacgtcgtcgacgaaatgcagggctccttcctcgagtacgcgtactcggtgatctactccagggccctgcccgacgcccgcgacggcatgaagccggtgcaccgccgcatcgtgtcccagatgaacgagatggggctgcgccccgaccgcggctatgtgaagtgcgcccgcgtcgtcggcgaggtgatgggcaagctgcacccgcacggcgacgcctcgatctacgacgccctggtgcgcatggcacagccgttctcgatgcgccttcctctggtcgacggccacggcaacttcggttccctcggcaacgacgacccgccggccgccatgcggtacaccgagtgtcggatggccgacgccacgtcgttgatgaccgaggcgatcgacgaggacaccgtcgatttccagtcgaactacgacggccaggagcgcgagccggtcgtcctccccgccgcttaccccaacctcctggtcaacggggtctccgggatcgccgtgggcatggccaccaacatgcctccgcacaatctgggcgaggtcatcgccgccgcccggcacctgatcaagcacccgggcgccgacgtcgagacgctgatgcgcttcgtcccgggacccgacctgcccaccggcggccgcatcgtcgggctgggcggcatcaaggacgcgtacacggcgggccgcggcacgttcaagatccgcgccaccgtcgccgtggagaacgtgacggcacgccgcaagggcctcgtcgtcaccgaactgcccttcaccgtcggtccggagaaggtgatcgccaagatcaaggacctggtctcggcgaagaagctccaggggatcgccgacgtcaaggacctcaccgaccggacgcacggactgcgtctggtcatcgaggtgaagaacggcttcgtaccggaagcggtgctggagcagctctacaagctgacgccgatggaggagtccttcggcatcaacaacgtggcgctggtcgacggccagccgctcaccctgggcctcaaggagctgctggaggtctatctggaccaccgcttcgaggtggtacgccggcgcagcgagttccgccgcaccaagcgccgcgaccgcctgcacctggtcgagggcctgatcgtcgccctgctcgacatcgacgaggtcatccggatcatccgggacagcgacaactcctcgcaggcgaaggagcgcctgatggcgcacttctcgctgagcgagatccagacgcagtacatcctggacaccccgctgcgccggctcacccggttcgaccggatcgagctggagagcgagcgggacaggctcaccggcgagatcgacgcgctgaccgcgatcctggagtcggacgcggagctgcgcaagctggtctcctcggagctggccgccgtggcgaagaagttcggcacggaccggcgcacggtgctgctggagtcggccggtgcgcagatcgcgtccgtgccgctggaggtggcggacgacccgtgccgggtgctgctctcctcgacgggcctgctggcccgcacggcgaacgcggagccggtcgagatctccgaggacgcccggcggaccaagcacgacgtgatcgtgtcggcggtggcggcgacggcgcgcggcgacgtcggagcggtgacctccacgggccggatgctgcggctctcggtgatcgatctgccgcagctgccggacacgcacgcggagccgaatctctcgggcggagcgcagatctccgagttcctcagcctggaggcggacgaggagctgatctgcctgaccaccctggacgagtcctcgcctggcctcgcgatcggcacccttcagggcgtggtgaaacgcgtcgtgccggactacccggccaacaaggacgagttggaggtcatctccctcaaggacggtgaccgcatcgtgggcgcgaccgagctgcgcacgggcgaggaggatctggtgttcatcacctccgacgcccagttgctccgctacccggcggcccaggtgcgcccgcagggaaggcccgccggcgggatggcgggcgtgaagctgacggccggggccgaggtgctgtcgttcacggcggtggacccggcggccgaggcgatcgtgttcacggtggccggctcgcacggcacgctggacgactcggtgctgacgtccaagctcaccccgttcgaccagtatccgcgcaagggccgggcgaccggcggggtgcgctgccagcggttcctgaagggcgaggacgtcctggtcttcgcctgggcgggccccaccccggcacgggccgcgcagaagaacggcaccccggcgaagctgccggagccggacccgaggcgggacggctcgggcacaccgctgctggagacggtggccgtgatcgcgggaccgccgctgtaggcggtgcgccttccccgggagggcttgccgtacgacggggagcggcccggggcgttacgcctccgcggccgcttcccgcgggtcggcaggcccgggtgcgtcgaggacgtccggttcgggagcctgctcctgtacgtaacggagcacgccccacagtccgcgcgacaggcggcgaggcccgccgacagcgctgcggcatcgatacccgcgccgatcatgacgagctgggtgagccgctgttcgccgcgcgtccacgggcgggggacgaagcgcaggaaacggcccaccgcgtgcagcgcgtaggtgttgtcccggtcccccgcgccgaagtccgcgaaccccttgatccggtagagcccgtcgggcc

SEQ ID NO: 3811 - DNA, 1001 bp, Unknown
  Kingdom: Bacteria, Phylum: Actinobacteria, Class: Actinobacteria, Order: Streptomycetales, Family: Streptomycetaceae, Genus: Streptomyces
cggcttcagatcgcggtggatcagcccggcccggtggatgctcgccagcgcctccgcgagcgccgcccccagcccggccagcggtcccgcgcccagcggtccgagcgtcgcggcagcctgggtgagcgtcggcccggcacagaactcggtcgccagccacggccgtacggcatcggggtcggcgtccagcaccgcggccgtgaacggaccggcgaccgcccgcgcggcaagcgtctcgcgccggaaccgctcccggaacagcgggtcggcggcgagatgttcatggacggtcttcaccgccgcgagccggcccgacgccgtgcgggccagatggacccgccccatgccgccctcgccgagcagcgccacgagccggtaccccgcgacctgctccatgccgtgtgttcctctctcgtgccgccgggccgggacgatcaccgcgggccccttctgtgcgacgcccgcgcccaccgcttcggttgcgtccccgggtggttccctccgggctccccccggcctcccaccgggccggggaaaatccttcgcgtgcgaccggagcgttccctaaggtcatggacatgcacctcccggtgcgaaggcggcggctccttcctttcccgaaatgtgccgcagccactggtgatctcgggaggcgcgagcgccggggtgcccggtgcgcaggcgacggatacttctggatcagagggtcgcgggttcgagtcccgcccggctccggccggtagctcagtcggtcagagcatctgactgttctccgtcgccgactcctgatctcgggcaccccgttccgccgccgcgcccttccccaggaattcgggggaattcttctcatggcccgtttcaacttccgtacccacaggtcccggtccaccgggcccgtgcccacctcgcccgtcgcgacgaccggtgcgctcgcgcccaaccaccagggcggcaccggacatgtacgcgacgcccgctccgagctcttcctgctcgccgtc

SEQ ID NO: 3812 - DNA, 1492 bp, Unknown
  Kingdom: Bacteria, Phylum: Actinobacteria, Class: Actinobacteria, Order: Streptomycetales, Family: Streptomycetaceae, Genus: Streptomyces
actggcccgaccagcccgccttctggagcagtgcggcgagggcgggctggtcgggccagtcccggatcgactcggcgaggtagacgtacgcgtccgggttggaggacaccgcgcgggcggccggcgggatcgcccgcatcaggtactccgtgtagaccgtgcggaacggggtccaggtcggctgggagaactcgcagatcacgacgcgtccgccgggcttcgtcacgcggtacagctcgcgcagcgcgacctcggtgtcctggatgttgcgcagcccgaaggagatcgtgacggtgtcgaacgtctcgtccttgaacggcagcttcatgccgtcgcccgcggtgaacggcatccaggggtggcgctccttgccgaccttgagcatgccgagcgagaagtcgcacggcacgacgtaggcacccgccttcacgaagggctgcgaggaggtcgccgtaccggccgccaggtccaggatcttctgcgcggggcgggcgtcgaccgcccgggcgacctcccggcgccacagccgggcctggccgagcgagatcacgtcgttggtcaggtcgtagttggccgccacaccgtcgaacatcgaggcgacttcgtgcggctgcttttccagggaggctcgggtcacccttccattcaagcagcccggcgtcacggaccagcgggggcggtctcccgttcccgcacctccctcgaactgatcttcacttctcttcaaccttttcggcacacgggtgctctgtaaggggtgggagtccgcacccagggcggagttcgggggagcacggaagcgcgagggagggagggcggatgccggcaggggctgagcccgccatggccgacggcgagggcgccgcgttcgaggcgtacgcccggaccgggcagcgccgcctgtaccggacggcctacctgctgtgcggagacgtcgagggcgcgcaggacctgacgcagacgacgctcgccaagctgttccagcactggcggaaggcaagccgggcggacaacctcgacgcctacgccaagaccgtgctcgtccgcaccttcgtggccgaacgccgccgtaccgtcaccgatctgctcgcccacaaccgcaacgctccccgcccgcagcccaatcccgccccgggcgccgacctccgggtcacgctgctcgccctgctcgccgaactcccgccccgggcgcgggcgatggtcgtcctgcgctactgggacgacctgagcgtggagaccgtggcctcgctgctgcggtgcagcgagtccacggtgaagagccagtgctcacgttcgctcgtccgactgcgcgcccggatgggcgacgtccagctctactccaccggaagctgagggccggtcatgatcccggaaccgcacgagcacctgccgtcccgcacgcacgacgaggagctgttccgggacgccctgcaccggaccgtcggcccgctgtccctccagcccgatctggtcccggacgccgtacgggacc

SEQ ID NO: 3813 - DNA, 1639 bp, Unknown
  Kingdom: Bacteria, Phylum: Actinobacteria, Class: Actinobacteria, Order: Streptomycetales, Family: Streptomycetaceae, Genus: Streptomyces
tgtacgcggtctacgacccggtcacccggcgctgcacgttcgccaacgccgggcacctccccccggccgtcgtcgagcccggccggccggcccgactcatcgacgtaccgccggggatgccgctgggcgtcggcggcgagccgttcgaggaggtcgaggtcgagctggccgagaacgccctgctcaccctctacaccgacggcctggtcgagtcccgcgaccagccgctggacgagggcctggacgcgctgcgggccgtcctcaccggtccgcagatggagctggaggacgcctgcgaccacgttctgagcaccctcgacacccggcacggcgaggacgacatcgccctgctgatggcccgcatccaggggctccccgaagaggcggtcggggactggacgctgccgcgcgaaccccgctccgtggggcgcgcccgtgagctggcccgcacccagctggtcgcctgggacctcgacgacctggtcgacaccaccgaactcctcgtcagcgagctggtcaccaacgccctgcggtacggcgagggcgagatccggctccggctgctgcgtgaccgcaccctggtctgcgaggtgtgggacgccggtctcgtccagccgcgccgccgccgcgcccgcgacaccgacgagggcggacgcggcctccagctggtcggcctgctcagcgccgcctggggctcgcgccgcaccccgcgcggcaagaccgtctggttcgaactggccctgccggacggggccccggccgccgaactctccgtggagcagctcctgagcatgtactgaccccgcccggtccgccgcccgctccgcgagggtctacgcgcccgtcttcagggccgccagccgggcctcgacctccgcactgtcgcccaggctgtccaactgctcgaactgggcgtccagcgaggaggccgccagttcctgcttgcccagcgccttcgcctcctcgcgccgcaccttgtcctcgaagcggctcagttcgctcgtcgggtcgaggacgtcgatgttcttcacggcgtccatcatctggttctgcgcctgcgcggacttcgaacgcgccaccaactcgtcgcgcttggccttcagctgggagagcttggccttcatctggtcgagccccgccttcagcttctccaccacctcgctctgcgaggcgatcgtcggcccggccgccttcgcctcctgttcggactggagctggcggcccagcgcgaccttcgccaggttgtcgaacttgtcggcctccggaaccgacccggccccgcgcagctcgtcggccttccggctggccgccagcgccttgccgccccactcggccgccgcctcgacgtcctccttgtggtcctgctccatcagccggaggttgccgatggtggtcgctaccgcctgctcggcctccgcgatgttgttcgtgtagtcacggatcagctggtccagcatcttctgcgggtcctcggcctgatcgatgagggcgttgatgttggccttcgcgagctgggtgacgcggccgaggatggtctgcttggtcatggcacggctccttggatgtcgagatcgctggtaggggtcacggccggcggggcgggggggtccaggtcgttcagaagcggccgccaccgccc

SEQ ID NO: 3814 - DNA, 2386 bp, Unknown
  Kingdom: Bacteria, Phylum: Actinobacteria, Class: Actinobacteria, Order: Streptomycetales, Family: Streptomycetaceae, Genus: Streptomyces
cccacgaacaggagaccctggtgccggtcctccctggagccgagccgttccgccacgagggcggagaggtcggcgtcctcctctgtcatggcttcaccggatcgccgcagtcgctgcgcccctgggcggactatctcgccgagcgcgggctgacggtctcgctgccgctgcttccgggacacggcacccgctgggaggacatggcggtcaccggttggcaggactggtacgcggaggtggaccgggaactgcgggccctgcgggagaagtgcgagcaggtcttcgtcttcggtctgtccatgggcggcgcgctgagcctgcggctcgcggccaagcacggggacgcgatcagcggcctggtgctggtcaacccggccaacaaggtgcacggcctctccgcgtacgcgctgccggtggcccgtcatctggtgcgaacgaccaagggcctggccgacgacatcgcgctcccgggttcgcacgaggtcggctacgacaaggtgccgctgcacgcggcgtactcggtgcggaagttcttccggctggtcgacggggagctgccccaggtgacccagccggtggtcctgctgcacagcccgcaggaccatgtcgtgccgcccgcggacagcgcgcgaatcctgagccggatctcctccacggacgtctcggagatcctgttggaacagagctaccacgtggcgacgttggaccatgatgcggagcggatcttcgatgagagctaccggttcatcggccgtctcgcaccgagcgtcgggatgaaggggagcacgtccggtggctgagcacgacgcggaacgcacaggcagcgacgaggagcgcgaaccgcgccccacggagcccgcggccgtcccggaggggacgaagccggcggggacagagggagtggagcaggagcgggcgatcgacgaggacgcggcgtgggccgcgatcgtcgaggggtacggggaggagccgccggacccgccgggcgccaagccgttcaaggcggtcgaggacctggccctgctggaggacgaccagcgcaatgtggtggggccgaaggacggctccgccagtgatccggcggacaaggggtccggaaagacgcccccgaagccgccggagaagaagccgctcggcagctccgtggtcttcgcacccggcgtcaccggtccccgcgattacgagctgcccgagtccaaggacgacggcgagggccggccggacgagggggacgagggccatttcgttcccccggagccgccgccgctgccggaagcggacgtcacggcgaagttcgcctggctcgcggtgatcggcgggccggtcctgatgctcctcgcggtgctgctccagtgggagatgacatggtggctcaccacgctctgcgtcggcggcttcatcggcggcttcgccaccctggtggcccggatgccgcacgacgacgatgacgacacctatggcgacccgggacgcggcgcggtcgtgtagcccgtgggaattctgagggcggccaggaccggcagatggtccgtggccgccctcaggtcttcctcgctcacaccgtcaagaccggcagggacgccgcagccgagcacctcgacgccgggcgtcgcgaacaccgcgtcgatgcgcttgcgcggttcgtccgggggaaacgtcagctcgccgccccacggagccacggcccggcagtcctggagggacccggccaggtgccggaacgccttcccggtcggtacgtcgttgaggtcgccgcccgccacggcgtgctccacgcccatcgccgtcagccgttccagcagcagatccgcctgggcgaggcgctcgtcgcgctggaggctcagatggcagctcagcacccccatcctggtcccggcgatccgcaccacggcggtggcgaagcctctgcggtgcaggcccggggtgagcggcagcaggatgtcctcggtgcgctcgacggtcacccgcagtgagcacagcagcagcggtccggcggcggtggccccgccgctcagcaccaccaggccgctgctcttcgcgagcctggccgcggccttgcgccagcggaagaagcgcggggcctcctgaacgagcaccaggtccggcgcgcaggcgcggatgacgcgggccagcgcggcggtgtcgtcgtgcatcgaccggacgttgtagctcagcactctgatgacggctgaaccgtccggctcggtacgggagacgggcaggggcgtcaggaccatgcgggccacgatacgacggacgcccgccgcagccccggagggcgacgacgggcgtccggtgggtcgaacgaagccgttctcagccctggcgggccaggtcggccgctcccacgagccctgccttgccgccgagttgcgcggccagcacc

SEQ ID NO: 3815 - DNA, 2643 bp, Unknown
  Kingdom: Bacteria, Phylum: Actinobacteria, Class: Actinobacteria, Order: Streptomycetales, Family: Streptomycetaceae, Genus: Streptomyces
gtccggggagggcctggactcggcgcggccgttgcggggcggaacggcgagctggaggacgtcggcgaggctgcccgcgtaccggtcggcgacggcgcggcagagagcgagcaggtcgggcccgaggaccggctccggggagaccacggaggcgagggcggccagcgcgccctgatagtcggattcggcgcggcgctcgacgatgaagccgtcgatcagaccgccgccctcacgccgtccgccctggacgttgcgcccgccggcgccgaagcgcacccggacccggacgcccggctgtgcgtcggcgtccagctccttggggacggcgtagtcgaagtactggtcgaggtggaggacgcccttgttgaccaggacgcgggcgacgggcagttcctcggcgagcgcggcgccccgccaggtccgcggcttggcgcgcggcaccttcgcccggcgcacggtctcccggatcagcgcaagctgctccggcgccccggcaccgggttcggcggactgctcgttctcgctgctcacagctgaattcctaccagagagcactgacagcggcgggagcacggcagcggggcccggccaccgcgttcggtgtccgggccccgctgtcgtactcgatggcacccgccccgctgtcgtacgcgggcggtttcgctacagaccggcggcggcgcgcagagcgtccacgcggtcggtgcgctcccaggtgaagtcgggcagctcacggccgaagtggccgtaggcggcggtctgggcgtagatcggacggagcaggtcgaggtcccggatgatcgcggccgggcggaggtcgaagacctcgccgatcgcgttctcgatcttctcggtgtcgaccgcggcggtgccgaaggtctccacgaacagtccgacgggctcggccttgccgatcgcgtacgcgacctggacctcgcagcgcgcggcgagaccggcggccaccacgttcttggcgacccagcgcatcgcgtacgcggcggagcggtcgaccttggacgggtccttgcccgagaaggcgccgccgccgtgccgggccatgccgccgtaggtgtcgatgatgatcttgcgaccggtgaggccggcgtcgcccatcgggccgccgatctcgaagcggccggtcgggttcaccaggaggcggtagccctcggtgtccagcttgatgccgtcctcgacgagctgcgcgagcacgtgctcgacgacgaactcgcggatgtcgggcgcgagcagcgagtccaggtcgatgtccgacgcgtgctgcgaggagacgaccacggtgtccagccggaccgccttgtcaccgtcgtactcgatggtgacctgggtcttgccgtcggggcgcaggtaggggatggtcccgttcttgcgcacctcggacaggcgccgggagaggcggtgcgcgatgtggatcgggagcggcatcagctccggcgtctcgtcgcaggcgtagccgaacatcaggccctggtcgcccgcaccctgcttgtcgagctcgtcctcatcgccctcgacccgcttctcgtacgcggtgtcgacgccctgcgcgatgtccggcgactgcgcgccgatcgacaccgagacgccacaggaagcaccgtcgaagccctttttggaggagtcgtaaccgatctccagaaccttgttgcgcacgaggttggggatgtcggcgtaggccttggtggtgacctcgcccgcgacatgcaccagaccggtggtgatcaaggtctcgacggcgacgcgcgaggaagggtcctcgcgcaggagcgcgtcgagaatcgtgtcgctgatctggtcagcgatcttgtcggggtgaccctcggtgacagattccgaggtgaagagacggcgggacacatcgctccctggggttgcagcggctgctggctgatcatgggtggtacgaccgagagctgcgctcggcgcgtaccgtcggccagtttatcggtcgcatccggcgaccggggcaggtgtctcgccctttgggaggttcgtgacatgcgccacgcggggctccagtaggacaatccacccaccctgacctttgttttaggccttatgggacgatttcgctcgcccggagggttgattatgaaatcggctggaaccttcccgaaaccagatcccagaccgtgtcggcgagcgcctccttgggaccgtacggcaccggcgtctccgtgccgtcggctgcgaggacgaccgcttcgttctcctccgagccgaaggtcttgcgctcccccacctcgttgaccacgaggaggtcgcagcccttgcgccggagcttcgcacggccgttgaccagcacgtcgtcggtctcggcggcgaaaccgacgacgatctggtccgcacgggcccgctcgccggagacctcggcgaggatgtcggggttacggaccagagtgacggcgggcgcctcctcgccgtccttcttcttgatcttgccggaggcgtacacggcggggcggaagtcggccaccgcggccgccatcaccacgacgtccgcgtcgggggcggccttcagcacggcctcgcgcagctgcacggccgtgccgacgcggaggacgtcggccccggccgggtcggcaagcccggtgttggcctcgatcagggtggcccgggggcccgggg

SEQ ID NO: 3816 - DNA, 1197 bp, Unknown
  Kingdom: Bacteria, Phylum: Actinobacteria, Class: Actinobacteria, Order: Streptomycetales, Family: Streptomycetaceae, Genus: Streptomyces
tgagatcggcctcgtcgcgccgggacgcccagcgcgacgaggccgatctcagttacgttcgccgactggtgcagggccgtatcgacatcctgcgcgcggaactggcccgccgccgggatccggaggcgccggtggaggacgcggcggtggtgagccggctctcggagatcctggccgacaccccgtcccggcaccgctcctccgcccggcacgtcacgctgacgacgccgcgcggggacgagttccggcagctcgccgccgagaatctcgccgaggtcgagctgtccgacctggacgcccggacggacgaggaactgcacacggccatgggccggctcgtccgctacgaacagcaggtctcccgccgccgtcacgagctccagcgcaccgccgacgattgcggcgcggagatcgcccgcaggtaccgtgacggtgaagcacaagtagacgacctgctcgcctgaagcgatccttccgggcgcgggtcccgcaccccgtccccggaaggccgccatgacgtccatcgacgctccctccgccatatcctccgccccggccaccgtcccgcccgtcctggccgaggtcgtgcgctccgggttcacggaggggcaccaccggggagcactggtcctgctggccgccgacggcagcgtggagcgggcgatcggcgatccgacggcaccggtcttcccccggtcctccaacaagccgatgcaggccgccgcgatcctgcgggccggtctcgatctctcgggcgaacggctggcactgaccgccgcgagccactccggggaacccttccacctcgacctcgcgcggaagatgctcgccgagcacggactgagcccggccgacctccagaccccgcccgacctgccgctggacccggtggaggcggaggcctacctcgcgagcgggaacgtacgcgagcggatcacgatgaactgctccggcaagcacgcggccatgctcggcgtctgcgtcctcaacggctgggacaccgcgacctacctcgacccggcccatccgctccagcagctcgtcggacaggtcgtcgccgaagccgccggcgagccggtcgcggcggtcggcacggacggctgcggggccccgctgatggcgatcgggctgaccggtctggcccgcgccttccggtccttcgtgctggcggaacccgggagcgccgagcgccgggtc

SEQ ID NO: 3817 - DNA, 3191 bp, Unknown
  Kingdom: Bacteria, Phylum: Actinobacteria, Class: Actinobacteria, Order: Streptomycetales, Family: Streptomycetaceae, Genus: Streptomyces
  misc_feature (508)..(509): n is a, c, g, or t
gcagggcggcggacagctgggacttgacgacgcggatgccggcggcggccagtgcgtcgagtgcggtgccggggtcctcgaaggaggtggcgaggtggcaggtgtcgacgcagatgccgatccggtcgtgggccacgtcggtgagcggggtgatggcgtcggctgtggtctccaccgtgcagccgggttccggttcgaggccgacgcggatggacttgccggtcagttcggccagtgcgtcgaggcgctgggcgagtgtggtgagggcggcgcgtgcggcgcgggccgcctcggggtcgccgtcgaagggggtgcgccaggcgagcggcagggtggagatggtgccttcggtggcgtcgtccgggagcaggacggccagaaggcgggcgaggtcggtggtgtgggcgaggcggtcgggttcggtccagtccggccggtagacccggtacttgacctcgtcggagccgaacccttcgtaggggaagccgttgagggtgaccacttcganntcgcgcagctgggcgcggaccccttccaaggtttccgccgggtggacgttggtgcagtaggcgaggtggaccgtcgaaccgtccgggtggcggaagcgcatcgcctcactccccgccgcgcaggatggagttgccctcgtggagtggatcgggggccgggacgtcgagttggaggcggccgctccggccgtagaaggcgaccgggttgcgccacaggaccttgtcgacgtcgtcctcggtgaagccggccttcagcatggcgtcggcgaccttgcgggtcttgagggggtcgctctttccccagtcggcggccgagttgacgatcatcttctcggtgccgtggttctggaggatggcgaccatccggtcctcgtccatcttggtgtccggatagatggagaatccggcccagcagccgctgtcggcggcggccttcaccgttgtctcgttgaggtgatcgaggagaacgtgctccggggggaggttcgattcgcggatgacgtcgatggtgcggtgcagaccggcgagcttgtcgcgatgcggggtgtggacgagcgcgggcagcccgtggtcggcggcgagctggagctgggcggccagggcgtggtcctcggccggtgtcatcgagtcgtagccgatctctcccaccgcgacgacgccgtccttcacgagatagcggggcagcgcgtccaggacaggagtgcagcgggggtcgttcgcctccttggggttgagggcgagcgtgcagtggtgcgcgatgccgtactgggaggcgcggaagggctcccagccgaggagcgcgtcgaagtagtcgaagaagctggcgggcgaggtgcggggctggccgagccagaaggagggttcgacgagcgcgcggacgcccgcgtcgtacatcgcccgatagtcgtcggtggtgcgggaggtcatgtggatgtgggggtcgaagatgcgcatcaggactcctccgtgggggcgggggctgcggtcggcggggcctggtgggcgccctcgtcggcaggggcggtgagggcgagcaccgtgcgcaggtcttcggggacggtgcggccggcggcggtgcgttcgtcggcgaagtcgcggagcatgcgcgcgagttcgtcgtctcctcgggcccggtcgtcgagccgcgcgacggccgcgaccggcacttcggtgaacaggcacttcagtacggcgtgccgccaggcgtgcgggtccaggtggtcggcggcgtaggggccgacggccgcggcgaccagccgggtgtcgttggcgcgcagagcgtcctcgacgagcgggagcgcggtgtcgccgaggtcgagccggtgcagggtgagcaggacggcgcggcgttcggcggcggtgccctgttcgtagagccgggtgacggaggacagcggggcgcgggcctcgacgagcaggagggagcgtacggagtcggcgtgctccggtccgcagtgccggccggcggcggcgtagcgcaactcccacggcggtgaggtgtacgggccggtcgcctcccgaccgggggtgccgggcgtggccgcgtcgtgggcggcttcggcgagggcctcgtcgagccaggcccgggccgctccgtcgagttcggcgtcgagttccttgcgggacttcagcacggggcggctccctcggtgacggtgccgcgcgtcatggcgtcgcgcaggaagtcgatcgaggtgcgggccagttcggggcccgcgtgggagtggcggggcagttcgacgacggtgaggccccggtagtccgaggcggccagggcggcgagcacgggcgggaagtcgatctccccctcgccgaacgggaggtgctcgtggactccgcgccgcatgtcctcgatctggacgtgccggagccagggggcggattccttgacgcactccagggccgtcgcctcctccagacactggcagtggccgatgtcgagggtgaggccgagcggtcccgggtcgccgaggaggccgcgcagatggtggaagtcggcgagggtggcgaggagatgaccgggttcgggctcgatggcgagaggtatgccggaccggtcggccgcttcgagtacgggggtgatggcttcggtgagccgcctccacgcggtgtccggcgaggtgccgggcggggtgacgccgctgaagcagtggacggcgtgcgcgccgagttcggcggccacgtcgacggcgcggaccagcagggcggtgcgggcggcacgggcgtcggggtccgggtcgaggagggaggggccgtgcttgcggcgtgggtcgaggacatagcgcgcgccggtctccacggtgacccggagcccgagggaggtgagccggcgccggacctggcgggtgcgctcggtgaggtccggcgccatggggtccaggtgcatgtggtcgagggtcaggccgacaccctcgtagccgaggtcggcgagcaggccgagggcgtcgtcgaggcgcaggtcggtgagcccgttggtgccgtatccgaggtggagggtcatgtgagactcaccttccgggcgaggctgcgggcgagggggacgagccccatgacggcgagagcggggacgggtgcaccggcgcgggcggtgagcgcggcctggagcgggatcatggcccggatgcccccgccgaccgcccgctgggtcaggggcggggacgggttgagtgcggcgtgcaggag

SEQ ID NO: 3818 - DNA, 1236 bp, Unknown
  Kingdom: Bacteria, Phylum: Actinobacteria, Class: Actinobacteria, Order: Streptomycetales, Family: Streptomycetaceae, Genus: Streptomyces
cggtgtcgcggtcgtcggcgtcatcgtcatagcggcgggcgcccccgccgtgctcggggcctccgccgatctgaccgagtcccagcggctggtcaccctcgcggagctgaaccagcaggcggtcaccctcgggcactccctcgccgacgaccgcgacaccggcgaccagtcggctgcgcacccgcacggtccgcttgtccgcgacgggctccggaggcgtcgccccggaaccgtcgcgcgtcgtgcctttgctccgcggccgcttcttctgcaccggtgctcgcaatcttgactcgtccacccttgaagcagaggtgacgcacggtcacatggaagggcgccccgctcctggtacggcttctgaccattccagcgcttttgagaggggggcgcgcatcaaccgctccgccactcgaaggagtgaacatcactctggagttggcgaacaagtctcccctggtgcgcccctgaccatgcgtgggccatggggtggaacttccgctccgcctttggcaggatgcccgcccgcatcggttcggagccgctccttccgccccgcgctcccgcgttgacctgctggtacaggccatttccggtcgcgtgcggagatggtgaagggctcgtgcagactggcggcatgcgtatcgaactcgccacggcgcccggcagtcccgaacgccccaacgaggactgggcctccgggactcttcccgcgtccggccagggcggtgtgctggcccttctcgacggcgtcaccccgccgcggggggacgacggttgtgtgcactcggtcccgtggttcaccgcacgactgggcggcacactggtggaactgtccggttcccgccccgacctccccctggccgcggtcctggccgaggccatctcccgtacagccgacacgcatcgagccacctgtgacctttctcacgtacgcacgcctcaggcgaccgtggtcgtggcccgttgggacgaacgcgtgatcgagcacctggtgctctccgactcggtcctgttgctggagtcctccgacggcacggtccgggcggtcctcgacgaccggctggacctgctgccgccgggctcgctcgcctcgaacgagatcgccgatgccacggtgcgcaaccaggagggcggcttcttcaccgccgccgccgatccgtcggtggcggcgcgcgcggtgacgggcagcacccaggcggccggcgtccgggccctcgccgcactcacggacgg

SEQ ID NO: 3819 - DNA, 2016 bp, Unknown
  Kingdom: Bacteria, Phylum: Actinobacteria, Class: Actinobacteria, Order: Streptomycetales, Family: Streptomycetaceae, Genus: Streptomyces
gttctcgctgcccgccgccggaggccacgaccaccggcaccccgctggccacgaccaccggcggcgggcagcgagaacccctcgtacagcgagggcacgcaggagacctgggcgctgcgcacgaggtcgaccagctcggcgtcgcttatgcccttgacgaactcgacggcgtccgcgagcccgtgccgctcgatcgcgcgggcgacggggccgttctcggcgcgctttccgacgacgacgaggtgggcggcggggttctcggtgcggagcttggcgagcgcgtcgacgaggtggacgaggcccttgagcgggacgtcggcgctggaggtggtgacgatgcggccgggcacctcggggaccgaggggtccggggaccacaggtcggtgtcggcgccgatgtggacgacgctgatccggtccgcgcgtacgccgaggtcctcgacgatctcgtcgcgggaggagccggagacggtgaggacggtgtccagcttgcgggcgacccgcttctgcatccgggtgaaggcgtaccagcggcgtacggaggcgcggcggcggcggttggcggcggcctccaggtcgagcctgcggtccacggtgatggggtggtggatcgtcgtcacgagcggggccccgaggtcgccgaggagcccgtatccgagggtctggttgtcgtggacgacgtcgaactcgccgcgccgggccagcagatggcggcgggcgcgcaggctgaaggtgagcggctcggggaatccgccggtccacatggtggcgacctcggccaggtcgatccagtcgcggtactcgccgcgcttcggggtgcggaacggatcgggctggcggtagaggtcgaggctgggcagttcggtgagcggaacgccctcgtcgagcaccgggtagggctgcgcgccgatcacctcgacgctgtggccgaggcgggccagctcccggccgaggtggcggacgtacacgccctggccgccgcagaacggattgcccttgtacgtgaggagtgcgatgcgcaacggccggtcgccggtcccggcggagctgccgtcgcccgtgcgggggcctgtctctatggcctcagcggtcacactcggcccccttctgactgcgtgttcgccggagcgtaaccggtcgcgctaatctagaacaagtttcagacttgatagaacaagttgcatacttgatcgttcgacgtgcatcgaatctaccggcaggtagcgtcggcgtgacggccggatcaggtgattcgcgccacgacggacgccctggcatgctgtgcgcgcccggccgctccgcttcgtccgtccgggtgcgggatcaagccatggatcacggatcgtggatcggggacaggatgaccgcggacgccagaccggcagcgcctccgctgaccgaacgccaggaggcccgtcgccgccgcatcctgcacgccagcgcccagctggccagccggggcgggttcgaggcggtgcagatgcgggaggtggccgaggccgccggggtcgcactgggaaccctctaccgctacttcccgtccaagatccatctgctggtcgcgaccatgcaggaccagctgcagcacatgcacaccacgctccgcaaacgcccgccggccggcgacgacgcggcccagcgggtggccgagacgctgatgcgcgccttccgcgccctgcagcgcgaaccgcacctcgcggacgccatggtccgcgccctcaccttcgcggaccgcagcgtgagccccgaggtggacaccgtctcccggctcaccacggcgatcatcctggacgccatgggcctggagcacccgaccccggagcagctctccgcggtccgggtcatcgagcacacctggcactccgcactgatcacctggctgtcgggccgggcctcgatcgcccaggtgaagatcgacatcgagacggtctgccgtctcatcgacctgacggcggagccgggccggaactgagaggtgacccgtcggcggggcgggccgccgacgcgtcacctctc

SEQ ID NO: 3820 - DNA, 2402 bp, Unknown
  Kingdom: Bacteria, Phylum: Actinobacteria, Class: Actinobacteria, Order: Streptomycetales, Family: Streptomycetaceae, Genus: Streptomyces
acgcagccggtcggcccggagaggccccgcgcggcgagggagcgaccaaagtcgcgggaccggctactttcggcgcggcggacgggaccggtggccgacgcggcgggtgcggggcgggcgggaggctcgggcccatgaagaaaatcgtcgagacgatcgggttcctcgtcttcgcccagggcgccggcggactgctgtacgagtggacgggctggttccggctgtggacggtggtgcggcgaatcgacttcctcagcgaccgcgggttgttcgtcaacatcgtgctgatcgtggtgggggtggccgtgatgatcgccgcggacgcgatcaagtcctgacaccacagcggtgccgtcatcgacaagcttcggccacgtcccggggggactccccggcggcgccggtggtcacgctccggcgcgctcccggcccgcaccgcgtcggccccacgcggtgcccgccaggacgaggaccgccccggcggcgccgagcagcccgagccgctccccgccgaggctgatgccgacggcggcggcccacagcggttccgtaccgagcagcaggctgacccgggacggcgaggtgcggcgtacggaccacatctgcacgaagaacgcgaacagcgtgcagaacaccgagaggaagaccaggcccgcccactcccgggcaccgaagtccgccgccgctctccacggcgaggcaccggtgccggggacggcggcgaggacggcgaagacggcgaccgcggccccgagctggacggtggtcagggagagcgagtcggcgtcctggaccgctttgatcctggccatggccaggacgtggacggtccgggcgagggcggcgagaagcatcaggaggtcgccgcccgagggactggtgaacccgccgccctgggtcagcaggaccacaccggcgacggagagtccggccgcggcgacgaatccggccgacgggcgcacgcgggtcacggcggcctcggccagcggcgtgaagatcatggtgaggctgatgatcagcccggcgttggtggcggaggtgtgcaccaccccgtacgtctccagcaggaagatcccgctcagcaccaggcccagcagtcccgctccccgccactgcgcaccggtcagcgcccgcagtctgcaccatccggtggccacgagcaccggcagcacgatcgcgaagcgcaggacgaggacggcgacgaccgtgtgggcggtggtgatgcccttggccgcgaggtagctggcaccccagacgacggcgaccgccagcacgggagtatcggtgacccaggcgcggtgcggggaggcgacggcgggcacggcggcagcggacatctggttctcctggatctccacggaacatgttgtggagacctcaccggctcgcacgcggagcgatcacgctatccgccgggctcctgaaaaaggaacacctgtctcagcgctcggatcgtcccggggtatcacccgtggtcagaggcggtcaggccgttcggccggacggcggagggtccgtcggccgcgccgccgctccctagactgacgcctcgataactctgaggcacggagtggtcacatggcgtcgttgagagcggacgggcgggtcgagcgggggaaccagacccggcagttgatcctggggcgggcggtgcagatcgcctcggtcgaaggtctggagggcctgtcgctggggcggctggccaccgagctcgggctgagcaagagcggggtgttcgccctcttcggctcgaaggagggactccagctggccaccgtacggggggcggtggccatatacgtcgaccatgtgctgcgccccacccgatcggtgccgccggggctcggacgggtgtggcggttgtgcgaggcgtggatcgcgtactcccgcgagcgtgtcttccgaggcggttgcttcttctacgccgccaccgccgagttcgacgcccgcggcggcagggtgcacgacgccctggcgtccgcgcagacgggctgggtcaccttcgtggagcagacgatcgaggaggccaggtccgccggggagctggccggggacaccgacgtgtgccagctggccttcgagttgatcgccctgctggagctggccaacgccgagtcggtgctccagaacaacaacctgggctacgacaaggcggcgagggccatcctggtccggctgcgggccgcggcgacggatcccgcgctgctgccgtgacggcaggcgggccgggcggccgtgggcgtccgatacccgccggtgcgcgggtcccggtgggcgtttgctgggggatgtcgtcggagcgacggcgtcccccagcaaaggaaccggccatgtccagcaccctgtccaccaccgcccccgccaccgttcccaccggccttccggaccgggccgccctggtc

SEQ ID NO: 3821 - DNA, 1895 bp, Unknown
  Kingdom: Bacteria, Phylum: Actinobacteria, Class: Actinobacteria, Order: Streptomycetales, Family: Streptomycetaceae, Genus: Streptomyces
gcagtgggggcggggaggatcgacgtgggtgcagtgaagagcaaacggatgccgcgcgccgtgcgcgagcagcagatgatggacgccgcggtgcggaccttcgggcagcgcggctaccgggccgcctcgatggacgagatcgcggagctggcgggcgtgtccaagccgttggtctacctgtacctgaattccaaggaagagctgttctccgcctgcatccgccgcgaggcgaacgccctgctggaggcggtgcgggccggggtggagccggggctgcccgccgacggccaactgtgggcgggactgcgggcgttcttcctccacaccgccgagaacccggacggctggtcggtcctgcaccgccaggcgcgatcgcacggggagccgttcgtcagcgagctcggcggaatgcgggacgagatcgtcgcgttcgtgacgggtctgatcggggccgccgcccgcgaggcgcacagtgaccccgcactcgcggaccgggacgtggtggggctcgcgcaggcgctggtgggggccgcggagtcgctggcgggctgggccaacgacaccccggacgtctcggcgaaggaggccgcggcgaccctcatgaacttcgcctgggcgggcctggagaacctgatgcacgcgcgtccctggactcctccggcggcgtgaagaggccttcccgatcgggccgggacggatgagacgcccccggacggtcgcggcggacaatcccggggcgggtgggtagcaactcatcttcatcggccgttggttgagtacatgtactcaagaaggcgtctgcccgcgaggtcgagactggcggcccgaaccgacctcctaggagcaggcgatggccgccaccaccccgaaccacgccccgtcgctggacgtgcggctgtcgtcgagccgccgactgccggccgcccttgccgtcgcggtgactgcggcgctcgtcgtgtcgaggttcggcgccgccgacccgaccacctggctgctggagacggtgtgggtgatggcgggcctgccgctgatcatcctgttccgcaaccgtttcccgctgagtggcctgctctgcggtctgctggcggcgcatgccctggtgctcatcgtgggcggccactacacctacgcggaggtgccggtgggggactgggtgcgcgactggctcggatgggaacgcaacccctacgaccgcttcggccacctcgtgcagggcttcgtcccggccatcctcgtgcgcgaactgctcgtccgcacctcccctctgcgcggcagccgctggctcgccgtcctcaccgtctgcgcctgcctggccttcagcgccgtcttcgagatgctggaatggctggctgccgtcaccggcggcgaggccgcggacgcgttcctgggaacgcagggggacgtgtgggacacccagtgggacatgttctgcgccctgatcggcgccctctgcgccctgctgctcctgagccgcgtccacgaccgtgccctcacccgcccgggcccggagcggtcaccccgccggtgaacccccgatcgcccgccctaccgctccaccgtccccaccaggtgcacgcgtccgttcgccccgcgcagttcgaaggcgttcccggtggcgtcggccgcgtacgtcacggtggcgggcagcaggacgggggccttgaactcggcccgtacggaacggattccggccggttcgccggcctcggccaggcagcgggcgaccgtccacatgccgtgtgcgatggcccggggaaagccgaacagccgggcggtcagcgggtgcagatggatcgggttgcggtcacccgagacggccccgtaccgccgccccagatcgccgggcagccgccattcggcgcgggccggcaggcccccggcgatctggggcggcg

SEQ ID NO: 3822 - DNA, 1633 bp, Unknown
  Kingdom: Bacteria, Phylum: Actinobacteria, Class: Actinobacteria, Order: Streptomycetales, Family: Streptomycetaceae, Genus: Streptomyces
ccgctgcacctcccgccgggggtcgaggcggcgaccgccacggcccgcgaagccgtcaccgccgcctggcgtaccgcagcgcaccacctcggcgaacccgcggcgttcgccggacgctgaacggtccacgcgaccggaggggagcggctacccggcctcccgcgccacctgctccagacgctgccggtactcctcccaccagacggggtcgcccggcggcatgttgccggcggcggaccgcagcccgaccgtcccgtcgatgagctcccggacgacatcggcgtgcccggcgtgccgctgaaggtcggagatcacatggaccaggatctgatgcagcgtcacgcggctccgctcatcgggccaccaccggacgcgcccgaccgcgtcgagcggcagctcggcgatcgtggcgtccgcgtgctccgccacccggcggtagagggcgaggacgtcctcgcgcgactcgtcggcggacgcccacatgtcctggttctcctcggcgtcgtccccgtaggcgggcggggtctcgccgaacggccgcccgaacgtctcgccgaagtagcccagctccacccctgcggcgtgcttgaccagcccgaggagattggtgccggtcggcgtcagagggcgacggacgtcgtactcggagagtccttcgagcttccacagcagggcgtcacgggcggactgcagatagtgctggagatcagccttcggctgcgaagcggtcatgcgggcagtctgccaccggccactgacctacggggtccgtccggggacagccgggggcatcactccgcaccgttccgggacggggcccgggtggcggcgccgaccccggcggcgtaggtatggaggcgtgccgctccggaggacgtgcgacgccacggagcgcgccggcctgcgacggccggtgaccacaaggcccacccgccggaccggtgtccgtgtccggcggcccaccaccggggacgaggagacggatcccgatgaccgtggcggagcagagcacgccggtgcacgggattccgtgctgggtcagcctgatgacccgggacctgcgggccacccaggacttctacgggaccgtcctcgggtggacgttccgctccggaagcctcggtgcgggcttcaccgtcgcccacgtcgacggcctgccggtcgccgggatcgggcagatcgcccccggtctgcccacggccgtctcctggaccccgtacttcgccgtcgaggacgtcgacgccacaacgtcccgggtccgcgaacggggcggcaccatcgccgtcggcccgatccggctgggcccagggcgcggagccgtggccgccgaccgcgaaggcgccggattcggcttctgggaaggccggaccccgccctggtcgttcggccgcgaccacccgcccgcctccctcgaactgcggacgagccacgccttcgactccgcgatcttctatgccgaggtgttcgactgggcctccgaggagcccggcggctgcgaggtcggctacgcgtaccagcaggacgcggtcgtcgttcggcagggtggccgcaccgtggccaccctgcgcgggggcggggacgcgtcgtcctccgacccccggctgcgcccgcgctggcacgtccgtttccgggt

SEQ ID NO: 3823 - DNA, 706 bp, Unknown
  Kingdom: Bacteria, Phylum: Actinobacteria, Class: Actinobacteria, Order: Streptomycetales, Family: Streptomycetaceae, Genus: Streptomyces
cgcggtggccaccgcgtccctgcccgtctacttcaccgcggtgatgctcctgtacgggctggtccggctgaccgggctgctgccctaccccgcctacgtcccgctcaccgacgaccccctggcctgggcaaccaacctgttgctgccgtggatcgccctggccctgctctacgccgccatgtacgcccgccagagccgcagttcgatgatcgagacgatggcgcagccgtacatcaggaccgcccgcgccaagggcctgcccgcccggaccgtcgtggtcaaacacggactgcggtccgcgatgatgccggtcctcaccctcttcggcatggacctcggcgccctgctggccggagcggtcatcaccgagtccatcttcggcatccccggcgtcggcaggctcttctacgacgccctgcaacgctccgaccagcccgtcgtgctcggcgtcaccctgctcgcggccttcttcatcgtggcggccaacgtcgtcatcgacctcctgtacgccgtcgtcgacccgagggtgaggaactgacgtgtcgcccaccaccgaaccggaccaccccctgctgcgcgtccacgacctgcgggtcgccttcgacacccccgccggaaccgtccaggcggtcgacggggtctccttcaccgtggaggccggccgcaccctgggtcttgtcggcgaatccggctccggcaagtcggt

SEQ ID NO: 3824 - DNA, 1628 bp, Unknown
  Kingdom: Bacteria, Phylum: Actinobacteria, Class: Actinobacteria, Order: Streptomycetales, Family: Streptomycetaceae, Genus: Streptomyces
cctggacaccacgctcgtgggcggcggcgacgaggcgggcgacattggcgagcgcgcccgacgagcgggcggcggcggcgagttcgggcagggcgctgtccggtcccacgactccctgctggcactcgacggtcagcaggacggtggtggcggggtcgagcagttcggtgagccgctcctgtgatcgcctcgacggcacgggcgctcctccttctcctggtgtccgccgtccggtggtgcctgccgtccggtggcgggcggacttccgcggtcgggccgggcgcgcgagagtagcggccattgcgtcatgaaggaagagcgtccatgatttctgacaccgagtcagaacccaggagagggcggccatgaccgacacccagcgacgaggccgccggatcatgatgacgcccggggagcgggacgcctatctgagcgaacagcgcacctgccgggtggcgacgctcggcgccgacggcgctccgcacatcggcgctctgtggttcgtctgggacggcggttccctgtggctgtactccatcacgcgcagcctgcgctggtcccagctgcgccgggacgccaggatcgccgtggtggtggacgacggcgaggggtacgaggaactccgcggcgtggagctcaccggccgggcggagttcgtcggcgaggcaccccgcaccggcgagccgtgccccgaactcgtggacgcggaacggatattccccgtgaagtacttcggcctggcggagatgccgcacgacggacggcacgcctggctgcggctcaccccggagacgatcacctcctgggacttccgcaagctcgccgatctcgcctgatctccaccccgacctcggtcccggcctccaggcctatgcgccgtccgccgccacggccgagcccgccgcccgcaacgccttcaccgcggcgcggaccgacgggcggcggtccacgtccgtgcgccagaccgcgtggacgtgccgccgcacggtctgccgcaccggcaccagccgcaccccttcggggaccgggccgcgccccagccgtggagccacgcagacgccgaacccggccgcgatcagcgccagttgcgtatggtgctcgccggccagatgagcgatgcgcggctcgatgccccgggagcgcagggtgaacatcagccactcgtaacagaattcgccctcgggccaggacacccactcgtcgtccgcgaagtcctccaggtccacctcgtcacggtccgccagcggatgtccggccggcatggcgatgtccggtgcgtcgtcgaggagttcggccttggccagcccgccgggcacgggcagccgcttgttgctccagtcgagcacgacggccaggtcgacgtcgccgcggagcaccgcgcgcagcccttgttccggctccagctcccgggtacggacggtgaggtcggggtggtccgcacgcagggaggcgagcatcgtggggaacagcccgcgggccgcggtcgggaaggcgcagatccgcacctcgccgacgacctcgccccgctgcgcctcgatgtcggactgggccagctccacctgcgacaggatgcgcgcggcgtggtccgcgagcagccggccggcatcggtgaggcggacgccgcggcc

SEQ ID NO: 3825 - DNA, 3744 bp, Unknown
  Kingdom: Bacteria, Phylum: Actinobacteria, Class: Actinobacteria, Order: Streptomycetales, Family: Streptomycetaceae, Genus: Streptomyces
gcccggcccgacctcgccgggcaggacacggtcaccggcgtcgcccccgtccgcgttcctcagaggcccgcgcccgaggccgaaaccccgtccgaacccgacacggactctccgccctcccgggctgcgcgcacactgccgagacgccgcatgctcctggcgggactgggcgtactggcggcaggcgccgtccccgcggccatcgcgctcaacagctcaggaagggacgggtccaaggagagccggtcaggtaggaacgtctcgaaggacggggagaaagaaggagttcgcgtcagcggtgtcgcgctgacgggccgtgccgcgcccgtcgacgcggtggcgttcagccccgacggcaagaccctcgccggtggttaccggcaggacgtcgtacagctctgggacctcaccaccggcaggagcacaggcacgcgcacggacgatgcctcgatgcgagcggtggccttcagcccggacggcagaaccctcgtcaccggccactggggcgacaccaccaaggaggaccagagcggcgtgcggctgtggaacgtcgccaccaacggcatcatcgaagccagcttcaccggccacaccggcatagtcatatgcgtggcgttcagcccggacggaaagaccatcgcgagcggcgcggaggacggaaccgtccggttgtgggacgtcgccgccggccgctcccgccgttccctcgactgccatgccggttacgtctactcggttgcgttcagccccgacgggaagaccctggccagcagtggctcggcccctggggagggcgcgggggcggacgtgcagctgtgggatgtcgccacagggaaggcccgaggcaccttccccctcgacggcgaccggacctgcacctcgttggccttcggcccggacggcaggaccctcgccggcgcctccgggaagggggtggagttgtgggatctcgacaccggcgaccacctcgtcacgctcgacagcgggaagttcgcgagtgcggtcgcgttcagtcccgatgggaaacaggtcgtcagctcttccgggcagcatctcgcgttgtggaatgtcgccgaccgcaaacgcaccgccaccttcgtcggccacagctccggcgtcaatgcggtggcgttcagcccggacggcaggagtgtggcaggcggcagcgaggacatgtccgtgcggctgtggaagctcccctgagggagcttcggatgcgatccctcccacctcgccgggcgacacctggcgaccaccacgccgatccacggcctcgtcggccgaacgtggggaccccatgccacggtcgccgcctgagccggtgtcgtccggaccgcctccttcggatccaacggcgtgagcatggagattcaccgctcgcgaggacggacgggcgtgacccccccggccggcgtcccggctcggtccttcgcgatgttccggatcttccttgtgctgcctgacccggcgagcaggacgagtacctccggcgacgtcgactcccgggcaaggagacgctgcatccagtccgtggccttcgccagctcggcgggggtcggcacgtgaccgtcctcgatggacaggtggaacagccagtcgtggacgcggcggcggatgaactcgcggtacgcctccgtactgagccgttcgatctccggcagaagttcggccgaccactgccggaactcggcaggaccggtcaccttcctcgcgatgctgtccacgagggcgaccaccgccgtcttggacgccatctcgtccgggtcgcgcaggatcgtggccacgaacgcgcggtcccggtcgcggctccgcgaggaggcgatcaccaggacgacgcgttggtacacggacgagcgcacgtgctcgtccgcgacggcatcgtcgacgtccacgtcgatgatgccggcacccgcgagcatgtcggacaggtcggcctgcaaggtcatcgcgccatcccctcccagcaggtcggtgctcggcggcgaagtgccctcgacgggccgggggcgcctgcgccgagggcgcggcgcgaagcgcgaacggcgtacgcggccggtccccacacagtcaagaacctttagtttatgctcacttgtgagcgaactcggagcacctctgtgcggccagtgcgcagatttttcgaggattcacccatccggaagcgcggactacggcataggatcatgccgcgcgtccctggggcctcttctgccccaccagcatcgttcccccaccagctcgccctcaccggcaccccccaccatccgttaacaggtacaggtatctgcgtgtcaccgatacacaagcccggttccggcgacggagccgcgcagtgaaaatcaatcgtcgcctcgtactcctcgtcaccgcgccgctcaccgtggccgtcgccttctccgtcctggccctcgcacccgcgaccaaccaggcgctccaggccgaccggctgacctcgatggtcgaagccgccgacggagcaagcgagttggccaaccggttacagcgtgagcgggcggcggccaccgccctgatctccgaacagggagacgcggaagcattccggttacgtgcgaacgcgaccgacaagagcatcgccggattccgcagcaagaccaaaggactctcctcggtacccggcagcgcacagggcgctctggaccgtatcgagcgcttcgtcgaggagatgcccggcctgcgcgcccaggtgcgctcgggaagcagcaccgtctcggccctcgccttcggctaccggatcgtgatcgccgacctcaacagctaccgcgacggcatcgcgcaggccgacggcgtggacgccgacatcgcggaccggatccgtgccgccgccgccctgtccgaggccgcggagcacacggcccagcagcaggtcaccgtcatgagggcgcatgcggcgggcggcttcaccaccgcctcccagcggaccttcgacgccggccggatgggctacaccgagtcgaccggcgtcatgttcgacctcgggccgggcgaatggcggacctggctggagcgcaccctctccggtgcgaaggcgctggaggcccgacggctcgaggacgagatcgggcggacgggcaccggcaaggacctcacggtcggccccgaggaatggcagaaggccgccaacgaccgtcaggaacttctgcgttcggtcgagaagcgagtcgacgcggccgttctcgcccaggtctccgacgcgcgcaccaccctcatctggacggccggcgcggaagtcgcgctggtggtgctgaccctggtcggcgtcgtcgtcgtcgcgatccgcctgggccgtgtcatgatccggcggctgcgcgatctgcgcaacgccgcgcacgaggtcgcccactccgggctgcccgccgtgatgaacgagctgtcccagcccggcgcactgcgcggcgcgacacctgaagaggtggcccggcggaccggcgacccggtcaggaccacgggcgaggacgagatcggcgaggtcggtgaggcgttcaacgccgtccaccacgaggccgtccgcctggcggcccaacaagcgtatgtgcatgaacagttggccgagacgctggtcggtgtcgcacgtcggggagcgcggttgaccgctgtcatggtgtccgagctggacacggtgcagcgcgacgaggccgaccccgtacggatgaagaccctcttcgctctcgaccacctcgccatccgcatggagcgcaacaccaacaacctgctggtgctgggcgg

SEQ ID NO: 3826 - DNA, 2840 bp, Unknown
  Kingdom: Bacteria, Phylum: Actinobacteria, Class: Actinobacteria, Order: Streptomycetales, Family: Streptomycetaceae, Genus: Streptomyces
ggcagaactcgtcgatcgggtagcccacgtggcggtcggcggtcggcagatgccccagcacccggtccccggggcggagttcggtgctgttcagcacggcgtcccccggccccagcacccggacgtgccagtcgtcctggaggatcagattgacctcctggccacccgcggccaccgcgtcgatggagatcagcggacgtgtctcgatcttgacccgacccaccgcgaccgtccgggtccggcccttggtgtccaccgccatcaccttgctcccggcccgcagttcgctgaggtagcgggtgcgaccctcgtcggcgagggtgtacgagtggatggcgcccgcgttgacccggaagggacgggtgggcatgtacggcagcggatgggtctcgctgacgcacaggatcatgcccttggagtgcgagccgaccaggatgccctcgtccttgcccagataggagcaggtgtccacacaggcgcgctcccccatgccgatgtgggccacggcggtgacctccagctccacgaggaggagttcgccggtgccgccggccgcggtcgccttgagcgcggtggcgtcccccacgctccggccgggcatcagcacgccgtcggagccgagttggagacagccgaagatgacagcggcctcctcggtgttcttcgccatggtgatgatggcgccgtcggagtcggcggcggcggcgatcacgatctccagcgggatcttggtcgggtcccggaactccagcacgctccagcgttcggtgcgggccgcctcgatggcggcgtccaggctctcggcgtcggtgatctccaccagccgtccgaactccacgtcgggagcggcctcggcggcctgtgcccgggcggaggcgtccccgccgacgatgacgaccccggcggagccgtagctcgcgggctgcttgcccgccggaggcatcagcaccttggtgacggtcggcggcaacccctccagatcggccgggtcggcggcgactatgccgtcgatccgctggtgcagcgcctcctccacgatggcctgccgggccttgccggccgaacggatgtcaagccagcacagtttctctgagctcactgccgtgcccttcctcgatgtgaccgagcgtgcccccggggcgggtgtggacgactccagccaccctggcggccatcgccccggggtcgggggactggaagatgtttctgcccatcgcgactccggccgcgccacccgcgacggcttcacgggcgaaggccagcacctcgtcctccgtgtcgcgctgcggaccgcccgcgcagatcagcgggatcgggcaggccgcggtgaggtcccgcatctccgcccgcgtgcgcaggcagggagccttcaccaggtcggcgcccaggtcggccgcgagggtgacggcgtgggcgaccagttccgggtcggcggggtcggtgatcttcggcccccgtgggtacatcatcgccagcagcggaaggttccagcggtcgcactggtcggccaccgctccgaggtcggccaactgccgcgcctcttcccgcgaacccatgttgatgtgcacgctcaccgcgtccgcgcccaggcgcagcgccgcctccaccccggtgaccaggtgcttggcgtccgggtccggcgcgtgcgcggtactggcgttcagatgcaggatcagggacatcgaggccagccgggagtggtcgatgtggcgcacgctgcccttgtgcaccacgatcgcgtccaccccggcgccggagagctgcccggcgagccggtcgatgctgctgccgcgcggcaccaccgggccgtcgctgagcgagtggtcgagcgggacgatcatcagccgctgggggtcgtggtgaaacagccggcgcagccgcacagcgcggccgaagtgctggtgtgtggtcatggagttcccttcggcggtgcaccgtcgtacgcctgccggccgttaccggagcgcagacaggccaggtcgggcttgccgcgctcgttgagcggcatcgagtcccagaacgtgatctcggcgggggcgtgcagaggggtaagcagctcgccgacgtgggtgcgcagttcctccgcggaggaggtccggcccgccctgaacacgacggcagcgtggacgtactcggtccggtccggatcccgtacgccgtggacggccgcgtgccgtaccgccgggtgggagagcaacgcgcgctccaccgcggcgggatggatcttcaggccgccggacttgatgacctgtccgctgcggccgctcagccgcagatagccgtagcggtcccagtggccgaggtccccggtgtccagccagccgtcccgcaggacgcgggcggtcagctccgggtcgtccgggtagccgtccatgaccgtggaggcgcgtacccagagctccccggcctccccgcgcggcaccgggtcgccggtgccgggctcgcgcacctccacctccacccagggcagcggccgccccacactgcccaggagctcgggttccaggtggtcgaacgggctcagattgctgatgccgccggcctcggtggtgccgtacagctggacgagcaccgggccgaacacccgcagggcctcggcgatccggtgcggcgcggcgggtgtgccgctgtagaccacgcggcgcagcgaccacagggcctccccgacggggcccgagccggaacgctgctcgtggcccggcgcgtcggccagcagttccgtgagccggtacaggtgcggaacggccaggtaggtgtcggtgacgccgtggtcctcgaaggcccgcagcaccttcggagcgtcgaagtcctggtgcagcaggacctggccgccggcggcc

SEQ ID NO: 3827 - DNA, 586 bp, Unknown
  Kingdom: Bacteria, Phylum: Actinobacteria, Class: Actinobacteria, Order: Streptomycetales, Family: Streptomycetaceae, Genus: Streptomyces
cccggccgggaccgccgtcgcctcgtcctccagtccctccggggagacggtcacgggaacgtcgtcggacatggcgacccctcaccggtcctggggcgagcgggtgggcagcggtgcggtcaccggacggccgggcaccggttctgcctgcggcacggcgtcggccttggtccggcccgaggtgatcgcccaccgggccagcaggaacgagacgggggtgacgagaacgcccgctgccagcgcggcgaggttcttgtccatcccgagaccgctcaccgccccgtagagcagcgctccggacgccaccaggttgaccagactggagaggggatagcggacgaacccatgccaggtcggcctcgtccggcaggtgacgtaggagttgagcaggaacgagcacacgatgctgaccgcgtagccgatgacgtgggcggtcaggtaggggatccagcggttcagcgaggcgtagatcccgaggtagaccgcggtgttcacgcagccgatgaggacgaagctgccgaactggcggaccgtacgggaccggccgggggtgccgggcgcgggggccggcacccccggccggtcc

SEQ ID NO: 3828 - DNA, 2815 bp, Unknown
  Kingdom: Bacteria, Phylum: Actinobacteria, Class: Actinobacteria, Order: Streptomycetales, Family: Streptomycetaceae, Genus: Streptomyces
ccgcctcacggatgtcggcccccggcggcggccgacatccgtgaggcggcggcggcgatggcggagtcgtggttgaggatggagaggatcaccgtctccagcagcacgcactcggcgaaggaaccctccacccgcaggatcggggagccggggaagtagacctcgccttccgggtagccccagatgtcgccgctgaagcggtagccggccagccattcgagggtgggctcgtcgacgatgttctgctgccgcaggaagccgatcatctcgtcgtcgaagtggaagttctccacggcgtccagcacccgcccggtgcccgcgacgactccgtagcgccgcccttcgggcagccggcgggtgaacgcctcgaagaccgagtgccggtcggcggtgccggccttgagggccgcctgcaccatggtcagctcgtactggtcggtgaagagcgcggtcgacggaacgccgacccgtcgcccgaggtccgctgagttcatggctgggatgctaccccctattcgtcaaagtgacgagatgtggggtccgtttatgcgcgggacccgcccgggtggcagcatgggacaggtgagcgttgctaccccgctagagatcgaacgtcctgattcggccgaggagaccttcgcggtccccgagccggacgtcccgtgggtgacgctcgtccacaatgacccggtcaacctcatgagctacgtgacctatgtcttccaggcctacttcggctacccgaaggacaaggcccaccgactcatgatggacgtgcaccagaagggccgcgccgtcgtctccagcgggagccgcgaggagatggagcgcgacgtccaggccatgcacggctatgggctgtgggccaccctcacccaggaccgcaactaggaccgcccgggctcaccgccccgccccgccctgccccgttcgacccaccatcggagaatccatggccggccatttcgaggccaccccaggcggcggcgcggccgtcgcgctcgacgaggtcgagatctccatcctgcgctccctcgccgtccagctgctcgaactgatcggccccggcgagacgcccgcggacggcgaggacccgctcgccgccctcttcgccgagggccccagcaggccgccgtccgacccggcgctcgcccggctcttccccgacgcctatggcggccccgaccggcccgccgaggggggaaagccggaggaggagctgcgcgagctgtcctccgagttccgccgcttcaccgagaacgacctgcgctccggcaagcgcgaggacgccgtcaccgtcgtccgcaccctggacgcactctcgcccaccggggacggcggcgcggtcctcactctcaccggcgacgagtgccgcagctggctccgctcgctcaacgacctgcgcctgaccatcggcacccggctggaggtctccgacgaggacgagggcggcgagggctcgctctaccggctccccgacaccgatccgcgcaagcccatggtgatggcctacctctggctcggcgcactccaggaaacgctcgtcgaagcgcttatgccgtaatgccgtaaggccgtgaacggagagggcgtccccccgccgcaccggggcgggcgccctctccgttcgctcaacggacgctcagatccgcataacgatcgcaccaagtgatccggccttttcgtgccggacagaaccccttgcccgctttttcctgtgtcgtgcgccacagaatgtcccaccatgtcccgtgacggccgtgataaatcttcacgaccacccggggacgccacccctgtttcccgggggcgccacaaaccggccgaacgccggcggcactccatccatatccggggggatcaggacctgatccgcagccttgtcgaggcgcggatcggcgtggagaaaggcgcatcaccatgacatcggcgcaggtcgacgacggacaggtcgacaagggtcggcccggcggcgacgccggggactccgggaccagtggcgagggataccagcgcggtctgggcgctcgtcagattcagatgatcgccatcggcggagccatcggcaccgggctcttcctcggcgcgggcaaagccatcgaccgggccggaccgagcctcatcctggcctacgtcatcgcgggcctggtcatcttcttcatcatgcgggcactgggcgaactcctcatgtaccgcccggtctccggctccttctcggagtacgcgcgagaattcctcggcccgttcttcggattcgtgaccggctggacctactggctcttctgggtcgtcaccggaatcaccgaagtcaccgccgccgccacctatatgacgtactggtggaacattccgcagtggctgtccgccctggtcttcaccgtcattctgtacggcgccaacctgatctccgtgaagctcttcggtgagctggagttctggttctccatggtcaaggtcaccgcgatcatcggcatgatcctgatctgcgcgggcgtcctcaccgtcggattctccgacgccggcgacaccgcgaccgtcgccaacctctggaacgacggcggcttcttccccaacgggatcaccggcacgctcatgacgctccagatcgtcatgttcgcctttctcgccgtggaactcgtcggcgtcaccgccggggagtccaaggaccccgagaccgtgctgcccagggccatcaacaccgtgccgtggcgcatcgccgtcttctacgtcggcgcgctgatcatgatcctctcggtcgtgccgtggtccaccttcaagcccggcgtctccccgttcgtgaaggccttcgaggaga

SEQ ID NO: 3829 - DNA, 1592 bp, Unknown
  Kingdom: Bacteria, Phylum: Actinobacteria, Class: Actinobacteria, Order: Streptomycetales, Family: Streptomycetaceae, Genus: Streptomyces
agccggtcagccggtcagcccacgatcggcgacaccgcgacgcagccgcccgccgtgagcatgccctcccccttcgcctccttgatgaccttgccctggtaggtgatggtgcaggtgatgtcggtgccgcccgcgtccacggccaccggcatgacggcgggcggcatgatgccgcgcagctcgacggtcttcttccacggcagggtcggcgaggtgacggtctccagctcgggctccatggcctccccggcaccaccgtggtaggtgatctcgtcgacgcccttgccggtgacctcgtacgtgacctcgtacttctcgtccacggtggtgtcgacccccttggcgatcgcctcgtccaccgactcggccgagcaggcaccgagcccgagcacgagaccggcgatcgcgagggcgtgggcagcggtgcccacgaggcgggtggttctgacggtgcgtgcggtgcggatggtgcggttcattccgggatcccccctggatcggaccgggcacggatctgttccgtacgcggagatcgcagggaaacgcagggaaatggcaaagtcaaatcccgctccgcacggctgcttcgcaggtcaaaggggactgtcagtggtgccccctaccgtcggggacatgctgctatctcacgggggagaaccctcgcccaccggtggaccggtggcgcgctggacggtggaacaggtgctggcactggctcctgacgacgcatcacgcgcggcgggcacgcggctcggcgcggccggtccgtggacgggtacgggccgcgacgccgcgggcgcggtgtgggggctgtgcaaggggagcggaagcacgccgtaccggacggtggtcgacaccaccggcccggcctactcgtgcagttgcccgagccggaagttcccgtgcaagcacgcgctgggtctgttgctgatccgggcctccgacgaagccgccttccggccgggcgagccggccgactgggccgcggcgtggatcgagggccggcgcggacgcgcggcggagaaggccgggcccgccgcgagcgccgacgccgcgcggagccccgccgacgccgccgccaggaagcgggcggagcgccgtgccgagcgcgtcacgggcggggcccaggagctggaacagcgcctggccgacctgctgcgcggcggactggccgcgaccgaccgctcggggtacggcctgtgggaggagaccgcggcccgcatggtcgacgcccaggcacccggtctcgcggcccgggtgagggagctgggcgcgatcaccgggtccggtccgggctggccggtccgtctgctggaggagtgcggcctgctgcatctgctggacacggcctggctcggccgggagcggctgccggacccgctggccgcgaccgtgcgtacgcgagtgggactgcccatgtccgccgagggctccccggtccgtgaccactggctggtcctcgcgcagtacgacaccccggacggcaagatcgtcgcccggcggatctggctgtacgggcgggagtcgggccgcacggctctgctgctctcgttcggcgcgccggggaccggcccgccgcgccgaacgagagc

SEQ ID NO: 3830 - DNA, 2715 bp, Unknown
  Kingdom: Bacteria, Phylum: Actinobacteria, Class: Actinobacteria, Order: Streptomycetales, Family: Streptomycetaceae, Genus: Streptomyces
ctcctgtacgtaacggagcacgccccacatggcgcgctcgacggcagcggcgtccgcacgcccggccccgtccgcgcgacaggcggcgaggcccgccgacagcgctgcggcatcgatacccgcgccgatcatgacgagctgggtgagccgctgttcgccgcgcgtccacgggcgggggacgaagcgcaggaaacggcccaccgcgtgcagcgcgtaggtgttgtcccggtcccccgcgccgaagtccgcgaaccccttgatccggtagagcccgtcgggccgggagtcgaggaactccatgaagcggcgcgggtccatggggatgtccgaggtgaagtcgacgctctcgtacgaggcgtggaggtggtcgtcgtgcacctcgtgcccatcgggcgcctcctcccgcagcaggtcctcgaaggtgagctggcggaacttgtcctcgtggtccggccgcagggccgggtcgaagaggagctcggggtcgatccggccgtgcacggcggagatcacggcggcggggccgctcagctccgcgacggccgctcgcagccgctcccgctcggcctcccccacccggtcggtcttgttcaggacgacgaggtcggcgacggcgagatggcggtcgatctcggggtgccgctgacgcgtgcggccgaattccgccgcgtcgacgacctcgacgaggcccccgtacaggatgtgcgggttgtcgctggccagcagcatgcggacgagttcctggggttcggccagcccgctcgcctcgatgacgatcacgtccagtcgggcggacggccgggtcagtgtctccaggaaggtgtcgagttcgctcgcgtcgacggcgcagcacagacagccgttgcccagcgagaccgtggagccgacctgtcccgagacggtcatggcgtcgatctcgatggccccgaagtcgttgacgatcacgccgatcctggtgcccgcgcggttgcggagcagatggttcaggagcgtggtcttgccggagccgaggaagcccgccaggacgacgaccgggatctgcggggtacggggcgaggtcaacgggggccttcctgggagcgtcgtcagggtgccgggaccggctgcggcgggggtgcgccgacgtagcgggccgccgggcggatgatcttcgagtcctccgcctgctccaggatattggcgctccagccgatcacccgtgccgcacagaaggtgggggtgaacatcgcgcgcggcagcccgcacagctccatgaccactccggcgtagaactccacgttggtgtgcagttcccggcccggcttgagctcggcgaggatggcctcgacctggccttccacctccacggcgaagtccgcgagcggtccgccgaagccctgcgcgagggacttgagcatccgggagcgcgggtcctcggtgcggtagacggggtggccgaagcccatgatgcggcggcccgagaggacctgttcgcggatccagccgtcgatgcggtccggggtgccgatggcgtccagggtgtccagggcccggctgggggctccgccgtgcagcggtccggagagcgcgccgaccgccgcgaccaggcaggcggccaggtcggctccggtggaggcgacgacccgggcggtgaaggtggaggcgttgaagccgtggtcgatggtcgagatgaggtactgctcgacggccctggcgtgctcgggctccggctccgacccggtcagcatgtacaggtagttcgcggcgtgcggcaggtcctcgcggggttcgaccggcgagagtccctggcccaggcggtggagggcggtgaggatcgtggggacggccgcgcaggcggcgagcgcgtcctcccgtcgctgctcggccccgatgtcgtacacggggcggaatcccgccgaggcgccgagcagggacagagccgtgcgcagtccggcgagggggccggacacggcgccggcgcgggcgatggcgggcagcgcctcgcgcacctcggcgggcagggtgcgcagtgcggccgtgcgggcggcgaagtcggcggcggccgcccggtccggcagttcgccgtggaccatcaggtaccagacgtcctcgaagccgcgggtccgcgcgagctcgatcgccgagtactggcggtagtggtagaagccctcgcggccgcgcacgtcgcccagggcggtgtcggtgacgacgacgccggcgagaccgcgggggacggcaggggtggtggtcatggctgttctcttttcgacgcacggaacattgattcgactgtctatgcttgacttgaattctgtcaacgttgattgaatcaatgtacggagcgggatccttggtctccctcatggattcaggatggatacggtggtcggcatgacggatcaatcagcgcccgacgagccgggggcgccccggctcaccacccgggaggccgccgaactgctgggcgtgaagccggagacggtgtacgcctacgtcagccggggccagctgagcagcgtgcgcgccgccggagggcggggcagcacgttcgacgccgacgaggtccggacgctggcccggcgctcgggacgccgggacacctccccggccgggagcgacctggccttccgcaccggcatcacgctcatcgagggcgaccgctgcttcttccgcggggtcgacgcgacggagctggcccggcgccacagctacgaggaggtcgccgagtggctgtgg

SEQ ID NO: 3831 - DNA, 3462 bp, Unknown
  Kingdom: Bacteria, Phylum: Actinobacteria, Class: Actinobacteria, Order: Streptomycetales, Family: Streptomycetaceae, Genus: Streptomyces
catgcgcatggtcgtggactttccggcgccgttggggccgaggaagccggtgaccgtgccggggcggacggtgaattcgaggtcctggacgacggttctgtcgccgtaccgcttggtgagtccgtgtgccttgatcatgcggtcgacgctacggagcggagaaacatggtgtccagctaaagattcttacgtatcattagcaatcatgacgtccgagcttcccctcgatcaggtgcggaccctgctggccgtggtcgacgaaggcacgttcgactcggcggcgaacgctctgcggctgacgccgtcggcggtcagccagcgggtcaaggcactggagcagcgcacgggccgggtgctgctgatgcgcacgaagccggtacggcccaccgagtccggtgaggtggtggtgcgcttcgcccgccagctggccaggctggagcacgacgcgcaggcggcgctcgggatgtccggtcccggcgagccgacgctcctgccgatcgcggtgaactccgattccctggcgacctggttcctgcccgccctgcggcgcgtgccggaggagctggggctctgttacgagctgcgccgggaggaccaggaccatacggccaccctgctgcgggagggactggcgatggccgcggtgacctcgtcgccggaggcggtgacgggctgctcggtgcgccgattgggccggatgcggtatctgccggtggccagtcccggtttcgccgaccggtggctgggacggcgggagggcaccgcgttgcgcgagctgatcgccgacgccccggtgatcggcttcgaccggcgcgacgaccttcaggacgccttcgtgcgcgggctcggccccgccccccgggcgagcgcgcggcgccacctggtacccacgtcggaggggttcgcgcacgccgtggcggccggcatgggctggggcatggtgcccgaggtccaggcggagcagttgctgagcagcggccggctggtgcggctcaccccggaccgcggcgtggacgtgccgctgtactggcagcagtggaagctggaatcacgggccctggcggccgtctccgaggcggtggcggcggaggccgccgaagcgctcgacagcgactgacccggctgagcggcacagcacccgcccccggaacccccgctcgccacgcctacaggcgattgccaccacggccggcgaggccctgcgcaccgccaccccacccgaaactgaggggcatcctgttcgacacggccgaggggctcgcgcaggctccgcgacggccggcccaggagggcctgaccgagcgcgtcgccctgaagaccggcgacttcttcgcctcggccccggtcggcggcgacctctatctgctcaagagcatcatccacgactgggacgacgagaggtgcgcggtcatcctgcggcatatccgcgaggtcatccccgaccacggctccctgctgatcgtcgaaccggtgctgcccgccaccgtgccgccggaccggcaggacaacgtctacctcagtgacctcgacatgctcgtcaacgtcggcggccgggagcggaccgcggacgacttcgcggccctgtgcacggcgggcggcttcgtcctccggagcgtgacacccctgcccgcgcccaacatcttccagatcgtcgaggcctcaccggtctgacgggccgcctcggaacgggtgcgcggcacgccttagaatggcgggcccttcccgcggaaaagactcggaggcgtcctccccatgcgtgtgctgctggtggaggacgacgacgacctgcgggacgtgatcgcctccgggctgcgggacggcggcttcgccgttgactgcgcgtcggactggccggaggcggacgtgctgctgcacgtcacggcgtacgactgtgtggtgctggaccggatggtgccctccggcgacaccctcgcgccgctggagagcaggcgccgggccggctggtcggtgcccgtgctgtgcctcaccgccctggactccctgcacgaacggctgcgagggctggagagcggggcggacgactacctgaccaagccgttctcgatgcgcgagctcgtcctgcgcgtccgaggcctgagccggcgggcgtcggcccggctcccctccttcctgagctgtgcggacgtggtcatggacgtggcacggcacgaggtgcggcgcggtggtgtgctgctgtcgctgagcccgaaggagtacgccgtgctccagcagctcctcgtccaccgggccgccgtcgtcacccgcaccgggctgctggaacactgctgggacgagatggccgacccggtctccaacgtggtggacgccgtcgtcgcgggcctgcggcgcaagctcggctcccccggcctggtgcgcaccgtgcgggggcaggggttcctgctgtcggcggagccggggccgtcctgatggcgaagcccccgcggcgtcaccgctccccggccaggaggcggctgcaccggctgcggctgcggctgaccgccgcgtacaccctgatcaccgtcgtcgggctggcctgcctgtccctgctggtgatccgtaccgacgaccgggcgcggttggacgccgagtacgacgagatgcgccgccgggcgtccgtcgcggcctcgctcgtctattacgaggacggccggatccgtctggacgggctcgacgacgacgaggcgacctcggggactccgcaggtcctggtgctggagggccggcccggcggggatccggtcacggtgttccgcggccgcaccgcgcagttcgccgtgccggccggggagatccgggcggcgacccgttcggcgatggccgaggaagggccggtgcggaccgaggcacgcgaccgcgcgggagagcccgtggctctgctggccgtgcccttctatcacgacgccaccgacgaggtggtcggcgcggccgtcgcggtcggcgatccggagcgcggggcggccgagcatcgcagtctggtcctctccctcgtcgtcggggcgggtgcgctgacctcgctggccgcgctgaccgggcatgtcctctccgcgcggagcatgcggccggcctgggaggcgctggagcagcaggagcggctgctcgccgacgcggcgcacgagttgcggaccccggtcgcggtgatgcgcggatcggtggaggtggccgccggcgctccgggcggcctggaggcgcatctgcctcggatccggcgggcggcggaccggatggccgacgtcgtggagaacctgctgacgcggggacggttggaggccgccgtggacgtcgtacgggcggaaccgctgcggctggaccaactcgtcgaggaggtgtgcgcggagctgccggagggcgggcacggcctggagtcgcggtgggaggagtcggtggtcgaggcggacgccgcgctcgtgcgggtcgccgtacggcgttgtccagcagattgcgcacggcgacccgcacgagcgc

SEQ ID NO: 3832 - DNA, 1728 bp, Unknown
  Kingdom: Bacteria, Phylum: Actinobacteria, Class: Actinobacteria, Order: Streptomycetales, Family: Streptomycetaceae, Genus: Streptomyces
gggccgggggcccaaggccccgggagggaacccgtgggcccggacgggccccgggttcaggtcgtggtgccgggccttccgcaggagcggaggaactcccgggtgcggcgggcgatggggaacggcttgtccggtgggcacggatacatgtcctgctccacgatcgcgaacaggtcgacgtccagggcgcgggccgcgtccaggaccggttccagggcggggaccccgcccggcggctcacacatcacacccctggccaccgccgggccgaacggcaccccgtccgccaccaccgtcgccaggatcttcggatcgacctgcttgaggtggaggtagccgatgcgttccccgtacgtctcgatgagcttgacgctgtcgcccccgcagtaggcgtagtggccggtgtccaggcagagcgagacgagatccggatcggtggcgtcgaggaagcggttgacgttctcctcggtgtcgatgtgggtgtcggcgtgcgggtggacgacgatgcgcagcccgaagcgctcccggacctcccggcccagccgctccgtctgcgcggtcagatcacgccactgcgctggcgtgagcacccggtcctccagcacctcgcctgtcttgtcgtcacgccagaaggaggggatgacgaccaggtgttcggcgcccatggcccgggtcagtccggcgatgtccgcgacatgcgcccacgtccggtcccagacgtccgggccgtggtgcaatccggtgaaaacggtcccggcggagaccgtgagcccccggtcgcgggtctcgtcggccagccgggccgggtcggtgggcagatagccgtacgggccgagttcgatccacgcgtacccggcctcggccacctcgtcgaggaagcgctgccacggcacctgcttcgggtcgtcgggaaaccacacaccccaggagtcgggggccgagccgatacggatgcgggccgaggagcggacggagggggtcataacgcccagcctcacgggccgtgcggaggagtgtcaagggttcgtccgaatgtccggacaaaatattgacagggttcccgggaggggactagacctgggaccagccggccaccggtgggtcgaagggatgggcatgcctgagccgtacgacgtgatcaccatggggcggatcggggtggacctctacccgctggaggtcggggtgccgctcgcccgggtcgagacgttcggcaagttcctcggcggttccccgacgaacgtcgcggtggcggcggcccggctgggacggcggacggccgtgatcacccggaccggacaggacgccttcggcgcgtatctccaccaggaactggagcggttcggcgtggacgcccggtgggtgagggccgtggaggagtatccgaccccggtcaccttctgcgagatcttcccgccggacgacttcccgctctacttctaccggcagcccaaggccccggatctggagatccacgcgccggacctcgacctggacgcggtgcgcgacgcccggatcttctggatgacgggcaccggcctcagcgccgagccgagccgctccgccacgctggccgccctcgcggcgcgcggtgcgaggacggccggcgcccgcccggccggtgcgccgcgtacggccaccgtcttcgacctcgactggcggcccatgttctgggacggcggcgacgacaacgccgaggctcccgcgcggtaccgcgaggcgctggcc

SEQ ID NO: 3833 - DNA, 4521 bp, Unknown
  Kingdom: Bacteria, Phylum: Actinobacteria, Class: Actinobacteria, Order: Streptomycetales, Family: Streptomycetaceae, Genus: Streptomyces
ggccggtgcccgcgtccggaacgggagtcgcgtgcgcggtcggcggcatggacgccgccagctcccggatccgttcgagatcctccgcgctcaacggcccgatccgccaggcgtcgtggtcggtcctgctcagtcccgggagcaggaggccgcgggcgacgaactggagggcgagaagcgcggcggcgccccagaaagcggtggcgggtgaggcgtccgcgacggcgcgtgcccgggtgaggaccggcagagcgtcctgtacggggaggcactgcgccgtaaccgcacggggtcgcaggtcgggtccgacgatggtcagctccgacaaggtcccgggagtgtcgaaaggggtgctaccgtccggattccagaacgcgatcctgccggtacgggctggatccgcggggacgaagaccgtggagcagcgggacagttcggcgatctcggagggcgttgccgcagggtgcctgtgcacagcgatgtcagattcctcaaatttgactagtgggcggagtcgccgagggtactccaattcgagcgacgacaggccgtaggcctatgtgacgtgtgtcactccttcttctgcccggtcccgatggtgcagccagccccaccatcgggaccgggggtcttccccaggggaaccagggtggtggcgccatggtccccaccggcccccggtccgtacgttcgatgaggtcagcgcatatgttccagagaccggagacgtcatgccccaggcgacagccactgttgcggatcccgccgacgaaagcagtccggaccttccggtcgacgcgcgcggggcggcggccggaagcgacttcgcaccgctgctgcgtgcggtgcgggaccaaggcctgctggagcgccgcacggaccggtatgtgctcggcatcgccgtcaacctggcggccctgggtgcggtgatcaccggcttcgtcctgctgggcgacacctggtggagcctgcttctcaccctgccgctggcggtcctgtggacccgtacggccttcgtcgcccatgacgcggggcatgcgcagatatccggcgaccgcaggacgagccggctgatcggtctcgtccacgccaatctgctcctcggtatgaacgaggcgtggtggaacgacaagcacgtgcgccaccacgccaacccgaaccacatcgacaaggaccccgatgtcggagtcggcgccctggtctggacccagaagcaggcggcacagcgtgagggattcgcccgctggctgaccaggaaccaggcccggctgttcttcccgatgctgctgctcgaaggcatcgcgctgaagatctacggatttcagttcctgcgccgtcagcccctgcgggagcgagccgtctcggcactgctgctgaccgcgcacttcgccctctacgcgacgctgctgctcagcacgctgtccccgggcaaggcgatcgtcttcgctctggtgctgcacgcgctgttcggcctccacctgggcatggccttcgccccgaaccacaaggggatggagatgcccgaccccgacggcgagcgctggggtcacctccagcggcaggtcctgacctcgcgcaacgtacgcggcgccgtcctgacggactggttcctcggcggactgaactaccagatcgagcaccacctcttcccgagcatgccccgccccaacctgcgcctcgcccagcccttggtcaaggcgcactgctccggtatcggcatgccctatgcggagaccggactgatcgagtcctaccggcaggcgctgtcgcacatgcacgaggtcggagagccgctgcgatagcgcggcacgcggggaacgtaagggcgcgcggacgcgttcacacaacaggagcggcgccggccgcgaaggaggcgtggaccatgtcgaatggtgcgaaggtcgctatcgggggagtgctcgcggcagccatcctgtggcccctgatcggattctggtgggcgctgctgatcgtgatcggcgttcccgtggcgggctatctgctgctggacccgtcccagcggcgcaggctccgcaggatcaaccgcaaggagatcggtcgctgagcacgcgggcgtcacatgggccggacggccagcccgtccagcgctgtgagcaggccgggcagcgcggctccacggccgaccggaatcaccgtgcccggctcctcgtccagcaggaacagagcgatgtcgtcggtccgggccaccatcgaccaccccggaccgtcgacgcgcagggtgcgtgcgtcggccgaggcgtacgaagaacggatccgaccggggggcggcggggccttcgtataggcggttgcctgcgcaagggccctgcgcacaccggggtgccggagggacgaggaggggtcgctctccggttcgtcctcggcacccttctccggctctcccccgtcgcgcggccgtgagaaccgcgcgtcgtcgagctgctcgcgccacaccgaccactgcgcggcgatctcgtccgcccccagccgccgctgagccgggccccaggcctccgcatcgggaggggtcagcggaggcgggccctccccggccgtctccggatcgtgcggttccggcacgccgggcgcggagacggccaggtccatcggccagcccggcagcgcacacaccatggagcgttcgtcgggggagaggtcgtgctccatgccgcagtcccacgcggcgatggcgccggccacctgggcggcgtcctcgacgaccacggtccaccgagccccctcgccgtcctgaccgaggacgagcccgtagccctcctcatacggttcgagtgcgagcgcgccgcacgcggccacgtagtcgtcccccagcacgctggggaaccgggcgggtgtcagcagcatcgcggtcagcaccagcagcgcgtcgtcggcgaccgcatcgtccgcaccggccacgctgtcctccccatcgctcatcgcccgtccgcccatcgctcggtcctgcgtcccttggtccgtcggcgcaccctaactactcggtaaccccctcgtcgaggccccgacgggcaggagcgaaccggcgccgtgcccaccccgttcgggtgcgggaagccgaaggtccgggcgtgggggaggcctccgcgtaaggttggatgtccggccgaacgagggggagcagcgtggtgaagcggtacgaccggctgaaggagattcagcgactggaccccgaacgggacttcctggagatctaccgtctcaccgtcacccacgagttcccctgggacatcacccgtgccctcgaactggccctctaccgcacctatgccgtgcccagcatcggtcgacttctcgatgagacagcggagttgacggagcgttcccagaaacgctacgacgacaccgccctgttgctcgacacagtggtggagcacggcttcgactccgacgacggccgcacggccgtccgccggatcaatcggatgcaccgcagctacgacatcagcaacgacgacatgcgctacgtcctgtgcacgttcgtcgtcaccccgaagcgctggctggacagtttcggctggcgacgcctgtgctgccacgagctgggcgccttcgccgcctactaccgcacgctcggtgcccatatgggaatcaaggacgttccggagacctacgaggacttcgagcgcaccctcgacgcctacgaggacgagcacttcggctgggacgaaggggcccgtcgggtctccgacgccaccctggcgttgatggggtcctggtatccggcgcccctcgccccgctggtgcgcggtgccagcctcgcgctcctggacgactcgttgctgagggcgttccgctaccgccgccccgggccggtggcccgcggagtgaccaggggcgccctcaggctccgggctcgtgccgtccggctcctgccgccccggcggaagccccactacgcgcgccagaaccccgagatcaagggatatccgaacgggtacgagatcgcggagctcggtacgttccccacgccgggcatccgtggctgcccggtccccggccatcggccgtcgcagccgcccgccgagtgaggcggcgggccccgaccggtccatgtgccgggcacggacgcttcctgtacggcggcgggcccggccgcgcccgccgcctcaggcctgcctgacggcgagggcgagaaagcggtcgtcctcgtcggtgtaggactccagcctccaccccgcaccggccagcagcgcgcgcagcctgggctcggcccgcaggtcctcgtcggtgacgatgcgtccctggcgcgcggcgagggcggcccggccgatcggatggaacagggccagcaccccgcccggccggaccacgcgggcgagttccgccgcatcggcctcggggtgggccagatgcgagatcagccccgcgccgaacaccgcgtccaggactccgtcacgcagcgggagccgcgcgacgtcggcacggacgagtgccccgctgtcccctcgccccgcccgcaccgctgcctccagcatggccggagtgaggtcggctcccagcacc

SEQ ID NO: 3834 - DNA, 2615 bp, Unknown
  Kingdom: Bacteria, Phylum: Actinobacteria, Class: Actinobacteria, Order: Streptomycetales, Family: Streptomycetaceae, Genus: Streptomyces
  misc_feature (177)..(246): n is a, c, g, or t
gagcggggcgacgggcagcacggtcatggcggtctccggggacggaagaggcgaggggcgctgccgggctgtcgcggggtgcgacggcccggtcccttacttcttccgtcaccggctggattcgacgtgaccgttgtggggagcggggatgtgcgacggctgaatccccagggacgnnnnnnnnnnnnnnnnnnnnnnnnnnnnnnnnnnnnnnnnnnnnnnnnnnnnnnnnnnnnnnnnnnnnnncttgatcgggttctccgcctcaactctggcccactgggacgagttgggggtggcacggccgcgggtggcgccttcggccatcgccgcggtgccctcgtcgccctcgatgacatgggcgaggctcggcttgttggggacgtagctcatgccccgggccagctccgtctgccacttctcgctcgccagcgccttgacgacggcgatgcccgcggtgcgttcgtcggccttcttcgggacgatgaggtcggagccgccggtgaataccgaaccgggggtcttcgaggacttgccgggaatggggaagtagccgagctttcccttgagttcgggattcttctgctcgatgagcgcggcgctgcccgggaccgagatgatctgggcgacatcacccttggcgaagacgtcggtctgcgggggcttctcctcgtcggcgtccgtcgggccgtcgccgagcgcctggagtttctggtagaactccatgcccgccagcgcctccggggtgtccagggcgccctgccagtcgccgccgttctcgtcggcgagttccccgccctcgtcccagatgaagccggcgagcacgtaccagttctgacctgccaggtaaatgccctggttgcccgcgtcgttgagcttctcggtggcggcgatccactcgtcgcgcgtcttcgggacggagtcgatgcccgcctcctcgaagatctccttgttgtagatcaccacccggttggccgcgtaccaggggatgccgtactgcacgccgttgatgctgcccggctgggcgaggccgggcagccagtcctcgctgcccaggtcgcgcatcgattcgagggtcagatcgcgcaggccgccgctctccgcgtactgcgcgacctgcgtgttccctacctcgatcacgtccggggcgtcgtcgccctccagtgcggagatgaccttggggccgatgccgctccagtcctggatcttgaattccagctcgatcgaggggttctcctcctcgtacgagcgggtgaacttgtccaggaagccgggcgagacgctgtccttcatcagccagaccgtcaccgtgcggtcaccgctgcccgagcccggtatgaagccgcatccgccgagtgcgacggatgagacaagcgcgatggctccggccagtatgcggttcttcacgtggtcaccttctgcgaaacggcacaacgaaatcgggacccggtgtggggggattgcgggcggcgctcgcacgggtggttggctgaattttggtatggaccaatcagtaggtcaaggcgggctctcgcctcgacgcacctcaccctccccctcgcgggagacctcggattggggcaacgtggtcacaggaaaggagacaaaccatggggaaccacacctatcgagtcaccgagatcgtaggaacctccgaggagggcatcgacgcggcgatccggaacggcatcgcaagagcggcggaaacgttgcacaatctcgattggttcgagattgatcaagttcggggccatatcgaagatggccgaatcgcgcactaccaggtcgggctgaaagtcggcttccggctcgacgaaagcgcctgatcaggtacgcccctcacgctcctgggcatccttcagcgctgccgacgggtcggcccagcgggcccgtaccacggtaaatccggccacctgggccgcgtcgcagaccagctcgtcgtcgtccacgagcatgcgcacctgacccttccgccccagctgccggaggatgtccagctttgtccggcgggcgggccgccggtcgtcgttgcgccgcatgaacagcgtgccctcgggcagcccctgccgactcagccagcgcacggtgtcgcgacggcaccgctcgggccgtccggtcagatagacgatgcggcactcctcggcgctcgcgagcaccatccgtacgccctccacgagcggcgggtcctccacggccgcggcgaagaaaccggcccagtcgcgcttcgggccctccaggaagtgctgccggtgggcggtgtccgcgagcgtgccgtccaggtcgaatacggccagcggccgtgcgtcgttgtccactcccccagcttagaaagcccgtcggttcccggcgtcggtcgtcgccgggaatcccgggagagcgtcggtgctcacgggaatcctggaggagcggcggtgttgatgagagcgtgacgtctgtgatcgcctcgacccgcttctccgtcctggaccgttctcgcacccgtgaggggcacgacgcgccccgggcactgcgcgacaccgtggacctggcccgggaggcggaggccctcggcttccaccgcttctgggtctccgagcaccacggcgtgccgggggtcgcggggtccgcgccgacgg

SEQ ID NO: 3835 - DNA, 1622 bp, Unknown
  Kingdom: Bacteria, Phylum: Actinobacteria, Class: Actinobacteria, Order: Streptomycetales, Family: Streptomycetaceae, Genus: Streptomyces
gcagcggcgtctgggtgctcggcgacccgggaggtctccacgccgaagtcggcggccgtgcggatcaacgcgtcctccagccggcggacgtgcgcgacgacgtcgaccgggcgcggcagcttctggatcgggtagccgacgagctgcccgggaccgtgccaggtgatcttcccgccgcggtccacgtcgatgaccggggtgccgtccagcgggcgctcgctctccgcagtgcggcgccccgcggtgtagacgggagggtgctccagcagcagacaggtgtcgggcacccggtcctcgaaccggtccgcgtgcacctcgcgctgcttctgccaagcctccgtgtattcgacggcctgttcgccgaagcccagacggacgaaccgcagttcgctcaccgatgcctccctacgtgggccccgcgtgcccggaggggtgtccccggggtgacggcaccctgcactgatcgcgcccgcatccactgtacgaccgtcgcccggacggccccccggcaggttcggcgacgggtgcgggaggtcggccccgggctcgtccgcggcccggtccggaccgtccacaggccggacgtttccgtcagctctgtccggaatcctcacacgatcggatgaacgtggagcaaagggggacggtgaccgctccggtggccgctaaattcgcgccgttcccatgagggctgcccgtccggccccgaaggcaggagaccgtacagctgatgtcggaacgacccccgcagcgcacacccaaccgtcgactcgcctcactcatcgcggaagccgggttctcgcacgccggcctggcccgccgggtcgatcagctcggcctcgaacacggcctcgacctgcggtacgacaagacctcggtcacccgctggctgcgggggcagcagccgcgcggcaccacgcccgcgctgatcgccgaggtgttcacccggcggctcgggcggcggctctccgcgcaggacctcgggctcgacgcctgcgcacccgtctacgcgggcctggagttcgcggccacccccgccgaggcggtcgacatcgtcagcggtctctggcgcaaggactccggcacccacgtcgagctccgcaagatcgccttcaccccggccggactcgtcgtccccagccgggactggctgatcggccgggccgacgaatgggtggcccgggacggcgccgccgcccgccggaccgggggagaggccgggaccccctcacccggccgcccggacggggctcagcgcaccgaggtccggggactgccgcgcccggccgccggaccgctgcggcccacgcccccgggcccggccgccacgcaccccgccgccacgcacccgcccgccggtgggctgcccgtggtcccgcgccagcgccggacggaccgcggccccggccagcgggtcggcggcggggacgtcgccgccctgcgttcggtcggcgagctgttccgcaccctcgaccacgcctacggcggcggccacgcccggcaggccctcgtgcggtatctggagcacgaggccgaaccgatgctccggggaacgtacggcgaggccaccggacgtcggctgttcgccgcggtcgccgacctgacccggctggccggctgga

SEQ ID NO: 3836 - DNA, 6845 bp, Unknown
  Kingdom: Bacteria, Phylum: Actinobacteria, Class: Actinobacteria, Order: Streptomycetales, Family: Streptomycetaceae, Genus: Streptomyces
atggagacgccgagggcggccgcggtgagggcggcgacgccctccgcctcgacgcccggggtgtcgtgggccaggaccagcccgtcggtggaggcggccagcgccccggagagcagcgggacccgggcgcgtaaccgctggagctcgtcgaggacatcacgcgcttcggcctcgggcaccatcagctgtctcctcccggcacgctgtctgagcgcgcgtatcacaaggcctccaatgcgtctcggagccggcgcagcagggcgatatcggggtcggcggtcacctcggggagcgtgatccggccggatgcggacgaggccggcaagggttgggcgcggaccgcctccaccaggccggccgccgcgaggcgccgcaggtcgaccaggatgtggaatgccgaacgtcccagcgcccgcgcgatgtccgaggccgtgcggaccccgtcggccagctccaggagccggcgctgccgggccggaaccggcgcgtcggtcgggtgcgcggccgtccgcaggagcggggcgctgtcgcaggcggggtcgggccagatccggtccaggaactcgcgtctgcgcagcgtctcgcgctccacggcggccaccgggacgggccgcacggggccgatccagtgcgccaccccgtagcggaagcgggcgggcgtcccggtcggggcgagcgcgaagaacgcggcgtcgtacagcgcgccgagatggcacaactccagtgctccgcccggcacatgaccgctgtccacgagatagcggccgacccgtcggtgtgccccggcctgcgccacggcgtcccaccagccctcgtgccgcagggtcccgccggtggtgagcaggacgtcgatgccgggggtggcggggctctcggcgtgcaccacctggccgtcggcgaggtagagcgtgccccggtcgcgcatcagggcgccggtggcgcgctcggcggcgagacgccggagcatcggggagagcaccgggagccggtccgttccgggggcgtcggggtcggcggctatcgcgctcatgccagcaccaggcgctcggccagctcgccgaggcgcattctggcgagcgcgagattgccctcggagcggtccagccacagatgcaggaagacgctgctgtcgaaggccgtctcgacgaaccggagcatgtggtacccgtcgcgggtggtgacgatgacgtcctcgacgggggtgctcggcgcctgtccggggtgctgtgcgccgccgtccgcggcgaggcgggcgaaggccggctgctcggcggtcatccgggcgacctccgccgtctcggcggcggtcgcctcgtggtcgccgttgggggattccccgatggtgccgagggcgagaccgctcgtccagtcgaccaccgaggcgccccgggcaccgggcagcctcatgacttcgagcaggcactcgtcgattccgggcacgcggatttcccctcccgacgtggcgtacggctgtaacgcagaggctacgcaacgtgcttacggcaggtggaggttctggcattttcctttggtacatgcggcccgcggtgaaaggagcggccggaacgtcctggcggtgggcggcgtcccgtcaggcgtcccgggcgccggacctctcgcgggccgtcatcacggccttgttgagcacccacagcccgatcccgatcagcagcaggatcccggcccggacgtacacgtcggagccgcggtcggcgagcgggctcgccaggatcagcgaggtgagcgcgccgagcaccggaagcgccgtgggcgtacggaagtggcggtggtccacccggtccttgcggagcaccagcacggcgacgttgacgacggcgaagacgcagagcagcaggaacgaggtggtgtcgccgagcccctcgatctcaccggtggagaccaggccgatggccaggagggagacgaagacgatcccgacccacggggtgcggcggccggccagcaccttgcccatcgcgggcggcaggatgcgctcgttggccatgccgtagcagagccgcgaggccatcatgatgttgatcagcgccgagttggtgacggcgaacagggcgatcagcgcgaagagtttcggcgggaaatcgacgcccccggccttcaccacctccagcagggggccgctggagcccgcgagggtgcgggagtccaccaggagcgaggagaccagggcgaccaggacgtagatggtgccggtgatgcccaccccgatgaagatcgcgcgggggaaggcgcgggcggggttcttggtctcctcggccatgttcaccgagtcctcgaagccgacgaaggcgaagaagcccagcgcggtggcgccgagcaccccggtgagcagggcgtacccggtgccgccggtctcgatctgggtcaggcgcgagggctcgccctcgccgctgaacacggcgtacgcgccgatcgcgaggatcaccgcgagtccgctgacctcgaccagggtcaggacgacgttcgccttcaccgactcggcgaccccgcggagattgatcgcggcgagggcgaggacgaacaggatcgcgatcagggtcggcggcaccgcgtcggtgaactcccccaggtagtcgccgctgaacgcccgcgccgccgcgctcgccgaggagaggcccgagcacatcaccatgaaggcgacgacgaaggtcaggaaggggaccttgaacgccttctgggtgtagagcgcggcaccggcggccttcgggtacttgccgacgagttccacgtacgaggcggccgtcagcagggcgacggcgaaaccgatcgcgaacggcagccacagcgcgccgccgaccttgcccgccacgttcccggtggtcgcgtagatgccggtgcccaggatgtcgccgatgacgaagaggatcagcagtttggtgccgagggcgcgcttgagcggcggtgatcctccggggatcccggggtcgccggtcgtgggggtgtcgcgagtgctcatccatgcctccggtcctgcttccgcgtggctaggcagaacctgttcccggtcgcggcgcgaaccgcacctgttgactacgactattcagagcatcaggatgtgaatagattttcaccatcgcgaggaggcaccgccatgtcaggaccccgccccgtacgggcaccgcgcggcagcgcactgaccgccctgggatggcagcaggaagccgccctgcggatgctgcagaacaacctcgaccccgaggtcgccgagcatcccgacaagctcgtcgtctacggcggcaccgggaaggccgcccgcgactggcgctcgttcgacgcgatggtccgcaccctggagacgctcaagcaggacgagacgatgctcgtccagtccgggcggccggtcggcgtcatgcagacccacgagtgggcgccgcgcgtgctcatcgccaactccaacctggtcggcgactgggccaactgggaggagttccgccgcctggaggcgctcggactcaccatgtacggccagatgaccgccgggtcctggatctacatcggcacccagggcatcctccagggcacctacgagaccttcgccgccgtcgccgcgaagaagttcggcgggacgctggcggggacgatcaccctgaccgccgggctcggcggcatgggcggcgcccagccgctcgccgtcaccatgaacgacggcgtcgccatctgcatcgactgcgacccgcgcgccatcgagcgccggatcgagcaccgcttcctggacgtgcgggcggacaacctggagcacgccctccagctcgccgtcgaggcccgcgacgcccgccgtccgctctccatcggactcctcggcaacgccgccgaactgctgccccggatgctcgccgagagcgcgcccatcgacatcgtcaccgaccagaccagcgcccacgacccgctggcctacctgccgctcggcgtcgacttcgacgacatggccgacctcgccgccgacaagcccgccgacttcacccagcgagcccgcgagtcgatggcccgccacgtcgaggccatggtcggcttcatggacgccggcgccgaggtcttcgactacggcaactccatccgcggcgaggcacggctcgccgggtacgaccgcgccttcgacttccccggcttcgtccccgcctacatccgccccctcttctgcgagggcaagggccccttccgctgggccgcgctctccggcgaggcgtccgacatccacaagaccgacaaggcgatgctggagctgttcccggagaacgagtcgctgcaccgctggatcaagatggccggcgagcgcgtccacttccagggtctgcccgcccgcatctgctggctcggctacggcgagcgcgacaaggccggcgagcgcttcaacgacatggtcgcgagcggcgagctggccgcccccctggccatcggccgcgaccacctggactgcggctcggtcgcctccccgtaccgcgagaccgaggccatgctcgacggctccgacgccatcgccgactggccgctgctcaacgccatggtcaacgtcgcctccggcgcctcctgggtctccctccaccacggcggcggcgtcggcatgggccgctccatccacgcgggccaggtctccgtcgctgacggcacgaagctcgcgggcgagaagatccgccgcgtgctgacgaacgacccgggcatgggcgtcatccgccacgtggacgccgggtacgacatcgccgagaacgtcgccgccgaccagggcgtacgcgtccccatgacggagggcaactgatgcccacgggcgcatccggcacttcctccgccacctcttccggcacccgggggcagtggcgcgcgggggactccttcctctcgatgtggcgggagctggcccccatcgggcgccactccgacagcggtggctaccggcgctacgcctggtcgccggcggacctcgactgccgggcctggttccgcgcgcaggccgaggcgcgcggtctcgcgtacgagagcgaccgcaacggcaaccagtgggcctggctcggcgaccccctggccggggacgccgtcgtcaccggatcgcacctggactccgtcccggacggcggcgccttcgacggcccgctcggcgtggtgtcctccttcgccgcgctcgacgaactccaccgcaggggagtggagttcacccggccgctggcgatcaccaatttcggtgacgaggagggggcccgcttcggcctggcctgcgtcgggtcccggctggccgccggacagctcgccgtcgccgacgcccaccggctgcgcgacggggacgggatcggcctgcccgccgccatggaggccgccggatacgaccccgggaccatcggccccgacccggaacggctcgcccggatcggcgcgttcgtcgaactccacgtcgagcagggccgcgcgctcgacctgaccggtgaccccgtcggcatcgcctccgccatctggccgcacggccgctggcggttcgacttccggggcgaggccaaccacgcgggcaccacccgcctcgccgaccgccgcgatccgatgctcacgtacgccgagacggtgctcgccgcccgccgcgaagccgaactgaccggcgctctcgccaccttcggcaagatcgcggtcgagcccaacggggtcaacgccatcccctccctcgtgcgcggctggctcgactcccgcgccgccgaccaggccaccctcgacgccgtcgtcgacggaatcgagcgcgccgcccgggagtacgccgagcgggccgggatcgacctcgacgtcgtgcgcgagtcgttcacgcccgtcgtcgcattcgagcacgccctgcgcgacgagctcggcaagatcctggaggggagcggcgacacggagcggcctgtacccgtcctcggcaccggcgcgggccacgatgcgggtattttgtccgcctcggcgcccaccgccatgctcttcgtacggaaccccaccggcatctcgcactcacccgccgagcacgccaccgaggacgactgcacggccggggtcggagcactcgccgacgtactggaaggtctcgcgtgcagctgacacaccggacgacgggcgcacccgtcaccgcgacgtactggatggaccacgcctggctcggcacccacgtcgagccgggcgtcaccctggacgtcgcggacggccgcatcgccgggatcaggaccggggtcgagacaccgccgcccggcgcgaccgtgctgcgcggcctgaccctccccggcctcgccaacacccactcccacgccttccaccgggctctgcgcgccaccgtccaggtcggctcgggcaccttctggacctggcgcgagctgatgtaccggacggcctcccggctcaccccggacacctacttcgacctggcccgcgccacgtacgccgaaatggccctggccggcatcacctccgtcggcgaattccactatctgcaccacgctcccggcggcaccccctacgccaaccccaacgccatgggcgaggcgctgatcgcggccgccgccgaggccgggatccggatcaccctgctggacaccgcctatctcgccgccggattcggtgagaagcccaaccgccaccagctgcgcttctccgacaccaccgccgaggcctgggcggagcgcgcctccctcctcaagggcgacgaccacaccctcatcggcgcggccatccactccgtccgggcggtcccggccgaccggctggccatcgtcgcgcagtgggcagaggagcggaacgcaccgctccacgtccacctctccgagcagaccgcggagaacgacgcctgccacgccgcccatggccgcacccccacccggctgctggccgac

SEQ ID NO: 3837 - DNA, 3418 bp, Unknown
  Kingdom: Bacteria, Phylum: Actinobacteria, Class: Actinobacteria, Order: Streptomycetales, Family: Streptomycetaceae, Genus: Streptomyces
gaggccgcggcgggcgcggccatcgccacgggcgaggcggagatcaccctggagacgctggaggcgaccgtcgaccgcgccgccgtgaagtacgaccgggacggcgaccagcactacgacgtcgccagcgcgctcatcaagtcgatccgcggctccgacgtggacgccgctctgcactacctggcccgcatgatcgaggcgggggaggacccgcggttcatcgcccgccggctgatgatctcggccagcgaggacatcggcctggccgatcccaccgcgctgccgaccgccgtggccgcagcccaggcggtggccatgatcggcttcccggaggcggcgctcaccctcagccacgccaccatcgcactggcgctcgctcccaagtccaacgcggcgacactggcgatctccgccgcgcaggacgacgtgcgcagggggctcgcgggacccgtcccggcccatctgcgcgacggccattacaagggcgccgccaagctcggccatgcccaggggtacgtctatccgcacgacgtgcagggtggcatcgccgcccagcagtacgccccggacgcggtccgcgaccggcagtactacacccccacccgctacggcgccgaggcgcggtacgcggacgtcgtcgagcgcgtccgcgagcgcctcggccgttccggcgagagcgcggagtcgtcctagggcctcccggccgcgggatcaggacgcggccgcctcgaagagcgtgtgcacggcgcggcgcagctcgatgatgtcgcggaccggctcggggaactcgaagcgggcgtcgaagcaggaaccccggtcctcgacgaagcggacccgcagcccgaagcggtccagggcgaccggcacggccctgggccggtgggaggagcgggcgcgggcggtgcgctcgcccagcagagcgcacagggtgcgcatctgctcgtcgtgggcggagtgcaggtgctggagcagctccggctcgtggaagaccagcggatcgggagccgcgtcccggaagtcctccggctcgatgtcctcggcgccccagaggtcgtccacgtacgcctcgccgaactccaggcgcagcatcatccggccgggctcggccaggccggggacggaggtgagccagccggagatccacgcccggccgcggatccggtgcggtacggagaccggagcgacgtccgtgatctccagcacggcggtcagctcgtcgccccgcgcgtgcgtcgcggcccgaacggccggggaatccgcggggaattcgaggaacaggtcgccctcgggccccacgctcctgctgtccgggatcaggggttcggcgcgggccggatcgagccctggtacgacgagcagcgcggagcaggtactctgtacgagagttcgtgtgcgctcggctgctgacggcatccgagtgttttcaagcccgctgggacgcggctgaccacgatcagatcggccttccgtcgtagcagcaccttctggtgtgctgccgctgtctgtgctgtccgtgacgtgagtggtgttcccagggcgagacatgcgatctccttgagtaaggtaagcctaacctaacctacaacggaggtctggagaacgtgcctaaccagtcgcgtcccaaggtcaagaagtcgcgtgccctcggcatcgctctgacgccgaaggctgtcaagtacttcgaagcccgtccgtacccgccgggcgagcacggccgtggccgcaagcagaactcggactacaaggtccgtctgctggagaagcagcgcctgcgtgcgcagtacgacatcagcgagcgccagatggcgcgcgcctacgaccgtgccaagaaggccgaaggcaagacgggcgaggcgctggtcgtcgagctcgagcgccgcctcgacgccctggtcctgcgttcgggcatcgcccgcaccatctaccaggcccgtcagatggtcgtccacggccacatcgaggtcaacggtggcaaggtcgacaagccgtccttccgcgtgcgccccgacgacgtcgtccaggtccgcgagcgcagccgcaccaaggtccccttccaggtggcccgcgagggtggctacgacaccgacggtgagaccccgcgctacctccaggtgaacctgaaggccctggccttccgcctggaccgggacccgaaccgcaaggagatcccggtgatctgcgacgagcagctcgtcgtcgagtactacgcccgctgatccaggcgtagccgctctcaccagcgctccggcccgcccctccctgtcatccgggaggcggcgggccttcgcgttcccccggctccgcccgatgccggcgccccacccgtgcccggtccgtccaccgccgaggccggtccgccgccggccagggcccggtcgaccgcggcccccggatccagtcggcggcccgctcgcagcccctcctcgtacgccgcgctccccagctcccggcgcgcctgctcctcgcactccgcccgtggccgcccgtagaacgccgagccgaacagctgcagacccaccgacggccagatgccctccgccgctccctggagcacggcggcctccccggcgtccccctccaccaccgtcaccagggccagcagctccagcgacagcaccgtgcccagcagatcgttgaacgtccggccgatcgtcaggcactccccgagcatctgccgcgcccgggccggccggccccgccgcagcgccgcgtacgccaggacgtacagcgcgtacgccagcgcccaccgctccccgtggtcctcgcagatctcccggacctcgtcgcagatcgccgccgccgcgtccagatcgccgaggaacgccaccgccatggccagctccacctgcgccatcagcacattgctgttcagttcgccgacctcgcggtaccggcggagagcttcgcggagcagctcctcggcgcgcggcaggtcgtccgtcacgatcgccaggcaccccatgcggtgcaccgcgtacgccagtgccgtcgcgtccccggagcgctcggcctcctcccggcactcctggagcgccgagatcgcgccgaccgcgtcgccctgcagcacggccacatagcccagcacccacagcaccttcagccgtgcggcatcgtgcggggtcggttcctccaggacgtggtccagccagtgccggccctcggacagccgcccgcacccggcccagtagaaccacagggtgcccgccagatactgcgccagatgcacctcgtcggggctctccatcgaacactccatggcccggcgcagattgggcagctcgctgtcgatccgcgccgccacctccgcctggcgcggactgaaccagtccagctcgcaccaggtcgcgaggcccaggaaccagtcccggtgccgacgccgcagccgcggggcgtccccggcggctgcggcgtcggcacc

SEQ ID NO: 3838 - DNA, 2234 bp, Unknown
  Kingdom: Bacteria, Phylum: Actinobacteria, Class: Actinobacteria, Order: Streptomycetales, Family: Streptomycetaceae, Genus: Streptomyces
tgcccgcccaccgcgaacggtcacggggcgcagccacgcccggagccggacgtccgatcgcgagccggtccgccgacccgggcgacgccccctccggccagccggattgtcggtgcccggccacaacccgtcgcccccgtaggcagatcacgaagtaatccgatcaataaacggtcaccatgtgctacttgatacgtcacttagcgataacagaaacgacggaaccggtgatttagacaactgggtgtagtgctgcctgcacgaagcgttattctcctcagacgcatcacggagaccggcactcgctaccacgggtgacgtttttcgaactgctcgtgatggaagctctgcctctgggagtcccgtgtacccacacgtcggggttgacgcctcgggcctggctacgctgcgtgcatcggtcattgaccgcttgcgcggcttcgtccccaccgcgtacgccgtccccgcatttgccacccctgcacctgccggcccttgctacgcactggccgaacgcagtgcggcggtcggaagacgcggcacccgcgccgcctcgaccacgtcgaccgtccgccgtcccaccgccgacagcgacagcgcccgcatgatggatctcgtcgagcgcgcacaggccggtgaggcggatgccttcggccgcctgtacgaccagtacagcgacaccgtgtaccggtacatctactaccgcgtgggcggcaaggcgaccgcggaggacctcaccagcgagaccttcctccgcgcgctgcgccgcatctccacgttcacctggcagggccgcgatttcggggcctggctggtcacgatcgctcgcaacctggtcgccgaccacttcaaatccagtcgtttccgactggaagtgaccaccggcgaaatgctcgacgccaacgaggtggcgcgcagccccgaggactccgtcctggagtccctctccaacgccgcactgctccaggccgtgcggcgactcaacccccagcagcaggagtgcgtgaccctgcggttcctccaaggcctctcggtcgcggagaccgcccgggtgatgggcaagaacgagggcgcgatcaagaccctccagtaccgagccgtacggacgctcgcccgactcctgccggacgacgcccgctgatccgacctctgcgtgaccgtcccgtcacgcactggtccgatcatctttcgcgcgtaacccaagtgccgagcgactcgttgtgccggttgcaggccccctgtcgtcaccccctgtccgtagccactcactccatcgagtggaaacgctcaaggtgtgcaaccttccggaccgccaggggagtcgaccgtcatgacgagaggaggtgccgccagtgatcgcaaacgtttcggcacaccggcgggcgaacgccttcgcccaggccctggaagaacaacccccccagggtgcggcggccgtacagcccgcggagccggccgaccaggccgaccgcggaccgctgttggccctggcgaacggcctcggtgagctaccgaagccgcagttggaccccgaggtcaaaatggtgcagcgagcccagctcgtcgcggccatggaggccatgttcgccgagggcggcgcgtccacgggccctacggtgcccgtgcaacggggcaagggggcccaccgggcctcaccactgcggaaattgcgaccccgctcacgctgggcgaagggcctcactgccggcgggctcaccgtcggcgtggccgcgggagcgttcggcggcgtggccgccgccagctccgacgccctccccggtgattcgctctacggactgaaacgcgggatggaggacatcagcctcggcatggccaagggcgacgccgaccgcggcgaggtctatctcgaccaggcctccacccggctcagcgaggcccgcaggctcatggagcgcggccgctccggcgcactggaccacgaatccctcggcgccgtcagacgcgcgctcaacggcatgtcccacgacgcctccgagggccaccgcctgctccactccgcctaccagcgcgacggagcgatcggccccatccaggccctggacaccttctcccgctcccaccgcgacacctggagcagcctccgcgaccggctgcccgtccagctcaccgacgtccgcgacgaggtcagctccgtcttcgacgccatagaggacgaagtcgcaccgctccagtccctcctcccccgccccccgggcacgggaacggacaccgga

SEQ ID NO: 3839 - DNA, 3060 bp, Unknown
  Kingdom: Bacteria, Phylum: Actinobacteria, Class: Actinobacteria, Order: Streptomycetales, Family: Streptomycetaceae, Genus: Streptomyces
acggagggccggatcaccgcagaactgcgggccccgtccccggaccggacggcggcccgcagttcggcggtgatccggccctccgtgtcggcgtacgcgtcggagacggcggtcaggtcctggtggcgggcgaccacgaggcgcgcgcccaggccttcggagaccttcgccgcgaaccgggacaacgaccgctggtcgggcggcaggtcgagccctgcggcgacggcggcgacccgctcccggaggtcgttcacggcggtgttctgggtgcgctggaggacggcggtgcgggcgtcccggtaggcgagggccgtcgcggtcaccgcactgacgagggcgaccaggacgaaggtgacgacgagcctggcccgcagtccgccgacgaaccgccgcgaaccacgcccgagggagcgccgcgacgagcgccgcggcccgtgcccggagggacgccggggggtcggccgtctcacagcggcccgaagcggtagccgaaaccccgcacggtctggacgtaccggggcctggccggcacgtcctcgatcttggcccgcagccggcccaccgccgcgtccaccagccgggagtcgcccaggaaggcgtggtcccacaccgcggcgaggagctggtcccgggtgaggacccggccgggcgaggccgacagctccagcaggacccgcagttcggtgggcgggagggcgagcaccgtcccgtgcttggtcacggtcagcccggcccggtcgatcaccagaccggcgtgatcggtgcggtcggcgtcgggcccccgcgcgtcggcgccctgccgcggatacggttccgcgcggcgcagggcggcccggatgcgggcctccaggacgggtgcggtgaccggcttgaccacgtagtcgtcggcccccgcctccaaccccgtcacgatgtcccggtcgtcgccgcgcgcggtcagcatgatgacgggcagcgtcgccgtacgggcccggatgcggcggcacacctcgaagccgtccatgccgggcagcatcaggtccagcacggccagttcgacccgctcgccacgctcccccgccagcagcgcgagggcctgctcgccggtggcggccgtctccacgccgtacccgtgccgacgcagcacgagctccatcccgtcccgtacggacgcgtcgtcctcgatgagcagcacatgcggcatggggccgattatgcgcacgccgggtccgtctccgcctcctccctccgagggtggacgcgcaggtcggaggcattgttaccttcccatcacgtggccatgcacgggccatcatccacggcggccagcgtgaggcccatgagcttccccaccacatccgccgggctccgcctggccgccttcgtggccgttcccgtcctcgccctcaccgtcgcctgcggtggaagcgacgacaccaccgggaccaggagccacgacgccgtcgccgacgtgccgtccccgaagagcgatccctccggggccgcgagcacgccgagcaccccgagcgcgaagcccgccggcaagagcgcctactacgacgcccaggtcgcgttcgtccagtgcatgcgcgccaagggcggctacaaggacttccccgaccccaagctcagcggccacctcgactgggagaaggtcaacgagatcggctcccagccgggccgcaaccagggcatcaaggccggaatgaacaacgtctgcctggacgagctccgggcgtccatggcggtcgagcccaagcgcgaccagcagaaatcctacgaatcgatgctcgcgcacgcccagtgcatgcgggacaacggcatcagccggttcaccaacccggtgatgtccggcggcaacgcggtgcccggcggcgacccgaacccggcctccccggtctacgaccccgagtcgcccgcgtacaaggaggcccggcaggcgtgcaggtcgaagctcctcgacggcctggacggcatgcagtgaagcgccgcaccccctacgtcgcgctcggcgcggtgacggtcgcggcggtggtcgccatcggcctctccggaggcgttccgttcctcgggaacggcgacgacgcgaacgcctccggccgggaggacggcctcccgcccgccacggccgccgtcgtccgcaccgacctcgtcctctccaggaccgtcgacggcaggatcgacttcgcccagcgccgcgccgtcaaggccgccgtggagggcaccgtgacggtggcggcagccgagggggagaccgtgacgagagggcaggccctgtacgagctggacgacaagccggtcacgctcctctacgggccggtcccggcgttccgcgagatgaagacgggcgaccggggcagcgatgtccttcaactggagcgcaatctgcgggacctgggttacggagccgggctgtacgtcgacacggagtacggccgggacaccgaggccgccgtcaagcggtggcagaagcacctcaaccgcgagaccaccggcagggtcggccggggcgacgtcgtcttccagcccggccgggtcaaggtggtctccgccgacgcggccctcgccgaccaggtcggcccggacgggcccgtcctgacgatcgcctccaccgagccggtcgtccgggccctcctggaccaggccgacggcgcgctcaccgcacgcggcacgaaggtggaggtggccctgcccagcgggaggaccgtgcccgggaaggtcgccgggacggtacgcccggaggagggcggggcggaggccgcgtcccaggagggcatcaccgtcgaggtcgtcctcgacggcggtcccggcgcggcctccggcgaggacgccgaggcggcggcgagcgtgacgttcgtcagcgaggcccgcaagggggttctcgcggtgccggtcgaggcggtagtggcgctgcgcggcgagaacggggggtacgggctccaggtcgtccggggcgcgacctccaggatggtccgggtggagacgggcatgacggccgacggacagatcgaggtcagtggcgcggagctgcgcgagggcatgaaggtgggagtggcgaaaccatgaccccgccctcccggg

SEQ ID NO: 3840 - DNA, 2332 bp, Unknown
  Kingdom: Bacteria, Phylum: Actinobacteria, Class: Actinobacteria, Order: Streptomycetales, Family: Streptomycetaceae, Genus: Streptomyces
gccctgcgcgaagcgggctgccagcccgcttcgcgcagggcggcgtcgacggcgacggggaaacgggtggaggagtgctgctggcggtcgtgcatcggtgggcggtcagcccttctcggcggtggtcgcggcgccggtggaggtcaggtcgacggggcgtacgccgaagtgggacaggagtgcggaacaggaccggcagggcggtgcgtagctgccgtggagggggtcgccgtcctcgcggatgcggcgggcggtgagccgcgagtgcttgagcgcgcggcgcgcctccccgttggtcaggggttttcgctgggcgcgtttggagcgcccgccctcggcggcggtgagctggcgggagagcagtatggcttcggggcagcggccggtgaagcgttcgcgctggccgctggtgagggtgtcgaggaagtcctggacgagcgggtgcagcaccggtggctggtcccccttgcccgcggtgcaggtcagcgtctcaccgcgtacggacagcgcggcggccacggcggggagaatcccgtcgcggcggtggatcagtcggggcgtacggctggtctcggtgctgctccagctgagtcgtggatcccctgatgtgacggtttgtgtggaatgcatcgtgctgacgtccctccctgcaatcccccgagttgcggggacagcctgccaaatgtgccaggtggtggggaagctgggtcggggaaacgcgtctgcgtgtcgcccgaaggtgcgagaccgccgcctcaccgtcacgcgaatgtgaccgttcgtgacggatccggcgggacgggatcccctgttgccccaccgcttaggctgtgcggaacaccggacgcagcagggggcaacagccatgacgacaggtcggctcgggcagcaagccgcgccaccgaacgccgcctacgccgggcaggtcgtgaacttcccggacccggtccgggcgtcccgccaccccagaggggtgcggatggacgggagcggccacccggttctttcgccgtacgcgcgtgccgccgccgagatcgccgatccgcccccgggcttcggcatcgatgagctgcgcctcaccgactacgtgtcggcgaacgcggcgatggcggcgagcggtcacgacctgtgggacacgattcccgcggtggcgaccccgcacggctggacctggcaccacgtgccgggaggccggcggatggagctggtgccggtcgaggtgaaggcactgctgcgtcatcacggcggtctggcgggtacggacgtggaccagaaccggcgaggcacccgaccgttgcaggagacccgcccgacgcacttccggctgcccaagggcgccgccgcggtgagcgagcagcaggtccagggagtcgaggaggacctcggctaccggctgcccggcgcgtaccgctcgttcctgaaggcggcgggcggctcggccccggtgggcgcggcgctggacgcggaactgggactgctggtggaccagccgttcttcacggtgcgtgacgaggccgcggtgaacgatctggtgtacgtgaacaagtgtctgcgggaccacttcaccaaggactacctgggcgtcgcgttcgtccagggcgggattctcgccgtgaaggtgcgcggccaggacctcggttcggtgtggttctgcccgtacgacgatgcccgggaccaggacggctggagtgtccaggagcgtgtggagcggctgctgctgccctgcggcgcggacttcgacgccttcctccagcggctggcgggcaatccgccggagctggagaccgtggcgaacctgatggtggacggcggcttcgcgcgcgccgtcccggtggaggggtgagcgcggtggtgactttcgcgcaggcgcaggagcgggcggacgagtgggtcaacggtgacgtgcccgcgtaccagcaccgtgaggtgcgggtccgtgagttcgagctgggtttcgtggtgtgggccgaggaccggccggagggccccgtgtcggacgggggccgtcagcggctggtgatcgcgcgcgacagcggtgaggcgacgttgtggccggggctgccggtgggcgaggtgatccggcggtacgaggaggagtacgggactccggccggtgcgccggtcgccgcgcccgagccgccgcagcgggtggatctgaaccagacgtcgttcctgttgaccccgccggagtggctccaggaggcggcggacaagctgggcattccggatcatcgtgcggagcggcgggagtcggcggacgcgtccgcagccgcctccggtgcgccggttgccgctgccgatgccgctcctgttcacgcgcccggacccgcgt

SEQ ID NO: 3841 - DNA, 904 bp, Unknown
  Kingdom: Bacteria, Phylum: Actinobacteria, Class: Actinobacteria, Order: Streptomycetales, Family: Streptomycetaceae, Genus: Streptomyces
ggggtggggtgggcgtgagcccgcccgcactccgccgggccatcgtctgccgtctcagggccgtcgcgcgggcggccggccgaagcggaccgggacgcccggggagtacagcacgctcatcggatcgccggccggtgcgggcagaccgcccgccgccaccaggtcctcgtcgcactccaggagctccgcccggtgcagcggccaccggggatgcacgttgggcaggtacagggtccggccgaagaagccgctgtgcagggcccagcgtgcggtgaggaagtgctccaggggcgtcggctccgcgatcggacgcccggtgcgcagcacgatcctgctccgtgcgccgcgcgggcccggcaggcgtcgggtgctcgtgtacgtgagggtgtcgccggagcgtgcgacgtccatccgggaccacacgtacggcaaccggaacgcggtccgtgccacgacgaccgggatgagccgcgaggcgtcgagggagcggaagacgactccgcgccgcccgtgttcgtccaccgagtacagccggacgttggtctcggggaacgttcccaggtacgggacgccgggcagtcccagccaccccacccggtgcatccggaacgccacgagccccacgtacgtcgtcccgtcgaacgtgtccggcaccgtgcccggcggcaggagcggcgccacgtccgcggggtcgacggcccagtgcaggaacgccagatccagccaggactgcgtgagcagcgagaacgccggagcggcgggagggcccggggacacgggctcgggaggcagtgatctcgacggcaccggttcgggggcgcgggcggcgaaggacatgcccgcagcatcgcagacgggctcgctccggccccctagcccttcccgtcctccgccagctccgcca

SEQ ID NO: 3842 - DNA, 3345 bp, Unknown
  Kingdom: Bacteria, Phylum: Actinobacteria, Class: Actinobacteria, Order: Streptomycetales, Family: Streptomycetaceae, Genus: Streptomyces
ggcccgcacgggccggtcatcatcagcccggcgagcgatgcggcggccagggccgcgacgacagctcttcgccgccggggccgacgccgggggagcggggtgtcaggatgagaacgtacgggcacggtggcctcctgaaggcgatggggcatcgggcggagcggcggggtccgctcccgcgagccccagcatcgggcggccggacgaggcttgcccccgaggtggaccatccggccgatcaccgccacaccgtcagcgccgggccgcgcaccggtcacccgcccgctctccgtttccgtctccgtctccttgagcggtgccgctcagcgggccgggggagcgattccgctcagatccaggacgtaccgccgcccgggacggtcgccgaacatgacgtcctccgtcggctcgaacccggagcgcgccagcaccgcgcgcgaacccgtgttgtccagcgtcgtctccgcgcgcagtgcggtgagcccgtactcccggaccgccaggacgcagacctgctggaccgcccaggtggccagcccgcgtcccgcggccttctccgctatccggtagcccagctcggccgaaccctcccgcacctcgacgaggttgatccggcccaggacgccgccgtcgtcgtcctcgatgacgtggaagtggagcagccccgcgtcctgttcggcgagcagctcacggtggcgttcggcgaacgtggcgaagtagtcgtcgccccggtcgggaatggacgcggcgaagtaggcccggttctcccgttcgaaggcgagcagagcctcggcgtggtcgggacggagcctgttgatggacgtcatgccgggatgctaagcggtgtcccgccgggggtgtccagcggctgcgtccggcgtccgggcggttcggcctatccgggatgtccacgctccagcgcgtgggccagtccgcgttcggcgtcgtcggccgaggcacgccggtaggcccgctcgtacgccgagtcgcccgcgacctgccgggcccggagttcccactgctcgcggatcgccccgagctccggggtgccccggtgcgggtggccgatcatgcgccagtacgtgtgtccggtgccggaggcacgggccgcggccaccccgttgccctgcgcggcgatggatccggcgagcaggtcgaggccgagcgctatgccgaggctgtcatggagctcgtgcttgctcgcgagcatcgcgcgcgcgtggctctcggcatgtcggggacggcgctggagcaggtggatgagggcgagttggtgatcggcgtaggcccgtgcccagtgctcgccgaaccgcaggctgatccgctggagtcgcatggcctcctcgtacgcctcgtcgagcctgccgagcgcggacagggcgaacaggcgtatcacgcggcagcgcagctgcgagggcgcgtcggcggggtcgccctcgtggtcgctcagcgcgcggtcgctgacggcgtacgcggtgagcggccggcccatcatcagatacgtgaagctcatggcgtgggccgcgagcagcaccgcctccggggatccgtcccggtgtgccgcgtgccggcactcctcgccggtgcgacgggccgcctcgtgctcgccctgcagggtcagcgtgatgcccagggcccacagtgcccttgtgcggtggggaccggcggagagcggcagggcgagcacccgttccagatacgcacgggcctggtgcagatggccgcagcagctccagaagagaccggcgcacccggccatctccatcgccatctccgggtcctcggccagcaggtggtccagggccgcgcacaggtccgcgtgggtgtcggcgatccggtggtaccagaggacctgcgacggcccgagccagcccgcgtacgcctggacggcgacatgcgcgaagtgccgggcgtgccggtccgtgaggagcgcgtcctccgccagctccgccagccacatcgccccgtactcgcgcagcgtgtccagcatccggtagccgtccccggcgcgccggagcacggactggtcggccaggcgttccagggcgggagcgacggcctcggcgtccagtggcccgcccgcgcacaccgcctccgcgtccggaatcgtgatgacgccgcggaagacggagagccgtgcccacagcagccgctccagcggtgcgcagagctcgtggctccagccgatcgtggtgcgcagggcacggtgccggcggggccacagcgtgtcgtcggtgagctgctccatccgggaggccagccgtccggtgatctcctgcgcactgctctcgcggagctgggcgcaggccagttcgagggcgagcggtatgccgtcgagccgacggcagatctcggcgacggcggccgtgctttcggggtcgtcgagcgagaggcacggggcgacggcggccgcgcgctcgtggaagagccggacggcctcgtcaccgtcgtcgcccgcggagagcgggggcacctcgacgcacttctcgtccgccgtgcccaacggctccctgctggtgaccaggaccgtcagacccggggccgaggcgagcagttcggcgacgagctgcccgcagggaccgacgatccgctcgcagcagtcgagaacgaggagcagacgtcggccggacagccattcaccgagagcggccacgggccggcggggactgtggtccaggagtccgacaccgtcgcagaccgtcgtggcgagcagttgctcgtcgtgcagatgggagaggtcggcccaccagacgccgtcggggtagccgtcccgggcacgctcggcggtgcgcagggccagccggctcttgccgaccccgccggggccggtgagcgtgaccagtcgatgatctcgaagtgcccgttcgacgccgaccagttcgttgtcgcgtccgacgaagctggtcgtcacgacggggaggttgcccatcacggggacatcctgcctcgccgcgacccaccgcctccgttcatggcgaaaagcagtcagaaacggccgacaatgcatcctgttcgttcgacaagtggcatgcgtcgaaaggggttggcgtgcctgcctcctcagccgccgagaacagcggccagtgactccagggcccccaccgggtcggggccgaccggggcgagcacgatgtcggtgacgcccgccgcccgcagcccgccgagacgggcacgggcctcctccggggacccggccacggcgagtcgggcgacccagtcgtcgggcatgcgccgggcgaactcctcacggatcgcgcacccggaccgcagcgcgaacagttagtcggcgaacgggagagggacgatgtgcgcgtgccagtcgggctcgccgatccactccagccc

SEQ ID NO: 3843 - DNA, 2904 bp, Unknown
  Kingdom: Bacteria, Phylum: Actinobacteria, Class: Actinobacteria, Order: Streptomycetales, Family: Streptomycetaceae, Genus: Streptomyces
gcccgaggacggggagcggggcagcgaacgcaggaaagccaccgcctgcgccgccgtcagctcggcccgcagatcgaacccggccgaggcgacctgcgcctcggcgaaaccgcgcagccaccggtcgggcagcggcaccttcttctccaccacgggaccgtcgagcgtggtcaccgccatctcctgcggacccacccgcagatgcagcggatcatccgccgtgatccgcgagagcgcctcccgcagcggagggttcacgtccacgttcgtcgttccgtggccggtctcccggccgtccaggccttcctggagcacgtcgaggcgtgcgtacaccccgccgcagccggagaacgactcgaagcgcagccggtcgccgttgcccgtcaccactgggtccagcgaggcgggcagcgtgcgctggtagtagcgggcggcggccacgtccgcgaccgccagcagcccgcgtgccgctgtccgcggatcggagaggaagcccgcgaagaaccgcgggtgcgcctccgctccgcgcggggtgaggcctcccgaggtctcgagaccgagggacggccccacctgcgaggattccagggaggacgggcgtgcgtaggccaaggcctgaacggatcgggtcatgaaaaaaagcgtaggacccaccactgacagcgggcctcacggcagccgcggttcactgcccgacgcggaccggccggagcaccttggtgaacagcacggctccgccctcggcccgcagacgcaccgtcagctccgcactgtcgccgtcgatttccacctcgccgaaatactgcggggactccatcggcgagacattggcccggtcgggagcccgcacgaagacccggtccgggccgaaggtgccgtccagcgcgttggccgggaagccgcccgccgccagcgggcccgacacgaactcccagaacggggcgaagtccttgaacgccgcccgctccggcgcgtagtgctgggccgaggtgtagtggacgtcggccgtcagccacacggtgccggtgatcctgcggtgcttgatgaaccggagcagttcggcgatctggagttcccgtccgagcggtgccccgggatcgccctgcgccaccgcttcgaagtccgtcgcgccgtcgggtaccacgaggccgagcggcatgtcggcggcgatcaccttccactccgcccgggaggcggccagcgagcgcttcagccaccgtgcctgctcctcgccgaggatgcccgtcgtgccgtcggcctgccggcccggggagttggcgtttcggtacgaacgcatgtcgagcacgaacacgtcgagcagcggcccgtggtggacgacccggtacatccgcgaacgccggcctgaaccgtacgagggcgcgagcggcacgtattcgtggaaggcgcgcacggagcgcgccgcgaggatgtccacgttcttctcggtgtaacgcgcgtcgtcgaggatctggccgggataccagttgttgcgcacctcgtggtcgtcccactgcacgacggacggcacctgcgcgttgaagcggcggacgttccggtcgagcaggttgtagcggaagttgccccggtactcgtccagcgtctcggcgaccttcgccttctcctcggtcatgacattgcgccagatccggccgtccggcagcgtcacgctcggcgccagcggaccgtccgcgtagatgctgtcgccgctgcacaggaagaagtccgggtccaggcggcgcatctcctcgtacacccggtagccgccgatgtccggattgatgccccagccctgccccgcgatatcgcccgaccacaggaaccgcaccccggagcgtcgccgggccggcgcggtgcggaaggtcccgtagacgggcctgccggtacggcgcggatcggccggatcggcgagcgtcacgcgatagtgcacctgctcgcccgcgggcaggccgtacagcggtgtggtgccggtgaagtccgtcccggggccgatcgacggcccgtaccacctgcgcactcgccggaacgactcggtcgccgaggtctccaccagcatccgggccggccggtccgagcgcacccacaggagcgccgaggaggcggtcacgctgcccacctgcacaccccaggacgcttcgggccgccccgccaggtgcagggcgggcgccgccgaagccgtcgcgggggagagggcgaccgccgcaggggcgatcagcgagccgcgcaggacggcacggcggccgggcgagggaacacgcggacggtgcggacggtaggacatcgaagcgcctccagggaggtgggcgggtggtgcgccgttcgcgagaaggccgtggaccggcgccggtctccgcccatgcctagtgcctcgcggcggccggagccccaaccccgggtgaacggagccggtcagccggggacgggccgtccggaacgccgcgcggccgccagcgcggcgatcccccgggcgatgccgccgggggagagatgggcgtagcccaggacgaggggcagggtgccgtcctcggagtcggccgttccgcagtcgcgcagcggccgcagagcgatgcccgccccggccgcccgctccaggaagacgtcctcggggccgtagcgcgccggcagccgggcgatgatgtgcagtcccgccgcgatgccgctgaccgtcgcgccggggaagtgctcgccgagcgcggccaccagggcgtcccggcgttcccggtaggcccgctggcagcgtcgcaactgccggtcgtagccgccgcgcacgatgaagtcggccaggacggcctggtcgatcaccgggttgcccagatccatggtccgtttgcgggcgacgatccgctcggtgagcgcggcgggggcgatcagccagccgagccgcaggccgggcgccagtgacttgct

SEQ ID NO: 3844 - DNA, 3210 bp, Unknown
  Kingdom: Bacteria, Phylum: Actinobacteria, Class: Actinobacteria, Order: Streptomycetales, Family: Streptomycetaceae, Genus: Streptomyces
tcgggcggccgcccgatgtccaggcccttccctctgcgttctgctcgccaggctgtcagggttggttcgagcagttcccaacgggcatcggacaggtcactggggtacggccgctgtcggcgaggcatgtttccgtagtaccgatggcagccgtcccgccacagggcgcaaacaggcgcgaccgggggcgtgttgggatcagacaggagcgaagggaccgaaacggaccctcgaaggccgtcacccgccccatctgccacaacaagcgtctaccgcctcagccggcccgaagcggtccgccacctgaactgcaatgaagcacccctgtcgggacaaaacgctctttaaagcgtgtttcgaaagtagcgccatccgcccggagggcgggctcggcggcgtctggcgcgtgcgaccgcaaggcggagggtcgccgcgatactggatgtatcgggggtgatcccgacaacgcggcgagcgtgcgcgcccggcgacgccgagcaggcgggactttcgaaacacgcgctgggtcgacggtcgggcccgcaggccgaagggtcggccgcgaacctcgccaggggccccgcgggcgcgaggacgctccgcgcgggccacggcggctcgtcatccgacttcacgactgcggagacctggcgtacgcaacgcctttcagtggcaacatcggctactggcctggctatcagcatctcttgcgacccagtggctgaaaatccttgcagcaacttgcagccactccgtcgcgcacccaagatgcgggacatgacaagccgactgcagcacatgccgcgtcccgccgctctcgcctccgcgaccgcgatcggcctcctggtggctctggccgccaccccgtccgccacggccacagaatccgcggctccggagtgcgtggagtaccaccagagctggcgatacaccagcgtcgtgaacggctgcgccgacaccgtcgccatcacggtcgagtacacgaacggcccggggtccccgtgccgtgttctcgggcccggcgaatggggaaccttcgccggttacgggacgaacggcgatcacgtcaccgcgctgcggacgtgtgtcccctcccccaccaccagcggcatgtgaagacatccgctgttcatgtgtgcgttccggcggctacacgcatcactcgtaccgtctcgacggtccggcttccctactgaggagtatcgtgagcgcttccgctctgaccgctctggccaccacgttcatcatggtgaccggagcccccgcgcacagccaggtcccggtatccgttaccgccggcgtggagacgcctgccgtccacgacgacgaggcgggcgacaatgccgacgccgacgaccccgcggtctgggtcgaccccgaggactccggtcgcagcatcgtcatcggcaccctcaaggaggccggtctcgacgtctacgggctcgacggcaaacggctgcagcatgtcgcggcgcccgaggcgcccggcgaggacgcctccgtcggccggttcaacaacgtggacgtgatctacggcttcgaactcgacgggaagaagaccgacctggccctcgtgagcgaccggggccgcgatcgtatccgcgcctacgcgatcgaccccgccgccgtcgccgcgggcaagccgccgctcaaggacgtcaccgcaccgaacgtcaccccggtcttcgcatccagcgagtccgaggtggacgaacagcgcacgtcctacggcctgaccgcgttcagcgatgacgacgacgcctacgtcgtggtctcccagcgcaacgaatcccgcctgcgcctgctgcagttgaaggaccgcgacggcagggtcggctatgagaaggaggacacgctcgacctgcccgataccttcgagctgcccaacggcgcgtcctggacgccgtgcgccgaccccggcgagcttccgcaggtcgagggcatggccgtggacaaggaggagggcgtgctctacgcggcccaggaggccgtgggtctgtggcgtatcgagctcgacgacgaggagttcgcgtcccccgaactcttcgaccgcgtacgtgagtacggcacgccgtggacgtacgacgagaacgccgacgaggagtgcgctctcgacaccgacaacgatcccggcttcggcggcgagcacctcggcgccgacgccgaaggcgtcacgatctatcacgcggaggacggcaccggctacgtcctcgcctccagccagggcgacaacaccttcgcggtgtacgagcggcagggcgacaacgcccacctcggcaacttcgccatcaaggacggcccggccgtcgacggggtgcagcactccgacggctccaccgtggtcaacgtcccgctgggcgctgctttcccgaagggcctgctgatcacccacgacggcgaggccaccccgcagaacccggaccgcggggacagcaccaacttcaagttcacgcgctgggacgccgtggcgggcgcgttcccccagccactggtcgtcgacaccgattcgttcgacccgcgcaaggccgactgacccggccgatgcctggacgacccggacgccgaagccgatgagctccagggccgaggcaccgggacaggaccgggagcgctgtcttcctcctgtcggcgagagggccttcgcgggtggtcgtcccacccgcgaaggcccatccgctcggtgtgcgccggactacggcgcgtccgtgagcggctcggtcacgacgctcatgtgcagtcggcgggtgtgatcgaccgtgcgtaccggtccggtcagcgtgacccgggccgtgagccgtgtgtcggtgctcgacgcgctcagccgcagttcgaggtcgcccggctccacgatccggcggccgtcgcggcccgtgaaggacgataggtccgccgggaccgtcacccgcaccctggccgctcgtccggcgtccaggccgaggcgtacgtacccgatgaggcgctgtaccggctggaccacggaggcgaccgggtcgtgcagatacagctggaccacttcggtcccctcccgcgcaccggtgttgcggacggtgcaggagagcgcgaactccccttccgtcgaggcctgtccgcactccacgacgaggtcgctccactcgaaggcggtgtatgtcagaccgtggccgaacccgaacgccggggtcggatcgacgctggacacatcgctggagtggcccagccgcgccgccaggg

SEQ ID NO: 3845 - DNA, 2416 bp, Unknown
  Kingdom: Bacteria, Phylum: Actinobacteria, Class: Actinobacteria, Order: Streptomycetales, Family: Streptomycetaceae, Genus: Streptomyces
catcctccaggccgacccggcggccgagctcggcgagcgtacggctgtcgcccgggtcggcctggaggatgtcgcacagggcgcgcagcagagggacggtgggagtgggcaggtgcaacggctgctgcgcggacgcccgcagctggtcgaggagcacggcgcggaggcgggcccgttcggggcggtcgtcgccctccgcgcgggtgtaggcgatgaggagttcgcgcagcagcgggctgacggccagcacggtcggtgtgtcgaggccgagcgggttctcggtgaccggcaaccccaccagatgcagatcgagttcgccgtaggcccggtgcgcgtgcaccgtaccggcgggcacccagatcgcgcgcgtgcccggggcgacccaggacccctcgccggtcgtgacggtcagcaccccgcgtcccgcgtagacgatctggtggtcgtcgtgccggtgggcgtcgatcgatccgccgggcgccaggtgccgggtgcgggtcggcgccacgggatcgtggcggatggcggcctgcggcacggaagcctggcggatgttcgtcatcatgtggcagtttatcgaaagcgcgacaacactcccgggccggaacatggcgggatgcgaaggaacacgccgatcgtcctgctgtccgtgggccatgcctgcgtcgacatctaccagggttccgtcgcggccctggtgccgttcttcatcgccgagcgttcctactccctcgcggtcgcctcgggcatcgtgctggccgcctcgctgctgtcctccgtggcgcagccgctcttcggcgtactcacggaccgctgggccatgccgtggctcctgccggccggcacgctgctcggcggtctcggcatcgcgttgagcggcctgagcggctcctatccgctgaccctggtgttcgtcgcgctgtcggggatcggggtggccgcctaccatcccgaatccgcccgcgtcgcccggatcgccggccggggaagccaccgggcgatgggctggttctccacgggcggcacggtcggcttcgcgctcgccccgctcatggtcgccgccgtgatgagcgtcggcgggctgcgctggacgcccctgctggtgctgccggccctcgtcggcgccgcgttgtgcctgcccgtcgtgcgcgtcctccaggagaggcgggccgccgccggctcccgtacgacgccgccggccggaagcgacgacgtcgcctccttcgtgaggctgtccgtggccgtggtcttccggtcgatcgcgttcatcggcctgagcaccttcatctcgctgtacgtccgccagcgcctgggcggcggcatggccgtgggcaccgcggccctgttcgtgctctacctcggcagtacggtcggctcggtgctcggcgggtccctggccgcccggtgggaccgggtggcggtcgcgcgctggtcgtacctgctcacggccgcggccgtcgcgggcgtggtgtgggtgcccggcccggccgtcttcctgttcctggcgctgacctcggccggactgtacgtaccgttctcgctccaggtgacgctcggccaggactacctgccctcccgggtcggcaccgccggcggtatcaccctcggcctgaccgtcagcatcggcggcctggccggccccgcgatcggcgcgctggccgacaccacgtccctgcggaccgctctggcgcctctcgtggcgatgcccctgctgagctggctgatcttccgcaccctgcccgaaccgcgcgtgccagggcctcggtccgggacggtcgaggaagcggacgaggccgtcgtccgggcggcgaaacccggatgacccggggccggggtgcttctacggtcgtcccatggacaggggagagcagtgcgaccacctgctgaacgtggtcgatgtcgaggccacctgctgggaggggcagccgccgcccggccaggtcagcgagatcatcgagatcggcctcaccgtcgtcgacctgtgggccggcgagcggctgggcaagcaccggctgctcgtccggcccgcgcgctcgactatcagcccgttctgcacggagctgaccgggctgacgcaggcggaggtggacggcggtatgcccttcgccgaggcctgccgggtgttggcggccgagcaccgtacggggtttctgccgtgggcgagttggggtgactacgaccgcaaccggttcatccgccagtgccgggcgacgggtacggagtaccccttcgggcggagccacacgaacgccaaggtcgccttcaccgccgcgtacgggctgcgccgccgccccggcatggcccaggcgctgaccgtggccggcctcccgctggagggccgccaccaccggggcgacgacgacgcgtggaacatcgccgccctggtgctggacctggcggggcggggtgactgggc

SEQ ID NO: 3846 - DNA, 1458 bp, Unknown
  Kingdom: Bacteria, Phylum: Actinobacteria, Class: Actinobacteria, Order: Streptomycetales, Family: Streptomycetaceae, Genus: Streptomyces
ggcgaccttgtgcatccggtgcgtgcggatgaggacttcggcgacggcgcccccggggccgacgaccgcggtgtgcagcgactggtacaggttgaacttgggggcggcgatgaagtccttgaactcggagatcaccggggtgaagcaggtgtgcagttcaccgaggacggcatagcagtcggcgtcctcggtgacgaggacgagcagccggccgaagtcggtgccgcgcagttcgccgcgtttcctgcggacccggtgcacggagacgaagtggcgtggcctgatgaggacttcggcgctgatgcccgcgtcgcgcagggtgccccgtacgttgtcggcgatggtgtccaggggggcgtccgggcccgccgcggcggcgatcagggcgcgggtgtgctcgtactcctcgggatgcaggatcgcgaagaccaggtcctccagctcggtcttgagcgcctgcacaccgagccgttcggcgagcgggatgaggacgtcccgggtgaccttggcgatcctggcctgcttctccgggcgcatcacgccgagggtgcgcatgttgtgcagccggtccgccagcttgatcgacatgacccggacgtcgttgccggtggcgacgagcatcttgcggaaggtctccggttcggcggcggcgccgtagtcgaccttctccagcttggtgacgccgtcgacgagatagcagacctcgtcaccgaactgttcgcgcacctggtcgagcgtcacctccgtgtcctcgacggtgtcgtggagcagggaggcggtgagggtagtggtctcggcgccgagctccgcgaggatcagggtgacggccagcggatgcgtgatgtacggctcgccgctcttgcgcatctggccgcggtgcgaggactccgcgaggacgtaggcccggcgcaggatggtcaggtcggcgtcgggatggtgggcgcgatgcgcctcggcgacatgtccgatggcgtcgggcagccggtcgcgggagaccgggccgagcagggccacccggcccagtctgcgcagatcgatccgggggcggctccgcctgcgaaggggagcgcccggatcggcggcctctgcactcatgggcacctccggcgacgtcgaccggcgctggggaggagcggatgcccctcggggccggtgcttgatgctatcgaccccaccacgtggcgcagtccagctctcgcccagcgtgaaacggatcacccattcgagcgaagctcgggccggtcatcgtttcgagcgagccattcctcaggaggtttcgagccagaccgggtcgatgacgccctcggcgacgatcaccgcgggtccggtcatgtcgatcgtgccgtcggggtgctcggtgatgacgagggtgccgccggggaggtccacccggtaggtgacggggaggccggtcccggcggggtcggcgccgtcccggcgggaccggcctccccgtca

SEQ ID NO: 3847 - DNA, 3207 bp, Unknown
  Kingdom: Bacteria, Phylum: Actinobacteria, Class: Actinobacteria, Order: Streptomycetales, Family: Streptomycetaceae, Genus: Streptomyces
ttacggctacccgcagcagggtggttccggcggtggccagcccaccatgcaggcggagctgtgcccgcagtgccgcacgccgcgtgaggcgatggctccgtactgcgaggagtgccgctggaacttcctcaccaacacggcgacctcctacaccccgctggccccgcagcacggcacgcccggcggacctccgcccggcctcaacctgccgcccggcttccaggcacagggccccggcgggccccctggacccggcggcggacagcccggtcccggcggtcccggtgggcagcccggtcccggcggccagagcggtccgcccggtgcgccccagccgcgcgacccgttcgactaccagggctcgcgcccctcgcagatgaaccgtcccgccgagccgctcgcccccgagaacggcccgcacggaaacggtggaccgcacgggaacggcggccagggtgggcctccgccgcaggcgttccagcagggccccccgccgccgccctcgttccagcagggtccgccgcagcagcagcagtccagcccctcgccgttcgaaccgcagcagtcggctccttcgacgcactcgccgttcgaaccgcagcaggcctcgcccttcgcgccgccgcaacagcagcagcagtcggcaccgcccgggccgccgcagtcgtcggggcacaccggcggcgaggacgactggatgctgccgccgccctcccaggcccagcaagcccagcaggcccactctcagccgcctcaggcgttccagcagccgggccacggacagaaccggggtcagggccagggttacgaccagcagggcccgggccagcagggtcacggtccgcagcacggtcaggaccaggggtacgaccagggacaacagcacggcggggtgcccgtccagggccggccccagcagtccacctcctggaccgccgtgatcgctcccgaccgcgcgtacttcctcgcgatgatgcagcgcagcggccccgaggcgaccgggctgaacctgcccgcctactccccggagcagcgccttccgctcaccgggagccagatcaccatcgggcgtcgtcggcacagcaccggcgagtcccccgacgtcgacctgtcggtgcccccggaggacccgggcgtctcgcaccagcacgcggtgctggtgcagcagcccgacggcagctgggcggtcgtggaccagaactccaccaacggcaccacactgaacggcgccgaggacccgatccagccctacgtccccgtaccgctccaggacggcgaccaggtgcacgtcggggcatggacgacgatcacggtgcgccgggactgagacccgctcagccggtggcgagcggccaggtgtacgggccctgcgggtcgtcgagccaggcccactgccggccctggccgaccgtgatgccgtacctctcccgctgcgggcgctcctcgcgctcccagagggagagggcctcgtgcggatcgagggtgcccgcggtcagggtcaggaggaaccggaagaggtcgtccccggcgatccgccgcggcagcccgccgaggtacggcagcccgccgggtcccgggagcgcaccgcgcaggggcacgaagtacgccggggtgtgcaggaagtgcccctcggcgcgcgggccgtgcaccgtggcgcggacctggagggacaccaggccggtggcgagcggcgcgaggatgcgcgcccccggacggcactgttccggccaggcctccggtacggacggcagggtgcaggtcgcgatgatccggtcgtacggggcgcgcctcgggcagccccgggccccgtcgccggtgaccaccgtcgggtggtagcccgccgcggcgaggtggcgccgggccgactccgtgatctccgggtccaggtcgagactggtcaccgcggagtcgccgagccggtgggccagcagcgccgcgttgtagccggggccggtgccgatctccaggaccgtgtgtccgtcccgtacgtcgagggcgtcgagcatcagggccatcagggacggctggctggaggacgagacgagttcgccgtccttgagccgggtggccagcgcctcgtccgcgtacaccccgcgcagccagcgggagcgccgttcggggtcggggtcctcgccccagaggcgttcgcaaccccggattccgtgcacgtagtagtacggcacgaacagatggcggggtacctcggcgaaggccgtgcgccaggcggggtcggtgagcgcgccccgcgcggcgatctcccccacgagcgctgcccgcgccgcgtcggcctcggcgtcgggcggggaggggccttgccggtgtgcacccatgtctccactgtcctgcgccggggccgcgcgggcgagcggccgagcgggtgtttcggccccttggtcctaggacccccgtcctcggccggtgcgtctgcgaccatggacgggtgactgagatcccgcgcgacacgcttcaggagcagaccttctacgagcaggtcggcggcgaggcgaccttccgacgcctggtccatcgcttctacgagggcgtggcggacgacgagctgctgcggccgatgtatccggaggaggatctgggtccggccgaggagcggttcgcgctgttcctgatgcagtactggggcggcccgcgcacctacagcgaccaccggggtcacccgcggctgcggatgcggcacgcgccgttccgggtggaccgggcggcccatgacgcctggctcgcccatatgcgggtcgcgctggacgagctggggctcgcgcccgagcacgagcggcagctgtgggactacctgacctacgccgccgcctcgatgatcaacaccgtcgactgatcacatctgtacgttccgtgacggggtaactccggaattcgacactccacctccgcataacgatcacgatcgcatcaaggtgcgcctgtaagcggttaccagaaccctgttgcctctgaaagcatcaccggtacgtcggggggcgtgcgcacgcggtgtttccggggctgggggatcaggtgacgggtttcgtccttctgcgggtgagggctcatcgcctcctgctgtccgcggccgttctcgccgtcctgctgaccacctccgtcctggcggcgctcaccgcgctcgtaggttccgtgggcgacgcggccctgcgccacacgctcacccacgggtcggccgcctccgccgccctcgtcgtc

SEQ ID NO: 3848 - DNA, 846 bp, Unknown
  Kingdom: Bacteria, Phylum: Actinobacteria, Class: Actinobacteria, Order: Streptomycetales, Family: Streptomycetaceae, Genus: Streptomyces
  misc_feature (378)..(379): n is a, c, g, or t
ctctacggcatgttctggctctgcaagaccgccctgccacacatcccggcaggcggttcgatcatcaacaccacctcggtgcaggcgtacaagccgagtccccatctgctggactacgcgatgaccaagggggcgatcgtcaccttcacccagggactggcccagatgctggcctccgacggcatccgcgtcaacgccgtggcccccggccccgtctggacacccctcatcccggctaccctgcccgacaccgccgagttcgggaagcagagcccgctcggccgccccgcacaacctgcggaaatggcacccgcctacgtcttcctcgcctccgcgagcgcctccttcatcaccggcgagatcatgaacgccaccggnngcgcgccgtccgggaaggcgtggtgtatgaccatgaaccaccatgaaacgccggtgctcgacgctctcaccgcctaccgcgaccggggcgagctcggcttctccccgcccggccacaaacaagcacgaggcgcgtctccggccgtgcgcgccgtgctgggcgacgcggtgttcctcggagacgtcctcgccaccggaggactggacgaccgccgggagaagtcagccgtactgcaacgggccgaagacctcatggccgacgccgtccacgcggagcacaccttcttctccacctgcggcagctccctgtcggtcaaggccgccatgctcagcgtcgccgcacctcaccagaagctgctggtcggccgggacgcccacaagtccgtcatcgccggcctcatcctctgcggcatcgagcccgtctggctggaaccccagtgggacaaggagcggcacctcgcccacccg

SEQ ID NO: 3849 - DNA, 2350 bp, Unknown
  Kingdom: Bacteria, Phylum: Actinobacteria, Class: Actinobacteria, Order: Streptomycetales, Family: Streptomycetaceae, Genus: Streptomyces
ggtcgcaccgggcgcacacgcgccgccggtcaccagtgccatcagccgtctcgtgttccccatggccttcatggcgctggaagctagccgacgcgttccggcgcgtccagggtgcgtcgccgccgaccgggcaggagagcggagtgcacggtggtcgggagaggccgccggaagccggtgacgcagctcacgccgcgcgccggtgcacgaaacgacgagttccgtcgtctactccaatgccgggaaccgttcacccggccgtgcgagagggagcaggtcttgtccagcgttatcgagcagtccgtgcaggcccgcatggtcgcgtccgcaccacggatggagactctgcccgccactcttcagtacgaccgccagtaccccttcgccgtacgcatggcgttcccggccccggcgaccctggaaggcaccgaggtgtcctgggagttctcccgcgaactgctggccgccggggtggactcccccgccgggcagggagacgtgcgggtgaggccgttcgggtacgagcggaccgtgctggagttccacgcccccgagggcatcgccatggtccatgtgcgcaccgaggagctgcggcgcttcctccagcgggcgcaggagctggttccggtgggcgacgagcaccggtatctggacctggaccggagtctgaccgacctgctcggtggtcctcgctgacctcgtaaatccggttgccgggcccgcaccccggccctaccttcgtgatggttcctgttgtcgtcgatcggagtgggacgttgctgatctgaggtcctgtgcacaccgtgcagcgcccgccgcgccatgtcgcggccggagcgcccgtgtgcgatctcagcttccgccggccgtccttgtcgttcccgacgtacaacgggagatccgtatgcctgccaccgacacccacatcagctgtacctccctcgccttctcctggcccgacggcagcaaggtcttcaccggcctcgatctggccgtgggtcccggccgtaccggtctcatcggcctcaacggctgcggcaaatcaaccctgttgcggctgatcgccggtgaactcaccccgcggtccggtgtgatcagcacccgcggcgaactgggccatctgccccagaccctggtcctggacaccgcgctgcgggtcgacgaggtgctcggcgtcgcggaccggcgcgtggcgctcgacgcggtcgagtcgggcgacgtccggcccgagcacttcgcggtgatcggcgacgactgggacatcgaagaacggtccctcgccaccctggacgggctcggcctcgggcacatcgggctcgaccgcaccatcggggagatgtccggcggcgagtgcgtcctgctgcggctggccgcgctgctgctggaacggcccggggtgctgctgctggacgagccgacgaacaacctggacgtgtacgcccgtcggcggctgtacgacgcggtcgacgcctggacgggcgcgctgctcgtcgtcagccacgaccgggagctgctggaacgggtggaccggatcgcggatctgcgggagggttcggtcacctggtacggcggaaatctgtcggcgtacgaggaggcgctggccgtcgagcaggaggcggcgcagcgcatggtgcgcgtggccgagtcggacgttcagcgacagaagcgcgaactggcggacgctcacgtgaagttggcccgacgcaagcgctacgggcagaagatgtgggacaccaagcgtgagcccaaggtcgtcatgggtcaacgcaagcgctccgcgcaggagtcggccggcaagcaccgcaacctgcacaccgagcggctggccgcggccagggagcgtctcgacgaggcggagctggcggtgcgggaggacgaggagatccgggtcgagctgccgggcacccgcgtccatccgggcagtgaggtgctgctgctgcgcgatccggtgcctccctacgggacgccgctgcggggcgagttgatggtgcggggtcccgagcggatcgcgctgaccggtcgtaacggggcgggcaagacggcgctgctgcgattgatcgccggtgagctggcgcccctctcgggcgaggcgagcaccctggttccgacgggtttcctgccgcagcggctggacgtgctggacgacgcgtcgtcggtggcgcggaacgtggcacggtcggcccccgacaggacggacaacgccgtgcgggcgcggctggcccacttcctgttcaagggggcggcggcggaccgcccggcggggaccctgtcgggcggggagaggttccgggcgacgctggcgatgctgctgctggcggacccgccgccccggctgctgctgctcgacgag

SEQ ID NO: 3850 - DNA, 1164 bp, Unknown
  Kingdom: Bacteria, Phylum: Actinobacteria, Class: Actinobacteria, Order: Streptomycetales, Family: Streptomycetaceae, Genus: Streptomyces
cttcaccgtgccgcgcgtcccgggcacgatcaccaggtccgcgtcggccagctcctccgcccggtccacgaaccgcacgacgacgcccggttcggcggccagcgcgtccacgtccgtgaagttcgacatcagcgggaccgcgcagaccgccacccgcagcacgtcctcgccgtgcgggggagccacgaccgactcccgcaccgcgccgcgcaaggacacccgcaggccgtcctcctcgtcgataccgagaccatgggcgtacggcagtaccccgtacgtccgccgcccggtcagctcgaacagcatgtccaggcccggctccagcagcgagacgtcgccccggaacttgttcaccagataacccgcgaccagcgactggtcctccgcgctcagcagcgccgtcgtcccgaagaaggaggcgaagaccccgccccggtcgatgtccccgacgaccagcacggggaagcgcgcggcccgcgcgatccccatgttcacgatgtcggtgcgccggaggttgatctcggcgggggagcccgccccctcgcagatcaccgcgtcataggccgaccgcagctgctccaggcagtccgtgaccgtgccgagcagcgcctcctgacggcccccgtggtacccccgggcgctcatctcgccgaccggcttccccatcaggaccacctggctggaccggtcaccgccgggcttcagcagcaccgggttcatcagggccgtcggctccacccgggcggcctgcgcctgcatcgcctgggcccgcccgatctccgcgccctcccgggtcacgaaggagttcagggacatgttctgggccttgaagggcgtgaccttcacgccccggcgcaccagccagcgacagatgcccgccgtgacgacgctcttgcccgcgtccgatgtggtccccgcgaccagcagtccgccgctcatgcccgctcccgttcccgtaccgcgttccgtgccggaccgttcatgaccgtccccgcttccgtcccgcgaccgtctgccctgctgccatccgccccgcgagcatccggcccgccacgcacacacccagggccagcgtgctcacccggcgcgacagccgtaccgcgcgttcgatgtccgcgccccgcacgtcccgcccggactccccgttcagcaccggccggtgct

SEQ ID NO: 3851 - DNA, 1986 bp, Unknown
  Kingdom: Bacteria, Phylum: Actinobacteria, Class: Actinobacteria, Order: Streptomycetales, Family: Streptomycetaceae, Genus: Streptomyces
ggggccgtcgccgtcgaagagcgcgtccgcactccggggggagcgttgcggggtgccgagccgccaccagagggcggcggcaaggccgatgatgatgacgaccaggacggcgagtccggccggtccgccgggggcggcgcccgcggcggcgtcgaatactccggcgacccagtcccagaactggttcagggcacgctggaggaagttcgggtcgttctcgtggtacatcggcttggacagctcgctctcggccgcctcccgtgcggggagacgtggagtgtccacgggtatgtcgcccgctgccgtgtcccgccgtgctgtggtgatgccccccgcccccgacaccgcatcagctcctgggggtatcggcgccgtagccgggcaggcccgcggcccgtgcgaggtcgaggtccagtgcttcgcggcggatgcgctggtccacgtagaggagggccatcacgccggcgacgaaggggtagatcagcgtcgagacgatcacttcgccgatgccggtgacgatcaggaaggaccagccgaaggagggggcggtgccgttgaggaattcgctgacgtcggttccgtcgacgatcaccgcgatgatgccgaacgggatggagacgaggaacgtcagcaggaaggtcagcagccaggtcagggcgaggaccccgaaggtgcgccaccaggcgccgcggaccagtttcgccgacctgcggagcgcggccacgatgctctgccgttccagcatcagggcgggggcggcgagtgcgaagctgacgttcagccagagcatcacgacgcaggcggcggcgaagccgaggaaagcgagtgccgctcccgcctcggagcccagcagcaggccggggccgatgcccacggccatgatcgcggccatgatcaagggcaccagcacggtcagtccgagcagcgggaggagccgggggcgtgcctctgcccaggcgtcggagagcgtggtgggacggcccagcaccgagcggctgatgaccaccgtgatgatcgacgcggtgaagagcgtggcgatcatcgtgacgagggtggccggggccagggcgatcagtgtcgaccgggcggagtcggtggcttggcggagggcctcggtgccggtggcgttcgggtcgacggaggtcggctccggcagcaggtagcgctgcatgaggatgacggcgatctgggtgaccaccgagacggcgaggctgaagccgagtgcggtacgccagtgggcgcgcagggcggagacggagccgtcgaggatttcaccgaggctcagggggcgcagcgggatgacgccgggcttcgcggccggcggcggtcctgcccagccatgtcgctgcgggccgccgccccagccaggtgcgggcggctgtgttccggggccgctgccggggttgctcggtggggaccactgcccggggggcggctgctcgggggaccactgtcccgtcgggccgcttccgtcctggggttcggaggggcggggaatcgccgtctccttgccgtcggagggggcagatccgggcgacgcccagcccggagagtcgttcattctcgctccttcaccgtcctgaccgctcatcggggcggcaggttggcagccatcgtgccacgcgtcggtccggggcggaccagccgctctgtctccttggcgccttcatgtacgggcggctcaccgggcagactggacagatggctgatcaggacgcgcaatcgccggtgggcttcgagcctcccgcgctttccgtacttcgctgggacgagcctccggaaggccccgtgctggtgctcctcgaccagacgcggctgcccgccgaggaagtcgagctggtgtgcaccgacgtgccggcgctcgtgcgggcgatccggacgcttgcggtgcgaggggctccgctgctcgggatcgccgggggctacggggtggcgctcgccgcggcgcggggcttcgacgtcgtggaggcggccggtctgctggag

SEQ ID NO: 3852 - DNA, 980 bp, Unknown
  Kingdom: Bacteria, Phylum: Actinobacteria, Class: Actinobacteria, Order: Streptomycetales, Family: Streptomycetaceae, Genus: Streptomyces
ctgtgccggccccggccgccgccgcacctcccgccgcccaggaagcacagcgccccctgcccggcatccccgaagcccctgatggggaccgctggttcacccacaccgcgaacctcgcctccacccacccgaacttcacccagcaggcccgcagcactgtcttcctcgacacgcacaccggtgtgctggtccaccgcgaccagacgttccgcatcgacctgccgaccgccggcgccgcggaaatcctgaacaccgtcttccacgtccttcccggcggcgtcgagcggatctacatcaccgcgggcgccccctggcaccggcaggccgaccagcaccccttcctcaaggacaccgtcgccgcctggctgaacgcccccacacccggctggcgcacggacaccggccgcggccgggaccggatggccggccacttcgtccacccccgcaaccccgtcggccgctaccagcgcgaacacggcgagcagcacgtcgagatccggtcggcgggggagtggttcgacaccgaaggcaccgaacccgccgtcatccgggacgcgttcgtcctgctgtggaaggccctgcgccgccactggcccgacgccgtcctgatgggctcaccgtcccagaccggccgtgacctgtggacccgcaccatccccaccaagggccagtacgcggacggctaccccgttctgtccgaagagctccgcggcctcttccacgccaccgcagggcagggccgcaccgaactcatcaccccgccccgcgttcccgcccagctccccgccctggtcgagtacgaccgcaccttcgcctacgccaaacacacctggaaatccggagtcggcaccccccgccgcgtcaccgcggccaccttcgcctcctggtcccagaaagaacagaccaaagccctgttcgcctgcggccactggcacgtccgcgtcaccgtccccgacacctggacccacatcgggatcctc

SEQ ID NO: 3853 - DNA, 2516 bp, Unknown
  Kingdom: Bacteria, Phylum: Actinobacteria, Class: Actinobacteria, Order: Streptomycetales, Family: Streptomycetaceae, Genus: Streptomyces
gggagcagatgagcacggaggagacggccgcggcgctcggcatgtcggccggtacggtcaagagcacgctgcaccgggccctggcgcggctgcgccaggagctggagagccgcgagctggtcagccgcgaggcggtcgcccgggagaccgggggccgccggagcgcggcgccggtcgcctccgcccgtgtccccgcccagcggtcgccggtgtccacggtgccgggggcgagggcacacacaccggcgcagcggaacgggcgtcacgacgagcgggggatggagcggtgcgcggcctgagcggcagcggcggtgtcgggggcggcttcggggacgattccccgggcagcccgtccgggagcggccctgcctcgagtgactcctccttgagcggttcctccctgagtggttccgggagctcggacgacggcgacgacccggggagatcgggccggacccggggattccggagcggtatggcggcgggtggcacggccttggccggactcgtcgccttcgggctgttcggcgtcggctgctccacgggcggcaccggcacccgcgacgagggtcccgccggcagccagccggtcgcccagatcaccccccgggccaccccgtccggcacgaccccgcccgtcaggcgggtcgacgccgtgcggctcctcaaggacgaccccaaggtgggccggcaggtcagggacgggctcaagccctgcgcgggcaaggcctatccgatcgacacgtcctacgggtcgatgaccggcggccgggcagccgacgtggtggtcaacgtgatgagctgcgccgactcggtgggcgtcggaacgtatgtgtaccgggcggacggcgacggctcgtacaagaacgtcttcgcggccgaggtccccgccgtctacggaacgatcgaccggggcgacctggtggtgacgacccaggtctacggctcgaaggatccgctggcgtacccgtccggctcggaggtggtcacctaccgttgggcgagcgaccgcttcaccgagcacgaccgggtgcacaacgacttcagccgtgccgtcgggggcacggacagcgagcttccggtgcagtcggagccgatggacccggtggaaccggtggaacctgttccgtcggacacgccggtggagcagagcaggaattgacctcgggcaggaacgatgtcgtgccggtggaaccgggcgggaacggaaagcgagaagcagccccatggccgagacccacgtcctcttcgtcgaggacgacgacgtcatccgcgaggccacccagctcgccctggaacgggtcggcttcacggtcaccgcgatgcccgacgggctctccggtctggaggcgttccgcgccgaccggccggacatcgccctgctcgacgtgatggtgccgggcctggacggggtgagcctgtgccgccgcatccgggacgagtcgaccgtcccggtcatcatgctctccgcgcgggccgactcgatcgatgtggtgctcggcctggaggccggggccgacgactacgtcaccaagcccttcgacggcgcggtcctggtcgcccgcatccgggcggtgctgcgccgcttcggccacgcggcggggccggacgggctgggccgcagcggtgcggaggaggaggccggggcgttcggcggggtgctggtcttcggcgatctggaggtcgacacggacggcatggaggtgcggcgcgccggcgagcaggtggcgctgacgcccaccgagatgcggctgctcctggagttctcgtccgcgccgggcaccgtcctgtcccgcgacaagctcctggagcgggtctgggactacggctggggtggtgacacccgggtcgtggacgtccatgtccagcggctgcgcaccaagatcggccaggaccggatcgatacggtccgcggcttcggctacaagctgcgcggatgaagcggccggggggcgtgaagcggccggtgggcgtgaagcggccggtgggcgtgaagcggccggtggggcgcggatgaagcgactggccctgcggaccggagtccgctggaagatcagcatcgccatcgcggcggtcggcgcgctcgtcgcggtggcgctgagcctcgtggtgcacaacgcggcccgcgtctcgatgatcgagaacgcccgcgaggtgcagttggagcggctgctgggtgcccagcgcttctacgaggcgacgagcatgcagaagggcgggccgaagttcggggcgaagctcaacgacccgacgatcccgccgagcctgcgcgacgaggtccgcaagaaccgccgggccacccatgtgacgcaaggacccgacggggtccccgaggtctgggcggcggttccgctggcgggcggggacgtgctctcgctgcactcccggttcgcggaccgctccgccacgatcatggacgacctggaccgggccctgatcatcggctcggtctcggtggtcttcggcggctgcgcgctcggtgtcctcatcggcggccagctctcgcgccggctgcg

SEQ ID NO: 3854 - DNA, 843 bp, Unknown
  Kingdom: Bacteria, Phylum: Actinobacteria, Class: Actinobacteria, Order: Streptomycetales, Family: Streptomycetaceae, Genus: Streptomyces
ccgcgtacggcgtgacggtggcggtgggtcagtacaccgtcacgccgtacgcggagagcgcctcggtgaccggctggtggatggccgagcccgcggtgcccgagcagccggagctgccggagtggataccgagcgcgacggatccggcgaagtgcgccccgccgctgtcgccgccggccgagcaggcggtggtgcggaccatgttgtagacgggtccgtcgccgtagttgacggtgacgttgacggcggtgaccgtgccggaggtcaccttcgtggtggatccgctcttcttgatcgcctgaccgacgacggcgttggcggcggagctgatgtcctgggtggagccgttgtagaggtcgacggttccggcgggcgacgagccgtccgtgtagcggacgatgccgtagtcgttggtcgggaagctggtgccctcccggacgccgacgaccgaaccaccggagctggccgaccagttggcggagatgttggtgcagtgtccggcggtcacgaagtagcgggccccgcccttggtgacgttgaaggccgccgagcagcggctgccgccgccgtagatcgctccgccgcccagcacctcgcggtggaagacgcccggcacgcgcttgatgtcgaccgcgccgtcgagccgttcggcgacggcttcgaggcgggccatgtcccgtgcggagacggaggagtcggcctcgacggcgacccggttggtgcgcgggtcgacgccccaggaggtgccggtgatcttggcctcggcctccagggtctccatcgcggcgtcgagctgggcggcgctgcgggccacccggcggacggtggccccggcggcgcggg

SEQ ID NO: 3855 - DNA, 679 bp, Unknown
  Kingdom: Bacteria, Phylum: Actinobacteria, Class: Actinobacteria, Order: Streptomycetales, Family: Streptomycetaceae, Genus: Streptomyces
ggggaaggggcggacgtggtcgggcccgtcgagggcgggggttcggacacgacccgggccccccgaccccgtacgctctcgcgggccgagaaccccaggtcggccagggacgacccgggaaacatgtgcaggaacacgcgttcgtaggcgtagttggggcagcggatctccccggactccacgcgcccgatgtagcgggcgtcgcacgcgacctgctccccgatctcccgcgccgctctgcggacggccgccgcgaactctccggcggagcgctgtccgcgcagctgacggaaggcgaggttgggaactgccgctgtcgacaccatggccggcccctctctggtgcggccggggcccgtggttcccggcgtcccggcggagcaagaacgtacctgctgtgacgggtcgcacacgcagcgtttcgttgcgaaaggggcataccacccctgatctgccatgaactgccaccctttgcggcggtgtgggcccgtagcccttgacgcaccccgggcgttggtccatgtggagacggagcgtggctccgttcggcgatgagaggaggggttcccttgttgcatctcggcagggagaccggctcacggacgaccgcgacgcaaccgatggccctgccgcgcggggaccagtcctgcgacctcgtcacggtccccgcgcggcaggg

SEQ ID NO: 3856 - DNA, 929 bp, Unknown
  Kingdom: Bacteria, Phylum: Actinobacteria, Class: Actinobacteria, Order: Streptomycetales, Family: Streptomycetaceae, Genus: Streptomyces
gccttccactggcaccccggcctcctcctcgacggcgccagcctccaagtccccttcctcgccgacctcgtcaccctcgccgaccccgccagcccctggagcttcctcaactacctccgcacccgcgaccggctcttccccttctacttcgccgagcgcttccacatccaacgagccgaatacgacgcctactgccgctgggtcagcgaacaactccccggcctccacttcggccaccaggtcgacgccgtccgctggaacaccgaccgcgccctcttcgaagtcgacttcacccaactcgaccgcgacggcgaagccgaagccctcggccgcgcctacgcccgccacatcgccctcggcatcggcaccgaacccttcgtccccgaacccctcaaacccctcgccgaagccgaaaccgtccccgtactccactccgccgactacctccgccaccgcgagaggctcctcgccgccgaacacatcaccgtcatcggatcaggacagtccggcgccgagatcttcctcgacctcctgcgcgcccgccccgaaggcgccgagaagatccactggctcgcccgcacccaggccttcgcccccatggagtactccaaactcggcctcgaacacttcacccccgactacagccgctacttccacgccctccccgaatccgcccgcgacgaactcgtcccccgccaatggcaactccacaaaggcatcgacgccgacaccatcaacgccatccacgacgagctctaccgccgcaccctccacggcggctggcccgacgccaccctcacccccggcgtccacgtccgcaccgcgggacgcgtcgccgacacccgcgtcgaactccacctcgaacacacccagcaaggcacccgctcccgcctcaccaccgacgccgtcatcctcgccaccggctaccg

SEQ ID NO: 3857 - DNA, 3077 bp, Unknown
  Kingdom: Bacteria, Phylum: Actinobacteria, Class: Actinobacteria, Order: Streptomycetales, Family: Streptomycetaceae, Genus: Streptomyces
ggtccggccgcctgggcgatgcgctgagcgagggcgaggacccgctcgtcggcggcggtgaccctggcctcggcaccccggcgcagttcggcgaggcgttcctcgacggcggcgaagcggcgggtgtcgaagagccggccgaggagcttgccgcgggcttcggcgtccgcgcgcaggaagcgggcgaagtcgccctgcggcaacaggaccacctggcagaactggtcccggctcatgccgatgagctgggtcagctcctcgccgatctcctggtgcgacttgctgagggcctgccagccgcgctcgggatcataaccgcgcagccggctctgcgccttctccacggtgaagccgtcgccgcgcttcttcgggcggggctgggcggggctgcgggtgacttcgaggcgcctgccgccgacggtcagctccagttggacctcggtggacaggtccgcgggcgcgtggtcgctgcgcagggaggccccggggctctgccgggcgccggggacggctccgtacagggcgaagcagaccgcgtccaggacggatgtcttccccgcgccggtgggtccgtggagcaggaagaggcctgcggaggagagggcgtcgaagtcgacttcctgggtggcgccgaacgggccgaaggcggtgatgctcaggcggtgcagtctcaccgggacacctcgcgcacggtgtcgtccacccgtacgtcgtcgaacgcggcccgcagcacggtgcgttcgaggtcgctcgggccgctgccgccgcggacatgggcgacgaagtcctcggcgatctggtggtcgtcgcggcccttgaggcgctgggcgtaggacgcacccgggtcgtccggcggccgctcggggtcgaagacgaggctgagggtgtgcgggaagcgccgggcgaggcgggccatgggttcggcgggacgcaccgggtcggtgagggtggcctcgacccaggcgtgctcgtggcgttccagggcggggtcctccaggagcgtgtcgagccggccgcggagccgggccaggggacgctccacggggcagtcgatccgttcctcggccgcgatgtctccgtcgccgtcgaggtcgatgagccacatggtcttgcggtggtcggcctcggagaaggagtaggcgagcggggagccggagtagcggacgcggctcgtgacccgctgggagccgtggagatggccgagggccacgtagccgacgccgtcgaagaccccggccgggaccgccgcgaccccgccgacggtgatgtcgcgttcgctgtcgctgggctccccgcccgccacgaaggcgtgcgcgaggacgacggagcgggtgcccccggggcgagtggcgaggtcggcgcggaccttgtccatggcggcggtgaggaccgcctcgtggccggccctggaggcccggagggtgtccttgaccagggccggttccaggtagggcagcccgtagaacgccacgtcgccgtggtcgtcggcgagcacgaccggggtggcgcagttctccgggtcggtccgcaggtggatcccggcccgttcgaagagtccggcgccgacgccgagccgacgggccgagtcgtggttgccggagatcatgacggtggggacgcccgcggcggcgagccggtgcagcgcccggtcgaacagctcgacggcggtgagcggcgggacggcccggtcgtagacgtcgcccgcgacgaggacgacgtccacctcgcgatcccggacggtcgccacgaggtggtcgagataggcggcctgggcgtcgaggagggagacgcggtggaaggaccggcccaggtgccagtccgaggtgtgcaggatcctcacgccatcactccgccgaatccggcctgcatcgtcattccgccggttccggcctgcatcgtcatcctccaccccgtgggccgcgcaccggcggcccgtgatcccgctcggcaccgaccacgctaacgccgccggcccgccgaacccgcatcgatcatgattcttgcgtccgtgggattgccctcacctcacacggtcgcgtccccgtacgcctcgccgcccagctccagcgtggcggtccccgcggtcgcgtcggccagccaggcggtgaacgcctcgacatcgccgtccggcagcccgatgccgatggtgacggcgtcggcgtaccgcacctcgcggacgtcccgcccggtggcccgcaggtcgttctccagctttccggcccgttggtggtcgacccggatcgtggcgagccggaaacgctgccgggtgatggtgccgagcgcgtcgagggcttcgccgaccactcccccgtacgcgcggatcagtccgcccgcgccgagtttgaccccgccgtagtagcgggtgacgaccgcggcggtgtaccgcacctcgcgccgcatgagcatctggagcatcgggacacccgcggttccgccgggttcgccgtcgtcgctcgccttctgcacggaggcgtcggcgccgatcacgtacgcgaagcagttgtgggaggcgctcggatgctccttgcggacgcgggagacgaagtcctgcgcttcctgttcggtggcggcgggggcgagggagcagaggaaacgggatcggttgatctcgctctcgtgcacacccgcgcgggcgacggtccggtactgctcctgcatccgtccaccctatgcgccgccgcgaggacgggtccctgcgggaatgagcgggcgggggtcgccggttgtcccggcatgaacgcagacgacacgtacgcggaccccgcgacgatcaggcggattctccaggacaccggcgacacctgggcggtggtgggcctgtccggcaaccggtcccgggcggccttcggtgtggcggaggtccttcagcggttcggcaagcgggtggtgccggtgcacccgaaggccgagacggtgcacggggagcaggggtacgcctcgctcgcggacatccccttcccggtcgacgtggtggacgtgttcgtcaacagcgagctggcgggcggggtcgcggacgaggcggcggcggtgggcgcgaaggcggtctggttccagctcggcgtcgtggacccggacgc

SEQ ID NO: 3858 - DNA, 2578 bp, Unknown
  Kingdom: Bacteria, Phylum: Actinobacteria, Class: Actinobacteria, Order: Streptomycetales, Family: Streptomycetaceae, Genus: Streptomyces
gttccggcgagcccggggaacggccgcgacggcggcgccggtcggcgagccgggacagcctgcggcggtaggcctcgtcgtcgcggacggcgagggcggtggaggtggcggaggcgacggcggacatcacggcggcgacgacgaccgccgtctccgggttggcatcgccgcgcccgtccgggatcaggcgcagcgcgatcagcagcagcgagccgttgaggaagaagaccagggcgcccaggacgagcgcgggcacgatgagcagggcccgcacgaggacgggccagaccagggccgacagaaggccgaaggctccggcaccccaggcggcggtgaaggccgtcttggtgatggtgtcgccgtcgtcggcctcgagccggaagtcgggcagggctccggccagcgcgagcatcgtgagggtggacaccgcccagaccgcgatcacccgcatcagggcccggcccgccgtacgccacttcccgtcacccacgccggtccacctcacaccctctccgaccccggcccgttcgtcccgagcccgccttcagcttttcacagcgccgtcgccggtcagcggcctcggtccgaccgtgcgaagggcggcgggacggtacggggggcgcataggctcgtaccggcagcgcaccccggcacgggccgcgcgggccgctcgtaccgggacccggaatcgcgggactcggaattacgggacccggcatcacgggttacggatcacgcatcagagtgtggcgaggatcgcgcgaggaggccgaggcgccggtggagatcacctggtggggtcatgccacctgcacgatcgaggactcgggggtgcgggtgctgaccgaccccctgttcgtacggcgtttcgcgcatctgcgccgccgccggggcgacgtgccgccgccgcgggccgcggtcgccgaggtggtgctgatctcccatctgcactccgaccatctgcatctgccgtcgctggcccggctggctcccgggagccggctgatcgtgccgagcggcgcggtggccgcggtgccgggactgcggatgctgcggcggatgcggcagctgcacgtgaccgaggtgagaccgggcgacacggtgcgggtcggcgaggtgcgggtgcgggcggtccccgccctgcacgacgggcggcggctgccggtcgggccgcaccgcgtgccggcactcggctatgtggtcgagggcgaggcccggacgtatttcgccggggacaccggcctcttcgacgggatggccgacgccgtggggccggtggacgtggcgctgctgccggtgggcggctggggaccctacctgggacacagccacctggacccggcccgcgccgccgaggcgctgacccgtctcgcgccgaggtccgcggtgccggtgcactacggcacgtactggccgatcggcctggacggggtgcgcccgcacgagttccactcgccgggcgacgagttcgtacggtacgcggcgaagcgggcgcccgaggtgacggtgcatctgctggggcacggcgaacgcgtcaggccggaggccggccggtgatccaggagatccagcaggtggtgcgggaactgcccaccgagtcgacccagcaggcggtcggctatccgaccctgttcgccctggtggcgctggggtccttggtgcccgtggtgccgacgggggcgctggtgagttcggcggcggtggtggccttccaccagacgtcgccgctcaccctgctcttcgtcttcctgacggcgtcggccgccgcgttcctcggcgacgtctgcctgtactggctgggacagcgcggggtccggtcgaagaacggctcgaagtggctggcggccatcacccgcagggccgcgccggagcggctggcccaggcgcaggagaagctggcggagcacggcgggacggtgctggtgctgtcccgtctggtgccggccgggcggatcccggtgatgctggcgtgtctgctgggcaggatgccgttgcggcagttcgcccggggcgacgttccggcctgccttgcctgggcggcgacgtaccagttgatcggcatcctgggcggttcgatgttcccggagccgtggcagggagtggtcgcggcggtcgccctgacgctgctgatcagcggggctcccgcggtgtggcgcaggctgcggtcgcggttcggccacgggacgggcgacgcgacgggttgaacgcgccaccgtccgggggcggccatgacgcgacacgcacgcaccgcgcacggcgtctccggcttctccccggcctcgctcagcgcagcgcgccgaacaccgccgcgaacccgtccagcgcccgcgccacatgcgcgagctccaggggcttcgcggcggtgagggactccgtccgctgctgcggcgtggcccccagcagcggtccggtgcccaggcgtacgcgcagggcgcccagctcgtccccgaagcggtgtccgccgggggcaggtgcgccgagccggtcggtgaggtactcctccagctccatggagtccgtcacgcccacctccgcgagccgtgagcgcagcgggcccaggtcggcgtagaggtggcgg

SEQ ID NO: 3859 - DNA, 912 bp, Unknown
  Kingdom: Bacteria, Phylum: Actinobacteria, Class: Actinobacteria, Order: Streptomycetales, Family: Streptomycetaceae, Genus: Streptomyces
cccgagcggcacctacggcggcctgtaccagttcgacacccggacctggcagtccctcggcggcagcggccgtccccaggacgcacccgccgccgagcagacgtaccgggcgaagaagctgtacgtgcagcggggggcgagtccgtggccccactgcggccgtaggcttaccgggtgagcagcacagagcccgacgccctcctgggccccgcagacatccgcgacctggccgcgaagctgggcgtacgccccaccaagcagcgcggtcagaacttcgtcatcgacgccaacaccgtccgccgcatcgtgcgcacggccgaggtccgcccggacgacaccgtcgtcgaggtcggccccgggctcggctcgctgaccctggcgctgctggaggcggcggaccgcgtcgtcgcggtcgagatcgacgacgtgctcgccgccgcgctgcccgccacggtccaggcccggatgccggagcgcgccgagcgcttcgccctggtccactccgacgcgatgctggtcaccgagctgccgggcccggccccgaccgcactcgtggcgaacctcccgtacaacgtggccgtccccgtcctgctgaccatgctggagcgcttccccagcatcgagcggaccctcgtcatggtccaggccgaggtcgccgaccggctggccgcccgtcccggcaacaaggtctacggcgtgccgtcggtgaaggccaactggtacgcggaggtcaagcgcgccgggtccatcggccgcaccgtcttctggcccgctccgaacgtcgactccgggctcgtctccctggtccgccgcacggaccccatcgccaccaccgcgagccgcgccgaggtcttcgccgtcgtggacgcggccttcgcccagcgccgcaagacactgcgcgccgccctcgcc

SEQ ID NO: 3860 - DNA, 2516 bp, Unknown
  Kingdom: Bacteria, Phylum: Actinobacteria, Class: Actinobacteria, Order: Streptomycetales, Family: Streptomycetaceae, Genus: Streptomyces
cgtactcgggaggtgcgggttcccggcgtccagccagcggcccggggtatgggcgcgggcctccgccgcgctgagctgtggccggttcgcggggacggtgacgcgggcgccggggccggtgttgcggtgctcggcgaagcgctggtcctgccacgggaagcccgcggacatggtgacgtacggctccttcgcgtcgatccccgggccgagccggctgtcgcggacggtcagcatggggtgcgcggtgaggtccgaggagggtacccaggggcgggcgagcttgtagtaggcgtcgggggcggtgctcgtgacgcgggagcgcaggaccaggaagccgtacggattggctcgggcggtgctcggcgcgaagacatagccgtacggggccgaggccagatcggtgcgggcgagcgcgcggaagtggcagtggtcgaagacggcggtggcgcgcccgaagacgaagtcgacgtccccttccatgaagcagtcgcggtagtactggcgggcgaacgcggtgacggcgggggagtcggcgtacagggtgtcctggtggccgaggaaccggcagccgtagaacgccgaccggtccccctggaccttgatggcgacggcctgcgtgccggtgtactcggggttgtccgagcgcagccagtcgttggcgaaggtcaggtcgcgggcggtgaacccggccgcccggacggtgacggaggccgatccgctggtgcccagggttccggacccgtcgggcttgggcgtacccgccgcgttgtcgtacacgagcacggtgtcccgggcgtcaccgctcgcaccgatcagggtgagctcctcgtgggcggggccgatgagcaccgtcgcccggtacacgccgggggcgatcacgagggtctgtccggtgccggccgccgcgtcgacggcggactgtacgtcggtgtggtcgccgcggccgtacgcgtcgacgtacagcgtgcgggggtccaggcgccgggtgggtgagccgtagcggccgaaggggcggggggtcacggccccggcgtgggcggcggtcgcgccgagtgcgagggaggcacccgttccggcgagcagggccagggcggtacgtctgctgggcagggaaggtccgctgggcatgaagggactcctcgggtgagcggcgaaaggccggagcggcgctctccgggatggtggaaagcatgcggtgccgctccggccggttcagggaggtgtgtgtggcagcgtccggtgacggtcacgcccgggacgatgaggtccgggaccgtcgtgtccgggtgtgaaggcccgagtgctcagcggccggtcacgctcaccctgcccgctcccgcctcaagcgccacgagcaccggcacgacgagcgggtggtggaccgtcgtacgcaggcggggagtccagccggcgccctcggtgaggtgctcgccgggaacacccgcgttgtgcacggcgaccaggtcggtcttccgcccgtcgacgtaattgttccttgccgtgagcgacgactccgaccacttcttcaggatcgtcgcgcggtccacctcccgtgtgagggtgaacgcgttgtgttcggcgaccagttgggactccgctccgatgccgtacgtgtatccgtaggcagtgtccttcgtcgccacgaagtggttgttgtacgagtcgacctggccgaaccgcacgcgcggtgcccgctccttgacgtccttgaagaggttgtggtggagcgtgacgcggagcttgccccggtcggtggcgccggcgccgtcgctgttgccgatgagcatggtcttgtcgtgatccttgaggacgttccacgagacggtgaccaggtcggcgccgcgcacgatgtcgaagaggccgtcgtgctgctggtacacctggccgaagtagtggggctggtccgcgtcggggcggtcgccgtcgctgaacgtgttgtggtcgacccagacatggcgggacccgtacacgacgaggttgtcgtactcggagttccaggcgccttcgtccccgtccgtggggtcccactgggggaagcagtcgtaggtgtcctcgaaggcgaggttgcgaatgatcacattggagacgtccctcacctggagcgaggcgccgatgaccttcgggttcttccccacgccgaccagggtggtgttggaggggaccttgatattgacggctgccgcctgcgccttcgcggaggcgacgcgggcctcctccagcggacccgaggggaccgcgtcccggccccagacctcggggtcgtaggcggcgaggtacttctccagcgtgtagccgccggttcggtactgctcgcagccgatcggcgtgccgttgacgtcggagttgccgtgcagggtcccggagatcctgacgatcttcggcgcgtcgcccgcctccgcgaaggcggcgatgagttcggcccggttggtcaccgtgtagacgtggtcgggggtggcgttcgcgccacccgtggtggagccgtcgtcggcggcccagccgtctccggcgggcagtac

SEQ ID NO: 3861 - DNA, 719 bp, Unknown
  Kingdom: Bacteria, Phylum: Actinobacteria, Class: Actinobacteria, Order: Streptomycetales, Family: Streptomycetaceae, Genus: Streptomyces
gacaagatgcgcctcgccgaggagggcttccacgcgcccctcgacctggtcgacggcgcggcccgggtctacgacccgatcgtgcgcggtgagagcggcgaggcgctctacggctgcttcctcaaggactacgcacccgccaactggtaacccgaacggctcaaacggcccgacggccccgtgcggcggccgaaaacccggcccaggatgttccctgggccgggttttcgctgcactcggtggccgaaagtgacctactgcacacgttctatcgagcgcggcggcgctcatttggttacgctgaggcgaacggacgccatcgaggagcccacgaaggtttcccgaccgtcctgggacatggccggtaacccgaccattgttccgcccctaaccggcgccaccgcgaccgacatatcccaacccctgccccgcgcggggcggtcgcgccccggcatcgctgccggagcgacggcgacgccccgggcgacgcgacacgaaggagtgcgcggtgacgacaccggaactgaccgagcgcgaaatgcgccccgccgaacggaacacgagccggcccggccggcccgagaagctgcggaacatcgaggtctgggccaggtccgccccgatccggctcgccggatacgaggacgacctcgccgagccgcacatcctgcccggcatcgactgaccgctcagcgcgtcccggggcccgtctccccgcc

SEQ ID NO: 3862 - DNA, 3047 bp, Unknown
  Kingdom: Bacteria, Phylum: Actinobacteria, Class: Actinobacteria, Order: Streptomycetales, Family: Streptomycetaceae, Genus: Streptomyces
ccgcttcgctggtggccgtgtcgcccgcgatggcggcgggtcgctcgacgcagtgcagccggtgagcggcccgcaggtcggcggcggcgctccgggcggcctcggcgatcgccccgtcgtcggtggtgacgacgacgtcggtgacctcgggggcgccgagcgcggcgcggacggcgcgggcgaccagggggatgccgccgacctcggcgaggttcttggcggggacgcctttggatccgccgcgggcggggatcacggcgaggacggtcggggtcatggtggctgctcctggagtggtgttcacagctcccccatccggcggatcacgggggccacgcgctggacgccctggcggtaggcgccccgggccgcgttgcggacggtttcgcgcaccgcgccccggacccggccgggctcctgcggtgcggccgcgccgggcaggggagtgccgtcgggggccaggtggtggcggccgaggatgccggggaggtagccgggggcgggggcgggtgtgtagtagggggccagcggcgggagttgtcccgtgccgaggagggcggtgaccttggcgcgggccgtgtcgtaggcggtgccgtacgagccgtcggcggcgacgccctggccggccagccactggccgtcgggccggggccggatcccgccgtcgagccggtcccaggaggtgaggagcccggagccgacgaagtggtggttgccgagcgtctcgcggacgccgaggtcggtgaggacggcggtcgggatgcggcggtgcagggactccagcgcggccgtcgaggagaccgtgaccaggaggtcggtgcggtccaggacctcgcccatgtgcccgtacaccagacggaagttgggcggcaggccacccggcagccgctgcgcgagcttctggtagggcagttcctcgatgtgcgtggtgtgctcgccgggcttggagcgcagcttgagcagcacctcgcggcgcgggtgcagccgggcgtgctcgacgagcctgcgcagcaggtacgtacggtcggcgcgggaggccggcacggagggctgggcggcgaacaccaccgtgtcgcggccctcttcgggacggtagggagctccgcccaggaaggggagggcggcctccgtgacggccgatgcgtcggcgcccactccctcgtacaccgcgcggaaacgctccgcgtcgtgggccgagttggcgaggacgacgtccgcgccgtggcggagcaggagtccgtcggcgagcttctcgtagacgacgccgacgtatccggtgacgacgacgggccggcgcggcaggtcgagggcggcgaggccgtgcagcatggcctggacgccgccgccgacgagggcgaggacgacgaggtcgtaaccctcgtcgcgcacggtgtgcaggaactcgacggcggtgacctcacggactcgctcggtgtcgatcccgacctcgccgacctccgcgagctggcggggcgtcggggtggcccggccgcgcagcagcagcccgctgacctcgacgggccgggcgtccggaccgtccgccccggcggtcagacggcgcgcggtgagcgcgccccatttccaccgggtgtcggagtcggcgaggacggcgacccgcagcgccggtcggagcgcggcgggggtttcggccggttcggcctcattgctggtacgtgggggcacgtcctagaagttaggaaggcatttcgatgcgcggcccaacgtgatggcaacagatggttaacagcgagccgacgattggggggcgggtccgaagaggacctcaattccggttccgcgaaaggtgattcacctgagcgacgggcgttgttcacctcctgggcgcattgcggaaaaggaatgcgccggagccgcacctaacgtgatgtgcgtggttaagctctccgtcatcgtgccgttcttcaacgtgcagacctacgcgcccgacaccctcagaagtctgcgggccaacgcccgcgaggacttcgagttccttctcgtcgacgactgttcgaccgacgggacaccccggctgctgcgccgggccgccgacgagatccccggggccgtgctgctgcggcacgaggtgaacggcggtctggcgaccgcgcgcaacaccggtctggaggccgcccgcggcgagtacatcgccttcctggacggcgacgactggctggcccccgggcactacgagcggctggtggcccggaccgaggcgctgggctgcgacttcgtgcgcaccgaccatgtccaggcgaacggcagatcgcggaccgtacgccgggtgccgcacgggccgcacggggtggtgagcgacccccggtccgcgatcctgcccgcccaccgcaccacctcggtggactacgcgttcgcctgggctggcctctatcaccggcggctgctggaccgggggctgctgcacttcaccgacgggctgcgcacggccgaggaccggccgtggatctggcggctgcaccgggaggcggaatccttcgccgccctgggcatgctcagccatttctaccggcgcggggtggccacctcactgacccagatcggcgatgtgcgccagctcgatttcctgcgcgctttcgaccaggtgatcgccgagacggccgccgaccgtgacgcggacgatttgctgccgaaggccgtacgcacctattgcgcggtcatcgcccatcatctgggcgctctcgacaaattcgaaccggccgtggtccgcgagctgaagtcgcgcggcgcggcggccctgggacgcctgccgcagcggctgctggacgaggctctcgacgccatggacgtgacacgagcgccccgggtgcgcaggctgcgccgccgtccggtcgccgcgaagggggcctcggccgcatgaccatccggatcttccacgcctcctcccccgccgcgacgatgctgctcgccgcggcgatcgacgcgggctgcttcaccgagcccgaccgccggatcctgctgctgtcccggacggggcaggctccggagaccgtcgccgatgtctcggagaccgccggcttcgagcggctgcg

SEQ ID NO: 3863 - DNA, 858 bp, Unknown
  Kingdom: Bacteria, Phylum: Actinobacteria, Class: Actinobacteria, Order: Streptomycetales, Family: Streptomycetaceae, Genus: Streptomyces
cgtcgaggccggccgccgcgacggcggccggcctcgacgtggtggacctgcgctccgagacgctgcgcaccgagttccgtgacatcggcgcggtggtctacttcctgcgcaaggtgatctggatggtgccgggattcaccgtcgagcagtaccggccgcaactggccgcgctgcaccggcagatcgaggcggaaggaccgttccgcgcccgcacggcccgcttcctgatcgaggcccgcaagcccctgtgacggcggccggtggtcaccctccggtcaacccgcctaccccgtacgccagttcagctttaccccggaggcaacgggatcgcgcgggcgaccgtcctactcgacgggacgcacgcacagcgaaggagggggagcggtcatgaccgtggagaggggagactgtgcggcgcctgccggtcgcgcgcggcacggcaacgccgactggctcacgggggccaggatcaccgccgtcctgggggtctactaccggcccgagggccgggcgggcgagccggaggccgtcgagttcgtcctctcggaggaccagtccgtcctgctgacctgcgcctccgaccggacgctgcacgtcaccccgggcgcctggccgaggctgcccgactggtgcgtaccggcgaaccagtggcagcacgccccgcccgccctgctcccgccggtgccgtacgggggagcgtggacggtcgtgggcacccaggagctcagggacgccgacggggaggtgctccaggccgtcatccggtgcgaggaaggggacttcgtggtggtcgccggagacacgatggcgatccgcttcgatccccgtccctgacacgagagcccggcccccctgacc

SEQ ID NO: 3864 - DNA, 1508 bp, Unknown
  Kingdom: Bacteria, Phylum: Actinobacteria, Class: Actinobacteria, Order: Streptomycetales, Family: Streptomycetaceae, Genus: Streptomyces
cgcccggctcggtcgtccgtcgttcgtggccggaggctccggcctcggtcgtccgctgctcgtggccggggacttcgggcccgggcggcgtcacctgtccgttccctccggcgcggtgcgccggtagtcgccggacttgccgcccgacttcgcctcgacccgcacgtcggtgatgaccgcgctcttgtcgacggccttgatcatgtcgaccaccgtgagcgccgccaccgagaccgcggtcagggcctccatctcgacgcccgtgcggtccgtcgtcttcacggtggccgtgatctccaccgcgtcgtcggccacgctcagatcgaccttcacgccggaaacggccagcggatgacagagcgggatcagatccggggtgcgcttggcccccatgatcccggcgatccgggcagtggcgagggcgtctcccttggggactccctcgccgcgcagcagctcgatcacgcgcggcgaggcgagcacccggccggtggcgcgggcgacgcgggtggtgacgtccttcgccgacacgtcgaccatgcgggccgcgcccgcctcgtcgatgtgcgtcagcctgttctgcgtactcaactcactccgcctagcggtaggggcgccggtcacgcctcggggaaccggagggtgtcccccggaaggcacggcggcagataccgtaccgccaccgggcggcggtcagccgagcaggatcacgtccgtctccgtgccgggctcgaccgaggtcacgtcctcgggcaccacgatcagcacgtccgcctgcgcgagcgcggcgatcagatgcgaaccggaaccgccgaccggagtgaccgtgcccgcctccgcgtcgtagcggccgcgcaggaactgacggcggccgtccggcgacgtgagcgccttgtcggcgctcagccgggcgcgggccgtgggacggtgcacgtcggtgaggcccatcagggcacggatggcggggcggacgaacaactcgaaggagacgtagctggagaccgggttgcccggcagggccagcagcggggtgtggtccgggccgatcgagccgaagccctgcggcttgcccggctgcatggcgagcttgcggaactcgacccctccgcccggctcgtcctcgtccccgacggaggacagcgcctccttgaccacgtcgtacgcgccgacgctgacaccgcccgtggtgacgacgatgtccgcgcggatcagctggtcctcgatcgtggcgcgcagcgtctcggcgtcgtcggccaccgcgccgacccggtaggcgatggctccggcgtcccgggccgcggccgtcagcgcgaaactgttggagtcgtagatctggccgccggtcagctgctcgccgggctggaccagttcgctgccggtggacaggacgaccacgcgggggcggggccgtacgaccacggtggcgcagccgatcgccgcgagcagcccgatctgcggcgggccgacgaccgacccggcggccagggccaggtcgcccggcttgacgt

SEQ ID NO: 3865 - DNA, 2819 bp, Unknown
  Kingdom: Bacteria, Phylum: Actinobacteria, Class: Actinobacteria, Order: Streptomycetales, Family: Streptomycetaceae, Genus: Streptomyces
cgaggaccaccacggcggcgcggccgacgacgcggagaaggccgacgaccacaaggccgccgacaccgacgcgtcgtccaaggagagcagcaccgtcgcgtcctcctcgtccagcgacaccaccgcccgcacgctgggcatcatcggcatcgtcatcggcatcgggggcatcgcgttcggtgtgctcgccggacgtcgccgctcggcctgaccggccggttccctcacccgcaccacgttcaggacacctcatccatgcgcaacaccaaagcagtgacggccgtggcgttcgccgccgcggccgcactggccctctccgcctgcggcaccgctgacgacaaagcggagtcctcgtccatcgccgacatcaacgccgcgccgaaggacaaggccgccaccgtcctcgaccagccgttcaccaagccgaacctcgtcctcaccgacacccacggcaaggagtacgacctccgcgaggtgaccaagggcaagccgacgctcatctacttcggctacaccaactgccccgacgtctgcccgctgaccatgagcaacatctccctcgccaagcgggagctgcccaaggccgaccaggagaagctccaggtcgtcttcgtcaccaccgaccccgagcgcgacacccccgcctcgctcggcaagtggctctccgcccaggacccctccttcaccggtctcaccggcgacttcccgaccatccaggccggggcgcggcagatcggcatcggcatcgacgcgccgaagaaggagaaggacgggaccatcgtctcgatgcacggcgcccaggtcgtcgccttctccccgaagacggacgagggatatgtgctctacggcgaggacaccaccgccgaggagtacacgaaggacctccccaagctgatcaagggggaggctccgtgaaccgccgggtggccctcgccggcgtcctggccctcaccacggggctgacgctggccgggtgctcgtcggacagcgcgcccgacctgaaggtcgtcggcgcgtatctgccccagcccgtcagcgacatggccgccggtttcctcgtcgtccagaacaacggcgacaccggggaccggctcacctcggtgaccagtccgctctccgacgacgtcacgatccacgagacgaagaaccagaagatgcgcgaggtctcctcgttcgaggtgcccgcgggcggcgagctcgacctcgaacgcggtggcaaccacatcatgttcatgaagctcaagcagaagcccaagaagggcgagaaggtctccgtcgagctgcacttcgagaaggccgaccccatcacggtcgacctgccggtgaaggaaaccacccacaacccgaagaagcagtgagggactgaacccatgtctgccaccgccccgtacgccgggccgtccccgctacgacggcccgtcgccgccgtcgcgctcctcgccgcgctggtcagcctggtattcgggctgctgctggccggcgcgggcccggcgtccgcgcacgccgccctcaccgggagcgacccgcaggacggggcggtggtggacaccgcgcccaaggaggtcaccctcagcttctccgaggccatcgccgtgggcgacgactccatccgggtcctcgaccccagcggcaaacgcgccgacaccgaagccgaaccgcgcgatctctccgagggcggcaccgtccgctacggcgtcgcgctccactccggtctgccggacggcacctacacggtggcctggcaggcgatctccgccgacagccacccgatctccggcgcgttcacgttctccatcggcgccccgtccgagaccacggtggccctgtcctcccaggaggcgggcggcggcccggtcggcgtcgtctacgacatcgcgcgctacgccgcgtacggcggattcgtgctgctcgtcggcggcagcgcgttcgtcctggtctgctggcggcgcggcgcgaccgccctgccgatgcagcagctcgtggtccgcggctggctcacgctgaccgcggcgaccctggtcatgctgctgctgcgcaacccgtacaccggcagcgggaagttcgccgacgccttcgacctcgccgggctccagtccgtcctggacaccaagcccggcgccgccctcgtctcccggctgctgctgctcggggccgccgctctgttcatcgccgtgctgttcggcacgtacgcccggcgcgaggacgagcaggaaaggaaggacctcaccttcggcctcgccgtcgggggtggggtggtcgcggcgggcatcgccgccacctgggcgatgtccgagcacgcctcgaccggcatccaggcgagcatcgccatgccggtggacgtggcgcacctgctggccgtcgccgcgtggctcggcgggctcgcctcgctcctggtggcgctgtaccggacgccggacatcgggagcgccgtggtccggcgcttctccgcggtcgcgttcggcagtgtcgtggttctggcggcgaccggtatctaccagtcctggcggcaggtcggctcctggtcggcgctgaccggtacgcgctacgggcagctgctgatcgtgaaggtggcgctgatcgccgtcctgctcgcggtcgcctggttctcccggcgctggacgggacggctgacggacaccgccgtcgcctcctccgggaccgaggaggaagacgccgcgaccgagccggagaacaccgccccgaacggggtgtccgacgaggtcgcccccgagcgcgccgcacaactggcccgtcagcgggccgtcctgaccgcgacgaagaagaaacggatacgggacgccgacccggagcgctccggg

SEQ ID NO: 3866 - DNA, 1337 bp, Unknown
  Kingdom: Bacteria, Phylum: Actinobacteria, Class: Actinobacteria, Order: Streptomycetales, Family: Streptomycetaceae, Genus: Streptomyces
cccagcccgacatggaggtcgtggccgaggccggggacggggcggaggcgatcgagaccctgcggtccaccgccgtcgacgtggtgctgatggacgtccgcatgccccggctggacggcgtcgaggcgacccgccgcatctgcgcgcagcaggacccgccgagggtgctgatcctgaccaccttcgacctcgacgagtacgccttctccgggctgaaggcgggggccagcggcttcatgctcaaggacgtgccgcccgccgagctgctcgccgcgatccggtcggtgcacagcggagacgcggtcgtcgccccgtcgaccacccgccggctgctcgaccgcttctcgccgatgctgcccagcggcgacaaggagccgaagaacaagcacatcggcaagctcaccgaacgcgaacgggaagtcatgctcctggtcgcccagggcctgtcgaacggggagatcgcggcccggctcgtgctctccgaggccacggtcaagacgcacgtcggccgcatcctcaccaagctgaacctccgcgaccgggtccaggtcgtcgtcctcgcctacgagaccggcctggtccgggccggcggcggcgcgggctgagcagccgcggcgcgggacggcctccaggaagccgagacgactcagcgcaggacgccctccaggaagtcgctgccgagccgggcgacgaccgtcaggtccagctggtgcaggacgtagcggccgcggcggcgcgtcgtgaccagcccggccttcttgagcatggagaggtggcgggagacctcgggggaggtgatgccgttggagtcggccagctcgccggtggtgtacggggagcgggccaggttgcggcagagccgcatccgcatcgggtgggccagcgcctccaggcgcagctggagcagttccacggaggcgggcgccggcaggtcgggcaggtggaccgggtagtggatcaccggccgccagcccggggcgtgcagcaccatcagatgcggccagccgaagctggtcgggatgagcgtcagaccccggccgacgcccgggtcgacggcggtggtccggccctcggacagcttgtcgacgttgatccggcccgcgctctcgtccagcgtcacggcggacgacaccgccccgaccgcgtcggccagtcccttgcgccgcagcaactccgtcttgtgccgggcgtcggcgaccagctggacggagacccggcgccaggtgtccgcgaagaacgcctggtcgcagtcctcgaagagccgccggacccagccgcgtacggaggcggggtcggccagcagccgccgggtgaagtccatctgctgcgggccgcgc

SEQ ID NO: 3867 - DNA, 4376 bp, Unknown
  Kingdom: Bacteria, Phylum: Actinobacteria, Class: Actinobacteria, Order: Streptomycetales, Family: Streptomycetaceae, Genus: Streptomyces
tgccgcccctgcacatcctctgggtgcccgcacccgagatcggggaccaggcggtgctggagaccccgggcgtccgggtcgacgtcatcgacgacccccgacgggatccacttggccctccgcagctgcaccactcccccacgctgtacggcgtcggggcccaccgcatccggggcggcggccgggcgccgggccgggtcactccggcagcggggtcccggggccgggtgcggcggcgcacgccgcgtccagccggatgcggtgggccatcacggcctcggggtcgtcgatgacgtcgacccggacgcccggggtctccagcaccgcctggtccccgatctcgggtgcgggcacccggaggatgtgcaggggcggcactccggtcagggggtgcggcgggtggtccatgggcaccacctggacggtgacgtgctgctcgtgcatcgcctcggccagcgcggcccgctgcccgtccatggtctcccggtcgccgacccgcgtatggagggccgctgccgggaacagggcccacagggcggccccgcgctcgcgcatacggcggcggcgctcccggagcagctcgacgcgtcgttcccggcgggctgggctgtcctcgggatactgcgtgcggtggagcgcggcggcgtacgcgggtgtgcgcagcagctcgggcaccagcgccgggtgccaggtgcgcacgaggctcgccgaggattccactccgatgacgtcctgctgccagccgtccatcgcgtcccgccaccggtgccaccagccgggcaggttcgcggctccgagcccggccatgatgggatcggcgacggcgggcggaacgccgtagcagcgcagcagttcgccgacctgccgggggtcgagtccggtctcggcgcgttcgatgcgccggacggtggcggggtgggcgtcgagcgcctcggccgcggcccgcaggctgattcccgcgcgttcccgcagcatacggaggcggaccgcgaggacgcgatgctccacggtgggaccggatcgggctcgcatgcgcataccttcctcgtcgagccccggggcggagcactacacactctgtcgcttgcaaagtatgcgctttgcgccgagagtgcatacatgtcggaaatagtcagttgcgcggagcatgctcccgatgacggaggtgtccgaggtgccggaggtatccgaggtgcacacagctggtgggttccccgattgcccgggggtgttccggaggcccggcaccgggtccaggaggccatgcgagcctggggcgaaccggccgaccggatcgaggcggcggctctgatagtgaccgagttggtcaccaacgccgtgcagcacaccagcacccggcgaatccgctgccgactcctgcgctccgcggacggcgtgcgcatctgcgtatggaatcgcggccgggcccggatcccggcgccggcgtccccgggcgactcggcgggccttcccgtcgccggggtcccggcgacagacggccgcgaggacgacgacacgctcgatcgcctggcggaggacggcaggggactcctgctcgtcgacgcgctggcggcccgctggggcacgcgcgccgcactggcgggccgcctcgtctgggccgacctctagagttccagccttcctacgacgccccgcagcgccccgtgacgcctccgcgaccagccggaccgcccgccctccgggcgttcccccgatgtcctcgcgtgatcaggcgggagcggtacggcactccgggtggccccagccgttcgggttcttcgcgatcggctccttggccgcgtacggctttccgcagtggcaccggcccgcgaagcgcgccgtgatcgtgccggtggaccgcccgccccgggacgcgcccgcggcacttcgccccttcgcgccgcccgacgtcccggacgcctccgaccgccccttcggggaccgcgcgggcgcgggcaccggcagcgccgtggcgccgtgcgccgtgccggccgggcgctgagccacggccgcctcgctggcggcctggtcggcgatcgcgttgagcgggtcgccgttcacctggtgtgccggcacatagcggaacgtcaccgaacggtcggtgagcagagcgtcgatgcgcgtgaccagctcacggttggcgacgggcttgccgccggaggtcttccagccgttgcgcttccagccgggcagccacttggtcacggcgttcatggcgtactgcgagtccatccgcacctcgacgcgcgccgccggaccggtggactccagcagctccgccagcgccgtgagctcggcgacgttgttcgtcgcggtgccgagcggaccggcctcccagcgcacggggttcccctgcgcgtcggcgacgacccacgcccaggcggcgggccccggatttcccttcgacgccccgtcacacgcggcgatgatgcactcgttcatcccctgatcatgccagctccgcatgaccgttccgaccggccgcgcggtcgccgcgaccggggcgcgccacgacgtctccggcccgcgtccttgacctcaaccaaacctgaggtcatagcgttccgagtgaacccggggccgcacggcccacggggtccgcaggccgtcgggggaaccgggggccgtcagacttcggagcgccccatggacatggaagtcacggcgtggcattcgctgcacagtgcgatgaacgcccagcaggaccgtcggcccttctcccggacggcgttgcgccgcatcatggtcttcgcccggccccaccggcggaggatctaccgcttcctgctgctgagcgtcctgacggcgctgctcgcggtggccaccccgctgctggccgggaaggtcgtcgacgcgatcgtgaacggtgcggagaccgggacggtcacccggctcgccctgctcatcgcgctcatcgccgtcgtcgaggccggtctcggcctgctcacccgctggctgtcgtcgacactgggcgagagcctgatcctggacctgcgcaccgccgtcttcgaccacgtgcagaagatgccggtggccttcttcacccggacccggaccggcgccctggtcagtcggctcaacaacgatgtgatcggcgctcagcgggccttcagcaatacgctctccggcgtcgtctccaacgtcgtcacgctgctgctgacgctcgccgtgatgctcacgatctcctggcagatcacgctgctctcgctggtgctgctcccggtgttcgtcgtgccggcccgccggatgggggcccggatggcggggctccagcgggaggccgccgaccacaacgccgccatgggcacccagatgaccgagcggttctccgcccccggcgcgacgctggtcaagctcttcggccgcccctccgacgagtcggccgaattcgccgcccgcgccgaccgggtgcgtgacatcggcatccgtacggcgatggcccagtcggcgttcatcaccgctctcacgctggtctccgccctggcactggccctggtctacggactcggcggctactacgccctgcgcggcagcctggagccgggagccgtcgtggcgctggcgctgctgctgacccggctgtacgcgccgctcaccgccctcgccggggcccgggtcgaggtgatgagcgcgctcgtcagcttcgagcgggtcttcgagatcctggacctgaagccgctgatcgaggagaagccggacgcccgccgggtgccggagggcccggtctccgtggagttcgacaaggtgtccttcggctacccctccgccgagaaggtctccctcgcctcgctggaggaggtcgccacgctcgacgaccgcggcggcacaccggtcctgcacgaggtctccttccgtgccgaaccgggccagatgatcgccctggtgggctcctccggagcgggcaagtcgacgatcgcgcaactgctgccccggctgtacgacacggacgccgggaccgtgcggctgaacggtgtcgacgtacgcgatctgagcgcggactcgatccgggacaccctcggcatggtcacccaggacgggcatctctttcacgagtcggtgcgggccaacctgctgctcgcccggcccgacgcctccgaggacgacgtctgggacgccctgcgccgctcccggctcgacggcctgatcgcctcgctgccggacgggctcgacacggtggtgggcgagcgcggctaccggctctccggcggggagcgccagcgcctcaccatcgcccggctgctgctggcccgtcagcgggtcgtgatcctcgacgaggcgaccgcgcacctcgactccacctcggaggccgccgtccaggaggcgctggccgaagcgctggccggccggaccgccctggtgatcgcccaccggctctc

SEQ ID NO: 3868 - DNA, 5087 bp, Unknown
  Kingdom: Bacteria, Phylum: Actinobacteria, Class: Actinobacteria, Order: Streptomycetales, Family: Streptomycetaceae, Genus: Streptomyces
ggcggcggccgccgccgaggaggccggggacgccgcccgccccgacgaccacgatccgtcgcgagccgcggacccggccgcgaacacgggggagtacatccccgtacagcagtccgccgacccgtacgccgcgaatcccccggcgcacgccccgcaggaagccaccggcggctatgcggcggtcccgcagcagcagtacggcgagtacgcgcagtgggacggccagcagccgggcgccgactactacacgccgtaccagccggacccgtacgcccaacagcaacagcaacagcaggagaacgccggctaccagggatacgacgcccaggacccctacacgcagcagtacaacgtgcagggcacgtacaacgagcaggccacgtacggcgggcagggtacgtacaacgaccagggcgcgtacgacgagtacggccagtacgtcggcgggcagtaccagcaacccccctacgccgcgcccgaccagcaccccgccgagaacggcgaacagaccgaccccccggccccgggccaggccccgtggcagaccggtaacgcatcgcgaggcgagtccgagtgaagtccacccacctgtccctgatcgcgggcgccgccgtcctggccgccatcaccggattcgcgacggtcaccgcgccgggcgccccggcggacaccgggacgaagtccgcagagctgctgccggtcgagcgctccagcctggtctgcccggcgcccagcaactccgacctcgctgagacgcagtacgcctcgttcacaccggcgggcgagggcggcgacgccaagggcaccgccgagctgaaaccggccctgccggtcgtggacgacgaggacgagaccgacccgaagaaggtcaagaaggcggaggaggcggcgaagaaggcgaaggagaaggccgacaagccggtcctcgccgtgaaggagcccggaaagccggtcgtcgccgaggcggacggctccgacgccccggccctcgtcggcacggccaccggcagcctggcccccggctgggccgcacagcagaccaccgaggtcaccgcgggcggcgcccgcggactcctcggggtcacctgcaccgcccccgacacggacttctggttcccgggcgcgagcaccgcgaagtcccgccaggactacctccacctcaccaaccccgaggactccgccgccgtcgccgacatcgagctgtacggccccgagggcgcgctcaagtccgacgtcggcgacggcatcaccgtgccggcccgttccagcgtcgccgttctgctgtccactctcaccaccgaggccgtcgaccagctgaccgcccacgtcaccacccgctcgggccgggtcggcgcggtcgtcctgagcgcggacgacaacgcgggcagcgactggatcaccgcgtccgaggaccccaccggcacgctcgtgctgccgggcatcccggccgacgccacctccgtacagctggtggcgttcgcacccggcgaggacgacgcggacgtgaaggtccagctcatggggaagaacgcggcgttctccccggccgggaacgccaccctgcacatcaagtcctcgatgacggcggccgtcgacctcaaggacgtcacccgcggcgaaccgggctccctgcgcctgagccccgtccagaaggaccgggcgaccccgatcgtggccgcactgcgcgtggtccgcggcaagggcgacaagcaggagatcgcctacatcccggccaccgggccggtcggcgcacgggcgagcgtcccggacaaccgggccaagggctcgacactgtcgctgaccgcgccgggcgccacggccaaggtgaaggtcaccgcgtcggcgggcagcggcggcggcgaaccgaccgtggagacgtacacggtcaaggccggcacgaccctcgcggtcacccccaaggccccggacggactcaagggcgcctacgcgctgaccgtcgagacgacgtcgggcggcccggtccacgcgtcgcgctccctggcgcgcacggaggacggcgtccagatgttcaccgtgcagacgctccccgacgacggggggacggtcgaggtcccgacgacccggcaggacctctcggtcctggacgactgaggtcgcgtcccgctgtcaggcccgggaaggccagggcccttcgtctggatcatgccgggctcgcgaggcccggcccgatccactcgcgaggtccggcccgatccagaagaaagccctaatcctgcccgtaccgggggtcgaccgactcgggcgccagccccaacagctcggcgacctgctcgacgacgacctcgtgcacgagcagggcgcgctcgtcgcggctcttggtacggatctcgacgggccgccggtagacgacgatctgcgcgggccgccccttctccgcggacaccgagctgccgagcggaacggtctcctccggggtgccgggcacatcgaggacgacgaagtcgacctcggccagctggggccaacgccgctccagccgttccaccgagtcctggaccagatcacggaaggtctcgccccggctggccgacagcggcacctgcggtggtgcgaccggcccgcgcataccgcggccatgacggtcacggcgccggggccgcggctcgaacgggtggggaggtacggagctgtccatcaccgacgcagcgtaacgctccgggagccgggaggttcgtggagacgacgcggccgaccggcctttggggagcggccggccggccttgggggaatgcggccgaccggcctcggggggaagcggccgaccggcctcggggggaagcggccgaccggccttcgaggaagggtgtcgtcccgcttccggatgtccgcagttgaacatttcagccaaggttgagcccttttcaggcccgtaatccgatcattgagcctgcgcccgccgccgggatccacccccgtccgcgaccggcacgaccaccgtgtgatcgctgggccccgccctggcgcaggtcagggtagccgcccggaacgacgctgtgccgcaggtcacagggcgacacggtggggtgacccgagggggagtcgtcgcagcccgctcaagagtgcggtaccgtccaacatcgtgagccctgtacgtcgctgttcgcgcaccgcgtgcggccgccctgccgtcgcgacactgacgtacgtctatgccgattcgactgcggtcctcggcccgctcgccacctacgccgagccccactgttacgacctctgcgccgaacacagtgagcggcttaccgcgccacggggctgggaagtggtgcggctctccgacggctccgcaccggcgcaccccagcggcgacgacctcgaagcactggccaacgcggtccgcgaagcggcacgcccgcacgaccggggcccggacggcgggggccggggaccgcgctccgccgacccggtggaagtcgcgcgccgggggcacctgagggtgctgcgctctcccgactcctgaggcacccatcggaagcccgctcctgagaccggggccgagggccgactgtggacgccgactcctgaggtaccgaccggccgggtagtttgggcggtccgcaaagaccccaggaggaccggccgtggttgctgatctgtcgcagctcgtgaaggcgtacgacgtgcgcggagtggtgcccgaccagtgggacgaatcgctggcggaactcttcggagccgcgttcgtccaggtcacggccgccgacgcgatcgtgatcggccacgacatgcgccccacgtcgccggcactcgccggcgcgttcgcccggggagcggcggcccggggcgcggacgtcacgctcatcggcctctgctcgacggaccagctgtactacgcgtcgggggccctcggtctccccggggcgatgttcacggcctcgcacaacccggcgcggtacaacggcatcaagatgtgccgggcgggcgccgccccggtcggccaggacaccggcctcgccgagatccgcaccctggtcgagcagtggtcggaaggcgccccccggccggccgccgcccccgtccccgggacgatcaccgagcgggacaccctcaccgactacgcggcccacctcctcggcctggtcgagctcacggcgatccgccccctcaaggtcgtggtcgacgcgggcaacggcatgggcggccacacggtccccacggtcttcgagggcctcccgctcgacctcgtaccgatgtacttcgagctggacggcaccttccccaaccacgaggcgaaccccctcgaccccaagaacatcgtcgacctccaggcccgcgtcctcgccgagggcgccgacctcggtctcgccttcgacggcgacgccgaccgctgcttcgtggtcgacgagcggggcgcgggtgtctccccctccgcgatcacggccctggtcgccgcccgcgagctggcccgcaacggcggcgagggcatcgtcatccacaacctgatcacctcctggtccgtccccgaggtggtccgcgagaacggcggcaccccggtccgcacccgcgtcggccactccttcatcaagacggagatggcggagcacggggcgatcttcggcggcgagcactcggcgcactactacttccgagacttctggaacgccgacacgggcatgctcgccgccctccacgtactggccgcactcggtggccaggagaagccgctctccgagctggtcgcggagtacgaccggtacagcggctccggcgagatcaactccaccgtcgccgaccagaccgccagcctggccacggtcaggaaggtctacggcacccgcgacgacatcaccttcgacgagctggacggcctcacggtcacggccgccgactggtggttcaacctccgcgcctcgaacacggaaccgctgctgcgcctgaacgtcgaggcgagggacgagaggacgatggcggcagtacgcgacgaggtcctgaccctgatccgcggagcctgaaccagccgacggccgcaccccgctccctcttggccctgttctttcagcctctccggcgtgcgctcctcccgttccctcctggccccgctcttttcagcccctccggcgtttgaggag

SEQ ID NO: 3869 - DNA, 975 bp, Unknown
  Kingdom: Bacteria, Phylum: Actinobacteria, Class: Actinobacteria, Order: Streptomycetales, Family: Streptomycetaceae, Genus: Streptomyces
gcaggagggtttctacgcccgcatgcgggcgtagaaaccctcctgctggtcctggaggaaggcgccccgggtctgttcggcctcctggtaggcgcgtacggcttcacggttgaagtagtagtagtgcaggtattcgttggggatcgcacccagcgaccggagcagttccgcgccgaagaggcggccctcctcgaaggagtcgagcagcttcgggtcggcgagcagccggggcagttcgtcccgcccgtccacgtacagcccccgcacccacccgaggtggttgagcccggcgtagtcgatccaggcccggtccgggtcggctcccaggacgcgggcgacgcgccgccccagaccgaccggcgagtcgcagatcccgatgacccggtcgcccaggtgccgggacatcgcctcggtgacgaggcccgccgggttggtgaagttgatgacccaggcgtgcggggcgagccgggcgacgcggcgggcgaggtcgagggcgacgggaacggtgcgcagcccgtacgcgatgccgccggcgccgacggtctcctggccgaggacgccctcgtcgagggccacccgttcgtcggcggcgcgtccggccagaccgccgacccggatggcggagaagacgaagtcggcgccgcgcagtgcctcgtcgagttccgtggtggcgacgaccgcgggggcgtccgcgatgccccgcccctgttcctccaggacgcgggcgacggcggtgagccggtcggcgtcggtgtcgtacagcgtgacccgggagacgcggccctcggcgtgatcgccgaggagggccccgtacacgagaggcacccggaatccgccaccgccaagaattgtcagcttcacgcttctcgatggtacgggcagctccgggctccccggcgctgcccgcgcccacgccggaacacgacgcggcggccccggagcacgcccacgtgacccggggccgccgcgtcgtgt

SEQ ID NO: 3870 - DNA, 743 bp, Unknown
  Kingdom: Bacteria, Phylum: Actinobacteria, Class: Actinobacteria, Order: Streptomycetales, Family: Streptomycetaceae, Genus: Streptomyces
cgctccgggagccggacagcgcggtcgcggccaggccgccccgttggagggccatcgccatcagcgccgcggaggcggtctcgccggtggcgagcaactggtcgcgttcgtgacccgccgggtgtgggttgaccgcgtcggcccggccgaccagttcgtcggtggtgtcaccctgtgcggagaccacgacgaccacgcgccgtccggagcgggcgagtgcgccgacccggtcggcgacctgacgtacctgggacacggtggcgagcgaactgccgccgtacttctggaccaccacgtcccccgtgggaccgctgccttgcgtagtcacgcgctgcttccccccgccttgtcgggcccggcttcccgagcactgcgacgagcttccaggacggggatatcgacgccgtgtccgcgtcgcaccggcgggctattgcgcgggtatcgggacagtgcggacgcggaactgaccgtggacggcgggttcggccggagcccggcgcccgacggacccgggccggccggtgcccggctcccggacgaccgggcccgctgacagactggtcccatgcatccgccgagcccccgccgcctctccctccagcagatcgtcgaaggccagcgccgcgccgcgttcgtcgggcgaaaggccgaactcggcctgtaccgggccaatttcgcgctgccgccggaagacccccggcaccggttcgtcttccacgtgcggggaaacgccggggtcggca

SEQ ID NO: 3871 - DNA, 3047 bp, Unknown
  Kingdom: Bacteria, Phylum: Actinobacteria, Class: Actinobacteria, Order: Streptomycetales, Family: Streptomycetaceae, Genus: Streptomyces
gggctgtcccggacagccctcggccacgtccgacggggcccgtgccccgcagccgtggcgccggccgaagccggggcggcctccgcgcaccgcggaggccgccccgtcccgcacagccgaccaccacgaaccacgggagccccgatggccgagccgctccgttccaaccgcgatttccggctgctctggttgagcggcctcttcgccgctctgggcggccagatgagcgccatcgcgctgcccctgctgatcctcaaggagaccggctccgccgtgcaggccggcgccgtgggaacggtggccgtctgcgccgtgctgatcacgatgctgccgggtggggtcatggccgaccgggtcgaacgccgccggctgatgcgactgtgcgacgtgggcagcctggcggccgtcaccgctctcgccctcgccgtgtggaacgggcacgccccgatggccctcgtcctgctggtcgcgacctccggcgccgtactgaacagcgtctacgcacccgccgccttcggtctgatgcgcgcggtcgtgccgccggaccggatgagcacggcgaccgcccggctccaggcgcgcacctccacggcccggctggtcggcccgctcgtcggaggcgcgctgttcggcgtgcaccaggccctgccgttcaccgcccagttcctcgggctgttcctctccaccgtctgtgtggcgctcgtgcggacccgctcggaggccaggaccagggcgggttcggtgttcagccgccgggaactcaccgcagggctctccttcctctggcaactgccttacctccggacggtgttgctcgtcttcgggctgggcatgaacttctccttcggtgccctcaccttctcggcgctcgcggtcttctccgacagcgggcgctccggcctcggcggcggcttcgtcatcacctgcgtctcggcgggcgccctcgccggcgcgctgatcgcaccccggttcgcggcggagcgccacgtccggacgctcatcgtcagcacctgctggagctgcgtggggacggccgcggtgctggcctggatcggcagcccgctggtggccggactgctctgcgcgctctgcatgtgcctctcgacggtcgccagcatcggcttcctctcgaccctgctggtcgtcactcccgaggaccggatcgggcgggtgcagagcgccgcggggttcctctcctcgatcgtccagccgttcggcccgctcgccggcggcttcctgctcgccacgctggacagcagcgccgccttcggcgtgatcggctgcgtgctggccgtctcggcggccgtcgtgacgctcgccccctccgtccgcgccggggccgccgcccgggagaagccggagatggacggaaccgttcgcacccgcccggcgaccaccccggagcggaccacggccgggccggcccccgacgccgcgggtcccggcgcaccctgaggaggaaccccgtgcccggtctccagcagacccagctctactgcctcgccgaccgtacgtacttcgagacccccgcccggatccaggacgggagcacccgctacacgctggactccgacccgccggccgagggctggcgccgggtcgccggcggcctgtggacctccctgctccccgaggaccgcgaaccggccgggcagggctggaagatccatgtctccaccgtcccggaggaggccgagcagaccctgctcgacaccgcccggatctgccgggcccacggggtgccgttcaagttcctccgcagtgagcgggcgctcctgctgatgtccggcaagtacatgtcccgggcgggcgccgggaagttcatcacggtctacccgccggacgagaccgtcttcctgcgggtgctggacgagttgacccgcgccctcgccggccgccgcggcccctacatcctcagcgacctgcggatcggcgacgccccggtgtacgtccggtacggggcgttcgtctcccgctggtgcctcgacgaggacggcgaacgggtgctggccctgcgccatccctcgggcgaactggtgcccgacgagcgcggggtggtgttccgggtaccgccatgggtcaccgtgcccgacgcgctgcgcccgcatctggcggcccgcgccgccgccggggacgccgccttcccctacgacgtctccgaagccctccagttctccaacgcgggcggcatctacctggcccggcaccgggagaccggccgccaggtggtgctccgcgaggcccggccgcacagcggtctggacgaggcgggcgacgacgcggtgacccggctgcaccgtgagcaccgggccctgaccgcgctggccgggctggactgcgttcccgaggtgtacggcgtacggaccgtgtgggagcaccacttcctgatcgaggagcacatcgagggggtcaccctcctggaggagatcgtcggccgcttcgccctgctccacagcaccggcaccgccgccgaactcgccccgtacatcgcctgggtggactcggtgaccgagcggctcaccggcgcgctggccgccgtccacgggcgcggactgcgcttcggcgacctccacccctccaacatcatcatccgtcccgacggccgcgtggccctgatcgacttcgagtacgccacggccctcgacgacccggacaccccggtggcgggcgcaccggggctccaggcgcccgccgggaccatcggcgaggaggccgacacctacgcgctctgggcgacctggctctacatgctgatgcccatcatggagatggccggccacgaccgggccaaggccctgaccctggaacggtgggcccgccggaggtacggcctcgacgccgcggcgggaccgcgccggcccgcggcgctgcgggccgccgagagcaccgacggccgcgagagggagaccgccgcgctgctcgacggtcccgagccggactggtccggcctgcgggagaggctgctgcggggcatccacgcgggggcgacgcccgagcgcaccgaccgcctcttccccggggaccccgacgtcttctcgaccggcggg

SEQ ID NO: 3872 - DNA, 944 bp, Unknown
  Kingdom: Bacteria, Phylum: Actinobacteria, Class: Actinobacteria, Order: Streptomycetales, Family: Streptomycetaceae, Genus: Streptomyces
cggctgagcccggttgggaggggcctccgcgacgggccgggaccctacttcttacgggacagcgtcaggccgtccgagaccgtcagcaggacgctgtccatccggtcgtcggcgctcacatggtcgttgaactccttgatcgccgccgtcggaccggtcgcacccgggtccgtgaccccgccgtggaagaggacgttgtccgtggcgatgaccccgccctgccgcatccgggggaccagctcctcccagtacgcgatgtagccgcccttgtccgcgtccaggtaggcgaagtcgatgtgcggctcggcgggcatcgcacgcaaggtgtccagggccggggcgatgcgcagatcgatccggtccgcgacgcccgccttcgcccaggcctcccggccgtacgccgtccactcctccgagatgtcgcaggcgatcagcgtgccgtcggcgggcagcgcctgggccatcgccagtgcgctgaagccggtgaacgtgcctacctccaccacgtgccgggcaccgaccagccggacgaggaaggcgagcagcggggcctgctcctcggccgactgcatgcccgcgtgatcggggaaccgtgcgtacgtggtgtccaccagctcccgctggacccggtccagcggcgggttgtgggccagcatgtacgcgtacagctcgtccgtgatcgtggtgtcgttgcccttggtcatccggctgcgcttccctctgtcgggtcgtggagtggcggggcgccgtgtctgtccggcgctcctcgccccagcctcgcgcaacccgcgctctcacgcagaggaagccgccaggaaccggcgcaggatctcctcccccgccgctcctccccgctcctccaaggccaccacgtgcggggcccgccagccctcgtcggccagttcgccgtggccgggacgccagccgaggtcggcggcgagcag

SEQ ID NO: 3873 - DNA, 1088 bp, Unknown
  Kingdom: Bacteria, Phylum: Actinobacteria, Class: Actinobacteria, Order: Streptomycetales, Family: Streptomycetaceae, Genus: Streptomyces
cgctcaccgaggcgctcgcgcgggtcgccggacgcggcccgcgcgagcgcctcggtgagcgcggcgaactcctcggcgcgcccgacgaacacggggctgactgacctggtctccacgccgccgagcatcgcatacgcgtacgaggcggcgggacccttttcgcggacggtgatcatgctcccggcgcggtccggtcccgcatcgcccggtccggagggggcgtcggcgggaccggtgaccggcgcggtggtgctcccggaccgggacatcgtcaggcggcgggagcgaagcgggtgcggtcctccaccaccttcccttcggggtcaccgcgtccggggcggcgggcggcccggcgggcgaggcgggcccggccgagctcacgctcggtgtcggcccggcggatcagctcggcggatgtggagcggtagagctcgtactcgtacatggtgtgcccctggttcctggtcgtggcagcggaccggagggtgcccggccggtcggccgggaccctgtgttcgccgtgtgtccactgtcgtcggccaggagggggcgccgcatcgggcgagttccgcatgttcgcggcggcgggggccttagaacccgccccctgggtgcccgaggggcggacgggcgccttaggcgcgtgccgtacggggccgtgagcagagggtcagccgccggccggagcgcccgcggtgggcagggagacgaagaggtcgaagtacatgcccgcggagatcagcacgccgaggacgccgagggcgacaccggccagggcgaccgcgcggacccaggtgggctgcggacgctcggagggggcgccgaaggcggggcggaccaggacgaagacgccgacgagcagggccaggacggcgaagacgccgttgaccagggcggtggtgtgccaggcgtccccgtagatctcggagatctgctgggccgcgctgccgccgccggaggtctggatctggccgatgagcgtctcgcgctcggcggcgacccggccggtccacgcgccggtcagggcgacgacgcccagggcggcggagacgacggccgccgcacccgcgccgacgccgtcacggagg

SEQ ID NO: 3874 - DNA, 3030 bp, Unknown
  Kingdom: Bacteria, Phylum: Actinobacteria, Class: Actinobacteria, Order: Streptomycetales, Family: Streptomycetaceae, Genus: Streptomyces
gaggccgcggcgggcgcggcggccttcccgtgcccttcgtgccctccgtggccctcgtgcgcggacgcggcgctgcggctgccggcgggagccgggggcggctcctcccaactgcgctcccgcacggtgaccttgacggtgcgggtctggttggcgatgccgaagaggtcgcggtacttcttggtcacgttgatcttggcggtgtacgtaccggcggccagctggaccggcttggagtagtacccggcgtaggtgttggacgcccagccgttctccacgccccacaccgaaccgagggtgaaggggttcaccggacagctctgcggatacttcgagttggccggcgcgtccggccggacccgcccggaggcgttgttggggcagaacgcctcggtcttgctgagcaccgtcttgcccgccgcgtcggtgagcttgatctgcgcgaagtccggcagcccggcgaagtccttcacgagcccggcgggaagtgccttggtcgtggtcttcttcccgttccggaagacctgcgtggccacgaccggggccttgtaggacttccgggtcaccttgagctcgaaggcgccgttctcggcggtgagatacgtcccgagatccaggtagacgccgggctcctctttccacgagtcgagcgtcaccgaggtggaggcggcgatcaggctgagcttcggcgtcggctccgccgtcttggcgtcgggcgccgcggcgacgacgcccgcggtcacggcgacggccgcggcgacggcgatcgaggggcgggtcaggcggttcgtgcggccctgtggggatctggtcatcattcctcgtacttccggcttccgggtgtgacggaacgtggacgagcagcacggccccaactcacctgtggcgacgctgtgtccggactgtgagaggcggcgcggggccccgcaggttgtctgcactcacccgggcggcccacagttgtccgaaaagtaccgtccggctctccgcaacggagccggacgggaagccccggcacggctcctgcgcagcggctctgccggacgtcgcccctgctcgcttttcggccagggacgccgggggcggaccggcttgtttcgtacggcgccgggtcacggcgctctcgatgcgggtgatgccgtgcggtgcggccaactcgtccgtcacctaggcgtgaagaccgctcacactgcgccaccccaccatgacgaagacggagctggggcccggtggcgagggcggcgaacgcgacctgctggtggaccgggtcctgcggcgccgtcaaggaggcggcaaggcctcaggccgccgcccgacgcttcgcgttctcctgccactcccgtccgatcgatcgcatcagagccggatagacccccaggtaccggaagggtttgatgccgagcatgtacagggagccgagacggccgttgggtttcaccaggacggccaactggccgcgaaagccgccgttcccgtcggggacccagccgatgtgcagcaccccgtgcatggtcttgttggcgcactcggcggcccactcgtcgtgcgtctggaagaccgaggtgaacggcgccgtgctgaggtcggggccgcgcggcccctcgcgcaggtcgtcgggcagccggtcgcgcagcgtcgtcacccggccgccgacgcccgcgtcctgcttgtcccagccgaggagcgcaccgagtttccaccgcaccgcgaagaggaaacggcccacggggttgccgccgtccggaccttccttgccgttcgccatctggtcgaccaggtggcgcaggtcgtccgggccgcccggcgtctgaagcgcccacacgtcctccagcctgaagtcgccggcgatctcgtggatccgccaggggcgggacgtatggtcgctcggggaaaggcgcaggtcactcatggcggcttcctgtctatacggtggcgtatagaacgagcatagactcatgtgtacggctccgtatatcaggcggggtgtgtgaggagggacacggcatgggcgcgatccgtacgccacgcgacaagtggatcgaggaagggcttcgcacgctcgccgtcggcggccccgaggctgtccgggtcgaggtcctcgcccaggcgctcggtgtcaccaagggcggtttctacggctacttccgcaaccgcgccgcgctgctggaggagatgctcgacacctgggaacgcgaggtcgccgagggtgtcatcgagcggatcgagcgcgatggcggcgacgcccgtgaacggctcgggcacctcttcgacttcgtcgggtcgggcggtctcgtgaccggcgccggggtcgagctggcgatccgcgactgggcccggcgcgacgaaggagtcgcgcgtcgcctccgccgggccgacaaccgccgcatggactatctgcgcgagctctacggggccttctgtcccgacgaggacgatgtcgaggcccgctgcctgatcaccttctcgctgcgcatcggcgaccacctcatcgcggccgacaacggcccgcgcgaccgcgcgcacgtactcgccgcggtcagggaccggttgttgagctgaggacggcggaagccggtcattcggcgaagcgcgggaccaccagaccggactcgtaggcgatgaccaccgcatgggtccggttctgcgcgccgagcttggtcagcacgttcccgacgtgggtcttgatcgtctccaggctcaccgtgagggactccgcgatctccgggttggagagcccggtggccatcaggcgcagtacctcctcctcccggccggtcagggcggcctgcggcagggccgccgcggagtccagcgggcgggcggcgaccatgcggcccagcgcccggaccgcctcggcgatccggcggaccgggaatcgtttgaggacgaagccgctggcgcccgcgccgagggcggcggtgacgtagccgtcgttctcgaaggtggtgatcaccacgaccttcggcgggtcggccgcttcggccagcagatggcgggtggcgtcgatcccgttgcgacgcggcacacgta

SEQ ID NO: 3875 - DNA, 3572 bp, Unknown
  Kingdom: Bacteria, Phylum: Actinobacteria, Class: Actinobacteria, Order: Streptomycetales, Family: Streptomycetaceae, Genus: Streptomyces
aggtgtggctgctggcggcgggcgaggacaaggcggaggctgcggccgtcgcgctgtccggggccggagagatccaggccccggcggcgggcgcgtacgggcgcagccgcacgctgtggctgctggacgccgcggcggcttcgcggctgccgcacgcgctgtatgcgcaggcgtccgcctgagcgttcactccccgcaggcccggccctctttcccgagcgggccgggcctgcggcgtgaaaggctcgctccatggcgcatatcggaaccgtggtgatgggcgcgtccgacgtacggcgggccgccgtcttctggaaggcggcgctggagtacaccgagcgcgagccgggcaccgacgactgggtggtgctggtcccgctgagcgggcccggcgtggggctgtcgctggggcgctccgcctcccccgtgcaggaggtcccccgggtccacctcgacctctactccgacacccaggaggccgaggtggagcggctgatcgggctcggcgccgaaagggtcgcgtgggagctgtaccccccggacccggacttcgtcgtactcgccgaccccgagggcaaccgcttctgcgtcatcgacacgacgcacggcggctgagcggtccggtcccgcggtcggaaggctcgccgctcggggggcttccgaggggtagcgcccatcaggacagctcggtctccacaccgcactcctcgaacagggcaaggacgcgctcggtgaattcgctgcccaacgcctcacgggaggccgcgaagtttcgccacaccaggcggaacggagccgcttcgtcgcggcgcatggtccgcaggcagtcgaagagcgcgtcgaggttcgagccgaagtagccgccgggcccgttgacggcttctcccagggcgcagtagaagccgtccctcgtggtgatcgcggtgctgtcgatgacagccgtcccgccggtggcgtaacgggtcgcgctccgtccggcatcgaaccacgcggtctgcacgacgtgcagccagctctcgtgccactcggacgggtggcgggcccactccccgggttcgacgggtcgccccgtggcccactgtcgccagatctctccggccctggggtactcacaggtgtatccgtagaaggagtagccgaggtcggggcggtcctcgccggacggcacgggctgccggaacgcggcggacgccctcccgatgtcgtacgtcccgagcgtccccccctgccggtcgacgacctgcagttcggcccgctcggtcttccgccgggcacggccgacctggtgcgcccggacgaaggtgacggtctccggcggctcccggtcctcctccatgaagtagtccagaagatcttcggcagcgatcaggacctctccggactcctgatcgacaagtcgatacagaatgtcctgcgaatcgtcgatgccttcactttcggggctcatgcgtaaccgttccgttcaacgggaaggccgaagccgcgcgatcccccggccggaactcccggagctgatcgcgcggcttcgactcggtgctgtctactgtctacttcttccagccccagtcagggaaatgaggggccgtgaagcgctggatcttcttgtagtgggtcgaggtccacccgatcatctcaaccccgttcggcagggtcttgaccaggattcgctggttgttgggagcgcccggaaccgcgtactccttggcacccgcccacttcggccactccatgccctggtaggtgtcgtgggagacgagcctgccctgcttgtagaggtcgtacccctccgcgatctcctgggacatccccttgggcagcttgtccgacaggcggccgttggggcacttgtccgcggctgcctggaccgcgacggtccgggcttcgcccatcatgacgcgtgcgcccttgccgttgcaggggagcttcttgaggatcttgagcttgagggcgctcaggatgagatcgtcgacgcacgagagcgacttgttcgcgaggcagctctcgatctcgtcggcgccgatgtaccaggcgaccatctggtcgatgtacgagctctcgctgcaccccatgccgccgccgccgtcggcgacgcagatgaggaccgtgtcgcccggcctcagctccttgttgtccagcaggccctgacggaactcgacgaaccgcttctgcacggccttgcgcatctcgtcgtcggagagcggcttgctcggatccttcatctcggcccggatctgctcctgcagttccgcgatcagcttggtggcggcgatcttcatcgcctcggtctcggccttggccgcggcgacggcgtccttgcccgcggcctccgccgagattccggcctggtaggccgagatcccggcctggtacgcgtagttcccggcaacgccgacggagtgctgggcccgttccgcggagcgggccgccgactgggcgtccttctgtgccgccgcagccgcgttgcgagccgttcgggcggattccgccgccttctcggaggacgcggccgcctcgttcgccgacgcgtcggcctgcttggcgtaaccgtccgcgtccttggccgagtcggccgccctgttcgcccacttcacggcgtccgcggcgttcttgcgcgcttccgcggcagccttctgggccaggtgcgcgtccttctgtgcgaggtgggccgacttgtaggcggcctgcagcagggtgttgacctccgctatgtgggctccggcgttggcgtcacgctgccgtgccttgtggaggccgatctccaggaaggggcgcagtccggtcggcggacccgacagcacggcttgcgccgcggccttgacctcggggccaccggtgctgagggccttgctgaccagcacgcggtcgtcgtcctgccgggccgtgtactgcccggtctccaggaactgcgccacatcggcgtcggtaccgtcgagcgccgcgcctgcggcggccttcacaccgggaccgccctcggcgaggagcttggcgacggcgacccggtcgtcgtcgcccttgcccggatacgcgcgggtgcgaaggaactcccgcacctgctcgatcggcgcgtcgaccgtgtccagggccgtctgctgctgggccgggatctcgctggtcgcggcgatgtgggcgacgctggcgcggtcgtcctgctccagcgccaccgccagcgcggtgtgcacgaactcggccacgccggcgtcggtgcccgacagcgcggcctcggcggcgctccggacccaggtcccgctgctgttgagcatgttgaccgcggcctgccggcccttggtggcggtgatcgccgggtcggttgccgccttggcctcgtccagcagtgtccgcgtcttcgcggtgagttcctgggcgcggccgacctgccactcggcggcggccgtacgggcctcgtgcgcccggttggcctcctccgccgccaggacctcctcgtcctgttgctgggccagccgttcggcgtccgtcttacgggcgaggtcgaccacggtcaaggcctgtcgtgccgccttcaacgcgttgtcggcggagaccgtcgcagcgttcgcggcagcggtggacgccgc

SEQ ID NO: 3876 - DNA, 4367 bp, Unknown
  Kingdom: Bacteria, Phylum: Actinobacteria, Class: Actinobacteria, Order: Streptomycetales, Family: Streptomycetaceae, Genus: Streptomyces
tgatctacacctcgggttcgaccggacgccccaagggcgtggtcctgccgcaccgcgcgctggccaacctgatcgcctggcagggcacgcggtccggggccgggccggggacgcgcaccctgcagttcgccccgatcggcttcgacgtcgcgttccaggagctcttcagcacctgggcgaacggcggcacactggtcctggtcgacgaggaggtgcgccgtgaccccgccggcctgctcgacctgctcgccgccgagcacgtggaacggctgttcctgccgttcatagccctccagcagctcgccgagtacgcctgcgccacggaccggcggctgcccggactgcgcgaggtggtcaccgccggggaacagctgcatgtcacccccgccctgcgggagttcttccgggaccgcgccccccgggccgtgctggagaaccagtacggcccgtccgagacccacgtcgtcaccgcggaacggctggcgggcgacccggagcactggcccggtctgccgtccgtcggacgcccgatcgccgggaacagcgtccggctgctggacgcgttcctgcggcccgtcccggtcggctccgcgggcgagctctgcgtgtccggcgaggccctggccgacggctacctcgggcgtccggagctgaccgcgcagaggttccccaccgtggcgggaacccggctgtaccgcaccggcgacctcgcccgttacctgccggacggccggatccagtggctgggacgacgcgacgaccaggtcaagatccgggggcatcgggtggagaccggcgaggtggagtccgcgctgcgggcgctcccccgggtcgccgacgcggccgtggtcgcgcaggagcggcccgtcggcggacgccgtctgctgggctactacctggggacggcggagcccgggacgttgcgccgggaactcgcccgacagctccccgagtacatggtgcccgccgtgctcgtggcgctcgacgcctttccccgtaccccgagcggcaagctcgaccgggccgcgctcccgcgtcccgaacagctggacgcacccacggacacctatgtcgcccctgccaccccgaccgaggaacgtatcgccgcggtctgggccgaggtgctcggcctcgcccggatcggcgtccgcgacgacttcttcgctctgggcggccactccttgctggccacccggctcgtactgaggctgagacaggaactcggtaccgagctgccgctcagcgcggtccccgcgaacccgacggtgttccggctcgcggccctcatcgacggcgccacccaggccgaagggacagacctgagcgccgagatcgcgctgcccgcggacatcgtcccggccggcgaggtggtcaccgtcgcaccggatcccgcgcacgtgctgctcaccggggccaccgggttcctgggagccttcaccgtccactcgctgctggagcggaccgacgccacggtgcactgcctggtgcgcggcgcggaccgggagggagcggtcgagcggctgcgctccgtcctggagggatacgggctgtgggacgaccgctgcgagcggcgggtgtcggtggtccacggcgacctcgcccagccgctgctgggtctgggcgggaaggacttcgacgcactggcgcgcaccgtcgacgcgatctaccacgtgggggcggcggtcaacctgatctcgccgtacggtcagctcaaggacgccacggtgaacgggaccgcgacgatcctgcggttggccgcacggcaccgcaccgtgccggtgcaccacgtctccacggtgggcgtctacacgggcacggcggaccaccccatcggccccgagcacccgaccggtccgcccgaagcgctggaacacgggtacacccgcagcaagtgggtggccgaagggctggtggaggtggcgcgggcgcggggtctgccggtctccctctaccggccgacccgtatcgcgggtcacagccggacgggtgcctgccagcgcggcgactacttgtggctgatgctcaagggctgtgtccaggcgcggtccgccccggtggggggtggacacctccttcgacctcgttccggtggaccatgtcgccgacgcgctggtggagatatcccgtcgcgacgccgcgtcgggccggacgttccatgtggcgtccggccgtctcctgcggctggagaccgcgttggagtggctgcgagcacgggggtacgacctgccgggggtcgagccgcgtgcctggctggagcggataggcgaggacccggggaatgccgccttccccctgctgggcacactgacggcggagttcaccgggggcggctccgaagggagcctggtcttcgatcccggcaccgcggacgacgcgctggccgggacgggggtggtacgccccgaggtcgacgagaagctgttcgacgcctgcgccgactacttcgtcggggagggatggctgccagggccctgaggagctcgtgcgcggtcaccggtggatgttgggcggagcaggccgtcccggggcgtcccggcgcgccggactcgggccgaaccggtcaggccggcctcgtcccggcgggcccgcccacgaccgtgagcaggtccacgacgaagatcagcgtcgagcccggcgggatcagcggagagggcgactgtttgccgtagccgagacgtgggggaacgatgatctcgcgccggccgccggccttcatcccccgcaccccccggtcccagcccttgatgacccggccgccgcccacggcgaacttgaacggccggccctgctcccaggaggagtcgaactccctgccggaggcgaaggtgacccctacgtagtgaacttggacgaccctgcccggcttcgcctcgggtccatccccgaccacgaggtcccggaccatcagttcggtgggcgcgtcgcccaccggaacctcgactccgggcttcgtcagttcgctcatcgcggtcccatcgttctccaccggaatctctggcacgggttccggccggacacatggacggtccatgcggcaggcgatcaccgtaccggcgttgatcctcgcggaccgcccaggaaccgccgcgggccgcgaacgtcacgcgccggcccggacctgtttcaccggcacggttcgtcacgtcggggtggagggatctcgggccggatctcaggcccggcacgtcgatcaagccgatatgctgatgcagattatgcaagcgatgtgcaagcaaggagggtcatggctactcgggcgaccgacgtcgggacgaaccagagtgtcgaacgcgcggtctcggtcctgcgcgcgctcgactccggccgcgccgaactgcgcgtatccgatgtcgccgaactgaccggcctcggctcctcgaccacctcccgtctgctgtcgacgctggagcgtctcgacatggtggagcgcgatcccgtcagcaatctgtaccgcctcagcctcggcatcctgccgcttgccgccaccgccgcgaatcgccatcccgtccatcgcgccgcacggatggtcctccaggacctggccacccgtaccgggctcggggccaatgtcgcgatccggcgcggcaccgagctgatgttcctgtgcaatttcgaggggacccgcgcgcccaagtcgcacacgcaggccggacacaccgccccgctgcacgccaccggcatcggcaagtgtctgctcaccggcatcggccccgaggagcgtcgcgcgctgctgcccgaaccgctcgtcgcgcacaccgacttcacgacgaccggccacgacctcctcgacgccgagatcgacaccgtgcgccgcaccggctacgcgatcgaggccgaggagcgcgccctgggccgcgcctccctcgccgcgcccgtccgtgacgtctcgggggaggtcgtcgccgccatctcgctgtggggaccggcctccctgctcggggagcacaccgacgtcgacgggcagcgccccgctctcgtccgcgaggtcatcgaggccgccgacgccatcagtcaggcactcggcgccctctgaatcacggcggagcacgcggcaggggcccggtgaagcccggtcatggacgatccggccgtcccgtcgaccgccgaacgggaggagcaccggcagttccccgtcatggaccgcgcggtccaccggcgcaccgaccgggcgtacgcgatctcgatgtcgagccggcgcatcgacgatcgagaacggcaacctgcacgccgcaggcaccaacgcgctcatcgtcgacggccgcccccagccagcgggcctcggctggtcacaggagttcaccggcgccgagtgggcgcgcctcgacggagtcggtggctacgtcttccccggcggcgcgcgccgccgg

SEQ ID NO: 3877 - DNA, 776 bp, Unknown
  Kingdom: Bacteria, Phylum: Actinobacteria, Class: Actinobacteria, Order: Streptomycetales, Family: Streptomycetaceae, Genus: Streptomyces
gctccggcagtcgcagcccgccgaagcccgcatcgccgccggcctgctcgggcacggtggcggctgccgccggcgtcgcggctggcagcgcgggaccctgtcccggcagactgcgctgtacgggtgaccgcagggtgctggcgcggtgacgtgcgcccggtagggcaccgggagattgtccggctccatatgtactcatgctgttccgtcccctcgaccggtgcgtcggcacaccgacatcgtgcatcgtgccactccgcacggtgccgatgcaggtgctctgtacccgttcagcccaagataggttggtctgtatgcgtgcagtggtacagagagtggacggcgcgagcgtctccgtcgccggtgcgacggacggcccctcggcccgcggcgtcgtcggggagatcgtcggcgagggcctgtgtgtgctggtcggggtcacccatgacgacaccccggagaaggcggcgcagctggcccgcaagctctggtcggtgcgcatcctggagggcgagaagtcctgttcggatgtgaacgcaccgcttctggtgatttctcagttcactctctacggggacgcccgcaagggccgccggcccacctggaacgccgccgcgcccggcgaggtggccgaaccgctggtggacgaggtcgtggcacagctgcgggcgctcggggcgcacgtggagacgggccggttcggggcggagatgcgggtctcgctcacgaaccacggcccgttcacggtgatcatcgaggtgtgacggcgggcgcgg

SEQ ID NO: 3878 - DNA, 3727 bp, Unknown
  Kingdom: Bacteria, Phylum: Actinobacteria, Class: Actinobacteria, Order: Streptomycetales, Family: Streptomycetaceae, Genus: Streptomyces
ttccgcgccgccgacgaggacgcggcgggcctcctcgtcggcggcgcggaaggtgtcgaggaatccgttgcccgaggtggcgtccgccgacggtgcggcggctgccgcgaggtcggcgaccagcggcggcggggacgggtaccaggcgaggaagacgggccagtcgacgacggtggcgacgaccagttgggcgtggtcctgaccgatgacgcgttccaggacggccatgccggcgtccggggacagcgagctcatgccgcggctgtgcagatagtggtcgaccaggccgagttcctcgatcattccggtggcccaggggccccagtccaggctgagcgcgggcagtccccgggcacggcggtggtgggcgagggcgtccaggaaggcgttgccggcggcgtagttggtctggccggccgtggtcagcagggaggcgatcgaggcgaagagcacgaagtgttcgaggggttcgtcccgcaggtgccggtgcaggaggtgggcgccgacggtcttggggtcgtggacggcgtcgaaggcggcccggtccagatcggcgacgagcgtgtcgcggacctgtcccgcgaggtggaacaccccgcgtacgggtggcgctccgctgtgccggtgggcgtcgagccagccggtcagggcgtcctcgtcggtgatgtcgagggtcgcgaggacgggctgcgcaccgagcgcctccagctcgcggagcagggcgacggcccggccctcggcggtggcggggtcggtgccggcccatttctcccgggccgggacgggggtgcgcccgaccaggatgatccggcgggccccgcggcgtacgagggtgcggcacagcagtcggccgagcgcgccgaacgcaccggtgaccagatagcttccatcggcccgcagtcgcagcggcagcggccgggtcagaccctcggcggggcggaggcggctggtgcggcggccgccgtcgcgcagggcgatctcctcctcgtcgtcgctgagaacctcgccgaggagcgcttcggcctcggcccggtcgccgtcggggcccggctgccgccgggggtcgaggtcgatgagtttgccggggtgtccgatcagttcctggtggcgcagcacgcggccgatgccccaggcgggtgctccgaggggttcgggtccctcgccgggcagggccggctgggctcctcgggtgacgatgtgcaggcggcctccgtccccccgggcgagcaggagccgggcgagggcgatcagtgagtaggcgccggcgccggtgtggtcggtcagggaggtccggtcgcacgcggcgagagcgggcgcgtcgaggttccacaggtgcaggaccgtcccgcggaagggacctccgtcacggtccaggtcggcgaggagccggcgcagatcggtgtcggatccggggtcgacggtgaacgtggcgccgtcaccggacgcggtgtaggccgcaccccggcgcaccagacggcagcgttcgccccgggcggcggccagggcggcgaaggcgtccgcgacgcccccggtgtcggcgaggaccagccagtcgtggtcctgtgccgctgtcgcgggggccggccggcgatcggcttcgctccccgtcggctcgccgcgtacgtcaccgtcgttcacgtcagcgtcgttcacgtccggcgacagggaggcggcgtcgtcggcgggcagcggcgggcagtcggtccagatgggttcggcgagccaggagtcgatcgtggtccgggcgacggcggtggccgccttctccacgtcggcggcgcggaagccgaggacgcggccgagcgtggctccgtcgtcggcgtacagggcgatgttcccgagggtggtgtcggcgtcgccggggagcagggtggcgtgggcccagaacggctggtcgccgatgggttcgagggcgacctcgtccagggagagcggcagtctgatcccggtgtccggggcggggtcctcgggggtcagcgggatcagcggagtcagaagagtctggaagcaggcgtcgaggagaacggggtggaggtggtggccggcggcgtcgtcgccgatcgcccggggcgggcggatccgcgcgaggacctctccggcgccgatccagacctcctcgatggcctggaaggcggggccgtagtggtagccgagggcggccagggcggtgtagcagtcggggccttcgagccggcggagggacctggcccggatggcgggggcgtcgagcggcggggcggtgcggcggcgttgcccggtgcggacgattccgccggcgtgcacggcccgttccccgtcgtccccggtcggggaggcgatggtgaaggcggcgttctccagggagagcgacacctccacggtccggtcctcgccgtcggggaggaagagagccttgcgcagctcgacatcggcgaggacggcggtggtgccgccggtgagcttcaggacggcctgggcggccatttccagatagccggcggcggggaagaccaccgtgtcctggatgcggtggtcggcgaggtacggcaggtcctcggtgtccaggcgggcctgccaggtggggtccgtacggtcggtgcggcggcccaggagcgggtggtcgcggtggcccaggcggacctgggcgaccggccggggttcggtccagtggcggtcgcgccggaaggggtggcggggcagggtgaccggccggccggccggctggaggacgctccagtcgatggggacgcccaggttgtggagcgagccgagggaggcggcgaagcgctcgctctcgttctcccggcggcggatcgagggcagggtgagtccgctcgtcccgcccgcgtccaggcattcgcggatcgcgtggccgaggaccgggtgcgggccgatctccaggaacacctggtggccgtcgtcggcgatgcggtcgacggcggagcggaagcggacccgctcacggacgttcgtccaccagtacgcggcgtccagttcctcgccccgggcggtcccctcgacgcctgtgggatacagcggcacctgagccgcgcgcggctccaaaggggccagttccgcgagcagttcgttcttgatccgctccatgacgacgctgtggtagggcacttcgaccgtgaggaacttcgcgaactgctgctcggcccgcaactcctcggccagcagcgtcagcgcggcctcgtccccggccagggtgatcgcggtggggctgttgacggcggcgatggagacccggtcgctgtaggggcggacccggcgctccgcctcgtcctccgacagactgacggcgagcatggcgcccgtgccggccagggtctgctggaggcggctgcggtgcacgacgatcctggccgcgtccctcagggagtagacgcccgccgcgtggaaggcggcgatctcaccggtgctgtggccgaccacggcgtccgggcgcactccgtgggaccgccacagggccgcgaggcccacctgcacggcgaagttcgcgggttgggcgagccaggtctccgccatccgggagacggactcgtcggcggtcatctcctcgatcagggaccagtcggcgaactcccgcagtgcccggtcgcacgcggtcacggcgtcgcggaagaccggctcctcctccagcagttggcggcccatgccccaccactggggacccatgccggtgaagacccacaccagacgccggtcggcggcgtcccgggcgcggccgtggacgacccggggg

SEQ ID NO: 3879 - DNA, 6018 bp, Unknown
  Kingdom: Bacteria, Phylum: Actinobacteria, Class: Actinobacteria, Order: Streptomycetales, Family: Streptomycetaceae, Genus: Streptomyces
cgcgctggccgaccggatcgaaggacggacgccgcagtccgtcaccctgcccgcccgcctcgtcgtacgccgctcgtgcggcgggaccgcatcgaaccagaggagcgaccggtgaccgcaccggacaagcaactggtggccgcaccagatgagttgctgcgcatcgaaggactgcgcaagaccttccccggcgtggtggcgctcgacaacgtcgacttcgacctccgcggaggcgaggtgcatgtcctgctcggcgagaacggcgcgggaaagagcaccctcatcaagatgctctccggcgcctaccgccccgaccacggccgcattctggccgaggggcgcgaggtgcgcatcgagggcgcgcaggacgcggaacgcctcgggatcgccacgatctaccaggagttcaacctcgtacccgatctcaccgtcgccgagaacatcttcctgggccgccagccgcgccgctacgggctcgtcgaccaccgccggatgcgccaggacgcggagaagctgctgcgccgggtcggcgtcgacgtgcgacccgacgccaaggtccgtgaactgggcatcgcccggctccagatggtggagatcgccaaggcgctcagcctggaggcccgcgtcctgatcatggacgagccgaccgccgtgctcacctccgaggaggtcgacaagctcttcgcgatcgtccgccaactgcgcgaggacggcgtcgggatcgtcttcatcacccaccacctggaggagatcgccgcactcggcgaccgcgtcaccgtcctccgcgacggccgcaccatcgaccaggtccccgcgtcgacccctgaggacgaactcgtccagctcatggtgggccgcagcatcgagcagcagtacccgcgcgaacgccccgaacgccccgactccgcagacgcgttgctgtcggtgcgcggactcacccgggacggcgtcttccacgacatcagcttcgacgtgcacgcaggcgaagtcgtcggcctcgccggactcgtcggcgccgggcgtacggaggtggcgcgcgccgtcttcggggccgacccctacgacgcgggcaccgtcgacgtgcgcggcgaacgcctcgcccggcacgacgtgcccgccgcgatgggtgccgggatcggactcgtaccggaggaccgcaagggccagggcctggtcctggacgcttccgtgcaggagaacctgggcctggtcaccctgcgctccgcgacccgctccgggcttgtggacctcaaggggcagcgcacggccgccgcccgcatcgccgagcagctcggcgtccgcatgtccggcctcggccagcatgtgcgcaccctctccggcggcaaccagcagaaggtcgtcatcggcaagtggctgctggccgacacccgagtgctcatcctcgacgaacccacccggggcatcgacgtcggcgcgaaggtcgagatctaccagctcatcaacgagctgaccgcctccggacacgccgtcctgatgatctccagcgacctgccggaggtcctcggcatgagcgaccgggtgctcgtcatggcccagggccggatcgccggggaactccccgccgacgaggccacccaggacgcggtgatggcgctcgccgtcggcaccccgaccaccacccagggccccgcccccaccgaacaccccgcaccgaagaaggaagaggagggcccccgtggccactgagacagccaagagtgacgcgggaacgggcggagtctccgtgatacgccgcgtcctgctcgacaacggcgcgctcagcgccctggtcgtgctggtggtggcgatgtcgctgctctccggcgacttcctgaccacccagaacctgctgaacgtcggcgtccaggcggccgtcaccgccatcctcgcgttcggcgtcaccttcgtcatcgtctcggcgggcatcgacctgtccgtcggttcggtggcggccctgtccgcgacggtcctcgcctggtcggcgacctcggcgggagtccccgtcgtcctggccgtcgtgctcgcgatcgtcacgggaatcgcctgcggcttcgtgaacggcgccctcgtctcgtacggcaaactcccgccgttcatcgcgacgttggcgatgctctcgatcgcccgcggcctctccctcgtcatctcgcagggcagcccgatcgccttccccgactccgtctcggtgctcggcgacacgctcggcgggtggctccccgtgccggtcctcgtgatgatcgcgatgggtctgatcaccgcactgatcctcggccgcaccttcatcggccgctcgatgtacgcgatcggcggcaacgaggaggcggcccggctctccgggctccgcgtcaagcgccagaagatcgtcatctacgcgctgtccggtctcttcgccgccgtcgcgggcatcgtcctggcctcgcgcctcgtctccgcacagccgcaggccgcccagggatacgaactcgacgccatcgcggcggtcgtcatcggcggggcgagcctggccgggggagccggcaaggcgtccggcaccctgatcggcgcgctcatcctcgccgtcctccgcaacggtctcaacctcctctccgtgtcggcgttctggcagcaggtcgtcatcggcgtcgtcatcgcgctcgccgtcctgctggacacgctgcgccgcaaggccggatcgggagcggcctcctccgcgggcaccgcccccggggcccccggggccggccgcaagggagcgctcaagctggccggtgcggcactctgcgtcgccctcgtcgtcggcgcggtctccttcttcaactccggctcgtccagcggcacgacgaaggtcggcatgtccctctccacgctcaacaaccccttcttcgtgcagatgaaggaaggcgcacaggcggaggcggagaaggccggcatcgacctcaccgtcaccgacgcccagaacgacgcctcccaacaggccaaccagcttcagaacttcacgagttccggcgtctcctcgatcatcgtcaacccggtggactcggacgccgtaggaccgggcgtccgcagcgccaacaaggcggacatccccgtcatcgccgccgaccggggcgtcaacaaggcggagaccgcgacgctcgtcgcctcggacaacgtggcgggtggcaggctcgccgccgacgcgctggccgacaagctcggcgggaagggcagcatcgtcatcctccagggcacggcgggcacctccgccagccgtgagcgcggtgccggtttcgccgagggactcaaggcgtacccggacatcaaggtggtcgccaagcagcccgcggacttcgaccgcaccaagggcctggacgtcatgaccaacctcgttcagtcgcaccccggcgtcaccggcgtcttcgccgagaacgacgagatggcgctcggcgcggccaaggcactcggcagcaaggccgggaagtccgtctcggtcgtcggcttcgacggcaccccggacggcctgaaggcggtcgaggccggcacgctctacgcgtcggtggcccaacagcccgcggaactcgggaagatcgcggtgcagaatgctgtgaaggccgcgaaggacgagaaggtcgagagcacggtgaaggtgccggtcaaggtggtcacccgggagaacgtcgccgacttctcctgaacccggcccgccaaccggcctgttgatgccggaccgacgaaagcaggaagcacgcacatgcacgacaacgcccccgacgaccggtacgacctgctggtcgtcgggtcggccaacgcggacctggtgatcggcgtcgagcgccgacccgcgcccggcgagacggtcctcggctccgacctggccgtccaccccggcggcaagggcgccaaccagtcgctggccgccgcccgcctcggcgccaggacggctctgctcgcccgggtcggcgacgacgaccacggacgcctcctgctggagacccagcgcgcggcgggcgtggacacggacggcgtcctggtgggcggggcccccaccggcgtcgccctgatcaccgtcgacccctcgggcgacaacagcatcgtcgtctccccgggagccaacggccgcctcacgcccgaggacgtccgggcggcggccccgctgctggccgcggcccgggtgatctccgtacagctggagatcccgctcgacacggtcgccgagacggtacgcggccgggggccggagacccggctcgtgctcaacccgtccccgcccgctccgctccccgaggaggtgctggccgcctgcgatccgctggtggtcaacgagcacgaggcgcggtacatcctcggcgacggcgcgggggagtccccgcaccactgggccccggccctgctcgcgctcggcccgcgctcggtcgtgatcaccctgggcgcggccggggccctggtggcggacagccgtacggaatccctggaccatctggtcagcccgaaggtcgaggccctcgacaccaccggcgccggggacgcgttcacggcggccctggcctggcgtctgggccgtggcgacgagctgcgggaggcggcggccttcgcggtcagggtgggtgcgaaggcggtcacggcgcggggggcgcaggagtcgttcccgacgctggaggaggtcgacgcgctgtgaagaagtcgggcatcctcaaccgccacctggcgggcgcgatcgccgaactcggccacggggacggcgtcctggtctgcgacgccggcatgccgatcccacccggcccccgggtgatcgacctggccttccgcgccggtaccccgtcgttcgcggaggtgctggacggcctgctcgacgaactggtcgtggagggcgcgacggccgcccacgagatccgtgacgccaacccggaggccgcggcgctcctggacggtcacttcccctggctggaactgatcccgcacgacgacctcaaggcgctcacgccggcggcccgcctggttgtacggacgggggaggcccggccgtacgcgaacgtactcctgaggtgcggggtcttcttctgagcgagtgcgctcgacgcggttgagcgcgcgccctcttccgcctcttcccgggccgatcgcgacgacggtacgaggacgggtcgcctccaccgccgagcggctcctccaggtcaccgaccccgacggcggtgatcgtcccgtgcgtcgagcggttcggggaccgccgaggggtgacctgatcccggtgaggtgaagtgcgcggcagggaggaggagttcggggacgttccggccgcggggatattcctggcgcatcccgtcggtgcgcgctaggctccccacgatgaatcactccatgagcagattgggggacccgtccgcgcaaggtgagtgctgatgctcccttcgaccgcgaaccgggattcccacccgtcccccctgtcctccccgtctttctggccgcgcgtgcgcgagttcgccgtgccggcctcgatgatcgagactgcgaccgcccgccgtgaggccggggactgggcaggagcgtgcgccgcagcaggcgtcgacatcgatttccgcctccggtccgtggtgcgcggccacggccgggaactcgccgcccgcatccgggcggaccttcgccatctggctcctgacctgctgcgctggcacctgccgaggatcgcaccgcacgggctgctgcgcccgggtctgacgatcgaactgtcccgctacgacccaccggagcgcgacggaccgtcccctctgcacctggtcgtccggaccccgcccgcctgggcggacgccgggcagcggatcagcctcgcactgtgggacggctcgcacaccgagcccaccgcccgccgtcacccccacccgcgtccgaaccggcgcttccgcctcgatctgcaccgtcacctgtgggacgcgcgcagggccgatgagctacggatccgttccggcctcgacgacctgccgtccgcccgtgccgccgaagccgtcgaccccgacctgtggggcgccgtcccgccggaccggcgctgcgccgtcgacccccgggcgg

SEQ ID NO: 3880 - DNA, 1001 bp, Unknown
  Kingdom: Bacteria, Phylum: Actinobacteria, Class: Actinobacteria, Order: Streptomycetales, Family: Streptomycetaceae, Genus: Streptomyces
cggcgatttccgagcccacggtccgtacgtcggccgacggccggatcagcgtgctggaactcccggtaccccatcccgcgccctccgccgaggcgatcgagtcgctcacccgcctccgccaggaccacatccccgcgaccgtcggccaactgtccggcgtggagacggcggtgagcggcgatgtcgcccggggccgcgactacgtgagtcacgagagcgacaaactgccgctggtcctcggcttcctgctgctgatgaccttcctgatgaccgtgtgggcgttccgttcggtggtgctcggcgcgatcggcgtcgtactgaacctgctgtccgccggcgcctcgctcggcatgctggtgctggtcttccaggggacgtgggcggagggactgctggccttcgactccctcggggcgatcgcgtccagggttccgttgttcctcgtggtgatcctcttcggcctgtcgatggactaccaggtgttcgtggtcagccggatccaggaggcccggcagagcggcatgtccgcccgtgaggcggtgctggagggcatcaaccgttcggccaaggtggtgaccagcgcggcgatcgtgatggtgacggtgttcggcgcgttcgtggccctgcacctcaccgagatgaagcagatgggattctgcctggccgtggcggtcctgctggacgccgtcgtcatccggctcatggtcctgccgtcggtcctgctgctcctcggtgagcgtgcctggtggccggcccggcgtcccgggcggaccgtgcgggcccaggaacccgccgccggatcgccggcggaagtaggctgacgcggtgaatcaacggccgcagcccgaaaccccgttgaccgtaccgtcgccgcaccggtggaacgccgtcttctgggtgctgctgggcgtggtcccgccggccctcgcggtcgccgacgcacccgctacgacgcgctacccggtgctggggctgctggccgtgctcgccctgtcgtacgg

SEQ ID NO: 3881 - DNA, 2151 bp, Unknown
  Kingdom: Bacteria, Phylum: Actinobacteria, Class: Actinobacteria, Order: Streptomycetales, Family: Streptomycetaceae, Genus: Streptomyces
ggccggggaggcgccggggtccgtgccgtcggcatcggggccgtcgggggtggccggaggtgtggcggggtggacgttgcccgtggcggcgaccgtggacggggccggttcctgggagacgttgaactcggccagcaggtccttgccgaagccgaagaagtacgtcgcgacgaacccggccacgtagccgacgagcaggccgcccgcgtagatcgcgatcgtcgagcccaggccgtggttgccgtcgaggagagggaacagggcccagccggacggaccgatggccgtcgagccgaccgtgtcgccgagctggttgaacagaccgacgaagccggcgccgaacgcgccgccgaagcacgccgtgatgaacgggcggccgagggggagcgagacgccgtagatcaggggttcgcccacgcccagcaggcccgccgggagcgcggacttgatggtgcggcggatcgactcgttgcgggggaggcggaagtagacggccacggccgcgcccacctggcccgctccggccatcgcgaggatcgggagcaggaccgtgtagccctgctgctcgatgagcgtggtgtggatcgggatcagcgcctggtgcaggcccagcatcaccaggggcaggaacaggccgccgagcacgaatcccgcgcccgcgccgccgttggacagcagccagtcggcgaacgtgccgatcgcggaggagacctcgccggccacgtacatcaggccgaagatcgtcaccaggccggagatcagcaccgtcagggtcggggtgaccaggacgtccagcgcctccggcacccaccggcggcaccacttctccacgtacaccgcgaggaccgccgcacccagcgcgccgagcacaccgccctggccgggggagagcgtctggccgaaggcgtcgatgttcgcgacgcccgggaagacgatgatcgccgccaccgcaccgcccaggatcggcgtgccgccgaactccttcgccgtgttgtagcccacgaacaccgcgatcagcgccatgaagccggacgccatcgccgccagcgcgggcgtcacggcgggcagccactccaggttcaccagcaggccgttgaggcccgcgatgatcccgcagccgatgagcgccgggatcagcgggacgaagatgttggcgatcttgcgcaggaacagcttgaacggggtggcgttcttcgccttccgctgcgccttgatcgccgcgccctgtgcggccagttcctccgccgagacggcggtgacagcgggggcgtcccccggggccggcgcggcctcgcgggcctcgtcgaccaggtgctcgaactccggggtgacccgggcgaccgtgcccggacccagcacgatctggtacgtgtcgtcgtcgacgacgcccatcacggcgggcagggccttcagggcctcgtcgtcgacgagggaccggtcgtgcagaccgaggcggagccgggtcatgcagtgggcgatggaggcgacgttcgcggcaccgccgacgagcggcaggatcgcggcggcggtggcgcggttcttgtcttctgtggccatggtgctcggtgccttgctgtgcggggggtggggcggattacccgggtgggtcaggtggtgcgtacggccgcgagggcggcgcggaggtggccgtccgcctcggtgaggcgggtggcggcggtggggccgtcgacctggccgaggatgaccaggatcgcgttcttgacctcgccgtcggtggcggcgagtgcggcctcgatctcggcgtcggacgcgccggtggccagggagacgatgtgccgggagcgggcccgcagcttctcgttggaagcgcggacgtcgaccatgagattcccgtacgtcttgccgagccggatcatcgtgatcgtcgagatcatgttgaggacgagcttctgggcggtgcccgccttcagccgggtcgagccggtgagcagctcggggccgacgacgacctccaggccgtgttcggcggcggcgccgagcgcggagtcggcgttgcaggagagcccgatggtcagggcgccccgctcgcgggcgtgctcgaccgcgccgatcgcgtacggcgtgcggccggaggcggagatgccgaccaccgtgtcgtcggcgctcagcttcagtccgtccaggtcggcg

SEQ ID NO: 3882 - DNA, 1887 bp, Unknown
  Kingdom: Bacteria, Phylum: Actinobacteria, Class: Actinobacteria, Order: Streptomycetales, Family: Streptomycetaceae, Genus: Streptomyces
ccgccgccggactgaccgcgacgacggcactcggcgcggcaggcgtgctggcgtcggcatccgccgcccacgccacgggcgacggcttcggtctgcgcatcgtggaccgcgacgagcgcgacccccggatgcgctacttccgcttcgcgaccgacgcgatcggctgggatcccgccgtcaacgtcctgctgccggacggctaccacaccggcggacgcaggtacccggtcctgtatctgttccacggaggcggtaccggtcaggacttcatcgcgttcgaccggatgggcatccgcgcctggaccgccgggaaaccgctcatcgtcgtgatgcccgacggcggcgcggcgggctggtactccaacccggtcggctccaacgtcggcccccgcaactgggagaccttccacatcgcccaactgctcccctgggtcgacgccaacttccgtacgtacgccgagtacgacggccgggcggtgtccggcttctcgatgggaggcttcggcgcgctgaagtacgcggccaagtactacgggcacttcgcctcggtcagctcccactcgggaccggcgagcctgcgccgcgacgccgggctcgtcacccactgggccaacctctcgtcggccgccgtggagttgggcggcgccacggtctacggcgcgccgctctgggacgaggcccgagtcagcgccgacaacccggtgcagcgcgtcgagagctaccggaacaagcgcgtgttcctggccgccggcaccagccccgacccggtcaactggttcgacaccgtcaacgagacacaggtcctggcaggtcagcgggagttccgtgagcgcctcggctcggcgggcatcgggcacgagtggcacgaggtgcccggcggtcacttcgtccgccccgatctgttccagcgggacctggacgggatcgtcgcccgtctccgcaaggcctgacgggccgcgtcactgacgtccggcggaaccgtcgtgtgcagcggcgggccgttcggcgggtatccggcatcccggcgtgaacatcgcggccccggggcacgtacctctgaccgaagtgaccgggacgggaacaccgacgaagggaatgccgcgatgagcgcaacgcaggagcgccggagcctcctcggacgccgcacggtcgtcgccgcggtgggagcggccggagcggctgccgccctcaccgcgtgcggcggaggatcggacggttcgggaggctcggacacggtcgagcagcccgggagcggaggcggcaagggcggagaggtgctggccgcgaccgcggacatcccggagggcggcggggtggtcttcgccgcgcagaaggtggtggtgacccagccgcagccgggcgagttcaaggcgttctcgtccatgtgcacccatcagggctgcgcggtcaaggacgtctcgggcggcacgatcacgtgtccctgccacaactccacgttcgacgccgccacgggcagcccgaccggcgggcccgccacccagccgctgcccgcccgggagatcaccgtcgagggcgactcgatcaggctggcgtagccgctccctgccccgccttcggactgcgcggtcgcttccaactgccgagaacggcgtccgtggtggtgacggtggcgaccagggcgagcgtgttgcggaccatggcgggggtgtactcggcgggcacccccgcgatggcgtcggccggtacgacggccgtgtaaccgaggttgaccgcgtcgaagacggcgttggggacggcgatgttggccgatacgccggtgacgacgagcacccggcagccgaggttgcgcagcagcgggtcgacatcggtgccggccaggggcgagaggccgtgcagccggcggacgacgaggtcctcgtcggccac

SEQ ID NO: 3883 - DNA, 1302 bp, Unknown
  Kingdom: Bacteria, Phylum: Actinobacteria, Class: Actinobacteria, Order: Streptomycetales, Family: Streptomycetaceae, Genus: Streptomyces
gaagccggtgcgaatccggcacggtcccgccactgtgaccgggccccctcccacgcggacgactccccagcggacgacgtcgcaccggagggcggcccggaagtcaggaactggcccgccgccttctcgcatcgaccaggggacgcggaaatcccccggagaggcctcgccatgtcccggcgcacccccgcgctcatagccgccgccgcgctgctcccgctcgccctcaccgcctgctcctccccggacggcgaagccgccaccggggacaggacagcggcgaagagcgacggattcccgtacaccgtgaagaactgcggtgtcaccaccacgttcaaggccccgccgaagcgcgtcgtcaccatgaaccagcacgtcaccgagatcatgctggaactgggcctgaagaagtccctcgtcggcaccgcctacctcgacgaccaggtcctgccggagtacggagaggactacgcgtccgtcccggtcatcgccaaggagtacccctcctacgagcaggtcctcgccaccaaccccgacttcgtctacggcggctacggcagcgccttcgccgccggcgacggccgcagccgcgaggcgctgaagaagtccggcatcgagagccggctcaacaccgagagctgcacccagggcgaccggcccatggacaccctctacgaggagatccgcgaggtcggccgcaccttcggcgtcaccgaccgcgccgaggcctggatcaagcaggccaaggccgacaacgccgccaccgccaagaagctcgccggcatcgagcccgtctccgtcttcgtctacgacagcggcgacaagaccgccttcaccgcgggcggcgaaggcatcggcaacgaactgatcgagcgggccggcggcaccaacgtcttcgccgacctcgacaagcccttcggcgacgcctcctgggagaacgtcgtcgcccggaagcccgaagtcatcgtgatctacgactacggctccaccaccgtcgaacagaagaagaagcgtctcctcgacgacccggccctcgccgacgtccccgccatcaagaacaagcgcttcgcggtcatgccgctctccgacgccgtcctcggcgtccgcgtccccgccgccgtcggcaaactcgccgcccagctccacccgggggccaccaccccgtgagctgccgcacccccgcaccgcggcggctgctccgctacaccctggtgctcggcgtcctcgccgcgctcctcgccgccgccgtgctcgccgcactcgccctcggctccgtccgcatcccgcccggccaggtcctct

SEQ ID NO: 3884 - DNA, 1152 bp, Unknown
  Kingdom: Bacteria, Phylum: Actinobacteria, Class: Actinobacteria, Order: Streptomycetales, Family: Streptomycetaceae, Genus: Streptomyces
ggtgcaccagtccgctgcccatgccgagggccgccgcgatccgggagacctcggggcgctcctccggctcccgggggtgcgcggcctcctggacgagacctcccagccggccgtcggtcccgtcgtcgccgaggagatgcgcggtgacccggtccggtacccgcagggtgcgggagagcagcgggcgctcaccgtccgcgatctccagcagcccgcccgcgacgagcggggcggacggcgtgaagcggaagcgcccggagccggcggcgggcagcccgcagagttccagggccaggccgatggtgggccggcggcgggtgaggtcgtcgttgagatagccgtacagccgctcgaaccgggtgtcgatgtccggggccatggctaccagcaggagttcgacgtccagcggggcgagaccgaagcgctccgccagccggctcagtcggcttccggctgcggcgtccggcatggccccgtcctcgtatgccggtacgggcgtgaacgcgtcgcgggtctccaggatccgtgccgcgccctccggggtgaggtactgcccccggtagggatcgtcggggtccgggtcgacggcccggcgtgccgcgaccgcctcccggacccgctgctcgacgcggccgagccgctcccagagttcctcgacgccggtcatcgggccgtggctgtggagccgttgtggtgccagggtcatcgtgcggcgttcccccgcctgcgtcggccgggcggcaactgtcgttcacggggcgcggcgaagccctgcccgcccgggtcggacgctccgtcgtagcgcaggcgccggccggggccgccgccgtcgccgtccaggtggggtgctgccttcatcacgagtccttcggtgacgggcgggcccgcgggggtgcgttcgccggccagcggtgccacgacccgcaggtcgatcgcggccttcagctcgccgccgagcgcggaccagacgtccgaggcggacggtccgccggctcccggccctgcggcttccagctccacggtcaggccgagttcggcgaggcttccggtgtgcatccgggcaggcagcacatcggagcggacgagggcgcgcaacacctcggagagcagccggtgttcgtcctgcgggcggttggtccaggcggtgaccag

SEQ ID NO: 3885 - DNA, 1761 bp, Unknown
  Kingdom: Bacteria, Phylum: Actinobacteria, Class: Actinobacteria, Order: Streptomycetales, Family: Streptomycetaceae, Genus: Streptomyces
cggacccgccgccacggccgacctgcgtgcctggtccgggctggccggactgcccggcgcggtcgccgccgtacgcgacgagctggtccgcttccgagacgagcggggacgggagctgctcgacctgcccgacgcgccgcgcccggacccggacactcccgccccggtgcggttcctgccggccttcgacaacgcgatcctcggctatcaggaccgcggccggatcatcgacgacgcccaccggggcctctcggtcgccggcgagcgtgtcgtgctggtcgacggccgtgtggcggccacctggcgcgtcaccgacgaggtcgtcacggtggaacccctgcacgccttctcccgcgccgaccgcgacgccgtggccgaccaggggagggagctcgcctcgttcctctccgacggcgagagcgatcgcgtacgggtggaggccgcgccgcgctgagcggaccgggcgccggggaagcgccctcgtgtctgcccggcagtacgggaacaggcctatttcgtcagggagtttgtacgagacgcggtgggaggcggactgaaagcaccggacacgggtcacaagcggaacatgacgtccagcgacgtaaccacagagcccacgccgcacggcgacggtaagcgcgacgcccgcccctcccgggcgtggccgaaggccctcggcgtcgccgcggccgttctggtcctgctgttcgcgggcagccggctcagcctgctgccgggactcgacgacctcttcggcgaggagacccacgaccggacgggccccgccgtgctcaagtcgatccaggacatgagcgcgtacgaggccgcctcgggcgacttccaggtcgtcgtcgatctggagaaggacgcgaagttcgtccccgacgccctgcgcggcacccgcaccctgttcgtcggggcgggcacggtcggtgcctccgtcgacctgggcaaggtcaccgggagcggcgtcgtggtgaacgaggaccgcaccaccgccgaactccggctgccgcacgccgtcctgggcaaaccggccctcgaccccgaccgttcctacgcggtgtccaaacagcgcggtctcctcgaccggatgggcgacctcttctccgacaatcccggcagtgagcaggcggtcaacaagctcgccgtccagcacatctcggaagcggcgaagaagagcgaactgaccgcccgcgcggagaagaacaccgccgacatgctgaagggcctgctcggctccctcggcttcgagcgcgtcacgatccgctacggcgacgaccaggggtgatcgcgtcatacgggcggccgcgcgggatgcgcgtggccccccgcgtgcttcggaggggcggccgcccccgcgcaccacccttgacgtgaacgcgtcggtcggtatggtctagtccaagtgcaaggcctttccggacacctgtcatcaggcttgtccggcaagcgacttgcggcccttcgcgcctcttggccccacactcgcgaggcctcgccgtcgaagccgggccccccacggcccgccaccgcgcggtgcggtctcatgtgaaggagaagcatgcacgcgaaaaggaagaccgcgctcgccgtcggcgccatgctcgccccggtcctcgccctgagccttccggcgagctccgccagtgcccacggctacatctccaacccaccgagcaggcaggcgcagtgtgccgccggcacggtcagctgcggcgcgatcacgtacgaaccgcagagcgtcgagggccccaaggg

SEQ ID NO: 3886 - DNA, 2042 bp, Unknown
  Kingdom: Bacteria, Phylum: Actinobacteria, Class: Actinobacteria, Order: Streptomycetales, Family: Streptomycetaceae, Genus: Streptomyces
ggaccgaggccagcgcctcgccgtcccacaggcccagcaccttgttgatcagggtgcgtgcctggcagcggtcgccggccgcgcgggccttctccgcctcggccgccaggtcctgcgccagcgtcaggtcgagcgccgtccggtcggtccggatcgcgtagccgccggactcgctcaccagggtgtcctggcccaggatcttgcgcagccgggaagcgtacgtccggatcgtggccagcgcctgcgagggcgggtcctcgccccagaacgcgtcgatcagctcgcccgcggtggccgtccggccctcgcgcagcagcagcgcggccagcagggcgcgctgctggggcgagccggacgagagcagctccgggccccgccaggcccgtacggggccgagcacggtgaacctgagggcgtccggcgtaaccggtttctccggagcacgctgctccggtacgcgcacgcgtggcccgttgtcacggtccattgatgccccctgtcctgctcgcctgccggtcccgctcgtctgcggatcctgccggtggtgcccgcgtccgaatgtccgcccgtgcgtcgaagtgcggtatgcatccggatggcgcggtaccgctggtatcgcgctcaacagtctgccttgtctcgggcggactcgtcagcagtgggtgacgctctgcacaagccctcgacaacgattcgggaaccgtgccacgtgccgtgccccctcccgtaccccgccggatgcgcgcacagtagctgacggttcgtcagatcagcgctaccgtggaacgcatggagaccttcccgaagatcatctcggtggacgaccacacggtggagcccgctcatgtctggcgggaccggctcccgtccaggtacgcggacaccgggccgcgcgtcgtccgcgcgccgctgaaggaaatgaccttcctgggcggcaagttcgctcccgtgatgggtgcgaagggcgacgacggaccggtcggcgactggtgggtgtacgaggacctgtaccgtccgctcacccgcctggacaccgccgtcggttacgacagggacgagatcaagctggagatcatcacctacgagcagatgcggccgggctccttctcggttccggagcggctcgccgacatggacgtcaaccacgtccagtccgcgctgtgcttcccgaccttcccgcggttctgcgggcagacgttcaccgaggcgagcgaccgtgagctgggactcctcggcgtgcgcgcgtacaacgactggatggtggaggagtggtgcggccccgaggcgcacggccgcctcataccgctcaccctcgtcccgctgtgggacgcggagctggccgccgccgaggtccggcgcaacgcggcgcggggggtgcgcgcggtcgcattctccgagatacctccccatctcggacttccgtcgatacatgcggacgactgggatccgttcctcgccgcctgcgacgagacggggaccgtgatcgccatgcacatcggctcctcgtcgaggatgccgtccacctccgccgacgccccgcccgccgtcggctccacgatcaccttcgccaactgctgcttctcgatggtcgactggctgatgagcggcaagttcgagcgctttcccaacctgaggatcatgtacgcggagggccagatcggctggatcccgtacatcctggagcgcgccgacgtggtctgggaggagaaccgggcctggggaggcgtcgccgagaaggtccaccggccgccgtccgaactgttcgccgagcatgtctacggctgcttcttcgacgacgccttcgggctgaagaacctcgacgcgatcggcgtcggcaacgtgctgtacgagacggactacccgcactccgactccacctggccccgctcccgcgaggtcggcgaggagcagatggggcacctggccccggacgtcgtcgaccggatcgtgcgcggcaacgcgatcgaactgctgggcctcaccgaggacgggctctgggcgggggcgtagagcccgggcctgggtgcgggcgtggggctggg

SEQ ID NO: 3887 - DNA, 3911 bp, Unknown
  Kingdom: Bacteria, Phylum: Actinobacteria, Class: Actinobacteria, Order: Streptomycetales, Family: Streptomycetaceae, Genus: Streptomyces
gctcggcggcgggggccgcggcctcggccggcgcgcccgagccgtcgtcgatgacggccagctcggcgccgacctcgacggtctcgtcctcggcgaccttgatggaggccagaacaccggacgcgggggccgggatctcggtgtcgaccttgtcggtcgagacctcgagcaacggctcgtcggcctcgacgcgctcgccctcggccttcagccaacgggtgacagtgccctcggtgacgctctcgccgagcgccggaagggttacggaaaccgacatggtttcagttgctccttacgaaattgcggaagtggtcggtcgtcgcgcccgggaccgggggatcagtcgtgggcgtggagaggcttgccggccagcgccaggtgagcctcgcccatcgcctcgttctgcgtcgggtgtgcgtggatgagctgggcgacctcggagggcagcgcctcccagttgtagatcagctgggcttcgccgacctgctcgcccatacggtcgccgaccatgtggacgccgaccacggcaccgtccttgacctggacgagcttgatctcgcccgcggtcttgaggatcttgctcttgccgttgcccgcgaggttgtacttgagggcgacgaccttgtccgcgccgtagatctccttggccttggcctcggtgatgccgacggaggcgacctcggggtggcagtacgtcaccttgggcacgccgtcgtagtcgatcggaacggtcttcagaccggccagacgctccgccaccaggatgccctcggcgaaaccgacgtgggcgagctggagggtcgggacgaggtcgcccacggccgagatcgtcgggacgttggtctgcatgtactcgtcgaccaggacatagccgcggtccatcgcgacgccctgctcctcgtagcccaggccctgcgagaccgggccgcggccgatggcgacgagcagcagctccgcctcgaaggtcttgccgtcggcgagcgtcacacggacgccgtcctgcgtgtactcggccttgtcgaagaaggtgccgaggttgaacttgatgccgcgcttgcggaaagcgcgctcaagaagcttggagctgttctcgtcctcgaccgggacgaggtgcttgaggccctcgacgatggtgatctcggtgccgaaggacttccacgcggaggcgaactcgacgccgatgacgccgccgcccagcacgatcgcggacttcgggacgcggtccatcttcagcgcgtggtccgaggagatgatccggttgccgtcgatctccaggccgggcagcgacttcggcacggagccggtcgccagcagcacgtggcggccctggacgcgctggccgttcacgtccacggaggtgggggaggagagcttgccctcaccctcgatgtagtggaccttgcgcgaggcgatgagtccctggagacccttgtacaggcccgagatcacctcgtccttgtacttgttgacggcctccatgtcgatgccctcgaaggtcgccttcacgccgaactgggccgactcgcgggcctggtccgcgatctcgcccgcgtgcagcagtgccttcgtgggaatgcagccgttgtgcaggcaggtgccgccgaccttgcccttctcgatcagggcgacgtccaggcccagctgcgctccgcgcagggccgcggcgtaaccgccactgccaccgccgaggatcactaggtcgaaaacggtgctggcgtcgttcgccacgtcacgtcctccatgcatgtgcgccgtacgccgggccccgtcgctggggtgtgaccggccggtcggctggtgtgcggccgcttttgtcttcggccctgtggtgggggccctgtcctgccgagaacccatcttcgcacttgtcgacggtgggcgggacgcggggcccgggtccgggacggatgatcgtccgttccggagggttactgctgcgtagataccgacggattcggccggtgttcgtcgagagcgaaacccgctcgccctccgtcgtccatccgccctccgtcgctcatccttgccgcttccgctccgagaacacgtacggccccggacctatgcccggggccgtacgcgacggaaggcgggaactcagccgaggtcgccggcggcggtgcgctcggcgagccgcaccagggtgcggaccgcggagccggtgccgcccttgggcgtgtagccgtacggcgcgccctcgtggaaggccgggccggcgatgtccaggtgcgcccaggcgatgccctcgcccacgaactccttcaggaacaggccggccaccaggccaccgcccatccgctcgcccatgttggcgatgtcggcggtgggggagtccatgcccttgcggaggtcggccgggagcggcatcggccaggagggctcgccgacctcctcggcgatctcgtggatcgacgtgcggaaggcgtcgtcgttggccatcacaccgaaggtgcggttgccgagcgccagcaccatcgcgccggtcagggtcgccacgtcgacgatggcgtccggcttctcctccgaggcgcgggtcagcgcgtcggccaggacgagccggccctcggcgtcggtgttgaggacctcgacggtcttgccgctgtacatgcgcagcacgtcaccggggcgggtggcgttgccggagggcatgttctcggccagcgccagccagccggtgacgttgaccttcaggcccaggcgggcggccgagacgacggcggcgaacacggcggcggcgccggccatgtcgcacttcatcgtctcgttgtggccggccggcttgagcgagatgccgcccgagtcgtaggtgatgcccttgccgaccagggccagggtcttctccgccttcgggtgcgtgtaggcgagcttcaccaggcgcgggccgcgctcggcgccctggccgacgccgaggatgccgccgaagccgcccttgacgagggccttctcgtcgaggacctggaccttgatgccgtgctccttgcccgcggcggtggccacggcggcgaaggactccgggtacaggtcgttcggcggggtgttgaccaggtcgcgggcgcggttgatctcctcgaccagcgccagggcgcgctcgacggcggccttgtaggccttgtcgcgcggcttggcgccgagcagggccacctcggcgagcggcagcttcgggccgctgtccttggacttcgcgtccttgggggcgagcttgttctcgccgccctggtaggcggtgaaggcgtacgcgccgaggagagcgccctcggcgacggcggcggcgtcctcgacggaggcggcgggcagcgcgaagccggccttcttggagccgtgcagcgcacgggccgcggtgcccgcggcgcggcgcagcgcctcggcgtcgtaggcgtcctccttgtccgggaccggaccgaggccgaccgcgatgacgaccggggccttgaggccggacgcggcgggcagcttggtcagttcgccctcggcaccggtggcgcccagggtcgcgaggacggcggcgagctttccgtcgaacgccttgtccacggcctcggcgccgggcgcgaggaccgggcccttgacgcccttggcgacgccgacgacgagtgcgtcggcgcgcagcgtcgccgcaccggcagtgctgagagtgagagcagtcacggtggtgaaatctcgcttccgttgagttcgagttcggtcgaggggtgggccgaccgtgcccggcgcatcgtagacgcgccgacgatgtgccgggaatgagcctacgcgcgcggttcctgctccatgacggcggcgggccgttcccgacggtcacggcggtcggttccgcccggcgcgacgggctgtacggcggccctggtggcgctggcgctcgggacctgacggcgcggcacatgggggcgaccaccgcgacggccgccgtacag

SEQ ID NO: 3888 - DNA, 1091 bp, Unknown
  Kingdom: Bacteria, Phylum: Actinobacteria, Class: Actinobacteria, Order: Streptomycetales, Family: Streptomycetaceae, Genus: Streptomyces
tgctgggcgtcgccgcccagggcgcggtccagcaggccatccggcaggcgaagtccgccgtcgaaccggtcatcgaacgcaacccgcagctcttcgaccacctcgccgccgccggcaacgaactgctggccgcctatcgctccgcggtcgagggccaggagggccgctggacccgcaccaccgagggcgcgtcgggcggagcgagtcccaccgaccccacggagaaggtcgccgacgacccgtccgacccccgggacgacggtccctccgggaccgaacgcatcgacctggactgaccggacgaccggccggtaccggccggacacatcgaccgggaccgaccggccccggccggacccggccacgcctcgggtacggttgcccctagcggggctcgaccgaaactgagggattcatgggactcaccatcggcgtcgatatcggcggcacgaagatcgcggctggagtggtcgacgaagagggccggatcctctcgacgttcaaggtggcgaccccgccgacggccgaaggcatcgtcgacgcgatctgcgcggcggtctccggtgcgagcgagggacacgaggtggaggccgtcggcatcggcgccgccggctacgtcgacgacaagcgcgccaccgtgctgttcgcaccgaacatcaactggcgtcacgagccgctcaaggacaaggtcgagcagcgcgtcggcctgcccgtcgtcgtcgagaacgacgccaacgccgcggcctggggcgagtatcgcttcggggccggccaggggcacgacgacgtcatctgcatcacgctcggcaccggcctcggcggcggcatcatcatcggcaacaagctgcggcgcggacgcttcggcgtggccgccgagttcggccacatccgggtcgtcccggacggtctgctgtgcggctgcggcagccagggctgctgggagcagtacgcctccggccgcgcgctcgtccggtacgcgaagcagcgtgccaacgccacccccgagaacgccgccgtactgctcggcctcgctgatgtgcttgccctcgatgccgtccaccgagccgtcgccgaggccgagcagtacggcg

SEQ ID NO: 3889 - DNA, 1095 bp, Unknown
  Kingdom: Bacteria, Phylum: Actinobacteria, Class: Actinobacteria, Order: Streptomycetales, Family: Streptomycetaceae, Genus: Streptomyces
ggagtgccgccccctcttcgtcagctgctaagccttgaccgaaccgtcctggtcgtcgccctggtcgtcgtcctcgtcctcgtcgtcgtcctgcccgtcgtcgaggtcggcgtcatcacgcacgtcgtcctcgtcgtcacggtctccggacgcgtcctcgccacgaggcgtgatctcgtcggccgcgtccggaccggtcgagtcttcgtcaccgaggacatcgacgaactccacgccgtcgagctcggcgagccggtccgacgcgtcggtggaaccgtccttgtcggcctccagcgccttcccgaaccactcccgcgcctcgtcctcgcgccccgcctccagcagggcgtccgcgtacgcgtagcgaagtcgcggcgtccacgactgcacggagttggacgcgagctcggggctctggagcgtcacgatggcggcgtcgatctgacccatgtcacggcgtgccccggcggccaccaaccgcatctcgacctgtccggccttgtccagcttctgcacctcgggctcgccggccatggccatcgcccgctcgggccgtcccagcccgcgctcgcagtccgccatgacgggccacaggtccacggacccggtcatccgccgggccgcccggaactcggcgagcgcctcggcgtacttctgtgtcgcgtacgccgcgaacccggccgcctcgcgcacagccgcgacacgggacgcgagccgaagggcgatacgggcgtacgcgtacgcctcctcggggtcctcgtcgatcagccgcgccaccatgacgaggttgcgcgcgacgtcctcggcaagggtcttcggcaggctcatgagctcctggcgtacgtccttgtcgatctcgtcgcccgtgacgtcgtccggaatcggcagccgcttgatcggctcacggtcacggtcccggtcatcacgtccccggaaacccccgcggtcgcggtcgtcgcgctggccgccgcggtatccgccccggtccctgtcgccaccccggttgtcatctcggcggaagccgccaccggagccaccgccccggttgtcatcgcggcggaagccgccgccggagggccggtcgtcgtcacgacg

SEQ ID NO: 3890 - DNA, 2065 bp, Unknown
  Kingdom: Bacteria, Phylum: Actinobacteria, Class: Actinobacteria, Order: Streptomycetales, Family: Streptomycetaceae, Genus: Streptomyces
tcccgaagtcgatcagctgcgggccgccggccgtcagcaggacgttgcccggcttgacgtcgcggtggacgagcccggcggcgtgcaccgcggacagggcgcgggcaagcagccggcccaggaccgcgacgctgcgcacgggcagcggcccgcgccgggcgacgatgtcggaaagcgtcgggcctgggacgaactccgtggccagccaagggcgttcggcctcggtgtcggctccggtgacggacacggcccaggggctgtcgacccgccgggcggcctccgcctcgcggcggaaccgggtccggaaggcctcgtccccggcatgctcgggcaggatcaccttgatcgcggcgagcgctccggcgtcggtacgtccgaggtagacgacgcccatgccgcccgctccgaggcggccgaggagccggtgtccgccgatccgggcggggtcggtgggtcgcaggtcgtccatcgcccggcctcagctctgcttctcgacggcggattccagccggaccagcatggcggactgcgcctggacgacgaggtcgtcgatctcccgctcggtacgtcccttcgcccccttgccggtcacggcgacggtgaactgcagggtctgcgcctgctgccaggcgtagtggtgcggtccgccgagctcggagctctggtactgccccatctcgctgagggagtcctcggagttgctctgcgtggcctcgccgccgaggagcgcggcggcgaccatggagccgatcagttcgccctcgcgcaactgctgggtggggcagcgcatgctctcctcgatcgactccgccatctcccaggccgcgtcctcgcgggtgcggtgcacggtgacgacggcgccgaggcgcaccggtccctttcccggttcggcgggcagctcgaacgaccgggtgagggtggccaggacgctgtacgcgggcttctgctgctgccagacacagtcctcgccgagcacgggccaggtcgcggggccgctctcgtacgggctccgcttcaccacccccgccccggggccgaagctgtcggggtcggcgatgacgcggtcgatgaagtcgcgtgcctccgcccgggtcttcggaagccgggcggggtcgggtacgagcgactgctcggccgacggcccggcaccggcgctgccgccgccgggtcccggcctcgcgctcgccgaagcgtcctgcttctccactttccccggttcgtccgccgcgccggaacagccggcgagcagcacggtcgccagggccaggggcagcgcgtaccggacccctcttaacggcacgtgacaggtcacagcgtttccccgttcctcctcgacgccgcgtcgatcataggttcgccaggcgtggtcgacgggtgccgaggggggactgttacctcgtcggaacatgtgtggcaccgtccccggggaggtcagcagcggccggaaccaccggtccgtcgtggcgtgcgggacgggccgcctgctcatccgtccccaggtcatggacagcccgcgcggacctcggccggagcagatcaacatggtgcagcggtccacggggcagcacctgacgcagcgtggggattccgtccccgtccttgataacgtcgccttcgcggctgcgtacttctcccccgacccagccgtacggggtgggcacggggatcgggcgcggcaggacgaagagggccgacagatgagccttgcacaggtgcactacacctccgccgcgccgggggacgaaggaacagcggaccggttcacggcggtcggtcccggggtgtcgggggccctgctggcggagatcgaacccttggtgcgctacgagcttcccggcggcgttcccgagcggccgtccgacggggaactgcgctcgctgccgcaggcgttcgggtatttcgtcctgtccgacggcagccggttggtggcgcgttcgaccccggtacgggacatgggcggcacgggcgtccggttccacgcgcacgcggtgcacctgccgccgggggttccgctgccgggcgaccggctgccggtcgaggcgtggcggtcgccgcactgggtggc

SEQ ID NO: 3891 - DNA, 2573 bp, Unknown
  Kingdom: Bacteria, Phylum: Actinobacteria, Class: Actinobacteria, Order: Streptomycetales, Family: Streptomycetaceae, Genus: Streptomyces
agcagttggccatgagacatgatcacaccggacccgagcgccgcaccctgctgagggtcgccctcggcctcggaaccgccaccgccgtgcatctgatcgccgccgatccggcgtcgacgcccagccgccccgcacgcgccgcggacaccccgcccgccgcggccgcgggacccccggcgaccgtccggggccggccctccccgtaccggctcgaacccatgacggccaacaccccgccccggttcagaccggccacgccgcccgtgcgcgtccggcccttcgagcatctccccgagatcgggcactcgatggtcctcagcttcgacgacggccccgacccgctctacaccccggacatcctggccaccctgcgcgagcaccgggtccgcgcgatgttcttcgtctgcggagagatggccgacggcaacccggacctgctccgcgagatggccgacgacgggcatgtggtgggcaaccactcctggtcccacccgttgatcccgaagctctcccgccccgcgatccgcgacgaactggggcgcaccagcgaggtggtggaccgggcgctcggtaccccgccgctgtggtatcgggccccctacggtgcgtggaaccgcaactccttcgagatcggggccgagttgggcatggagccgatggcctggaccgtggacacgctggactggaagacgccgggcgccggcacgatcgtccgccgggtgctggacggagcggcgcccggcgtcgtcgtcctctcgcacgacgcgggcggcgaccgctcgcagagcgtcgcggccctgcgacgctatctaccccggctgctggactccggttaccgcatcacggtgccgcaccgcctctgagccgaggagcgcgtacgcgcacggccgcgcccccggcgacctcacgctctcgtggtcgcccggaggcgcggccgtgcggggcgcgcggttgtcagcgggtgtcgacgagccgggcgaagaccaccacgttgccgtcgtagccacccgccttggagtagcccccgccgcaggtgatgacccgcagctccgcgtggccggtgtcgccgtagacccgggggccggggaagtcgttcttggagaagacctccaccccgtacacctcgaagatcccgacccggccgtcgtagcgggagacctcgacccggtgacccttctggagcgagccgaggccgtagaagacggcgggcccggacatgttgtcgacgtggccgacgaccacggcggtgccgcgctggccgggggcgatgccgttctggtaccagccggcgaggttgggatcctcggcgggcggggcgtcgatccacccgttggcgtccaggttgacgtcgatgatcggggcgtccacgtcgatggacgagaccttcacccgggaggccggggcgtacggcagcggctgcaccggctcgccctccaccggcggccccgcggcgtccttgcccaggtccagcgaggcggccgccgcgggctgcggggggcccgcctctccgaactccgtgccgttgcgcatgagggcgaggccgctgagcagcaccagggcgaccgcaccccatggcacacgtctggtccgctcggcgccagcgtattcccggcccatggttctcccttcgtcgcgacgctgtgaacgttaggggtgccgcgtccgggcggcgatcagagaggggcgaacgggtggcggcgggatcgggcccctgccggatgactgcccatcggagtaatgagcagataaaacttctgacggtctgtgacctgcgactccgtcagtttcgggggttttcgtacggcgtgtcgcgtcaccggggtggagcaacgccgaagtgcgagtggtcggcccgctggtgagtgttcgtcatgggaggcgttctcgtcgatccagcccgggggaaaagcccccgggggcgtttcccgctggaggttcacacgatgcgtgtctcacgcgctctcgcggtcaccgcgaccgccttcgcggccgtcgggctctcggcccccatggccgccgccaccaacggcccggtcaacgtcgccgtcaaccctcaggccgtccaccagggcggcacgctgaagatcaccgcgcagggctgcggtcacggcggcaaggtttggtcgaacgcgttcccgacgaccaccctctcgccgggtgacggcaccaacttcgcccatgcccgagtccggaacaacaccacgccgggtcagtaccacctctccgtgaagtgcagtgacaacgaccgcatcgcgacgcacaagttcaccgtgctcgccggcaacggcgcgcagggcgggctcggcggctcgatgggtccgagctccgtggagatgcaggtcggcggcggtctggtggccgcggcggccgtcggcggcgcggtcttcctcgtccggcgccgacggacgagccatgcggcgttctaaggcgtcgaacctcccgcccggcccgatacgcccgtcgccccgagtcctggatcaggacccggggcgactgtcgtgcgccgcacgctcgcggtcagtggcggcggtcggcggtgcggcggcgcgcgaagtagagagcgcccgccgcac

SEQ ID NO: 3892 - DNA, 2262 bp, Unknown
  Kingdom: Bacteria, Phylum: Actinobacteria, Class: Actinobacteria, Order: Streptomycetales, Family: Streptomycetaceae, Genus: Streptomyces
cggcggcgatgaccaggtcgtggtgggcggcgagctcggcggcgggcggggccggggcgtggaagcggaggtcgacgccgaggcccgcgcagcgctcgtgcaggatctccaggagccggcggcggccgagggcggcgaagccgtggccgccggaggtgtgggtccggccccggtggacgatgtcgatcgtgtcccagcggacgaactcgcggctgagcgcccggtacacctcggggtcggcgtgctcgatgccgccgagggtctcgtcggagaggacgacgccgaagccgaaggtgtcgtcgggggcgttgcgctcgaagagggtgaccgtgcggtccgggtcgagccgcttgaggagagccgcggcgtagagcccgccggggccgccgccgatgatcacgatccgggtcacgaaaagtccgcctcgcgttgtgtaacccgcggccgtctgccgccccggccggggtccgggggatcgccccgggggaatgcagtacgtactccattgtcccgcacgcgccaaagtgcttcgccccgggtccctccatacgggaaagagggcctgcgccgtacgggaacgagccgccgggaacgggaccgcggacccaccccgtactcccccgaccggggccttcgtcacaggaaccgccgctcccgcgccctcctcccgtaccctcggtcccatgtcgctctacgccgcgtacgccggcaacctcgacgcgcggctcatgacccgccgcgctccgcattccccgatgcgcagcaccggctggctcaacggctggcggctgaccttcggcggggagcagatgggctgggagggggcgctggccaccgtggtggaggcgccgcgctcccaggtcttcgtcgcgctgtacgacctggcgccgatggacgaggactcgatggaccgctgggagggtgtcgggctcgacatctaccggcggatgcgggtgcgggtgcacactctggacggcgaggagccggcctggatgtacgtgctgaacggctacgagggcgggctgccctcggcgcgctatctcggcgagatcgcggacgccgcggaatccgccggcgcaccgcacgactatgtgatggaactgcgcaagcgcccctgctgaccagggcggaccggggtccggtcccgccgtcgtcgtgcaaaagcacaaagacccgcggcgcgtctttgcgccagtacatctacgcgcgtagggattcagcggttacgctcgtccgcgtgaacgcatctgttattccggacaacatccagggcgacccgcaggctgccgccgccggggccgccgcccgcctgcgcgagctgaccggcgccgagacccatgacgtcgccctggtcatgggctccggctgggcgcccgcgggcgaagcactcggcgtcccggaggccgagttccccgtgaccgacctgcccggcttcccggcgcccgccgtcgagggccacggcggcacggtccgctcgtacaggatcggcgagaagcgcgcgctggtcttcctcggccgcacgcacttctacgagggccggggcgtcgccgccgtcgcccacggggtccgtacggcggtggccgcgggctgcaagaccgtcatcctgacgaacggctgcggcggtctgcgcgagggcatgcgcccgggacagccggtcctgatcagcgaccacatcaacctgacggccgcctccccgatcatcggcgccaacttcgtcgacctgaccgacctgtactccccgcgcctgcgcgcgctgtgcaaggagatcgacgacaccctcgaagagggcgtctacgtccagttccccggcccgcactacgagaccccggccgagatcaacatggtccgggtgctcggcggcgacctggtgggcatgtccacggtcctggaggccatcgcggcccgggaggcgggcgccgaggtgctcggcctctccctcgtcaccaacctggcggcgggcctgtccggagaacccctcaaccacgaggaggtcctccaggccggccgcgactcggcggcccggatgggcgcactgctggcccgggtgctcgaccgcgtctgagccgagcctccgggaccggctcggccggttctctccgaggaccggctctggttgatccctcgggaatcggctccggctgatccctcggggaccaaccctggctgatccctcgggaatcagctccggctgctgcctgcctctcctcggctcccagcgccttcccggcccgcccggccgcgtcccagcccgtccggcgtttg

SEQ ID NO: 3893 - DNA, 1809 bp, Unknown
  Kingdom: Bacteria, Phylum: Actinobacteria, Class: Actinobacteria, Order: Streptomycetales, Family: Streptomycetaceae, Genus: Streptomyces
gggtcgcgtcggccgtcatcagcgccttcggcctgctcgcggtgcccgacgccgccctgccgctggggttcgccctgtgcgggccggtgctcgtaggggcggcggtggactgctgggtggggttcaccggccggggcgcggcgctgtcgctggtgttcgccgtcctgcgcgtgacagcggtctgcggcacccaggaatggaccggcggcccgctgaacccgtgggcgctgaacatgctgaccaccacggcgatcaccctgcagtgggagtggcgacccgcggtcgccgtccccgtcacggccgggctgttcgtggtcgatgtgagcgcgatggggggtgaaggcctcggcggtctgctgccgcgcctggtcttcgaatgcctgctggcgcgcctggggttcgtgctgctccgccggtcggggaggcgggtggacgagtcgcgggagcgccggtctgcgctggtacgggccgaggcgctcgcatcggcgcggcaccggcaggagcgcgagtacctcgcgctcctgcacgacacggcggcggcgacgttcctcctggtggcggcgcaggcgaaggagatggggcgggagcggatcgccgagtacgcccggcacgacctcgcggtgctcaccggcaccgccggaggggcggccgctaaggacagcgccgtggacctgacggcctcgctgcgcgccgccgtccggcacggcctgctgtccgtcgacgtccgctcggagggcgccgcgctggttccggcctcggtggcgctcgcattcgtgcgggcggtgcgcgaggcgctggtcaacgtcgagcggtatgccggggtcgacaccgcggtgctcagcctgtgccgtgagcagggcagcggcgaccggatcgtcgtcgaggtcaccgatcacggggtgggcttccggccggaggaagtggggtcatcccgtcgcggcatccggggttcggtggtcgagcgcctcgtcggcgtcggcggcaacgccaccatcacctcgcggccgggcgcggggaccacggtgaggctggtgtggcccggtgagtgaggagggcccttcgggcggcggcccgtgccgtacgggccatgcctcgggaaaccgcacggacggcgtcccggtgtcccgtgcggctcaagccccgggcgaccacgtgtacgcgacgatgcggatcatcctggtctgcgccgccgtgctgctgcagttcggcctcggcctgcaccccttgctggcacaggggcactcctcccggtggctcgcagtggccgccttcgtcgttcttgcctgcgtcaccgctgcctgctgcggttgggtgctgcggcgcaagccgctgcccgccggcttcgtgacggccgccgctcccgtcgtgctcgcggcgtcgttctgcgccacggccgcggtcgccccggaccagcgattccaggctcccgactggtcgttcggcctggtggggtggcatctgctggttctgttgctggaccgggccagggttctggtcgcggtgctggccacgcacctcgtggcgagcacgggtctgttcctggcggcgggggtgcccgagcgggcggcgttcggtgcggccggggcctccgccttcggcgcgctcgccgtccagttggcggtcctgctgatcacccgtgttctgcaccggcagtcccacgaggcgacgacggaggccgaggagcgggaccggttggcgaaccggatgctggcggcgcatcagtgggaaaaggaccggcacagtgtgttcgccgggcagttgggggcgacgctgccgttgctcgcgggtctggccgacggcgcactggac

SEQ ID NO: 3894 - DNA, 2342 bp, Unknown
  Kingdom: Bacteria, Phylum: Actinobacteria, Class: Actinobacteria, Order: Streptomycetales, Family: Streptomycetaceae, Genus: Streptomyces
gcgtttccgactctatcagactctttcgcgtccgattcccggtcgaagcgggatgctttccaggttcttcgctttcgcgttttccctttccggcggttccgactttaccagactcttttccgttccgtttccggtccgaatatgatttccggtggcctgtggagtggccttgcctttcggcggatccgactttatcagaaactcgaggagttaaaggaacgacccgatgagattcgagaaaggagaatcatttggctcggcggagttaacaagcactcctgcacgagcgagatagatactacgcgctcatcccgaacttgtccagtccgaggcaactgctcaaatctacctccccacatctgccgtgtcaacggtttttgggggcgaggaggacactagcaggtcagcaggggtgaaagcacatccgcggtcaggctgcggtgggaagttcggcgctgcgttcgaccgctgtgaggtcgcctgtgtcgccggcgcgggccgcacggccgcccaggatgtagacgtatgcgagaaagaccagctcagcggcgacgccgatggtgatccgggcccaggtcggaaggccggacggggtcacgaagccctcgatgagtccggagacgaacaggaccagtgccagaccgatcgccatgcccagggcggcgcggccctgctgagccagcgcggtcctgcgtgacagggggccggggtcgatcacggtccagccgagacgtagccctgtgccggcggctacgaacaccgcggtcagttcgagcaggccatggggaagcaccaggccgaggaagacgtcgaggcggcccgcggaggacatgaggcctatgccgacgccgaggttgagcatgttgaggaagaggatccagatcaccggtatgcagaggaacgcgcccaggaccaggcacagggccgcggcctgcgcattgttcgtccatacctgtgccgcgaacgacgccgccgggtggctggagtagtaggtctcgtactcgcctcccggcctggtcatcgcacggaggtcttccggcgcggctattgcggcctgtacctcggggtgggtgccgatccaccagcccagcagtgccgccagcgccgtcgagagcaccgcggtgggaatccaccagtggcgcgagcggtagatcgcggcggggaatcccgcggtgaggaaccgggccgcgtcccgccaggaggccttgcgggtgccggtcaccgtcgaccgggcgcgggccacgagctgggtgaggcgtccggtgaggagcgggtcggggctgctcgactggaccagagagaggtgggtcgccgtgcgctggtagaggacgacgagttcgtccgcttccgcgcccgtgaggcggcgcccccggcgcaggaggtgttcgaggcggtcccactccgtgcggtgggcggtgacgaagacgtcgaggtccataggcggctgttgctcctggcaagggtgcgtacgggtccgtactactgcggcgcgctggcggtcagcttggcagactgtgaccggctggggcagagaaggtcggcgaagggtggggcccgatgagtgagctggtgaccggggacgcggtcgttctggggttgaggcccgcgcggctgccgagccgagcgctggcctcggcgatcgacctggcggtgacattcgtcgtcttcatcctcgtatcggtcgtactgggcatcgcttccgtctcgttggacgaggcggcggtcgcggcgatcggggtcgcctccttcctgctggtcctgatcggtgggccggtcgcggtggagacgctgagtcatggccgctcactgggaaagctggcctgcgggctgcgggtggtgcgggacgacggtgggccgatccggttccggcacgcgctcgtgcgcggggccatggggctcgtcgagatcctcatgaccttcggcgccctggcctcgatcgcgtccctggtgtcggcgcgaggtcgtcggatcggtgacgtgttcgccgggacactggtgatccgggaacgggtcgcggccacgggccggtccgtctccgtgccgcctcccccgccctggctggtcggccggttcgcacagctggacctgtcggccgtgcccgacgaactctggctcgggatacggcagtacctgacgcggatgcagcagctggatcccggcgtgggtcgttcgatcgcggaacggttggccggtgaactggtcgcacggacgggagccaccgcgccgcagggcgttcccgcggccgcgttcctggccgcggtggttcatgagcggcagtcgcgggatgcgcggcgcgtgttcgccggaccccgggccgccgacgggctcgtaccgtccggggt

SEQ ID NO: 3895 - DNA, 1291 bp, Unknown
  Kingdom: Bacteria, Phylum: Actinobacteria, Class: Actinobacteria, Order: Streptomycetales, Family: Streptomycetaceae, Genus: Streptomyces
gccttccactggcaccccgggctgctcatcgagggcgcgacgctccaagttcctttcctggccgacttggtgagcctcgtggagcccaccagtccctggtcctacctcaattacctcaagatccgccgcaggctcttcccgttctacttcgccgagcacttccacatccaccgatccgagttcgacaactacctgcgctgggtgagtaccgaactccccgccacccgcttcggtcaccgggtcgacgcggtgtcctgggaccccggacaggacgcgttcgccgtggagttcacccggctgggtcccgacggggagacgctcacgaccgggctcacccacgcccgtaacctcgccctcggcgtcggcacggccccccacgtccccgaaccgctgcgggagctggtccaggacccggccgccgcggtcctgcactcggcggactatctctcccagcggaaccggttgctggccgcccgccacatcaccgtcgtcggctcgggccagtcgggcgccgaggtcctgctggacctgctccggtcccggcccgagggggcggaggggctcacctggctggcccgtacgccggcgttcgcgccgatggagtacagcaagatcggcctggagcagttcacccccgactacacccgctacttccacggacttccgcaggccacccgggaccggctcctgccccgccagtggcagctgtacaagggcgtcagcggggacacgctcggggacatccacgacgagctgtaccggcgcagcctcggcggaggctggcccgatgtcaccctcacccccggcatcgaggtcaccggcgcagcagtcaccgaggcgggccgcatcgaactgggcatcgagcacggccagcaggaggcgcggggccggctcgtcacggacgccgtcgtcctcgccaccggataccgggagcgccccgtcgacctgctgctcgccgctctcgacccgtacgtcgtccgcgacgaggccggtcgtccgcaggtcgacgcggcccaacggctcgttctcgcaccggagatagccggttccgtcttcgtgcagaacgccgagcggcacacacacggcgtcggggcgccggacctgggcctggccgcctggcgttccgccgtcattgtcaacgcgctgacgggcaaggagttctacccgctgcccgagcggacggccttcaccacgttcggtctcggcgcgcgggaccgtgacggccgggacaccgcgtcacgtccggccgaagaacgacggtgacgaccgtgtcggaacggccgcgggccgc

SEQ ID NO: 3896 - DNA, 1553 bp, Unknown
  Kingdom: Bacteria, Phylum: Actinobacteria, Class: Actinobacteria, Order: Streptomycetales, Family: Streptomycetaceae, Genus: Streptomyces
gccgggccccagccgccacaggaggtggtggagccggtgcccgtcctcgtgccggtcgcgcagttcgccgcgttgcgcgggcggccggaggcgtacggaagagatggcgcacccctggtggctcggcgggtcggcggtggtccgtccttcggccgccacggtccgccgattatatgcgcgacccgggatctcacccgattggcctaatgggttcccgggcggcccggtgccgccgtacgggcccggggccccgcaccgggcttccgggagccacgatcggcgcgggcggccggttgcagcgtccatgcgggtgaggcgcgatggaatccggacgcgccacctctggtggagccacccacagggcgtgcccgagaggaggaatcggttatgggagccgctgacggtttcacggattccggagaactcgacggtctgaccgtgtacgacaacgacggcgagaaggtcggcagtgtgggccgggtctacgtcgacgacgacaccggcaagcccgactgggtcacggtcaagaccggcctgttcggcatgaaggagagcttcgtcccgctcgccggagcccgccgggtgggctccgacctgcacgtcgcgcatccgaaggacagcgtcaaggacgcacctcgcgtggacgcggacgcgcacctctccgtagccgaggaggaggagctgtaccggcactacggcctgaccaggaagtccggcaacctcggcgagaaccggtcggcgggcatggacgcgccgaccgtagccgggaccggggcgatgggcgcggcgggcgccgcgggcgcggcccgtgggaccggaacggctcccaccgccaaggcgaccgggaaggcgaccacggcgggtacgcgcgccgggacgaccggcgcgggaacgacgggagcgggcatggcaggagcaggcagcggtacgggcaggcaccgcgacacggacgcctccaccacggcacgcccgatggcgggcgccggcgcgggcacgtcccggtgggccgacatgagcggccgcgaggagatgatccgctccgaggagcagctgcacgtcggcaaggaggagtacgagagcggcagggcgcggctgcacaagtacgtggtgaccgaggaggtcacccggaccgtgcccgtgtcccacgaagaggtccgcgtggtccgcgaaccgctccagcccggtgagaagaccaccgggaccacggacttcggcgagcaggacgtcgaggtcacgctgcacgcggaacgcgccaccgtacgcaaggaggccgtgccggtggagcgggtccggctggagaccaaccgggtcaccgagcagaaggaagtctccgccgagatccgcaaggagaagatcgactacgcggacggcccggacatgggcaagggcaaggacgcgggtggcgagttcggccaggggcgacgccgctgacccgcacttcccgaggtggccgcacggccgctcccacgtcctcggccgccgggcgggctcgttcaacgggcccgcccggcgggctgtccgcagccgtccgcacggtccggggccggtgcggc

SEQ ID NO: 3897 - DNA, 1121 bp, Unknown
  Kingdom: Bacteria, Phylum: Actinobacteria, Class: Actinobacteria, Order: Streptomycetales, Family: Streptomycetaceae, Genus: Streptomyces
  misc_feature (779)..(879): n is a, c, g, or t
ccgcctgcaccagctccgcgggtcccatccgcatggctgaccgacccgccgagatgccagacaccgcgatctcctcactgctgttcacacgcccgatacgccgttcatcctgtcagatccggcgatccttgatcggccctgtcggaccgcgttcatctgcccttggttcagtgtccgcatgcccagggggcgacggccgtggccgcgtccgcctgcgcccgcagctcccgcaccgccgccgccgggtcctgcgcaccgtagaccgcggagcctgccacgaagacgtcggcgccggcctcggcgcaccgctcgatggtggcggccgagaccccgccgtcgacctggagccacagttcgaggccgtgcttgctgatcagctcccgggtgcggcggatcttcggcagcatgatgtccaggaaggactggccgccgaagcccggctcgaccgtcatgatcagcagcatgtccagctcggggagcaggtcctcgtacggctcgatgggcgtcgcgggcttgagcgccatcgaagcgcgcgcccccttcgcccggatctcccgcgccaggcgcaccggagccgccgcggcctccgcgtggaaggtgacggatccggcccccgcctccacgtactggggggcccagcggtccgcgtcctcgatcatgaggtggcagtccagcggggtgtccgtggccttgctgagcgcctcgacgatcggcacgccgagggtcaggttgggcacgaagtggttgtccatgacatcgacatggagccagtccgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggccgaacacggtcggccgcccacggggccggatgcccggccgaccgctccacagggccggaggcgctcagccggtccggcgcagcagcgccaggtacatcgcgtcggtgccgtgcagatgcggccacagctggacgtcggggccctcccccagggcgggcaccccgggcatcagcgggcgggcgtcgatccactccgcctccaccggctccccgccccggcccttgaggacgtcctcga

SEQ ID NO: 3898 - DNA, 2842 bp, Unknown
  Kingdom: Bacteria, Phylum: Actinobacteria, Class: Actinobacteria, Order: Streptomycetales, Family: Streptomycetaceae, Genus: Streptomyces
ttccaccattttcgctgcggcaccgcagcgaaaatggtggaacggaccggtccagggcctgcagaaggtcgggcggagccttcagctcccggtggccgtcctccccgccgccggtctgctcgtcagtctcggcaacctcttcagctcctacctggacggcgctttctgggacaagacctccaaggtcctgctcaacggcggcggcgcgatcctcgacggcgagctgggcctgcccctgctgttctgcatcggcgtcgccatcggcttcgcgaagaaggcggacggttccaccgcgctggcggccgtcgtcggcttcctggtctaccggggagtgctgaccgccttccccatcgacggcaccgtgacggaggccctgcccgacggtgagccgcagaaccccggtgtgctcggcggcatcctgatcggactgctgaccgcggtcgtctggcagcgctaccaccgcaccaagctggtcgactggctcgggttcttcaacgggcgacgcctggtgccgatcctgatggcgttcctctgcgtgatcctcggcgtgctgttcggcctgctgtggcagccggtgggcgacgcgctgacctggttctccaagcagctcatcgacctcggctcctggggtgcggcgatcttcggcttcgcaaaccggttgctgatcccgatcggcatgcaccagttcctgaacacgttcttctggttccaggcgggcgagttcaccggggcggacggccagaccgtgcagggcgacatctcccggttcttcgccggggacccgtcggccggccagttcacctcgggcttcttcccgatcatgatgttcggcctgccggccgccgccctggccatcacccactgcgcgcggcccgagcgccgcaaggaagtggcgggcctgatggtctcggtggcgctgacctcgttcgtcacgggtgtgacggagccgatcgagttctcgttcatgttcgtcgcgccgctgctgtacggcgtgcacgcggtgctcaccggggcgtcgatgggcatcacctggctgctgggggtgcacgcggggttcagcttctcggccgggttgatcgactacgtcgtcaactggcatctggatacgaaaccctggctgatcatcccgatcggcgcgtgcttcgcggtgatctactacgtggtcttccgcttcgcgatcaccaagttcgacctcaagacaccggggcgcgaaccggaggagatcgagaaggagatcgagcaggatctcaccaagtagcgccgaacagcaggagcgcggggtttcgagcccggcgcggacggcacgtacgaggccctcggaccacctggtccgggggccttcggcatgtcaccgaaagtgccggatctgctactgcgaataagcagggaattgcaggttccttatctaaccctcaccgtgctaaaactggtctacaccactgagtggtccagaccacggctgtctgccggcgtctgtcgagtcgccgcctccccgcaatcaacgacctgggcggcaccgtgtcccatggaggaagttgatgaccacggctgagaccgcacccgcggccgagaagaagaagggcgccggcgcgatggccgtcatgcagcgcatcggccgcagcctcatgctgccggtcgccgtgctgccggcagccgcactcctggtccgcctcggcaatgccgacatgctgggccgcgagtcgttcccgaccttcataacgaagctcgcgggctacatggccgcgggcggcaacgcgctcctcgacaacatgccgctgctgttcgccgtcggcatcgcgatcggcttcgcgaagaagtcggacggctccaccgcgctggcggccgtcaccggctacctggtcttcaagaacgtgctcggcaccttcacggacagcaacctgccgcaggtcgccaccgtggccgacggcaagatcgtgatggtcgacgcggcggtcaacgccggtgtcctcggcggtgtcgtgatgggcatcgtcgtcgccctgctctaccagaagttctaccggacgaagctgcccgactgggccggcttcttcagcggccgtcgcctggtcccgatcctctccgccttcgcgggtctgctcatcggtatcgtcttcggtctgatctggccggtcctcggcgcgggtctgcacaacttcggtgagtggctcgtgggctccggcgcggtcggcgcgggcatcttcggtgtcgccaaccgtgcgctgatcccggtcggcatgcaccacctgctgaactccttcccgtggttccaggcgggcgagttcaacggcaagcacggcgacatcgcccggttcctggagggcgacccgacggccggacagttcatgaccggcttcttcccgatcatgatgttcgcccttccggcggcctgcctcgcgatcgtccactgtgcccgtcctgagcgccgcaaggtcgtcggcggcatgatgttctccctcgcgctcacctcgttcgtcaccggtgtgaccgagccgatcgagttcacgttcatgttcgtcgccccggtgctgtacgcgatccacgcggtgctgaccggtgtgtcgatggcgctgacctgggcgctcggcatgaaggacgggttcggcttctcggccggtctggtcgacttcctgctgaacctcggcatcgcgtcgaagccctggctgctggttctggtcggcctctgcttcgcggtggtctactacgtggtcttccgcttcgcgatcaccaagttcaacctcccgaccccgggccgggagtcggacgaggagctcgccgagctgcagaaggccgaggcgaagtagccctcgccacgtccgtacgccgaagcccccgctccccg

SEQ ID NO: 3899 - DNA, 3283 bp, Unknown
  Kingdom: Bacteria, Phylum: Actinobacteria, Class: Actinobacteria, Order: Streptomycetales, Family: Streptomycetaceae, Genus: Streptomyces
ccccggccgccgcggccgccggtctcggcccccgcgcggccttgcgccgttcctggtcgctgacgtggacgcgggccggagcgccccgcgtcctggccctcgcgctgccactggccgcgctcaccgccggaatgatccggctggtggtgcagttcgccctgccgctgcggcccctcgtccgtagcctcgtcgagcaggccacgggcaacttcttcgccgcgtactacgccggcgtcctcgcccccgtcatcgtgggggtcctggtcaccgcggccgtgaccctccccgtcacgtgcacggccttcgcggtcctccacgaccggctgcgggtgcccgcacccctccacggagcgccgggagcgcgtccgaccccctcgcccgacacgcctgttctccgccgttctccgccatgatcaagcccggccggtgtcgacaacgctcgtgagcaatacacctagggcacgtcgaaccggacgagcgccttggcgaccggcgtgccgctgcgccgcgcgtacgtcagccgctcgcgcacctcacgcagcgtccgcggacggaatccgggcccgccacagcagctcttgtggaaccccacgcccgcgttcagcaggaccgcgagggcccgccatgccgcgacgtcccgccgacggggtgccgcgaacgccgaccccgcgtggatcatcggctccgcgcagcgcgggcagttccgctgcctggccctgtcatggggctgcttgaacgagacccggcaggggaggcagacgtacgaagttttcccatggctcaccggatcagcctagagatcgcgccggaagagggccatggagttcttcggacctcggccaggaccggacagcacgggtgcaggcgatactggtcgtagcagtcgccccgccgtcgaaccggctcctggccggggcggccggtggggctcgccttgccgattcctccgaggggagccgttcatgaccacggcgaaagacctgttcatcatcgccatggatccggtaccggatcacgccgtgggacagggcgacctgtcgctcgcactcgcgggagccgaactgctcgatctcatcgctgcgggagccatcaccgtggacggcgacctcatcgtgccgcgcggatcttcggcgccggacgaccggctgctcggcgaggccgccgcacggatcaccgggcaaccgccctacgagcggatcgaggactggctgtggcggcgcggccgggacctcgcggccacgtaccaggacgctctggaggaggacggcgaactcacgcagaagagaagcggccggctgcccttcggccccaggcgcgtggagctggtcgatacgcccggccgccgccgggccatcgcgcgccaggaggagggggaacccgtcctggccgccctcgcgtcggccgtgggcatcgacggcggaccgtccggcgaggacgagtctcgcctcgacgacgggacggtgacgaccgtggtcgccaccgtccatgaagcggtgatggagctggaggccgtacgccagaggcggaccatcgagaacacggccttcgccaacgtctggcgcggaccgtgagccggatccccggccgaggcgtacggcagggttgaccttgacacggtgcgagcgctccgggggctggaggacggccgtgcgtcggtgcggctgcgagccgctctggcggtcggctcgacgccggcgctgcaggcgctgtccaacatcagctgcgcgacatggggtgacggacctcgcccggggtgccgcccgcgggggccggcgcggcgtgtgccgtcgtgccggacggctcctccgcccccaccgggtcccgtgacgcgtcgtggggagcggtgtcggccggcggccggtccaggagcagcggaatcgccagggcgggcagcagccagacgaacacgatgaggcggtagccgtacagctggcccagattcgggtggcccgcctggttgaggaggcccgccgcgcctgccgccagggcgatcggcagaaccacggaggcccgcctcagcagcgcccaggccgacagcgcgagcaggacggggagggccgggttggcagcctggtggcgcagccacgccgaccagaagaccccctcctgcacgaagaactcgggccaggggtcgggcagatcgggccgctggtagtggtgggtcagcaggtcctgggcgctgtcctggcccatgggccaccccagcagatgcgccccggcgtagacgcccgccgccagcgcaccgcacagtccggccgcccggagtacggggccgggctgccgccgcttcagacggagccggccggaccaggccaggaagactgccgcgagggctaccgccagcagcagggcctgggagtagcggacgaggaacatcagggcgaggccgcccgcgacgaggagcgcgccggttcggggcccggccgcaaccgcccgggccgtcatgcccgtgctcgtaccggattccacgtccgtacgaggccggtcccgcagcagcaggacacagccgaggaggaccaccgtgccgagtgccagggagagtccgtcgctcagcgggttcatggcgacggtgccggtgggcagcgcgaggtacagggcctgcccggccagtcccgcgcgccgggagacgcccgcggcgcggagggtgaacaggacgcagacgctgccggccagggcgaggacgagcccggcgagccagaggccccaggtggggccgaggacggtcaggaaggggaccaggaacagcggatagcccggcctggcctcgaagatggccatgaaccgctggttggcgaacggggcggtcatcccctccgtgttgccgtggcgggtccagtacgcgaccgagtcgttcagccgacgcacgcactgctcctccgactcccccacggccttcctgttggtccaggggacagggctcagggaagcgtgctggccgctggcgcaggagtaggcgatggccttccggcccgcctcctgacggctctcgccactgaagctcagggcgtaggagaggtagttcttcgtgtcgggcgaggcccgtccggtgaccgccgtcagctggagtccggcgaaggccacggcgatgagcagcatcccgatgaggcccaggtgctgttttctgcggatgttcggcatcggacgggcgctcccctgcatacggcggttgcctcatcaacgagagaacccccgtggggtggcgttcccgggcggttccgggagccggcgcgtgccgggacccggcgggctcggcgtgcgctaccggccccgcggctttccgcgc

SEQ ID NO: 3900 - DNA, 4803 bp, Unknown
  Kingdom: Bacteria, Phylum: Actinobacteria, Class: Actinobacteria, Order: Streptomycetales, Family: Streptomycetaceae, Genus: Streptomyces
cggtctcgccccgctgatggcggccaggatcgccgagaccgtgcaggagatcaacgcgagcggcacctccgtcatgctcgtcgagcagaacgcggccatcgccctgcggctcgcctccacggcgtacgtcctcgacgtcggcgaggtcgccctgtccgggcccgccgacgaactcgccgcgtccgacgaggtccgccgccgctacctcggtgtcgtcgacgaggacgcggccgcggacgccgacccggccgcccggagccgccgaaccctgagcaggtggtccgcgtgaccaccaccgccacggcctccgcgcacagcaccacggccgcactcgccgtcgaggacgtcaccgtccgcttctcggggctcacggccctcgacggtgtctccttcaccgtcgagcccggcagtgtgcacgccgtcatcgggcccaacggcgcgggcaagtccacctgcttcaacgtcctgtccggcgtctaccgcgccacctccgggcacgtccgcctcggcgacaccgaactcaccggactcccgccgcacaccatcgcgggcctcggggtcgcgcgcaccttccagaacctggcgctgccgccgcacgcgaccgtcgccgacagcctcctgctcggccgccaccggctgacccgctccgggttcgtcgccaccggcctgcggctgccctcggccgcccgggaggagcgacgccaccgcgaccgggtccgggagatcgccgcattcatcggcctcgacaaggagttggagcgcccggccggatcgctgccgtacggacagcagaagctcgtagagctgggccgcgccctgtgcatggagccgaaggtcctgctgctggacgaaccgatcgccgggatgaccgcggttgagcgccgccgcaccgcggccgtcgtggccgatgtgcgcgacagcctcggcatctccatcgtgctggtcgagcacgacatgggagtggtgatgcggctcgcggacgcggtgaccgtactcgacttcggacgacggatagccgggggcacccccgccgaggtccagaacgacccggccgtcgtccaggcctacttgggagcacctcaatgaccacgttcgtcgaactcctcctcggcggcctgtcgatcggctcggtctacgcactcatcgcgctcgggttcgtcgtcatcttcaaagccaccgaggtcgtcaacttcgctcacgcgtccctgctgctggcaggcggctacgtcaccgccgtgctccacgacgacatcgggttctggcccgcgctgctcgtcgggatcgcgggagcggcgaccgtcggggcggccatcgagttcttcgtgatgcgccgctaccggggcagcgaccagagcgtcctggccatcgtcaccatcggcgtcgacattctcctgatcaccgaactcacccgccggatgggcacggacgtgctcgccctcggagacccctggggcaacgaggtcgtctccgtcggcggcatcaccctcgcccagacccggatcgccgcgttcctcgccgccgggctgctgatcacggtgttcctgctcgccttccgctacacctcgtggggcgtgtcgatgcgggccgccgccgagaacccgcagacggcggcgctcatgggcatcaagctgggacgggtctcgctcgccgcctgggcggtcgccggagccctcgccgccgtcgccgcgctcttcctcaccgtgttcccgaccccgggcctggagcgcgccacgtcgctcgccgcgctcaaggcgttccccgccgcgatcctcggcggactcgactccaccaccggggcgctcgccgggggactcatcgtcggcgtcaccgagtcgctcgccaccggctaccagagcgacctctccttcctcggccgcggcatcggcgacctggcgccctacctggtgatggtggcggtcctgctcatccggcccgcgggactcttcggcacgaaggagctggcccgtgtctgacaccaccgccgaagccgcccccgaagttcctgccgcacctgccaccgcacccggcggcggcgcggagagcttcaccgaccggctgcgccgaccccgtacgtacgccgtcctcatcggctccctcctgctcctcgtcctccccttctacctggaccgcttctggctccaggccggactgttcgcgatggcggcggcgatcggcgccatcgggctcaacatgctcaccggcgccaccggacagctctccatgggccacgcgttcttcctcgccgtcggcgcgtacggatactgcgtcctggcgggtgagagcagtaccgagaacgggcacacgctgaccggactcgggctgcccacctggctggccgcgatcctcgccgtactgctcgccggagcggcgggcggcctcttcagtcccatcgccggccggctgcgcggcgcctacctcggtatcgcgaccctcgcgctgatcttcatcgggcagcacgtcctgttcaacgcgggctcgctgaccggcggttacaacggccgcgccgtaccgccgctgtcgctgttcggcttcaccttcgacgacaccgaagtcgtcgtcgccgccgtgccgttcggctcctcggagaagctctggtacgcgggcctggtcgcgctcctgctgagcgcgctgttcgcccggggggtgctgcgcggccggccgggccgggcgatgaacgccatccgcgaccaccggatcgcggcgggggtgatgggcgtgccggtggcccgctaccgggccggcgtcttcgtcctgtcctcgatgtacgcgggcctcgcgggcgtcctgctcgccctggtcttccagcggaccgtgcccgagtacttcggcatgatcctgtccctcgaatacctcgccatgatcgtcatcggcgggctgggcagcgtcgccggagccgtgatcggcgcggccttcgtcaccctgctcccgcaggtgttcacgcactacagcgactccctgccgctggtctccgcccccggcacgggcgggctggctcccggtgaggcgtcccgctacctgtacggcgccgcggtggtcgcggtggtcctgttcctgcccggcggcctcgcccgcctgggcctcgcacgcgcgaagaagcccgcggctccgaacaagccgagggccacgaagcagtcagcggctccacagcagtcagcggttccgaagcagtcggcgcctccgaagaatccaggggagaagtcatgaaactcagagtgctcacggccgtggtcgcgaccctcgccgtcaccctcgtcgggtgcagcggcaaggccaccgacggaaaggcgaccgaggagggcgagggcgggatcaagaccggccccggggtctcctcctcgacgatctccctcggcgtgctgaccgacatgaccggcgtctacgcctcactgggcaagagcgtcacccaggcgcagcagctgtgggtcaagcagacgaacgacgagggcggcatctgcgaccggaagatcgaactgacggtccgcgaccacggatacgacccgcagaaggccatcgccgcgtacaccgaactggagccggaggtggtgggcttcgcccagttcatcggctccccgttcgtcgccgccgtcgagcagcgcatcgacggccaggacaagggcctcgtgctgccgcaggcctggtcggcgaatctgctgggttccccgtacgtccgggtcatcggcgccacctacgacgtcgagacgatcaacctcatcgactatctcctggccgagaagcgcatcgccaagggcgacaagatcggtcatgtgtacttcgagggcgactacggcgagaacgcgctcgtcggctcgaagcacgcggcgaaggaggccggtctcaccgtcgtcgagcagaagatcaagccgaccgacaacgacatgacggcccaggtcgccgccctcaagcaggccggggtcaaggccgtgatcgtcagcgcgggtccgcgccaggcggcctcgctcgtcggcgtcgcggcggccaccggcttcgacgtcccggtcgtcggcaacaactcggctttcgccccgcagctgttgaagacccaggcgggccccgcgctgctcaaggactactacgtcgccgcctccacgctgcccatcggggacccgggcgacggtccctccaagctcgcgaaggagtacgccgcccagtacccgaaggacgtgctcgacaacggcgtcgtcgccggttacacggcggcctccctgttcggcgaggcgctgtcgaaggcgtgcgacgacaaggacctcacccgcgaggggatcgacaaggcgctgctcacgatcaaggggtacgggagcgagttcggggtgtcgcacgacttctcggacccgaaggccccgtccacccgggagagcgtcatcatgaagccggacgccggcgccgccggcgggctgaaggtggtccggccggccgaggtcgccgcggcggccgagtccttcaccgccggttcctgagccctcaccggcccgccggggggcgtacggacgagaccgtccgtacgccccccggcctcgccgtcccggcaccgtcgggtccgccggtcagacctcgctgccgtccatcccgatgtaccggaagcgcccccgctccacgcggtagacgaagaccccggtcccggtgtacatcccgttggcggcctcgaaggcgtagctcttggacacccccttgtacgaggtcgtccgcagcgcgggcagcaggtcctggcggctgatcctctcccggcccagcccccgcgcacaggcggcgatcagcccgaccgcgtcgtacgcctccgccgcgaacagcggcggaggcgtacgacgc

SEQ ID NO: 3901 - DNA, 544 bp, Unknown
  Kingdom: Bacteria, Phylum: Actinobacteria, Class: Actinobacteria, Order: Streptomycetales, Family: Streptomycetaceae, Genus: Streptomyces
cgcacccgggtcgcgtccaggccgagcggggtcagcacctgctggtgcagcaggacctcccacggcgtaccggtggccgccgccagggtgtggccgaggaccgagacggcgaagttcgagtagtgccagcgggtcccggggcggtgccgcgggcgggcccgcaggaaggcccggaccacccggtcggccggatagccgccgtacgggtcggtggaccagcggggcaccgcctgcgggtagaagtcggcgggcaggcccggcagccccgaggtgtgggtgagcagatggcgcagggtgatccggcgcaccgccgggtgcaccgggaagcccggggccagcaggtccgccgcccggtccgcgtaccgcacccggccctgcgccaccagccgggccagcagcagccccgcgaacggcttcgacgccgaacccagctcgtacagcagccgctcccggcccaccgggcccggctccgcgccgccgccggtgtggacggtgcgcaccccgttccggctgaccgcgagcaccaggtccggtgcgtcgacag

SEQ ID NO: 3902 - DNA, 1285 bp, Unknown
  Kingdom: Bacteria, Phylum: Actinobacteria, Class: Actinobacteria, Order: Streptomycetales, Family: Streptomycetaceae, Genus: Streptomyces
cgcggtgctggcctacctgggcgtgctcttcgcgaccttcctcgcctcccaccgcaaagcaaagtcgcattggcaactgaaccgctccgcagccgagttcatcaagtccaactgctggcgctacgcggtccacggcgcgccgttcgacagcacgtccgagcacccggaggcgctgttcgccaatcgtctggaggacggtctccaggagctgcggaaagtgggctgggccgacccgcgcgaggaactgccggattccggcggcctcattacggagtccatgcgtgcgttacggaacaaggcctacacggtccgcaaggaaacctacgtacgggaccggctcatcgaacagcggcgctggtaccgcagacgtcagcaggcctcccggcgcggggcactcctgtggtcgggcgccattgtcgcgctgacgctcccggcgctggcgctgagcgtgttccaggccttcggggtggggcgctcgttcggcctgacgggggcgttctccgcggcggcggcggcctgtctcgcctggaacgagatgcgccggcaccatccgctgatctcggcgcactcgctggtggagaaggacctggagtcgatgcaggccgccatggagaccaccctcaccgagcggcactggccggcggcggtgttcgagaccgaacggatcgtgtcgcccgagcacaccgactggctggtcagacaccgcgtgtgagccggagaggccgtgcggggagcgaaaccccgttcccgtacggcctgttcggcgggcgtccgccggtcagccgcgcagcaccccctcgcgccagatcacggtgacggggcggcccagggcgcgggcgtacgccacgatgtcggccgtgccgccgagaccccgggcggggaggccgtcccagaccgcgagcagccggtcgcagtggtcggcgatgtaggcgcccgccgcgtagtacgcctcgtcggtggagtacgggaagccgagccggacctcctgcgcggcgcgcgccttgagcatccggtagcgggcgaggtcgacgtcgttctcgaaacaggcctcgtagtcgccgctggggatcacggcggtcagttcggccccgcaggcgagggcgaggtcggcgaagagctggtcggcgccgaccgccaggctggagagcgcctgcgtcgcgccgtcgaggccgcagagcgcggcccgcagacccgcgagcacatgggcctcggcctcggcggggatggagcggtgaccggtcactccgatgcgattcacggacctgctaccccctgatgccagcgg

SEQ ID NO: 3903 - DNA, 2394 bp, Unknown
  Kingdom: Bacteria, Phylum: Actinobacteria, Class: Actinobacteria, Order: Streptomycetales, Family: Streptomycetaceae, Genus: Streptomyces
ggtggggagcgccccggcgccacccccgccggaggcggcccgggggacatcggctagccgacgacccgacgacgtcgttcaggacctgcgcccgcggaaggtgcggcgcaggtcgctcacccacgcctcggggttctcccaggggatgaagtggccaccgcggtcatgggcgttgacattgacgtggttgaaccaggccgcctgcggaccgttctcgaacgtccggacgcgctcgtcggcggtgtggacgccgggcgggttctcgtaggtgacgaaggtgaggccgaccggggcctgcacgaccggggtgcggtcgtgggccggggcccacggatagcggttggcgttggcgtagtaacgcatcgacgtggcgatggagttgttcacccagtagatcgtggcgtgggtgagcaggtcgtccttgctgaagacggacgcgaggtcgccgccgttgtcgctccaggcgttccagcgttccagcagccaggcgagcagtccggcgggggagtcgctgagtccgtgggccagggcggcgccgtcgagcatgtgcaccgcgaggtgcggcgcccagcggcggtcctgctcgacgacgcgggcgcggacgtcggcgggcaggtcgtcggtgaggggccggttccgagcgaagtcccaggcgcgcgggccggtgaagaagtcgagcgggagcccggagccgatgtggatgccgtacagctcgtcggcgtacttgtggccgagctggctggagacgaggccgccgatgtcgcagcccccggcggcgtacttctcgtatcccagtgtctcggtcatcagcgtgtgccagaggtcggacaccttccagaagttgacgtccggaaagccggtgagcggtccggggaagccgaagcccggcagcgacggcacgatgacgtcgaacgcgtcggccgggtcaccgccgtacgccgccgggtcggcgagggggccgatcaccttcgaccagtgccagaacgtccacggccagccgtgggtgaggatcagcgggatcgggcgcgggccccggccgggctcgcgcatgaagtgcacggggacgccgtcgacgctcacccggtactgctcgtgggcgttgatggcggcctccgccgcgcgccagtcgtagccgtcccgccagtgggcgaccagctcacggagaaagctgtccggaacgccgtaggaccagtcctcgttcccctcgtccagcggcggccgggtcagtgcgagacgggcgcgcaggtcgtcgagtacccggtcggccacctggatcggggtgggctccagggggaaggcgtgcggggaggtcatggcgtggtcccttccggggaggaggaagcgctgtcgccggaacgcttccacatccgccccgtcccgcgccgtccgacggcccacccgggccgccgggcagcccacccccggcgctaccgccgcaggtcgtccctggcctgcgccgcgaggtccgggaagtccgtcaccaccgcgtccacgccctgctcgtagtggaaggcgtactcggcgaacgcgtcgccgaaggcggtgggtgcactgccccggcggtacgcggccgggaggtactggttctccgcccggaaggtgtacgcgccgaccttcaggcccgccgcgtgggcgtccgccagcagggtgcccggcgggacgagcgaggacttgtccgggccgatccagtccgcgtacgaggcgatctcgcggagcccggccggggtcatcatgtcccggtaggagatcccgtgtccgtacgggccgccgctcgtgcccagcgcctgccacagcgggagtccgaggcgggccgcggccacccggcgcaggctcgtgggctcgaaggactggacgacgcagtcccgggcggtcagccggttccggcggatcacccggatcagctcctcctccagtggcagcccgatcgagcggaagtacgtcgggtgcttcgtctcggggaacaccgcgatccgccggcccgactcccgggacagccgcctggccaggtcgatcacttcctggaaggtcatcaccgagccccgcccatcgaagaccgtgttgcggtcgcggaccagcgggagccgttccacggtgcgcagcgtcctcagctcgcgcaggtcgaagtcctcggtgaaccagccggtcaccgccttgccgtcgacggtcttcgtggtgcggcggtcggcgaactcgggccgtccggcgacgtccgtcgtccccccgatctcgttctcgtgccgcacgaccaggacatggtccttcgtcggcacgaggtccggctcgatccagtcggccccggcccgtacggcataggtgtacgcgtcggcggtgtgctcgggccgccagcccgccgcgccgcgatgcccgatgaccagagggcccgacgggcggtgg

SEQ ID NO: 3904 - DNA, 2282 bp, Unknown
  Kingdom: Bacteria, Phylum: Actinobacteria, Class: Actinobacteria, Order: Streptomycetales, Family: Streptomycetaceae, Genus: Streptomyces
gccgtcctgctggaggccgtggtcgcggcgggggtgccgcgcttcctcttctcgtcctcggcggccgtctacggcgtaccggacgtggacctcatcacggaggagacgccctgtctcccgatcaacccgtacggcgagaccaagctcaccggtgagtggctggtgcgggccgccgggagggctcacgggatctcgaccgcctgcctgcggtacttcaacgtggcgggtgccgccgcacccgagctcgcggacaccggggtcttcaacatcgtgccgatgatgttcgagcggctgacgcgcggcgaggcaccacggatcttcggtgacgactacccgacgccggacggcacctgcgtccgcgactacatccatgtcgccgatctggcggaggcgcatctcgccgtcgcgcgtcggctggacggcgcgggcgccggtgacctgacgttgaacgtcggccggggcaagggcgtctcggtccgggaactggccgaggtgatcggcgaggtgacgggccgcggcccgaagccggtggtcgggccgcgccgggccggtgacgcgccgaaggcggtggcgtcggccgcgcggatcaccgaggagctgggctggacggcacggcgggacgtgcgcgagatggtggagtcggcctgggagggctggtgcctgcgccaccccggggcgcgggccgagcgacgtccgtgagaggcggcggagccctctccgccgtgcgcgagtgatggtgtcactgctctgacctgcggaacgttttcgcaggtcagagcagatgacaacggtgttcagtgccgtgttgcctgataccccccacccgtagttcactggccacgtccgggcggtttcgccctggcgccgaagcacggacctggaggcgttcacatgggggctggccacgatcacggacatacgcacggcgggccgccaccgacgggcacggcggccgccgcgtaccggggcaggctccgggtggccctggcgatcacgctgggcgtgatggtcatggagatcgtcggcggggtgctctccgactcactggccctgatcgcggacgccgcccacatggcgaccgacgccctggggctcgggatggcgctgctcgccatccacttcgccaaccgtccggccgggccgaaccgcaccttcggtttcgcccgcgcggagattctggcggcgctcgcgaactgtctgctgctgctgggggtcggcggctatctggtcttcgaggcggtcgagcggttcatcaccccggccgagacgaagggcggcctggccatcgcgttcgccgccgtcggcctggtggccaacatcgtctccctctccctgctgacgcgcgggcagcaggagagcctgaatgtgcggggcgcctatctggaggtgctggccgacaccctgggctcgctcgccgtgatcatctcggccggcgtcatcatggcgaccggctggcagcccgccgacccgatcgcctccctggtgatcggcctgatgatcgtcccccggaccatgaagctgctgcgggagaccctgaacgtgctcctggaagcggcgcccaagggtgtggacatggcggaggtacgggcccacatgacggagctgcccggggtcctggacgtccatgatctgcacgcctggacgatcacctcgggcatgccggtcctctccgcccacgtggtggtgcgccaggagatgctcgactccatagggcacgagaaggtgctgcacgagttgcagggctgcctcggggatcacttcgacgtggagcactgcaccttccagctggagccgagcggtcacgcggagcacgaggcgcggctctgccactgaggcgctcccgagggcgggccgaggcggtgctaggctgatttcgctgagacgttcgagtctcgcggtggagcggagcccggtgacaccgggaccccgacgagaggagctgaggttgatgacggccgcaacgacgccttcccggcgcggcaatcaatccttcctcatctcccgggtttccggctaggtccacttcttcccggatcgggtcggagccctcgtacccaagggttcccacgttgaccgaccaccctgacgacgcctcgcgcaccgaggcgtccttcacacccgacggacacggccgcggcgcgtatgtgccgcaccccgtcgatccccgatggaccacccgtccggaaacaccggcggaccgtgcggccgtgcacgcggtcaacacggccgcgttcccgaccagggacgaggccgacctcgtggacgccctgcgggccgacgcc

SEQ ID NO: 3905 - DNA, 1484 bp, Unknown
  Kingdom: Bacteria, Phylum: Actinobacteria, Class: Actinobacteria, Order: Streptomycetales, Family: Streptomycetaceae, Genus: Streptomyces
tccccgggccgtgcggacggccccgccgaggctggccaggtcgctgcgcgggctgggccgcagggtgcccaccggcggccggagcacgctggacgaggagagcacggccgagcacggactcaccgacgggctgtgggtcccctacttcctccccgaccgcgagcgggcgttcgacctggtgctcctcgtcgaccgggcccccaccatgccgccgtggcacggcaccgtccggcagatcgccgacgatgccgcccgcagcggggccttccgcgatgtccgcacggtcggagtgaccctgcccgccggggccggcgaacccgcgctgcgctggcccggtggccgcgacggcgaccccgccgaactgctcgacggccgcagctcgcgactcttcctcgtcgtcacggacggactcgcccacggctgggcgggccccggggccgaccggttactggaacggctcgtgtccggcgggcccaccgcgctcgtccacctcctgccgccctatctgcgccaccgctcctcgctgttccccttccgcgcccaactggacgccggaggcttcggagcgccgaaccggcggttccgcttccgtccgccgctcggcgcgcacgaccccgtccggccgctgcccgaaccggacgacgacaccgtgcccgtaccggtgctcagcgtgcgcgccgggtccttccgcgcctgggccgacctggtgaccggcgaacgcggggtgcggcgaacgctgccggtggtcctcgcgggggcgatggccaagggggcctccgcccccggactgcgcacccccgtcgtcgacggtccccgggcggcggccgccgccgtccgcaggttccgctcgctcgccagcccgttggcccggcagctcgccgtgctgctggccctcgccccgatggacttcgccgtcatcgacgagctgcgcgacctcgccctgcccgacgccgggcccgagcacctcgccgaggtcatgatgggcggactgatcgactgggacaccggtcccgagggcggcccggacttcgccgacgacgtacgcgaagcgctgctcgccaccagcaccaggacccaactcgcccgcaccgtgggcttgttggcggagttgcgtacgggacagggtcacggagcgcggctccgcgcggccctccgcgacccggtgcgcaccgccctccccggtgcggagcccggtgcccgcccctggctccggatcgaactggccgtcctgcgagcgctggcgggcccctacgccggccgggccgccagggtggccacccgcctggcgggctcgtcgggcggcccgcctgcccggccgggtgagatcggtggggaaccgatgaaaaacgccccgaattgggcaaagctgccaccggacagcgtcgtttcaccaggaggacccgtgccgcccacgacacccccagcagctgacacctcggcaccagctgacaacaccgcccggagggcacgcgaggagatggaag

SEQ ID NO: 3906 - DNA, 1477 bp, Unknown
  Kingdom: Bacteria, Phylum: Actinobacteria, Class: Actinobacteria, Order: Streptomycetales, Family: Streptomycetaceae, Genus: Streptomyces
cgcgggcaccggcctgctcacccgggtcctggcggccgagggccaccggacccgggcggtcgagccggatgccgcgatgcgcgcccgcatcaccgccaccgcccccggggccgtggccctggccggcagcgccgagaacatcccgctgcccgacgccagcctggacgcggtgctggtcagccacgcctatcactggttcgaccccgctcccgcccacgccgagatcgcgcgcgtcctgcgtcccggcggcgttctggcgaccctctggaacctccgcgacgaagaggtcccctggtcggcggcgctgtccgggatcctcgccgacgaggacaccgggacggacccgcgcacccccgcggcgatcatgctgcacggcgcgttgaaggcgctgcgcacccaggacaccgagtggctcaccggctggctgcgcgaccccgcgttcgggccggagttcggggccgtcgaacagggcttctttccgcactccgagacgaagacgatcgattctctcgtcacgctcataaaatcacggtcgtactacctgacgtcctctccggaccgccgccgggaaatcgaggaacgtatacgtgaactcgccaccgtgtacccggaactgaaaagcggcaacaccttcgagctaccctacgtaacggtggtattcaccacggtccgcaactgacggaccgcaccggaacacggaaaaccggaagccgaaggcacgggagtccggcagaccggaaacttcttcgccgaaagggaacacggtgctctcacccgtcgccgcgtccgtctgcgcctcacgaggcggcggcaaggcacgctgggaaggtttcttcaccggacaccgggtctgggacgagacacgcgtcgcggagagcgccaaacggcttctcggcatggacaccgcggccgtggcgagggccgccggcgaggtggtgcggccgtaccgggcccagccgggcagcaccgccccgtcgctcctgctgcacaccaccacacccctgctcaaggcgttcgacggcgacctggccgctctgctgagcggccaggaaccccacgacgtgaccacgtacgtcgaggccaggtcggtgtatctgggcactcccgacgacctcacgctgggccgtaccgccccctgggccgaggccgcggcgctccggggcgtccccgccgtcgacatcggcgacctggaccactactacctgacccacgccctgctgctcatggcggaggcccacgaggagcgggcggaaacccccctccgccaggtcatcgactggctgcgtgagcgtcccgacgcggtggtccggctgtacgcgctggacgtggagacgcagatcttcctgctctggctgctgcgcaggaccgggctggccgaactggccacggacgccaacagcccggcggtcgccaccgagtggaaccggaagaaccacatccaccccacggtcgccgacgcccgcgcgatgcccgcgtc

SEQ ID NO: 3907 - DNA, 1420 bp, Unknown
  Kingdom: Bacteria, Phylum: Actinobacteria, Class: Actinobacteria, Order: Streptomycetales, Family: Streptomycetaceae, Genus: Streptomyces
gcggcggcgcgggccgccagcggcttcatgtcggggtgcttgatcttccagcgtcccgacatctgctcgacgaccagcttggagtccatccggacgtggacccgcagcgcgtcacccgcgtccgggaacaacgccttcgcggcgctcagaccggcgatcaggccccggtactcggcgacgttgttcgtcgcgacgccgatgtactcggcggcctcggcgaggggttcaccggtggccggatcgatgacgaccgcaccgtagccggcggggcccgggttgccccgggatccgccgtcggcctcgaccaccacctggcgcgaggcgctcattacaggcccgactccgaggtgcggaccaggatccggtggcagttctcgcagcgcaggaccgtgtcgggggacgcggcgcgcacgtcgcccacctcggccatgttcagctcaagacggcagccctcgcagcggcgctggtagagccgggcggcgccgaccccgccctgctgggcgcggagcttgtcgtacagcttcagcaggtcggcggggatgacctcggcgacgatctggcggtccttggtcaccgtggcggcctcggcgtccagctcggcggtcgcggcgtcgcggcgggcggtggcgtcgtcgaccttggcctggacggcggcgacccgctcggtcagctcggcgacccgctcctgggcggcctcacggcgctccatgatctccaggacgacgtcctccaggtctccctggcgcttggcgagcgagacgatctcgcgctggaggctctccaggtccttgggcgaggagaccgcgccggagtcgaggcgctgctggtcgcggacggcgcgctggcgcacctggtcgacgtcctgctcggccttggtctgctcgcgggtggtgtcgctctcctcggtggtggaggcgaccagcagatcacgcagctgggcgaggtcgctgctgagctgctcgatctcggcgtgctccggcagcgaggtgcgcttgtgggagagctgggcgagacggaggtcgagggcctggacgtcgagaagtcggatctggtcggcgggcgcggcgttcagttgggggctccagaggaatggtgggtggtccaggggtcggtgacctgcttcgagacatggacccgcaggtcccatccgtggcggtcggaaagcgcgtcgagctgggcggccgcctgctcgcaccagggccattcggtggcccagtgggcggcgtcgacgaggccgagcggcgagtgctgcacggcttcggacgccgggtggtggcgcaggtcggcggtgaggaaggcgtcgacgcccgcggcgcgcacggcgtcgaagaggctgtcgccggagcctccgctgacggcgacggtgcgcacgagcgcctccgggtcgccggccagccggatgccctgcgcggtggcgggg

SEQ ID NO: 3908 - DNA, 1285 bp, Unknown
  Kingdom: Bacteria, Phylum: Actinobacteria, Class: Actinobacteria, Order: Streptomycetales, Family: Streptomycetaceae, Genus: Streptomyces
gggcggactgcgggatcggcggcgtacggggcagctccgcagcgaaggccccggcggccgtctccttcgcccggtgcgtacggagcacgtcggcgccgaccgcgcgggcctcgggcgatcgcccctggtaggcgtccttctgggtggccgggtcgcccagcacgagggcggcctccagccgggaaagcggcacgaggccgtccttgcgcagcaggtagtacgtggagccgccgcctggcacgctcacctcgaagagctggccgatcgtgctcggctccccgccgagcgccggtcccttccgcccccgccccggtgcctcgggcggtttcagggcgggtccgggggccagggcatcgagaaaggcggccgagaccggcatggcccgctcggagccgaagccgagggcattgcgggcgtccgaggcgcggtccaggggcagcctgctgccccgccacaccaggtactcggtgcggtccgggccgctgacgagcactccccggtcggcgccgatgtcctgggtctccagcggcgcgccggcgaccagtgtggtggcccccggctcgtccacacccgcccccacgacggcaccggaggtgctgggcagcgcgccgcccggcccggtgacgcacatgtgccaggctccggcgtcgagttgaccgggcccggggagggtgtcgggcgcgccggggataccggccggggatcccacggggacgtcgcgcagcgaggcggtggagacgtccacagccttcagctgcgggcctccgatcagccgggccgacgcgtagttgcggaccgggtggagtacgccgtcggtgccggtccacagatagcgggcgccggtctcgcggttgaccaccaggttctcgcccttgcgccaggtgtcgttgccgccggggcgcaggagcccgtagacggtggcgccggcgccgatcaggagggtcaccaggaggccgaagacgacccctcgggtcgtccggcccagcgggctctccggggcgtccgggtcggccgtcagcaggcccgagctgagcctgcccatcatgaatccgtgggcctgcacctggtcgcgcttggactgcacagcctctcctcaactcttcttcgatggaccggcgatggaacggcgtacgggcggcctcagccgaacaggccgcgcagccagccgaagaggcccgccacccacagggtgaacggcagcagcgcgaccgcgaggccggtgtgggccagctccgccgcccggccccagtacggcagcacccggcggccgggcggcggagctggc

SEQ ID NO: 3909 - DNA, 516 bp, Unknown
  Kingdom: Bacteria, Phylum: Actinobacteria, Class: Actinobacteria, Order: Streptomycetales, Family: Streptomycetaceae, Genus: Streptomyces
agtgctcctcggtgagaccccgggcgccgccgccgcgggtctcaccgaggagcactggctgctggacggagcgctgcggctgatggccgatgaagccgtgccgtacgcgaccagggccgtgggggtcgtggaggcgcgctcggcgccgctgctgcgcatgctggaggaagagggcatgccggacccggcgttgaccttgctgcgccaccccggcctggactggacgctggcggaggtacggacctccggcgggccgcagccgtggaccggactgagctggggccgtgacgagacggaggcggtgcaccgtgcgctggccaccgcgctggcccggcaccagacccacggggtgcccggcgcgggcttcctggccgaaggcgtgcacaccgacgccctgctgttcgccgatgcctcggcgcaggccgcgctgcgcaagcagatcgcggacacggcggcggccgccgggctccgctacgcgggcaccccgcgtcgaccggacccggtgaccggcgcgtt

SEQ ID NO: 3910 - DNA, 1979 bp, Unknown
  Kingdom: Bacteria, Phylum: Actinobacteria, Class: Actinobacteria, Order: Streptomycetales, Family: Streptomycetaceae, Genus: Streptomyces
ccttcgcctgctcggcggcggcgacggccttgtccgtcttgagccgtgcctgcttgccctcgcgttcgacgatggacacgagctggtcgatcgtggccgcttcctcgtcgcgcgcccgggcgatgtgctgaccggtgttgaggaaccactggatcgccttcgcggacccgtcctgcagcgcgcgctccgcgtactccttcacctggggggaggcggtgccgaggatcttgaagacctcgacctgctcgtcctcctcctggccgtcgaagcgggtgtccaggaggaaggtctccaacgcctcctgggtgtccgcgtccagggcggtgttcgcgcggcggcgcaggcccgctccaccggtctccatgacgcggaagacctcggcgcggaggtcggtcttgagcggggccagatagccgtccttgaggtacgcggtgatggcctcgtcgccgccggacagcgcccggctcgccgcggcctggacggacctgcccgcccaggcgaggccctggaacacggccacgcggttgtcctcggccttggccggggcgagttcgccggacaggaacgccgacacctgggcgtcgctgccgaccagtgcggcggcggctgcctcccgtacggcacggccaccggtcaggtaggcccagaggacctgaccccgagcggtgtccgggaccccgcccggcagctcggcgtcgccctccgcggcatacgcgggggccccggagagaacgagcgatccgggtacggcggcgacggcggtcatcgccgtcagggtggtgatgatgcggcgtctgctccacaggctgggtggcacgaggtggttcctttcggtgtgaggacgctgggtgcgctccgcacgacggcagggcggcacagccctgcggctgtcctgccgacggcgttctttcgggatgtgtccggccgctacccggaggtgacgatctccacgagcacgtgctcgcggccctccgggtcggcgctctcgcccaccgcggcccaggagttggccgctacgtcgtactggttgtcctcgccgtcgacggtcgtcgacagttcggtggcgtaaccgttggtctggacgccgtagacggcgggcagttccaggctcaggtatccggatgcgcccgtggtccggaaacagaacttgtcggcgctcgcgtggcgcgcgtagacctgcaggaggtccggagcgctgccgcactccgccagcacgatgtgtccgtcgccccgcttcagcagaatcccctgctcggcgaggatcttgtcggcctgtggataggcgaagtcctccacggcgtgtccggggccctcctccgccaccggacggagcgtcaactcctcctgggccggggccgtccgccccgtggcaagcgctgccacgatgacggcggacagtgcgcccgccgtcagcgcggccttccgtacgcgctttctcaaatcccctcctcgcaatcaccggaaaggcgctccgagccccctgctcgtaccccgctgccgcctttccgggagcgttcagcccaacagttgccgcaggcgaaggcaagcaagatacgtacggcatgggcgacataagaggaagcggaatgtgaacttcgacacaacggcgaaaaggttgtatgaagatcagcgtcgatcacgtcacgaatttttcaagaagcccggaacgcgtcctccgcttcccggtcgacgggtggccggaatgtgcatcttgaccagagcatgacatcgcacgatcctgtgcccgtcgcacagctccaccccccaccccgacggactcaggagactgccgcatgcgactcgccagtacacggacgtcccggccgagaacccggccggcgaaaacccggcgcaacgccgccctggccgttctgctcgccctcggtctcgccgctcccgccgccaccgtggcgaccgccggacccgcgggcccgaacgcggccgtcgtcgcggacgagcggacgctccagtacgagatc

SEQ ID NO: 3911 - DNA, 1010 bp, Unknown
  Kingdom: Bacteria, Phylum: Actinobacteria, Class: Actinobacteria, Order: Streptomycetales, Family: Streptomycetaceae, Genus: Streptomyces
  misc_feature (536)..(537): n is a, c, g, or t
cgcgcggcggcctcggcgacttcgggtggctgctgcaccgggtggggccggaatgcgggtgaccgccccgacgtggcggggtcagggaatactgtccgcatgacggagacgacgatcggcatcggcggagcggcggagagcaccgacatggtgctgaacatcggtccccagcacccctcgacgcacggggtcctccggctgcggatcgtgctggacggcgagcgcgtgcagcacgcggagccggtcatcggctatatgcaccggggcgcggagaagctcttcgaggcgcgtgactaccggcagatcgtcatgctcgccaaccgccacgactggctgtccgcgttctcgaacgagctgggcgtggtgatggccgtcgagcggatgctcggtatggaggtccccgagcgcgcggtgtggacgcggaccctgctcgccgagctgaaccgggtcctcaaccacctgatgttcctcggctcctaccccctcgaactcggcggcatcaccccggtcttccacgccttccgggagcgcgaggnncctcggcaacgagatcttccggggccgtacgcgggacgtgggcgtgctgtccgccgccgcggtgcacgcgtacggggtgtcggggccgatcgcgcgcgcctcgggcgtcgacttcgacctgcggcgcgacgagccgtatctcgcgtacggggagctccaggacaccctgaaggtcgtcacccggaccggaggcgactgcctggcccgcttcgaatgcctgctggagcagaccctcaactccctggacctggcggacgcctgcctggaccggatggcccacctggcgccggggccgatcaaccagcgactgcccaaggtgctcaaggcgccggagggccacacctacgcctggacggagaacccgctcggcgtcaacggctactacctggtgtccaagggcgagaagacgccctaccggctgaagctgcgctccgcctcgttcaacaacatccaggcgctcaccgagctgctgc

SEQ ID NO: 3912 - DNA, 3375 bp, Unknown
  Kingdom: Bacteria, Phylum: Actinobacteria, Class: Actinobacteria, Order: Streptomycetales, Family: Streptomycetaceae, Genus: Streptomyces
gctccacgtcacgggccgccgccaccaccgcgtcgaacgtccggtcgcccagcgtgaccggcgtgcgcagcgccccgtacagcacgccccgcaccgcacgccgtacgacgacggggaccgcgacgaccgagcgcagcccctccgccgccaccgccgcgtcgtactcgtggctgatgtggcgcgaaaaggcgtagtccgtcaccgcgcagggccgggacagcgcgatggccttgccgcccagaccgctcccggcggagatgaccaggccccgcagcgcactggtctgcgcaccgttcagctcggcgatccgcgcatggcgcgcgtcggacagcaggccgccgaacaccacgggaagcccgctcgtgcggcgcagcctcaacagcgctgcctgcatctcgaccgcatcgaccggttccggcactccgacacccttccgcccggcccgtgccgtcccccgggcggaggagcggaccacccccgtccgggggtggtgagacctgggtcactgtttacatgatgttaggcgaccggttcgtcatgaggagggcacatgtcggcaaccagcgctaccgagacgttccgggccgcccgggacttcctgctggagcaccgcgaggactacgagcgggcctacgcgggcttccgctggccccgggcggaccacttcaactgggcgctggactggttcgacgtcatcgccgagaacaacgaccgcaccgccctgcacatcgtggaggaggacggccggcgcaccgaggtgtccttcgcggcgatgtccgaacgctccgaccgggcagccaactggctgaagggacagggcgtacgggagggcgaccgcatcctcgtgatgctcggcaaccaggtcgagctgtgggagaccgccctcgccgcgatgaagctgcgcgccgtcgtcatccccgccaccccgctcctgggccccaccgacctgcgcgaccgggtggagcgcggccgggtgcgccatgtgctggtgcgggacgcggacaccgcgaagttcgacgaggtccccggggactacaccaggatcgcggtgggcgaggaggtggcgggctggctgccgtacgcgggggtggccgaagcgtccgccgcgttcacgccgggccgggagacggacgccgacgagccgctgatgctctacttcacctccggcaccaccgccagccccaagctggtcgagcacacccatgtgtcctaccccgtcggccacctggcgacgatgtactggatcgggctcaggccgggcgacgtccatctgaacatctcctcgcccggctgggccaagcacgcctggtcgaacctcttcgccccgtggaccgccgaggccaccgtcttcatcttcaactacacccgcttcgacgcgggccgtctgatggcggagatggaccgctcgggcatcacgagcttctgcgccccgccgaccgtctggcggatgctcatccaggccgacctgagccagttgaaggtcccgccgcgcgaggtcgtcgcggccggtgagccgctgaacccggaggtcatcgagacggtccggcgggagtggggcgtcaccatccgggacggattcggccagacggagaccgctgtccaggtcgccaacacccccggccagctcctcaagaccggttcgatgggccgcccgagccccggcttcaccgtcgaactgctcgacccgatcaccggccgtcccggggcggcggagggggagatctccctcgatctggccgaccgtcccgtcggcctgatgaccggctaccacggcgacccggaccgcaccgccgaggcgatggcgggcggctactaccgcaccggggacatcggcgcacgcgacgcggacggctacatcacgtatgtgggccgcgccgacgacgtgttcaaggcctccgactacaagatctcgccgttcgaattggagagcgccctgctggagcacgaggcggtcgccgaggccgccgtcgtgcccgcccccgacccgctccgcctctccgtcccgaaggcgtacgtcgtgctcgcggagggctgggagccgggaccggacaccgcgaaggtcctcttcgagcactcccgggcggtcctcgccccgtacaaacgcatccgcaggctggagttcgcggacctgccgaagaccgtctcgggcaagatccgccgcatcgagctgcgcgaacgcaccgccctgggatccggcgccgagttcgacgagggggacttcacgtgagcagcctgtcctacgcgcacggtgtcggtgacaccgcgctgctcggcgacaccatcggccgcaacctcgaccggacggccgcggtgcacggcgaccgcgaggccctggtcgacgtggcctccgggcgacgctggacctacacggaattcgtcgcggacgtcgacgtgttggcccgcgccctgatggcgtcgggggtggcgaagggtgaccgggtcggcatctgggcggtcaactgccccgagtgggtgctcgtccagtacgccacggcccggatcggggccgtcatggtcaccatcaaccccgcctaccgcgcccatgaggtggcgttcgtcctcaagcaggccggcgtctccctgctgatcgcctccctctcgcaccgcaccagcgactaccgcgccctcgtcgaacaggtccgtgccgactgccccgacctgcgcgccgtccactacatcggcgacccgtcctgggacgagctgaccgccgccgcgcccgccgtcaccccggagcgactggcggcccgcgaggcggagctgtcctgcgacgacccgatcaacatccagtacacgtccggcaccacgggcttccccaagggggcgacgctctcccaccacaacatcctcaacaacggatatttcgtcggggagacgatcgcgtacacggaggccgaccgggtctgtctgccggtgcccttctaccactgcttcggcatggtgatgggcaacctcgccatcacctcgcacggcgcctgcgtcgtgatccccggcccctccttcgagcccgccgccgtgctcaccgccgtccagcaggagcgctgcacctcgctgtacggcgtgcccaccatgttcatcgccgagctgaacctcccggatttcgccacgtacgacctctcctcgctgcgcaccgggatcatggccggttccccctgcccggcggaggtgatgaagcgggtcgtcgccgagatgcacatggccgaggtgtccatctgctacgggatgacggagacgtccccggtctccacccagacccgccgcgacgacgacctggatcgccgtaccggcacggtgggccgcgcgctgccgcggggcagcgtgacgccggtgaccgggtcgacgaccttgacctcgatgtgcggcagcgcgcggcccacc

SEQ ID NO: 3913 - DNA, 1399 bp, Unknown
  Kingdom: Bacteria, Phylum: Actinobacteria, Class: Actinobacteria, Order: Streptomycetales, Family: Streptomycetaceae, Genus: Streptomyces
gggtcaccacggcggtggcggttcggtgccgccgccgtgggtgtggccgccgccgcgctcggtttcgcgctggcggacccgatgctccagggcggtatcgccaccgccgtggtgaccccgctcgcctacctggggcggggcaaggagacgcagttccttgaccagggtgctccgccgctgcgggtggacatgtccgcccagcagctcaacgacgcgttgcgcgccgccggcctcctgaaaagcggcaagagcggtgacgaggacggtccgaaggtctcttgctcgatgggcccggtccgcgacggccgtggctgggccgtgatcttcgacctgccccggggtggcggcaagaccgcctccgacgtcctcgcgaagcgtgaggtcatcgcgcaggaactcggggtggatgagatccaggtcatcatgtcccgggtccgcgccgcgaagggcggtaacgccggccgcgtcagtatgtgggtcgcggacgatgacccctacctgggtcctctcaacccgtcgccgttggagaaggtggagcggttctccatctgggagccggtcccgttcgggcaggacgcgcgcggtgtccgggtggagatcccggtcatgtggcagtcgatgttcttcggcggtctgccccggcggggcaagacgttctcccagcgtctgctgaccgctgccgggctgctggacccgttcgtgcggcactacgtcgcggacggcaagggcggcgcggactggatgcccatgaaggccgtcgcccaccggctcgtgatgggcgccgaggacgacgcgatcgaagcgctcaaggcgatgctggcggagctgctgacggagatggagcggcggttcgcgctgttgcgggacctgccgacgtcggtgtgtccggaggggaagctgacgccggacatcgtcgcgaagtacaacctgccggtcatcttcgtcaccatcgacgagttgcaggagtacttcaccgcgatggagcgggaggaccgcgagcaggtcatcaacgacctgtgccgcatcgcccgacgcggtccggctgccgggttcgtcagcaacttcgcttcccagcggcccgacgcggacagcgtgccgacgaagctgcgggagatcatcaccatccgctacagcacgcaggtcgtggaccgggcgtcgtcggacatggtgctcggcaagggcaaggccgcgcagggtgccgacgcgtcggtcctgtccgaggagcacaaaggggttggcgtcctggtgaccggtccggcgtcgtacgtgacggtgcgggccgactacctcgacgggacgggattcgcggtcctgtgccgcaagggccgggtcctgcgtgaggtcgcggggcagctcaccggggaagccgcgggcgatgtcaccgccgccgccgacgcgg

SEQ ID NO: 3914 - DNA, 2305 bp, Unknown
  Kingdom: Bacteria, Phylum: Actinobacteria, Class: Actinobacteria, Order: Streptomycetales, Family: Streptomycetaceae, Genus: Streptomyces
gccccacccgcacacctggccccgatgacgacgcggaccccggcgccggtccggcccctaccgtcggccggtccacgtcgcgcccggacatcccgcacaatggacagatgtcttttccgccctccggccggcactcgggcgccgcccaccacgagtactgcaacaccggcctgtgctgccggtgccagatgcggacctggacgacgaaggcgggcaacgagcggctctgcgggccgtgcgcggcctgctgccacgagtgcggccgggcgcccgcgccctatctggacgggctcgacggcgggctgtgcgccgaatgccgcggactgtgcggccgctgccacgcccccaagcgacccgacgggtcctgcgcctgcgaccgctggcgggagaacgcccggagcaaccctcccggctacgtcctccaggccctgccgccccagctcctccaggcgctcggcggccggctgcccagcaccgtgcacgacctcatccaccaggaactcgccgtccgcagctccggcctcctgcgcgagcgcatcgaacgccgctggaacctgcgctgggcccacgcgctgggcgagaaggacgaggacggccgccgccggtggagcgcccaggacatcgccgaacagctcctgcggcccggttcgtgcaccgacccgcagtgcgaggacggctacctcctcaccaccgacaccccgtgcacccgctgccggcagccgctgcaccgcttcgtcacctcggtcgccgaccacaccgcgaccccggagcacgcacgttccacggcggccggaatccgccgggcgatgctggagaaccgctcgcgtcccaagcgtccgccgcgctgagcgcaacctcctcgtggcagtggccgggtcccgatgaccccgccgtgccgcagagcgctcacccgcgccccggccctgaaactcgccgccggtgcgcgacacggcccggaggcggtgagcttcctcagccgttcaccagacgggagcggatgaggaagcgcaccccctccggggcctccagcgagaacccgctgccacggccctccaccacgtccacgatcagccgggtgtgggcccacaccgcgtactggctccgcgacatccagaacggcacgctctcgggcaccccctcgacggcgaggtccgccagcagcacatcggcgtccccggtgcggaactcaccggccggatagcacatcggcgcgctgccgtcgcagcagccgcccgactgatggaacatcaacgggccgtggtccgtccgcagtcgccgcagcagaacggccgcggccggcgtcagctcgacagcgggtgatttcgggtcacactccatggacctgccccttcccggctgcggcgaggccgcgacgaccggacacaagtcaactcgaccggacgttgcgaccgggttgcacgccctatgctcgcgcccatggagcaacgggaagtcgtgaagcgcgtgatcggcatcctcacagaggcgcgcgaaatgcagcgtctgctggaggcggacctcgaacgggaagatctggacgcgggagcgggcgccgtcaccgccctgctgaacgagacgatgccccacatcgccatccccgacgacttctccgtcgaggaggtggtcaccgtcgtcgggcgcgaggtcggcggcgcggtcgaacagctcgtgagcgccttcaccctcgcgttcacgatgctggcccaggtccacgactccgggcagaccgacgtgtcgtcggcggacgtcctccaggacctcgcgctgcgggtcgagggcggcggaccggacgaggacgagaatcccctgttgtagcggcctgcgttccgccgcgcgggtatgcatagtggagggagaagcgcgaatctccctcgcggcatggaggcagctgtgggaaagagcaccgacatagcccgcgccaaggcgcggaggctcagaggcatgatcaaggaatcggacggcatcgccctcgagaacgagcggctgaaggccgagggcaggaaggaacaggccgaggcccgccgcgaggaggccctggcacgcgcggcgcgggcggcctccgaccgctgagagaagcgaaggcgcccgtgccgtcgccacggcacgggcgccttcgcgagtccgcccggccccgcggctgcggcagtacggcagcagccgctgccgtactgccgcagccgcggggccgggcggactcgcgaaggcgcccgtgccgtggcgacggcacgggcgccttcgcttctctcagcggtcggaggccgcccgcgccgcgcgtgccagggcctcctcgcggcgggcctcggcc

SEQ ID NO: 3915 - DNA, 3016 bp, Unknown
  Kingdom: Bacteria, Phylum: Actinobacteria, Class: Actinobacteria, Order: Streptomycetales, Family: Streptomycetaceae, Genus: Streptomyces
ggcggcccgctccgcctccagctccccgagcaccagcccctccccgtagtacgcgtgcgggaacggcgggtcgctgtggatggtggggctcgcggcgtacggcatctcccgcaacgagtccgcgagcacggggccggtcccccgcagcggggccaccagccgctcgccctcggccgcgtcccccgtgaaggcgacccgcaccgagacgacgtaccgtccgcgcaactcctcgggcagctgcggcatgtccgggtagacgagcgcggccagcgacgacgtcagggactccggcacggtccgggtccactccagatagcggcccgccacctcggccgcccgctccccggcgaacgcgatcgagcccccgtacagccgctccaccgccaccaggtcgatctccagagcggtcaccacccccagccggtgcccgccgccgcgcagcccccagaagagctccggctcgcgctccggcgtgacccggcgcaggaccccgtcggcggtcaccacctccagcgcccggacccggtcggcggcgtacccgaactcccgggccaggatgcccagtccgccgcccagcgtgtaggagaccgcgcccaccgagggcgacgagccgttgagcgcggccagcccgtgcgggatcgccgcagcggtcaccgcgccccaggtcgcgcccgcgccgatccgtgcggtgcggcggaccgggtcgacggcgacggagtccagggcacgggtgacgaccaggacgccgccctcgaccgctccgggcagcccgtgcccggtggcgtgggcggtgaccgggagcccgcgcgcggctgcgtacgccacggcgtcccgtacgtcgtcgggggtggcggccccgaccagccggccgggccggatcgggaagccggtctggaagctggcgggtgcggatccggtgggctgggacgacatgggggaggctctccttcgctcgcgtttcggcggtgcgaggaagagcctccccgggatacctgacaacctctgtcaggtaatgatcgaacgggtaccgatcagctgaggatcacgtacggatcacttggcgacggccttgcggccgcgcatctcccggaacagcgagatgcccaccaccagggccgcgaccagcagcgacagcacgacctgctcgcgggcggcgtcgtcggtcagcatgtagaccaggacgaaggagatcatcgcgatcgtcgcccaggtgaggtacgggaagagccacatccgtacgaccagcttgccgggggtctcgcgcaggatgatgccgcgcatccgcagctgggtgaagcagatgaccagccacacgaagagcgcgaccgcgccggaggagttcagcaggaactggaacaccgtgtcgggccactggtagttgaagaacaccgccacgaagccgaagacgaccgaggacaggatcgccgcctgcggcacaccgcgcttgttgaccttggcgaaggccttcggcgcgtcgccccgctcgccgagcgagaacgccatccgggaggcggtgtagaggccggagttgaggcaggacagcacggccgtcagcacgatgaagtccatgacctggcccgcgtgcgggatcccgatcacgtcgagggcggcgacatagctgcccttctcgacgatcgacgggtcgttccacggcagcagcgtcagcacgacgaagatcgagccgaggtagaagacggcgatacgccagatcacgctgttggtggccttcgagacggcccgctgggggtccgacgactcacccgcggccagcgtcacgatctcgctgcccatgaacgagaagacgaccatcagcacaccggtcaggatcgcgccgggcccctcggggaagaacccgccgctgtccgtcagatgcgcgagacccgaccccgggttgtccgaccccggcaggaatccgaagaccgcgaggaagccgatgaccacgaacgcgccgatcgccacgaccttgatcccggcgaaccagaactcgaactcaccgtaactgcccaccgagaccaggttggtggcggtcagtacgaccatcacgatcagcgcccaggcccactggggcacccccgggatccagctctccaggatcttcgcgccggccgtggcctcgacggcgagcaccacgacccagaagaaccagtagagccagccgatggagaaaccggcccagcggccgagcgcctggtcggcgtaggcggagaaggaaccggagctcggccgggcggcggccatctcgccgagcatccgcatcacgaggacgaccatcaggccgaccatcgcgtacgacagcagaatcgccgggcccgcggccgcgatgcctgcgctggaacccacgaagagcccggcgccgatcacgccgccgatcgcgatcatcgaaaggtggcggttcttcagacctgcctgaagcccgcccgacgagtccggccggtccggctcgccgggctcctggcccggcttcgccagcgtcgtctgcgacgtcatggggggaatccttacgtttggtgcgtgagggtgtgccctgctccgccgtggggtggtgcgaagacaaggccacgcattcaagcccggaaagagacggaagcggaaccccctctttcggatcgtttgccggatcgttgcccgagtggtgttgaccacatcgaacaaggcgggaggccccgaccccgctgacggctaccccgcgacgttcgtgccacacttcgcaccatgcgcgtgtacctcggatccgaccatgccggctacgaactcaagaaccacctcgtcgagtggctcggcgcccacggccacgaggccgtcgactgcggcccccacatctacgacgcccaggacgactacccgccgttctgcctgcgcgccgccgagaagacggccgccgacccggacagcctcggcatcgtgatcggcggctccggcaacggcgagcagatcgccgccaacaaggtcaagggcgtccgcgccgcactggcctggagcgagcagaccgccgccctcggccgcgagcacaacgacg

SEQ ID NO: 3916 - DNA, 947 bp, Unknown
  Kingdom: Bacteria, Phylum: Actinobacteria, Class: Actinobacteria, Order: Streptomycetales, Family: Streptomycetaceae, Genus: Streptomyces
gtcgaaggagttggggcccgccgcgcccaactcccgtgccgcccaggccatcgccttcgcgcacggcgcgatcggcaagccgtacgtctggggcgcgacgggccccaactccttcgactgctcgggcctgacccaggcggcctggaaggcggccggcgtgagcctgccgcgcaccacctacacccagatcaacgccggagcccggatcccccgctctcaactggcccccggggacctggtgttcttctactccggaatcagccatgtcggcctctacatcggcggcggccggatgatccacgctccgcgccccggagcgccggtccgcatcgcacccgtcgatgaaatgcctttcgccggagcgacccgggtggcatagtccgccgcgccggtcccgatctcccgccgaaggaactcccgtatgacgatggcgaacgccgtccaggactacgcccgcgcgctcgcgctgcgctccccggcccactaccgggtgggcccgttcaccgtccggcacaacccgggctgggaactgaagtacgccaactacgccatccccgaccggggtgcggaacccacggcggacgacgtggcggcgctggtcgacgcgttcgggacgcatgaacggctgccacgcctggagttccttcccgcctgggcccccgccgtcgaaccggccctgctcgccgccggtttcaccgtggagaaccgcgcgccgctgctcgcctgcggccgcgaggacctccgggagccgaaaccggtcgacggcctccgtatcggcgcgccggtcaccgaggcggagttcaccgaggccgcccgcgtccagcaccagggtttcggcggcgagggcgagcccgagccgggaatgaccgactggctacgggcggcggccaccggcgacggggtcgccgcactggccgtcctcgacggagcgccggccggggccggcg

SEQ ID NO: 3917 - DNA, 1258 bp, Unknown
  Kingdom: Bacteria, Phylum: Actinobacteria, Class: Actinobacteria, Order: Streptomycetales, Family: Streptomycetaceae, Genus: Streptomyces
gtccgtgccggccggcacggggcgctgcccggccccgacggagcgggcgaaccagcgtcctgcggttcgtcggcgcgccgccgccttccccaccaccggcacggtcgacgtcctcggtcaccggctcggccacgtcgatgtgcgggagctgcgcgcccgcatcggccacgcctccacctcccagcacgtcccgcgtgcggaacacccccacccggcggtgcccgatcccgcaaacgagttcggcgtccacgtccgagcgccgggccggagtccggaccaagacacgcgttcattcggcaggcgggcacccgctcgcactcgctgcgacacccggttgcgaacgccaaccaggcacgagcccacccccgctcgatccgctccaacacccgcagacccggcagggggacggcagagcgcctcagggcgccagcaggggcagtccggccgtacgccacagatcacggaagcctcgctccggcccgtgctcttccgcctccgtacgccagacccgtaccgtcgccccgctcccggcgggtccgtccaggggagcccagcccggttcgccgtgggtggcgaactcgacccaggcgcgggccatgcgccgggagagttcctcgtctgccgcgccgggcgggccgccgacgaggaagtggagactctcctcgtggaggttgccgaacgcgaacgggatgtccgcgcagtgccaggcccgcacccgtccccccgcacggtcccggcggcggtcgaagcgggcgaggaagacccggccgcccgccagggcatgggcctcggcgaggcgggtgctgtactcggcgaacaggaggccggagcagagggacaggtagacatcgagaagcggcgcgtccggcaggcgctcgcggtgaccctcgacgagcgatgcgggaagcccgaagtcggcggcgaaggcggccagtcgctcctccgacgtgatcttcgcactgctgcctaccgcgtccaggagccagtactcctccgtggtgtggcagaccagcagctccaccgaaccgcccgctccggccgccagtgcctccagcgggtcggcggtcaggagaacgccgtcggcgaccggaccgtagatcgccgggtcgtagtggcgccggcccgatccggggtcctgtgcgtaccgctcgcacactcggtccgttgcggccacgaggacctcgggcggggcggcgagcagccccgcgcgaggtactcgtggccgcaacggaccgagtgtgcgagcggtacgcacagg

SEQ ID NO: 3918 - DNA, 617 bp, Unknown
  Kingdom: Bacteria, Phylum: Actinobacteria, Class: Actinobacteria, Order: Streptomycetales, Family: Streptomycetaceae, Genus: Streptomyces
agatcgcactcaccgtccgcgatccgctccacgaagccggtcagcggcgcggggtccagcgagccgtcgcagtcgcagaagcagacgaactcggcctcggcggcgagcagtccggcgtggcaggcagcgccgaacccgcgccgttcctccgtgacgacgagcgcgccgagggaacgggcgagctcggccgaaccgtcggtcgagccgttgtcgaccacgatcgcgcgccagccctcggggatgcgatcgagcacccagggcagtgcggccgcctcgtcgaggcaggggagaacgatgtcggccccggggagtccggtgtgcggggcgggcggaaacggaagcgcggcagaagaatcggtcacccgcatcaccctacggagacaactccggcattcaggacatcaggatcttacgaaacatggacatcggccgcctgcgggcggtcggctcccgacgtcccgggacgggggtgccacagtggaggccatggaagagaccccgcccgcccggcatccggcgcccgccccgcagggggcgcgcggccgggtcctcgtcgtggacgacgacccgaccgtcgccgaggtcgtcgtcggctatctgcaccgcgccggttacac

SEQ ID NO: 3919 - DNA, 1904 bp, Unknown
  Kingdom: Bacteria, Phylum: Actinobacteria, Class: Actinobacteria, Order: Streptomycetales, Family: Streptomycetaceae, Genus: Streptomyces
cgatgtggcggcggccctcgccgacatcctggacggtgggatcctcatccatgacgcggacggcgccgaactggcccgcgcccgcaccgagccactgccgcagccgatcccggcggtggccgcctcccgggccaggggccgggccgttcccctggatggcacctgggtctgcgccgtcctcgcgggccccgaactcctcggctccatcgcgctgaccggccgggcgggactcgcggacgccgaccggctcctgttcgagcgcgccagcgtcgtcaccgcgctgctcatgctgttgcgccgctcggtcgccgagacggaggaccgggtacggggtgagctgctgggcgacctgctctcgcgcaccggcgacccgggcaccctggcggcccgcgcacgccggctcggcgtcaacctgaaccgacggcacagcgtgttcgtcgcgcacagcgaggtggccccccgtcaccggctgctggccgcgaccgcccggagcgcacagtcccgcaacggcctggccgggctgcaccacgaccacatcgtcctggtggcgccgtccgacgcaccggggccggcggcccaggcgctcgccgccgagctgggccaggcggtcggcttccccgtcacggtcggctcggcgggccccgccaccggtccggccgagctgccgcacgcgcacagcgaggccgaccgctgtctctccgcgctgcgcgccctcggccacaccgggagcggcggggccgtcggcgacctcgggttcatcggcgtactgctgggcgaccaggcggacctgggaggctatgtgcaccggacgctgggacccgtactcgactacgacagccggcgcggcaccgacctcgtcaccacgctggacgcctatttcgcccagggggcgagcctcacccggaccaaggacctgctccacgtccacgtgaacacggtggtgcagcggctggagcgcatcggccggctcctcggccaggactggaacacgcctgcccgcaccctggagatccagctggctctgcggctccaccgcctgacgcagggcctgtgacgggaggactccccgacggcgggtggtctctcagtcgtccagacccgcccggacccggcgggagggctggaagacgtacaggtcgaggatgtccggggcgtccgcgagacccgggcctcccgccgccgcccaggtcacgatgtcctgctcggcgtgctggtcgccctgggcgcggccgtcgtcgcgggcatcctctacggcgtgatcgcgggctccatcgagcgcgaggtcggctacgcggcggtcggcgtcggcttcctggtcggcttcgcgtcgagcaagatcggcggctccaacccggcggtcatcggcgccgcggccgtcttctcgatcggcgccgtctacctcgggcagctcgtcggcatctcgatggtgctctccgacctggcgcagatccccttctccgaggtcatcggcgaccacttcggcaccgtgacggaggcctggtcgcaggaggccgacttcatgacctacctcttcctcgccctcggcgcgatcgccgccgtcggtggcgccaagaaggccggctgacacccgcagtaccccgcggaacacgcggaagggcccggaccgtcacggtccgggcccttccgtctgtgtacgggagatcagcggcggtgctgcgagtccgccaccgtcacctcgacgcgctggaactccttgaggtcgctgtagccggtggtggccatcgcgcgacgcagggcgccgaagatgttcatcgagccgtccggggtgtgcgaaggaccggtgaggacctcctccgtcgtcccgaccgaaccgaggtcgaccagcttgccgcgcggcacgtcctcgtggacggcctccatgccccagtgccggccgcggccgg

SEQ ID NO: 3920 - DNA, 2511 bp, Unknown
  Kingdom: Bacteria, Phylum: Actinobacteria, Class: Actinobacteria, Order: Streptomycetales, Family: Streptomycetaceae, Genus: Streptomyces
tgccgccgcggcggcacgcccggatcgggctctgctacctggacctggacggcttcaaggcgatcaacgacaccctggggcaccggaccggggaccggctgctggccgccgtcgccgcgcggctcaccgactgcgccgagagcgacgcctcccgcgactccggcggcagccggctggtggcgcgtctgggcggcgacgagttcgcgatcctggtcgaggactcggcgggcaccgaggaactcgccgagctggcccgctcggtcctcgccgcgctccagcagccgttcgacctcgccggacagcgactttcggtctccgcgtcgatcggggtggtcgaaagggcggcggcgggcacctcgcccaccggtctgatgcaggccgccgacaccacgctgtactgggcgaaggcggacggcaaggcccgctggaccctgttcgaccccgagcgcaacgcccaccgcatgacccggcagtccctctcctccaccctccggcccgccgtggaacgcggcgagttcacgctggagtaccagccgctggtcgggatggcggacggggtactgcgcggggtcgaggcgctggtgcgctggaaccatccgcagttcggcgtgctgccgccgaatcggttcgtccagatcgccgaggaggacggctcgatcgtccagctcggccggtgggtgctgcgcaccgcgtgccggcaggcgcggcgctggcagctggaccacccggacgagccgccgctgttcatcagcgtcaacgtcgccgtacggcaggtctgggactccgacctggtcgccgacgtggaccggatcctggccgagaccgggctggccccgggactgctccagctggagctgaccgagtcggcggtgatgggttcgggcggccgtccgctgcgggcgctccaggcgctgagcgacatgggcgtacggatcgccatcgacgacttcgggaccggctattcgaacctcgcctacctcagcaggctgcccgtctccgtgctgaagctggacggggccttcgtgaagggcttccggtacgaggacggtacgcctccgagccccgccgacgagaccatcgtggaggccatggtgcagctggcgcaccgcctgggcctgaccgtcaccgcggagtgcgtggagacggccggacaggcggagcggctgcggcggatcggctgcgacaccgggcaggggtggctgtactcccgggccgtggcgccggagcagatcgccgggctgatcgggtcccggccgctggagggctgacgcccccggccggccgggacccggagcggcgctacggggccgcgggcaggccgtacgcgtccgcgatcaggtcgtagctgcgcagccgcgcctcgccgccgtgcgcgttggcggtgatcatcagctcgtcggcccccgtccgcttggccaggtcgtcgaggccgccgcggacctcgtcggcggtgccgtggatcacgttggcgagccagccgtcgacgaactcccgctccatcggggagaagtcgtacgccgcggcctcctccgggctcgggatcagccccggacggccggtgcgcagccggaccatggacagggcgccggtcagcacctggcggcgagcctcgcgctcgtcgtcggcggccagcgccgacaccccgatcagggcgtacggagcgtccagcacggcggagggccggaaggactcgcggtacaggtcgagcgcggggatggtgttctgcgccgagaagtggtgcgcgaaggcgaacggcagccccagcgtcccggccagccgcgcgctgaagccggaggatcccagcagccagaccggcggccggtgcgcggactgcacgccgccgggggcggttgcctggaccgggcccggtacggcgtggatccgggcgtaggggtgtccgtcggggaagtcgtcgtccaggaagcggatcagctccatgagctgctgcgggaagtcgtcggccccttcgttgagccggtcgctgcgccgcagggccgccgccgtcgcgccgtcggttccgggggcccggccgaggccgaggtcgacccggcccggggccatcgcctccagggtgccgaactgctcggcgatcaccagcggcgcgtggttgggcagcatcactccgccggagccgagccggatgcgctcggtgtgggcggcgatgtgcgccaggatcacggccggggaggacgaggcgaccccgggcatggagtggtgctcggcgacccagaagcggtggaagccgcggctctcggtgagcttcgcgatgtccacgctggtgcgcagggcctgggtcgcggtgcggccctgccccacggtgaccagatcgaggacggacagcggaacggcggccgttccggctgcggcgccccggatcccgtcgccgtcggccgcgccgccgctcgcgtcaccactcgtgtcgctgcgggtctcgtcgcctcggatctcgtccacgtgtcggcctctcccggtgctgctgtcgtacggctgtgtatcggaggagtccaacag

SEQ ID NO: 3921 - DNA, 1835 bp, Unknown
  Kingdom: Bacteria, Phylum: Actinobacteria, Class: Actinobacteria, Order: Streptomycetales, Family: Streptomycetaceae, Genus: Streptomyces
accccttggcagagcttccgaaagccctcgcccccaccccggaccggcatccggtttccgggcgagggcaagcttcacccgcccagccgttacgctggacccgtggcagtcgtcgatatttccgaagagctgaagtccctctcctcgaccatggggtcgatcgaggccgtcctggacctggatgcgctgagggcggacatcgccgcgctcgaggagcaggctgcggcgccgtccctgtgggacgacccggaggcggcccagaagatcaccagcaagctttcccacctccaggccgaggtccgcaaggccgagaccctgcgcggccgcatcgacgacctcgaagtcctcttcgagctcgccgcggacgagggtgacgccgacgcccaggcggaggccgagaccgagctggagtcggtgaagaaggcgctggacgagatggaggtccgcacgctcctctccggcgagtacgacgcgcgcgaggccctggtgaccatccgggccgaggccggcggcgtcgacgccgccgacttcgcggagaagctccagcgcatgtacatccgctgggccgagcggcacaactacaagaccgaggtctacgagaccgcgtacgcggaagaggccggcatcaagtcgaccaccttcgccgtccaggtcccgtacgcctacggcacgctctcggtcgagcagggcacccaccgcctggtccgcatctcgcccttcgacaaccagggccgccgccagacgtccttcgcgggcgtcgaggtgctcccggtcgtcgagcagaccgaccacatcgagatcgacgagtccgagctgcgcgtggacgtgtaccgctcctcgggccccggcggacagggcgtcaacaccacggactccgcggtccggctgacccacctgccgaccggcatcgtcgtctcctgccagaacgagcgctcgcagatccagaacaaggcgtccgcgatgaacgtcctccaggcgaagctcctcgagcgccgccgccaggaggagcaggcgaagatgaacgcgctcaagggcgacggcggcaactcctggggcaaccagatgcgttcgtacgtcctgcacccgtaccagatggtcaaggacctgcgtacggagttcgagatgggcaaccccgaagcggtcttcaacggcgagatcgacggcttcgtcgaagcgggcatccgctggcgcaagcagagcgagaagtagcctcggcggtacggagattgggcccggacaggcgactgtccgggccttttcgcgtcggtgccggggtcggcgggagcggggggaacccgtgctcgatgcgtcacagtcgtgcttccgaatagccgtcaagaacccccataccggtgtctagtgcacggaacggccttgacgtaatccttaactctggccagggtgctagagcagcatgcgtatgtctgggacgggtgcgaaccggggggctggcggggtgaccacgacacgacgtggccttgccgagagcgattccccgcagggccgtggcccgcatatggctgctccaatgacgagatcggctactgggggtagcaacacatgacgaagaagacgcgtatccgcgtcgcgcggatcgccgctggtgcggttatcgccgcgggtgcctcgctgaccgcggccggtgcggcgcaggcgctgaacggtccggacgagacccagatcaccacccagaacgagaccgaggacggtctcatcggtggcctcatcgagggcaccaccgagggcggcgacccgggcggcgtcgacgcgggcgccgacggcggtgctgctgacggcggtgccgacggtggtgctgatggtggtgctgacggcgg

SEQ ID NO: 3922 - DNA, 2775 bp, Unknown
  Kingdom: Bacteria, Phylum: Actinobacteria, Class: Actinobacteria, Order: Streptomycetales, Family: Streptomycetaceae, Genus: Streptomyces
gcgtcgccgcggccgccgagttcgccgggctggcccccgagggcgccacccccgcgcagaccgcgctgcgctggatcatccagcagccgggcgtgaccagcgtgatccccggcggggtggcgccctcgggggccagctcggcgaactcggcggccgcggcgacgccggtcgcgtagtcgatgccggagaacgtctcgccccggtcgaacgcctcgccgtgccggttgtacgtgcggtggtccttggggccgaagaccgtgtccttggtgtacctgccggagagcaggcccgaggcgagcggcacccgggcgatgatgccgacgcccgccgccgcggcggccgggaggacctcgtccagcggtttgaggcggaacgggttgaggatgatctgcacgctcgcgacgccgggtcgcgcgatggcggtcagcgcctcggcgcaggtctcgacgctcaccgcgtaggcggcgatccgctgctcggcgaccagggtgtccagggcgtcgtagacggcgtcggaggagtagacgccgctgggcgggcagtgcagttgtacgaggtcgagcgtgtcggtcccgaggttcgcgcgggaacggtcgttccaggtgcggaaattgtccaggacgtagttctcctcgacctggtccgcgcggcggcccatcttggtggcgacgagaacgccggcgtcggggcggtccttgaggtagcgcccgatgagctgttcgctgcggccgtccccgtacacgtccgcggtgtcgaagaaggtgacgccggattcgacggccgcgtcgagaaccccgaacgcgtcgtcctccgcgacctctccccagtcacccccgagctgccaggtgccctgtccgacgaccgagacgtcacggccggtcctgccgagtgtgcgctgttccatgaggatcatgctattccgcttctcgcgtcgggggtggacggcggcaggagcacctctgccgccgtccacgtttcggagccgccccggtgcgggcgggcggtcagtcgccggtcgtcacgcggacgtagtcgatgaccatctgctgggggaactgcgtgctgccgtcggggtcgccgggccagtagccgccgaccgcgaggttcaggatgaggaagaaggacttgttgaacacccactggtttccgcccagatcggccggggtgcgccgctggaagacctggccgtcgacggaccaggtgatggagtcgggtgcccagtcgacggcgaaggtgtggaagtcgtcggcgaacgcctgcccgttcggcagcgtgtacgcggctccgatgccaccggagccggagtacccgggcccgtgcagggtgccgtggacggtgccgggttcgaagccgacgttctccatcacgtcgatctcgccgctgttcggccagccgacgttgccgatgtcgtcgccgagcatccagaacgcgggccagatgccctggccgcgcgggatcttgatgcgcgcctcgacgtggccgtaggcggcggagaacctgccggaggtgttgagccgggacgaggtgtactcgcaggtcccgtaccagcactggtagttgcccgggttctccttccgggcggtgatcaccaggttgccccggccgtcgagcgccgcgttgtcgttgcccggggtgtagtactgccgctcgtggttgttgacgttgtcgccggtctcgatctgccacttgccgccgtccacggcggcgccggccggtccgtcgaactggtcctcgaaggcgacggcccgcgccccgggcgcgggggccggggacccggcggcgggcgcggcggacgctccgccggggagtgcggtcaggatggcggaacagcagagcagcgaggccgcgtagagagcgacgcggcggcgccgggagacgctgcgcgccgtggagtgcgtggggtgcacggtcatcacatcacttcgcgtgggggcatgtgcatgacaggtcgacgccgagaggtgaacggtgggggcgatcacctcgagcgcatatttcaatacttgatttaagggagtgccgcaggagccgtcaagaacctggtccggaccggagaggtaacggcatgccccaggggcatatacgcctgaaggcagtggcctcatcgtgcgattcgtccccggcagccgcagagtggagacacggaccggcgagacgggccggggccacgaagggagcacgacgtggagaacgacggcacaccgcggccccacttcgtcgtgcagatccatgacgcgcggcgcctgcacttcgatttccggctggaggtggacggcgtactgaaatcctgggcggtaccgcgcgggccctcggagaaccccagcgaccgacggctcgccgtgccgacggaggatcacgccctggagtaccgcgagttcgagggagtcatcccccgaggcgagtccggcagcggcacggtcatcgtctgggaccagggcacctaccggccgctcgggcacgacgggcagggtgactccgtccccttctccgagtccctggcgctcggccatgcgacgttctggctgtacgggtcgaagctgcacggcgagttcgcgctgacccgcatccagaagggcgacgagccggacagcggcggccacgaggcgtggctgctgatcaaggccaacgaccgtctcgccgttcgcgacagacccggttcccccgacccgtaccacgccaggtcagcccgtacgggacggacactgcaccaggtcgccgcggcggcgtcccgggggcccggggactgaccgcacacccccgggcgggctcgcgcgc

SEQ ID NO: 3923 - DNA, 2214 bp, Unknown
  Kingdom: Bacteria, Phylum: Actinobacteria, Class: Actinobacteria, Order: Streptomycetales, Family: Streptomycetaceae, Genus: Streptomyces
ggatacgaccggccggtccggctcggcgcggccggcggcctcgggactccggaggcggtggccgccgccttcgccctcggcgcgtcctacgtggtcgtcgggtcggtgaaccagacggccgtcgaggcgggcctgtccgacgaggccaaggcgatgctctgcgacgcggacgtctccgatgtggccatggcgccggcggccgacatgttcgagctcggtgtgaagctccaggtgctctcccgggggacgatgttcgccccccgggcggcccggctccacgcggcgtaccgggcccacggttcgctggaggagatcccgtccccgctgcggacctcgatcgagcgcgatgtgctgcgcgccccgttcgacgaggtctggcagcggacgcgcgccttctgggagcagcgcgatcccgccgagatcacccgggcggaggccgatcccaagcaccgtatggctctcgtcttccgctggtacctgggcagttccagccggtgggcgatcaccggggagggatcgcggcgggccgactaccagatctggtgcgggcccgcgatgggtgccttcaaccagtgggtggccggcacgttcctggccgacccggcacaccggtccgtggtgcagatcgcgctcaatctgctcgaaggggctgccgtgctcactcgcgcccatcaactgcgcacgtacggcctggcgttgccggccgaggcgttcacccacccgccgtgcgagctggcgtgagcggccccgacgccgccgaggcgtcagcgacgaacacccgacttcgaggagacaccgtgtccggctccaccccccgccaggtccccatcgccgtggtcggcgtgggcgccctggtccccggcgcgaccgacgcggccggctactggcggaacgtgacgggcggccgcgacctgatcaccgatgtgcccgccgcccgctggcgtgtggaggaccactacgacccggacccggccgcccccgacaagacgtacgcccgtcggggcgccttcctctccgaggtggacttcgacccgatggcctacggggtgcctcccgccagcctgtcgtcgacggacacctcccagctgctcgccctgatggtcgccgaccaggtgctggcggatgccggcggtctgtccggggtggaccgggaccggaccggtgtcgtcctcggcgcggcctccctcgaactgcttccgcacatgtacgggcgcacccagcgtcccgtgtggctggcggcgctccgggagagcggcctcgacgaggcggaggcgcggaccgtgtgcgaccgcatctcggctcgtttcgcgccgtggcgggagtcgtccttccccgggctgctcggcaacgtcgtcgcgggccggatcgccaaccggttcgatctgcacggcatcaaccacaccaccgacgccgcctgtgccagctccctggcggccttgtcgacggcggtgggtgagctgtccctcggccgcgccgacctggtgatcagcggtggcgtggacaccgggaacgacatcggcatgttcctgtgtttttccaagacgcccgcgctgtcccccagcggtgactgccggccgttctcggacgcggccgacggcaccatgctcggcgaagcggtcgtcatgtacgcgctgaagcggttgtccgacgcggagcgggacggtgaccggatccacgccgtgatccggggcgtcggcacctcgtccgacggcaggagcacagcgatctacgccccgctgcccgacggccaggcgcgggccctgcgacgcgcctacgagcaggctggctacggaccggagaccgtggagctggtcgaggcgcacgggaccggcacgaaggccggggacaccgccgaactggccgcgctcggcgaggtgttcgggtcctcgggccggaccgacggacaatggtgtgcgatcggctcggtcaagtcgcagatcggccacaccaagtgcgcggcgggagcggcggggctcctcaaggcggtcatggccctgcaccacaaggtcctgccgccgacggtcaaggtcgaacggccgaatccagcggccgccgccccgcacggcccgttctacgtcaacacggaggcccgcccgtgggtacgggccggtcatccccgccgggcggcggtgtcgagtttcggcttcggcggcagcaacttccacgtcacgctggaggagtacgcgccgtccggggcgggccgcgcggcccgcc

SEQ ID NO: 3924 - DNA, 3433 bp, Unknown
  Kingdom: Bacteria, Phylum: Actinobacteria, Class: Actinobacteria, Order: Streptomycetales, Family: Streptomycetaceae, Genus: Streptomyces
tcgtcggggagggggtggtgttcatgcgccgcacgctagggggcccggatgagagcccgcttaacgccggggccgcgcggggtcccggacggcgctcagcgcccggtgcgggcccgccattccggagcgaggacggaccagatctcggagtcgtggcggacgccccggtggaggtagttctgccgcatcaccccgtcccgggtcatgccgagccgctgcgccaccgcgatcgacctggtgttcgcggcggaggcgatccactcgacgcggtgcatgccgcgctcgtgcaccgcccagtcgatcaggcgctcggcggcgcgggtgatcaggccgcggccctgagcggcgggctccagccagacgccgatctcgcaggtgccggactccgcgtcgaagacccggaagaggacgccgccgacgaggacgccgtccagccggatgccgtacagccgaccggtgtccgccgcctgcttctccgcgtaccgctggagcagggcgcgcgccgagtccacgtcggtgacgaacgaggcgagcgggatccaggagtcgaccagctccctggcccggtccatgtgggcgaggaactcctcggcctgccaggcctccagcggacgcagctccgccctgtcgtcacccagggatacggcgaacatcgtgctccttctcggcgggccggaccatcaccggtacggcaccctcttcggcacccgtaccgcgtgcctccgggatcttcgcacggagcggtacgcagtcgggcggctcgatgctgatccggggcagccacctctccagccgggccggcagccaccagttcgccccgccgagcatgtgcatcagggcgggcacgagcagggtgcgcaggacgaacgcgtccagggcgacggcggtggccagcgcgatgccgaacatggcgatgacccggtcgccgctgagcacgaaggcgaggaagacggagatcatgatcacggctgcggagttgatgacccggccggtctcggcgaggccgacccgtacggcccgccggttgtcgccggtctccagccactcctcgtacatgcggccgaccaggaagacctggtagtccatggagaggccgaagaggaccgagaccatgatcacggggagaaagggttcgatgggtccggcgctgccgaggccgagcagctcgctcccccagccccactggaagacggccacgacgacgccgaaggaggaggcgacggcggccacgttcatgacggcggccttgagcgggatgccgatggagcggaaggccaggaggaggagcaggcagccgagtccgatgacgaccccgacgaagagcggcagcttcccgacgatgatctcggcgaagtcgtcgtagctcgccgtcaccccgccgacgtgggcctccagtgaggtgccgtcctggaccggcggcagcacgtcgccccggatccggtcgaccagctcgctggtgtcctgcgactggggggacgagtcggggacgacggtgaggaaggcggtgtcgccggcgttgttgtacgtgaccggaccgacggacgcgacgccctcggtggtacgcagcttctccggcagcgagtccagggcgagccggtcgtccgcgccgtcgagctgggcggcgatggtgagggggccgttgaccccgggcccgaagccgtcggcgatcaggtcgtaggcctgccgggtggtggcggtggccgggttgttgccctggtcggaggtgcccaggtggaggccgagggcgggcagcgccaggaccaccatgaccacggccgcgatggcgccgagaagcttggggtgccgctccacgaaggcggaccagcgggcggcgaagccggtgggcagttcgggccgcggtccgtgttcggcgagctgtcgccgctcgcggcggctgagcgcccgcatcccgatgcgggagagcagcgcgggcagcagggtgacggaggccagcacggtgaggacgacggtgagcgaggcggcgatggcgacgccgttgaggaagctcagccgcaggatcagcatgccgaggagcgcgatgcagacggtggccccggcgaagacgacggcgcgcccggtggtcgtgacggcgttctccgcggcttcgtcgaccgacatgccgcgccgcagccctctgcggtgccgggtcacgatgaacagggcgtagtcgatgcccacgccgagtccgatgagcatgccgagcatcggagcgaagtcggccacggtcatcagatggccgagcagcacgatgcccgcgtaggcggtgcccacggagaccagggcggtggcgatgggcagcaggctggcggcgagcgagccgaaggcgaggaagagcacgacggccgcgacgacgacgccgatgccctcggcgaggtggacggagggcgcttcggtgagggcgacggcggtgccgcccagttcgacctggaggccgtccgcctcggcggccttcgcggtgtcgacgagggcctgggcccgggagacggggatctcgtcggcgggacggtcgaaggtgaccgtggcgtacgcggtgtggccgtcctcgctgatctggccgggtccggtacctccgtaggggccggtgaccatgccgacgcccggcagctcctcgatcgcgtggagcgtccgggtcatggtctgctcgacgtcggcggcccggaccgtggagccggtggtgtgccagacgacggtgtcggtgtcgccgccgaggtcggtgaagccgcgggagaggagttcggtggcccggccggattcggtgccggggacctcgtagtcgttggagtacgccgaacccgcgaagcctgccgcggcggcggtcccgccgagggcggcgagccagatgaggacggcgacgaggcggtgcctgatgcaccagcgggcgatggcagccaacggatgagctccctgcgggttcgtggacctttacccgcagataacgtgatctgcccgcaaacgtctcatgacctgagaccgtcactctgtcagcagaacgtgatcctttgtccgtttcgtggccatggtcacagggcttgatctgttccctacacggaacggatcaagccctgcggccctccgtccgggtcagccggagacgctggcgcggccgttctcgatgtgtcccatgagccgccgccggaagccggactccccgtcgacggtgacggcgaggtcgtaccagccgtgcgcgtcggccgccgagtgcacgagcgcccggctgcggcccggcttgaccgtgacgcgccgggtccagtcccgtacgtcgtcctcgtcgacgtagccgagcggccgtaccaggaaggtcagggtccggcggccggtgttgcgcagggtgaggtgcaggtcgcggtcgcggtggtcgatgcgggtggcgacctccgctcccccgtcggccggtccggcgaactcgcgccggaagccgttcggtccggtgacc

SEQ ID NO: 3925 - DNA, 1287 bp, Unknown
  Kingdom: Bacteria, Phylum: Actinobacteria, Class: Actinobacteria, Order: Streptomycetales, Family: Streptomycetaceae, Genus: Streptomyces
  misc_feature (174)..(175): n is a, c, g, or t
  misc_feature (797)..(798): n is a, c, g, or t
cgtgcggccacgctgcttggcgtccaggacgaccttgcggatgcgcacggtctccggggtcacctcgatgcactcgtcctcgcggcagaactccagggactgctccagcgacagcttgcgggccgggaccacgttctccgtggtgtccgcggaggccgcacgcatgttggtganncgccgacgatcatgccctcgtagacctcggtgccggcctcggtgaagatgacaccgcgctcctggaggttgaccatcgcgaacggcgtgacggagcccgaacggtcggccaccagcgagccgttgtgacgggtgcgcagctcgccgaaccacggctcgtggccctcgaagatcgagtgcgcgatgccggtgccgcgggtctgcgtcaggaactccgtacggaagccgatgaggccgcgggagggcacgatccactccatgcggacccagcccgaaccgtggttcgtcatggtctccatacggcccttgcgggtcgccatgagctgcgtgatggcgccgaggtgctcctccggcgagtcgatcgtcatgcgctcgatcggctcgtgggtcttgccgttgatctgcttggtgacgacctcgggcttgccgacggtcagctcgaagccctcgcggcgcatctgctcgaccaggatggcgagcgcgagctccccgcggccctggacctcccaggcgtcggggcgctcggtgtccaggacgcggagcgagacgttaccgatcagctcgcggtcgaggcggtccttcacctggcgggcggtgaccttgtggcccttgccgcccttgcnngctcgtcgaccgtgatcagcgggagcgcgatcgggttctcggggtcggccaaagtctcgccgatcatgatgtccgggaatccggcgacggcgcagatgtcacccgggcccgccacctcggccggcttgcgggtgagcgcctcggtcatcatcagctcggtgatgcggacgttggacatggtgccgtcacgcttgatccaggtgacggtctggcccttgcgcagctcgccctgctcgacgcggcagagagcgatacggccgaggaagttgtcggcgtccaggttggtgacgtgggcctggagcggcgcttccgcgtcgaactcgggggccgggacgtgcgacaggatggtgttgaagaacggctccaggttctcgctgtccggcgggacggtgccgtcctcgggcttggtcagcgaggcgacgccgtcacgggcgcaggcgtagacgatcgggaactcgatctggtcctcgtccgcgtccaggtccagga

SEQ ID NO: 3926 - DNA, 891 bp, Unknown
  Kingdom: Bacteria, Phylum: Actinobacteria, Class: Actinobacteria, Order: Streptomycetales, Family: Streptomycetaceae, Genus: Streptomyces
gtcggtggggtcccagcgcagtccgcccggaccgccgcgttcgcctccgcccttgcctcccgggcctgagccgttcccgccgggacggccgccgaagccgccgttgccccggccgggctgcttgttgctccactggctgccccacgacgggcggtccccggacgagccgttcccgtccgacccgtccgacccctcggacccgtcggacccggcggggcggcgcggctgccacggctggtccggacggtccgcgggcggcgcggcgaacgggttgtcctcctgtggcttcccggcggagccggagaccggtgcggatcccgaggaggaatccggcgatgagggaccgggggacgaggattccggagacggggaatccggggaggaaggacccgacgaggagggacccggggacgaggagcccggcgaggaggagtccggcgaagaggactggcgttcccgcatcagcggagcggaccgctcgggcggggggaggcggaaggcggtgcgacggcgtcggtccggcatgtggtgaacgtcttccccatctcgtcatgtccgcccgtaggacggttcgtccgcccggtggacggctcgctgtcccctgacgctacctcccggtcacgcccccgtcccgtgggggccgtcgggtgtgccggtatcgttgctgacggtcggcccgttcgtagggttccccgtatcgggcgaagcgatactttcgtacgaccctacaaagagcatgccgcacctgcgtcatcatgcggtcatcacgtgagaaagggccccgacgtggcctccccgcccccttccgccactcctgcccggctggtcgtgctggtctccggatccggtacgaatctccaggcgctgctcgacgccatcggcgacgacccg

SEQ ID NO: 3927 - DNA, 2510 bp, Unknown
  Kingdom: Bacteria, Phylum: Actinobacteria, Class: Actinobacteria, Order: Streptomycetales, Family: Streptomycetaceae, Genus: Streptomyces
gttcgtccaggaccagcagctccggggtgccgaggagggcgacggccagcgagacgcggctgcgctgtccgccggagagcgccccggcgagggcgtcggcgtggctggtgaggtcgacgtccccgatggcgcgggtgacggcgtcgcggcgggcgtcccggtgggcgcggccggggcgcaggacggcggcgaagtaatcgaggttctgccggacggtgaggtcggtgtagacggagggcgcctgggtgacgtacccgatgcgggggcgcagggccgggtctccggcggggtggcccaggacgtcgagggtgccggtggccttggcctgggtgccgaccacggtgcgcatgagggtggtcttgccgcagcccgaggggccgaggaggccggtgatgctgccggggcggacggtgaagtcgagggcgcgcaggacggtgcggtcgccgcggacgacggtgaggccgcaggcttcgatcgccgggggtggcgggtgcgtcgggggttcgggcggcgttgccctggattcgtaattcatcatgtgatgaattcttcgcccgacagtgccgcccgtaaaggggtggggacgcggacgaaacgacgcggcggcccgccgacgggtgtcggcgggccgccgcggcgtctctcgggcgggccggtctcagccgcgcttcgggcgcttgcggccgggggtcctgcggactgccggattgccggtgcgggtcgagcggcgcttctcgaaccggacgcgggccgtctcgtactcggtgcggcgcagcttttcgcccggggcctcggtgagcgagcggacgaagtaggcgaggagcgagccgatgaagccgatcgccttcagtccgcgcagggagtcctcgcgggccgggtcctccgggcgggcggcgaaaccctcccaggtcttgcggaacgcgatggcgctgcagatggagaacatcgcgatgacgagaatcccgacgaagctcccgacctccgcgatctccagcccctcgtaggcgaagcgcaggaggaaacaggcggccacggcggcggccagcgagccgacggcggcgccgacgcgccggaggccgtaaccgccgtcgtggtcgacccacgtggtgccgaagaagcggatgggctcgggctgcgggcccggggccgtggcgggcggggtgccgggggctgcgctgttctcgctcacggggtcgattatccccgttgcccccggacacccgggtccaatacctgtcgttcggaccgtgccgggttcgcggggtccggcaccctgatccgacctgatccgaacgaaagtccctcgccgtcagtcgcagcgcggtgcgatgtagccgtcacgccccgtgtagacgtagacgtccgcgacgaactggccgttggcgatgttgtcccagaggttcgacgtgccgtacgggccggtgacccactcccccggcttctggcagtagatcgggatcttctgtccgtacggcagggtcctgacgatgcggtagctggtgcccggtccggtgcggacgttgacccggtggcccggagcgatcggatagcgggtgccggtcgccgcggcttccgccgtggccgtcaccccttcgatcccgtccaccgcgtccgccgggtcctgggtgtgctccgcggtgtgctcttcaacgcccatgtgggcctcccccgttgagaaaacgcgtacgcgggacgcgtacgacgcgcaggctagcaagccccgtgcctctcgcacgcaccatcgactaggctccgtgcgtcgcatgcgcacgaacacacgggggtgggcgatgccgccgctgcgagagcccggaacgcatccggaagcggagtttccgcagtacgccggcacctaccgtcttgaggcctgtctcggctcgggcggcatgggtgtcgtgcatctggcgcgctcggcctcggggatgcaactcgcggtgaaggtggtgcacgcgccgtacgcggcggatcccgagttcagggcgcggttccggcaggaagtggcggccgcgcggcgggtgagcggggcgttcacggctcccgtcgtcgacgccgacccggaggccggacggccctggatggccaccctgtacattcccgggcccacgctcgccgagcaggtgaagcggagcggcccgatggcccccgccgagctgcgcaggctgaccgccgggctggccgaggcgctgcgggacatccatcgggcgggcgtgatccaccgcgatctgaagccgagcaacgtgctgctgaccgacggtggtcccaaggtcatcgacttcgggatctcccggccgtacgacagtgatctgcgcaccgagacgggcaagctgatcggctcgccgccctatatggctcccgagcagttccaacggccgcgcgaggtcgggccgccggccgacgtgttcgcgctgggggccgtgatcgtgcacgcggcgacgggccggggtccgttcgactcggacagcccgtacatcgtggcgtaccaggtggtgcacgaccagccggacctcggc

SEQ ID NO: 3928 - DNA, 1497 bp, Unknown
  Kingdom: Bacteria, Phylum: Actinobacteria, Class: Actinobacteria, Order: Streptomycetales, Family: Streptomycetaceae, Genus: Streptomyces
cgacgatgtgaccggccgtcgtcagcgcggtcgagggatcgtcgacgaactgggcgatcccgaaatcgccgatcttcaccgaaccgtccgcgtccagcatcaggttgcccggcttgatgtcgcggtggacgatgccctggcggtgcgcggcggccagcccggcggctgcctggcccgcgatcagtgcgacctgttcgggatggacccgctcctgggcggccagcaggtctccgaggctctgtccctcgaccagctccatcaccaggaagaaccggtcctcccaggccccgaagtcgaacacggccaccaggtgcggatggctcaaccgggcggcggtctgcgcctccagccggaagcgagcggtcgacgaggcatccgcctggtcccccagcagcagcttcacggccacggcgcgtcccagcacctcgtccgtggcgcgccacacctcgcccatgccgccacgaccgatgggggataccaatcggtaccgaccagctaccagcacctgtacacctatctcgcattgtggcccgctccggctgccggcccccgtggttcccggtctccggcggagtcctgggcggagcggcgaacgacatgatcaggatatcggtccggcggagccctgacgccccgacggccctttcgccgggccctgctgacggcccggtacgcctccgcgcccgcccgggcgccgcgagataccgccggacccgggtcaggcgagcagccgacggtacgcggcgtcggccgtgaacgcggactgcccgtccctgaaaagcagttcggcggtcccgaacgccgggtcggacgccgtctccggcacataggggacggcgaagcaccgcatgcccgccgcgtgcgcggccgccgctcccggcggggcgtcctccagcaccacgcagtccgccggctccgcccccatccgccgggccgcctctaggaacacgtccggctccggcttgccgtgcgcgacctcctcggcggagacgtacagcgggatgtacgcgtcgagcccggtcaccgcgagcaccgcgccgatcgcggcccgggacgaccccgaggccaccgccatcggcaccccggccgcgtacaggcgctccacgaagacccgcatctgcgggaagacctccgtcgacgccccggcgagctccagatacagggcgttcttcccggcgagcagctcctcgaccggggcgtcgatcccgtactccgcgcgcaggacggtcagcgtctcccgggtgccgatgccgatgaaccgggtgtgggcctcccagtcgaagtcccgcaccccgtaccgggcgaggagccgacgccccgcttcgtagtagttcggctcgctgtccaccagcgtcccgtcgagatcgaagatcacgtgggggccgggcgcggtcacggggcgggaagtcatggccccagcatgccgcagcccgcagcggcggacccggtcacccccgaccgggtgcggaccccggccggtcccggtcggccgccgcc

SEQ ID NO: 3929 - DNA, 1486 bp, Unknown
  Kingdom: Bacteria, Phylum: Actinobacteria, Class: Actinobacteria, Order: Streptomycetales, Family: Streptomycetaceae, Genus: Streptomyces
ggccgctgggggaggcggcggagaagggctgacgcgggggccggatcgcccggcccgccccgggctcgccacccggtcgcacgcgccgggaaaacggctggctcgctccgcccgcactccgcagagtgaccgtatgacgccgcccgatcctgatcccgcgttcctgcccggactcgacctgtcccggatcctctacgaggaggccgtgcggcccgtgctcgacgcggagtaccccggactgcggtacgccgccgcccggatcggctccggctccgaggtgctcggcttcgacaccgcccggtcggcggaccacgaatggggcccgcgcctggacctgttcctggagccggccgacgccgccgcgcacggggagcggctgcaccggctgctcgccgagcggctgcccaagcaggtgcgcggctggccgacgcacttccggcacgccgaccctgccgacccggtggggcacatggagccgacggacggcccggtccaccaccgcgtcctcgtcgccgacgtcggcgggtggctgcatgatcggctcggcctccgccccggtcccggtggggagtcccccgaaccgacggtccgcgactggctggccatgccgcagcagaagctggcggaggccacgggcggcgcggtgttccacgacggcgtcggcacgctgaccagggcgcggcaggagctgcactggtacccggacgaggtgtggtgctatctgctggcctgccagtggcagcggatctcccaggaggaggcgttcgtcgggcgctgcgccgaggtgggggacgagctggggtccgccgtggtcgcggggcggctcgtgcgtgacctgatgcgcctgtgcctgctcctcgcgcgggagtacgcgccgtacggcaagtggctggggagcgccttcgcccggctgcccggggccgacgaactgctgcccgtcctgcggggggccgtcacggccatggaccacccggcgcgcgaacggcacctctgcgacgcgtacgaggccgtggccgcgttgcagaaccgctcgggcctcacggaggccgtggaccccgggcggcggccgtaccacagccgcccgttccaggtgctgcacgccgagcgcttcgcccaggccctggcccggagtatcaccgacccggaactgcgggtcctgccgctgaccgggagcgtggaccagtgggcggacagcacggacttcctcgggcggcagggggccgtgcgggccgcggtcgacgcgctcggctgacgccctcgcggcacgggccgtcggccgtcggtcacctggcgacgaggacgacgagaccgatgaccacggcgacgacgagtacgccgatcaccggcgcgaaccagggcccgtacaggaagtcggagaagctggacgacaggatcggcttctcctgctccggacctgccggtacgggcgacggatgcgcggagggattcggcgctggtgcggtccggggcggtggggcggtggccg

SEQ ID NO: 3930 - DNA, 3784 bp, Unknown
  Kingdom: Bacteria, Phylum: Actinobacteria, Class: Actinobacteria, Order: Streptomycetales, Family: Streptomycetaceae, Genus: Streptomyces
  misc_feature (3624)..(3652): n is a, c, g, or t
ggctgcccgccggacaccccgccgatgttcaccccgctgcggctgcgcggcctcgaactgcgcaaccgtgtcgtcgtctcgcccatggacatgtacacggccgtcgacgggatacccgccgacttccacctcgtccacctcggggcccgcgccctcggcggcgccggactcaccatgaccgagatggtctgcgtcagtcccgagggccgcatcaccccgggctgcaccggcctgtggaacgacgaacaggccgccgcctggcggcggatcaccgacttcgtccacacctccgcccccgccgccgccatcggcgtgcagctcggccactccggccgcaagggctccacgaagcggatgtgggaaggcatcgaccagcccctggagagcggcaactggccgctgacggccgcctccccgctcccgtacgagcccggcgtcagccaggtcccggcggagctggaccggaccggactggacgccgtgcgcgagcagttcgtggcggccgcccggcgcgccgccgactccggcttcgacctcctcgaactccactgcgcccacggatacctgctctccgggtttctctccccgctcaccaaccgccgcaccgacgcctacggcggagcaccggccgggcggctccgcttccccctcgaagtcttcgacgccgtacgcgaagtctggccgcgggaacggccgatgaccgtgcggatctccgccaccgactgggccgagggcggcaccgacgccgaggacgccgtcacgatcgcccgcgccttcgccgagcacggagccgacgccatcgacgtctccaccggccaggtcgtggccgaggagcgccccgaatacggccgttcctaccagaccccgtacgccgaccggatccgcaacaccgtcgacgtccccgtcatcgcggtcggcgcgatctcctcctgggacgacgtcaactccctgcttctggcgggccgcaccgatctctgcgccctggcccgcccccatctgtacgacccgcactggaccctgcacgcggcggccgaacagggttataccggccccggcgctccctggccgcttccgtacggcgccggcagccgccccccgcccaccggccgcaccgacggaccgaagccccggctcacgctgggctgaggcagtcgtggcagcggcacgggacggggtgcggcaccccgccccagtgctcctcgcggtaccgcgcggccaggcgcccgagcagggcggccagttcctcggcgcgctcccgcgtggcccacgacccgtcgacgcccaccgccgccgcgcggcgcagtaccgccgggctgtacaccgggacgggccggaacgtgtggagattacgggtcgccatgtcgacggtgatgtacgcgccggtgtgccggccgcgcccgacggtggtcaactgctcgtgccccatgcccggataggtgtcgacgacgtgcaccttcgacccgccccggtacgacttggtccccggtcgcagctcctgcccgccgtcgccgtaccgccgccaccgcaccacgttcgcggcgacgagccacagcggctccgcagccacgggatccgcagtgacgggctccccgtccacgggctgctccgtcacgggctcctccgcaacagcagccggtccgccaccggttcgtaaccgatgcgcagatacacgccgttgctcgtcgggttggcgaggtcggcgaacagcacgacctccgacgcccccgactcccgggcggtgcggccggcctcgtccgtcacggcggccgcgtacccccggccgcgaagctccggcggggtgtacaccaacgtcacccgcaccgtccccgccagcatcagggagcgccccgcgagagccaccggagcgccgccgctctcccagagggtgagcgctccgcgttccgtgccctcgtccaccagccactcggccgaggacttcgactgtccggtcgcgtcggcgaagccgcgcacccactccacgagcaccgcccggtccgcaggtgtcgccgccctggcgcggccctccggtgcgggggagggcggccgcggcgggcccagccggtacagccggtgctcctgctcggtccggtaaccgggcagccgggtggccagcagcgccgcggtgtcccggtccgcgtcgacggcgtccagatccgggcccgctcccagggcgtcggccagcggacccaccgcctccgccggcacggcgttcagcagcgccggatgcggcggagtgcgcaccagggtccccgccaccgtgccgtccgccccgcgccaccagccgaacaccggatcgcccccgccgtagtggtgcgggcccgcacgcctcagccgctcggtgaccgtcagcgccaccgtgtgctccacgggccgcgcggcgagcgacgcgccggccgcggcgaggaacgtgccggtgtcgtctccgaaggtccaggtcatgcctcatcctgcccgtgggccggggccggggcatctggatttcacccccgcggggagtcacggccgtacgtaccgttccccggcgtcccgcagccgctcgtgcagcctgccgaacacctccgccgaccggccgcccggccagtcaccgggcagcagctccgacggcagacccgggtccgcgtaagggagttgacgccacgagtccagtgccagcagatagtcccggtaggcggtctgcgggcggggtgcgtcgtcggtctccccggacgtctcccagtcccgcagcaccggctcgtgcagttccaggaactcgtggtgcaggcgcgccaccgccgccaggtcccaccagcgggccaccgcctcgcgggtcgtcaacgggggcgacggagtccgcaagccgctcgtggacaaggtgctcgaagcggtcgacgagctgggctacatcccgaaccacgcggccaggaccctggtgacccggcggacgggagcggtggccgtcgtcatcgcggagccggagatacggatcttctccgaccccttcttctcccagcagatccgcggcatcagcaaggagctgaccgcccacgacacccagctcgtcctgctgctggtggaggggcccggcgacttcgaccggatcgcgcggtatctgtccggcggacacgtcgacggagcgctggcgttctcgctgcacaccgacgacccgctgcccgcgatcacccggcgggcggggattcccacggtgtacgggggccggcccagctggacggccgaccccggggaccaggccgtcccgtacgtggacgcggacaaccggggcggcgcgcgggtggccgtgcggtatctcaaggacctcggccgggagcggatcgcgcacatcggcggaccgcccgaccagacctcggcgatggaccgtctggacggctaccgggacatcctgctcgacgtggacccgacgctcgtcgccgagggcgcgttcaccgtggagagcggagcgcgggcgatggcggagctgctggagcggcggcccgacctggacgcggtgttcgtcgccaacgacctcatggcatcgggtgcgttgcgcgtgctgcgggagcgcggagtggccgtgccggagcaggtggcgatcgtcgggttcgacgacatggactcggtggccgagaccaccgatccgccgctgaccannnnnnnnnnnnnnnnnnnnnnnnnnnnnccggctgctgctgcgcggcctggaccgggaccgtacgggcaacggcccggctcccgactcggtgatcaccccgacgacactggtgcgacgggcctcggcctgatcgccacgcgagcgcgggagcgcgggagc

SEQ ID NO: 3931 - DNA, 2428 bp, Unknown
  Kingdom: Bacteria, Phylum: Actinobacteria, Class: Actinobacteria, Order: Streptomycetales, Family: Streptomycetaceae, Genus: Streptomyces
acgagaacgggggcggacccacacgtgtaaccaacccggccggatcactgcgcaccccgggatcagccgaagagcaggagaaccgctccgtagctcagcgcggcgaccagcgccgcggccggcatggtgatgaaccagccgaggatgatgttcttcgcgacgccccagcgcaccgcgttcacccgcttggtggctccgacgcccatgatcgcggaggtgatgacgtgcgtcgtcgagatcggcgcgtggaacaggaacgccgaaccgaacatgatcgaggcgccggtcgtctccgccgcgaaaccctgcggcgggtccagctcgatgatcttgcggccgagggtccgcatgatgcgccagccgcccgcgtacgtgcccagcgagagcatcagcgcacaggcgatcttgacccagacggggatctcgtcgttgggaccctcgacgtccgcgatgaccagggccatcacgacgatgcccatcgtcttctgcgcgtcctggaggccgtggccgagcgccatgcccgccgccgagaccgtctgcgcgatccggaagccgcgcttggccttgtgcgggttggacttccggaatatccacatgatgccgaccatcaccagatagccggcgatcaggccgacgaacggggagatgaacatcgggatgacgaccttctccagcaccccggaccagatgacgtccgtgccgccggccagcgccgccccgaccatgccgccgaacagggcgtgcgaggacgaggagggaaggccgtagtaccaggtgatgaggttccagatgatcgcgccgaccagcgccgcgaacaggatccccatccccttctgccccacgggcgtcgcgatcaggccctcgctgacggtcttggcgaccccctggcccaggaaggcgcctgcgaggttcatcaccgccgccatcgccagggccgcacgcggggtcagcgcccgggtggagaccgaggtggcgatggcgttcgccgagtcgtggaagccgttcgtatacgtgaagccgagcgcgacgccgatggtcacgatcagcgcaaaggtgtccacgaggttcaggactccttgaccgcgatggtctccacggtgttcgcgacgtgctcgaacgcgtcagccgcctcttccagcacatccacgatctgcttgagcttcagcacctccatggcgtcgtacttgccgttgaagagctgggccagcagcttgcggtggatctggtcggcctggttctccaggcggttgacctcgatccagtactccgtgaggttgtccatggtccgcagccccggcatggcctcggcggtcagttccgccgcccgggccagcacctcgatctgctgctcgacgcccttggggagctcctggacctggtagaggacgaccaggtcgacggcctcctccatgaagtccatgatgtcgtcgagcgaggacgccagcttgtagatgtcctcgcggtcgaaaggcgtgatgaacgaggagttcagctggtggaagatcgcgtgggtggcatcgtcccccgcgtgctccgctgcccgcatacgctccgcgatctcgactcgggaggcagaatccgccccgagcagttccatcaggagtttcgagcccgtgacaatgttgtccgcagacgcggagaacatgtcgtaaaagctcgtctccctgggggtcagacgaaagcgcacgtggggtcctcgggatgctttggattcggtcaggctgatgctaggcgcatcatccggccacggctaaccggcgttcttcagtgtcgcccatcggacacggcgatcagcacggacccccggtcacgtttcgacagaattcgataccatatacccagcaggggtatgtggacggcacggcgcggcggaccggagcagggcggccgagccgtccggcaccgcccccacggcacaacagcaggaccgcagttccgcatttccgcgttccggcagggacacttggagaacaacaacgggaggacgcagatgaccacgaccgggaccacagggacggaatcaacgggcgtggcggccccggacgcgggggcggccgcccctgtggacatcgtcaccgaccacgaccgcggcattcacggctaccaccatcagaaggacgaacacctcaaacggctccgccggatcgagggccagatccgcggcctccagcgcatggtcgacgaggacgtctactgcatcgacatactcacccaggtgtcggcgtccaccaaggcgctccagtccttcgccctccagctgctggaggagcacctgcgccactgtgtcgccgacgcggccgtcaagggaggcgtcgaggtcgacgcgaaggtcgaggaggccacgaaggccatcgcccgcctgctccgcacctgaggcacggccccgtgagcggcgggggtgcgggcgtcacccccgccgctcacgggg

SEQ ID NO: 3932 - DNA, 4596 bp, Unknown
  Kingdom: Bacteria, Phylum: Actinobacteria, Class: Actinobacteria, Order: Streptomycetales, Family: Streptomycetaceae, Genus: Streptomyces
gccgccgggggcgcggtggccgtgtccgcgcgctccgccagctggagggcgtggtcgcggaaggtgctgcgcagggggaccggcgccggttcctcaccgcgggacagggcgtcgtacacgctcgtcagctcccgcaccaggagcgcggcgctgtagccgtcgccgatgatgtggtgggcgtgtaccaccaggacgtgttcgtcgggagcgaccgtgagcacccgcaggcgcagcaggggccaggcccagggttcgaaacggcgcgcccgttcggcggtgatccgctcctccacctggcccgggtcggtgagtgcctcgaagtcgaccggcaggcgcagcgaggccggaagttcctgctggaccgccgggcgagccccggcggggaagacggtgcgcagcatcgggtggcgcccgacgagcgtgtccaccgcgctctggaagcgggcggtgtccaggcggccgtgcagacgcagccgcgtgagccaggacgatgtcgtgcccggtgcgatggcttcggccagcaggaagccccgctgggtgggtgtgagcgggaagggcgggggagtgacggccggatcgagcgtcccggggcggtcgcgcactgcgtcgcgtcccggggtcgacgggtccgctgcggcgtcaacggccgtgacggtggtgtcggcagggtcgattccggtgcccgccacggcatccacggcggaggcgagggccgcgagtgtgcgattgcggtagatgacggtcggccgggggagcggtccgccctgcttctccagccgggcgaacacttccagcacgagcagggagtcgccgcccagaacgaagaagtcgtcctcgcgggacacgtcgtcggcctggagcagggcggaccagatggcggccagccggacttcggtgggagtgcggggcggtgtgcggacgtcgcccgtacgtgcggcgctgccggcgtccgggtccgccgcggtcggttcggccgcctggagtgccgtcagcccacggcggtcgatcttgcccgtgctcgtgagcggcatcctgccggcgcggatgatccgggacggaagcatgtacgcgggcagtgactccgcgagatggagccggagcgccacggcatccgcgccggaagacccgggccccggcgtcacgaaggcgatgaggcgtccgtcctcggcgatgacgacggcgtgggcgacgtccggatgggcctggagcaccgcctcgatctcgcccggctcgacccggttgccccggatcttcacctggtcgtccagccggccgaggaattccaggacgccgtcctcggaacaccgcacccggtcgccgctgcggtaccagcggcgtccgcgccggagcgtgaacgcggcctcggtgagggccggttcgccgagatagcccggagtcaggccgattccggagatgaggagctcgccggcctcgccgggccgcctgggctccccgtcggggccgacgacctccacctccgtgcccgcaacggggaggccgatgggaagccgtcgcacctggtcgccgggccgggtccggatgatgtggcagctcgtgttgatggtggcctcggtcgggccgtacaggttggcgatgcgctggccgtcgccgaagaggtcgaaccaacggcgcacatgggcgggtgacagggcctcgccgccgacatggatccaccggagcgcggacaggtccggcggcggtgcaccgtgccgtacgcgttcctcggaagcgctgaggagttgttcccagagcgtgggaacggagctccagacggtgatgcggctgcgttcgacgtgggtcagcagccggtcgggatcgcgcagcaggtcccaggccaccgtgaccacggtggcgccgacgagcaggggggcgaggagctggcggacggaggcgtcgaagcagggcgacgcggtctgggcgagccggtcgtgctcgtcgtatccgaaggtgtcgatcgcccagtcgaggtagttctccatcgaccggtgggtgatggggacggccttgggccggccggtggatccggaagtgaagatcacgtaggcgacgtcgccggcgtcggccgggccgtcgggtgcggggatctcgtccggggaccggacggaaccggcggcgacacggcccgggcctgcggcgggctccggaaccgcactccgggaggacggagccgaagcgtcgacggacaccagggccacgtcgccgagcgcttcccccaccgcccgggtggcggcgtggcagagcaccgtacgggctcccgagcgcgtgagctggtccgtcagccgggcggtcgggtggccggcgtccagcggaacccagcccgctccggcgcgcagggccgcgacgaccgagacgacggtgtcggcgccgggttcggtgagcagcccgacgaggcttcccggggtgacgccgcgggccaggagagaggccgcgagggcgtgggaggcacggtcgagttcggcgtacgtcagggtgacggcgccggtgtcgacagcgaccgcgtccgggtcggcccggaaccgctcgaccagccgccgcacgatcgtggcggatccggatccggacccggacgaggagcgggaagtgggtccttggacctccgcgcaggtcgatccggtgtcctggctcggcttggactccgtgaccaccggtgcggcgatgccgggctccctacggacgacggtcccggcagtggaccgcggccgatccggcccgccgggccgcggccgggtcccgggagcacccgggacgtcggaccgaggctcgacgagcgcggccaactcgtcgtggaagtcccggtccaggcgggccaccgtcgccggttcgaagagccgggcggggaagttccacgagaagcgcagcaccgcctcgtcctgccagcacagcaggctcagacgggtcgcggcggtggcggtgccggcagcggtcggccgcacgctcaccggacaatccccgtcgagagcggcggggaagcgcgagaagctgaagcctgccgggctcaccgtccggggaccggccccggccggatccgccggcagcagccttgccaggtccaggccggtgaggctcgcgtgctgctcgctgtccagccagatcaccgccagccgctcggccagggctcccaccgactcgtccgggtccgtcccgcacagcaggggaagggtgtcggcgagcggccccacgagccggtccaggcccgccaggcgatcgtcccgccgggcgcgggcgacgttcaccgcgatctcccgctgtccgctccaccgggccagacagcgcacgtgcacggcgagcagcagatggaacaggctcaccccatgagcggcggcccgcttctccaacgcggcggtcagcaacgggtcgagggcgctctggtgcgtggtcgtcggcgccgcgggcagggcggacggatcaccgtcgtacggcagccgcagcggttcgtcccgggagtccagccgccccgaccagtacagccggtcggcggcgagggccctcacaccgtccggggaggaccgctcatcggaggtggcggtcgcgtaccgcgcgaagtcggtgccgagcgcgggcagcgtcggtgcgtgtcctccggcgagggaggtgtagagcgaccagagttctccggcgaggatgttgaggctgtatccgtcaccggccgcatggtggatcaccagcaccagatgggacagctccgggctctcccgggcgaggagcgcgcgcacgggaggctcggcggagaggtcgaacggccggttgcacagggccgtttcgagctcctccatgcggccggtcagctcacggacctcgtaccaggcggacagtgcggcgggcggagcgacgtactgcctcggtgccgccgggccgatcacgtcgccggtgcttccggtgtcctgggtggtttcggtgctctcgatacggatccggagcatggtgtgccggtcggcgagctcggcgagagcccggcccaggagccgggtgtccaggggaccccgcacggtctggcggacgtagccgtgagccgggatgtccgggtggagccgactgctggtgtgcagggccagttggacgggggtgagggggaaaccggccccgtccggtacgggaggcggagcgggcgagtgggtgcgggaagatgcggccggcggtgcgggggagggggtggcgtcgaggtgcgcggccagctcggcgaccgtgcggtactcgaagaacagcgtggcgggaagagtcctgcccagctcccgttcgagctgcctgacgaggtccacggcggcgagcgagtcgagaccgagggcgagaaacggttcgtcgtcgggaaccccggcgccgggcagtgacagcgccgaggccagcagccgccgaagcaatgccgcggtagcggtatccggcccggtcccgccgcgcggactgccgctcacacgcgtgccggtgccggctgcccggcccgaggtcgccggttccgttccggtgtccgtgccggggtgcgttcccgtggcttccgccggcgcggtcggttccgccacggccacgggcgcggcggacggcgtcaggtcggcgatcagcaggtgcgccgcgtcgacgccgcacgccgtacggagcgccgccagt

SEQ ID NO: 3933 - DNA, 676 bp, Unknown
  Kingdom: Bacteria, Phylum: Actinobacteria, Class: Actinobacteria, Order: Streptomycetales, Family: Streptomycetaceae, Genus: Streptomyces
  misc_feature (155)..(156): n is a, c, g, or t
acggccgcggcgctcggcatccccgccgggaccgtcaagtcccgctcgtactacgccctgcgggtccttgcgcggacgctgcccggctactcccgcaggtcctccgcccggagcagtgccagcagggcggaggcctcggccacctccacgtaganncctggatgtggcgggcgacccggcaggtctcctcggcgtccagagcgtccaggacgtacgcgcccagcagcaggcgcacatgcgggtcgtcgccggggtcggcactcattcacagcctcgcatctcctgggcgatcctccccttctgcccacgcgcggcgcccgcccccggttcaatgctgcgtgaagcccggcaccgagcaaggaaagaggcgagacgggatgcgtcccgaggatacggatgggaccggtgggaacgggctccaggtaccgatgacctggctgtccaccgagtacctcgccgacgagctgttacggaccggcgacctgatggaaccgacgaccctggagttccgcgcggggcgcgacgccctcgcgctgacgatgttcctgtgcggaatcccccgtgacgctcccgctccccgggccctgcccgaaccgcgggtcgacgagctccggatgctcacggcgtacgagtgcacctggcgcgcctggatctgcgagcggctggcggaggcggg

SEQ ID NO: 3934 - DNA, 2735 bp, Unknown
  Kingdom: Bacteria, Phylum: Actinobacteria, Class: Actinobacteria, Order: Streptomycetales, Family: Streptomycetaceae, Genus: Streptomyces
cctccggactcgccatggtcctggacgtggtcgccacggcggtcaccgggcgggcgggactcagtcccgcgtacccccggctgcgggagagcgccgacgccctgcggctggcgacgctggccagagcctcgctgcccgccggcacgcacagggcggtcacgctcgatcacgatccggccgcggccctggtcgccgccggacccgacctggcgctgcggatggccctcaccgtgctcgacccggtcctcgccgcaccggaccgcaaggacctgatggagacgctcaccgcctggctcgactcggacaccggatccaccaccgagatcgccgagatcctctactgccaccgcaacaccgtccgcaaccgcctcgaccgggtctcccggctcaccggacgctccctgctccggccggcggacgtcgccgccctgtacgccggggtgcgggccctcggactgcgaccgcgctgaccgcgcgtcgcgcgagggtcccgggcgcatccctggagcgctcgcacatctgtcgcatagcctcctgaccatgactgcgacgactgacgacgtgtggctgcccttcccggccgaggagatcgacgggctgcccgagggcctcaactacctcttctgggacggcgaaccggactacccgggggacccggccgactgtgcctactacgtcgttccctacatgaagggccccgaggtcgcggtgcgcccgctcgcctcgatgcgtggcgtccaggtggtgcagacgctctccgcgggcatcgaccacgtggagccgggcctccgtctgcttcccgccggcgtacgcctctgcaacgccaagggggtgcacgaggcgtccaccgccgagctgacgctcgcactgatcctcgcctccctgcgcggcctccccggattcgtccacggccaggacaaggaggaatggcgttccggcttctacccgtcgctcgccgacaagtccgtcctcatcgtgggctacggatccatcggttcggccatcgaggaccggctcgcccccttcgagtgcgcgcgggtggcgcgcgtcgcgcgctccgcacggaccaccgcacgcggtcccgtacagacgctcgacgacctgcccgctctgctgcccgaggccgatgtcgtgatcctctccactccgctgaacccgtccacgcaggggctggtggacgccgacttcctcgccgcgatgcccgacggagccctcctcgtcaacgtcgcccgcggcccggtcgtcgacaccaaggccctgttgtccgaactcgaatccgggcgcctgcgggccgcactcgatgtgaccgacccggaacccctgcccgcggggcatcctctctggcatgctccgaatgtcttgatcacgcctcatgtgggcggcagcacctcggcgttcgaaccgcgcgccaagcggctgctggccgcgcagctcacccggttcgccgccggagagccggtgcgcaacgtcgtgaccaccaccggctgaccccgtcgcagcggccacgctacggggcggtccggatgcacgcagtgccgctcacctcgtctttcgtcacggagcgtagagaatctatggccctgagtgacggatctggtgtatcgtccgatccggggggctgcgccgtggaagggacggcgcggggggagcaccggaacgcgagggggcgacgggcgatgtgctggccatggagagacgatccgacgcggacgagcggacggttgcggccgcccgcaccgacggaacaccgtgcccgccgatggccggatccctgccctgtaccggcatcgccgaagcggccgcggccgggccggagcgagcggtgccggagaggccccgcgaggagccgggcgccggtgagcgcgttcccggcgggcccggggcggggagccctccggtgagcgcgctgggggccctgctcgcaccgcggtccaccgccggctccacgggcctgcggtcccggatcctgctcggcgtcgtctgcgcgggatattcgttgggcgccgccgtcggctggggctcgccgcaagtcgccgtcttcatgggggacttcggactcgccgcggcagccctgatcgccgcggtctcctgcttcctctacgcacgggcggtcgcgggccgcctccggcccgcctggctgctgttctcgctctcgtccctcatggcggcctgcggaaacgccgtctggggctggtacgaggtgatcctcggcgtccccgtgcccacgccctccctcgccgacttcttcttcctctgcttcgcgccgcccgccatcgtcgggctgctcgtgctcgccaaacggcccgtcacccgggccggctgggtgtgcctggccctggacgcgtggctgatcggcggctccctgctgacgctcgcctggagcctcgccctcgcgcacaccacgaacctggcgggcttccaggacgccagcgtcgcgcccgcggccctctcgctggcctatccgctgctcgacatcgtgctcgtctcgatggtcctcgccctgcacttccgccgggccggggtgaaccgctccgcggtgaacaccgccatcgccgccctcgcgctcaccgtcctgagcgacgccgtgttcacctcgccgctgctgcgctccacctaccactcgggccagctcctcgacgccggctggttcgccgggtcgctgctcctcgcctacgccccctggggtgcccgcaggggaggccggccgtccgcccgccccgggccaccgcgcgcca

SEQ ID NO: 3935 - DNA, 3067 bp, Unknown
  Kingdom: Bacteria, Phylum: Actinobacteria, Class: Actinobacteria, Order: Streptomycetales, Family: Streptomycetaceae, Genus: Streptomyces
cgtcgatgccgagcgcgagccagggcccgccgtcggcggcggagagcccgtcgccgtaccgggccagctcgccggccagccgttcccaggtgatcgcttcgagtcgcacggctccatcatcgccggaccggcggtgggacgctcgggtgggagaggtccggccgcccgtgagggaggttcaggcgcctcgcagttcggcggcgagcgggccttcgccgagcacctcgacgcggccgtccttcaccgcctccgcgaaggtcgcccggccctccgccagctccaggcacaccccggcgtcgaggacgatccgggcgtcgggacggtcggcgggaccgtatccgtacaccgcggaacccgctgcggcgccagggagcacggcccccgctcccccaccgacatggaggtggaactcgccctcctccagccggacttcgaggtcgccctcctgggtgagcccggcgagggcgccgagcaggggcagggcgaaccagtgggcgcgcaccgcgtcggtggggcggcgctcgacgagggcgggcgctccccactcggcgagggcggtgaggacgggcagcagggagtggccgcgcgcggtcagctcgtagaccgatgcggccgccgggggcggcagcttgcggcgcagggccagtccggtctgttccatgtccttgagccgggaggccagtacgtccgtgctgacgccgggcaggtcggcgtgcaggtccgtgtaccggcgcggaccgcccagcagttcacggacgatcagcagcgtccaccggtcgccgacggagtcgagggcgcgggcggtggcgcagaactggtcgtagctccggcggcggacgggacgtgctgctggctgctgctgacgtggcatgcgacgcagtctagacatgttgttggactttccaagctgaagcttggtaaaaccaagtatcgcaattcggctcgggaggcagcgcatggagttccggcagtccagcaagctcaacgaggtctgctacgagatccggggcccggtcatcgagcacgccaacgccctggaggaggcgggccacagcgtgctccggctcaacacgggcaaccccgcgctcttcggcttcgaggctcccgaggagatcgtccaggacatgatccggatgctgccgcaggcgcacggctacaccgattcgcgcggcatcctctcggcccggcgggcggtggtccagcgctaccaggccatgggcctgaccgaggtcggcgtggacgacgtgttcctcggcaacggggtgtccgagctgatctccatggcggtgcaggcgctgctggaggacggcgacgaggtgctgatcccggccccggacttcccgctctggacggcggtgaccacgctcgcgggcggcaaggcggtgcactacgtctgcgacgaggagtccgactggaacccggacctcgccgacatggccgcgaagatcaccgaccggaccagggccgtcgtgatcatcaacccgaacaaccccaccggcgcggtctatccgcgcgagatcctcgaaggcatcctcgatctggccaggcggcacggactgatggtgttcgccgacgagatctacgaccagatcctgtacgacggggccgagcaccacagtgcggcggtcctcgcccccgacctggtctgcctcaccttcagcggtctgtcgaagacgtatcgggtggccggcttccggtccggctggatggtggtgtccggtccgcggcagcacgcccgcaactatctggagggcctcaccatgctggcctccatgcggctgtgccccaacgccccggcgcagtacgccattcaggccgcgctcggggggcggcagtccatccgggagctggtcgcgccgggtgggaggctccacgaacagcgcgaccgggcctgggagcggctgaacgagatccccggcgtctcgtgcgtgaagccgaagggcgcgctgtacgccttcccccgcatcgaccccaaggttcaccccatcgtcgacgacgagaagttcgtgctggacctgctgctgcgggagaagatccaggtggtgcagggcaccggcttcagctggccgcgcccggaccatttccgcatcctgaccctcccgtacgccgacgacctcgacgcggcgatcagccgcatcggccgcttcctgaacggataccgccagtgagccgctcgcacggtccggccggggtcagatgaggcggaacaggtcggcggcggcgtggacgtcggtgaggtcctcgatggagcggaggttgtcgcacagcgcgtccaggaccgaaccggcctcggcggcaccgggggcgccgacggcgaggccgaagacgcggaagcccagcacccgcctggcgtcgttccagccacgcatccattcctcggtgacgccgcattcgtcgtcggtgatcatcacgatgtcgccgcgcagggtggcggcgtcgtcgaactcctcctccagcagttcgcgggccgctgtcaggggcgtctggtagctggtgccgccgccgaggaaggtctccgcgaagtcgagcacctgctcgacgccggcggaccggcccgccgggaagcggaagacctggatcctgtcctcggcggagaacaggatgccgacgaagtcgcgcccggcatcgcgggcctggtccagcagcgccagggcgcacgccttggaccacgcctcccgcgtgaccccgccgggccctgccgcgtacatcgagtgggaggtgtccacgcacgcgatgacggcaccccgtcccgtcggctgctctccctggctgtcgtagagcatcagctccccggcggcgtaccgcgcggcgaagacggcacgcagctcgggcaggccgaggttggccagttcggaggggatcaggcgggagaggtcgtcgccgagcgtgacgccgaccaactcccccgcggtgctctccaccttgcgggcccgctccccgtcggccatctggcggaagcggccgatcagttcggcccatcgggcgagacggccggcccgcagccgctcggcgaggcgggcgcgccgcgcgtacggcatccgctccagctcgccggagcccacacccc

SEQ ID NO: 3936 - DNA, 4303 bp, Unknown
  Kingdom: Bacteria, Phylum: Actinobacteria, Class: Actinobacteria, Order: Streptomycetales, Family: Streptomycetaceae, Genus: Streptomyces
gcggcggcggtcgcggagcgggtggcggacgcgggggcgggcgacgagtacgcgcgccagttccatctggagctgcgggtgcaggcgctgctggaggatctgcggcacaactaccgcccgcactccctggactggcggcgcagcaagcgcacggtcccgccggtggtgttcctgccccgggccacccaggacaacggcggcatcctgctgatcaacgcgatcaacagcgtgcggtcgcggcgcagcgaggtggatccgctgctgctgctcgcctcgctccaggcccccgagatcatgcggcacaccccgccgctgcccccggagcggccgggtcccggtgcgccgaccggttcgtccggtgcgcgggcccgctacgagcgctgggtggacgatctgagtctgggccagtcgccggtggcggcggcgaccctggcgtgggtgctcctgctgccgctgtccaccgagaagctgacccacgagcacgcgcacgcgcagctcgtcacccaccgggtgcggcggacctgggcgtggtgggtgatgtcgcgggcgagcgtcgccgtgctcgtcgtgggcagtctgctgggggcgttcctgtgggccggtcactggcgcgagacgtactgccacgggccgctgaccgaccggaacacggacgcgatctgggccgggaagggggacgaccgggagtgcgtgggggtggcgaccgcgcccgaggtgctcttcgcgcggggcaacggcctggagctcaacggagccgggaagggcatcaccttcgagcggatcgagcaggcgatccgggacgagaacgacgacatcgagccgggcgacgcgtacgtgacggtcgtgtacgccggtccgctcaccgccacgggcaaggatccggaggcgacccgcaagggcctggaggagctgaccggcgtctatctgcagcagcgggcggtgaacaagaccgtgcgccggtcggtgaagctgcgggtgctgaccgcgaacggcggcgaggacatgctgcggcagctcaccgccgtgcggaagatcatcgaggtggcccggcgggatccgacggtggtcggggtggtcggtctcggccgcaacacccaggagagcgaaaaggcgacaaagctgctgcgcgaggccgggctgccggtggtgaacacgacgaactccagcagcgacctgccccgggagttccccaactacttcgggctcgcggcgacggacgaggagcagacgcatgtgctggggctggtcgcccggcagatcgcgaagggcctcgaccgcccgcacgcgatcgtgctgtcgcgcgaggaccgcaacggggacctggaccggtacaccgccgagcagcgggacgcgggccggaagatgctggcggacgcgggcttcgaaccgggcaggcccgtgacgtacgacctcgcgggcggggcgagcctgaacaccccgctgacgaccatctgccaggccgagcgggtgcccgacgcgctgtacttcgccgggcgggtcgaggacgtgccgacgctgatgcggggcctgtcggagaccaccgggtgctcggaccggcggatgacggtgttcaccggggacgacctgacgaaggggacgttcgacgacagcacgtcgatcgcggccaacgtcacgctctaccacagctcgctcgccccgctggaccggggaaagaacctcggcttctacggggacgcctaccgcacgctgcgggcgctgcaccccgagggggaggtcaccgcgctggcgtcgggacgtccggcgtacgaggacgatctgttcgccagcgggcagaccgtcatctcctacagcgcgacggccgccctgtacgacgcggcggcgcgcggcgacaagcgccggagcgcggccgagacctgggcgacgctgcacacggtggacctcaacaacatgccgacggggacgatctcgttcagcagggcgaggtcctcggtctccgacaacgtgcacggtctcaacatcgtcaaggtggtccgccccgggccgagcgccgagcggaccctcgtgtgcggcaagcccgccggggtctcgcccccgctgacggcgaaggactgcaggccgtgaggcccgcaccccgggtcagtcgaccaggtcgcggacgacggcgtcggccaggagccgcccgcgcagggtgaggaccgcacggccgttcccgtacggctccgggtccagcagcccgtccgtcagggcgcggcgggaggcggcgaggccgtcgggcttcagcagggagagcgggcagccgtcgcgcagccgcagctccagcaggatgcgctcgacccggcggtcctcctggccgaggatctcgcggcccgcaccgggcgagcggccctcggagagcgcctgggcgtacgcgccggggtgcttgacgttccaccagcggaccccgccgacgtggctgtgggcgccggggcccgcgccccaccagtcggcgccacgccagtacagctcgttgtgcaggcagcggccggcctcggtggtggcccagttggagacctcgtaccagtcgaagccggcggcggcgaacgcctcgtccgcgatgaggtagcggtcggcgtgcgcgtcgtcgtcggtcatcgggatctcgccgcgccggatgcggcgggcgagctgggtgccctcctcgacgatcagggcgtacgcggagacgtggtcggggcccgcgccgatcgcggcgtccagagtggcccgccagtcgtcgtcggactcgccgggggtgccgtagatcaggtcgaggttgacgtggtcgaagcccgccgcacgggcctcggcgacacaggcctcggggcggccgggggtgtgcgtgcggtccaggatcttcaggacgtgctgcttggcgctctgcatgccgaaggagacccggttgaagccgccctcgcgcagcgcggcgaggtaggccgggtcgacggactccggattggcctcggtggtgatctccgcgtcgtccgcgagcccgaactcctccctgatcgccgccagcatgcggacgagatcggcggcgggcagcagggtgggcgtgccgccgccgacgaagaccgtgcgcacggggcgggggtcgtcgccgaggaccttgcgggcctggcggacctcctcgatcaggtgggcggcgtagttgtcgcgggaggccagcgccccgccggtgccgcgcagctcggtggcggtgtaggtgttgaagtcgcagtagccgcagcgggtggcgcagtaggggacgtgcagatagaagccgagcgggcggtcggctgcgccttccagggcgtggcggggcaacgccccgtcgtcgggcacgggctcaccatcgggcagtacggaaggcataccgtccattgtcgctcgctccggacgcgcttcagtccgcgtggagaaccagcagggccacatcgtcgtccggtggccgctcggcgaactcgtggacggcccgtctgatccgctcggccgtcgcctcggcgggcagtcccgcgcacccggcgagcacccgggccagcccgtccccgtcgtcgaacatcagcgggcccgaccggcgctcggtcactccgtccgtgacgcagagcagggtgtccccgggcgtcaggtcgaaggtctggctctcgtacgccacgtcctccaccactcccagcagcacctgcggatcggccgccgggcgtacggagccgtcggggcgcagcagcagcggcagcgggtgcccggcgctggccaccgtgcagcggatcccgccgtcggggagcggcacgacctccccgtacagcagggagaggaaccgtgactgggtgccgtcgtggagttgccggcctccggcggcggcgaccatcagggcggcggcctcggcggcctccatggcgtcgtcgaggagcagccggttcagccggtcgagcacttccccgacgccgaagccctcccgggagagcagccggagccaggggcgggcgaggccggtgacgacggcggcctcgggaccgctgccctggacgtcgccgaggacgaagcaccagcggtctccggggcacgggaagatgtcgtagaagtcaccgccgaccaccccgtcgtcgctcggttcgtagacgagggcgctggtgactccggggatctcggcgaccttgctggggagcaggccgcgctggaggatccggctgatggtggcctgccgggtgtaggcgcgggccgcgccgacggcgaggccgaggcggcggacgaagtcctcgatcagcgacgccaccgcctccggcacctgggcgacgccctcgcggccgacgaggacggtgccgagcccccggccgcccgcggtgatccggaa

SEQ ID NO: 3937 - DNA, 2182 bp, Unknown
  Kingdom: Bacteria, Phylum: Actinobacteria, Class: Actinobacteria, Order: Streptomycetales, Family: Streptomycetaceae, Genus: Streptomyces
gaactgctcgatgcggccctccccgtacaccgcgatccggtcacccatccgcaccgcttcctcgatgtcgtgcgtgaccaggagcaccgtcttgcgcacccgctgctggagcgccaggaactcgttctgcagccgctcccgcaccaccgggtccaccgcgccgaacggctcgtccatcagcagcaccgggggatccgccgcgagcgcccgtgccacgcccacccgctggcgctgcccgccggagagctgcgcgggatagcgcgagccgtacgtccccgggtccaggcccaccaggtccagcagctccgccgcccgctcccgggcccgtgcgcgcttccagccgaccagcgccggcacggtcgcggtgttgtccaggacggtccggtgcggaaagaggcccacctgctggatcacatagccgatccgccggcgcagcttcaccgggtcggtcccggcgatgtcctcgccgtccaccaggatctggcccgaggtcggctcgatcagccggttcaccatcatcatcgtggtcgtcttgccgcagccggacggccccaccagggtcaccagctcaccctccgccacctcgaaggacaacccgtcgaccgctgtcgtcccgtccggatagaccttgccgacctgctcgaaccggatcatgtctgcacgctaggagccctcgggccgccgcgcacacgggccgggaccgtccggggcagcccggcaccaccccttcgcccgaccggtgcggccatgtgctgaactggccctttcgcccggatcagcccgcaccccggattcaggagttcccgtgatcagttaccggcagcccggcgtcgtcctcaccgaccggcggttcaccgtgccactggaccacagcgaccccggcggcgagcagatcgaggtctacggccgggaagcggtcgccacctcccgtgccggagaggaactgccctggctggtctatctggagggcggccccggcttcggcgcgcgccggttcgtcggcacggaggcctggctcggccgcgccctgcgcgactaccgcgtcctcctcctcgaccagcgcggaaccggacggtccaccccggccaaccggcagaccctcccgctgcgcggcggcccgcgcgaacaggccgactacctcgcccacttccgctccgactccatcgtccgcgactgcgagctgatccggccccagctcaccggcggagcaccctggacggtcctgggccagtccttcggcggcttctgcgccgtccgctatctctccgccgcaccggaagggctcaaggcggtcctgatcaccggcggactgccctcgctgcacgcacacgcggacgacgtctaccgggccgcgtacccccgtatcgaacgcaaggtcgccgcccactacgcccgctacccccaggacgtcgggcgcgcccgcgcgattgccgcacacctcgccgagcaccggcccgagagcgccggacaccggctgacgcccgagggattccagtcgctcggcatcatgctcggcagcggtagcggaagccaccagctccactacctgctggagaacgcgttcgtccgcaccccgggcggcaccgaactctccgacgccttccaggaagccctgcgcacggccgcctccttcgccgggcacccgctgtacgccctgctccacgaggccatctacgcacagggcgagcgccccaccggctgggccgccgagcgcgtccgggccgagttcccgcagttcgacgcggcgacggcactggcgggcgacggcccggtcctcttcaccggcgagaccatccacccctggcacttcgacgtcgacccggccctgcgcccgctgcgcgagaccgccgaactgctcgcgcagcgtgccgactggcccgcgctctacgaccccgagcggctcgccgccaacgaggtgccggtcgcggcggccgtctaccacgacgacatgtacgtcgacaccgaggactcgctgcgcacggcggcggcgatccgggggctgcggacctgggtgacgaacgagtacgagcacgacggcgtgcgcgccggcgggcctcgcgtactggaccggctgctggcactggtgcgcgacgaggcctgaccggccgggcgccgcgaacgccccggggccggtcgtggaccggccggccccgccgaatcagcgctggagctcctccagcgt

SEQ ID NO: 3938 - DNA, 2064 bp, Unknown
  Kingdom: Bacteria, Phylum: Actinobacteria, Class: Actinobacteria, Order: Streptomycetales, Family: Streptomycetaceae, Genus: Streptomyces
cccgctgctgctctcggcggcgtccgccgagtaccgcggtcgggtggtcgccgtgttccagccgatgacgcagctggcggcgatggtcgcggcggcgctgtccggctggctcgcgggcaccgtactgcgggacttcgacggctcggtggcgggcttccggttcggtcccatcgacacgatcatcgccgtggccgggctgtgcatcctgctgtccggtctctacgcccgcagcgccctgccggacacggagaccgccgaggacggcggccccgccggaggacccggggaggaagaggccggtgaggaagaggccggtgagcccaccggaccggccgaggaagtggcatcgaagaccgccgccgccggaacccccgccccaccacgacgagggagcaccgagtgacctccgccgcccgaccggcacagcacgcgtacccccgcacagcccggcaggacgtcgtggacgagctgcacggggtacgcgtccccgacccgtaccgctggctggaggacgcgaaggcggccgaggtgatccgctgggacgccgagcaggaggccctctacgcggcggagcgggcggcctggcccggccgggagcggtgggaggcggaggtggcggcgctcaccgccgtcgatcgcgcggcaccgcccagggtccgcggcggcagggtcttctggctgcggcaggacgcgggccgggagcatcccgtgctcatggtggcggagcccggcgcggatgccgggcgggtgctgctggatccccaggtcctcgatccgtccggccgcaccgtcctcgacgcctggcagccgtccctggagggcgggctgctggcctttcagatctcccgggacggcaccgaggactcgcggctccaggtgatcgacgtggtgaccggggaggtcgtcgacgggccggtggaccgggtgcggaggtcgtcggtcgcctggttgcccggcggcgaggcgttctactacgtccggcggctggacccgcggctgcaccccggcgaggagcagtaccaccgccgggtctggctgcaccgggtcgggaccgcgaccggcgccgacgccctggtcttcggcgagggccgggacaggacccagttctacagcgtgtccgtgtccgccgacggccgctggctcggggtcagggccacgctcggcaccggccgccgcaccgacctctatctggccgacctgagcgtgggaccgctggaccggccaccgctggtgccggtccaggagaacacaccggccgccacccatctgcacgtggcgcccggcaccggtccgcaggacccggtgtggctgcgcaccgaccacggcgccgctcgcggccacgtcgtcgcgtgcccgccggaggcgctccaccgtggccccgaggcgtggcgggaggtggtcgcgggacgtcccgacgcggtcctcacccacttcgcggtggtctcgggacccgagctcgaccacccgctcggcctggccggctggacccgccgcacggtggcggaagtgaccgtgcacgatctgacggacggcaggcaggtggcctccgtaccgctgccgggcagcggcaccgtcggcggtttcgcggccgggccggccggcagccacgaggcctggttcacctacaccgacttcgtgacgccgacgcgcgtcctccgcttcgacggacggacgtgccgcgtgacgcgctgggagcacggcgcgcggcacgcgccggaggccgagggagcggtcacccggcaggtcgccttcccgtcccgggacgggacgacggtacggatgttcgtgatctcccccaccggcagcccggacgtaccgcgcccggccctgctcaccggatacggcggcttcggccagatcatgtcgccccggtaccggccccaggtcctcgcctgggtcagggcgggcggcgtcttcgcctgggcgggactgcgcggcggcggcgaggagggcgaggagtggcacctcgccggcagcggggccaacaagcagaacacgttcgacgacttcgccgccgcctccgaccacctgctggcggccggctgggacgcaccgggccgggtc

SEQ ID NO: 3939 - DNA, 3352 bp, Unknown
  Kingdom: Bacteria, Phylum: Actinobacteria, Class: Actinobacteria, Order: Streptomycetales, Family: Streptomycetaceae, Genus: Streptomyces
gcggtcgccgcgacgatcgccacgatcgtcgtcttcttcttgtcgtcgccgggcctcggcccgccgggcggacccgggacggcgtactgcggcaccgtcggctgctggtagggattgggctgctggtaccccggctgcccgccgggcggaccctgcgggtacccgtagcccggctccgtgggttgccccggctggccctgcggcggatatcccggttgctgatagggattcggctgctggtaccccggctgctggtacgggttctggttctggtcctgcgggttctgctcgcccccgggcggctgcgttcctggccacatggccagtaaccatagatgggccgcccggccacttctacggccgccctgtcccagagccgtcacaaggggatggccaaacggtgctactggtgagtaaccttcgggcatgagcgctgaacagatgaccgtgggcgagatgctcgtcgcgacggttccgatggcccggaccctcaaactcgacttcctggagacgaccccggagcgcgccgtcgtccggctccccgaccaggcggactaccacaaccacctcggcggaccgcacgccggagcgatgttcaccctcgccgagtccgccagcggcgcgatcgtcatcgccgccttcggggaccagatgtcgcgcgccgtgccgctcgcggtgaaggccgagatcggctacaagaagctcgccaagggcgaggtcacggccaccgcgaccctcggccgccccatcgccgacgtcgtcgccgagctggatgccggacagcggccggaattccccgtcgccatagagatccggcgcgccgacggcgcggtcaccggcgagatgaccgtcgtgtggaccctgcgccccaacagctgagaaccgccgtacccacccgggccgccgcctctccccggacgggagggacggcggcccgggtgcgctgtcggccggaagtacgggtgtcagcccgcgtgcgcctcacggtgggccttcgccagctccacgtacccggccgcgttgaagcggatgccctccagctcctcggcggtcagcggtcgcttcaccttcgcgggcacccccgcgacgagcgagcccggcggcacccgcatcccctgcggcacgagggcctgcgccgcgaccagcgaacccgccccgatgtgcgcgccgttgagcaccgtggcgcccatccccaccagcacgtcgtcctcgatcacacagccgtgcaggaccgcgttgtgcccgaccgagacccgcgcgcccacggtgagcgggaacccggggtcggtgtgcacgctgcagttgtcctggatgttgctgtccgggccgagcgtgatgggaccgcagtcggcccgcagcacggcctggtaccagacgctggagcccggggcgagcgtcacctcgccgatcaccacggaggtcggggccacgaacgcgtccacgtcgatgtccggctccttgccgcccatgcccgtgatcaacgcctgctccgccatcgcctgctccttcgcgccggtgtggtgctcctgggccttcccgtcgaatcggtcggatccgtcggtccgggccgactcacacggtaggggacgactcccggcgggcagcgcccggtggggcgaacatcacaggtcatcgcacggatcgcccaccgcgccgccgactaccgtgagcgcgtgccgaagaaccgaaacacgttctccttcctcgcccgctggccgcgccgtgccgcctcccgcgcgatccacctcggctgggcctgggcacagcgggcgggcgcggtcaccgccgagcaccccggccggctgcggttccgcgcgatcggcacggggacccggctcgccttcccgcaggggaccgtgttcggggagccgtggatcgagctcggcgcgcactgcgtcatcggcgagcaggtcacgctcacggccgggatgatgccggacctggacctcggccccgacaccgtcctcaccctcggcgacggcgtggtgctgggacgcggcagccacgtgatcgcggacacgacggtgacgatcggcccggacacgtactgcggcccgtacgtctacatcacctcgaccaaccacagctacgacgacccgcaccagcccgtgggcaagcagtggccccggatggaaccggtggtgatcgggcccggctgctggatcggcaccggcgcggtgatcctgcccggagcccggctcggccggaacgtggtggtcgccgcgggcgcggtcgtccggggcgaggtgcccgaccacgcggtggtcgcgggggcccccgcccgcgtcgtccgcagctgggacccggagaagggctggcagccgccgctgcgcacgcccgcgcccgtgccgatccccgagggcgtcacccccgagcagctgctggccctcgcggaaccggacgaggcacgcgataccccgtagggcggcggtgccggtacccgtggccggacgcgggagtgcgccgtgcggcagtgcaatattcttgaccccggcatgcgccgtacgtgactcagcacaccgcactcggtacccgcactccgccacccgcactccgccatccaccgcagggacggtacgtgtccgacctcgaccagctcacccagtcgctggcccgcaacctcaagcgctggcggggggagcgcggcttcaccctcgacgccctcgcggcccgcgccggagtcagtcgcgggatgatcatccagatcgagcaggcgcggacgaacccgagcgtcggcaccacggtcaaactggccgacgcgctcggcgtcagcatcaccaccctcctcgaccacgagcagggcgcccaggtccggctggtcccggagggccaggccgtgcgtatgtggtccaccgaggcggggagctccaccacgctgctcgtcggcgccgaggcccgcggaccgctcgaactgtggacctgccggctgatgccgggggagggcaccacctccgacccgcaccccgagggcaccgtcgaactcctccacgcgaccgagggcgaactgaccctcgtcgtcgacggccgcacccaccccgtccccgccgggacctccgccgccttcgaggcgcacgtgccgcacggttaccgcaacgagggcgacgaaccggccgtgttcaccatgaccgtcgccatcccgcccgtccgctgagacgcccggccggctccgcgcccgccgctgttagcgtgagcgccatgcgcgcacccatcggcaccttcgaggacgccgctcccgctgcggaacggctcgacctgctccccgcccccgtcgtcacggccctgaccgccggctggggagagttcaccgccgagcagatcatccacgtcgacagcgacccggccctcgccgaca

SEQ ID NO: 3940 - DNA, 1232 bp, Unknown
  Kingdom: Bacteria, Phylum: Actinobacteria, Class: Actinobacteria, Order: Streptomycetales, Family: Streptomycetaceae, Genus: Streptomyces
atccactccagccccgggcgggcggcggccagcgcggtgagcggatcggcgtcgacggacgcgatgttgtacgcgaccagacggtgggggcggccggcggcgatgtgcccgagcgcggcccgcgcgtactcgggagcgaccggctccgcgaggaccgttccgtcggccacctcgccggagagcgccagcgacttggggccccggacgcccgccaggatgtcgggcacgacgtcgggaagtgcgctgggatcgagctgtacgccgtcgaggtgcacgtactgcccgcgccgctgcgtgagttcgccgcgcagcagcgcccgcagggcgtcgacgtactcgcggaggaaggtgagcgggctcctgggccactggccgacgctgcgcatccagtggggcatgccgtgtcccacggcgatgtcgacgcggccggggaagagctgtgccagggacgcgatctccagcgccgcgaacgccacgttgcgagccccggcgggcagcagtccgatgccgacccggatgcggtcggtggacgccagcacggcggccgcctgggcgacaccgccgcggaatccgaggtcctcgaccacccacagggcgccgaatcccagctcctcggcccgccgtgcgtacggcaggatccggtcggcgggcaggtcgcgcggcagcagaacgcccacggtccggtcggttgcggggggacgcacaggtgttctccttcggtcggcggccgagcgagggcgatcagtgcgcccgccgccccgttccggtgctgcgaagatagaagatagcgaagcgccgaaggccgacgggacggcggccgggaggctctgtcgtacccctgcgctacgttgctggcatgacgcaattcgtactggtggcgggggcctggctcggctcgtgggcgtggcgcgacgtggagcccgtcctgcgcgcggccggtcacggggtccacccgctgaccctgtcgggcctcgccgacaagcgggaagcggtggcggggcagcagacgcacgtccaggacgtcgtcgacgaggtcgagcgcctcggcctgcgcgacgtggtgctggtcggccacagctacgcgggcattccggtcgggcaggctgccgaacggatcggcgaccggctcgcccgcgtcgtgttcgtcgactccaacgtcccggccgacggcgcgtccttcgtctccggctggccggacggccgggccggcgtggaggccgccatcgccgcca

SEQ ID NO: 3941 - DNA, 1390 bp, Unknown
  Kingdom: Bacteria, Phylum: Actinobacteria, Class: Actinobacteria, Order: Streptomycetales, Family: Streptomycetaceae, Genus: Streptomyces
cccccggaccgaccctccgccggctgctgtccccggaggccgctcgccggggccctcatgacctgccgggcgttcgcctccgcctcccgctcgaagcggtcggaggggtcggacaccttgagaccgccgccggtctccgtgcccgcgaccggcccctggcgctgctggatgacatgggtcagctcatgggcgagggtgtgcgcgtccccgccgccgtcgccgatgacgacatggttgccggacgtataggcacgggccccgataccggccgcggaggccctggccgcggcgtcggtgtggatccgtacgtcggagaagtccgcgccgagccgcgcctccatatcggtacgggtgccctcgtcgagcggccttccgccgccacgcagcacgtcgtggacggcggagcgctgtacggcgtgctcctcgccctgcccctgaccgctctcccggagcagctgaaccaccgccgcgttgccgagacctcgctggagggcgaagaggcccctgggctcggtccgtgcccgctccacaggtgtgcgagccgaggcacggtcgtgttcgccaccggccgtgctgacgttctcgtggtcgcgcaacgggtcctcttctgccgcaggggttcgacctctcctgcgtacaggacgggaaggggccgaagccaggcccctgcgggcagcgtgacccggctgaaagggcgaaccggctcagacctccgacgcgtacgtgacgaagtcggcccgggcggccgggccgaagccgaggtgcgggccgtcggcggggaggccgcccgcctgctcgccgggctccaggtctccgcgccgcagttcgtcctctccgaggtggacgtggagcggctcacccccggggtcgccgcctggctggagcggggggtccggccggacgcggtgcgggtcgcgctcaccgatgatccgcccgtacccctccggcacccggcgaagctggtgcggcaccggctcatcgcgctccttccgccgcccgtaattgccgccgtacccgtcgtccccctccagaactgcgacgagtgcgaccgggccttccggtcgcccgtgccggggtgctgcggggagtgcggcgacgtccgcggccacgccgacgacgagccgtgccagctcggcgtgtgatcagtcgatgcggtcgcagacgctgtccgtggcgaccaccgggcccgtcacggtcttgtgtcaccacggccatacaggctgtgccgagagcgcctggaacgatgctgcgggtcgctcaccaaaagctcaccacgacggggccgggccaggggtggccccgcgggcagggacggctggatgctttcccgatggctcttcctcgacgcggaggaccgtcggatcccatcctgagcacgaggccgtgagca

SEQ ID NO: 3942 - DNA, 1179 bp, Unknown
  Kingdom: Bacteria, Phylum: Actinobacteria, Class: Actinobacteria, Order: Streptomycetales, Family: Streptomycetaceae, Genus: Streptomyces
gatcaccggcgagccggacgggccgccgacgctgccgccgttcggactcgccgactccatcgcggcgctggccacggcgtacgcggtgatggccgcgctcgcgggacgggagaagaccggcgagggccaggtggtggacctggcgatcatcgagccgatcctcaccgtgctgggcccgcaaccgctctggtacgaccagctcggctacgtccagccgcgcaccggcaaccgctcccgcaacaacgccccgcgcaacacctaccggaccgccgacggccactgggtcgcggtgtccacctccgcccagtccgtcgccgagcgggtgatgcggctggtcggccgcccggagctgatcgacgagccctggttcggcgcgggcaccacccgggccgagcacaccgaggaactggacggggccgtgggccactggatctcccggcacagccgcgaggaagtgctgaacggcttcgagaaggcggaggcggccgtcgcgccgatccatgacgtgcgggaggtgatggaggacccgcagtaccgggcgctgggcgccatcaccgagatcgacgacccggaactggggccgctgcggatgcagaacgtcctcttccggctctcggagacccccggcgggatccggtgggcgggccgcccgcacggcgcggacaccgaggagatcctggccgggctcggcctctcggagacccggatcgcggcgctgcgggaccagggggcgctgtgaccggccgcccgatcccggccccgccgctgccggagggtccgccgccgcccgtcggccggccgccgctgacctggctgtacgtgcccggggaccggccggaggtggtggccaaggcgctgggcagcggggcggacgtggtgatcgtcgacctggaggacgccgtcgccccggaccgtaaggagtacgcgcgctccgccaccgccgaactcctcggcgaccaggtgacggcggccccggacgcggtgcccgtccatgtccgggtgcatggcgaggacgacatccgggcgctggcggaactgccgggtctgaccgcgttccggctgccgaagatcacgcatgcggtctcggtgcaccatgtggcggccgtggccccgggtgtggcgctgtatccgctgctggagtcggcgctcgcgatcgagcacgcgtactcgatcgcctcg

SEQ ID NO: 3943 - DNA, 1716 bp, Unknown
  Kingdom: Bacteria, Phylum: Actinobacteria, Class: Actinobacteria, Order: Streptomycetales, Family: Streptomycetaceae, Genus: Streptomyces
tgtccgggcagcgccatcttgaggtcggaggcgtggatgccgatggcgtggacccggtgtccctggtcggcgaagaggcgggcggtctggtgcatccagccggtgacgccgccgagttcgtcggtgctgttggagacgatgaagatgtcgcggctcatcggccggccccccggtcgtggtcgatggtgtggcgggcgccccgggaggatccggcggcgaagacggcggcgacgatcctgcgggccgcgtcaccccggtcgtagggcccgaactgccgcacgaaagcccggcgtcggtcggcgtaccgggtgtcggacttcttcagctccgcgagggtcgcgaacagctcctcctgcgtcgcggtcaccggcccgggtgccttctcccgcaggtcgaagtagctgccgcgctcggccgcgtacgcctccaggtcgggggcgtacagcacgacgggccggtcgaggagggcgaagtcgaacatgatggaggagtagtcggtgatcaacacatcggtgagcgcgaggagttcgctgacgtcgtggtggcgcgagacgtcgacgacggttccgggcgggcagagcggcagccgggcggactccaggtagtgggcccgcacgagcagggtgtgggtgtcgccgaaccgctcggcgaactcccgtacgtccagcaggagtcgggtcctgcgctgcttgccgggtccgccccggaacgtcggtgcgtacagcacggtcttcttgtggtcgtccagcccgagcaccccggcgagcggcgggcgcggcagccgtccttcggtctcggcccgggtgcgctccgcgatcagggcgtcgttgcgcgggtagccggtgcgcaggacccgttcctcggggatccggtaggcgcgggcgagggtgttcacgtcgtgctcggagcggacgaggaagtggtcgaagcggtccaccgcccgctggagccgttcgcgccggggggtgctctggagccgtacgcgggtctcgtcgaagcccatccgcttgtacgcggagccgtgccaggtctggaggtacgtggtgtgccggggcttgttcagctgctgcgggaagccctggttgtcgacccagaactcggcgcgggccagcgcccacaggtagcgccaggaccagcggcgtacgaggcgggcgccgtccgggaagccggccggggagggatcgtaggaccaggtggcgtgcagtttcaggccctggcggcggatctcctcgtacagggcgcgcgggctgtccccgtagcaggtccccatgtggctttcgagaaccacggaacccctgcgcacggggagccgggtgagccaggtgttgtagacggggaccttgaaaccccgggagcggtagcggtccaggcgcttgcgcagggaccggacgaggagcttcgccttgcgggtgggccggaagcgggtggcgtagcggaccaggcggtgggcggtgcgggccgggcggcggcgggccgtcagccggagcgcgaagtggtccttgagcgtgatgtagggctcccaggtgtccccggcgagccgcccgagccggggcctggcggtgaaccgcaggccctcttccacctggtcctgcggggcgaacagatcgctgacggaccggggtccgtcgggaccccccgcggtcaccgtcagccgcgcgtcccacgccgtgtcgcgcataccgacggggcgcagccgacgtctcacgccggctgcgc

SEQ ID NO: 3944 - DNA, 510 bp, Unknown
  Kingdom: Bacteria, Phylum: Actinobacteria, Class: Actinobacteria, Order: Streptomycetales, Family: Streptomycetaceae, Genus: Streptomyces
cgaccagggcgggaaagggacggcgtcgccatggcagaccatcaggaagcaaccgtcactctgccgaccgatccggtctcggtctcatcggcccgcagacatgtggccaggactttggcccaatggggcctgcccgaggacaccgagttcgccgacatcatccggctgatcatctcggagctggccaccaacgccgtccagcacacgttcggccagtcgcccaccttcaccgtggacctgcgcctcgaacgcgacgaggagctgtatctcggcgtcacggacagtcacccccgctggccccagcggctgcccgccgccgtacggcaggacaacggccggggcatggtcatcatccgggcgctggccaaggagcgcggcggacggctccaggtgaccccgaccgccgagggcggcaagacggtctggatcgccctcccctgggtcgttcccgtccagggctgaccgcggctccgaagccggtcctgtcggtacccgtgggctgatctgccg

SEQ ID NO: 3945 - DNA, 3197 bp, Unknown
  Kingdom: Bacteria, Phylum: Actinobacteria, Class: Actinobacteria, Order: Streptomycetales, Family: Streptomycetaceae, Genus: Streptomyces
ggccgcccccttccccgtacccgtaccgtctcagcctcgccgcacctcgaagtggaagcagccgtactccacggcccgtacgtgcaccaacgccacctccgggtccgcgaacgcctcgtcgagggccgcgtcgaagcacgtctccgcgtcgtccgggatctccagcagccggccgcccacgatgtggccccgggcgtcgtagcggcgcaccgcgcgcagcgcacccgcccgtgcgaaggggtatccggtgcactccgggtccgggcccgggcacgcctcggcgtggatgaagacgggcccctgctcgtcgtacgcccccgggctcgccccggtcgcggtggcccagcggcgcagcggtgcgtaggagacgagggcgatgcgctcccccggtgcgttgccgcgcagacagcagcgcagggggtggccgccctcggtcgcggtgtacgggcggcagggccggcccgcgtcgtcggtggcgcggagtccggcgagagcggcggggtcgatggggcgtggctggtgtccggtcatggtccgagcgtgtcccggtgagcggtccgcgtccggcggaaaacggacatcgcgctgggagcacgtgcgtggaaggatgggccgaaacgccgcttatcaagtcgcacacctaggagatgaccgcgtgcctggcacgaatctgacccgcgaagaggcacaggagcgggcgcgcctgctgaccgtggacgcgtacgagatcgatctcgacctctccggagcgcaggagggcggcacctacaggtccgtgaccaccgtgcgcttcgactgcgcggaggcgggtgcggagtcgttcatcgacctggtcgccccggccgtccacgacgtggtgctgaacggcaaggacctggacgtggccgccgtgttccgcgacgcgcggatcgccctgccgcatctgcgtgagggcgccaacgagctgaaggtcgtcgccgactgctcgtacaccaacaccggtgagggtctgcaccggttcgtcgacccggtcgacgagcaggcctatctgtacacgcagttcgaggtcccggacgcccggcgggtgttcgcctcgttcgagcagcccgacctgaaggcgaccttcgcgttcaccgtgaaggccccgaccggctggaccgtcatctcgaactccccgacgccggagcctgcgggcgacgtctggaccttcgagccgacgccgcgcatctccacgtacatcacggccctcatcgtgggcccgtaccacgcggtgcacagcagctacgagaaggacggccagtccgtcccgctcggcatctactgccgcccgtccctcgcggagtacctggacgcggacgacatcttcgccgtgacccggcagggcttcgagtggttccaggagaagttcgactacgcgtacccgttcgccaagtacgaccagctcttcgtcccggagttcaacgcgggcgcgatggagaacgcgggcgcggtcaccatccgcgaccagtacgtcttccgctccaaggtgacggacgcggcgtacgaggtgcgggccgagaccatcctgcacgagctggcccacatgtggttcggcgacctcgtgacgatggagtggtggaacgacctctggctgaacgagtcgttcgccacctacacctcgatcgcctgccaggcggacgccgcgggatcgaagtggccgcactcctggaccacgttcgccaactccatgaagacctgggcgtaccggcaggaccagctgccctccacgcacccgatcatggcggacatccaggacctggacgacgtcctcgtcaacttcgacgggatcacgtacgccaagggtgcgtccgtgctcaagcagctcgtggcgtacgtcggcaaggacgcgttcttccagggcgtgcaggcgtacttcaaggcgcacgccttcggcaacacccgcctctccgacctgctgggagcgctggagaagacctccggccgcgacctgaagacctggtcgaaggcgtggctggagacggcgggcatcaacatcctgcgcccggagatcgagaccgacgccgacggtcacgtcacctccttcaccgtgctccaggaggctcccgcgctgcccgccggcgcgaagggcgagccgacgctgcgcccgcaccgcatcgccatcggctgctatgacctcgacgcggccggcaagctggtgcgcaccgaccggatcgagctggacgtcgacggtgagcggaccgacgtgcccgccctggtgggcaaggcccgcccggcggtcgtcctgctcaacgacgacgacctctcctacgccaaggtccgcctcgacgaggagtcgctgcgggtcgtcaccgagcacctgggcgacttcaccgagtcgctgccgcgcgccctgagctgggcctcggcctgggacatgacgcgcgacggcgagctggccacccgcgactacctctccctggtgctctcgggcatcggcaaggagtcggacatcggggtcgtgcagtcgctgcaccgccaggtgaagctggcactcgacttgtacgcggcgccggaggcccgtgagaccgccctcaaccagtggtccgacgcgacgctggcgcacctgcacgcggcggagccgggcagcgaccaccagctggcctgggcccgcgccttcgcggccacggcccgcaacccgcaacagctggccctgctccagtcgctgctggacggcaccgagaccatcgagggcctggccgtcgacaccgagctgcggtgggcgttcgtggagcggctggcggccaccgggctgctggacgaggaggagatcgccgccgagtacgagcgcgacaggacggcggcgggcgagcgccacgcggccaccgcgcgggcggcccagcccacccaggaggccaaggccgaggcgtgggcctcggtcgtggagtccgacaagctgcccaactcgctccaggaagcggtcatcagcggcttcgtccagacggaccagcgcgagctgctggccccgtacacggagaagttcttcaccgcggtgaagggcgtgtgggactcgcgcagccacgagatggcccagcagatcgcggtgggcctctacccggccctccaggtctcccaggagacgctggacgccacggacgcctggctggcctcggccgagccgagcccggccctgcgtcggctgatgtcggagtcgcggtccggtgtggagcgcgccctgaagg

SEQ ID NO: 3946 - DNA, 1103 bp, Unknown
  Kingdom: Bacteria, Phylum: Actinobacteria, Class: Actinobacteria, Order: Streptomycetales, Family: Streptomycetaceae, Genus: Streptomyces
gtcccggagccagcgacgggcgcgcgcgaagccggacgagagggtggtcacgtccagctacggtacgcggccggtccgcgggggcgtacgtcttccccggggagggcccggagcacccctgccccgcgtccggcggaccgggcgcggggcaggggcgcttggggtgctggtgcggcgatccgcgggcccgccggtgccggtcggtctcagttggggatgagcccgccgtcgctgagcatggcccgtacgtcttcgagggtggcgtcgggcgccggcaggatcagctcggacggctccagggagtcgtccggcagcggagtgccgagctcgcgcaccttgtccaggagggcgtggagggtcgtgcgaaagccggggccgtcgccgctctccatctccttgagcaggacatcgtcgagctcgttcagttcgacgatgtgactgtcggccagcttgacctggccctcccccatgatccgtacgatcatgacgctgccttactgcttgtcgaacttgtgcggggacgactgctgcgagggtgacgcaccgtcctgcgcgccgccctcgatggcctgctgcgaggacgaggagccgccggccagctcggccttcatgcgctgcagctccagctccacatcggtgccgccggagatccggtccagctcggcggcgatgtcgtccttcgccgtgccggtcgggtcgtccagggcaccggacgcgagcagctcgtcgatggcgccggcccgcgcctggagctgctgcgtcttgtcctcggcccgctggatcgcgaggcccacgtcgcccatctcctcggagataccggagaaggcctcgccgatccgggtctgggcctgggccgccgtgtaggtggccttgatggtctccttcttcgtgcggaaggcgtcgaccttggcctgcagccgctgggccgcgagggtgagcttctcctcctcgccctgcagcgtcgtgtgctgcgtctccaggtcggtgacctgctgctggagggcggcgcgccgggacagcgcttcgcgcgccaggtcctcgcggcccagcgccagcgccttgcggccctggtcctccagcttggacgactggccctgcagctg

SEQ ID NO: 3947 - DNA, 3963 bp, Unknown
  Kingdom: Bacteria, Phylum: Actinobacteria, Class: Actinobacteria, Order: Streptomycetales, Family: Streptomycetaceae, Genus: Streptomyces
agcgcctggagctgcagctggttcagctgcagctccaggcgcttgcgggacgtcgccacatcggcgacgccgcggcgcaccttctgaagcagctccagctgcttctggtacgagtaatcgagggtctcgcgcggatcctcggcccggtcaagggccttgtttgccttcgcgcggaagatcatccccatacgcttcatgacaccgctcatgggcttcgcgcgcccccttctgacggactgagctccagcactcccgatagaacccacagtacgggccctgtctctattaccgcactgttcgggcgtcgatgtgctcctccccaaggacgactgcacccagtgaagactcccgcccagggtgtaggtgaggccccggaacgttctcgtgacgggcacgggaacgggcggttgacacccgtatcgccccgtcgggacacctgtggggacgccgtccgttgccggatcgttcccgcccgggtctccgggcccgcgcgccgaccccgtacccttgggttttgtgttccgtagccgtgccaagacagagaaggcccccaccgacaaggtgacggcggacctctcccagcagccccgcgacccgcaggctcccaagggtcgccccacccccaagcgcagcgaggcccagacgcagcgccgtcgtgccgcgtccagtgcgccgaccgaccgcaaggcggccatgaagcgccagcgcgaagcgcgccgcaccgacctggccaggcagcgtgaggcgctcgcgtcgggcgacgagcgctacctcccggtccgcgacaagggcccggtcaggcgcttcgtccgcgattacgtggactctcgcttctgcatcgccgagtggttcctgccgctcgccgtgatcatcctgatcctcagcgtgatccaggtgcagaacatccagagcatctcgctgctgctctggctcggcgtgatcatcctgatcgtgatcgactcgatcggtctgtcgatgcgcctgaagaagcagctgcgcgagcgcttcccggacacgccgaagcgcggagccgtggcgtacggcctgatgcgcacgctccagatgcgccgactgcggcttccgaagccgcaggtcaagcgcggagagcggccctgagtacggaggcctccggcttcaccggggtctcctcggcgtggctggcaggtctcggcggcgtacgcaacaaggtccgtcaggagctcgtcgcgcggcagctggacgagcagatagccgggcggttcccggtgggacagcggctgcgcgtcctggacgtcggcatgggccagggcacgcaggcgctgcggctggcgcgggccggtcactcggtgaccggcctggagtcggacgccgggatgctgacggcggcccgggagaccctggcgaccgagcccgagggcatccgggaacgggtcaggctcatcgagggcgacggccgggacaccggtgtgcacttcctgcccggaagtttcgacgtggtgctgtgccacggcgtcctgatgtacgtcgaggagccggacccgatgctggccgggctcgcccggatgctggcccccggcgggctgctctccctgctcgtacggaacgcggacgcgctcgcgatgcgcccaggtctcgccggtgacttcggcgcggccctgaccgccttcgacaccgccacgtacaccaaccgcctcggcctcaccgtgcgggccgaccggctcgacgcgctgcgggccacgctcgcggggatcgccgcgccgctgcacgcctggtacggggtgcgggtcttcacggacaacgtggcggacgggacggagctggcggccgatgagctggagcgggccctgaccctggaggaccgggccgggcggattgacccctaccggggtgtggcggcgctgctgcatctgtgcggcgtgcgcggctagtacgggcgttccgggggcgggcccgttcggcccatcagttcgggcatccgaacggggcgggccccagactccggatatggatgtatccccctcccgcagccgggcgcgcaggctgctccttcccttgtccgcgactgtctgcgccatcgccctggcgggcggctgctccggtacgagtccggcggctccggcccccgaggccagtgcgtccggtacggcgcagggttcggtgaagcgctcccccgacgacctggagaacgcctaccaggccgtcatcaacgacgtactgccgtcggtggtgcagatcgacgcctcggagggcctcggttccgggatcgtctacgacggcaagggacacatcgtcaccaacgcccatgtggtcggcgacgagaagacgttcaaggtcagtgtggccaccggggaagcggtgctgagcgcctcgctggtctcctcctacccggagcaggacctggccgtgatcaagctcgacgaggtgccggacgggctgaagcccgcgaagttcggcgacgcggagaaggtcgaggtggggcagatcgtgctggcgatggggtcgccgctcggcctgtccagcagcgtcacccagggcatcgtctccgcgctcggccggaccgtgagcgagagcagggcgggcggcggcaccggcgcgacgatcgccaacatggtgcagacgtccgcggcgatcaacccgggcaacagcggcggggcgctggtcaacctcgacagccaggtgatcggcattccgaccctcgcggcgaccgacccgcagatgggcgacagcgcggctccgggcatcggcttcgcgatccccgtctcgatggtgaagacggtcgccgaccagatcatcaaggacggcaaggtcaccgattcgggccgggccgcgctgaacatcacgggccgcacggtcgtcgacgacaactaccgtcccgccggggtggcgctggtcagcgtggacccgggcggcgcggcggacgatgcggggctgaagcccggggacaccatcacgaagatcggggacagcgaggtcaccaccatcacctcgctctccgaggcgctggccggcgacaagccgggccagaaggtgaccgtgacgtacacgcgcgacggcgacagccggacggcggaagtcacgctcggggagatctgagcgctcgggaaatccgggcgatcaaggaaatccgggcggaagacgcccgaagggcgggtggtacggggagattcccgtaccacccgcccttccgccacccgcttccgcccgagtgtcaggcgctgtcggcctgcaggctcatcgggccgtagatcttggtggtgtcctcgaagagcgtcacctgtgcggcgccgccctccaggagctctttccagtactcaccgatccaggactccgcgtcgccctgggtggtgaactcctccggctgcagcgccggctccgtctccgtaccgtcggacttctcgaaccgccacgtccacgccatgccagcctcctgggtcgcgttgcttcccgaagcgtagccggacgcgcacctcgcgcggggacacgggaggatcaaggtgtggaactgactctgctcggcaccggagcccccgaagggctgccgcacccctcctgtccctgcgcggcctgcgcctcggcccgcggcccgtgggcgcgggccgcgacggcgctgctggtcgacgacgcgctgctgctcgacctcacccccggtgcggagttcgccgccgcccgcgcggggcattcgctgggcgcggtccggcaggtgctgctgacgcacccgcacgacgggcccgccctcgaactgcccgccgtgctgccacgggccggccgggtgccggacggccaggtcctgacgctgatcagcggacaccgggtacgggcgatggcgatggacgccccggggaccgggtacgaggtgaccgccccggagggcgagcggctgctgtacctgccgccgggggccgcccgatcacatcaaggacgaccatgtccacgggccggtccagctgctcgggcaggccggagggggcggcccccggcggcagg

SEQ ID NO: 3948 - DNA, 4501 bp, Unknown
  Kingdom: Bacteria, Phylum: Actinobacteria, Class: Actinobacteria, Order: Streptomycetales, Family: Streptomycetaceae, Genus: Streptomyces
aggctgacggagtccccgagagccgtgaccctcggggactccgtcagccttcggtcggagtggtggtcggagctaccgcgccgtgtggccgaaacgtgcgccggatgccgggagtccgccgacgccgggctggtacgtggtcaccggggcgaccgctccgcccgaggacacgttggagaccggcagggcgtacagggcgccgtgggcggagggaccgtacggcatgccgacgtacaggtgcgtacccgtgaagtggatgctcctgcccaggttctggcccgcgcccggggtgaccgggatgccgtcgccgtcgcccgcttcgagccagcggtcggtggcgcctgccgcgccgaagggcgagaaggtcgagatcgcgcccgcctgggcagccgttccgatggcctcgcccggcgcgccgacggcgatccgcatcgtgcccgtgcttccggcctctcgcggcgcggtgttgacgacgctcacggcctcgccgaagcggtccccggtctcggccgtgccggacacctcgtcgtcgccggtgcccgggttgagctcgcgcagataggtccaggtaccgccggcgtcgatacggacgaggatcgcccggcccgcggccgcccggtcggagccgtccacggtcatgtcctcaccgggcgatccgatcacgagcaccgaggccgcggactgcgtggcgcccgggacccggtagtccgccatggcgagggaggcgcccaactcgtcgccgggctcggaagcgccggagaccggctcggtgtcctggtcgagcccgccgacgacggtgggcacgccctgggcgttcggcgtgtggcggaacatggccaccccgccggagttcttgtcggtcccgatggcctcgccgggaacaccgacggcgatgtggtgcgcgtcgccggcgacgctggagccgaaggcgtcgtcggcctccacctcgccggggacgtcgggcttgtcctggtgcagcgtggtactggttccgccgcgcacgtagaaggccatgcccgctcccttggcggtgccgagggcctctccgggcgcgccgatcaggacccacggttcaccggtggaggtggtgccggcggcaagggagtggcccatgcggtcgcccgtttcgggggcggacccggcgattccaccggtacccgcgccctgctccaggtgcgtggccttctcggcgccggtgccgaggccgccgctcgcgccgtaaagcacgtcgacgaacccggcgttggccgcggtgcccacgtcttcggcgggggtgccgacgaccaggtccgtgtagccgtcctcgttgtggtcgacggtggccagggactcgccgaaccagtcgttggcctcggctccgccgggcacccagtcgaggtcctggttgatttcggcggtgcccttgccggcgccgtacacgacccggatcagaccggccgcggtgtggccgccgacggtggccttggggtcggctaccgcgatgtcctcgaccccgtcgccgttgaagtcggtgatacgggtgttcgcggtctcggccgcgacccaggacgacaggtcgtccacccgggcgaccacccccccggtggcggtcacggtctcgtcgaccccgaagcaacccccctggaaggaacggctgctcagggccgcgagggtggccgtgcctcccaccgatcggaccacggggccgccggagtcgccggcacaggcggcggccccgttcctgccggtgaccgccgccgtggtgggggtggccgagtcgacgccgtagacgccggtgtgcagcttcagcggcgaccactcgtcccgcgtacgcccgtatccggcgaacgtcagctcctcgcccgcggtgggggcggtggcggccagggcgatgggggtgacgtcggtgaccggccggttgaggcgggccaggacgacgtcccggtcggttcgcggcaccagttccacgatgcggcgctcggcgccctgggtgctggtcagatcggcgcggccgatgaccgccgtcgtcctcagcgccggagcccccgccggcacggccgtaccggcggccgggtcgtcggcgaagcaactggccgcggtgagcagccactcggcatcgatcagggtgccggaacagcctcggttgtggtcaccgacggtgatttcggccgtgtacgcgtaggtggtcccggcggcggtggtcccgccggcgacggcggaggcgggcgcggccggcagcacgagagaacccgctgccagggccgcggtcagcgcggcggcgcgcagagctgtcgtttgtcgcatgtgcagtcctttgtcggagattcgaagcaccggggtctccgggactacttggcggttcggatttccacgagcatgtgctcacggttctgctcgtccgcgctctcgcccaccgaggtccactcgttcttggtgatgtcgaacgacttcttctcactgccgacggtcatgtcgacctcggtcgtgtagtcgttgcccttgatggagtgcaccgccgggatttccatcgtcagccaccccgcatttccggtgacgcggaaacagatcttcttgttgtcctgtcggcgcgcccacacttcgatgaggccggtgccgccggcgcagtccaccaggacgatgtggccgtctccgcgcttcagcgcgatcccctgctccgcgaggatcttgtcggcctgcgggtagttgaagtcctccaccgcgtaacccggggtctcatcggcggccacggccaccgtgccgctcgccgccacgggtgaccctccggccagcgccagccaggccagtgctccgcccgcgacagcggtgcccgtgaccttcgccaggggtctcttccaccgcgacttcgtcctgattgcggtatgtgccttcactcgggtgcctcatccggtcgcatctcactcggtccgccaaagcggctggagcgagaacgacgacaagatgttcacgtcaaagcgaacccccccgggccttgctccgaagatccacttcggcgcggcaatattgccggtccgttcacatggtgtccaccgcatggatgcggcgaaaagggacgagcgagtacacccgcctgtgactcccgacaccgcccggaagggttgtagggctctccgtaaaggctgcataaaaaatgaaggagcgcgaacaggcgcggacgtggtgctcccgagcggtccggggccgagggccccggacccggtgatcgcgccccggggtcagaggacgatctggtctgttccctgttccagcttcgtgatcgcggcccggcaggcgccggcgaaacggtcgaagaccggggtcgtgctgccggcccggcccgcgcgggtgttgaccgtgaacatggcggcgcgcagctccgtggtcagctccagctgaccgcccttggcgagcatggtgcggttgaccgggttggcggggttgaccccggccaggtcgggcacctcgttcccgtcgcgccaggcgatgccgaccgcgtcgaactcggccatgagcagggtcttgaagcgggtgttcagccccccgacgaccacggcctccgggacggtgcccgcctgcgccgccgtacagccgtgcaggctcaggacgttgaggctgctcgccgccatggagaccgcgacgtggtcgtcgcagttcttcgcggtgacgtgcaggtcgcggttgccggaggagcgcagcccctcgaacatccagtagtcgaacaccccgtggccgtccgccagcggggcgagcgtggccgggtggtagccggcgatggcgaggcacagttcggaggtgccggtctcgatgccgccgccgtgcagagccatgacggtggtccggttgtacgggtatccctgcgggagggagtggtcggcgtactcgtgtctccggtagcggcgggcgaactcgacaccctcctggcccgcgagctttctgtagaggtcggtgttggaggtgtagatgtccagatcaccggtggcgtgggcgtcggtcgcggtgagcgagccgagcagcgggccgctgacggctgcggtggcgagggcggtgaggaccgtacgacggctggtggaagtcatgatcagcatcgtccccgacaccggcccggctgcacaggacgcctcctgtgccgtcggtcacggtccggtgggcccgacgcgctccaggaagggttccagcagtcctggtacggcctcggcggcgaaggcgagtccctcggcggtgtcggcgtcgtagaccgtgtaggcgcctccgccggcggcggtggtggccgtgatgctcaccagcccggcccggcgctggaagaccgactgcctgaccgtccagccgatcaccccggcgcgctccagggcggccgtggagcggcggaccgtgccggagcgggtgaccagatagcggccggagagcgcgtgcccgagcccccggaacgcgtccagggcgagcaccaccgccgcggggacggagaccgccgcgcagccgagcgcgatccacagcagcacgggcgtgaacagcaccccgaggacggcca

SEQ ID NO: 3949 - DNA, 3032 bp, Unknown
  Kingdom: Bacteria, Phylum: Actinobacteria, Class: Actinobacteria, Order: Streptomycetales, Family: Streptomycetaceae, Genus: Streptomyces
gacgtcggccggggccggggtgacggtgaccgccggccgctcgggcgcggcgtccagggtcacacccagggcgtcggcgagggcgtcggcggtgagcacgaggcccgtggaaccggtgcaggagacgacgatgtcggcacgtgtcagttcgtcaccgaccgcggacatctcgacggcccgggcacgcaccgcggtgtcgtcgccctgctggaggatctccaccaggcggtccgcgcgggagcgggtccggttggcgacgacgatgtcggcgacgccggtgcgggcgagggtcgcggcggccagcgaggacatggatccggcgccgatgaccagggcgcgcttgccggcggcccaccgctcggggtcggcccctgcggcgagctgctggagcccgaaggtgacgagcgactgcccggcccggtcgatcccggtctcgctgtgggcgcgcttgccgacccgcagggcctgctggaagaggtcgttcagcagccgtccggcggtgtgcagctcctggccgcgcgcgagcgcgtccttgatctggccgaggatctgcccctcgccgacgaccatcgagtcgagaccgcaggccaccgagaagaggtggtggacggcccggtcctcgtagtgcacatagagatacggagtgagctcttcgagcccgacgccgctgtgctgggcgagcagggtggacagttcggcgacgcccgcgtggaacttgtccacgtcggcgtacagctcgatgcggttgcaggtggccagcacggccgcctcggtcgcgggttccgcggcgagggtgtcctggagcagcttggcctgggtctcgacagcgagcgaggcccgctccagtacggagacgggggcgctgcggtggctcagtccgacgacgaggaggctcatgccggcatcacggcgggcatgtccccgtcaggtcccttccggctcgcgggcgtggcccgcatcgggggcgcgccctcgtcctcggcggcggagtcctcgccggccttgcgctgctcgtggaacgcgaggatctggagctcgatggagaggtcgaccttgcgcacgtcgacaccctcgggcaccgacagcacggtcggcgcgaagttcagaatggaggtcacaccggcggcgacgagccggtcgcagacctgctgggccgcaccgggcggggtggtgatcacgccgatggacacaccgttgtcgctgatgatccggtccaggtcgtccgtgtgctggacggcgatcccggccaccggcgtacctgccatggcggggtccgcgtcgatcagcgccgcgacccggaagccgcgcgaggcgaagccgccgtagttggcgagggccgcgccgaggttaccgatgccgacgatggcgaccggccagtcctgggtgagcccgagctcgcgcgagatctggtagacgagatactcgacgtcgtacccgacaccgcgggtgccgtaggaccccaggtaactgaagtccttgcgcagcttcgccgagttgaccccggcggccgtggccagctcctcggaggagaccgtgggcaccgatcgctcggagagcgcggtcagggcgcgcagatacaacggaagtcgggcgacggtggcctcgggaattcctcggctacgggtcgccggtcggtgagttcggccagttgccacggtgctcctgcgggatgagcggggctgcaggcggccgtatgtcccaggaccgccccgtcgaatgcaggctatgcctttgtgaacgcgtgcacaaagatagtgtccgttttgtctggtcaaagtgaccggggtcacgcacattccccgcgcgatcccggaaccggggaccgcatcagcccgttgcaacctcgaagggggcaaagcagtacacactcctcacagccaagcccccgaggccacccaaaacgcccacgatgttaaccgggtttcgcgtccgcacccagcgccttgcgcagcctcgccgggtccacgcgccagaacgtgtgctgttcgtcatcgatcagcaccaccggaatctgctcccagtactccttgtacagctcctcgtcctcggtgatgtccttctccacccacgacgcaccggtctcctcgcagaccgcgctcaccaccgcccgtgcgtcctcgcacagatgacacccgggcttccccaccagcgtgaccacccgctcggcgggcttcttcctcgtacgtcgcagcagagcactcatgccttcattctgcgcccgcggaccaccaccccggaccgcccggaatcaaccgattcaccattccgacccacagcgttcacgcccacgcatcgcggcaggtcgggcaggcacggacggactggctatgctcacggcatggccgctcttggatggctcacaccccgtaggcgttccgctaccgcacggagcgtcctggcaggcgaggccgccgccgaggccgcgcgcaagacctcggccgccgacgacgaatccgccctcctgaccaaggccccggaagaagcggacgcgacgcctcccgaggagcccgccttccccgtcgccggggacgaccgcgccgccgccttcttcgacctcgacaacaccgtcatgcagggcgccgcgatcttccacttcggccgcggcctctacaagcggaagttcttcgagcgccgcgagctcacccggttcgcctggcagcaggcctggttccggctggccggcgtcgaggaccccgagcacatgcaggacgcccgcgacagcgccctgtccatcgtcaagggccaccgggtgtccgagctgatgtccatcggcgaggagatctacgacgagtacatggccgaccgcatctggcccggcacccgggccctggcccaggcccacctggacgccggacagaaggtctggctggtcaccgccgcccccgtggagaccgccaccatcatcgcccgccgcctcggcctgaccggcgcgctcggcaccgtcgccgaatcggtcgacggcgtctacaccggccgactggtcggcgaacccctgcacggccccgccaaggccgaggccgtccgcgcgctgg

SEQ ID NO: 3950 - DNA, 1096 bp, Unknown
  Kingdom: Bacteria, Phylum: Actinobacteria, Class: Actinobacteria, Order: Streptomycetales, Family: Streptomycetaceae, Genus: Streptomyces
gtgtaggcgggggtgccgtccgggaggtggacgacggacggggtgcggggtgtgggcaggtggtccatgtggtgtcccttcgggtcagttggccgactcggcggcctggcgggcgatgtccctgatgccgtccagcagttcgtcgatgcggtcgagggggacgtacagggtggggctcggccccttcctgccggggctcgtatggatggcgaccacgggctgggcgcggtcggtgtcggggcggatggtgacggccttggcggtcagcgacggcccgtcaggcttgacggtgaagcggaaggtcatgaggtgccctttcaggacgacggagtgtcgtggcaggtgacgcacatgccgagcgaccgggggatgcaatagcccacgtcggttcggcagttgaggcaggtgcggcgggcccgcatcgccgcagcgagcgcagcagcacgggccggggtcatagggcggacgggcttggcgtggtcgacgcggtagaggtaggcgaccaacggggccttgcggcggcgggggcggtggagttcggcgacgacgtcctgaccacccggccgcagccccagcgctcggagctggcggcgggtggccaagccgtcgggggcgagacgccaccggtagatgtcggccatcaggcggccgctacgcgcttccacgcgcgccggagccggacttcggatgcggagtggccggcggctcggaagcgggtggacatctcccggtaggagagggccggggtctcgctgtgccggatctcatcgaccagctggtcgagttccgcatcggtgagtgcgggtgcggcttccagggcggggacggggttggtggggccccagacgggcagttcccatgtgggtgtgacgccgggtgtgacgcgggtcgtcacgctggtcagtgccctgcctgtgtccttcccggcccgggtgctctccagcgtcgaccaggcgcgggagagggcggtggcggtctgtgcctggacgcgtgcgacgcgcgccccggcctgcgtcacggccgtcagccgcgtctcctccgtgcccgcctcggcccccagccgggcacggaggagacgcggctgacggccgggacg

SEQ ID NO: 3951 - DNA, 1141 bp, Unknown
  Kingdom: Bacteria, Phylum: Actinobacteria, Class: Actinobacteria, Order: Streptomycetales, Family: Streptomycetaceae, Genus: Streptomyces
gttcacaccacgtccgcacgggggtcgtcgcgccttgcgatcgtccctgcggaagaccatcacgcgggaggggacggtcgtggccggtgcgggcacgggagcggccgccgggggcgcggcggcgtgtaccgggagcgggccgctgccgtacacctgcgcgcagccgggggacctgatcgacgtccatctcggcgagctgcacccgacgcaggccgtactcggcttcgaccaggtcttctacaagctcggccggtacggcagcgaccgcgacgaggcggcgggcggcgtcaacaagcgcttcgacgactggtgcgagaccaacggccaggaggaggcggccacggccggccccggagcacggctggacgatccgtcgagcttctcctgcaccgtcccggtcgggcaggagacggccgagacgatcgagccgatgaagacggccgtggtcggtccgggcggcaagctgtacctcaccgacgggcaccacacgctgacgtccttcctggagggtcccgacggctccaccgacctgcggatcaggctccgcgtcaccgacaacttcagctccctgtccaccccggcgttctggcagcggatgaccgagcagaagaaggtgtggctgcgcgacgagaacaaccgtccgctcggcgtggaccggttgccggaccgcctcggcatcacgcacttccgcgacgacccgtaccgcagcctcgtctacttcacccgggacatcggttacgaagtcccggacggcgccacggagttcctggagttctcctggggggcgtggctgcgcggcgagcacgacacgagcgcgtacgacctgacggccccgggcccgtacctcgacctggtgaagggtgcctcgaagtcgatggccgcgctcgcacccgacgcggtcgtcgacgacgggaggaccgccgctcagctcggccggatcgaggcgtggaacggcggcaagaaggagaccggcggggagttcgccaagctgggcaagccgctgagcgaccccaagccgggcaagctcgccgaggccctcgaccacaaggcccgcgtcctgcccacccccgcctgcacccgcacggtcaccggcccccgcaacggtccgctgaccgtcaccggcggcgtcacctgcctggac

SEQ ID NO: 3952 - DNA, 885 bp, Unknown
  Kingdom: Bacteria, Phylum: Actinobacteria, Class: Actinobacteria, Order: Streptomycetales, Family: Streptomycetaceae, Genus: Streptomyces
gggcagggtgcacgggggcggtcgggtccgggagatcggcgcggcgcaagcggtcgaagccgaggtcgagcgtgccctcgccggaggggtgcgaacaggcgaggagagtgagccgggggtggggggccggcaccaggcggccgatgatcctcagccgtgtccccggcgccgtggccagcagcgccacgttgtcgcggtgggccagcgcggggtcgtcgtcggcgacggtgagccggacgggaatgcctccttcgcaccgagcgagcaggcaggagccgcccgactcccgtaccgcgccgaggagttcgacgtccaggaagagcaggtcgctgccgccgccgtccgggtccgcatagcgggaggtggaccgcagggcgcgagcggcctgttcggacggcggcgtctcccacagggcggcgagcggcggctccgtccacgccgcaccccgtgcggtgacggccttgacgcccttccccgcgcccagtctgccgtccggcgataccgtcgcccccgcgaccgccaggccggcccggcccagctcccggtgggtgagcgcgctgtcccccagccgcacggtccggtcggccacgcccagggcgcgtccgacgccgccgggtgccacatcgccgaccgtgaagagacggccgtcggatccggcgacccaggtgcggacgccgccgtgtcccgagtcggtgaccacgggttcggtgaacaggccgtacaggcgcagcgagccgtccgggctgtacgggcggcgcgcgcggcctcgggctgcggccagctccgccccggacgacgtacccacccggtgcgcggtgcccaggagttcggccagggccgtgaccaggtcggccgtgcggtaggacgggtccccggcgcgtgccg

SEQ ID NO: 3953 - DNA, 3248 bp, Unknown
  Kingdom: Bacteria, Phylum: Actinobacteria, Class: Actinobacteria, Order: Streptomycetales, Family: Streptomycetaceae, Genus: Streptomyces
tcctggtcgacggcgggatcgccggggcgtacgtcaccccggtctgatcccttcggtctgccgacggcccgacggactgccgacggccctgcggtctgccgacggccccggcggccggacgttcgtggacgtccggccgccgggtcgccgttcagcccgcggaaacggccggatcgccccggaggcgccgggcgcggagcaccaggagcatctcgaagcgctggtccggttcgtcgatggcgtcaccccacagctcgcggatctgccgcagccggtagcgggccgtctgggggtggatgccgaggcgggcagccacctccggagcgccgccgggggtctcgatccaggcgagcagcgtctcggccaggcgccgggcctgggtcgggctgaggccgtccagcggggcgaggcagcggcgggcggacgcgtcgatcagctcctcggcgggaagcagcagcagttcctccgtccgctcggtgcagtacagcacctcgccctgcggcagcaggtccttcttgatcagctggaccgcggtctccgcccagcgcagcgaggtggccgcggccgccagcgggaccgccgggccgatcgccccggaccagccggccgtggcccgccgcagaatctccgcgcggcccgccgtgtccgggtccgggatgacgatgcgcggctgctcgctctccatctccagcagaatgccctgtccgaccgcgggggccacggcctcgcgggccgggcgcatgagcacgcccacggagatcgtctccggcagctcccagccgatgcgggcggcacgctcggccagggccacggacacgtcgccgcggtgttccaccaggaggagctcgatcagctggcgctggaggcggagccgttcactggcccgccgggccgccgcctcggcgtagccccgtaccgactgttccacgagcccgtccagatactcgaatcccgattcggccagctcgtacatggcgggcgcggggatgtcgacctgctggccgatctcggcgagcctgcgccaggtgagccggaccccgaggcgatagatggcctggagtgcgtcgaggctgcggccctcaagaccctcgccccgtccgaactcctggaacatctccggcggcacccgtgggtgggcgccggccgtgaggttgtggacgaagccttcgatggcgcggcggatgccgacgagcgccagcggttccccggattcgtcctcgaccaggtgcagatagggatattcctggcgaatctggtacaggatcgtctgagcgagctcgggggcctcggaccgggcgatcgcctcgaaacggtcgagcttcgaccgggggacgtcctgccaggccgggcgggtcacggagccgccggggcggtgtcatagctgatcaggggcgtattgggctggtcgggagtggcgtcgagcagtgccacgacaccgaccgccgcgccaacggcgagcgtgccggccaccaggacggtgacagcggcggcgatgagtctgcgcatagtcgggtcagctccttgctggaggcgatccccacccctgcagccgggcccctccggctgggacacagtgtcgacagcacattgacattccgtcaagggcttgcttactgttcacgccaatcgagggctgaccggcccgggcccgtgcacctccgcgaagagattcgacccaggagtgcccggatgcgccacaacgcttcacccctgtcgcttgtcctgctgggggcaggggttttcctgctcgtcctcgcgccgctgctcgtctggtacgtccagccgcatgccaagcgcacccccatcgacatcgacaccaccaccgtcttcaccgggacgggcagctatttcgacacgtccgaggtggagacggtcgagggcagaacgatcacgatcacgcggcaggtgcgcggggacgtggccgacagcgagaagagcggcaacgccgtgtgggacgtctccacctcggtcgaccaccagggcaccctgcccgcctccgacccccgtgacgccctccagtggacgctggagcgctgggtgaccgaccggaccacgaacgagccggtccactgctgcgaggagtccccgacgttcgacggggaggcctacctcaagttccccttcgacgtcgagaagcgttcctaccgctggtgggatggcacgctcggcggggtcgtacggctctcctacgccggtgagcaggaggttcagggctactccggtctgctcttcaagggcgaggtggagcccaccaggaccggggtgcgccaggtgccgggactgctcgtggggaagaagaagatcccccaggtgctggccgaggagtggtattccaacagcggcatcgagctggtggtcgacgagcggaccggccgcatcatgaacgcggcgatcggccctcggaagacgctgcgcgccccgggctccgcgaaggacgccgtcgtgctcctggagagcaagcgggtggagttcaccgaggagacccagctcaagcaggtcgagctggcgtcggcggacagcgaccggctggagatgctcggcacgaccgcgccggccggtgcggcggggctgggcggtgtgctcacgctggcgggcgtcgtgctcctcgtacggggccgccgaacggagccggaaacgccgaatactcacatgatgacgattccgcacacctgagttaccggcaagttgttgcaccggtgagtagccgggcgcgtacccgtgccgaaaactgtctatccccaccagagcacggccccccggtctcgtccccgtccgtccctctcctcttcacttcctcatcaccctcatcaccctcatcgcctcttctctcccatcaccctgttcgatccctcgccccgaagccgggtccccggcccggtgcacccctgtcccggccccccggtacgtccccgctccaagcggccctcgacccgagggccgctcccccgatcgcccgcctcccgagccgagttggagcacccatgccccagcacgtccctcccccactgcttgacgccgtcgcgcgtccgggtcagggcccggcgcctgccacggttcccgcaactccgagacgcatcgtcttcctcgcccaccgcgacctgggcaatccggccgccggcggctccgagctgctcgtcgaccagctcgccctgggcctcaccgagcagggccacgacgtcacgctgctgtgcggcggaccggccgcccgccgtccctaccgggtcgtctcggcgggcggccggtccgcc

SEQ ID NO: 3954 - DNA, 789 bp, Unknown
  Kingdom: Bacteria, Phylum: Actinobacteria, Class: Actinobacteria, Order: Streptomycetales, Family: Streptomycetaceae, Genus: Streptomyces
tgcccagcgccaccagtagcgtcaccacgacgaacaccaccagccgctggcgcagcagccgcggattggccggccgccgccccgccgaggtcgtgcgacccccggagcgggtccccggccgactgttcgtcccggccggagacccctgccgcttcccggaacgcgtcgtgtcgcgcgacgcctgctgcggacgcgagccaccggtgcgcggcggccccgaacgcgcgggcgcgccgcgcctgctcggctgggggcgggaggcggacggaccctccgaacggcgggtgtgctgatcggcgtacggatcggccatccggccggtcggccggtcggcgtcctgggcggagcgctggacgggcggccggctctcatgcagaccctgcgcctcgcgcgccgcgatctccttgagccgcatggacagttgcagcgtgctgggccgctcctccgggtccttcgccagacaggcgctgatcaggggagccaacgcgtcgtgcactccgtggagctgggcctcctcgtgcacgacgcggtacagcatcacctcggaactgccgtgtccgaagggggagtcggccatcgccgcgtacgccagcgtcgcgccgagcgagaagacgtccgtcgcgggagtcacggccgcgccccggacctgctcgggcgcgaggaacccgggcgatcccaccgccgtaccgacatgggtgagcgtgctcgccccggtcgcccaggcgatgccgaagtcgatgatgcgggggcccttgggggagaggaggatgttcgacggcttcaggtcgc

SEQ ID NO: 3955 - DNA, 3888 bp, Unknown
  Kingdom: Bacteria, Phylum: Actinobacteria, Class: Actinobacteria, Order: Streptomycetales, Family: Streptomycetaceae, Genus: Streptomyces
aagaccgcgggccgcgcctgaccgcacgtctgcgcaggcgcccggtgcccccaggggtgccgggcgcctgcgcgtgtccggcatttcccgttcgaacagggctgcccgatgcccgccgccgcgagcggaacattagactcatcggatcggcacgctcgatcagctcaaacgcaaggaggcacgggtggatctgctgacccgcatcaagggaccgcgcgacctggaccggctcagcctcggtgagctggaccagctcgcggacgagatccgcaccttcctcgtggacgcggtgtccaagaccggcggacacctcggccccaacctgggcgtcgtcgagctcaccatcgccctgcaccgggtcttcgagtcgccccgggacaaggtgctctgggacaccggccaccagagctacgtgcacaagctgctcaccggccgtcaggacttctcccggctcaagagcaagggcggcctctccggctacccctcccgcgccgagtccgaccacgacgtcatcgagaacagccacgcctccggggtcctcggctgggccgacggcctcgccaaggccaacgaggtcctgaagaaggacgaccacgtcgtcgcggtcatcggtgacggcgcgctcaccggcggtatggcctgggaggcgctgaacaacatcgccgccgccaaggaccgccccctcgtcatcgtcgtcaacgacaacgagcgctcctacgccccgaccatcggcggcctggccaaccacctcgccacgctccgtacgaccgacggttacgaacggttcctggcccgcggcaaggacatcctggagcgcacccccgtcgtcggccgcccgctctacgagacgctgcacggcgccaagaagggtctcaaggacttcatcgccccgcagggcatgttcgaggacctcggcctgaagtacgtcggcccgatcgacggccacgacatcgaggccctggaatcggcgctccagcgcgccaaacgcttcggcggcccggtcatcgtgcactgcctcaccgagaagggccgcggctacacccccgccctccaggacgaggccgaccgcttccacgcggtgggcaagatccacccggacaccggcctgccgatctccacctccggcctcgactggacctccgtcttcggcgaggagatggtcaagctcggcgaggagcgcgaggacatcgtcgcgatcaccgcggccatgctccagcccgtcggcctcggcaagttcgaggccgccttcccggaccggatctacgacgtcggcatcgccgagcagcacggcgccgcctccgcggccggcctcgccaccggtggactccacccggtcttcgcggtctacgccaccttcctcaaccgcgccttcgaccaggtcctgatggacgtcgccctgcacaagtgcggtgtgaccttcgtcctggaccgggccggtatcaccggcacggacggcgcctcgcacaacggcatgtgggacatgtcgatcctccagtgcgtgcccacgctccggatcgccgccccgcgcgacgccgaccaggtccgcgcccagctgcgcgaggccgtcgccgtcgacgatgcgcccaccgtggtccgcttctccaagggcgcggtcggcccggccgtcaaggcggtcggcaaggccggcggcatggacatcctgcgcgagccgaaggccgcccgcccggacgtcctgatcgtctccgtcggcgcgctcgcgccgatgtgcctggagatcgccgacctgctggacgcccagggcatctccagcaccgtcgtcgacccccgctgggtcaagcccgtcgacgaggcgctcgccccgctcgccgagtgccaccgcgtcgttgtcacggtcgaggacaacagccgcgccggaggcgtcggctccgccgtcgcccagtccctgcgcgacgccggggtcgacgtacccctgcgcgacttcggcatcccgccggtcttcctcgaccacgcctcgcgcggcgaggtcatggccgagatcggactgaccgcgccggacatcgcccgacaggtcaccggcctggtcgccaagctcgacggccgcttcgagagccgcgcggtggagcccgtccgcgactgacgcgctcacctccgtacggccgatgggccgggagagccgcccctgtacgggtggttctcccggcccatccgcgtgaaacgggccagatggcgcgttcatgtgcggcagcgtccccatcatggcgttcacaaccaatgcgtggaggtatcgcaggtgagcgcgcaggtcacaccaccccgcggaaacggcatgttccgcaccaagtccgtcgaacagtcgatcctggacaccgaggagccggaacacgcgctcaagaagtccctctccgccctggacctgacggtcttcggggtcggcgtcatcatcggcaccggcatcttcgtcctcaccggacaggtcgccaaggagacggcgggccccgccaccgccatcgcgttcgccgtggcgggcgtcgtgtgcgcgctggccgcgctctgctacgccgagttcgcctccacggtccccgtggccggctccgcgtacacgttcgcgtacgccgcgctgggtgaactggtggcctggatcatcggctgggacctggtgctggagttcgcgctgggtaccgcggtggtcgcggtcggctggtccggctacgtccgctcactgatggacaacgtcgactggacgatgcccgaagcgctctcgggaccggatgtggcggaagggttcggcttcgacatcctggccttcgccctggtgctggtgctgaccgtcatcctggtcgtcgggatgaagctgtccgcccgggtcacctccgtcgtggtggcgatcaaggtcgcggtggtccttatggtgatcatcgcgggcctgttcttcatcaaggccgagaactacaagcccttcatcccgccggccgagaagcagcccgccggctcgggctgggacgcgccgctcgtgcagatcctgttcggctacgaacccacgaacttcggcgtgatgggcatcttcaccgccgcctccatcgtcttcttcgccttcatcggcttcgacgtggtggccaccgccgccgaggagaccaagctgccccagcgcgacatgccgcgcggcatcctgggctccctcgtcatctgcaccgtgctctacgtcgcggtctcgatcgtggtcaccggcatgcagcactacagtgaactctccgtcagcgccccgctcgccgacgccttcaaggccaccgggcaccccttctacgccgggctgatcagcttcggcgcggcggtcggtctcaccacggtctgcatgatcctgctgctcggccagacccgggtcttcttcgcgatgagccgtgacggcctgctcccgcgcttcttctccaagacgcacccgcgcttccgcacgccctaccgcccgacgatcctgctcggcgtgctgatcgcgatcatcgccgggttcacgagcatcgaggagctggccaccctggtgaacatcggcacgctcttcgcgttcgtcatcgtcgccctcggcgtcctggtcctgcgccgcacccagccgaacctgccccgtgcgttccgtaccccgtgggtgccggtactcccgatcgcctcggtggccgcctcggtctggctgatgctcaacctgccggtggagacctgggtgcgcttcggtgcctggatggtcctcggggtgatcatctacttcgtgtacgggcgctcccacagccgtatggccgagcgggcgcgctgacgtccgtgccgggccgggtcctcacggagcgacctcgcccggcgcccgcagccccacctgtccggccaggaacgcgaggcactcggcctccagcgccaccacgcgcgagacggcgcgggcgccgggcgaggtcg

SEQ ID NO: 3956 - DNA, 1767 bp, Unknown
  Kingdom: Bacteria, Phylum: Actinobacteria, Class: Actinobacteria, Order: Streptomycetales, Family: Streptomycetaceae, Genus: Streptomyces
cgggaggcccggcggcgaccacggccgcgcgttgcggccgcctcggcctcggcgggactgctgtagaactcctcgtcggctgcgacctcgggttccacggccaccgggacggcgacctccgcggccagctcggcctcggtctcggcgggttcggccgcgtgctcgtcgtggccgtgctcgtggtcctgaccgtgctcgtggtcctggcccgcgccgccccggccgcgcttcttggacttcttgcccccgccaccgccgccgacggacgtcggctgctccatgtggacgatgacgccgcgcccgttgcagtggacgcaggtctcggagaaggactccagcagaccctggcccacccgcttgcgggtcatctggaccaggcccagcgaggtgacctcggcgacctggtgcttggtgcggtcgcggcccaggcactccaggagccgccgcagcaccaggtcccggttggactccagcaccatgtcgatgaagtcgacgacgacgatgccgccgaggtcgcgcagccgcagctggcgcacgatctcctcggccgcctccaggttgttcctggtgacggtctcctccaggttgccgccctggccggtgaacttgccggtgttgacgtcgacgacgatcatcgcctcggtcttgtcgatcaccagcgaaccgccgctgggcaggtagaccttgcggtccagcgccttcatcagctgctcgtcgatgcggtacgtcgcgaagacgtcgacctcggaggtccagcgcgacagccgctccgtcaggtcgggcgcgacgtgcgagacgtaaccgtggatggtctcccacgcctcgtcgccgctgacgatgaccttggagaagtcctcgttgaagatgtcacggacgacccggacggtcatgtccggctcgccgtagagcagcgtcggcgcgttggagccgctggtgcccttcgccttcttctggatgtcctcccactgcccctggagccgctcgacgtcacggcgcagctcgtcctcgctcgcgccctcggcggcggtgcgcacgatgacgcccgcgtcctcggggacgatcttcttgaggatggtcttgaggcgcgagcgctcggtgtcgggcagcttgcggctgatcccggtcatcgagccctcgggcacgtagacgaggtagcggccgggcagcgagacctggctcgtcagacgcgcgcccttgtggccgatcgggtccttggtcacctggaccaggaccgactggccggacttgagcgcggtctcgatgcggcgcggcccgtgggccatgccgagcgcctcgaagttgacctcaccggcgtacaggacggcgttgcggcccttgccgatgtcgacgaaggcggcctccatggacggcagcacgttctggaccttgcccaggtagacgttgccgacgtagctggtggcctgctccttgttgacgtagtgctcgacgagcacgttgtcctcgaggacgccgatctgggtgcgctcgccgctctgacggacgaccatcacccgctcgacggcctcgcggcgggcgaggaactccgcctcggtgatgatcggaacccggcggcggccctgctcgcggccctcgcggcgacgctgcttcttggcctccatacgggtcgagcccttgatggactggacctcgtcgaagccggtgcccggctcgcgctcctccttcttgcggggttcgcggaccttgacgaccgtacgctccgggtcgtcggcggtgccgtggtcggcctcggcggcggcgtcaccgctg

SEQ ID NO: 3957 - DNA, 530 bp, Unknown
  Kingdom: Bacteria, Phylum: Actinobacteria, Class: Actinobacteria, Order: Streptomycetales, Family: Streptomycetaceae, Genus: Streptomyces
gggacgcgctcgtccacgccgtggaagaggcggccgtagtccaggtcgtgcgggagcttcaggcccttgaaaccgaagcagcggatgcccaggtgggtgaaggccttggcgtcggtgccacccgggttgcagtacgggacggggtgaccgtccgggtcctcggcgcggacggcgtcgcacatcgcgtcgacgagcgggccgtcgaacgtcgtctccatcgcgatgtcgtggttgacccactcgcggctgacggaggggagcaggagccggtcgatcgtgtcgatcagttcctgctcgtgacccgggaggaaacggccgtcgacgcgggcggtggccttgccggggatgacgttggtctggtagccggcggtgaacatggtggggttcgccgagttgcggagcaccacctgcatgaagtccgcgaccgggccgagacgggcgaggctcgactcgatgtcgttctcgtcgaactcgacgccgtagagccgggcggcctcctccagtagggcgcggaccggctcgatcagccg

SEQ ID NO: 3958 - DNA, 3583 bp, Unknown
  Kingdom: Bacteria, Phylum: Actinobacteria, Class: Actinobacteria, Order: Streptomycetales, Family: Streptomycetaceae, Genus: Streptomyces
ggggcggtgggcgaccggggcgcgcgggcttatctgcgggagcaccgcgatgcgatcacgctcgtggagtgttcggatgtggccgaggcgtacgacatcgacacctcgcaggatctggagcacctggagtgaccgtgcggaagcccgctcgccgcgaacagtgcgtgcctgcggcggcacgccgcgccgcagtcggcgcgtttctgtcgacccggagaatctcgacatcaacaaaccattgaacttccaccatgaggaaactactatccactggtcagaagccctctgaacctcagacggcacccacggccgtatctcggagccatggcacgccgtgccgtctcaggcgacccggcggccatgagacgccgccgcccgctgaaggagtgacagctcatgtccgcaccagcgccgtccacgctggccatcgtcgatgccgagcccctgccccggcaggaagaggtcctgaccgacgcggccctcgcgttcgtggccgaactgcaccggcagttcaccccgcgccgcaatgagctgctcgaccggcgcggtgagcgccgcgccgagatcgcccgcacctccacgctggacttcctgcccgagacggcggcggtccgcgcggacgactcctggaaggtcgcgccggctccggccccgctgaacgaccgccgggtggagatcaccggtccgaccgaccgcaagatgaccatcaacgccctgaactcgggcgcgaaggtctggctcgccgacttcgaggacgcgtccgctcccacctgggagaacgtgatcctcggccagctcaatctcaccgacgcctacgagcgccgcatcgacttcaccgacccgaggtcgggcaagtcgtacgcgctgaagcccgccgacgagctcgccacggtcgtcacccgcccccgcggctggcacctggacgagcgccacctccagctggacggcaccccggtgcccggcgcgctggtcgacttcggcctctacttcttccacaacgcgcagcgcctgatcgacctgggcaagggcccgtacttctatctgccgaagacggagtcgcacctggaggcccgcctctggaacgacatcttcgtcttcgcccaggactacgtcggcatcccgcagggcacggtccgtgcgacggtgctgatcgagacgatcaccgccgcgtacgagatggaggagatcctctacgagctgcgcgaccacgcctccgggctgaacgccgggcgctgggactacctcttctccatcgtcaagaacttccgtgacggagggcccaagttcgtcctcccggaccgcaacgcggtgacgatgaccgccccgttcatgcgggcgtacaccgaactcctggtccgcacctgccacaagcgcggcgcgcacgcgatcggcggcatggccgccttcatcccctcgcgccgcgacgccgaggtcaacaaggtggccttcgagaaggtcaaggcggacaaggaccgcgaggcgcacgacggcttcgacggctcctgggtcgcccaccccgacctggtcccgatcgccctggcctccttcgacgcggtcctcggcgagaagcccaaccagaaggaccggctccgcgaggacgtctcggtggctccgggcgacctgatcgccatcgacacgctcgacgccagcccgacctacgacggcctgcgcaacgccgtcgcggtcggcatccgctacatcgaggcctggctgcgcggcctgggcgcggtcgccatcttcaacctgatggaggacgccgccaccgcggagatctcccgctcgcagatctggcagtggatcaacgcggacgtggtcttcgagaacggcgaacacgccacggcagacctggcccgcaaggtggccgccgaggaactggccgcgatccgcgaggagatcggcgaggagaccttcaccgccggcaagtggcagcaggcccacgacctcctgctccaggtctctctggaccaggactacgcggacttcctgacgctgccggcgtacgagcagctccgctgacctctccgtacgagcaccgcccccgggaccgcgcggtgccgggggcggtggtgttcccgacggggatcacctgccccactccgccgccggctcggcgcgtcgggcgagccggccctctggcctgctgggtccgaggcaccctgggggaggcgcgccgcacgcctggaaaacggcggccgggcggacctcagtccgtcaggacgactgtccgctgggccgagaagtcaccccacttgccgtccgggagcttggccctgagcttcaccgaatagcgggtgcccgccgggtcggagaggttcagccggtaggtggcgcgacccttgggaggcgtaccgccccagacgatggtggtcgtcggcttgccgttcagatagagctcgtaggcgggaaccactccgcccgtctcgggctggtcccaggacaggtcgagggtgaactcggcgccctccttgccgacctcggtccgcagaccggtgggggcggtactcgcgggggcgccgggggcggactcggtggtgaggtcgagcacgttgctgtcggccgaggacttgtcggaggcgtcccgggcccggacggtgaaggtgtagacggtccctgggcgcagacccgtgagcttcgccgtggtctcggaggccgggacgctgtggatccgggagtcctcctggtagacgtcgtacgaggtgacgccgacgtcgtccttggacgcggcccaggtgagggtggcggcacggctgccgtcggcgctgcccgtcagcctcgccggggcggtggggggcgtgtcgtccttgggcggggtggcctgagtggtgacggggacggccttgctgggcgcggagaggttcccggccgtgtccttggtccggacgctgaaggtgtagtccgtcgaggccgtcagcccgtcgacgtcgatcatggtcttcgtcgccgggacgctcttgaccttggcctttccccggtagatctcgtatccggcgaccttctcgttgtcggaggcgccttcccacatgacgtgcaccgaggtggagctgctggcctgagcggtcacaccgccgggggtgccgggaggctgcgtgtcggcttcggcggtgccaccgcaggcggacaggaggggggtgagaagcagggcggaacaggtcaacgcggcagatatgtgggggcgttgcacggtggtgccttccgtccggacagcaatggtccagacctgtatgccatggcgcgggggtcgccgacaagaggacggcgcggaaccttccgctatgtgatggtgtgcgccgcccgcgggtcacggagcgatgagttttcggtggtcgaggtgtcttccctgtatggacgcacaggagaaccccgtctcggacgccgctgcccttccggacctggagccggccgcccggcggatcgccgcgctgctcggtccggtcgacgacagccggctggacggccccaccccctgccccgactacgccgtgcgggagctgctcggccatctcaccgggctggccaccgccttccgcgacgcggcccgcaaggatctcggggcgagcaccgccgtctccccggacgccgcgct

SEQ ID NO: 3959 - DNA, 878 bp, Unknown
  Kingdom: Bacteria, Phylum: Actinobacteria, Class: Actinobacteria, Order: Streptomycetales, Family: Streptomycetaceae, Genus: Streptomyces
cctcaccacccgcatgcggcgccacgccgagggcctcgtgatcctctccggcgccgccccctcccgccagtggcgcaagcccatccagctgatggacgtcgtgcgggccgccgtcgccgaggtcgaggactacgaacgcatcgaggtccggcgcctcgcccggatcggcgtgggcggacccgccgtggccgacctcacccacctgatcgccgaactcctggagaacgccaccgtcttctcacccccgcacaccgcggtccaggtgcacggtgaacgcgtctccaacggcttcacgctcgaaatccacgaccggggcctcggcatggcccccgagatcctcctcgacgccaacctgcggctcgccgagactcccgacttcgagctctccgacaccgaccggctgggcctgttcgtcgtcagccggctcgcccagcggcagaacgtccgggtctccctgcagaaatcgccgtacggaggcaccaccgcggtcgtgttcatccccgcggcgctgctcaccgacgcccccgacacccacggcaccgggttccgcctcgaccgccgggccgagcgggcgatcggcagcggacggagccccgacgcggcgcagggcgcgcagagcacggccccgggcggggagcgccgcgtcaacggcaggtcggtggccctgtctccggtgcccaccgggctcaccggaccgggggtcctggacgggccggtcgagctggaggccccggtcggcccgctggacttcgccggcgacccgctggaccgttcgccggatccggccctggatccggctctcggacccgtcctggacggcgtgtccgacctggaggacaccgagagcgagcgcggcggcatcttccgcgcccgggacc

SEQ ID NO: 3960 - DNA, 1273 bp, Unknown
  Kingdom: Bacteria, Phylum: Actinobacteria, Class: Actinobacteria, Order: Streptomycetales, Family: Streptomycetaceae, Genus: Streptomyces
cgcccaggagtcgctctgtgacgtacggaccgttcctctcacgccgcaccctgctgaccgccgccggcgccgtcggcctcgccggggccctgcccgcaccggcggcacttgcctcgggcatcgcaccgagcctcgcggccctgcccccggtcacccccgaccggcgtgccttcgccgccgacgaacagctgtacgccccttatctggtgagcctggccgccatgaccggtgacatcaggaccggccccccgaacgcgggtttcctgggcggcggctggtggcgcaagccttcggagccgtacaacgcccgggtgcaggagcacgtctacaccctcgcctggttcctcaccaactcccgcccctggaacccgtaccgggggaacaccgaactgctggcggggctggactcggcgctcggtcactacctggggctccagcatccggacggctcgtggccggagtacggccctgacgagcactccctcgccgccaccggcttcgcactgggctacctcagcaagacccatgtgctgctcaaggacgcgaagctgctgcccgcccggcgcacccagatcgcccgtgcgacgcacgccgcgatgacctggctgctcgacccggccaacgggcgcgtgtggcagaccccgatctcctatgccaaccaggtcgcggccgggctggcggggtccgccctggctctgcggaccaatcccgacacggctctgcgcacggggttgaacaacgccttcgcacggatcgcccagcacggacagggtccggccggcttcttctacgagaagggcggcacggacatgaactacaacttcgaggtgatgctgcccgaactggccgacgcctggcgtcagtcgcacaacgcccatctggtgacgatggccggaaagtacgccgactggctgagctacaacctactgcgcgagcccgacggttcgggctggttcagtaacgtcgcaccctcgaccaggaccagcgcgctcgcctacgacgacacacgtccggaaccggaacgcaccgcgctcaacgcgcagttcacgccggatgtgccatcgctcggagcgttcgcctccgcccgcgaggacctggccaccgcccgcaccgcctgggccgcggacacctcgccggtggcgggcctgaccaagcaggacacctcaccgcggatcctcgcccacgcgctctacggcgagcggaacccgacccggaaggccaaggccgaagcggtgagggccctgccctacatcgcctcggagaacttcaccga

SEQ ID NO: 3961 - DNA, 936 bp, Unknown
  Kingdom: Bacteria, Phylum: Actinobacteria, Class: Actinobacteria, Order: Streptomycetales, Family: Streptomycetaceae, Genus: Streptomyces
agcgcgggtggggggcggggatggccgcgttcgtcgccatgacctcgtgggagggcgagttcaccgacgcgtacttcgcacagcccgaagccgaccccgccgcgttcggcttgcccaccgaggacgacggcacgcgcggtgacccgctgctgtccgaccggtcctgggcgatcagcgactaccggccggacgccgacgccctcgccgcggccgacacccgtgtggtgatcgccgtgggcgaggagtcccggaacgtgcagaccgggcggacgtccgccgcgaccgccgaactgctcgggcagcgggtgaccgtcttcccgagccaccacggcggcttcctcgacggggagttcggctatccgggaaagccggacgagttcgggcagcggctgcgggaggtgctcgacgcctcgtaaggccgtccagcgaacgtgcgtgccaggcgtcgccgagcaggcggggcagcccttagaaccccagccgggccactctccccttctcgcccgccgcccagcagcccaggtcgggcgtgcagtcgacggtgtcgtacgaaccggagtcgaccgtccgccaggtgcggccgccgtccagggtgaggtcggtgcccgtcgggccgacggccagggcggcggagcggctgtggggcagccaggcgacgccggagcggtaggcgggcggcggggtggcggacgcccgccagctccggccgccgttcccggtgacggcggcggccttcggggaggcctggtcggggcggtagtccccgccgacggcgatgccgtgctcccggtcacggaaggcgacggcgaagaccccgcgggccgggtctcccgccgggagggtcgacgtgctcgccgtccaggtcaggccccggtcccgggagtgcaggacccgggcggtcgccgctcccccggtggtcagctccggccccaagga

SEQ ID NO: 3962 - DNA, 1384 bp, Unknown
  Kingdom: Bacteria, Phylum: Actinobacteria, Class: Actinobacteria, Order: Streptomycetales, Family: Streptomycetaceae, Genus: Streptomyces
gggtggggatccgctaaggtgggcgtcagcccctcacgtggcgctatctgactgaactcccccagggccggaaggcagcaagggtaggtcggctctggcgggtgcgtggggggccctttgcgttccgggggcgtggtcgccaggggtggtgccgggcggctccgggtgctgtgcggacgtccgggggtgtggggttcgggctgtgtggggccggttgtcagtcggccccgataacctcgtaggtgtgtcgtcccttgcgctgtaccgccgctaccgccccgagtcgttcgccgaggtcatcggtcaggagcatgtcactgacccgctccagcaggccctgcggaacaaccgggtcaatcacgcgtacctgttcagcgggccgcgcggctgtggcaagacgaccagcgcgcgcatcctcgcccgctgtctgaactgcgagcaggggcccacgccgaccccgtgcggggagtgccagtcctgccaggacctcgcgcgcaacgggccgggttccatcgatgtgatcgagatcgacgccgcctcgcacggcggtgtggacgacgcccgtgatctgcgggagaaggcgttcttcggcccagcctccagtcgttacaagatctacatcatcgacgaggcgcacatggtcaccccggcgggcttcaacgccctgctgaaggtggtcgaggaaccgccggagcacctcaagttcatcttcgcgacgacggagcccgagaaggtgatcgggacgatccggtcgcggacgcaccactatccgttccggctggtgcccccggggaccctccgcagctatctcgccgacgtctgtgggagggagaacagccacgtcgaggacggcgtcctcccgctcgtcgtgcgcgccggggccgggtccgtgcgtgactcgatgtccgtcatggaccagctgctcgccggtgcgggcgacgacggtgtgacgtatgccatggccacctcgctcctcgggtacaccgacggctccctgctcgactcgatcgtcgacgccttcgccgccggcgacggggccgccgccttcgaggtcgtggaccgggtcatcgagggcggtaacgatccgcgtcggttcgtggccgatctgctggagcggttgcgcgatctggtgatcctcgccgccgtgcccgacgccggagagaagggcctcatcgacgcacccgccgatgtggtcgagcggatgcaggcccaggcctccgtcttcggcgccgccgagctgagccgcgccgccgacctggtcaacgacgggctcacggagatgcgcggggccacctcgccgcgtctccaggtggagctgatctgcgcccgggtcctgctgcccgccgcctacgacgacgagcggtcgctgcaggcccgcctcgac

SEQ ID NO: 3963 - DNA, 3466 bp, Unknown
  Kingdom: Bacteria, Phylum: Actinobacteria, Class: Actinobacteria, Order: Streptomycetales, Family: Streptomycetaceae, Genus: Streptomyces
ggcgccgcgctcccggccggtggcccgccgcgcctcgtggaggagggtgccgtcggtcccgaccagtgcggccttcattccggtgccgcccacatcgagggcgatgacatgtctcacgggagacagtttcgcccgccgacccccaaaaggtctagtccactagcgcggtttgttgcgcacccatacaaaatgatgaacgagtgaaggccggtctttttctgccggaaagtcacttatggggaagccggaccgggggaatccggaccaaaggtctggaccaagatacgggttggggttcccgactgccagtatgcgcacgccagttgtggctcccgggacccgtgtacgttgccgaagcgatactccggtggtgtagaccttcgcagcgccaatgggggaaaatcgcagttcatccggatggtgtccaggaagggcggcgttgccgcggccgatcagaggccgcaggccgacgccgtgcgcgccatccgtgagcaggcgatcgacgaggatgggcgaggctgtgcagcggcgctttttgggtctgaccgcggtggtggccgcgttgggaatgacggcaacgttgtcggcttgcgggggtgacgccgaggcgggcgacgtcacgctcaagctggtcgccgccgactacggcacgggcccggagaacagctccgagaagtactggagcggggtggcggcgggcttcgagaaggagcaccccggcatcaaggtcgacgtcaccgtcctgcactggaaggacgtcgaccgcgaggtcgccgagatggtcaaggccggtgacgccccggacatcgcccagatcggcgcgtacgcggactacgccaaggcgggcaagctctacaccgccgacgagacgctcgcgatccgcaccacggccaacttcctgccgggactcaccgacgcgggcaagatcaacggcacgctgtacggcctgcccttcgtcgccagcacccggctgctcttctacaacgagcagctcttcgaccaggccggtctggacgcccccgagacctgggacgacatccggagcgacgccgccgcgctcaaggcgaagggcgtcgattaccccttcgccctgccgctcggccaggaggaggcccaggccgagaccctgatgtggctcctcagcggtggcggcggctacacggacgacgtcggcgcgtacgacatcgactcggccgagaacgtcgccacgttccgctggctgcgcgacaacctcgtcggcgaaggcctcaccggcccggtcgcgccgggcaagctggaccgggccaaggcgttcgaggcgttcaccgacggcaaggtcggcatgctcaacggccaccccaccctgatggacaaggccgaggccgagggcatcaaggtcggcatggtgccgctgcccggctccgacggcccgaccaagggatccatgggcgtcgccgactggatgatgggcttcaaggagaacggtcaccgcgaggagatcggcaagttcttcgactacgcctactccgacgagaacgtgctggagttcgccgagagttacgacctgctcccggtgaccggcagcgcctccgccgcgatggaggccgacaagaagcacaagaagctgcgtccgttcctggaggcgctgccgaactcgacgttcaccccctacggcaagacgtcctgggccacggtcagcgacgcgatcaagaagaagatcggcagcgcggtcgcgccgggcagcaaccccgagagcatcctcggagaggtggcggccgaggcgacacgggcggaggccgccgagtagccgccgcggacgcggtgtcgggggcgggtattaggttggttgatatgaccgcccccgaccacgagcaccacgatccccgggccgagcccggcccccgcgccgacgagctgtccgtacgggaccgggctctgctggccctggagcggcgctcctgggcgggtcccggcgcgaaggagcgggcgatccgcgaggagctcgggatctcgccggtccgctactaccaactgctgaacgcgctgatcgacgacgagcgggcgctgcgcgaggatccggtcacggtgaaccggctgcggcgcgtgcgggacgcgaagcgcgggcggcgctgagcgctcccttccgggggctccgaccccgggcccccgctcctcaatcgtcggaggggttcggctccgccccgcagcccagcaccaggtccaccgcccggtccaggcagccccgttcgtggtcggtcagatacgggttcgcccgctgccgggcgcgggccaacgccagatcggcggccgacgcgccgccgtcgtcggcgagttccgcgaggagcgccgccagcagcggccgtacgtccgtcccggccggggactccggggcgagcgcgatccgggccagggtcagcgccgacatcgcccggtcgaggccgggcggaccctccgccgcggtggaccagtcggtcaccaccgcacccctctccgtcagcaccacgttctccgggtgcagatccagatggagcacgcagtcctccgggtccgccgagacccggggcggtatcgcgtggagctcacgcagcagccgggcgagcagcgcgcccgcctcggcggtccccagccgtcccgccagcagggcctcggccagggtcgggccggccagccgctggagcaccaggtccgtggggcgggcaccttcggcgggcggaccgatgcgcggcacggggaagccgaaggcgccgacgtaactcatcacggccagctcctccgtggtgtcggtgcggtcccggtaacggcgaaggacccaggagtcgtcgagtgcgtacacgtcggcggtgcgtcccgagcccagaagttgccctgtgtgcatgaggccgaacctacccgggcgcctcgcggaaagggagacgcgctcccgctccgcccggccgggccgtgaaatcggctccgtacccgcccgcgcggtgggcggacgcacgtgccgggcagccccataacgcggagggaggggggtgaacgggatctcctgcggtgggtgtcaccgccgctacggtttcggcaattccctggtccggaccaacccccaccggatccggacaccccctgaaccaaggagagttacgtggagagcaccacgctccgcagacgcgccctcgccgccggcaccgccacggtggccgtgggtgcgctcgccctcgccgggttgaccggcgtggcgtccgccgaccccgcggccaccaccgccacgccggtctccgcggacagcctgtcgcccggcatgctggccgccctggagcgcgacctcggcctggacgcggacgccgcccgcagccggatagccaacgagtaccgcgccgccgccgtcgccgcagggctggagaagtccctcggcgccagcttcgccggagcccgggtcagcggtgcgaaggcggcctcggaggcgtcggtggtggcgacggtcaaggccgccttcgcaccgctg

SEQ ID NO: 3964 - DNA, 4376 bp, Unknown
  Kingdom: Bacteria, Phylum: Actinobacteria, Class: Actinobacteria, Order: Streptomycetales, Family: Streptomycetaceae, Genus: Streptomyces
cgtccggcgcgccggacgcgccgaacctccgtatcgtctgctgcgtgcgttcagcaccgctatgcaccgataagcaccctgctgtgcccatgctgatccgacggaggtctcccgcatgcccacacccgtcaacgtcgccgtcatctactactcctccaccggcaccgtcgccacgatcgcgaaggccatcgccggggacgcggagaaggccggggcgcaggtgcgactgcgccgggcggcggagctcgctccgcaggcggccatcgactccaacccggcgtgggccgagaacgtgaccgcgaccgcggacatccccgaggtctcgccggacgacatggcgtgggcggacgcggtgatcctcggttcgccgacccggtacgggaacgtcaccgcccagttgaagcagttcctcgacacgctcggcgggatgtggcaggcggggcagctcgccgacaaggtctacagcggcttcacctccagtgccaccacccacggcggccaggagtccacgctgctcgcgctctacaacacgatccaccacttcggcggcattctcgtcacccccggatacaccgaccccacgaagttcgccgacggcaatccgtacggcacctcccacgtctccgggcagggcgacatcccggtcggcgagcagaccctgaccgccgctcgggtgcaggccgagcgggtcgtgaagttcacccgggcgatcaaggcgggcctggccgccgagagctgagcggaccaccgcccaccgcaggacgtcacgcccgcacgcgggacgaagccgcgccagcccggaggccggagcgagcgcagaagcagagcgagcccggaagccggagcgagcccagggggacgagcgagcccagagaggggcccaccatgccgctccaccgcggtgcccacccggaacaggacgaaccctccgaggagcggcgcaggctcgccctgaacccgttcttcggggaggcggacccgacggccgcgatgaacaccgcgccaccccggcaccggctgcccgacgggccgctgccgccgctgacggcgtaccggctggtccacgacgagctgatgctcgacgggaactcacgcctcaacctggccacgttcgtcaccacctggatggagccgcaggccggcgtcctgatgggtgagtgccgggacaagaacatgatcgacaaggacgagtacccgcgcaccgccgagttggagcggcgctgtgtggcgatgctcgccgacctgtggaacgcacctgatccgagagccgccgtggggtgttcgaccaccgggtcgagcgaggcgtgcatgctcgcggggctcgccctgaagcggcgctgggcgaagcggaacgcggaccgctatccggcgacggcgcggcccaatctggtgatgggcgtcaatgtgcaggtctgctgggagaagttctgcgatttctgggaggtggaggcccgactcgtcccgatggagggcgagcggttccacctcgacccgggggccgccgccgagctctgcgacgagaacaccatcggggtcgtcggcatcctcggctccaccttcgacgggtcctacgaaccggtcgaggagctgtgcgcggccctggacgccctccaggagcggaccggcctcgacatcccggtccatgtggacggggcgtccggcgcgatggtggcacccttcctcgacccggacctggtgtgggacttccggctgccgagggtggcgtcgatcaacacctcggggcacaagtacggcctcgtctacccgggcgtcggctgggcgctgtggcgtacggcggacgcgctgccggaggagctggtcttccgggtcaactacctgggcggcgacatgccgacgttcgcgctgaacttctcccggcccggggcgcaggtggtcgcgcagtactacacgttcctgcgcctcgggcgcgagggctaccgggcggtccagcaggcctcccgggacgtggccgggggcctggcccgcgcggtggcggagctgggcgacttccggctgctcacccggggcgacgagctgccggtgttcgccttcacgacgaacagcgacgtccacgcgtacgacgtgttcgacgtgtcgcgcaggctgcgggagcacggctggctggtgcccgcgtacaccttccccgccaaccggcgggacctgtcggtgctgcgggtggtgtgccgcaacgggttctcctccgacctggccgagctgctggtcgaggacctgaaggcgctgctgcccgaacttcgggcccagaagcacccgttgagccacgaccacgccgccccgacggccttccaccactgagcacggccaccgggcgccgctgagcgcgaccaccggcgcctctgggcgcgactactggctgaggcgcgcgaacctggccacggccagcgggaagaacaccgcgatgatggccaccggccagagcaccgcgaggagcccggcgtgctccgccgcccaggagccggtcgcgccgcccgggttgccgaacagctcccgtacggcggtggccgtggcggacatcgggttccactcgaccaccgcgcccagccagcccggcatcgactcgggggcggcgaagacgttggagaggaagccgaccggccagaccaggatctggaccgccgagaccatctccggccgtcccgccaccatggccagcaggatgccgacccagagcatcgcgaaccgcagcaggagcagcagtccgaacgcccccagcgcggcggcggcgccgtggtgccagcgccagccgaccgcgtacccgaccccggtcatcaccgcgagcgcggccgtcgactggagcatgtccgcggcgctgcggccgaccaggacggcgccggggaccatcggcatcgagcggaagcggtcgatgacgcccttgccgaggtcctgggtgaccgcgagcatcgtgctctccaggccgaaggccatggtcagcgcgagcatcccggggaccaggaactccgtggggtcgccgtccacaccccggccgccgccggccaccaccagcgccaccgggaacaccagcgtgtccgggtccggtcgcagcgagccgctccgcgcacaggccgccgcccccgccacgaccagcaggtatcccgcggtcaccgcgcagaacgcgcccgcccgcgaaggcccgggccgcccctcctccggctccgccgcatcgcgcgccgcgcggtgcgccagccagaccgggcccagcacgagcagcagcggcaccatgccgacgggggcgggcacaccgctcagcgtgtcgggccgcacgagtccggcgccgtgcgccagcagccagaccccggccgccgcgcgcagcaccccgcccggtccgctgtcggggtacggggagctgatccacaccaccatgaccagcaccgtcagcgacccgaggccgagcccggcggcgacggctccccgccccagggcggaggccaggtcgagggtccggttccgctcggccgtcgccttcgggctgcgttgcgtcatttgggtcacgcggcccatgctgccaacgacacgcgcttatttcgcgtaacgcgcgaacagccgttgtgtcgcccaatatacgtttatgtactttttcactcagtgcggggctgccgggggtcgaccatgacccggagcacgaccgacgaggccgccgcgccgcagctgccctcccccaaggagcgccgcagactgcgcgaggcgaaatcgctgagcgaggagcaggtggcggcggccgtcggcgtcacgcgcgccacggtgcgctcctgggagacggggcgcacgagcccgcgcggccgcaagcgcgcgctgtacgcgaagctcatcgcccccgaaccggagtcgctcgccacgccgacgccggccacgccggagccaacggcggcgatgacggctccggcgccgacggccccggcacccgtcccggaatccgtcccggaacccgtcccggaagccgctccggaggtgaaggcgatggtggtggcggacaccgacacggacaccggcaccggcaccggtgcggaggcgaccgacgagcggcgtccctcacccgccgaggcgttcgacgagctgtacacccgcaccgcccccggcctcgtccggcaggcctatctgctgaccggccgccgcgccctggcccgcgagtccgtcgagcgcgccttccaactggcctggcaccgctggcccgaggtggccgtcgaccgcgacccggccggctgggtgcgcgcggcggcctacgagtacgcgatgtccccctggcaccggctgcgccgcgcgcaccggcaccccgacgccccgcccacggagccggggaagcaggcgttgttcgacgcgctgctggacctcccccccgcctaccggcgcacgctgctcctgta

SEQ ID NO: 3965 - DNA, 2008 bp, Unknown
  Kingdom: Bacteria, Phylum: Actinobacteria, Class: Actinobacteria, Order: Streptomycetales, Family: Streptomycetaceae, Genus: Streptomyces
acctggcccgccgcctccgcccggacggcggcgcggccgggtggctcgtccggtccgccgtgtgcggcgcgatcgtcgtgctgtgcgccgatcagccggcccggctggcgctcgccccggtcgagactcccgtcggcgcctggacggccctggtcggggtgccggtcggggtcgtgctgctgaagcgggggagagggcccgcccgggagcgggggcccgtggccccctccgtacgggggacttcgccggacctccccgctcccgtcctgcggaaggcggaatgatgacgctcatcgagaccgtgcccggaccgggccgtcgggccctgcgtgcgccgggcgtccggatgggcggcctggcgctgctcgtcgccgcggtggcctgcgccgatctgttcgccggacggggcgtcacccccgaaggcgtacgggaggtgctgttcggcggcggcgaccccaccgccgagcacatcgtgctccaactccggttgccccggctgctggtggcgctggtcgccggggcctgcctcggggtggccgggctcgtgctccagtcggctttgcgcaacccgctggccgggcccgaggtcaccggcgtcactcccggtgcggtgctcggcgcggtcaccgcgaccggcctcggcctcgcgggctgggaatcccccacggccgtggtcgtggcggcctgcctcggcggcttcgccggagcgggtctgctgtggctgctcgccgggcgggaagggggcgacccggaacagacggccgtctacggggtcctcgtctcggcggtgctcgccgggctcaccgcggtcgtcctcctggtggcccccggtgaactcggcagtgtcgtccagtggttgatcggctccaccgagggccgggtctggcagcactggaacctgctctggccgtgggccgccttctggggtgcggcggcctggctgctcgccgggccgctgaccctgttgcgctgcggcgacgaacaggcctccgccgcgggcctggccaccggccggggtcggggtgccgcgctcgtctgcgccgtggcgctgacggccggcgcggtgtcggccgtgggggcgctcggcttcgtggggctgctggtgccccatcttgcgctggccgtcttcggggccgacctgcgcatcacccttccgggtgccgcgctgctcggcgcgacggtggtgtgcggtgcggacgccgccgcccaactgctgtcccggttgctggccaccgcgctcgacgcggaccggctgaccctcccggtcggcgccctgaccaccttcgtgggggcggggttgctgatggtcgtggcgcggcgacgggcggacgagcgatgacggagaacggtacgcggacgggacgcgtcggcgacgtcgacggaagtggaggacaacggatgaggagggtggcatggcggaaggtctgaccggacaggtggagtcgagcccggcgaaggcggccgggccggaagcggaaccgcgcgtgatgcccggcccggaggtcgtccgggcggaggggctggccttcggctaccccgggcgcatggtcctgcgcggggtcgacctgagcgtccgcgccggcgaactggtcgccctgatcgggctgaacggctgcggcaagagcaccttcctcaagctcgccgccggactgctcaccccgagcggcgggcgcgtcctgctcgaaggcgacgacgtgacgcggctgccgcgccgcaccgccgcccggcgcgtcgccctgctccatcagtcggcgccctccgtgccggggctgaccgtgcgtcaactcgtgcgtcagggtcgctacgccgcccgggggccgctcgggatgctgcgggagggtgacgacgaggtgacgtcccgggcgctcgcggacgtcggcgtcaccgcctgggccgaccggcccgtggacgcgctgtccggtggcgaacgccagcgggtccggctggccatggcgctggcccaggacgcccgcgtgctcttcctcgacgagccgaccacctatctcga

SEQ ID NO: 3966 - DNA, 5729 bp, Unknown
  Kingdom: Bacteria, Phylum: Actinobacteria, Class: Actinobacteria, Order: Streptomycetales, Family: Streptomycetaceae, Genus: Streptomyces
cgcgtcgcccgcgggcgacgcgggccacctctccgcgaaaggagcctgacgtcatggccgacgtaccgcacgcagcaccctccggcccggccgcggggagtcccgcgatgcccaccgacatgcccgacgagaactccctggtctacggggaggccgtcctggccgacccgcacgccgtgttcgccgcgatgcggtccgagtgcccggtgcaccaggacgtgatccagggcggcggcaaggtcctcgtaccgacccggtacgacgacgtacgggcgctgctgaccgaaccccggctgctgcggagcttcgccgtcgaggatcccggcgcgttccagggacacctgggcaacagcgacccgccgcggcacacccggctgcgcagactcaccgccaaggccctcacgcccaagcgggtggagcggctgcgcccggccgtggagcgcatcgccgacgggctcctggacgcgctggccgaccgggcggaagccgacctggtggcggagttcacccacccgctggccgccctcgcgggcgccgagctgctgggcgtcggggacgcggaggccgaggagttccacacctgctgggacgagatggcggccttccccgaggtcacctccttccccgcgttccaggcggccaccgaccgcctcgggcggctgttcggccggatcttcgcggcccgccgcgaccgtcctgccgatgacctcctctcggcgctcgtgcacgccagggcgggcgaggaccgcctcaccgacgccgagctggagcagaccgccgtcttcctggtgatcgcctccaacaagaccgttcccgcgatgctcggcaacgcggtgctcgccctgctggaccacccggaccaggccgaactgctgcgctcccgccccgatctgctgcgcgggaccgtcgaggagtgcctgcgctacgaggccccggtggcgctcaccaacccgctgcgcgcgggcgagccgatgagcgtcggcgaccgggagctggccgccggcgacctggtgcagctggcgctcatcgcggccaaccgcgacccggagcgctttcccgaccccgaccggctcgacatcacccgcccggtgggcggccatgtctccttcgggcacggcatccacatgtgcctgggcgcccagctctcccggatgaccggcgaggtcgccctcgggcggctgatcgagcgcttccccgcgctgcgcctggcacacgacgacccctcccgggacgccgtccggtcccgcgagcacgtcatgcggcggctgagcgcgctgcacgtaggcctgggcgggaccgcccgggccgattcggccgcccacccggtggcgtccgcgatctccgttccatccgacaggagctgatcagacgtgaccaccgccatcgaggcacacgggctgcgcaagcgctacaaggaccacgaggcgctggccggggtcgacctctccgtcgagtccggcaccgtcttcggactgctcgggcccaacggcgcgggcaagacgaccgccgtccgtatcctcaccaccctgctgcgcgccgacgagggccgggcgagcgtcgccggcttcgacgtggtgagccagtcccaggacgtccgcaagcacatcggcctgaccgggcagtacgccgcggtcgacgagcggctcaccgcccgcgagaacctggtgctggtgggccggctctaccggctcggcaagaaggagacggccgcgcgcaccgagtccctgctggagcgcttcgagctgaccgccgccgccgaccgcccgctgcgcacctactcgggcggtatgcgccgccgcctcgacctcgccgcgagcctcatcggccgcccgccgctgctcttcctcgacgagccgaccaccggactggacccgagcagccggctcgccctctggggcatgatccgcgagcaggtggccgccggggtgacgatcctgctcaccacccagtacctcgacgaggccgaccagctcgccggccgcgtcgccgtcctcgaccagggcaaggtcatcgccgacggcacgcccgaccagctcaagcgcaaggtgggcggcgagtggctggaagtgacggtcgccgcccgggagacgacccccgaggtggtgcgcgcgctgtcctcggtgatcgccggggaacccacgctcagcgaggacgggctcaccgtcagcgctccggtcgccgacgggattcgctccatcgccgccatctccgagtgcctggtcgccgcgggagtggacgtcgtcgacttcgcgatgcgccgcccctcgctcgacgacgtcttcctcaccctcatcggcaagaccaccgcggtgcccgaaccgcagaacgcctgagttagggagtaacggcatgacccaggacatggacctgcacaccaccgccgaggacggcacccgctcggcggaggccctgatcacccaggacttcgtacgggacccgcacaccacgtacgactggatgcgcgaggaggggccggtcaagctgcgtcagcagagcggctcggtcctgtggatgctcacccggtacgaggacgcccgcgcggccctcgccgaaccgaagctgcacaaggacccgcgccgcttccccaacccggccggcggcaccggcatggggccggaggagcccggcatggagctgctgtcgcggcacatgctcaacagcgacccgcccgaccacacccggctgcggaagctgacgacgaaggctttcaccgcccggcccacggaggcgttccggcctcgcatcacggaggtcgcggccgggctgctggacggcttcgagccgggcgggcggatggacatcgtgaacgactacgcgatgccgttgtccacccgggtgatctgcgaactcatcggcatcccggcggcggacggcgagatcttccgcgactggtacaccacgatgaccggggtgcacccgcccgagcaggtcaccgaggcccggcagtcgctgatccgctacctcggcgacctgatcgccgacaagcgggcgaggcccgccgacgacctgatcagcaatctcctccaggcccgggacgcggacgacctgctgtccgagaccgaagtcatgtcgatggtcttcctgctgctcggcgcgggtcacgagacggcgatcagcttcatcggcacggcgatgctgtcgctgctgtccgagccggaccaactggctctgctccagaaggacacgacgctgcttccgggagcgatcgaggagctgctgcgcttcgagagcccgatcaacatcgccacgttccggtacgcggccgagccggtcgagatcggaggggtcaccatcccggcgggtgactcggtgttcgtctccatcggcgcgctcaaccgggacccgtcgaagttctcggagccggaccggctggagatcacccgtcccgcgaccgggcacctcgccttcggccacgggttgcaccactgcctgggagcgccgctcgcccgggtcgaaggggccgtggccatcggccagttgatcacccggttcccggacatccgtccggcggtcggccgtgaggacctccagtggcggttcagcctgatgctgcgctgcctggaatccctgccggtcatcctgtgaccgggctgctgggggcgcccgcggcggaacacctcgggcatccccccgatccggaccccggcgacggcatgtacggctggctgatggcgctgctcgaccgggccggcgccgactaccgggtcatcgaccacgcgcccgaggggcgcaccgacctggccagcgaactgcgcggccaccggctggagatggccgcgaaatgcatggtcctgcgggtcagcaggaaggacggcgggggccaccacgtcctcgccgtcgtgcccggccaccgccgggtcgacctgcgccgcgtccgcaagctgtacggcggcagcgacgcgaccctcggtgaccgggaggaggcggagcgcctcaccggctgcgtcagcggctgcgtcatcccgttctcgttcgacgagcggctgccggtggtggtggacgcgaacctgctggtgcacgaggagatctacttcaacgccgcccggctggaccgttcactggcgctgcggaccgtccactacatctccctgagcgctccccgcatcgccgccatcgccaaatgaccggcgcaccggcgcaccgccggcgccggggtcagcggccggggcgcacgaggcgctgctcgtacgcgtagatcaccacatgcacccggtcgcgcatgccgagcttcgcgagcagccggccgacatgggtcttcaccgtcccctcggacaggtgcagttccttgccgatggcggcgttcgaggcgccgcgcgcgatgagcagcaggacttcgcgctccctggcggtgagcgcgtccagcgggtcggggcccccgttgcggcgcggcaggtccggggccacctcgtccagcagccgccgggtggtggtgggggagatgaccgcgtcgccccggtgcacggtgcggatcgcggagagcaggtcctcggccggggcgtccttgaccaggaatccgctggctccggcctggagcgcggcgaaagcgtgctcgtcgacgtcgaaggtggtgagcacgacgaccttcggcgccccgtcccgcgccagcagtctgcgggtcgcctccaccccgtccatccggggcatccggacgtccatcagcacgatgtcggcggaggtcaccgccagccgctccagcgcctgggctccgtcaccggcctcgccgaccaccgtcatgtcgtcctgggcctcgacgaccatgacgaagcccgcccgcaccatctcctggtcgtcgacgaggaacacccggatcgtcatgcccgctccccgtcgtgctccggcccggggccgcccgcgggactccgggacggcagccgcgcgctgaccaggaacccgccgccgggcgccggcccggtccgtacggtgccgccggccacggccgcccgctcccgcatgccgatcagcccgtgcccggccccgtcgccgggcccgggacccgtaccgttgtcgcgcacctcgatctccaccccgtagtccgaccagtcgaaccgtatcccgcaacgggctccggcaccggcgtgtttgagggtgttggtgagggcttcctgcaccagccggtaggcggccagctccgccgccggggtcagcccaccgggttcgccggtctcggtgaagtcgacggtgagacccgaagcgcggacccgccgcaggagttcgggaatctgcgccaggtccggctgtggtccgaaaccgtcgccgtggtcgcctccccggagcatgcccagcagcccccgcatgtccgtcagcgcctgccggcccgcctcctcgacggtcgcgaggacctcggcggcccgctccgggcgggcgcgggccgcgtaccggccgccctgggcctggctcacgatgacggacagcgagtgcgccaccaggtcgtgcatctcgcgggcgatccgcgcccgttcgtcccgggccgcccgggcggcccgctcctcccgctccgcctcggcccggaccgcacggtgctccagctcgcccacgtacgccagttggaagcggcggaacaggccgaggctgaatgccaccagcacgatggcgagcaggaagccgaagaggaaggcgggcggcagctgcacggtcgtggtcagcgcggaccgcagggtgaccgccgccgcgcacccctgcccaccgagcacggaggccagcggtccgcgcggcggcggtcaccctgcggt

SEQ ID NO: 3967 - DNA, 2040 bp, Unknown
  Kingdom: Bacteria, Phylum: Actinobacteria, Class: Actinobacteria, Order: Streptomycetales, Family: Streptomycetaceae, Genus: Streptomyces
cccgggtccgctgcggacgacgccgtccggaccggcctcgtccgcagcggacccgggcaggccgggagcggccgccccggcggacttcccggggtcgtcggatccctccggttccggttccgctccgtactcctccaggccggatcccgctccggactccttcgggccgggttccgctccgggttccgccgtcgcggcggccccggcggatccaccctcgatggcacagacagtcatggactcgtcacctccggctacgaaagctagttttcgcacttccagccgaacaacacgagccacctcacttcacacataagggtggtgatgcccggattctcctgaggtggagggggcgagtgtgctgttgaaggcgggcgtgtctatggtgaggcagccctaaccaagggcccgtgcctcatgcacgtacgcggaccatctggagcaagtgatgtcccttcgaccccgcggtaccgccgcagtcgccctggccgtggcggccgccctctccctgtcggcctgcgggggcggcggcgaggacggcgacgcggcgaagtccgacgcgggcggcggcaagaaggccgccgtcgccaccggcggcaaggacttcgcggacgcggcgaagaagaccgcggcgtacggcaccgacgccggggccggcgagttcccccgtacggtcacccacgccatggggaagaccgagatcaaggccgcgccccgccgcgtggtcgtgctggacgtcggcgagttcgacaatgtggtgtcactgggcctgaagccggtcggctacgcccccagcgagggcgacgcggccatcccctcctacctggagaagggtgcgggcgcgccgaagagcgtcggcacgatcaacagcctcaacctcgaagccatcgcgggcctccagcccgacctgatcctcggcagccagctccgcgccgcggacaagtacgacgagctgtcgaagatcgcccccaccgtgttctccatccgtccgggcttcacctggaaggagaactacctcctcaacgcccaggcgctggaccgcacgaagcaggccgagtcggcgctcgccgcgtacgaggacaaggcgaagaagctcggcgacgacatcggcgccgacaagccgaccgtctcgatggtccgctacatgcccgaccgtctccggctctacgccaaggcctcgttcatcggcacgatcctcgaagacgtcggtctgccgcgtccgaagaaccagcagatcaacgatctcgccgccgagatcagcccggagcggatcgacgaggcggacgccgactggatcttcaccggcgtctacggcgacccgaaggccacccagcgcgacaccacccggtccaacccgctgtggaagaacctgaaggccgtcaaggagggccgggccaaggacgtctccgacgagacctggtacctgggcctcggcgtcacctcggccggcctggtcctcgacgacctccgcgccgacctggtgaagtgaccgcctccgcggtacgggagcgtcgcggtgccccggtgaagtaacgattcgtgtccggccgccggtcctggcgtacaggtccggcggccaggggcgacggaccaccccggacaggtagcctttcctccgtgccccgtctgtctgaagtcatcgccgcactcgacgccctctggccccccgagcgggccgagggatgggacgcggtcgggacggtctgcggcgatccggacgcggagatcgaccgggtgctgttcgccgtcgacccggtccaggagatcgccgacgaggccctggagctcggcgcccagctgatcgtcacccaccacccgctctatctgcgcgggacgacgacggtcgccgccgacaccttcaagggccgggtcgtccacaccctcatcaagcacgacatcgcgctccacgtcgcgcacaccaacgccgacaccgcggaccccggtgtctccgacgccctggccggcgccctcgacctgcggatcaccgggcccctcgtccccgaccccaccgaccccgagggccggcgcggactcggccgg

SEQ ID NO: 3968 - DNA, 4931 bp, Unknown
  Kingdom: Bacteria, Phylum: Actinobacteria, Class: Actinobacteria, Order: Streptomycetales, Family: Streptomycetaceae, Genus: Streptomyces
ggcctggacgccggcggcctggggcccgagctggcggcgatcgaggccgatctcgtggggcgcatgcggctgcgggaggtgctggccgacccggcgctcgccgcgcggctgacccccagcatgtcgttgatcgagcaactgctgcgggacaagggcaacctgtcgggtgtcgccctcgccaacgccaagtcgctcatccgccgttatgtcgacgaggtggccgaggtgctgcgtacgcaggtggagaaggccaccgtcggcgagctggaccgctcggtgccgccgaagcgcgtcttccgcaatctcgacctggaccgcacgatctggaagaacctcaccaactggagtcccgaggaggagcggctctacgtcgatcgcctctactaccggcacaccgtccgcaggacgacgccgcagcggctgatcgtcgtggtggaccagtccggctccatggtcgactcgatggtgaactgcaccgtcctcgcgtccatcttcgccgggctcccgaaggtggacgtccatctcatcgcctacgacacccgctcgatcgacctcacgccgtgggtgcacgacccgttcgacgtgctgctgcgcacgaatctcggcggtgggaacgacggccccgtcgcgatggcgatggcccggccgaagatagccgagccgaagaacaccgtcatggtgtggatctcggacttctacgagttcgaccgctcccagccgctgttcgaaggcatcgaggccgttcaccgttccggggtgaagttcattcccgtcggctcggtgaccagctccggacgccaggaggtcaatccctggttccgggagcggttcaaggccctgggcacgcccgtggtctccgggcacgtgaacaagctcgtgcacgaactcaagacgttcctgacctgaggtctgcggggcggggtcccccgcccgccgcacgccttctctccgtgcatacctcccttcctccttgcgtacctcgctccttgcgtaccccgcaccttctccttccgcacttttccgcctgttcagaaaggccttctgatgtccgacgtgttgcgcgcccccgccgagaccaagtacgcggaggagctcgactggctggagtcgatcgacgacagccccaagccgttctcctggcggctgtccccgaagatggtccggctgttcatcctggggtccgagcgcgccgacggcctggaccgcgagatctcccagaagtggttcggcgaccggagcttcgtcgagcgctcgatcgtcactctcgcctcggaccgcggtctgctgctgataggagaccccggcaccggcaagagctggctggcggagctgctgtccgccgcgatctcccgcaactccacgctggtggtgcagggtacggccggcacgaccgaggatcacatcaagtactcgtggaacgtgtccatggtcatcgccaaggggcagtcgcgtgagtcgatgatcccgtcgccgatcatgaccgcgatggagacgggcgccatcggccgcttcgaggaactgacccgttccaccagcgacgtccaggacgcgctgatctcgattctctcggagaagtacatctccgtccccgagctgcagagcgacggaggggacgcgggcgacaacatcgtcttcgccaagccgggcttctcgatcatcgcgaccgccaacagccgcgaccggggcgtcaacgacctgtcgtccgcgttgaagcgccgcttcaacttcgtgcgcatcccggtcgtgacgaacaggaagagcgaggcggagatcgtccgcttccgcacggaggaactgctgcgccgccacgcgatcgacctggacgtgccgccgacgctcctcgacatccttctccagagcttcgccgatctgcgggcctcggccgccgccgcgggcagcgacgacgagaagctggagtcggcactgtcgacggcggagcagatcggcgtgctggaggacgccgtcctgcacagcaacttcttcggcgagagcacactgaccgcccggaccctcgcctcctcgctcgtcggctcgctagcccggcgggacccggaggacctggccatcttcaacaagtatctgcacggcgtcgtcgagccgcgcagcaaggaagagggcggctcctggccggagttcctcgacggcggccgcgacacgatcgccacgctgtcatgagcgggtcccccacgaacggccccggggagacgtcgttcgcggcgctgcgcgggcagctgcacgaggccgccaccgccttcgccgacggtccccacgcactggagggcatcctcctcggcatggtcgacgacgtcgaccgggcggtgcgcgagcctctggagatcttcccggtctgccaccattcgcccgcctccgccctcgccatggcccgccggctgcgcgagaagcagcccaaggtcatctatctggagctgtgcgaggacatggcgccgctcctcggcgagctgcgcaactgccgcctgccggtggcggtccaggcgttcgcgagcgacatcgacgggttccccgccgagtgggccccgctgtcggtcgtcgccccgatcaccgaggcctccgccgagtaccaggccatcgcgtacgccctcgacaccccgggggtcgagctggtcctcgtcgaccggtcctccgaccacgtcttccagtgggacagtcggcacggcgagcgcacccccgaggcggcggccggtcctgcggaggggcctgctgagtccgaagcagcgctgcacggtgaggcggtcggcgtggagatcggtgacctgcggccccgcttcgcggagctggaggaacatctgctgcgccacggcaaggtacggcactggtcggagtggtggcaccagtacgtcgaggtcccgctcggcgacagcgaccacgccgcctaccgccaggtcatgttcctcgtcggcagcctcttccggcggctcgcccccggcgacggggagcgggtccgggtggacgaggaccgcgagcgttacatgtggacccggatgcgcgagcacctggcggcgagcggggcggaccccgaggactgcctgtatgtgtgcggagccttccacgcggccagccgggtcgatgagttcggggtggcgggcggtgggtcgttcgagatctccccgcgctccgccaccacctggcagcacgggctgatcccgtccagccatgcggcgatcgaggcgcagttcgggctggcctccgggtcggtgtcgatcgcggcgacccagtgggcgaagaacctcaagcgcacccgggtccagccgtaccggctggccggtcaggacggtgcgaagaaaccgcgcacggcgaagaaggccgccccggccgcctccgcgcccccggcggaagccgccgcggaccggctctccgggttcctgcgccggccgccggtcctcgacacgctggacgaggccgagttgctcggctggtcggtggacatcgtgcgcgcggcgcggcgcagcggctatctggcgtccaccgccgacgccatcgcggtgttcgagacgtcgatcctgcttgccgggatgcgggaccgggccaagcccactccgtacgacttccaggacgcggcgatcacctgcatcgagaaggacacggtgccgggacggcgggacgtgcgccggctcgtcgagatcatgatgggcggcgacaggatcgggcgcgtcggctacgacgcgctgccgccgctggcccgcgatgtgcacgaccggctcgcgccgctggagctgaagctccagcagcgtggtgtgcagcgtgcgctgctggacatgaactcgcgcccggagctgggagcgtgctcagacgtgctgtggatgctccgccgcctgatgccgcacggcgccgcccggccgatcatgggtgagcggaggctcggcgagcgttcgatccaggagtcgtgggacctggcgctgggcacccatcagcgggcactgatcgagctcgggtacgagggcgtgagcatcgagcaggtcctggaacagcggctgcgccgcgaggcgtacgggccgcgggcgacgaccgcggccgtcctcgcctccgtcgaggacgcgacgctgtatctccgcagtcgccgtctcgccgatgagctgggcacccgcgccctggaggtcctcacctccgagcgcaccgtggacggggccccggaggtgctgcgccgggtgcgggggctgctggcgtactaccggaccggcgagccggttctgccgccgtgggtggagtcgttcgtcaaggccggttacgcgcactactgcaccttgctgccgacggcgttcaccgacgaggacgtcaccgcggggcaggtggcggcgatgctgggcttcctgttcagcatggagggcctggcgctgtccctgggctgcgaccgggcacagctggagctggccgtcgcccagtcgcgtcccacggacccggagcggacggcgctcctgtgggcggcgcaggtgcagctcggcgccctgtcccgggccgagctgcgggagcgctgcggcgaactgctggcgaacccgatggtggtgcccgcctatccgcgttatctcagcggcttcgtgcacgcgttggtgccggtaccgggactggcggacgtggtggtggaggccgtgtcgaacgcgttcgggcggctgccggatccgatactgctgccgtggctgccgaccttgatcacgacgctgcgcgccggtgcggcggatctggccccgttgttgatccgtgaggcggggcggatcttcccggcccggctcgcggcactggacgcgtgggtgccgccgtggcgcgaggcgccggaagccggtgctcccgcactcggcggtgcgcaggcggccggcggcggggaccgtggcaccgcgctgctcttcacgcaccctcggacgctcgacgcggtcgcggagctgctcggctgcgacggcacatgggcgccggccggcgagggt

SEQ ID NO: 3969 - DNA, 1991 bp, Unknown
  Kingdom: Bacteria, Phylum: Actinobacteria, Class: Actinobacteria, Order: Streptomycetales, Family: Streptomycetaceae, Genus: Streptomyces
cctcgcggacgcgttcccaggcgcggctggggaagtgcggtttgtccttggcggggacgacgtggctggcgatcggggagcggccggccgggagctggtccaggacggaggtctccaggtcgccgaagaccgtcatcgcgaccgtacgggggatgggggtggcggtcatgacgaggaggtggggaggctgcttgcccttcgaacggagggcgtcgcgctgttccacgccgaagcggtgctgctcgtcgaccacgacgaggcccaggtcgtggaactggaccttgtcctcgatcagcgcgtgggtgccgatgacgatgcccgcctcgccggtgaccaggtcgagcagggcctgtcggcgggccgccatgcccatggagccggtgagcaggacgaccttggtgccccggtcggagccgcccagcatgccgccctcggccagctcgcccatcatctcggtgatcgagcggtggtgctgctgggcgaggacctcggtgggggccagcatcgcggcctggccgccggcgtcgaccacggtgagcatggcgcgcagggccaccatcgtcttgcccgaccccacctctccctggaggaggcggtgcatcgggtgctcggtggccaggtcgtcgaagatctccttgctgaccttcttctggccctcggtgagggtgaagggcagcttggcgtcgaaggcgtccagcaggccgtccgcgacggggcggcgggcgacggcgggcagttgggtgtcggcgtagcggcggcgggccagggcgacctggaggacgaacgcctcgtcccacttgagccgggccctggcgtcctcgacgtccgccttcgtctgcgggcggtgcaccttcagcagggcctcggggagcggggtgaagccccggccctcgcgcagggaggcgggcagcgggtccaccgcgtcctgcgcgctgggcagtacggcgtcgacggccttggcgatccgccaggagtcgagctgtttgcaggcggggtagatcggcagcagccgcccggcgaaggcgtccacggcctcggtcgcctcgtcggcgtcggaggcgtcgagcagttggtacgtggggtgggccagctgcatcttgcggttgaagacggagaccttgcccgcgaacatcgcctggcggcccgggagcagctccttgtgcggcttgtggacgccgtggccgaagaagacgagctggaggcggccgctgccgtcggtcagggtgacctccagacgtttgccccggccgttgttgaacatcaggatccgggcgtcggcgacctgggcgacgaccgtgacgtgctcgtccagcgggaggtcggccagcgcggtcagcttgccgcgctcctcgtaccgccgcgggtagtggtgcagcaggtcaccgaccgtgtgcaggtcgaggtgttcggccatcaccttcgcggtggctccgccgagcagcttcagaagaggttcatcgaacgaggacacgcgacccattgcacaccacgccactgacagctgtccgccgggcgcggccgtgccgcggattcccggctactcgacgccgatcagcaggggtgcgcgctggtgtccgccccgatagaccacggtgtccacggcgaggtggccctcgcgcacgtgctcctccagcgcgtcggccagtgagtcggggacgtcctcgccgaggacgagggtgaccagttcgccgcccgccgccagcatccggtcgaggacggtgcgggcggtggccgggacgtcggcgccgatcacggccacgtcgccgtcgatcagtccgaggatgtccccggcctggcagaccccggccatggtccacgactggcgctccgcgacggccagttcggcgtagcgggtggcgccggcggcggcggtcatggcgaccacgtcctcgtcgaagccccggtcgggctcgtggacggcgagtgcggcgatgccctggacggcggcccgggtgggtacgagggcgacccggaccccctcggtcctggcc

SEQ ID NO: 3970 - DNA, 1318 bp, Unknown
  Kingdom: Bacteria, Phylum: Actinobacteria, Class: Actinobacteria, Order: Streptomycetales, Family: Streptomycetaceae, Genus: Streptomyces
  misc_feature (221)..(370): n is a, c, g, or t
  misc_feature (614)..(615): n is a, c, g, or t
cggggcccggtgacttgctcgccgccgagcagaacctcccccgaggaggcggcgagcaagtcaccgggccccggcacgacatcggctacgtgttccagcgcgcggcactgctggagtggcgctcggcgctgcgcaacgtcctgctccaggcggagatccgccggatggagccggtgccggcgcgcgaacgggccgacgacctgatccggatgaccggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatctcggaggccgtctacctggccgaccgcgtcgtggtgatgagcccgcgccccggcaccgtcacggagatcatcgaggtgggcctgcccgccgagcgcgactacagcgagacgctgggccgtccggagttccgtgcggcggcggcgcacatccgggatctgctgggcgcggtgtccgcccacgactgagggggccgaggggtcgagaggaagcgatacgtgccgggcaggcctcctgcccnncctgcccggcgcggtcgtgttagggggtgccgggacgcgttgctcccacgagagggctacggctgtcgccccgcttcggccgcgatgccggccgcgcaggtgatcgggaagggcgtcgccgcacaccagcaccgtcggtcgcagcccgagcaccggtgcggtgttcatcccggcaccccttccggtaaggggactcgcttcgttaagggctctaaccgaagacattgcgagactctctagtgagagttatggtctataactaaagcgagtggtcgtaggtagtcgctcgtggtgctggacccggcccggactgtctgcggcccggccgacgctgtctccgaaaggacctctcatgaccgcccctcgccctctgcacaccgtcctcggctccggacccgccggaaccgccctcgcccgcgagctggtccgccgggggtggcgcgtccggctggtcgaccggtcggggagcgggcccgcgatccagggcgtcgagcggtacgccgccgatgtcgccactccggagggcgcccgcgcggccgtggccggggccgacgtcgtgtaccactgcgtcaacgtcggctaccacctccaggtggaggtcatgccgaggatccaggaggcggtcctcggagccgccgaggcggagggcgcgcggctggtcgtgctcgacacgctctatccgtacgggcagacgcacggcgcg

SEQ ID NO: 3971 - DNA, 5847 bp, Unknown
  Kingdom: Bacteria, Phylum: Actinobacteria, Class: Actinobacteria, Order: Streptomycetales, Family: Streptomycetaceae, Genus: Streptomyces
ccccgtacggggtacaagggcgcgcccggtactcggtaacctggtacgaggccgtctccgaggcccgtccgtccccgcaccgtgtaccaggaaggtgtccaccaccgtggaaaccgcacgctcctccgtgatcgtcgccatcgacgggccctcgggcaccggcaagtcgagcacgtccaaggccgtcgccgccaagctcggcctgagctacctggacacgggcgcgcagtaccgggccatcacctggtggatgctgaacaacggcatcgacgtcggcgacccggccgagatcgcgaccgccgccgccaagccggtgatcgtctcgggcaccgaccccgccgccccgacgatcaccgtcgacggcgaggacgcctcgggcccgatccgcacccaggaggtcacctccaaggtcagcgccgtcagcgccgtccccgaggtgcggacgctcatcaccgagctccagcgctccatcgccgccgcggcgaccggcggcatcgtcgtcgagggccgggacatcggcaccaccgtgctgcccggcgccgacctcaagatcttcctcaccgcctccccggaggcccgcgccgcccgccgcagcggcgaggtcaagggctccgacctgaccgccacccgcgaggccctgatcaagcgggacgccgccgactccggccgcaagacctcgccgctcgccaaggcggacgacgccgtcgaggtggacaccaccgagctgaccctccagcaggtcatcgagtgcgtcgtcaccctcgtcgaggggaagcgggtcgccgcgtgagcgatgccacagacgcgcccacgctgcgcggagcggccgtcgggcggtccatcggcatcggcctgatgtacgggctgttcaggccccgggtcctcggcgcgtggcgcgtgcccgccgccggacccgtcatactcgcggtgaaccactcccacaacatcgacggaccgatgctgatgggcaccgcaccccggccggtgcacttcctgatcaagaaggaggcgttcgtcggccccctcgacccgttcctgcacggaatcgggcagatcgaggtggaccgccgagtcgtcgaccgcaccgccatcacccacgcgctcggcgtgctggaggacggcggcgtcctcgggatcttccccgagggcacccgcggcgaaggagacttcgcctcgctgcgggccggactcgcgtatttcgcggtacggggcggggctccgatcgtccccgtggccgtcctgggaagcaccgagcggcgcggacggttgatacgggggctgcccccgctgcgcagccgggtcgacgtcgtcttcggcgacgcgttcgacgcgagcgccggagacgggcggcggacgcgcagggcgctggacgaggcgaccctgcggatccaggcgaagctgaccgcccacctggaaagtgccaagcgcctcaccgggcgataggcgagacttgagtagtggaccgcgctgatcgcggtccatcgatgatgatgcaaagaggaacggacttcatgaacgaccagattcactccgacggctcgggccacgagcacggagcacttggcgatgccgagttcgcggagttcatggagctcgccgcgcaggaaggcttcgatcccgaggaggtcgagggcgccctcgacgaggccggtcacggcccgctccccgtactcgccgtcgtcggccgccccaatgtcggcaagtcgaccctggtgaaccggatcatcggccgccgcgaggccgtcgtgcaggacaagcccggcgtcacccgcgaccgcgtcagctacgaggcggaatgggccggacgccgcttcaaggtcgtcgacaccggcggctgggagcaggacgtgctgggcctcgacgcctccgtcgccgcccaggccgagtacgccatcgagaccgccgacgcggtcgtcttcgtcgtcgactcgaccgtcggagccaccgacaccgacgaggccgtcgtcaagctgctgcgccgggccggcaagcccgtcgtcctctgcgccaacaaggtcgacggacagagcggcgaggcggacgccagcgccctgtggtcgctgggtctgggcgagccctacccggtctcctcgctgcacggccgcggcaccggcgacatgctggacgcggtcctggaggcgctgcccgacgccccggcccagaagttcggcaccgcgctcggcggtccccgccgcatcgccctgatcggccgcccgaacgtcggcaagtcctccctgctgaacaaggtcgcgggcgaggaccgggtcgtcgtcaacgagcaggccggtaccacccgcgacccggtcgacgagctgatcaagctcggcggcatcacctggaagttcatcgacacggccggtatccgccgccgcgtccacctccaggaaggcgcggactactacgcctcgctgcgtacggccgccgccgtggagaaggccgaggtcgccgtcgtcctgatcgactccagcgagtccatcagcgtccaggaccagcggatcatcaccatggccgtggaggccgggcgcgccctcgtcgtcgccttcaacaagtgggacaccctcgacgaggagcgtcgctactacctggagcgcgagatcgagacggagctcgcgcagatcgcctgggccccgcgcgtcaacgtctcggccctcaccggccggcacatggagaagctggtcccggcgatcgagaccgcgatcgagggctgggagacccgcgttcccaccggccggctcaacgccttcctcggtgagatcgtcgcctcccacccgcacccgatccgcggcggcaagcagccgcgcatcctcttcggcacccaggcgggcaccaagcccccgcgcttcgtgctcttcgcctccggcttcctggagcacggctaccgccgcttcgtcgagcgccgtctgcgcgaggagttcggcttcgagggcaccccgatccacatctccgtccgggtccgcgagaagcgcggccgcaacaagtagcaccagtcacgacgaagccccgggccgctctcgcgagagcggcccggggcttcgtcgtgcggccttcgccgtcgggcctcaggagtcccgtgaccccggcggcagcgccgcgggccggggccgccccgcatgccgtcccacgcgctgccaggagccgaggctcccggcgtgctggctctgtccgccgcttccgccctggccgttgtgcccaccgttgccgctgtgcccggagggggcggggtgaccgctcagcgcggtcctggaggcgaagagaccggtgccgaaggacggaaaaccgagattctcctcgccgctccggtcgcccggcaacgcccggaacgagcgccggtactcggagtacagcgcgtcgtagatcggggtgggggagacgccccccgacggatcctgcgaaggacgcatggcagggatctgactctgatgctggcgggaggagtcgtatgagtgcacataggtgccaacgacctcaccgctcgtcggatgcggctccgccggagaaaacgctgttcggcgggggcgcccgagccggccggacacgatcaggttccggccagcggcatcgacgcggcgaccagcagcccgttgaccgccgccttctccagggcgtcccggagcaggtcctcccgcggctgctggccgatggtgccggccggggcggcgaagacgaggaccgtctgcgacttgttgaccgcggcccgccagccgtcggtcacctggagcggctggtgggcctgccaccaggcgacggggttgccgccgccggcgctcggctgcagcacggcgtgcagctggcccaccgccagcagcacggaccagcccgcgaggacctccggcagccggttcatgtcgggggcggggcggaagccctgctccagcagcagctggaggaactcgtcgcccccgctgccgtcggtgccgggccgggcgaccgggccggtcggttcgacgaccagggccgggcggagatcgtcctcgatgaggacgagtccgctggtgatgccgaggacggcctgttcgggcatgcgcccctccgtgttcttctgctcgcttccggtgatgctgcgcaccgcgccctggagctggtcctccgcgaccttgacgacctgcgaggggatgcatgtcgcgtgggcgaacgcgaggacggcggtctcgtcgccgatgaacagcaccgtgctggtgcgttcctggtcggagtcgccgggggtgcggcaggaggtgcagtcgtaactgcccggggcgttgtcgccgacgagcagccggtcggcttcgtcgtcgccgatctcggcgcgtacgtcctggctgacgtcgagcatgcgcggcacgggggctcctcgaactcggtgcgtgggccgggtggttcccgggctccatgaagagacaacgcgggatccgtggccggggtcacgcaccggggcgtacggaagtgcggcacaggtcgacacatcggtacgtcgagcagtcgacgtacggccctggaagttttaccggggtgcaggcaacctccccgcattctccttcgtcaagctcggaggaaagctttggcgaacgggtggcgggcagctccgggtttaccgctccggtggcccgcacacgcggtcccgatacgtccgggccctgcggctatccggattgactgcctccggaacccgcaggtcagtggcggcccggcggtggaacggggataccgtgcgcgatgtcgcggatgctccgggatttcccggtgtatgtcgggcggaaattcgccgggaagtgcagtcttgacaaggccaggccgacaggggaaacagcgacaccatgcatatttcttttcttctgcacaacgcctatggaatcggaggaaccatccggacgacgttcacgctcgcccgtacgctcgccgaacagcacgatgtcgagatcgtctccgtcttccggcaccgtgacgcccccgtcctcggcgcacccgagggcgtgacgctgcgccacctcgtcgacctgcggaggaagagcgcgacgtacgacggcggcgacgccgaacacgcgcggcccgccgcggtgttcccgcgcggggacagcaggcacaagcagtacagcaggctcaccgacgcccgcatcgccgcccatctccaggcagtcgaggcggatgtcgtcgtcggcacccgtcccggcctcaacgtgcacctcagccggcagacccgccgcggaccggtgcgcgtcggccaggagcacctgacgctcgacagccacagctaccggctgcgccgcgagatcgcccaccggtacacgctgctcgacgcgctcaccaccgtcacccgtgccgacgcggacgactaccggggccggctgaagttgccgggcgtgcggatcgaggccatccccaacgccgttccggaaccggcctgtccgcccgcgagcggtgatctgaagtgggtcgtcgccgccggccggctgcaccgggtcaagcgctacgacctcttggtgcgggccttcgcccaggtgtccgcggcccgccccgactggcggctgcgcatttacggcggcggtgacgccaccggcgacgaacaggcgtcgctgcgcaccctcatcgacgaactcggcctgcacaaccacgtgttcctgatgggttcggccaacccgatggaggccgagtggcccaaggggtcgatcgccgccgtcacttcggaccgcgagtccttcggcatgacgatcgtcgaggcgatgcgcggcggtctgccggtcgtcgccaccgactgcccgcacggaccggccgagatcgtcgaggacggcgtcgacgggcgtctggtgccggtcggcgacccggaggcgatcgccgccgcgctgctccagctgatcgaggacgacgaactgc

SEQ ID NO: 3972 - DNA, 536 bp, Unknown
  Kingdom: Bacteria, Phylum: Actinobacteria, Class: Actinobacteria, Order: Streptomycetales, Family: Streptomycetaceae, Genus: Streptomyces
cctccaccccagcggtaggctgacgacgcctgatccacgcggatcggaactcgcatgctcgaagggactcaccccatggcgctcgaagccggcctcctggagatcctggcctgcccggcctgccactccccgctcgacgaccgttcggcggccgacagccccgagctggtctgcacgggcgacgactgcggcctggcctacccggtccgggacggcatcccggtccttctcgtcgacgaggcgcgccgccccgcctgaccgcgagcgatacgcgtacgggcaggacgacgcagggacgcgggacggccatggcagcgcacgacagccgggccagaccccaggcggggccgcaccgttcggcaccgcgcccgtccaggcggcggccacgccaccgcgtccgtacccgtatccgcagcccgcaccccacccggtgatcggaggcccaccgccatgctcgacgagtccttgctcgacgccccggaagccctggcccgagccgaccgccgcgatctgctgcgcggcggtcggctcgggcc

SEQ ID NO: 3973 - DNA, 1329 bp, Unknown
  Kingdom: Bacteria, Phylum: Actinobacteria, Class: Actinobacteria, Order: Streptomycetales, Family: Streptomycetaceae, Genus: Streptomyces
ggggagagcgtgccggcctcgcgcacggacgcggccggagcggcgcgtacggacctggtggcggtccgccgtcgcggcgcgggaacggatctcgcgcccaatgcctgaaccccgcacccccgaggccgccgagcactccggacccgccgctccgaagccgtacgcccccgacgaactgcgggcgctggaccgcgcgcacgtctggcatccgtacggtccgatgccgggccgccaggagccgctggtcgtggagtcggcctccggcgtacggctccggctcgccgaacccgtcgagggacggcgcgagttggtggacggtatgtcctcctggtggtcggcggtgcacggctacaaccacccggtcctcaacgaggccgcgcgcggccagctggaccggatgagccatgtgatgttcggcgggctcacccatgagcccgccgtccggctggcgacccggctggtggagatcacccccgggccgctccagcacgtcttcctcgccgactcggggtccgtctccgtggaggtcgcggtcaagatgtgcctccagtactggcgttcggccgggcgtccggccaagcggcggctgctgacctggcgcgggggctaccacggggacacctggcagccgatgtcggtgtgcgacccggagggcgggatgcacgagctgtggtcggggtccctgccccgccaggtcttcgccgacgccccgccggacggcttcgacgcggagccggaccccggctatgtcacgcacctgcgggagctggtcgccgagcacgccgacgagctcgcggcggtcatcgtggagccggtggtgcagggggccggcgggatgcggttccactcccccgcctatctgcgggtgctgcgcgaggcctgcgacgagcacgacgtcctgctggtcctcgacgagatcgcgaccggtttcgggcgtacgggcaagctgttcgccgccgggcacgccgggatcgcgccggacgtcatgtgcgtcggcaaggccctgaccggcggctatctcacgatggcggcgacgctgtgcaccacccgggtggccgagggcatctccagcggcgaggtgccggtgctggcgcacggccccacgttcatgggcaatccgctggccgcctcggtggcctcggcctccgtggacctgctgctcgggcaggactgggagggcgaggtggcacggatcggcgcgggcctgcgctccgggctcgctcccgccgcggacatcaccggggtggcggacgtacgcgtcctgggggcgatcggggtcgtccagctcgaccacgaggtcgacatggcggcggccacccgcgccgccgt

SEQ ID NO: 3974 - DNA, 916 bp, Unknown
  Kingdom: Bacteria, Phylum: Actinobacteria, Class: Actinobacteria, Order: Streptomycetales, Family: Streptomycetaceae, Genus: Streptomyces
cggccctcggcgtccagcagcggggcggtcaccgcgtacgggtccttgccgtcggtccagtcccgcagggtgagcgcgggcgccccggtggcggcggccgcgtcgggtgcctccagggtcgggaccaccaggaccgggtcctggccggcccgcagcaccaggagcgtgaggcgttcggtgctcacggggcggtagccggtgaggtggacgaggtcgggacccggcgcgacgatcaccccggcgagcccggcctcggcggcggactcggcggcgcgcaccatccgggcccggtagtcgtcggcggtgaagggcggcggagcggactgctgggcggacgggctcgggctggacatcggggcctcctggcggtgcgacacggcacacagcatcctgcccgcccggcggggcgcgcgcgaccggcttgccggagtacggcggacgtcgggggaacgaccggtggatcgtccggaacgtccggcggctcagagccgcacgatcaggtccgcccggtcccggccccgctccaccagccgggcgttcgcctcgtcggaccgggccacccactcctccgcgcgatgccggggcctgccgtggcggacatggcggtcgacgagccggcgcacccgcacctcagggtcgaggtccaggaaccacacctcgtccagcagaccgcgcaccggggcccaggggccgtcgtcgagcagcaggtagttcccctcggtgacgacgagcgggacgtccggtggcacgggaagcgaacccgcgaccggctcctccagggaccggtcgaaggccgggacgtagaccgcgtgcaccgggtccggcgcccgcagccgccgcaggagagccgcgtacccggccgcgtcgaaggtgtcgggggctcccttgcggtcggcgcggccgaggcgctccagct

SEQ ID NO: 3975 - DNA, 624 bp, Unknown
  Kingdom: Bacteria, Phylum: Actinobacteria, Class: Actinobacteria, Order: Streptomycetales, Family: Streptomycetaceae, Genus: Streptomyces
tcctcggcgacggcgggccacgggccgggcaggacggtgccgccctcggacgcaccgtccgacgggccgcgcacggcctgggccggcacctgaccggcggacggcgcgtccgccttcgtgttcctgtcggccgctgcgatctcgccgagcggctcttcctgctgctcgttaccgctcatcgcggaagcccccgtatacaccctcagacccgaataccggccaagactgccacatggctcaatcgcgctggcccctcagtcccgccaaccactcatccggggctttttctcgaatgcgagtgctagaggccctactttcggggaatgattctccgtcgattcgtcccccgagtccgctcaccgctcgcccgaccgccggcggcgcgcgcccctccgtccgccccgcaccgcgggcggggcggacggacatggaccgatgaacgaccggacgagcggcacgggacgagtgatgcgggacgagtggggccgatccctgacatcacgccgggcgcgacctcagaccctccagcaggatgtccagcaaccgggccgaagccgcggcctgctgagcggcgtccggcagcgaaggggccgctgtggcgatgaccagcagcacatcggccac

SEQ ID NO: 3976 - DNA, 782 bp, Unknown
  Kingdom: Bacteria, Phylum: Actinobacteria, Class: Actinobacteria, Order: Streptomycetales, Family: Streptomycetaceae, Genus: Streptomyces
tccaggaaccggccgagcgcccccgcgtcccggacctcgccctcccggggctcgtgcagattccacggtacgtacgtctcgacgcagttcagccccatcgcggcgagcatcgccagccggtgctcccactgcgcctcgtgcacccggaagtagtgcagggcgcccgacagcagccgtacgggcttcccgtcgagccggaagcagtcgtcccccacggtgaagtccgtcatggtgctcgtacgctcctgtgctcggccgcacccggcggccctccggtcgattggtccgaccaccttcacctctggcgtcgcacccggtccatggacaaagatcgctgttgattggacacaacggaccggccgggatcggacaccacggaccagcagggagaggaaggaccgcgatgtatcacacctggatgcgcttcttcaccccgagcccgctccaccaccgcctgggcctcgtctgcctcggcgtcggcctccagcacggggcgctgcccaccgtcggaccccgcaccctcgaccaccacgttgccgtgatcgtcaactccggcaccggctggttcaagggccccgacggccgccgcacccctgtcaccggccccagcctcatctggctgacccccggcaccccccaccactacggcgccgaccccggcacccgctgggacgagagcttcgtcgacttcacccgccccgccaccaccccgaccaccgaacccggccacctcccccccgaccccccccccccccccccccccccccccccccccccccccc

SEQ ID NO: 3977 - DNA, 1069 bp, Unknown
  Kingdom: Bacteria, Phylum: Actinobacteria, Class: Actinobacteria, Order: Streptomycetales, Family: Streptomycetaceae, Genus: Streptomyces
gccgggtggttgcagatctgcttgagcgaggtcagcagcttcatgacgagtccccggcgggcgatgccctccgccgcctcgatctgcgccatcgtctcgcggacggccgcctcgtagagcgtggcctgctcacgggtgagggagacggggtggtcggtctccgtcttgggcggcagctcgggagcgatgccggggtcggacttcttgcgccgcaggaggaagggccggaccagccgggacagccgctccaccgcttcctcgttgcccaggcccgcggcggtgccggtgttctccacgatccgggcgtgccgggcccggaacgccttgagcgggccgagcagtccgggtgtggtccagtcgaggagcgcccagagctcggagaggttgttctcgacgggggtgccggtgagggcgacccgggccggcgcggggatggtgcgcagcgccttggccgtggaggagtgcggattcttgacgtgctgcgcctcgtcggcgacgaccaggccccagctctgctcggcgagctgggccgcgctggagcgcatggtcccgtaggtggtgaggacgaagccgccgtccgggtcgctcagggtccggtccgtgccgtggaagcggcgcacggggacgccgggggcgaagcggttgatctcgcggtgccagttgccgaggagggaggcggggcagaccaccagggtgggcgaggggtgcgcccggtgcagatggagggcgatgagggtgatcgtcttgccgaggcccatgtcgtcggcgaggcagccgccgagcccgagcgaggtcatccggtccagccaggccaggccgcgcagctggtagtcgcgcagggtcgcgtcgaggccgggcgggggcgcgatcgtggcgtcctcgctgaggatccgcgtacggagggcggccagcgccccggcggggacggcgtccacccgctcgccgtccacctccgcgctgccggtgagggcgacggcgagcgcgtccaccggatccaggagccccagctcccgcttgcgcgccttgcgtacgagggcggggtcgacgaccacccactggtcgcgcagcc
